United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 190

SEQ ID NO: 7910420 - DNA, 22 bp, Homo sapiens
cagtggcttacaatgaactaga

SEQ ID NO: 7910421 - DNA, 22 bp, Homo sapiens
cagtggcttaaataagattagg

SEQ ID NO: 7910422 - DNA, 22 bp, Homo sapiens
cagtggcttacaatgaactaga

SEQ ID NO: 7910423 - DNA, 22 bp, Homo sapiens
cagtggcttctcatgtcattca

SEQ ID NO: 7910424 - DNA, 22 bp, Homo sapiens
cagtggcttacaatgaactaga

SEQ ID NO: 7910425 - DNA, 22 bp, Homo sapiens
cagtggctggttagggacagga

SEQ ID NO: 7910426 - DNA, 22 bp, Homo sapiens
cagtggctggttagggacagga

SEQ ID NO: 7910427 - DNA, 20 bp, Homo sapiens
cagtggctgataacaaatta

SEQ ID NO: 7910428 - DNA, 22 bp, Homo sapiens
cagtggctggttagggacagga

SEQ ID NO: 7910429 - DNA, 22 bp, Homo sapiens
cagtggctggttagggacagga

SEQ ID NO: 7910430 - DNA, 22 bp, Homo sapiens
cagtggctgtgaccagggacct

SEQ ID NO: 7910431 - DNA, 22 bp, Homo sapiens
cagtggctgtgaccagggacct

SEQ ID NO: 7910432 - DNA, 22 bp, Homo sapiens
cagtggctgtgaccagggacct

SEQ ID NO: 7910433 - DNA, 22 bp, Homo sapiens
cagtggctgtgaccagggacct

SEQ ID NO: 7910434 - DNA, 22 bp, Homo sapiens
cagtggctgtgaccagggacct

SEQ ID NO: 7910435 - DNA, 22 bp, Homo sapiens
cagtggcagttagaaaatattc

SEQ ID NO: 7910436 - DNA, 22 bp, Homo sapiens
cagtggcaggggaagcaggtgt

SEQ ID NO: 7910437 - DNA, 22 bp, Homo sapiens
cagtggcaggggaagcaggtgt

SEQ ID NO: 7910438 - DNA, 22 bp, Homo sapiens
cagtggcaggggaagcaggtgt

SEQ ID NO: 7910439 - DNA, 21 bp, Homo sapiens
cagtggcagttcttgcctctg

SEQ ID NO: 7910440 - DNA, 21 bp, Homo sapiens
cagtggcagttcttgcctctg

SEQ ID NO: 7910441 - DNA, 22 bp, Homo sapiens
cagtggcatacttggctgatat

SEQ ID NO: 7910442 - DNA, 22 bp, Homo sapiens
cagtggctgagagtggacactg

SEQ ID NO: 7910443 - DNA, 22 bp, Homo sapiens
cagtggctgagagtggacactg

SEQ ID NO: 7910444 - DNA, 22 bp, Homo sapiens
cagtggctgagagtggacactg

SEQ ID NO: 7910445 - DNA, 22 bp, Homo sapiens
cagttaaaatgtgctataagaa

SEQ ID NO: 7910446 - DNA, 22 bp, Homo sapiens
cagttaaaatgtgctataagaa

SEQ ID NO: 7910447 - DNA, 22 bp, Homo sapiens
cagttaaaaggtatgctaccaa

SEQ ID NO: 7910448 - DNA, 22 bp, Homo sapiens
cagttaaaagaagtctatctta

SEQ ID NO: 7910449 - DNA, 22 bp, Homo sapiens
cagttaaaaggtatgctaccaa

SEQ ID NO: 7910450 - DNA, 22 bp, Homo sapiens
cagttaaacgatgatggggtca

SEQ ID NO: 7910451 - DNA, 22 bp, Homo sapiens
cagttaaacagattgagtgtta

SEQ ID NO: 7910452 - DNA, 22 bp, Homo sapiens
cagttaaacgggccatgtgagt

SEQ ID NO: 7910453 - DNA, 22 bp, Homo sapiens
cagttaaacgggccatgtgagt

SEQ ID NO: 7910454 - DNA, 22 bp, Homo sapiens
cagttaaaatgtgctataagaa

SEQ ID NO: 7910455 - DNA, 22 bp, Homo sapiens
cagttaaacagattgagtgtta

SEQ ID NO: 7910456 - DNA, 22 bp, Homo sapiens
cagtgtttgtatagaatatgca

SEQ ID NO: 7910457 - DNA, 22 bp, Homo sapiens
cagtgtttccgtcagtatgtga

SEQ ID NO: 7910458 - DNA, 22 bp, Homo sapiens
cagtgttttgagaagggcacgt

SEQ ID NO: 7910459 - DNA, 22 bp, Homo sapiens
cagtgtttgttgagaaaggcaa

SEQ ID NO: 7910460 - DNA, 22 bp, Homo sapiens
cagttaaaagaagtctatctta

SEQ ID NO: 7910461 - DNA, 22 bp, Homo sapiens
cagtgttttgttacttgggcac

SEQ ID NO: 7910462 - DNA, 18 bp, Homo sapiens
cagtgtcttggtaaaata

SEQ ID NO: 7910463 - DNA, 22 bp, Homo sapiens
cagtgtcttatttgtagctcag

SEQ ID NO: 7910464 - DNA, 18 bp, Homo sapiens
cagtgtcttggtaaaata

SEQ ID NO: 7910465 - DNA, 22 bp, Homo sapiens
cagtgtctggttggctctacgt

SEQ ID NO: 7910466 - DNA, 22 bp, Homo sapiens
cagtgtctggttggctctacgt

SEQ ID NO: 7910467 - DNA, 22 bp, Homo sapiens
cagtgtctggttggctctacgt

SEQ ID NO: 7910468 - DNA, 22 bp, Homo sapiens
cagtgtctgggacagaaagtca

SEQ ID NO: 7910469 - DNA, 22 bp, Homo sapiens
cagtgtctgcctttctgtttgg

SEQ ID NO: 7910470 - DNA, 22 bp, Homo sapiens
cagtgtctccagatgctccaat

SEQ ID NO: 7910471 - DNA, 22 bp, Homo sapiens
cagtgtctcccccaggttctgt

SEQ ID NO: 7910472 - DNA, 22 bp, Homo sapiens
cagtgtctgaaataacaccgga

SEQ ID NO: 7910473 - DNA, 22 bp, Homo sapiens
cagtgtctcccccaggttctgt

SEQ ID NO: 7910474 - DNA, 22 bp, Homo sapiens
cagtgtttagcacagtgcttgg

SEQ ID NO: 7910475 - DNA, 22 bp, Homo sapiens
cagtgtttccgtcagtatgtga

SEQ ID NO: 7910476 - DNA, 22 bp, Homo sapiens
cagtgtttccgtcagtatgtga

SEQ ID NO: 7910477 - DNA, 22 bp, Homo sapiens
cagtgtttagcacagtgcttgg

SEQ ID NO: 7910478 - DNA, 22 bp, Homo sapiens
cagtgtttagcacagtgcttgg

SEQ ID NO: 7910479 - DNA, 22 bp, Homo sapiens
cagtgtgaggaattagtgtcca

SEQ ID NO: 7910480 - DNA, 22 bp, Homo sapiens
cagtgtgaggaattagtgtcca

SEQ ID NO: 7910481 - DNA, 22 bp, Homo sapiens
cagtgtgcctgaatcaagtgtt

SEQ ID NO: 7910482 - DNA, 22 bp, Homo sapiens
cagtgtgcctgaatcaagtgtt

SEQ ID NO: 7910483 - DNA, 22 bp, Homo sapiens
cagtgtgaggaattagtgtcca

SEQ ID NO: 7910484 - DNA, 22 bp, Homo sapiens
cagtgtctttcagactcagaaa

SEQ ID NO: 7910485 - DNA, 23 bp, Homo sapiens
cagtgtgacgaggtgaggcaggc

SEQ ID NO: 7910486 - DNA, 23 bp, Homo sapiens
cagtgtgacgaggtgaggcaggc

SEQ ID NO: 7910487 - DNA, 23 bp, Homo sapiens
cagtgtgacgaggtgaggcaggc

SEQ ID NO: 7910488 - DNA, 23 bp, Homo sapiens
cagtgtgacgaggtgaggcaggc

SEQ ID NO: 7910489 - DNA, 23 bp, Homo sapiens
cagtgtgacgaggtgaggcaggc

SEQ ID NO: 7910490 - DNA, 22 bp, Homo sapiens
cagtgtgacttctgagctgcca

SEQ ID NO: 7910491 - DNA, 22 bp, Homo sapiens
cagtgtgacttctgagctgcca

SEQ ID NO: 7910492 - DNA, 22 bp, Homo sapiens
cagtgtgacttctgagctgcca

SEQ ID NO: 7910493 - DNA, 22 bp, Homo sapiens
cagtgtctccagatgctccaat

SEQ ID NO: 7910494 - DNA, 22 bp, Homo sapiens
cagtgtctccagatgctccaat

SEQ ID NO: 7910495 - DNA, 22 bp, Homo sapiens
tcagagaacacagaggtgatgt

SEQ ID NO: 7910496 - DNA, 21 bp, Homo sapiens
tcagagaacccggcaggcaag

SEQ ID NO: 7910497 - DNA, 21 bp, Homo sapiens
tcagagaacccggcaggcaag

SEQ ID NO: 7910498 - DNA, 22 bp, Homo sapiens
cagtgtctcagtttcacttgaa

SEQ ID NO: 7910499 - DNA, 22 bp, Homo sapiens
tcagagaacacagaggtgatgt

SEQ ID NO: 7910500 - DNA, 22 bp, Homo sapiens
tcagagaacacagaggtgatgt

SEQ ID NO: 7910501 - DNA, 21 bp, Homo sapiens
tcagagaacccggcaggcaag

SEQ ID NO: 7910502 - DNA, 22 bp, Homo sapiens
tcagagaacacagaggtgatgt

SEQ ID NO: 7910503 - DNA, 22 bp, Homo sapiens
tcagagaaatgctgagctcatg

SEQ ID NO: 7910504 - DNA, 22 bp, Homo sapiens
tcagagaacacagaggtgatgt

SEQ ID NO: 7910505 - DNA, 22 bp, Homo sapiens
tcagagaacacagaggtgatgt

SEQ ID NO: 7910506 - DNA, 22 bp, Homo sapiens
tcagagaaatgctgagctcatg

SEQ ID NO: 7910507 - DNA, 22 bp, Homo sapiens
tcagagaaatgaagtagggatt

SEQ ID NO: 7910508 - DNA, 22 bp, Homo sapiens
tcagagaaatgaagtagggatt

SEQ ID NO: 7910509 - DNA, 22 bp, Homo sapiens
tcagagaaataattgctgagtt

SEQ ID NO: 7910510 - DNA, 22 bp, Homo sapiens
tcagagaaatgacaatatatag

SEQ ID NO: 7910511 - DNA, 22 bp, Homo sapiens
tcagagaaatgacaatatatag

SEQ ID NO: 7910512 - DNA, 22 bp, Homo sapiens
tcagagaaatgacaatatatag

SEQ ID NO: 7910513 - DNA, 22 bp, Homo sapiens
tcagagaaatgacaatatatag

SEQ ID NO: 7910514 - DNA, 22 bp, Homo sapiens
tcagagaaatgctgagctcatg

SEQ ID NO: 7910515 - DNA, 22 bp, Homo sapiens
tcagagaaatgctgagctcatg

SEQ ID NO: 7910516 - DNA, 22 bp, Homo sapiens
tcagagaaatgacaatatatag

SEQ ID NO: 7910517 - DNA, 22 bp, Homo sapiens
tcagagaaaggccaaaatatca

SEQ ID NO: 7910518 - DNA, 22 bp, Homo sapiens
tcagagaaaggccaaaatatca

SEQ ID NO: 7910519 - DNA, 22 bp, Homo sapiens
tcagagaaaggccaaaatatca

SEQ ID NO: 7910520 - DNA, 22 bp, Homo sapiens
tcagagaaaggccaaaatatca

SEQ ID NO: 7910521 - DNA, 22 bp, Homo sapiens
tcagagaaaggccaaaatatca

SEQ ID NO: 7910522 - DNA, 22 bp, Homo sapiens
tcagagaaataattgctgagtt

SEQ ID NO: 7910523 - DNA, 22 bp, Homo sapiens
tcagagaaataattgctgagtt

SEQ ID NO: 7910524 - DNA, 22 bp, Homo sapiens
tcagactggattttcacgtttt

SEQ ID NO: 7910525 - DNA, 22 bp, Homo sapiens
tcagactgatcatctatcagat

SEQ ID NO: 7910526 - DNA, 22 bp, Homo sapiens
tcagactgactagtcaatgaaa

SEQ ID NO: 7910527 - DNA, 22 bp, Homo sapiens
tcagactgaccgaagcatctgg

SEQ ID NO: 7910528 - DNA, 23 bp, Homo sapiens
tcagaagtgggatacaaagctga

SEQ ID NO: 7910529 - DNA, 23 bp, Homo sapiens
tcagaagtgggatacaaagctga

SEQ ID NO: 7910530 - DNA, 22 bp, Homo sapiens
tcagactgaaagatacacctct

SEQ ID NO: 7910531 - DNA, 19 bp, Homo sapiens
tcagactgaaagtttagat

SEQ ID NO: 7910532 - DNA, 20 bp, Homo sapiens
tcagaagtgcagctgcccct

SEQ ID NO: 7910533 - DNA, 23 bp, Homo sapiens
tcagaagtgggatacaaagctga

SEQ ID NO: 7910534 - DNA, 21 bp, Homo sapiens
tcagaagtgcagcccaggaat

SEQ ID NO: 7910535 - DNA, 20 bp, Homo sapiens
tcagaagtgcagctgcccct

SEQ ID NO: 7910536 - DNA, 20 bp, Homo sapiens
tcagaagtgcagctgcccct

SEQ ID NO: 7910537 - DNA, 21 bp, Homo sapiens
tcagaagtgcagcccaggaat

SEQ ID NO: 7910538 - DNA, 22 bp, Homo sapiens
tcagagaaaatggaaactttta

SEQ ID NO: 7910539 - DNA, 22 bp, Homo sapiens
tcagagaaaatggaaactttta

SEQ ID NO: 7910540 - DNA, 22 bp, Homo sapiens
tcagagaaaatggaaactttta

SEQ ID NO: 7910541 - DNA, 22 bp, Homo sapiens
tcagagaaaatggaaactttta

SEQ ID NO: 7910542 - DNA, 20 bp, Homo sapiens
tcagacttgattctatgcta

SEQ ID NO: 7910543 - DNA, 22 bp, Homo sapiens
tcagactgcttagctcccagta

SEQ ID NO: 7910544 - DNA, 22 bp, Homo sapiens
tcagactggggctccctgagga

SEQ ID NO: 7910545 - DNA, 22 bp, Homo sapiens
tcagactggtgaccctgaatct

SEQ ID NO: 7910546 - DNA, 22 bp, Homo sapiens
tcagactgtgtcataagtaggt

SEQ ID NO: 7910547 - DNA, 22 bp, Homo sapiens
tcagactgtttgcaccataggc

SEQ ID NO: 7910548 - DNA, 22 bp, Homo sapiens
cagttaactgattttataaagt

SEQ ID NO: 7910549 - DNA, 22 bp, Homo sapiens
cagttaacttcatatgatcatt

SEQ ID NO: 7910550 - DNA, 22 bp, Homo sapiens
cagttaatcttgccattatatc

SEQ ID NO: 7910551 - DNA, 22 bp, Homo sapiens
cagttaatgtcctatacaatag

SEQ ID NO: 7910552 - DNA, 22 bp, Homo sapiens
cagttaaattctccagttacca

SEQ ID NO: 7910553 - DNA, 22 bp, Homo sapiens
cagttaaattctccagttacca

SEQ ID NO: 7910554 - DNA, 22 bp, Homo sapiens
cagttaaattctccagttacca

SEQ ID NO: 7910555 - DNA, 22 bp, Homo sapiens
cagttaaatttggctgttttct

SEQ ID NO: 7910556 - DNA, 22 bp, Homo sapiens
cagttaaatgatgtgccctaga

SEQ ID NO: 7910557 - DNA, 22 bp, Homo sapiens
cagttaaagtgcttatcacaga

SEQ ID NO: 7910558 - DNA, 22 bp, Homo sapiens
cagttaaatgatgtgccctaga

SEQ ID NO: 7910559 - DNA, 22 bp, Homo sapiens
cagttaaagtgcttatcacaga

SEQ ID NO: 7910560 - DNA, 22 bp, Homo sapiens
cagttaaaggcccaatatctgg

SEQ ID NO: 7910561 - DNA, 22 bp, Homo sapiens
cagttaaaggcccaatatctgg

SEQ ID NO: 7910562 - DNA, 22 bp, Homo sapiens
cagttaaagctgcatgtgtcag

SEQ ID NO: 7910563 - DNA, 22 bp, Homo sapiens
cagttaaagctgcatgtgtcag

SEQ ID NO: 7910564 - DNA, 22 bp, Homo sapiens
cagttaaacgggccatgtgagt

SEQ ID NO: 7910565 - DNA, 22 bp, Homo sapiens
cagttaaacgggccatgtgagt

SEQ ID NO: 7910566 - DNA, 22 bp, Homo sapiens
cagttaaacgggccatgtgagt

SEQ ID NO: 7910567 - DNA, 22 bp, Homo sapiens
cagttactcaataattcttgcg

SEQ ID NO: 7910568 - DNA, 22 bp, Homo sapiens
cagttactgtatgtcaaagact

SEQ ID NO: 7910569 - DNA, 22 bp, Homo sapiens
tcagatgccaactgaacaacag

SEQ ID NO: 7910570 - DNA, 22 bp, Homo sapiens
cagttacatgctcatgtcatca

SEQ ID NO: 7910571 - DNA, 22 bp, Homo sapiens
tcagatgccctttgttttagac

SEQ ID NO: 7910572 - DNA, 22 bp, Homo sapiens
tcagatgccctttgttttagac

SEQ ID NO: 7910573 - DNA, 22 bp, Homo sapiens
tcagatgccaactgaacaacag

SEQ ID NO: 7910574 - DNA, 22 bp, Homo sapiens
tcagatgcctgtggggtctagg

SEQ ID NO: 7910575 - DNA, 22 bp, Homo sapiens
tcagatgcgatgcattcaggct

SEQ ID NO: 7910576 - DNA, 22 bp, Homo sapiens
tcagatgctaaagatggaatta

SEQ ID NO: 7910577 - DNA, 22 bp, Homo sapiens
tcagcagaagtatagaggccat

SEQ ID NO: 7910578 - DNA, 22 bp, Homo sapiens
tcagcagaagtatagaggccat

SEQ ID NO: 7910579 - DNA, 22 bp, Homo sapiens
tcagatgctaaagatggaatta

SEQ ID NO: 7910580 - DNA, 22 bp, Homo sapiens
tcagcagaatcttcctacacct

SEQ ID NO: 7910581 - DNA, 22 bp, Homo sapiens
tcagcagaatcttcctacacct

SEQ ID NO: 7910582 - DNA, 21 bp, Homo sapiens
tcagcagaatatgaactgcac

SEQ ID NO: 7910583 - DNA, 18 bp, Homo sapiens
cagttacaccttcattca

SEQ ID NO: 7910584 - DNA, 18 bp, Homo sapiens
cagttacaccttcattca

SEQ ID NO: 7910585 - DNA, 22 bp, Homo sapiens
cagttacagagccagttagaga

SEQ ID NO: 7910586 - DNA, 22 bp, Homo sapiens
cagttacagagccagttagaga

SEQ ID NO: 7910587 - DNA, 21 bp, Homo sapiens
cagttacagccaggacaaggc

SEQ ID NO: 7910588 - DNA, 19 bp, Homo sapiens
cagtttaactaattttatc

SEQ ID NO: 7910589 - DNA, 19 bp, Homo sapiens
cagtttaactaattttatc

SEQ ID NO: 7910590 - DNA, 22 bp, Homo sapiens
cagtttaaggcaggacatggga

SEQ ID NO: 7910591 - DNA, 22 bp, Homo sapiens
cagtttaaggcaggacatggga

SEQ ID NO: 7910592 - DNA, 22 bp, Homo sapiens
cagtttaagacaagggggtgta

SEQ ID NO: 7910593 - DNA, 20 bp, Homo sapiens
cagtttaactttgagcagtt

SEQ ID NO: 7910594 - DNA, 20 bp, Homo sapiens
cagtttaactttgagcagtt

SEQ ID NO: 7910595 - DNA, 22 bp, Homo sapiens
cagttgttcccagcaatgaaag

SEQ ID NO: 7910596 - DNA, 22 bp, Homo sapiens
cagttgttcccagcaatgaaag

SEQ ID NO: 7910597 - DNA, 22 bp, Homo sapiens
tcagcagccgcagctgactcag

SEQ ID NO: 7910598 - DNA, 21 bp, Homo sapiens
tcagcagcatctgcctagagt

SEQ ID NO: 7910599 - DNA, 22 bp, Homo sapiens
tcagcagccgcagctgactcag

SEQ ID NO: 7910600 - DNA, 22 bp, Homo sapiens
cagttgttcccagcaatgaaag

SEQ ID NO: 7910601 - DNA, 22 bp, Homo sapiens
cagtttaaagaaggatgggagt

SEQ ID NO: 7910602 - DNA, 22 bp, Homo sapiens
cagtttaaagaaggatgggagt

SEQ ID NO: 7910603 - DNA, 22 bp, Homo sapiens
cagtttaaatgagtgactgcag

SEQ ID NO: 7910604 - DNA, 22 bp, Homo sapiens
cagtttaacctatccattatgt

SEQ ID NO: 7910605 - DNA, 19 bp, Homo sapiens
tcagcagcactgtgatttc

SEQ ID NO: 7910606 - DNA, 23 bp, Homo sapiens
tcagcagcagaagtgctgggatg

SEQ ID NO: 7910607 - DNA, 19 bp, Homo sapiens
tcagcagcactgtgatttc

SEQ ID NO: 7910608 - DNA, 19 bp, Homo sapiens
tcagcagattttgcaaaca

SEQ ID NO: 7910609 - DNA, 23 bp, Homo sapiens
tcagcagcagaagtgctgggatg

SEQ ID NO: 7910610 - DNA, 23 bp, Homo sapiens
tcagcagcagaagtgctgggatg

SEQ ID NO: 7910611 - DNA, 23 bp, Homo sapiens
tcagcagcagaagtgctgggatg

SEQ ID NO: 7910612 - DNA, 22 bp, Homo sapiens
tcagcagcagctcagcatgttt

SEQ ID NO: 7910613 - DNA, 21 bp, Homo sapiens
tcagcagcatctgcctagagt

SEQ ID NO: 7910614 - DNA, 22 bp, Homo sapiens
tcagcagcagctcagcatgttt

SEQ ID NO: 7910615 - DNA, 22 bp, Homo sapiens
tcagcagcagctcagcatgttt

SEQ ID NO: 7910616 - DNA, 22 bp, Homo sapiens
tcagcagcagctcagcatgttt

SEQ ID NO: 7910617 - DNA, 22 bp, Homo sapiens
tcagcagcagctcagcatgttt

SEQ ID NO: 7910618 - DNA, 21 bp, Homo sapiens
tcagcagcatctgcctagagt

SEQ ID NO: 7910619 - DNA, 23 bp, Homo sapiens
tcagcagcagaagtgctgggatg

SEQ ID NO: 7910620 - DNA, 21 bp, Homo sapiens
tcagcagcatctgcctagagt

SEQ ID NO: 7910621 - DNA, 21 bp, Homo sapiens
tcagcagcatctgcctagagt

SEQ ID NO: 7910622 - DNA, 21 bp, Homo sapiens
tcagcagcatctgcctagagt

SEQ ID NO: 7910623 - DNA, 22 bp, Homo sapiens
tcagcagagtttcatcttggga

SEQ ID NO: 7910624 - DNA, 22 bp, Homo sapiens
tcagcagagtttcatcttggga

SEQ ID NO: 7910625 - DNA, 22 bp, Homo sapiens
tcagcagatgatttccatacaa

SEQ ID NO: 7910626 - DNA, 22 bp, Homo sapiens
tcagcagatgatttccatacaa

SEQ ID NO: 7910627 - DNA, 22 bp, Homo sapiens
tcagcagatgtggtgaaaagtc

SEQ ID NO: 7910628 - DNA, 19 bp, Homo sapiens
tcagcagattttgcaaaca

SEQ ID NO: 7910629 - DNA, 22 bp, Homo sapiens
tcagcagatgggttgtgttggc

SEQ ID NO: 7910630 - DNA, 22 bp, Homo sapiens
tcagcagaggggaaggcatctg

SEQ ID NO: 7910631 - DNA, 22 bp, Homo sapiens
tcagcagagtggaacattgtca

SEQ ID NO: 7910632 - DNA, 22 bp, Homo sapiens
tcagcagaggggaaggcatctg

SEQ ID NO: 7910633 - DNA, 22 bp, Homo sapiens
tcagcagaggggaaggcatctg

SEQ ID NO: 7910634 - DNA, 22 bp, Homo sapiens
tcagcagaggcagactctcctt

SEQ ID NO: 7910635 - DNA, 22 bp, Homo sapiens
tcagcagaggcagactctcctt

SEQ ID NO: 7910636 - DNA, 22 bp, Homo sapiens
tcagcagaggagtgtcttgccc

SEQ ID NO: 7910637 - DNA, 22 bp, Homo sapiens
tcagcagaatgtggcatgtcac

SEQ ID NO: 7910638 - DNA, 22 bp, Homo sapiens
tcagcagacagttagctatatt

SEQ ID NO: 7910639 - DNA, 22 bp, Homo sapiens
tcagcagaatgtggcatgtcac

SEQ ID NO: 7910640 - DNA, 22 bp, Homo sapiens
tcagcagacattattttctggc

SEQ ID NO: 7910641 - DNA, 22 bp, Homo sapiens
tcagcagacctgttatttggat

SEQ ID NO: 7910642 - DNA, 22 bp, Homo sapiens
tcagcagacagttagctatatt

SEQ ID NO: 7910643 - DNA, 22 bp, Homo sapiens
tcagcagacattattttctggc

SEQ ID NO: 7910644 - DNA, 22 bp, Homo sapiens
tcagcagagcgagaccaagtca

SEQ ID NO: 7910645 - DNA, 22 bp, Homo sapiens
tcagcagagctcaggctccagc

SEQ ID NO: 7910646 - DNA, 22 bp, Homo sapiens
tcagcagagctcaggctccagc

SEQ ID NO: 7910647 - DNA, 22 bp, Homo sapiens
tcagcagaggagtgtcttgccc

SEQ ID NO: 7910648 - DNA, 22 bp, Homo sapiens
tcagcagactaggcagattact

SEQ ID NO: 7910649 - DNA, 22 bp, Homo sapiens
tcagcagactaggcagattact

SEQ ID NO: 7910650 - DNA, 22 bp, Homo sapiens
tcagcagactaggcagattact

SEQ ID NO: 7910651 - DNA, 22 bp, Homo sapiens
tcagcagagcgagaccaagtca

SEQ ID NO: 7910652 - DNA, 22 bp, Homo sapiens
tcagcagactaggcagattact

SEQ ID NO: 7910653 - DNA, 22 bp, Homo sapiens
tcagcagagcgagaccaagtca

SEQ ID NO: 7910654 - DNA, 22 bp, Homo sapiens
tcagctttttggattgcccaag

SEQ ID NO: 7910655 - DNA, 22 bp, Homo sapiens
tcagctttttacatgtgaaata

SEQ ID NO: 7910656 - DNA, 22 bp, Homo sapiens
tcagcttttgtcagaaattgta

SEQ ID NO: 7910657 - DNA, 21 bp, Homo sapiens
tcaggaaacacctcttaagga

SEQ ID NO: 7910658 - DNA, 22 bp, Homo sapiens
tcaggaaactacagttgaacta

SEQ ID NO: 7910659 - DNA, 22 bp, Homo sapiens
tcaggaaactacagttgaacta

SEQ ID NO: 7910660 - DNA, 22 bp, Homo sapiens
tcaggaaaatactgcttatcca

SEQ ID NO: 7910661 - DNA, 22 bp, Homo sapiens
tcaggaaaatactgcttatcca

SEQ ID NO: 7910662 - DNA, 22 bp, Homo sapiens
tcaggaaaatactgcttatcca

SEQ ID NO: 7910663 - DNA, 22 bp, Homo sapiens
tcaggaaaatactgcttatcca

SEQ ID NO: 7910664 - DNA, 21 bp, Homo sapiens
tcaggaaacacctcttaagga

SEQ ID NO: 7910665 - DNA, 22 bp, Homo sapiens
tcaggaaagagtaatgtataca

SEQ ID NO: 7910666 - DNA, 22 bp, Homo sapiens
tcaggaaagagtaatgtataca

SEQ ID NO: 7910667 - DNA, 22 bp, Homo sapiens
tcaggaaagaagatgctcagtg

SEQ ID NO: 7910668 - DNA, 22 bp, Homo sapiens
tcaggaaactgtcaagtgggat

SEQ ID NO: 7910669 - DNA, 22 bp, Homo sapiens
tcaggaaagaagatgctcagtg

SEQ ID NO: 7910670 - DNA, 22 bp, Homo sapiens
cataaactctctgtaccaatat

SEQ ID NO: 7910671 - DNA, 22 bp, Homo sapiens
cataaactcttgagattcttgt

SEQ ID NO: 7910672 - DNA, 22 bp, Homo sapiens
cataaaatggcttgttctttaa

SEQ ID NO: 7910673 - DNA, 22 bp, Homo sapiens
cataaaatggcttgttctttaa

SEQ ID NO: 7910674 - DNA, 22 bp, Homo sapiens
cataaaatggcttgttctttaa

SEQ ID NO: 7910675 - DNA, 22 bp, Homo sapiens
cataaaatggcttgttctttaa

SEQ ID NO: 7910676 - DNA, 22 bp, Homo sapiens
cataaaatggcttgttctttaa

SEQ ID NO: 7910677 - DNA, 22 bp, Homo sapiens
cataaattgtacccattccaac

SEQ ID NO: 7910678 - DNA, 22 bp, Homo sapiens
cataaattgtacccattccaac

SEQ ID NO: 7910679 - DNA, 22 bp, Homo sapiens
cataaattcagttctgcctctt

SEQ ID NO: 7910680 - DNA, 22 bp, Homo sapiens
cataaattcagttctgcctctt

SEQ ID NO: 7910681 - DNA, 19 bp, Homo sapiens
cataaatgtacaagataca

SEQ ID NO: 7910682 - DNA, 19 bp, Homo sapiens
cataaatgtacaagataca

SEQ ID NO: 7910683 - DNA, 19 bp, Homo sapiens
cataaatgtacaagataca

SEQ ID NO: 7910684 - DNA, 22 bp, Homo sapiens
cataaagttttataggctcaaa

SEQ ID NO: 7910685 - DNA, 19 bp, Homo sapiens
cataaatgtacaagataca

SEQ ID NO: 7910686 - DNA, 22 bp, Homo sapiens
cataaagttttataggctcaaa

SEQ ID NO: 7910687 - DNA, 22 bp, Homo sapiens
cataaagttaagctgtaagtat

SEQ ID NO: 7910688 - DNA, 22 bp, Homo sapiens
cataaagttaagctgtaagtat

SEQ ID NO: 7910689 - DNA, 22 bp, Homo sapiens
cataaagtgtataagtgaagaa

SEQ ID NO: 7910690 - DNA, 22 bp, Homo sapiens
cataaagtgtataagtgaagaa

SEQ ID NO: 7910691 - DNA, 22 bp, Homo sapiens
cataaagtaggcaagcattcca

SEQ ID NO: 7910692 - DNA, 22 bp, Homo sapiens
cataaagtcatgatctgagtat

SEQ ID NO: 7910693 - DNA, 22 bp, Homo sapiens
cataaagtcatgatctgagtat

SEQ ID NO: 7910694 - DNA, 22 bp, Homo sapiens
cataaagtctcataattcactt

SEQ ID NO: 7910695 - DNA, 22 bp, Homo sapiens
cataaagtctcataattcactt

SEQ ID NO: 7910696 - DNA, 22 bp, Homo sapiens
cataaagtctcataattcactt

SEQ ID NO: 7910697 - DNA, 22 bp, Homo sapiens
cataaagtaaagatgtcttcca

SEQ ID NO: 7910698 - DNA, 22 bp, Homo sapiens
cataaagtaaagatgtcttcca

SEQ ID NO: 7910699 - DNA, 22 bp, Homo sapiens
cataaagtagcagagcatgact

SEQ ID NO: 7910700 - DNA, 22 bp, Homo sapiens
cagtttatagctctagcagctt

SEQ ID NO: 7910701 - DNA, 22 bp, Homo sapiens
cagtttatagctctagcagctt

SEQ ID NO: 7910702 - DNA, 22 bp, Homo sapiens
cagtttatagctctagcagctt

SEQ ID NO: 7910703 - DNA, 22 bp, Homo sapiens
cagtttatagttgttatgtgtg

SEQ ID NO: 7910704 - DNA, 22 bp, Homo sapiens
cagtttatagttgttatgtgtg

SEQ ID NO: 7910705 - DNA, 22 bp, Homo sapiens
cagtttatatataagcacattg

SEQ ID NO: 7910706 - DNA, 22 bp, Homo sapiens
cagtttatatataagcacattg

SEQ ID NO: 7910707 - DNA, 22 bp, Homo sapiens
cagtttatatataagcacattg

SEQ ID NO: 7910708 - DNA, 22 bp, Homo sapiens
cagtttatatataagcacattg

SEQ ID NO: 7910709 - DNA, 22 bp, Homo sapiens
cagtttatatataagcacattg

SEQ ID NO: 7910710 - DNA, 22 bp, Homo sapiens
cagtttaagtagaactgagaat

SEQ ID NO: 7910711 - DNA, 22 bp, Homo sapiens
cagtttaagtagaactgagaat

SEQ ID NO: 7910712 - DNA, 22 bp, Homo sapiens
cagtttaagtgtgttgaaggta

SEQ ID NO: 7910713 - DNA, 22 bp, Homo sapiens
cagtttaagtagaactgagaat

SEQ ID NO: 7910714 - DNA, 20 bp, Homo sapiens
cagtttacaacataaattgt

SEQ ID NO: 7910715 - DNA, 21 bp, Homo sapiens
cagtttaataacaaagaagga

SEQ ID NO: 7910716 - DNA, 22 bp, Homo sapiens
cagtttaggtcatccttgcttt

SEQ ID NO: 7910717 - DNA, 22 bp, Homo sapiens
cagtttagtcctgccaccatgg

SEQ ID NO: 7910718 - DNA, 22 bp, Homo sapiens
cagtttacctatatgtaaattt

SEQ ID NO: 7910719 - DNA, 21 bp, Homo sapiens
cagtttaataacaaagaagga

SEQ ID NO: 7910720 - DNA, 22 bp, Homo sapiens
tcagctttctcttctatcgata

SEQ ID NO: 7910721 - DNA, 22 bp, Homo sapiens
tcagctgccccagtggccccag

SEQ ID NO: 7910722 - DNA, 22 bp, Homo sapiens
tcagctgcataagtcaccttgc

SEQ ID NO: 7910723 - DNA, 22 bp, Homo sapiens
tcagctgcataagtcaccttgc

SEQ ID NO: 7910724 - DNA, 22 bp, Homo sapiens
tcagctgcataagtcaccttgc

SEQ ID NO: 7910725 - DNA, 22 bp, Homo sapiens
tcagctgccccagtggccccag

SEQ ID NO: 7910726 - DNA, 21 bp, Homo sapiens
tcagctttgcaactgcacatc

SEQ ID NO: 7910727 - DNA, 22 bp, Homo sapiens
tcagctttgcaagttagaaaat

SEQ ID NO: 7910728 - DNA, 21 bp, Homo sapiens
tcagctttgcaactgcacatc

SEQ ID NO: 7910729 - DNA, 22 bp, Homo sapiens
tcagctttgatctcaggcaatc

SEQ ID NO: 7910730 - DNA, 22 bp, Homo sapiens
tcagctttgatctcaggcaatc

SEQ ID NO: 7910731 - DNA, 22 bp, Homo sapiens
tcagcttttaaaaacaagaagt

SEQ ID NO: 7910732 - DNA, 22 bp, Homo sapiens
tcagcttttaaaaacaagaagt

SEQ ID NO: 7910733 - DNA, 18 bp, Homo sapiens
tcagcttttgaaaaccaa

SEQ ID NO: 7910734 - DNA, 22 bp, Homo sapiens
tcagctttgggggtctcaggag

SEQ ID NO: 7910735 - DNA, 22 bp, Homo sapiens
tcagctttggtcacattgagtt

SEQ ID NO: 7910736 - DNA, 22 bp, Homo sapiens
tcagcttttaaaaacaagaagt

SEQ ID NO: 7910737 - DNA, 22 bp, Homo sapiens
tcagctttgccaccagctgtaa

SEQ ID NO: 7910738 - DNA, 22 bp, Homo sapiens
tcagctttgcaagttagaaaat

SEQ ID NO: 7910739 - DNA, 22 bp, Homo sapiens
tcagctttgggggtctcaggag

SEQ ID NO: 7910740 - DNA, 22 bp, Homo sapiens
tcagctttgggggtctcaggag

SEQ ID NO: 7910741 - DNA, 22 bp, Homo sapiens
cagggctcaccactgggatcct

SEQ ID NO: 7910742 - DNA, 22 bp, Homo sapiens
cagggctcaccactgggatcct

SEQ ID NO: 7910743 - DNA, 22 bp, Homo sapiens
cagggctcactcggctggcgtc

SEQ ID NO: 7910744 - DNA, 22 bp, Homo sapiens
cagggctcactcggctggcgtc

SEQ ID NO: 7910745 - DNA, 22 bp, Homo sapiens
cagggctcagaagacagacctc

SEQ ID NO: 7910746 - DNA, 22 bp, Homo sapiens
cagggctcagaagacagacctc

SEQ ID NO: 7910747 - DNA, 22 bp, Homo sapiens
cagggctcagaagacagacctc

SEQ ID NO: 7910748 - DNA, 22 bp, Homo sapiens
cagggctcaggaaatcagacgt

SEQ ID NO: 7910749 - DNA, 22 bp, Homo sapiens
cagggctcactcggctggcgtc

SEQ ID NO: 7910750 - DNA, 22 bp, Homo sapiens
cagggctcactcggctggcgtc

SEQ ID NO: 7910751 - DNA, 22 bp, Homo sapiens
cagggctcagaagacagacctc

SEQ ID NO: 7910752 - DNA, 22 bp, Homo sapiens
cagggctcagggactgcagaaa

SEQ ID NO: 7910753 - DNA, 22 bp, Homo sapiens
cagggctcagggactgcagaaa

SEQ ID NO: 7910754 - DNA, 22 bp, Homo sapiens
cagggctcagggactgcagaaa

SEQ ID NO: 7910755 - DNA, 22 bp, Homo sapiens
cagggctcaggaaatcagacgt

SEQ ID NO: 7910756 - DNA, 22 bp, Homo sapiens
cagggctcaggaaatcagacgt

SEQ ID NO: 7910757 - DNA, 22 bp, Homo sapiens
cagggctcaggctctgggattc

SEQ ID NO: 7910758 - DNA, 22 bp, Homo sapiens
cagggctcaggctctgggattc

SEQ ID NO: 7910759 - DNA, 22 bp, Homo sapiens
cagggctcaggctctgggattc

SEQ ID NO: 7910760 - DNA, 22 bp, Homo sapiens
cagggccttgttcaggagtgaa

SEQ ID NO: 7910761 - DNA, 22 bp, Homo sapiens
cagggccttgttcaggagtgaa

SEQ ID NO: 7910762 - DNA, 22 bp, Homo sapiens
cagggccttgttcaggagtgaa

SEQ ID NO: 7910763 - DNA, 22 bp, Homo sapiens
cagggccttgttcaggagtgaa

SEQ ID NO: 7910764 - DNA, 22 bp, Homo sapiens
cagggccttgttcaggagtgaa

SEQ ID NO: 7910765 - DNA, 21 bp, Homo sapiens
cagggctagagagaatgacaa

SEQ ID NO: 7910766 - DNA, 22 bp, Homo sapiens
cagggcggggtctgccggccct

SEQ ID NO: 7910767 - DNA, 22 bp, Homo sapiens
cagggccttttagcatcttctc

SEQ ID NO: 7910768 - DNA, 22 bp, Homo sapiens
cagggccttttagcatcttctc

SEQ ID NO: 7910769 - DNA, 22 bp, Homo sapiens
cagggccttttagcatcttctc

SEQ ID NO: 7910770 - DNA, 22 bp, Homo sapiens
cagggccttttagcatcttctc

SEQ ID NO: 7910771 - DNA, 22 bp, Homo sapiens
cagggccttcgtaagtgtccgg

SEQ ID NO: 7910772 - DNA, 22 bp, Homo sapiens
cagggcctgtcacgacgctcat

SEQ ID NO: 7910773 - DNA, 22 bp, Homo sapiens
cagggccttcgtaagtgtccgg

SEQ ID NO: 7910774 - DNA, 22 bp, Homo sapiens
cagggccttatcctgccattga

SEQ ID NO: 7910775 - DNA, 22 bp, Homo sapiens
cagggcctgtacaagtcccacc

SEQ ID NO: 7910776 - DNA, 22 bp, Homo sapiens
cagggcctgtacaagtcccacc

SEQ ID NO: 7910777 - DNA, 22 bp, Homo sapiens
cagggcctgtacaagtcccacc

SEQ ID NO: 7910778 - DNA, 22 bp, Homo sapiens
cagggcctgtcacgacgctcat

SEQ ID NO: 7910779 - DNA, 22 bp, Homo sapiens
cagggcctgtcacgacgctcat

SEQ ID NO: 7910780 - DNA, 22 bp, Homo sapiens
taggagagctgaactattgtct

SEQ ID NO: 7910781 - DNA, 22 bp, Homo sapiens
taggagaggtgaatggcacact

SEQ ID NO: 7910782 - DNA, 18 bp, Homo sapiens
taggagataatagagggc

SEQ ID NO: 7910783 - DNA, 22 bp, Homo sapiens
taggagaggtgaatggcacact

SEQ ID NO: 7910784 - DNA, 18 bp, Homo sapiens
taggagataatagagggc

SEQ ID NO: 7910785 - DNA, 17 bp, Homo sapiens
taggagactggctgtcc

SEQ ID NO: 7910786 - DNA, 22 bp, Homo sapiens
taggagacattgatcccaagaa

SEQ ID NO: 7910787 - DNA, 22 bp, Homo sapiens
taggagaagagtcagggcctaa

SEQ ID NO: 7910788 - DNA, 19 bp, Homo sapiens
taggaccctggtggccccc

SEQ ID NO: 7910789 - DNA, 22 bp, Homo sapiens
taggaccaggggctgccaggaa

SEQ ID NO: 7910790 - DNA, 22 bp, Homo sapiens
taggacccctgtggtagatggg

SEQ ID NO: 7910791 - DNA, 22 bp, Homo sapiens
taggaccaggcttggagatagg

SEQ ID NO: 7910792 - DNA, 22 bp, Homo sapiens
taggaccagatcaagactcttg

SEQ ID NO: 7910793 - DNA, 22 bp, Homo sapiens
taggaccaagtggagtgcaggt

SEQ ID NO: 7910794 - DNA, 22 bp, Homo sapiens
taggacatgtgttttatatatg

SEQ ID NO: 7910795 - DNA, 19 bp, Homo sapiens
taggaccctggtggccccc

SEQ ID NO: 7910796 - DNA, 19 bp, Homo sapiens
taggaccctggtggccccc

SEQ ID NO: 7910797 - DNA, 19 bp, Homo sapiens
taggaccctggtggccccc

SEQ ID NO: 7910798 - DNA, 22 bp, Homo sapiens
taggacccctgtggtagatggg

SEQ ID NO: 7910799 - DNA, 22 bp, Homo sapiens
taggactttgagaattgttatt

SEQ ID NO: 7910800 - DNA, 22 bp, Homo sapiens
taggactgataaggggccagag

SEQ ID NO: 7910801 - DNA, 22 bp, Homo sapiens
taggactgataaggggccagag

SEQ ID NO: 7910802 - DNA, 22 bp, Homo sapiens
cagggcctggagctgggcctgc

SEQ ID NO: 7910803 - DNA, 22 bp, Homo sapiens
cagggcctggagctgggcctgc

SEQ ID NO: 7910804 - DNA, 22 bp, Homo sapiens
cagggcctggagctgggcctgc

SEQ ID NO: 7910805 - DNA, 22 bp, Homo sapiens
cagggcctggagctgggcctgc

SEQ ID NO: 7910806 - DNA, 22 bp, Homo sapiens
cagggcctgcttccttcttgtt

SEQ ID NO: 7910807 - DNA, 22 bp, Homo sapiens
cagggcctggagctgggcctgc

SEQ ID NO: 7910808 - DNA, 22 bp, Homo sapiens
cagggcctggagctgggcctgc

SEQ ID NO: 7910809 - DNA, 22 bp, Homo sapiens
cagggcctgcttccttcttgtt

SEQ ID NO: 7910810 - DNA, 22 bp, Homo sapiens
cagggcctgcttccttcttgtt

SEQ ID NO: 7910811 - DNA, 22 bp, Homo sapiens
cagggcctgcctggttcctgga

SEQ ID NO: 7910812 - DNA, 22 bp, Homo sapiens
cagggcctgcttccttcttgtt

SEQ ID NO: 7910813 - DNA, 22 bp, Homo sapiens
cagggcctccccggcagtcttt

SEQ ID NO: 7910814 - DNA, 22 bp, Homo sapiens
cagggcctccccggcagtcttt

SEQ ID NO: 7910815 - DNA, 18 bp, Homo sapiens
taggaggatactgagatg

SEQ ID NO: 7910816 - DNA, 18 bp, Homo sapiens
taggaggatactgagatg

SEQ ID NO: 7910817 - DNA, 23 bp, Homo sapiens
taggaggagaccgcagtgttacc

SEQ ID NO: 7910818 - DNA, 22 bp, Homo sapiens
taggagctaaaatattttatat

SEQ ID NO: 7910819 - DNA, 22 bp, Homo sapiens
taggagctgagacatctttaaa

SEQ ID NO: 7910820 - DNA, 18 bp, Homo sapiens
taggagataatagagggc

SEQ ID NO: 7910821 - DNA, 22 bp, Homo sapiens
tagctattgttggtagttaccc

SEQ ID NO: 7910822 - DNA, 22 bp, Homo sapiens
tagctatttggaaaattccaat

SEQ ID NO: 7910823 - DNA, 22 bp, Homo sapiens
tagctacactgaggctgcttaa

SEQ ID NO: 7910824 - DNA, 20 bp, Homo sapiens
tagctaccttgatcccctgg

SEQ ID NO: 7910825 - DNA, 22 bp, Homo sapiens
tagctagaatgcttcgtgatat

SEQ ID NO: 7910826 - DNA, 22 bp, Homo sapiens
tagctagctgtggcttaaaata

SEQ ID NO: 7910827 - DNA, 22 bp, Homo sapiens
tagctcaaaggttaagtgtgga

SEQ ID NO: 7910828 - DNA, 22 bp, Homo sapiens
tagctcaaaggttaagtgtgga

SEQ ID NO: 7910829 - DNA, 22 bp, Homo sapiens
tagctcagcaggtgggacaggt

SEQ ID NO: 7910830 - DNA, 22 bp, Homo sapiens
tagctcaaaggttaagtgtgga

SEQ ID NO: 7910831 - DNA, 22 bp, Homo sapiens
tagctcaaaggttaagtgtgga

SEQ ID NO: 7910832 - DNA, 22 bp, Homo sapiens
tagctcaaaggttaagtgtgga

SEQ ID NO: 7910833 - DNA, 22 bp, Homo sapiens
tagctcctggctgcagggcctc

SEQ ID NO: 7910834 - DNA, 22 bp, Homo sapiens
tagctcctccccatccaggttc

SEQ ID NO: 7910835 - DNA, 22 bp, Homo sapiens
cagggcagccaggccccgtggg

SEQ ID NO: 7910836 - DNA, 22 bp, Homo sapiens
cagggcagccaggccccgtggg

SEQ ID NO: 7910837 - DNA, 22 bp, Homo sapiens
cagggcagccaggccccgtggg

SEQ ID NO: 7910838 - DNA, 22 bp, Homo sapiens
cagggcagccaggccccgtggg

SEQ ID NO: 7910839 - DNA, 22 bp, Homo sapiens
cagggcagagggaaactccttt

SEQ ID NO: 7910840 - DNA, 22 bp, Homo sapiens
cagggcagccaggccccgtggg

SEQ ID NO: 7910841 - DNA, 22 bp, Homo sapiens
cagggcagccaggccccgtggg

SEQ ID NO: 7910842 - DNA, 22 bp, Homo sapiens
cagggcagccaggccccgtggg

SEQ ID NO: 7910843 - DNA, 22 bp, Homo sapiens
cagggcagcttcctttgttagg

SEQ ID NO: 7910844 - DNA, 22 bp, Homo sapiens
cagggcagcttcctttgttagg

SEQ ID NO: 7910845 - DNA, 22 bp, Homo sapiens
cagggcagcttcctttgttagg

SEQ ID NO: 7910846 - DNA, 22 bp, Homo sapiens
cagggcaggaatttgacattgc

SEQ ID NO: 7910847 - DNA, 22 bp, Homo sapiens
cagggcagcttcctttgttagg

SEQ ID NO: 7910848 - DNA, 22 bp, Homo sapiens
cagggcagcttcctttgttagg

SEQ ID NO: 7910849 - DNA, 22 bp, Homo sapiens
cagggcagagggaaactccttt

SEQ ID NO: 7910850 - DNA, 22 bp, Homo sapiens
cagggcagagggaaactccttt

SEQ ID NO: 7910851 - DNA, 22 bp, Homo sapiens
cagggcagagggaaactccttt

SEQ ID NO: 7910852 - DNA, 22 bp, Homo sapiens
cagggcagagggaaactccttt

SEQ ID NO: 7910853 - DNA, 22 bp, Homo sapiens
cagggcagccaggccccgtggg

SEQ ID NO: 7910854 - DNA, 22 bp, Homo sapiens
cagggcagagccaggatttcaa

SEQ ID NO: 7910855 - DNA, 22 bp, Homo sapiens
cagggcagagccaggatttcaa

SEQ ID NO: 7910856 - DNA, 22 bp, Homo sapiens
cagggcagagccaggatttcaa

SEQ ID NO: 7910857 - DNA, 22 bp, Homo sapiens
cagggcagagccaggatttcaa

SEQ ID NO: 7910858 - DNA, 22 bp, Homo sapiens
cagggcagagccaggatttcaa

SEQ ID NO: 7910859 - DNA, 22 bp, Homo sapiens
cagggcagagccaggatttcaa

SEQ ID NO: 7910860 - DNA, 22 bp, Homo sapiens
cagggcagagggaaactccttt

SEQ ID NO: 7910861 - DNA, 22 bp, Homo sapiens
taggaaatttgaaatatgtggg

SEQ ID NO: 7910862 - DNA, 22 bp, Homo sapiens
taggaaatttgaaatatgtggg

SEQ ID NO: 7910863 - DNA, 22 bp, Homo sapiens
taggaaattttactggtctggg

SEQ ID NO: 7910864 - DNA, 22 bp, Homo sapiens
taggaaatttgaaatatgtggg

SEQ ID NO: 7910865 - DNA, 22 bp, Homo sapiens
taggaacaaagagcctcacatt

SEQ ID NO: 7910866 - DNA, 22 bp, Homo sapiens
taggaacaaagagcctcacatt

SEQ ID NO: 7910867 - DNA, 22 bp, Homo sapiens
taggaacaaaaggttttcctga

SEQ ID NO: 7910868 - DNA, 22 bp, Homo sapiens
taggaaattttactggtctggg

SEQ ID NO: 7910869 - DNA, 22 bp, Homo sapiens
taggaaatttgaaatatgtggg

SEQ ID NO: 7910870 - DNA, 22 bp, Homo sapiens
taggaaatttgaaatatgtggg

SEQ ID NO: 7910871 - DNA, 22 bp, Homo sapiens
taggaaatttcatttgaggtct

SEQ ID NO: 7910872 - DNA, 22 bp, Homo sapiens
taggaaatttatagaggtgttt

SEQ ID NO: 7910873 - DNA, 22 bp, Homo sapiens
taggaaatttcatttgaggtct

SEQ ID NO: 7910874 - DNA, 22 bp, Homo sapiens
taggaaatttatagaggtgttt

SEQ ID NO: 7910875 - DNA, 22 bp, Homo sapiens
taggaaattggaaactcttcac

SEQ ID NO: 7910876 - DNA, 22 bp, Homo sapiens
taggaaattggaaactcttcac

SEQ ID NO: 7910877 - DNA, 22 bp, Homo sapiens
taggaaattggaaactcttcac

SEQ ID NO: 7910878 - DNA, 22 bp, Homo sapiens
taggaaattggaaactcttcac

SEQ ID NO: 7910879 - DNA, 22 bp, Homo sapiens
taggaaattggaaactcttcac

SEQ ID NO: 7910880 - DNA, 22 bp, Homo sapiens
taggaacacagggacttgatga

SEQ ID NO: 7910881 - DNA, 22 bp, Homo sapiens
taggaacacacatgtgtagctg

SEQ ID NO: 7910882 - DNA, 22 bp, Homo sapiens
taggaacagtcctagaaatctg

SEQ ID NO: 7910883 - DNA, 22 bp, Homo sapiens
taggaacaactgcaggtacaag

SEQ ID NO: 7910884 - DNA, 22 bp, Homo sapiens
taggaacaagtttccttgctgt

SEQ ID NO: 7910885 - DNA, 22 bp, Homo sapiens
taggaacaagtttccttgctgt

SEQ ID NO: 7910886 - DNA, 22 bp, Homo sapiens
taggaacagtttcaggatgttt

SEQ ID NO: 7910887 - DNA, 22 bp, Homo sapiens
taggaacagtcctagaaatctg

SEQ ID NO: 7910888 - DNA, 22 bp, Homo sapiens
taggaacacatcctcctctagc

SEQ ID NO: 7910889 - DNA, 22 bp, Homo sapiens
taggaacatgcccttaccttcc

SEQ ID NO: 7910890 - DNA, 18 bp, Homo sapiens
taggaacattgattggag

SEQ ID NO: 7910891 - DNA, 22 bp, Homo sapiens
taggaacatatgcagtgctttt

SEQ ID NO: 7910892 - DNA, 18 bp, Homo sapiens
taggaacattgattggag

SEQ ID NO: 7910893 - DNA, 22 bp, Homo sapiens
taggacatgctacataaatagg

SEQ ID NO: 7910894 - DNA, 22 bp, Homo sapiens
taggacatgctacataaatagg

SEQ ID NO: 7910895 - DNA, 22 bp, Homo sapiens
taggaaatggctcagttactgc

SEQ ID NO: 7910896 - DNA, 22 bp, Homo sapiens
taggaaattaagtctcttttgt

SEQ ID NO: 7910897 - DNA, 22 bp, Homo sapiens
taggaaattaagtctcttttgt

SEQ ID NO: 7910898 - DNA, 22 bp, Homo sapiens
taggaaattaagtctcttttgt

SEQ ID NO: 7910899 - DNA, 22 bp, Homo sapiens
cagggcaggaatttgacattgc

SEQ ID NO: 7910900 - DNA, 22 bp, Homo sapiens
cagggcaggaatttgacattgc

SEQ ID NO: 7910901 - DNA, 22 bp, Homo sapiens
cagggcaggaatttgacattgc

SEQ ID NO: 7910902 - DNA, 22 bp, Homo sapiens
cagggcaggaatttgacattgc

SEQ ID NO: 7910903 - DNA, 22 bp, Homo sapiens
cagggcaggaatttgacattgc

SEQ ID NO: 7910904 - DNA, 22 bp, Homo sapiens
cagggcaggaatttgacattgc

SEQ ID NO: 7910905 - DNA, 22 bp, Homo sapiens
taggaaattgccaatatatgac

SEQ ID NO: 7910906 - DNA, 22 bp, Homo sapiens
taggaaattgccaatatatgac

SEQ ID NO: 7910907 - DNA, 22 bp, Homo sapiens
taggaaattgccaatatatgac

SEQ ID NO: 7910908 - DNA, 22 bp, Homo sapiens
taggaaattgccaatatatgac

SEQ ID NO: 7910909 - DNA, 22 bp, Homo sapiens
taggaaattgccaatatatgac

SEQ ID NO: 7910910 - DNA, 22 bp, Homo sapiens
taggaaattgacacctgcttga

SEQ ID NO: 7910911 - DNA, 22 bp, Homo sapiens
taggaaattgacacctgcttga

SEQ ID NO: 7910912 - DNA, 22 bp, Homo sapiens
taggaaattctcttgctaagtt

SEQ ID NO: 7910913 - DNA, 22 bp, Homo sapiens
taggaaattctcttgctaagtt

SEQ ID NO: 7910914 - DNA, 22 bp, Homo sapiens
taggaaattctcttgctaagtt

SEQ ID NO: 7910915 - DNA, 22 bp, Homo sapiens
taggaaattctcttgctaagtt

SEQ ID NO: 7910916 - DNA, 22 bp, Homo sapiens
taggaaattgacacctgcttga

SEQ ID NO: 7910917 - DNA, 22 bp, Homo sapiens
taggaaattgacacctgcttga

SEQ ID NO: 7910918 - DNA, 22 bp, Homo sapiens
taggaaattgacacctgcttga

SEQ ID NO: 7910919 - DNA, 22 bp, Homo sapiens
taggaaattctcttgctaagtt

SEQ ID NO: 7910920 - DNA, 22 bp, Homo sapiens
taggaaattagaacttggaaac

SEQ ID NO: 7910921 - DNA, 22 bp, Homo sapiens
taggaaattaagtctcttttgt

SEQ ID NO: 7910922 - DNA, 22 bp, Homo sapiens
taggaaattagaacttggaaac

SEQ ID NO: 7910923 - DNA, 22 bp, Homo sapiens
taggaaattctcttgctaagtt

SEQ ID NO: 7910924 - DNA, 22 bp, Homo sapiens
tatcatttaacagaatcattgc

SEQ ID NO: 7910925 - DNA, 22 bp, Homo sapiens
cagggtggcactcagcgcatct

SEQ ID NO: 7910926 - DNA, 22 bp, Homo sapiens
tatcattctaattctcctcgta

SEQ ID NO: 7910927 - DNA, 22 bp, Homo sapiens
tatcattatacagacgtataca

SEQ ID NO: 7910928 - DNA, 22 bp, Homo sapiens
tatcatttaacagaatcattgc

SEQ ID NO: 7910929 - DNA, 22 bp, Homo sapiens
tatcattgtgttatttcttcca

SEQ ID NO: 7910930 - DNA, 20 bp, Homo sapiens
tatcatgtttctagaccttt

SEQ ID NO: 7910931 - DNA, 22 bp, Homo sapiens
tatcatgtctggagatactttt

SEQ ID NO: 7910932 - DNA, 22 bp, Homo sapiens
tatcatgtgactccaatgtgga

SEQ ID NO: 7910933 - DNA, 22 bp, Homo sapiens
tatcatgtctctttggtctcca

SEQ ID NO: 7910934 - DNA, 22 bp, Homo sapiens
cagggtggcactcagcgcatct

SEQ ID NO: 7910935 - DNA, 22 bp, Homo sapiens
cagggtggcaggcaccatggcc

SEQ ID NO: 7910936 - DNA, 22 bp, Homo sapiens
cagggtggcactcagcgcatct

SEQ ID NO: 7910937 - DNA, 22 bp, Homo sapiens
cagggtggcaggcaccatggcc

SEQ ID NO: 7910938 - DNA, 22 bp, Homo sapiens
cagggtggcaggcaccatggcc

SEQ ID NO: 7910939 - DNA, 22 bp, Homo sapiens
cagggtggcaggcaccatggcc

SEQ ID NO: 7910940 - DNA, 22 bp, Homo sapiens
cagggtggcaggcaccatggcc

SEQ ID NO: 7910941 - DNA, 22 bp, Homo sapiens
cagggtggcaggcaccatggcc

SEQ ID NO: 7910942 - DNA, 22 bp, Homo sapiens
cagggtggcaggcaccatggcc

SEQ ID NO: 7910943 - DNA, 22 bp, Homo sapiens
cagggtggcaggcaccatggcc

SEQ ID NO: 7910944 - DNA, 22 bp, Homo sapiens
cagggtggcaggcaccatggcc

SEQ ID NO: 7910945 - DNA, 22 bp, Homo sapiens
cagggtggccaggtagataata

SEQ ID NO: 7910946 - DNA, 22 bp, Homo sapiens
cagggtggccaggtagataata

SEQ ID NO: 7910947 - DNA, 22 bp, Homo sapiens
cagggtggcaggcaccatggcc

SEQ ID NO: 7910948 - DNA, 22 bp, Homo sapiens
cagggtggccaggtagataata

SEQ ID NO: 7910949 - DNA, 22 bp, Homo sapiens
cagggtggccctgtggtctcat

SEQ ID NO: 7910950 - DNA, 22 bp, Homo sapiens
cagggtggccaggtagataata

SEQ ID NO: 7910951 - DNA, 22 bp, Homo sapiens
tatcatgatcagcaactaatca

SEQ ID NO: 7910952 - DNA, 22 bp, Homo sapiens
tatcatcttgttgtcatgcagc

SEQ ID NO: 7910953 - DNA, 22 bp, Homo sapiens
tatcatctgcaaagcacatcta

SEQ ID NO: 7910954 - DNA, 22 bp, Homo sapiens
tatcatcactgtaatccgttga

SEQ ID NO: 7910955 - DNA, 22 bp, Homo sapiens
tatcataagttaattaaacagt

SEQ ID NO: 7910956 - DNA, 22 bp, Homo sapiens
tatcataagttaattaaacagt

SEQ ID NO: 7910957 - DNA, 22 bp, Homo sapiens
tatcataagttaattaaacagt

SEQ ID NO: 7910958 - DNA, 22 bp, Homo sapiens
tatcataagttaattaaacagt

SEQ ID NO: 7910959 - DNA, 22 bp, Homo sapiens
tatcagtctcctggctgtgtca

SEQ ID NO: 7910960 - DNA, 22 bp, Homo sapiens
tatcagtcctattcccagtgag

SEQ ID NO: 7910961 - DNA, 22 bp, Homo sapiens
tatcagtccagggttttgtgac

SEQ ID NO: 7910962 - DNA, 22 bp, Homo sapiens
tatcagtggtcacaagatacat

SEQ ID NO: 7910963 - DNA, 22 bp, Homo sapiens
tatcagtgattgctgtatacaa

SEQ ID NO: 7910964 - DNA, 22 bp, Homo sapiens
tatcagtgctcccagcttagca

SEQ ID NO: 7910965 - DNA, 22 bp, Homo sapiens
tatattgtaggtgctatttgaa

SEQ ID NO: 7910966 - DNA, 22 bp, Homo sapiens
tatatttaaatccaggttgaaa

SEQ ID NO: 7910967 - DNA, 22 bp, Homo sapiens
tatcaggagttgacagttgcta

SEQ ID NO: 7910968 - DNA, 22 bp, Homo sapiens
tatatttaaatccaggttgaaa

SEQ ID NO: 7910969 - DNA, 22 bp, Homo sapiens
tatatttaaatccaggttgaaa

SEQ ID NO: 7910970 - DNA, 22 bp, Homo sapiens
tatatttaaatccaggttgaaa

SEQ ID NO: 7910971 - DNA, 22 bp, Homo sapiens
tagtgaattcctaataggaaga

SEQ ID NO: 7910972 - DNA, 22 bp, Homo sapiens
tagtgattataaaacagttttt

SEQ ID NO: 7910973 - DNA, 22 bp, Homo sapiens
tagtgaaatgataacagagcag

SEQ ID NO: 7910974 - DNA, 22 bp, Homo sapiens
tagtgaaatgataacagagcag

SEQ ID NO: 7910975 - DNA, 22 bp, Homo sapiens
tagtgaaatgataacagagcag

SEQ ID NO: 7910976 - DNA, 22 bp, Homo sapiens
tagtgaaatgagaatgtatgac

SEQ ID NO: 7910977 - DNA, 22 bp, Homo sapiens
tagtgaattcctaataggaaga

SEQ ID NO: 7910978 - DNA, 22 bp, Homo sapiens
tagtgaatgggggttatgagac

SEQ ID NO: 7910979 - DNA, 22 bp, Homo sapiens
tagtgaatgttggctattaata

SEQ ID NO: 7910980 - DNA, 22 bp, Homo sapiens
tagtgaatgttggctattaata

SEQ ID NO: 7910981 - DNA, 22 bp, Homo sapiens
tagtgaatagtccaatcccgca

SEQ ID NO: 7910982 - DNA, 22 bp, Homo sapiens
tagtgaaatttatgcacagcta

SEQ ID NO: 7910983 - DNA, 22 bp, Homo sapiens
tagtgaaagtcaaagacagcta

SEQ ID NO: 7910984 - DNA, 22 bp, Homo sapiens
tagtgaaagtcaaagacagcta

SEQ ID NO: 7910985 - DNA, 22 bp, Homo sapiens
tagtgaaatatgtgctgatagc

SEQ ID NO: 7910986 - DNA, 22 bp, Homo sapiens
tagtgaaagtcaaagacagcta

SEQ ID NO: 7910987 - DNA, 22 bp, Homo sapiens
tagtgaaacctgacagatcatg

SEQ ID NO: 7910988 - DNA, 22 bp, Homo sapiens
tagtgaaagtattaaacagctg

SEQ ID NO: 7910989 - DNA, 22 bp, Homo sapiens
tagtgaaagtattaaacagctg

SEQ ID NO: 7910990 - DNA, 22 bp, Homo sapiens
tagtcttaagtaattcatggaa

SEQ ID NO: 7910991 - DNA, 22 bp, Homo sapiens
caggggcaagaatgctgtcagc

SEQ ID NO: 7910992 - DNA, 22 bp, Homo sapiens
caggggcaagaatgctgtcagc

SEQ ID NO: 7910993 - DNA, 22 bp, Homo sapiens
caggggagtgagtccctctctg

SEQ ID NO: 7910994 - DNA, 22 bp, Homo sapiens
caggggagttttatgcaacaga

SEQ ID NO: 7910995 - DNA, 22 bp, Homo sapiens
caggggagttttatgcaacaga

SEQ ID NO: 7910996 - DNA, 22 bp, Homo sapiens
caggggagttttatgcaacaga

SEQ ID NO: 7910997 - DNA, 22 bp, Homo sapiens
caggggagttttatgcaacaga

SEQ ID NO: 7910998 - DNA, 22 bp, Homo sapiens
caggggagttttatgcaacaga

SEQ ID NO: 7910999 - DNA, 22 bp, Homo sapiens
tagtctttttaataaataatgc

SEQ ID NO: 7911000 - DNA, 22 bp, Homo sapiens
tagtctttttaataaataatgc

SEQ ID NO: 7911001 - DNA, 22 bp, Homo sapiens
tagtgaaacctgacagatcatg

SEQ ID NO: 7911002 - DNA, 22 bp, Homo sapiens
tagtgaaacctgacagatcatg

SEQ ID NO: 7911003 - DNA, 22 bp, Homo sapiens
tagtgaaacctgacagatcatg

SEQ ID NO: 7911004 - DNA, 19 bp, Homo sapiens
tagtctttattcttaattt

SEQ ID NO: 7911005 - DNA, 22 bp, Homo sapiens
tagtcttttgagaagtatatct

SEQ ID NO: 7911006 - DNA, 22 bp, Homo sapiens
tagtcttttgagaagtatatct

SEQ ID NO: 7911007 - DNA, 22 bp, Homo sapiens
taggtaggtgcaattaaaagta

SEQ ID NO: 7911008 - DNA, 22 bp, Homo sapiens
taggtagatcttagtaatgaaa

SEQ ID NO: 7911009 - DNA, 22 bp, Homo sapiens
taggtagctttggcgtttcttg

SEQ ID NO: 7911010 - DNA, 22 bp, Homo sapiens
taggtagctttggcgtttcttg

SEQ ID NO: 7911011 - DNA, 22 bp, Homo sapiens
taggtagctttggcgtttcttg

SEQ ID NO: 7911012 - DNA, 22 bp, Homo sapiens
taggtagatacatgtgttggct

SEQ ID NO: 7911013 - DNA, 22 bp, Homo sapiens
taggtacttaagatctcagcta

SEQ ID NO: 7911014 - DNA, 22 bp, Homo sapiens
taggtacttaagatctcagcta

SEQ ID NO: 7911015 - DNA, 22 bp, Homo sapiens
taggtaccaaggagtcactgga

SEQ ID NO: 7911016 - DNA, 22 bp, Homo sapiens
taggtacagctaaaaattatct

SEQ ID NO: 7911017 - DNA, 22 bp, Homo sapiens
taggtacagctaaaaattatct

SEQ ID NO: 7911018 - DNA, 22 bp, Homo sapiens
taggtacattattagatgcatg

SEQ ID NO: 7911019 - DNA, 22 bp, Homo sapiens
tagggtgcgggggtgtcacccg

SEQ ID NO: 7911020 - DNA, 22 bp, Homo sapiens
tagggtgcatgacaagatccct

SEQ ID NO: 7911021 - DNA, 22 bp, Homo sapiens
tagggtgccttttattgctgtg

SEQ ID NO: 7911022 - DNA, 22 bp, Homo sapiens
tagggtggagactggaagcagg

SEQ ID NO: 7911023 - DNA, 22 bp, Homo sapiens
tagggtgcttaatactagattt

SEQ ID NO: 7911024 - DNA, 22 bp, Homo sapiens
tagggtgcttagctgttaacta

SEQ ID NO: 7911025 - DNA, 22 bp, Homo sapiens
tagggtggagactggaagcagg

SEQ ID NO: 7911026 - DNA, 22 bp, Homo sapiens
tagggtggagactggaagcagg

SEQ ID NO: 7911027 - DNA, 22 bp, Homo sapiens
tagggtgggcagttcttgggga

SEQ ID NO: 7911028 - DNA, 22 bp, Homo sapiens
tagggtgggcagttcttgggga

SEQ ID NO: 7911029 - DNA, 22 bp, Homo sapiens
tagggtggttagaaggagtatg

SEQ ID NO: 7911030 - DNA, 22 bp, Homo sapiens
tagggtggttagaaggagtatg

SEQ ID NO: 7911031 - DNA, 22 bp, Homo sapiens
tagggtggttagaaggagtatg

SEQ ID NO: 7911032 - DNA, 22 bp, Homo sapiens
taggtaatggataatgaagtga

SEQ ID NO: 7911033 - DNA, 22 bp, Homo sapiens
taggtacacagtaagtgctcaa

SEQ ID NO: 7911034 - DNA, 22 bp, Homo sapiens
cagggctttcctgagaagtgat

SEQ ID NO: 7911035 - DNA, 22 bp, Homo sapiens
cagggcttggatctgtggtcag

SEQ ID NO: 7911036 - DNA, 22 bp, Homo sapiens
cagggctttcccttgtagaaat

SEQ ID NO: 7911037 - DNA, 18 bp, Homo sapiens
cagggctgtggggtcact

SEQ ID NO: 7911038 - DNA, 22 bp, Homo sapiens
cagggctgtggctttgtgctgt

SEQ ID NO: 7911039 - DNA, 22 bp, Homo sapiens
cagggctttgtaatatgagcac

SEQ ID NO: 7911040 - DNA, 22 bp, Homo sapiens
cagggctttgaacaggcatcaa

SEQ ID NO: 7911041 - DNA, 22 bp, Homo sapiens
cagggctttgaacaggcatcaa

SEQ ID NO: 7911042 - DNA, 22 bp, Homo sapiens
cagggctttgaacaggcatcaa

SEQ ID NO: 7911043 - DNA, 22 bp, Homo sapiens
cagggctttgtgtgcctgggga

SEQ ID NO: 7911044 - DNA, 22 bp, Homo sapiens
cagggctttgtgtgcctgggga

SEQ ID NO: 7911045 - DNA, 22 bp, Homo sapiens
cagggctttgtgtgcctgggga

SEQ ID NO: 7911046 - DNA, 22 bp, Homo sapiens
cagggctttttattagctgcct

SEQ ID NO: 7911047 - DNA, 22 bp, Homo sapiens
caggggaagatgccaagggaga

SEQ ID NO: 7911048 - DNA, 22 bp, Homo sapiens
caggggaagatgccaagggaga

SEQ ID NO: 7911049 - DNA, 22 bp, Homo sapiens
caggggaagatgccaagggaga

SEQ ID NO: 7911050 - DNA, 22 bp, Homo sapiens
caggggaagatgccaagggaga

SEQ ID NO: 7911051 - DNA, 22 bp, Homo sapiens
cagggctttttattagctgcct

SEQ ID NO: 7911052 - DNA, 22 bp, Homo sapiens
caggggaagatgccaagggaga

SEQ ID NO: 7911053 - DNA, 22 bp, Homo sapiens
caggggaaggagccttgaaact

SEQ ID NO: 7911054 - DNA, 22 bp, Homo sapiens
caggggaaggagccttgaaact

SEQ ID NO: 7911055 - DNA, 22 bp, Homo sapiens
caggggaaggagccttgaaact

SEQ ID NO: 7911056 - DNA, 22 bp, Homo sapiens
caggggaaggagccttgaaact

SEQ ID NO: 7911057 - DNA, 22 bp, Homo sapiens
caggggacactcctgcttgggc

SEQ ID NO: 7911058 - DNA, 22 bp, Homo sapiens
caggggacagtatggtggatga

SEQ ID NO: 7911059 - DNA, 22 bp, Homo sapiens
caggggacattaaagctccata

SEQ ID NO: 7911060 - DNA, 22 bp, Homo sapiens
caggggacattaaagctccata

SEQ ID NO: 7911061 - DNA, 22 bp, Homo sapiens
caggggacattaaagctccata

SEQ ID NO: 7911062 - DNA, 22 bp, Homo sapiens
tagggtacatgtgcacaacatg

SEQ ID NO: 7911063 - DNA, 22 bp, Homo sapiens
tagggtccaagccttataatta

SEQ ID NO: 7911064 - DNA, 22 bp, Homo sapiens
tagggtccatatggatgaatgg

SEQ ID NO: 7911065 - DNA, 22 bp, Homo sapiens
tagggtcccagataggagccag

SEQ ID NO: 7911066 - DNA, 22 bp, Homo sapiens
tagggtcctgcctacagagaca

SEQ ID NO: 7911067 - DNA, 22 bp, Homo sapiens
tagggtcctcatctgtaaatga

SEQ ID NO: 7911068 - DNA, 22 bp, Homo sapiens
tagggcctgacattcagtaggt

SEQ ID NO: 7911069 - DNA, 22 bp, Homo sapiens
tagggccagttagggaagcttt

SEQ ID NO: 7911070 - DNA, 22 bp, Homo sapiens
tagggccagataggcttcttga

SEQ ID NO: 7911071 - DNA, 22 bp, Homo sapiens
tagggccagttagggaagcttt

SEQ ID NO: 7911072 - DNA, 22 bp, Homo sapiens
tagggccatgtctgtcttgttc

SEQ ID NO: 7911073 - DNA, 22 bp, Homo sapiens
tagggcagttataacattagtg

SEQ ID NO: 7911074 - DNA, 22 bp, Homo sapiens
tagggcagtttcatgttatctt

SEQ ID NO: 7911075 - DNA, 18 bp, Homo sapiens
tagggccaaaatggaaaa

SEQ ID NO: 7911076 - DNA, 22 bp, Homo sapiens
cagggctccatgcagggactcc

SEQ ID NO: 7911077 - DNA, 22 bp, Homo sapiens
cagggctcatctgtgtgaccag

SEQ ID NO: 7911078 - DNA, 22 bp, Homo sapiens
cagggctcatctgtgtgaccag

SEQ ID NO: 7911079 - DNA, 22 bp, Homo sapiens
cagggctccatgcagggactcc

SEQ ID NO: 7911080 - DNA, 22 bp, Homo sapiens
tagggaaggagaccaagccaca

SEQ ID NO: 7911081 - DNA, 22 bp, Homo sapiens
tagggaagtgtataggggtcat

SEQ ID NO: 7911082 - DNA, 22 bp, Homo sapiens
tagggaagtgtataggggtcat

SEQ ID NO: 7911083 - DNA, 22 bp, Homo sapiens
tagggaaggagaccaagccaca

SEQ ID NO: 7911084 - DNA, 21 bp, Homo sapiens
tagggcaggcattggaagaga

SEQ ID NO: 7911085 - DNA, 22 bp, Homo sapiens
tagggaagtgtataggggtcat

SEQ ID NO: 7911086 - DNA, 21 bp, Homo sapiens
tagggcaggcattggaagaga

SEQ ID NO: 7911087 - DNA, 22 bp, Homo sapiens
tagggcaggtgaagaaaagcta

SEQ ID NO: 7911088 - DNA, 22 bp, Homo sapiens
tagggcaggtgaagaaaagcta

SEQ ID NO: 7911089 - DNA, 22 bp, Homo sapiens
tagggcaggtgaagaaaagcta

SEQ ID NO: 7911090 - DNA, 22 bp, Homo sapiens
tagggcaggtgaagaaaagcta

SEQ ID NO: 7911091 - DNA, 22 bp, Homo sapiens
tagggcaggggaggaatctgaa

SEQ ID NO: 7911092 - DNA, 22 bp, Homo sapiens
tagggcaggggaggaatctgaa

SEQ ID NO: 7911093 - DNA, 21 bp, Homo sapiens
tagggcaggcattggaagaga

SEQ ID NO: 7911094 - DNA, 21 bp, Homo sapiens
tagggcaggcattggaagaga

SEQ ID NO: 7911095 - DNA, 22 bp, Homo sapiens
caggctggagtgcaatgacgcc

SEQ ID NO: 7911096 - DNA, 22 bp, Homo sapiens
caggctggagtgagtgtagtgg

SEQ ID NO: 7911097 - DNA, 22 bp, Homo sapiens
caggctggagtgcaatggcaca

SEQ ID NO: 7911098 - DNA, 22 bp, Homo sapiens
caggctggagtgcaatggcaca

SEQ ID NO: 7911099 - DNA, 22 bp, Homo sapiens
caggctggagtgcaatggcaca

SEQ ID NO: 7911100 - DNA, 22 bp, Homo sapiens
caggctggagtgcaatggcaca

SEQ ID NO: 7911101 - DNA, 22 bp, Homo sapiens
caggctggagtgcagtggcgcc

SEQ ID NO: 7911102 - DNA, 22 bp, Homo sapiens
caggctggagtgcagtggcgcc

SEQ ID NO: 7911103 - DNA, 22 bp, Homo sapiens
caggctggagtgcagtggcgcc

SEQ ID NO: 7911104 - DNA, 22 bp, Homo sapiens
caggctggagtgcagtggcgcc

SEQ ID NO: 7911105 - DNA, 22 bp, Homo sapiens
caggctggagtgcagtggcgcc

SEQ ID NO: 7911106 - DNA, 22 bp, Homo sapiens
caggctggagtgcagtggcgcc

SEQ ID NO: 7911107 - DNA, 22 bp, Homo sapiens
caggctggagtgcagtggcgcc

SEQ ID NO: 7911108 - DNA, 22 bp, Homo sapiens
caggctggagtgcaatggtgct

SEQ ID NO: 7911109 - DNA, 22 bp, Homo sapiens
caggctggagtgcaatggcaca

SEQ ID NO: 7911110 - DNA, 22 bp, Homo sapiens
caggctggagtgcaatggcaca

SEQ ID NO: 7911111 - DNA, 22 bp, Homo sapiens
caggctggagtgcaatggtgct

SEQ ID NO: 7911112 - DNA, 22 bp, Homo sapiens
caggctggagtgcaatggtgct

SEQ ID NO: 7911113 - DNA, 22 bp, Homo sapiens
caggctggagtgcaatggtgct

SEQ ID NO: 7911114 - DNA, 22 bp, Homo sapiens
caggctggagtgcaatggtgct

SEQ ID NO: 7911115 - DNA, 22 bp, Homo sapiens
caggctggagtgcaatggtgct

SEQ ID NO: 7911116 - DNA, 22 bp, Homo sapiens
caggctggagtgcaatggtgct

SEQ ID NO: 7911117 - DNA, 22 bp, Homo sapiens
caggctgccgtggggtccaggc

SEQ ID NO: 7911118 - DNA, 22 bp, Homo sapiens
caggctgcctggaagaggactg

SEQ ID NO: 7911119 - DNA, 22 bp, Homo sapiens
caggctgccgtggggtccaggc

SEQ ID NO: 7911120 - DNA, 23 bp, Homo sapiens
tactgtgctgaatatttgagagg

SEQ ID NO: 7911121 - DNA, 22 bp, Homo sapiens
tactgtgccctgggtcagaact

SEQ ID NO: 7911122 - DNA, 22 bp, Homo sapiens
tactgtgaatacaaaataaatt

SEQ ID NO: 7911123 - DNA, 22 bp, Homo sapiens
tactgtgcaaaaatgaatattg

SEQ ID NO: 7911124 - DNA, 22 bp, Homo sapiens
tactgtgaatacaaaataaatt

SEQ ID NO: 7911125 - DNA, 22 bp, Homo sapiens
tactgtcttttcctaaatgggt

SEQ ID NO: 7911126 - DNA, 22 bp, Homo sapiens
tactgtctttccatccttgcct

SEQ ID NO: 7911127 - DNA, 22 bp, Homo sapiens
tactgtctttccatccttgcct

SEQ ID NO: 7911128 - DNA, 23 bp, Homo sapiens
tactgtcttctattaagtaagga

SEQ ID NO: 7911129 - DNA, 22 bp, Homo sapiens
tactgtctttaggggtagaaat

SEQ ID NO: 7911130 - DNA, 22 bp, Homo sapiens
tactgtctggcaattaagaatc

SEQ ID NO: 7911131 - DNA, 22 bp, Homo sapiens
tactgtctgggttcccaagcaa

SEQ ID NO: 7911132 - DNA, 22 bp, Homo sapiens
caggctggagtgagtgtagtgg

SEQ ID NO: 7911133 - DNA, 22 bp, Homo sapiens
caggctggagtgagtgtagtgg

SEQ ID NO: 7911134 - DNA, 22 bp, Homo sapiens
caggctggagtgagtgtagtgg

SEQ ID NO: 7911135 - DNA, 22 bp, Homo sapiens
caggctggagtgagtgtagtgg

SEQ ID NO: 7911136 - DNA, 22 bp, Homo sapiens
caggctggagtgagtgtagtgg

SEQ ID NO: 7911137 - DNA, 22 bp, Homo sapiens
caggctggagtgagtgtagtgg

SEQ ID NO: 7911138 - DNA, 22 bp, Homo sapiens
caggctgcctggaagaggactg

SEQ ID NO: 7911139 - DNA, 22 bp, Homo sapiens
caggctgcctggaagaggactg

SEQ ID NO: 7911140 - DNA, 22 bp, Homo sapiens
caggctggagtgagtgtagtgg

SEQ ID NO: 7911141 - DNA, 22 bp, Homo sapiens
caggctggagtgcagtggcgct

SEQ ID NO: 7911142 - DNA, 22 bp, Homo sapiens
caggctggagtgcagtggcgct

SEQ ID NO: 7911143 - DNA, 22 bp, Homo sapiens
caggctggagtgcagtggcgct

SEQ ID NO: 7911144 - DNA, 22 bp, Homo sapiens
caggctggagtgcagtggcgct

SEQ ID NO: 7911145 - DNA, 22 bp, Homo sapiens
caggctggagtgcagtggcgct

SEQ ID NO: 7911146 - DNA, 22 bp, Homo sapiens
caggctggagtgcagtggcgct

SEQ ID NO: 7911147 - DNA, 22 bp, Homo sapiens
caggctggagtgcagtggcgct

SEQ ID NO: 7911148 - DNA, 22 bp, Homo sapiens
caggctggagtgcagtggcgct

SEQ ID NO: 7911149 - DNA, 22 bp, Homo sapiens
caggctggagtgcagtggcgct

SEQ ID NO: 7911150 - DNA, 22 bp, Homo sapiens
caggctggagtgcagtggcgcc

SEQ ID NO: 7911151 - DNA, 22 bp, Homo sapiens
caggctggagtgcagtggcgcc

SEQ ID NO: 7911152 - DNA, 22 bp, Homo sapiens
caggctggagtgcagtggcgcc

SEQ ID NO: 7911153 - DNA, 22 bp, Homo sapiens
caggctggagtgcagtggggcg

SEQ ID NO: 7911154 - DNA, 22 bp, Homo sapiens
caggctggagtgcagtggggcg

SEQ ID NO: 7911155 - DNA, 22 bp, Homo sapiens
caggctggagtgcagtggggcg

SEQ ID NO: 7911156 - DNA, 22 bp, Homo sapiens
caggctggagtgcagtggggcg

SEQ ID NO: 7911157 - DNA, 22 bp, Homo sapiens
caggctggagtgcagtggggcg

SEQ ID NO: 7911158 - DNA, 22 bp, Homo sapiens
caggctggagtgcagtggggcg

SEQ ID NO: 7911159 - DNA, 22 bp, Homo sapiens
caggctggagtgcagtggggcg

SEQ ID NO: 7911160 - DNA, 22 bp, Homo sapiens
caggctggagtgcagtggggcg

SEQ ID NO: 7911161 - DNA, 22 bp, Homo sapiens
caggctggagtgcagtggggcg

SEQ ID NO: 7911162 - DNA, 22 bp, Homo sapiens
caggctggagtgcagtggggcg

SEQ ID NO: 7911163 - DNA, 22 bp, Homo sapiens
caggctggagtgcagtggggcg

SEQ ID NO: 7911164 - DNA, 22 bp, Homo sapiens
caggctggagtgcagtggcgct

SEQ ID NO: 7911165 - DNA, 22 bp, Homo sapiens
tagaacataagtcattcatttg

SEQ ID NO: 7911166 - DNA, 22 bp, Homo sapiens
tagaacataagtcattcatttg

SEQ ID NO: 7911167 - DNA, 22 bp, Homo sapiens
tagaacataagtcattcatttg

SEQ ID NO: 7911168 - DNA, 22 bp, Homo sapiens
tagaacataagtcattcatttg

SEQ ID NO: 7911169 - DNA, 22 bp, Homo sapiens
caggctggagtgcagtggtgcc

SEQ ID NO: 7911170 - DNA, 22 bp, Homo sapiens
caggctggagtgcagtggtgcc

SEQ ID NO: 7911171 - DNA, 22 bp, Homo sapiens
tagaacatcaggttgaatttgg

SEQ ID NO: 7911172 - DNA, 22 bp, Homo sapiens
tagaatacagtttaagaactac

SEQ ID NO: 7911173 - DNA, 22 bp, Homo sapiens
tagaatacagtttaagaactac

SEQ ID NO: 7911174 - DNA, 22 bp, Homo sapiens
tagaatacagtttaagaactac

SEQ ID NO: 7911175 - DNA, 22 bp, Homo sapiens
tagaatacagtttaagaactac

SEQ ID NO: 7911176 - DNA, 21 bp, Homo sapiens
tagaatacaggtattttggat

SEQ ID NO: 7911177 - DNA, 21 bp, Homo sapiens
tagaatacaggtattttggat

SEQ ID NO: 7911178 - DNA, 22 bp, Homo sapiens
tagaataatctgaggaaatgct

SEQ ID NO: 7911179 - DNA, 22 bp, Homo sapiens
tagaatatacactacagcttaa

SEQ ID NO: 7911180 - DNA, 22 bp, Homo sapiens
tagaatatacactacagcttaa

SEQ ID NO: 7911181 - DNA, 19 bp, Homo sapiens
tagaatagttacacagatt

SEQ ID NO: 7911182 - DNA, 22 bp, Homo sapiens
tagaatactagtgaagtcatcg

SEQ ID NO: 7911183 - DNA, 22 bp, Homo sapiens
tagaatactagtgaagtcatcg

SEQ ID NO: 7911184 - DNA, 22 bp, Homo sapiens
tagaatactagtgaagtcatcg

SEQ ID NO: 7911185 - DNA, 22 bp, Homo sapiens
tagaatatacactacagcttaa

SEQ ID NO: 7911186 - DNA, 18 bp, Homo sapiens
tagaatataggtcattct

SEQ ID NO: 7911187 - DNA, 22 bp, Homo sapiens
tagaatatacactacagcttaa

SEQ ID NO: 7911188 - DNA, 22 bp, Homo sapiens
tagaatatgattaattttctta

SEQ ID NO: 7911189 - DNA, 22 bp, Homo sapiens
tactcagagtcattgcccttct

SEQ ID NO: 7911190 - DNA, 22 bp, Homo sapiens
tactcatttcaaacagcacaaa

SEQ ID NO: 7911191 - DNA, 22 bp, Homo sapiens
tactcatcagactccagggtgg

SEQ ID NO: 7911192 - DNA, 22 bp, Homo sapiens
tactcaatttcttatgggtttc

SEQ ID NO: 7911193 - DNA, 22 bp, Homo sapiens
tactcaatctaggtggcttacc

SEQ ID NO: 7911194 - DNA, 22 bp, Homo sapiens
tactcaatgaagtagcctggtt

SEQ ID NO: 7911195 - DNA, 22 bp, Homo sapiens
tactcaatctaggtggcttacc

SEQ ID NO: 7911196 - DNA, 20 bp, Homo sapiens
tactcacaaatggtttagca

SEQ ID NO: 7911197 - DNA, 22 bp, Homo sapiens
tactcacattctgtttcttgct

SEQ ID NO: 7911198 - DNA, 22 bp, Homo sapiens
tactcacattctgtttcttgct

SEQ ID NO: 7911199 - DNA, 22 bp, Homo sapiens
tactcaaactcactaagacaga

SEQ ID NO: 7911200 - DNA, 22 bp, Homo sapiens
tactcaaactcactaagacaga

SEQ ID NO: 7911201 - DNA, 22 bp, Homo sapiens
tactatttttgcaacgtataca

SEQ ID NO: 7911202 - DNA, 22 bp, Homo sapiens
tactcaaaaagttatgaatcat

SEQ ID NO: 7911203 - DNA, 22 bp, Homo sapiens
tactattttgacatgaaattga

SEQ ID NO: 7911204 - DNA, 22 bp, Homo sapiens
tactattttgacatgaaattga

SEQ ID NO: 7911205 - DNA, 22 bp, Homo sapiens
tactattttgacatgaaattga

SEQ ID NO: 7911206 - DNA, 22 bp, Homo sapiens
tactatttttgcaacgtataca

SEQ ID NO: 7911207 - DNA, 22 bp, Homo sapiens
tactatttttgcaacgtataca

SEQ ID NO: 7911208 - DNA, 22 bp, Homo sapiens
tactatttttgcaacgtataca

SEQ ID NO: 7911209 - DNA, 22 bp, Homo sapiens
tactgtatttgataagtgaagt

SEQ ID NO: 7911210 - DNA, 22 bp, Homo sapiens
tactgtatttagaaagaactcc

SEQ ID NO: 7911211 - DNA, 22 bp, Homo sapiens
tactgtatttagaaagaactcc

SEQ ID NO: 7911212 - DNA, 22 bp, Homo sapiens
tactgtccatggtgctggacgg

SEQ ID NO: 7911213 - DNA, 22 bp, Homo sapiens
tactgtctaataagattgatgg

SEQ ID NO: 7911214 - DNA, 22 bp, Homo sapiens
tactgtctggagttgccaaagg

SEQ ID NO: 7911215 - DNA, 22 bp, Homo sapiens
tactgtctgcttcttatagctt

SEQ ID NO: 7911216 - DNA, 22 bp, Homo sapiens
tactgtctatacacttgattac

SEQ ID NO: 7911217 - DNA, 22 bp, Homo sapiens
tactgtctctgccctggccagg

SEQ ID NO: 7911218 - DNA, 22 bp, Homo sapiens
tactgtaggtgggtcactagta

SEQ ID NO: 7911219 - DNA, 22 bp, Homo sapiens
tactgtatatgcttgtatctga

SEQ ID NO: 7911220 - DNA, 21 bp, Homo sapiens
tactgtagccttgcactgtag

SEQ ID NO: 7911221 - DNA, 22 bp, Homo sapiens
tactatttggaattttaaattg

SEQ ID NO: 7911222 - DNA, 22 bp, Homo sapiens
tactatttggaattttaaattg

SEQ ID NO: 7911223 - DNA, 22 bp, Homo sapiens
tactatttggaattttaaattg

SEQ ID NO: 7911224 - DNA, 22 bp, Homo sapiens
tactattgaatcattgtcaatc

SEQ ID NO: 7911225 - DNA, 22 bp, Homo sapiens
tactatgttcttcctaaatagt

SEQ ID NO: 7911226 - DNA, 22 bp, Homo sapiens
tactatgttcttcctaaatagt

SEQ ID NO: 7911227 - DNA, 22 bp, Homo sapiens
tacctgaaccaagcccagctct

SEQ ID NO: 7911228 - DNA, 22 bp, Homo sapiens
tactatgtgaaaatactatagt

SEQ ID NO: 7911229 - DNA, 22 bp, Homo sapiens
tactatgtgaaaatactatagt

SEQ ID NO: 7911230 - DNA, 22 bp, Homo sapiens
gtgaggggtctggacgcacagt

SEQ ID NO: 7911231 - DNA, 22 bp, Homo sapiens
gtgaggggtctggacgcacagt

SEQ ID NO: 7911232 - DNA, 22 bp, Homo sapiens
gtgaggggtctggacgcacagt

SEQ ID NO: 7911233 - DNA, 22 bp, Homo sapiens
gtgaggggtggctgagcagttt

SEQ ID NO: 7911234 - DNA, 22 bp, Homo sapiens
gtgaggggtggctgagcagttt

SEQ ID NO: 7911235 - DNA, 22 bp, Homo sapiens
gtgaggggtggctgagcagttt

SEQ ID NO: 7911236 - DNA, 22 bp, Homo sapiens
gtgaggggtggctgagcagttt

SEQ ID NO: 7911237 - DNA, 22 bp, Homo sapiens
gtgaggggtggctgagcagttt

SEQ ID NO: 7911238 - DNA, 22 bp, Homo sapiens
gtgaggggtggctgagcagttt

SEQ ID NO: 7911239 - DNA, 22 bp, Homo sapiens
gtgaggggtggctgagcagttt

SEQ ID NO: 7911240 - DNA, 20 bp, Homo sapiens
cagccctgtgacctggccct

SEQ ID NO: 7911241 - DNA, 20 bp, Homo sapiens
cagccctgtgacctggccct

SEQ ID NO: 7911242 - DNA, 20 bp, Homo sapiens
cagccctgtgacctggccct

SEQ ID NO: 7911243 - DNA, 20 bp, Homo sapiens
cagccctgtgacctggccct

SEQ ID NO: 7911244 - DNA, 22 bp, Homo sapiens
gtgagggcaaattagaatcaaa

SEQ ID NO: 7911245 - DNA, 22 bp, Homo sapiens
gtgagggcagaacccccaggcc

SEQ ID NO: 7911246 - DNA, 17 bp, Homo sapiens
gtgagggcagaggatgg

SEQ ID NO: 7911247 - DNA, 22 bp, Homo sapiens
gtgagggcaaattagaatcaaa

SEQ ID NO: 7911248 - DNA, 22 bp, Homo sapiens
cagccctgtgcggagggccctg

SEQ ID NO: 7911249 - DNA, 22 bp, Homo sapiens
gtgagggaggtagatttcatca

SEQ ID NO: 7911250 - DNA, 22 bp, Homo sapiens
gtgagggataatatgcggggtt

SEQ ID NO: 7911251 - DNA, 22 bp, Homo sapiens
gtgaggggccaagagtagggca

SEQ ID NO: 7911252 - DNA, 22 bp, Homo sapiens
gtgaggggccaagagtagggca

SEQ ID NO: 7911253 - DNA, 22 bp, Homo sapiens
gtgaggggccaagagtagggca

SEQ ID NO: 7911254 - DNA, 22 bp, Homo sapiens
gtgaggggccaagagtagggca

SEQ ID NO: 7911255 - DNA, 22 bp, Homo sapiens
gtgaggggccaagagtagggca

SEQ ID NO: 7911256 - DNA, 22 bp, Homo sapiens
gtgaggggagtaaagccatgtt

SEQ ID NO: 7911257 - DNA, 22 bp, Homo sapiens
gtgaggggagtaaagccatgtt

SEQ ID NO: 7911258 - DNA, 22 bp, Homo sapiens
gtgaggggagtaaagccatgtt

SEQ ID NO: 7911259 - DNA, 22 bp, Homo sapiens
gtgaggggagtaaagccatgtt

SEQ ID NO: 7911260 - DNA, 17 bp, Homo sapiens
gtgagggcagaggatgg

SEQ ID NO: 7911261 - DNA, 22 bp, Homo sapiens
gtgagggcagcttggtcagtgt

SEQ ID NO: 7911262 - DNA, 22 bp, Homo sapiens
tagctacaatcactgtcctttg

SEQ ID NO: 7911263 - DNA, 22 bp, Homo sapiens
tagctacacatctaaacagcaa

SEQ ID NO: 7911264 - DNA, 22 bp, Homo sapiens
tagctacacatctaaacagcaa

SEQ ID NO: 7911265 - DNA, 22 bp, Homo sapiens
tagctaagcattatgtaaacta

SEQ ID NO: 7911266 - DNA, 22 bp, Homo sapiens
tagctaatggtgaagattcaga

SEQ ID NO: 7911267 - DNA, 22 bp, Homo sapiens
tagctacaaatctgataagtgg

SEQ ID NO: 7911268 - DNA, 22 bp, Homo sapiens
tagcattatctgtcttatcatt

SEQ ID NO: 7911269 - DNA, 20 bp, Homo sapiens
tagcattccagaaaactcag

SEQ ID NO: 7911270 - DNA, 22 bp, Homo sapiens
tagcattccatcactcagcacc

SEQ ID NO: 7911271 - DNA, 22 bp, Homo sapiens
tagcattccatcactcagcacc

SEQ ID NO: 7911272 - DNA, 22 bp, Homo sapiens
tagctaaatttttcatgtaata

SEQ ID NO: 7911273 - DNA, 22 bp, Homo sapiens
tagctaaatttttcatgtaata

SEQ ID NO: 7911274 - DNA, 22 bp, Homo sapiens
tagctaaaccagtatgtgaagg

SEQ ID NO: 7911275 - DNA, 22 bp, Homo sapiens
tagcgggtcaccctgctgtgaa

SEQ ID NO: 7911276 - DNA, 22 bp, Homo sapiens
tagcattatctgtcttatcatt

SEQ ID NO: 7911277 - DNA, 22 bp, Homo sapiens
tagcaatgtaagatgttaacac

SEQ ID NO: 7911278 - DNA, 22 bp, Homo sapiens
tagcaatgtgtgtgtataaatt

SEQ ID NO: 7911279 - DNA, 22 bp, Homo sapiens
tagcaatgtaagatgttaacac

SEQ ID NO: 7911280 - DNA, 22 bp, Homo sapiens
tagcaatgcttcattatttaaa

SEQ ID NO: 7911281 - DNA, 22 bp, Homo sapiens
tagcaatgtgtgtgtataaatt

SEQ ID NO: 7911282 - DNA, 22 bp, Homo sapiens
tagcaatgcttcattatttaaa

SEQ ID NO: 7911283 - DNA, 22 bp, Homo sapiens
tagcaatgctctatgatgaaaa

SEQ ID NO: 7911284 - DNA, 22 bp, Homo sapiens
tagcaatgctctatgatgaaaa

SEQ ID NO: 7911285 - DNA, 22 bp, Homo sapiens
tagcaatccgttgatcccttgc

SEQ ID NO: 7911286 - DNA, 20 bp, Homo sapiens
tagcaatgagtgttccattt

SEQ ID NO: 7911287 - DNA, 22 bp, Homo sapiens
tagcaatccgttgatcccttgc

SEQ ID NO: 7911288 - DNA, 22 bp, Homo sapiens
tagcaatccgttgatcccttgc

SEQ ID NO: 7911289 - DNA, 22 bp, Homo sapiens
tagcaatagaaacatataaagt

SEQ ID NO: 7911290 - DNA, 22 bp, Homo sapiens
tagcaatagaaacatataaagt

SEQ ID NO: 7911291 - DNA, 22 bp, Homo sapiens
tagcaagatgatgaattattca

SEQ ID NO: 7911292 - DNA, 22 bp, Homo sapiens
tagcaagatgtcactccaagtt

SEQ ID NO: 7911293 - DNA, 22 bp, Homo sapiens
tagcaagatccttccctggcgt

SEQ ID NO: 7911294 - DNA, 22 bp, Homo sapiens
tagcaagatcgtgtctctaaaa

SEQ ID NO: 7911295 - DNA, 22 bp, Homo sapiens
tagcaagatgatgaattattca

SEQ ID NO: 7911296 - DNA, 22 bp, Homo sapiens
tagcaagagtgggctttgtggg

SEQ ID NO: 7911297 - DNA, 22 bp, Homo sapiens
tagcaagatccttccctggcgt

SEQ ID NO: 7911298 - DNA, 22 bp, Homo sapiens
tagcaagagtgggctttgtggg

SEQ ID NO: 7911299 - DNA, 22 bp, Homo sapiens
tagcaagaggtgaaggtttcat

SEQ ID NO: 7911300 - DNA, 22 bp, Homo sapiens
cagggcagaaggcactctactc

SEQ ID NO: 7911301 - DNA, 22 bp, Homo sapiens
cagggcagaaggcactctactc

SEQ ID NO: 7911302 - DNA, 22 bp, Homo sapiens
tagcaagtatgatactccatga

SEQ ID NO: 7911303 - DNA, 22 bp, Homo sapiens
tagcaaggtgaagtatgggtga

SEQ ID NO: 7911304 - DNA, 22 bp, Homo sapiens
tagcaaggtgaagtatgggtga

SEQ ID NO: 7911305 - DNA, 22 bp, Homo sapiens
tagcaagtgttggtgaagatgt

SEQ ID NO: 7911306 - DNA, 22 bp, Homo sapiens
tagcaagtgttggtgaagatgt

SEQ ID NO: 7911307 - DNA, 22 bp, Homo sapiens
tagcaagtgttggtgaagatgt

SEQ ID NO: 7911308 - DNA, 22 bp, Homo sapiens
tagcaagtgttggtgaagatgt

SEQ ID NO: 7911309 - DNA, 22 bp, Homo sapiens
tagcaaggcttccaatgaacag

SEQ ID NO: 7911310 - DNA, 22 bp, Homo sapiens
tagcaaggcttccaatgaacag

SEQ ID NO: 7911311 - DNA, 22 bp, Homo sapiens
tagcaaggacaacatatgagag

SEQ ID NO: 7911312 - DNA, 22 bp, Homo sapiens
tagcaaggcgtggcactcaaat

SEQ ID NO: 7911313 - DNA, 22 bp, Homo sapiens
tagcaaggacgtccaaagaact

SEQ ID NO: 7911314 - DNA, 20 bp, Homo sapiens
tagcaagcaggaggtgcaga

SEQ ID NO: 7911315 - DNA, 22 bp, Homo sapiens
tagcaagcagattagaagatcc

SEQ ID NO: 7911316 - DNA, 22 bp, Homo sapiens
tagcaaggacaacatatgagag

SEQ ID NO: 7911317 - DNA, 22 bp, Homo sapiens
cagggcacagatcggggcgcac

SEQ ID NO: 7911318 - DNA, 22 bp, Homo sapiens
cagggcacagatcggggcgcac

SEQ ID NO: 7911319 - DNA, 22 bp, Homo sapiens
cagggcacggagaagtcacccc

SEQ ID NO: 7911320 - DNA, 22 bp, Homo sapiens
cagggcacagttatggaggtgg

SEQ ID NO: 7911321 - DNA, 22 bp, Homo sapiens
cagggcacagttatggaggtgg

SEQ ID NO: 7911322 - DNA, 22 bp, Homo sapiens
cagggcacagttatggaggtgg

SEQ ID NO: 7911323 - DNA, 20 bp, Homo sapiens
cagggcacactgcagcctcg

SEQ ID NO: 7911324 - DNA, 20 bp, Homo sapiens
cagggcacactgcagcctcg

SEQ ID NO: 7911325 - DNA, 20 bp, Homo sapiens
cagggcacactgcagcctcg

SEQ ID NO: 7911326 - DNA, 20 bp, Homo sapiens
cagggcacactgcagcctcg

SEQ ID NO: 7911327 - DNA, 20 bp, Homo sapiens
cagggcacactgcagcctcg

SEQ ID NO: 7911328 - DNA, 20 bp, Homo sapiens
cagggcacactgcagcctcg

SEQ ID NO: 7911329 - DNA, 20 bp, Homo sapiens
cagggcacactgcagcctcg

SEQ ID NO: 7911330 - DNA, 22 bp, Homo sapiens
cagggcacttaaattgcctcgt

SEQ ID NO: 7911331 - DNA, 22 bp, Homo sapiens
cagggcacttaaattgcctcgt

SEQ ID NO: 7911332 - DNA, 22 bp, Homo sapiens
cagggcacggagaagtcacccc

SEQ ID NO: 7911333 - DNA, 22 bp, Homo sapiens
cagggcagaacatatagatagt

SEQ ID NO: 7911334 - DNA, 22 bp, Homo sapiens
cagggcagaacatatagatagt

SEQ ID NO: 7911335 - DNA, 22 bp, Homo sapiens
cagggcagaacatatagatagt

SEQ ID NO: 7911336 - DNA, 22 bp, Homo sapiens
cagggcagaacatatagatagt

SEQ ID NO: 7911337 - DNA, 22 bp, Homo sapiens
cagggcagaaggcactctactc

SEQ ID NO: 7911338 - DNA, 22 bp, Homo sapiens
cagggcagaaggcactctactc

SEQ ID NO: 7911339 - DNA, 22 bp, Homo sapiens
cagggcagaaggcactctactc

SEQ ID NO: 7911340 - DNA, 22 bp, Homo sapiens
cagggcagaaggcactctactc

SEQ ID NO: 7911341 - DNA, 22 bp, Homo sapiens
cagggcagaacatatagatagt

SEQ ID NO: 7911342 - DNA, 22 bp, Homo sapiens
cagggcagaaggcactctactc

SEQ ID NO: 7911343 - DNA, 22 bp, Homo sapiens
tagataaattagaaagtttact

SEQ ID NO: 7911344 - DNA, 22 bp, Homo sapiens
tagataaattagaaagtttact

SEQ ID NO: 7911345 - DNA, 22 bp, Homo sapiens
tagataaattagaaagtttact

SEQ ID NO: 7911346 - DNA, 22 bp, Homo sapiens
tagataacagcactggcctcgc

SEQ ID NO: 7911347 - DNA, 22 bp, Homo sapiens
tagataacttgcacctacagga

SEQ ID NO: 7911348 - DNA, 22 bp, Homo sapiens
tagataagaatggcatcttctc

SEQ ID NO: 7911349 - DNA, 22 bp, Homo sapiens
tagataatttggcatcatattg

SEQ ID NO: 7911350 - DNA, 22 bp, Homo sapiens
tagataatttggcatcatattg

SEQ ID NO: 7911351 - DNA, 22 bp, Homo sapiens
tagataatttggcatcatattg

SEQ ID NO: 7911352 - DNA, 22 bp, Homo sapiens
tagataatttggcatcatattg

SEQ ID NO: 7911353 - DNA, 22 bp, Homo sapiens
cagggcaaagagagcacatgct

SEQ ID NO: 7911354 - DNA, 22 bp, Homo sapiens
cagggatggcgctggctgcccg

SEQ ID NO: 7911355 - DNA, 22 bp, Homo sapiens
cagggatggcgctggctgcccg

SEQ ID NO: 7911356 - DNA, 22 bp, Homo sapiens
cagggatggcgctggctgcccg

SEQ ID NO: 7911357 - DNA, 22 bp, Homo sapiens
cagggatggcgctggctgcccg

SEQ ID NO: 7911358 - DNA, 22 bp, Homo sapiens
tagatacacacacagtcatgtg

SEQ ID NO: 7911359 - DNA, 21 bp, Homo sapiens
cagggcaaccaagtccagaga

SEQ ID NO: 7911360 - DNA, 22 bp, Homo sapiens
cagggcaaagagagcacatgct

SEQ ID NO: 7911361 - DNA, 22 bp, Homo sapiens
cagggcaaggcagagcgtcccc

SEQ ID NO: 7911362 - DNA, 21 bp, Homo sapiens
cagggcaaccaagtccagaga

SEQ ID NO: 7911363 - DNA, 21 bp, Homo sapiens
cagggcacacagaggatggta

SEQ ID NO: 7911364 - DNA, 21 bp, Homo sapiens
cagggcacacagaggatggta

SEQ ID NO: 7911365 - DNA, 22 bp, Homo sapiens
caggctggtcccagagcattgc

SEQ ID NO: 7911366 - DNA, 22 bp, Homo sapiens
caggctggtcccagagcattgc

SEQ ID NO: 7911367 - DNA, 22 bp, Homo sapiens
caggctggtcccagagcattgc

SEQ ID NO: 7911368 - DNA, 22 bp, Homo sapiens
caggctggtcccagagcattgc

SEQ ID NO: 7911369 - DNA, 22 bp, Homo sapiens
caggctggtcccagagcattgc

SEQ ID NO: 7911370 - DNA, 22 bp, Homo sapiens
caggctggtcccagagcattgc

SEQ ID NO: 7911371 - DNA, 22 bp, Homo sapiens
tagacattttctcaacatctct

SEQ ID NO: 7911372 - DNA, 22 bp, Homo sapiens
tagacattttctcaacatctct

SEQ ID NO: 7911373 - DNA, 22 bp, Homo sapiens
caggctgggctccggagataaa

SEQ ID NO: 7911374 - DNA, 22 bp, Homo sapiens
caggctgggctccggagataaa

SEQ ID NO: 7911375 - DNA, 22 bp, Homo sapiens
caggctgggctccggagataaa

SEQ ID NO: 7911376 - DNA, 22 bp, Homo sapiens
caggctgggctccggagataaa

SEQ ID NO: 7911377 - DNA, 22 bp, Homo sapiens
caggctgggctccggagataaa

SEQ ID NO: 7911378 - DNA, 22 bp, Homo sapiens
caggctgggctggtgttagagt

SEQ ID NO: 7911379 - DNA, 22 bp, Homo sapiens
caggctgggctggtgttagagt

SEQ ID NO: 7911380 - DNA, 22 bp, Homo sapiens
caggctgggctggtgttagagt

SEQ ID NO: 7911381 - DNA, 22 bp, Homo sapiens
caggctgggctggtgttagagt

SEQ ID NO: 7911382 - DNA, 18 bp, Homo sapiens
tagaatcaaatattttac

SEQ ID NO: 7911383 - DNA, 18 bp, Homo sapiens
tagaatcaaatattttac

SEQ ID NO: 7911384 - DNA, 18 bp, Homo sapiens
tagaatcaaatattttac

SEQ ID NO: 7911385 - DNA, 22 bp, Homo sapiens
tagaatatgtggtgtatacttt

SEQ ID NO: 7911386 - DNA, 22 bp, Homo sapiens
tagaatatgtggtgtatacttt

SEQ ID NO: 7911387 - DNA, 22 bp, Homo sapiens
tagaatatgattaattttctta

SEQ ID NO: 7911388 - DNA, 17 bp, Homo sapiens
tagaatatggtgggctg

SEQ ID NO: 7911389 - DNA, 22 bp, Homo sapiens
tagaatatgtggtaggatctgg

SEQ ID NO: 7911390 - DNA, 22 bp, Homo sapiens
tagaatatgattaattttctta

SEQ ID NO: 7911391 - DNA, 22 bp, Homo sapiens
tagaatatgtggtaggatctgg

SEQ ID NO: 7911392 - DNA, 22 bp, Homo sapiens
tagaatatgtggtgtatacttt

SEQ ID NO: 7911393 - DNA, 22 bp, Homo sapiens
caggctgggcagcctccccggc

SEQ ID NO: 7911394 - DNA, 22 bp, Homo sapiens
caggctgggcagcctccccggc

SEQ ID NO: 7911395 - DNA, 22 bp, Homo sapiens
caggctgggcagcctccccggc

SEQ ID NO: 7911396 - DNA, 21 bp, Homo sapiens
tagaatcactaataagatgta

SEQ ID NO: 7911397 - DNA, 21 bp, Homo sapiens
tagaatcactaataagatgta

SEQ ID NO: 7911398 - DNA, 22 bp, Homo sapiens
tagaatcaagcagtagagcaga

SEQ ID NO: 7911399 - DNA, 21 bp, Homo sapiens
tagaatcactaataagatgta

SEQ ID NO: 7911400 - DNA, 21 bp, Homo sapiens
tagaatcactaataagatgta

SEQ ID NO: 7911401 - DNA, 22 bp, Homo sapiens
caggctgggctccggagataaa

SEQ ID NO: 7911402 - DNA, 22 bp, Homo sapiens
caggctgggcagcctccccggc

SEQ ID NO: 7911403 - DNA, 22 bp, Homo sapiens
caggctgggcagcctccccggc

SEQ ID NO: 7911404 - DNA, 22 bp, Homo sapiens
tagataaattagaaagtttact

SEQ ID NO: 7911405 - DNA, 22 bp, Homo sapiens
tagataaattagaaagtttact

SEQ ID NO: 7911406 - DNA, 22 bp, Homo sapiens
tagataaaagggcaaagggcat

SEQ ID NO: 7911407 - DNA, 22 bp, Homo sapiens
tagagttatccttcacaggtat

SEQ ID NO: 7911408 - DNA, 22 bp, Homo sapiens
tagataaaagggcaaagggcat

SEQ ID NO: 7911409 - DNA, 22 bp, Homo sapiens
tagataaaagggcaaagggcat

SEQ ID NO: 7911410 - DNA, 22 bp, Homo sapiens
tagagtgtccaacacataggag

SEQ ID NO: 7911411 - DNA, 22 bp, Homo sapiens
tagagtgtcataacagtgccca

SEQ ID NO: 7911412 - DNA, 22 bp, Homo sapiens
tagagtgtcataacagtgccca

SEQ ID NO: 7911413 - DNA, 22 bp, Homo sapiens
tagagtgttgtaattgaaaagg

SEQ ID NO: 7911414 - DNA, 22 bp, Homo sapiens
tagaggaaccaggcaggctgag

SEQ ID NO: 7911415 - DNA, 22 bp, Homo sapiens
tagaggaaccaggcaggctgag

SEQ ID NO: 7911416 - DNA, 22 bp, Homo sapiens
tagaggaaccaggcaggctgag

SEQ ID NO: 7911417 - DNA, 22 bp, Homo sapiens
tagaggagaacacaaattatag

SEQ ID NO: 7911418 - DNA, 22 bp, Homo sapiens
tagagtgtaatacaaactaaac

SEQ ID NO: 7911419 - DNA, 22 bp, Homo sapiens
tagagctggaaaactgcaggta

SEQ ID NO: 7911420 - DNA, 22 bp, Homo sapiens
tagagctggaaaactgcaggta

SEQ ID NO: 7911421 - DNA, 22 bp, Homo sapiens
tagagctggaaaactgcaggta

SEQ ID NO: 7911422 - DNA, 22 bp, Homo sapiens
tagagctggaaaactgcaggta

SEQ ID NO: 7911423 - DNA, 22 bp, Homo sapiens
tagagctggaaaactgcaggta

SEQ ID NO: 7911424 - DNA, 19 bp, Homo sapiens
tagagctgcttcctggcag

SEQ ID NO: 7911425 - DNA, 19 bp, Homo sapiens
tagagctgcttcctggcag

SEQ ID NO: 7911426 - DNA, 19 bp, Homo sapiens
tagagctgcttcctggcag

SEQ ID NO: 7911427 - DNA, 22 bp, Homo sapiens
tagagctgctggactgtaacag

SEQ ID NO: 7911428 - DNA, 22 bp, Homo sapiens
tagagctgctggactgtaacag

SEQ ID NO: 7911429 - DNA, 22 bp, Homo sapiens
tagagctggccgggacagctgg

SEQ ID NO: 7911430 - DNA, 22 bp, Homo sapiens
tagagctgggcagtgctctgag

SEQ ID NO: 7911431 - DNA, 22 bp, Homo sapiens
tagagctggccgggacagctgg

SEQ ID NO: 7911432 - DNA, 22 bp, Homo sapiens
tagagctggaatttgcagcaag

SEQ ID NO: 7911433 - DNA, 22 bp, Homo sapiens
tagagctggaatttgcagcaag

SEQ ID NO: 7911434 - DNA, 22 bp, Homo sapiens
tagagctggaatttgcagcaag

SEQ ID NO: 7911435 - DNA, 22 bp, Homo sapiens
tagagctggaatttgcagcaag

SEQ ID NO: 7911436 - DNA, 22 bp, Homo sapiens
tagaggaaatttccaaggtgag

SEQ ID NO: 7911437 - DNA, 22 bp, Homo sapiens
tagaggaaatttccaaggtgag

SEQ ID NO: 7911438 - DNA, 19 bp, Homo sapiens
tagagcttgttttaggaag

SEQ ID NO: 7911439 - DNA, 22 bp, Homo sapiens
tagagcttgattggattcaggg

SEQ ID NO: 7911440 - DNA, 22 bp, Homo sapiens
tagagcttggactgcattttcg

SEQ ID NO: 7911441 - DNA, 21 bp, Homo sapiens
tagagcttggcacagagtaga

SEQ ID NO: 7911442 - DNA, 17 bp, Homo sapiens
tagagctggttcaggag

SEQ ID NO: 7911443 - DNA, 22 bp, Homo sapiens
tagagctgggcagtgctctgag

SEQ ID NO: 7911444 - DNA, 17 bp, Homo sapiens
tagagctggttcaggag

SEQ ID NO: 7911445 - DNA, 22 bp, Homo sapiens
tagagctgtatcaaagagcctt

SEQ ID NO: 7911446 - DNA, 22 bp, Homo sapiens
tagagcttagagaatgagtttg

SEQ ID NO: 7911447 - DNA, 22 bp, Homo sapiens
ttttaaaggatactcttgtcta

SEQ ID NO: 7911448 - DNA, 22 bp, Homo sapiens
ttttaaaggatactcttgtcta

SEQ ID NO: 7911449 - DNA, 22 bp, Homo sapiens
ttttaaaggatagctctggttg

SEQ ID NO: 7911450 - DNA, 22 bp, Homo sapiens
ttttaaaggcagattatggctt

SEQ ID NO: 7911451 - DNA, 22 bp, Homo sapiens
tttgttcaatccagacaatagc

SEQ ID NO: 7911452 - DNA, 22 bp, Homo sapiens
tttgttcaatatgtgtttgtcc

SEQ ID NO: 7911453 - DNA, 22 bp, Homo sapiens
tttgttcaatccagacaatagc

SEQ ID NO: 7911454 - DNA, 22 bp, Homo sapiens
tttgttcacagggttgttgtag

SEQ ID NO: 7911455 - DNA, 21 bp, Homo sapiens
tttgttcacacacagggcagc

SEQ ID NO: 7911456 - DNA, 21 bp, Homo sapiens
tttgttcacacacagggcagc

SEQ ID NO: 7911457 - DNA, 22 bp, Homo sapiens
ttttaaactgcagaatttagaa

SEQ ID NO: 7911458 - DNA, 22 bp, Homo sapiens
ttttaaactgcagaatttagaa

SEQ ID NO: 7911459 - DNA, 22 bp, Homo sapiens
ttttaaactgcagaatttagaa

SEQ ID NO: 7911460 - DNA, 22 bp, Homo sapiens
ttttaaactgcagaatttagaa

SEQ ID NO: 7911461 - DNA, 22 bp, Homo sapiens
ttttaaactgcagaatttagaa

SEQ ID NO: 7911462 - DNA, 22 bp, Homo sapiens
ttttaaactgcagaatttagaa

SEQ ID NO: 7911463 - DNA, 22 bp, Homo sapiens
ttttaaagagatgctgtgcata

SEQ ID NO: 7911464 - DNA, 22 bp, Homo sapiens
ttttaaatctccagttgacccc

SEQ ID NO: 7911465 - DNA, 22 bp, Homo sapiens
ttttaaatctccagttgacccc

SEQ ID NO: 7911466 - DNA, 22 bp, Homo sapiens
ttttaaatctccagttgacccc

SEQ ID NO: 7911467 - DNA, 22 bp, Homo sapiens
ttttaaatctccagttgacccc

SEQ ID NO: 7911468 - DNA, 22 bp, Homo sapiens
ttttaaatctccagttgacccc

SEQ ID NO: 7911469 - DNA, 22 bp, Homo sapiens
ttttaaatctccagttgacccc

SEQ ID NO: 7911470 - DNA, 22 bp, Homo sapiens
ttttaaatctccagttgacccc

SEQ ID NO: 7911471 - DNA, 22 bp, Homo sapiens
ttttaaatctccagttgacccc

SEQ ID NO: 7911472 - DNA, 22 bp, Homo sapiens
ttttaaaggctgtatgaccaag

SEQ ID NO: 7911473 - DNA, 22 bp, Homo sapiens
ttttaaaggctgtatgaccaag

SEQ ID NO: 7911474 - DNA, 22 bp, Homo sapiens
ttttaaaggctgtatgaccaag

SEQ ID NO: 7911475 - DNA, 21 bp, Homo sapiens
ttttaacaaggatttccctag

SEQ ID NO: 7911476 - DNA, 21 bp, Homo sapiens
ttttaacaaggatttccctag

SEQ ID NO: 7911477 - DNA, 22 bp, Homo sapiens
ttttaacactcagcactatctc

SEQ ID NO: 7911478 - DNA, 22 bp, Homo sapiens
ttttaacactcagcactatctc

SEQ ID NO: 7911479 - DNA, 22 bp, Homo sapiens
ttttaacactcagcactatctc

SEQ ID NO: 7911480 - DNA, 22 bp, Homo sapiens
ttttaacttaaaatacatagat

SEQ ID NO: 7911481 - DNA, 22 bp, Homo sapiens
ttttaacttaaaatacatagat

SEQ ID NO: 7911482 - DNA, 22 bp, Homo sapiens
ttttaagaaatgtatgactgtc

SEQ ID NO: 7911483 - DNA, 22 bp, Homo sapiens
ttttaagaaatgtatgactgtc

SEQ ID NO: 7911484 - DNA, 22 bp, Homo sapiens
ttttaagaaatgtatgactgtc

SEQ ID NO: 7911485 - DNA, 22 bp, Homo sapiens
ttttaacttaaaatacatagat

SEQ ID NO: 7911486 - DNA, 22 bp, Homo sapiens
ttttaagaaatgtatgactgtc

SEQ ID NO: 7911487 - DNA, 22 bp, Homo sapiens
ttttaagaaatgtatgactgtc

SEQ ID NO: 7911488 - DNA, 22 bp, Homo sapiens
ttttaatactgctattgtagga

SEQ ID NO: 7911489 - DNA, 22 bp, Homo sapiens
ttttaatgggcgactattatgg

SEQ ID NO: 7911490 - DNA, 22 bp, Homo sapiens
ttttaatcctcttggtatctta

SEQ ID NO: 7911491 - DNA, 22 bp, Homo sapiens
ttttaatcctcttggtatctta

SEQ ID NO: 7911492 - DNA, 22 bp, Homo sapiens
ttttaattcaaagtgaatagtg

SEQ ID NO: 7911493 - DNA, 22 bp, Homo sapiens
ttttaattcaaagtgaatagtg

SEQ ID NO: 7911494 - DNA, 22 bp, Homo sapiens
ttttaattcaaagtgaatagtg

SEQ ID NO: 7911495 - DNA, 22 bp, Homo sapiens
ttttaattgcaattatggtccc

SEQ ID NO: 7911496 - DNA, 22 bp, Homo sapiens
ttttaattgcaattatggtccc

SEQ ID NO: 7911497 - DNA, 22 bp, Homo sapiens
ttttaatgtgctctgcaatgat

SEQ ID NO: 7911498 - DNA, 22 bp, Homo sapiens
ttttaatgtgctctgcaatgat

SEQ ID NO: 7911499 - DNA, 22 bp, Homo sapiens
ttttaattcaaagtgaatagtg

SEQ ID NO: 7911500 - DNA, 18 bp, Homo sapiens
ttttaatttcaggggtgg

SEQ ID NO: 7911501 - DNA, 22 bp, Homo sapiens
ttttatgagaatgcgccacttg

SEQ ID NO: 7911502 - DNA, 18 bp, Homo sapiens
ttttaatttcaggggtgg

SEQ ID NO: 7911503 - DNA, 22 bp, Homo sapiens
ttttatgcaagttatgattaaa

SEQ ID NO: 7911504 - DNA, 22 bp, Homo sapiens
ttttatgcaagttatgattaaa

SEQ ID NO: 7911505 - DNA, 21 bp, Homo sapiens
ttttatgcataggaaatatat

SEQ ID NO: 7911506 - DNA, 21 bp, Homo sapiens
ttttatgcataggaaatatat

SEQ ID NO: 7911507 - DNA, 22 bp, Homo sapiens
ttttatgagtgtccctctgtgg

SEQ ID NO: 7911508 - DNA, 22 bp, Homo sapiens
ttttatgagtgtccctctgtgg

SEQ ID NO: 7911509 - DNA, 22 bp, Homo sapiens
ttttatgattgagctggctaca

SEQ ID NO: 7911510 - DNA, 22 bp, Homo sapiens
ttttatgattgagctggctaca

SEQ ID NO: 7911511 - DNA, 22 bp, Homo sapiens
ttttatgattgagctggctaca

SEQ ID NO: 7911512 - DNA, 22 bp, Homo sapiens
ttttatgtcataaggacactca

SEQ ID NO: 7911513 - DNA, 22 bp, Homo sapiens
ttttatgtgctggactggcagt

SEQ ID NO: 7911514 - DNA, 22 bp, Homo sapiens
ttttatgtaataaactgtacac

SEQ ID NO: 7911515 - DNA, 22 bp, Homo sapiens
ttttatgtaataaactgtacac

SEQ ID NO: 7911516 - DNA, 22 bp, Homo sapiens
ttttatgtaatccttactgtcg

SEQ ID NO: 7911517 - DNA, 22 bp, Homo sapiens
tttgttaagatgctgttctgct

SEQ ID NO: 7911518 - DNA, 22 bp, Homo sapiens
tttgttaaggagtattgcttct

SEQ ID NO: 7911519 - DNA, 22 bp, Homo sapiens
tttgttaaatatttattgagtg

SEQ ID NO: 7911520 - DNA, 22 bp, Homo sapiens
tttgttaagatgctgttctgct

SEQ ID NO: 7911521 - DNA, 22 bp, Homo sapiens
tttgttaaatatttattgagtg

SEQ ID NO: 7911522 - DNA, 22 bp, Homo sapiens
tttgttaaggagtattgcttct

SEQ ID NO: 7911523 - DNA, 22 bp, Homo sapiens
tttgttaattcttatgttagag

SEQ ID NO: 7911524 - DNA, 22 bp, Homo sapiens
tttgttaaggagtattgcttct

SEQ ID NO: 7911525 - DNA, 22 bp, Homo sapiens
tttgttaattcttatgttagag

SEQ ID NO: 7911526 - DNA, 22 bp, Homo sapiens
tttgttaattcttatgttagag

SEQ ID NO: 7911527 - DNA, 22 bp, Homo sapiens
tttgttacattaaaaagtaggt

SEQ ID NO: 7911528 - DNA, 22 bp, Homo sapiens
tttgttactatagcatagagtg

SEQ ID NO: 7911529 - DNA, 22 bp, Homo sapiens
tttgttcaacaggtgaaataga

SEQ ID NO: 7911530 - DNA, 22 bp, Homo sapiens
tttgttcaacaggtgaaataga

SEQ ID NO: 7911531 - DNA, 22 bp, Homo sapiens
tttgttcaacaggtgaaataga

SEQ ID NO: 7911532 - DNA, 22 bp, Homo sapiens
tttgttcaacaggtgaaataga

SEQ ID NO: 7911533 - DNA, 22 bp, Homo sapiens
tttgttcaaacagaccctttgt

SEQ ID NO: 7911534 - DNA, 22 bp, Homo sapiens
tttgttataacaataaaaagtc

SEQ ID NO: 7911535 - DNA, 22 bp, Homo sapiens
tttgttcaacatcacttccacc

SEQ ID NO: 7911536 - DNA, 22 bp, Homo sapiens
tttgttagagtgtgggaggctg

SEQ ID NO: 7911537 - DNA, 22 bp, Homo sapiens
tttgttataacaataaaaagtc

SEQ ID NO: 7911538 - DNA, 22 bp, Homo sapiens
tttgttcaaaaattataagata

SEQ ID NO: 7911539 - DNA, 22 bp, Homo sapiens
tttgttataacaataaaaagtc

SEQ ID NO: 7911540 - DNA, 22 bp, Homo sapiens
tttgttcaaaaattataagata

SEQ ID NO: 7911541 - DNA, 22 bp, Homo sapiens
tttgttcaaacagaccctttgt

SEQ ID NO: 7911542 - DNA, 22 bp, Homo sapiens
tttgtgttgtacttctgtgcat

SEQ ID NO: 7911543 - DNA, 22 bp, Homo sapiens
tttgtgttggaagaaatgctac

SEQ ID NO: 7911544 - DNA, 22 bp, Homo sapiens
tttgtgttggaagaaatgctac

SEQ ID NO: 7911545 - DNA, 22 bp, Homo sapiens
tttgtgttgttttaagccacta

SEQ ID NO: 7911546 - DNA, 22 bp, Homo sapiens
tttgtgtttatgaagttattct

SEQ ID NO: 7911547 - DNA, 22 bp, Homo sapiens
tttgtgtttaatacaaggacct

SEQ ID NO: 7911548 - DNA, 22 bp, Homo sapiens
tttgtgtttgtacaatgcacta

SEQ ID NO: 7911549 - DNA, 22 bp, Homo sapiens
tttgttaaaatgcagattctgt

SEQ ID NO: 7911550 - DNA, 22 bp, Homo sapiens
tttgttaaaatgcagattctgt

SEQ ID NO: 7911551 - DNA, 22 bp, Homo sapiens
tttgttaaaatgcagattctgt

SEQ ID NO: 7911552 - DNA, 22 bp, Homo sapiens
tttgttaaaatgcagattctgt

SEQ ID NO: 7911553 - DNA, 22 bp, Homo sapiens
tttgtgttttagctggtgaggc

SEQ ID NO: 7911554 - DNA, 22 bp, Homo sapiens
tttgtgttttagctggtgaggc

SEQ ID NO: 7911555 - DNA, 22 bp, Homo sapiens
tttgttaaaatgcagattctgt

SEQ ID NO: 7911556 - DNA, 22 bp, Homo sapiens
tttgtaaaggcctgaatttcag

SEQ ID NO: 7911557 - DNA, 22 bp, Homo sapiens
tttgtaagaactataaattgct

SEQ ID NO: 7911558 - DNA, 22 bp, Homo sapiens
tttgtaactttagaattgatcc

SEQ ID NO: 7911559 - DNA, 22 bp, Homo sapiens
tttgtaactttagaattgatcc

SEQ ID NO: 7911560 - DNA, 22 bp, Homo sapiens
tttgtaactttagaattgatcc

SEQ ID NO: 7911561 - DNA, 22 bp, Homo sapiens
tttgtaacatcccaacaaattt

SEQ ID NO: 7911562 - DNA, 22 bp, Homo sapiens
tttgtaactctccctttgtata

SEQ ID NO: 7911563 - DNA, 22 bp, Homo sapiens
tttgtaacctaaagcaccagat

SEQ ID NO: 7911564 - DNA, 22 bp, Homo sapiens
tttgtaactgagtgctcagagc

SEQ ID NO: 7911565 - DNA, 22 bp, Homo sapiens
tttgtgtcgtcactgtcttctc

SEQ ID NO: 7911566 - DNA, 22 bp, Homo sapiens
tttgtgtcgtcactgtcttctc

SEQ ID NO: 7911567 - DNA, 22 bp, Homo sapiens
tttgtgttaaatgttaaattca

SEQ ID NO: 7911568 - DNA, 21 bp, Homo sapiens
tttgtgtgtcacgtgcacagg

SEQ ID NO: 7911569 - DNA, 22 bp, Homo sapiens
tttgtgtgtgctcacatagatg

SEQ ID NO: 7911570 - DNA, 22 bp, Homo sapiens
tttgtgtgtatatgtatataga

SEQ ID NO: 7911571 - DNA, 21 bp, Homo sapiens
tttgtgtgtcacgtgcacagg

SEQ ID NO: 7911572 - DNA, 22 bp, Homo sapiens
tttgtgtggcgttggccggcgg

SEQ ID NO: 7911573 - DNA, 22 bp, Homo sapiens
tttgtgtggtggatactgggta

SEQ ID NO: 7911574 - DNA, 22 bp, Homo sapiens
tttgtgtggtggatactgggta

SEQ ID NO: 7911575 - DNA, 22 bp, Homo sapiens
tttgtgtggatggaaggcagta

SEQ ID NO: 7911576 - DNA, 22 bp, Homo sapiens
tttgtgtgcttggtattgaaga

SEQ ID NO: 7911577 - DNA, 22 bp, Homo sapiens
tttgtaaaaggaggaagcatgg

SEQ ID NO: 7911578 - DNA, 22 bp, Homo sapiens
tttgtaaaaggaggaagcatgg

SEQ ID NO: 7911579 - DNA, 22 bp, Homo sapiens
tttgtaaaaggaggaagcatgg

SEQ ID NO: 7911580 - DNA, 22 bp, Homo sapiens
tttgtaaaaggaggaagcatgg

SEQ ID NO: 7911581 - DNA, 22 bp, Homo sapiens
tttgtaaaattagggaattcaa

SEQ ID NO: 7911582 - DNA, 22 bp, Homo sapiens
tttgtaaaggcctgaatttcag

SEQ ID NO: 7911583 - DNA, 22 bp, Homo sapiens
tttgtaaaaggaggaagcatgg

SEQ ID NO: 7911584 - DNA, 22 bp, Homo sapiens
tttgtaaaattagggaattcaa

SEQ ID NO: 7911585 - DNA, 22 bp, Homo sapiens
tttgtaaatagcagtactcatg

SEQ ID NO: 7911586 - DNA, 22 bp, Homo sapiens
tttgtaaatagcagtactcatg

SEQ ID NO: 7911587 - DNA, 22 bp, Homo sapiens
tttgtaaatagcagtactcatg

SEQ ID NO: 7911588 - DNA, 22 bp, Homo sapiens
tttgtaaatagcagtactcatg

SEQ ID NO: 7911589 - DNA, 22 bp, Homo sapiens
tttgtaaatagcagtactcatg

SEQ ID NO: 7911590 - DNA, 22 bp, Homo sapiens
tttgtaacatcccaacaaattt

SEQ ID NO: 7911591 - DNA, 22 bp, Homo sapiens
tttgtaaagtctgttctgagtt

SEQ ID NO: 7911592 - DNA, 22 bp, Homo sapiens
tttgtaaagtctgttctgagtt

SEQ ID NO: 7911593 - DNA, 22 bp, Homo sapiens
tttgtaaaggcctgaatttcag

SEQ ID NO: 7911594 - DNA, 22 bp, Homo sapiens
tttgtaaagtctgttctgagtt

SEQ ID NO: 7911595 - DNA, 22 bp, Homo sapiens
ttttctgacctatctacattta

SEQ ID NO: 7911596 - DNA, 22 bp, Homo sapiens
ttttctgacctatctacattta

SEQ ID NO: 7911597 - DNA, 22 bp, Homo sapiens
ttttctgactctattgaggtat

SEQ ID NO: 7911598 - DNA, 21 bp, Homo sapiens
ttttctggagtatgtctcctc

SEQ ID NO: 7911599 - DNA, 22 bp, Homo sapiens
ttttctgcctgcgtgtttagga

SEQ ID NO: 7911600 - DNA, 22 bp, Homo sapiens
ttttctgagctcagtgacttac

SEQ ID NO: 7911601 - DNA, 22 bp, Homo sapiens
ttttctgcctgcgtgtttagga

SEQ ID NO: 7911602 - DNA, 22 bp, Homo sapiens
ttttctgtattattgtgcttca

SEQ ID NO: 7911603 - DNA, 22 bp, Homo sapiens
ttttctgtaagaggactttaat

SEQ ID NO: 7911604 - DNA, 22 bp, Homo sapiens
ttttctgtaagaggactttaat

SEQ ID NO: 7911605 - DNA, 22 bp, Homo sapiens
ttttctgtaagaggactttaat

SEQ ID NO: 7911606 - DNA, 22 bp, Homo sapiens
ttttctgttacaaagtacagcg

SEQ ID NO: 7911607 - DNA, 22 bp, Homo sapiens
ttttctgttacaaagtacagcg

SEQ ID NO: 7911608 - DNA, 22 bp, Homo sapiens
ttttctgttacaaagtacagcg

SEQ ID NO: 7911609 - DNA, 22 bp, Homo sapiens
ttttctgttacaaagtacagcg

SEQ ID NO: 7911610 - DNA, 22 bp, Homo sapiens
ttttctgtgtatccaggcttcc

SEQ ID NO: 7911611 - DNA, 20 bp, Homo sapiens
ttttctgtgccaagaaaact

SEQ ID NO: 7911612 - DNA, 22 bp, Homo sapiens
ttttctgtgattctgaggttgg

SEQ ID NO: 7911613 - DNA, 22 bp, Homo sapiens
ttttctgtattattgtgcttca

SEQ ID NO: 7911614 - DNA, 22 bp, Homo sapiens
ttttctgtgattctgaggttgg

SEQ ID NO: 7911615 - DNA, 22 bp, Homo sapiens
ttttcttatggtgaagcacaaa

SEQ ID NO: 7911616 - DNA, 22 bp, Homo sapiens
ttttcttatggtgaagcacaaa

SEQ ID NO: 7911617 - DNA, 22 bp, Homo sapiens
ttttcttatggtgaagcacaaa

SEQ ID NO: 7911618 - DNA, 22 bp, Homo sapiens
ttttcttatggtgaagcacaaa

SEQ ID NO: 7911619 - DNA, 22 bp, Homo sapiens
ttttcttatggtgaagcacaaa

SEQ ID NO: 7911620 - DNA, 22 bp, Homo sapiens
ttttcttatggtgaagcacaaa

SEQ ID NO: 7911621 - DNA, 22 bp, Homo sapiens
ttttcttatggtgaagcacaaa

SEQ ID NO: 7911622 - DNA, 22 bp, Homo sapiens
ttttcttatggtgaagcacaaa

SEQ ID NO: 7911623 - DNA, 22 bp, Homo sapiens
ttttcttatgtgcagctatatg

SEQ ID NO: 7911624 - DNA, 22 bp, Homo sapiens
ttttcttatgtgcagctatatg

SEQ ID NO: 7911625 - DNA, 22 bp, Homo sapiens
ttttcttatgtgcagctatatg

SEQ ID NO: 7911626 - DNA, 22 bp, Homo sapiens
ttttcttactgtctgtgatcct

SEQ ID NO: 7911627 - DNA, 22 bp, Homo sapiens
ttttcttactgtctgtgatcct

SEQ ID NO: 7911628 - DNA, 22 bp, Homo sapiens
ttttcttactgtctgtgatcct

SEQ ID NO: 7911629 - DNA, 22 bp, Homo sapiens
ttttcttactgtctgtgatcct

SEQ ID NO: 7911630 - DNA, 22 bp, Homo sapiens
ttttctgtttgcttcaagacat

SEQ ID NO: 7911631 - DNA, 22 bp, Homo sapiens
ttttctgtttgcttcaagacat

SEQ ID NO: 7911632 - DNA, 22 bp, Homo sapiens
ttttcttatagagcttaaagtt

SEQ ID NO: 7911633 - DNA, 22 bp, Homo sapiens
ttttcttaggtgctccaagtag

SEQ ID NO: 7911634 - DNA, 22 bp, Homo sapiens
ttttcttatagagcttaaagtt

SEQ ID NO: 7911635 - DNA, 22 bp, Homo sapiens
ttttcttatagagcttaaagtt

SEQ ID NO: 7911636 - DNA, 22 bp, Homo sapiens
ttttcttaggtgctccaagtag

SEQ ID NO: 7911637 - DNA, 22 bp, Homo sapiens
ttttcttaggtgctccaagtag

SEQ ID NO: 7911638 - DNA, 22 bp, Homo sapiens
ttttcattgttcctcgagcatt

SEQ ID NO: 7911639 - DNA, 22 bp, Homo sapiens
ttttcatttacattagggaaga

SEQ ID NO: 7911640 - DNA, 22 bp, Homo sapiens
ttttcatttacattagggaaga

SEQ ID NO: 7911641 - DNA, 22 bp, Homo sapiens
ttttcatttacattagggaaga

SEQ ID NO: 7911642 - DNA, 22 bp, Homo sapiens
ttttcatttttgtagatgcaag

SEQ ID NO: 7911643 - DNA, 22 bp, Homo sapiens
ttttcatttttgtagatgcaag

SEQ ID NO: 7911644 - DNA, 22 bp, Homo sapiens
ttttcatttttgtagatgcaag

SEQ ID NO: 7911645 - DNA, 22 bp, Homo sapiens
ttttccaaattagaagtagaga

SEQ ID NO: 7911646 - DNA, 19 bp, Homo sapiens
ttttccacagaaatatgtt

SEQ ID NO: 7911647 - DNA, 22 bp, Homo sapiens
ttttccaaagtaccatgtccct

SEQ ID NO: 7911648 - DNA, 22 bp, Homo sapiens
ttttccaaattagaagtagaga

SEQ ID NO: 7911649 - DNA, 22 bp, Homo sapiens
ttttctattcattgtctatggt

SEQ ID NO: 7911650 - DNA, 22 bp, Homo sapiens
ttttctattcattgtctatggt

SEQ ID NO: 7911651 - DNA, 22 bp, Homo sapiens
ttttccaccttctagagattgt

SEQ ID NO: 7911652 - DNA, 22 bp, Homo sapiens
ttttccacctggttccagggct

SEQ ID NO: 7911653 - DNA, 22 bp, Homo sapiens
ttttccacagcaccataagatt

SEQ ID NO: 7911654 - DNA, 22 bp, Homo sapiens
ttttccacagcaccataagatt

SEQ ID NO: 7911655 - DNA, 22 bp, Homo sapiens
ttttctgaagtttaagacattt

SEQ ID NO: 7911656 - DNA, 22 bp, Homo sapiens
ttttctgaagtttaagacattt

SEQ ID NO: 7911657 - DNA, 22 bp, Homo sapiens
ttttctgaagtttaagacattt

SEQ ID NO: 7911658 - DNA, 22 bp, Homo sapiens
ttttctcttgttaatgtactga

SEQ ID NO: 7911659 - DNA, 22 bp, Homo sapiens
ttttctcttgttaatgtactga

SEQ ID NO: 7911660 - DNA, 22 bp, Homo sapiens
ttttctcttgttaatgtactga

SEQ ID NO: 7911661 - DNA, 22 bp, Homo sapiens
ttttctcttgttaatgtactga

SEQ ID NO: 7911662 - DNA, 22 bp, Homo sapiens
ttttctcttgttaatgtactga

SEQ ID NO: 7911663 - DNA, 22 bp, Homo sapiens
ttttctgaagtttaagacattt

SEQ ID NO: 7911664 - DNA, 22 bp, Homo sapiens
ttttctcttgttaatgtactga

SEQ ID NO: 7911665 - DNA, 22 bp, Homo sapiens
ttttctcagctgcactgtatta

SEQ ID NO: 7911666 - DNA, 22 bp, Homo sapiens
ttttctcagctgcactgtatta

SEQ ID NO: 7911667 - DNA, 22 bp, Homo sapiens
ttttctcaagatccaatgcact

SEQ ID NO: 7911668 - DNA, 22 bp, Homo sapiens
ttttctcaagatccaatgcact

SEQ ID NO: 7911669 - DNA, 22 bp, Homo sapiens
ttttctattcattgtctatggt

SEQ ID NO: 7911670 - DNA, 19 bp, Homo sapiens
ttttctcagcttctagcgg

SEQ ID NO: 7911671 - DNA, 22 bp, Homo sapiens
ttttctcttgttaatgtactga

SEQ ID NO: 7911672 - DNA, 19 bp, Homo sapiens
ttttctcagcttctagcgg

SEQ ID NO: 7911673 - DNA, 22 bp, Homo sapiens
ttttctcaggtgcttatctaag

SEQ ID NO: 7911674 - DNA, 22 bp, Homo sapiens
ttttctcttccctctggacctg

SEQ ID NO: 7911675 - DNA, 22 bp, Homo sapiens
ttttattgcaataaagtgtgta

SEQ ID NO: 7911676 - DNA, 22 bp, Homo sapiens
ttttattgcaataaagtgtgta

SEQ ID NO: 7911677 - DNA, 22 bp, Homo sapiens
ttttattgcaataaagtgtgta

SEQ ID NO: 7911678 - DNA, 22 bp, Homo sapiens
ttttattgcaataaagtgtgta

SEQ ID NO: 7911679 - DNA, 22 bp, Homo sapiens
ttttattgcaataaagtgtgta

SEQ ID NO: 7911680 - DNA, 22 bp, Homo sapiens
ttttattgcaataaagtgtgta

SEQ ID NO: 7911681 - DNA, 22 bp, Homo sapiens
ttttattgcaataaagtgtgta

SEQ ID NO: 7911682 - DNA, 22 bp, Homo sapiens
ttttattgcaataaagtgtgta

SEQ ID NO: 7911683 - DNA, 22 bp, Homo sapiens
ttttattatctttgaatgggac

SEQ ID NO: 7911684 - DNA, 22 bp, Homo sapiens
ttttattatctttgaatgggac

SEQ ID NO: 7911685 - DNA, 21 bp, Homo sapiens
ttttattgatgaatggccact

SEQ ID NO: 7911686 - DNA, 21 bp, Homo sapiens
ttttattgatgaatggccact

SEQ ID NO: 7911687 - DNA, 21 bp, Homo sapiens
ttttattgatgaatggccact

SEQ ID NO: 7911688 - DNA, 22 bp, Homo sapiens
ttttattgcaataaagtgtgta

SEQ ID NO: 7911689 - DNA, 22 bp, Homo sapiens
ttttattggagtgataccaagc

SEQ ID NO: 7911690 - DNA, 22 bp, Homo sapiens
ttttattggagtgataccaagc

SEQ ID NO: 7911691 - DNA, 22 bp, Homo sapiens
ttttattggagtgataccaagc

SEQ ID NO: 7911692 - DNA, 22 bp, Homo sapiens
ttttattggagtgataccaagc

SEQ ID NO: 7911693 - DNA, 22 bp, Homo sapiens
ttttattggagtgataccaagc

SEQ ID NO: 7911694 - DNA, 22 bp, Homo sapiens
ttttattggagtgataccaagc

SEQ ID NO: 7911695 - DNA, 22 bp, Homo sapiens
ttttattggagtgataccaagc

SEQ ID NO: 7911696 - DNA, 22 bp, Homo sapiens
ttttattggagtgataccaagc

SEQ ID NO: 7911697 - DNA, 22 bp, Homo sapiens
ttttattggagtgataccaagc

SEQ ID NO: 7911698 - DNA, 22 bp, Homo sapiens
ttttattggagtgataccaagc

SEQ ID NO: 7911699 - DNA, 22 bp, Homo sapiens
ttttattggagtgataccaagc

SEQ ID NO: 7911700 - DNA, 22 bp, Homo sapiens
ttttattagtggctagatgggg

SEQ ID NO: 7911701 - DNA, 22 bp, Homo sapiens
ttttattagtggctagatgggg

SEQ ID NO: 7911702 - DNA, 22 bp, Homo sapiens
ttttattagtggctagatgggg

SEQ ID NO: 7911703 - DNA, 22 bp, Homo sapiens
ttttattagtggctagatgggg

SEQ ID NO: 7911704 - DNA, 22 bp, Homo sapiens
ttttattagtggctagatgggg

SEQ ID NO: 7911705 - DNA, 22 bp, Homo sapiens
ttttattagtggctagatgggg

SEQ ID NO: 7911706 - DNA, 22 bp, Homo sapiens
ttttatgttcctgaagctatct

SEQ ID NO: 7911707 - DNA, 22 bp, Homo sapiens
ttttatgttcctgaagctatct

SEQ ID NO: 7911708 - DNA, 22 bp, Homo sapiens
ttttatgttgctataataggta

SEQ ID NO: 7911709 - DNA, 22 bp, Homo sapiens
ttttattagtggctagatgggg

SEQ ID NO: 7911710 - DNA, 22 bp, Homo sapiens
ttttatgttcctgaagctatct

SEQ ID NO: 7911711 - DNA, 22 bp, Homo sapiens
ttttatgttcctctttatgcga

SEQ ID NO: 7911712 - DNA, 22 bp, Homo sapiens
ttttatgttcctctttatgcga

SEQ ID NO: 7911713 - DNA, 22 bp, Homo sapiens
ttttatgttcctctttatgcga

SEQ ID NO: 7911714 - DNA, 22 bp, Homo sapiens
ttttatgtgtgaaatgctgtct

SEQ ID NO: 7911715 - DNA, 22 bp, Homo sapiens
ttttatgtgtgaaatgctgtct

SEQ ID NO: 7911716 - DNA, 22 bp, Homo sapiens
ttttatgtgtgaaatgctgtct

SEQ ID NO: 7911717 - DNA, 22 bp, Homo sapiens
ttttatgtgtgaaatgctgtct

SEQ ID NO: 7911718 - DNA, 22 bp, Homo sapiens
ttttcacacaaggtgataagtt

SEQ ID NO: 7911719 - DNA, 22 bp, Homo sapiens
ttttcacacaaggtgataagtt

SEQ ID NO: 7911720 - DNA, 22 bp, Homo sapiens
ttttattggagtgataccaagc

SEQ ID NO: 7911721 - DNA, 22 bp, Homo sapiens
ttttattggagtgataccaagc

SEQ ID NO: 7911722 - DNA, 22 bp, Homo sapiens
ttttattggagtgataccaagc

SEQ ID NO: 7911723 - DNA, 22 bp, Homo sapiens
ttttcagtttgcactgcagtgc

SEQ ID NO: 7911724 - DNA, 22 bp, Homo sapiens
ttttcagtttgcactgcagtgc

SEQ ID NO: 7911725 - DNA, 22 bp, Homo sapiens
ttttcacattgtcccagcacta

SEQ ID NO: 7911726 - DNA, 22 bp, Homo sapiens
ttttcatctctgctttgtacct

SEQ ID NO: 7911727 - DNA, 22 bp, Homo sapiens
ttttcatctctgctttgtacct

SEQ ID NO: 7911728 - DNA, 22 bp, Homo sapiens
ttttcatagtaatggtgcatgt

SEQ ID NO: 7911729 - DNA, 22 bp, Homo sapiens
ttttcagttttccaggtagccg

SEQ ID NO: 7911730 - DNA, 22 bp, Homo sapiens
ttttcatgaggaaatactgccc

SEQ ID NO: 7911731 - DNA, 22 bp, Homo sapiens
ttttcatctctgctttgtacct

SEQ ID NO: 7911732 - DNA, 22 bp, Homo sapiens
ttttcatgtcatgtccttgagg

SEQ ID NO: 7911733 - DNA, 22 bp, Homo sapiens
ttttcatggccaccgcaagtga

SEQ ID NO: 7911734 - DNA, 22 bp, Homo sapiens
ttttcatggccaccgcaagtga

SEQ ID NO: 7911735 - DNA, 22 bp, Homo sapiens
ttttcatggccaccgcaagtga

SEQ ID NO: 7911736 - DNA, 22 bp, Homo sapiens
ttttcatgtcatgtccttgagg

SEQ ID NO: 7911737 - DNA, 22 bp, Homo sapiens
ttttcatgtgatgtgacatttc

SEQ ID NO: 7911738 - DNA, 22 bp, Homo sapiens
ttttcattgagcacctgagtaa

SEQ ID NO: 7911739 - DNA, 22 bp, Homo sapiens
ttttcattgtaaatcaggaaac

SEQ ID NO: 7911740 - DNA, 22 bp, Homo sapiens
ttttcattgtaaatcaggaaac

SEQ ID NO: 7911741 - DNA, 22 bp, Homo sapiens
ttttcattgtaaatcaggaaac

SEQ ID NO: 7911742 - DNA, 22 bp, Homo sapiens
ttttcattgtaaatcaggaaac

SEQ ID NO: 7911743 - DNA, 22 bp, Homo sapiens
ttttcattgtaaatcaggaaac

SEQ ID NO: 7911744 - DNA, 22 bp, Homo sapiens
ttttcatgttccttgttaagtg

SEQ ID NO: 7911745 - DNA, 22 bp, Homo sapiens
ttttcatgttccttgttaagtg

SEQ ID NO: 7911746 - DNA, 22 bp, Homo sapiens
ttttcattgttactatgagcta

SEQ ID NO: 7911747 - DNA, 22 bp, Homo sapiens
ttttcattgttactatgagcta

SEQ ID NO: 7911748 - DNA, 22 bp, Homo sapiens
ttttcattgttactatgagcta

SEQ ID NO: 7911749 - DNA, 22 bp, Homo sapiens
ttttcattgttactatgagcta

SEQ ID NO: 7911750 - DNA, 22 bp, Homo sapiens
ttttcattgttcctcgagcatt

SEQ ID NO: 7911751 - DNA, 22 bp, Homo sapiens
ttttcattgttcctcgagcatt

SEQ ID NO: 7911752 - DNA, 22 bp, Homo sapiens
ttttcattgttcctcgagcatt

SEQ ID NO: 7911753 - DNA, 22 bp, Homo sapiens
ttttcattgttactatgagcta

SEQ ID NO: 7911754 - DNA, 22 bp, Homo sapiens
tttgaaagggaaataaactcct

SEQ ID NO: 7911755 - DNA, 22 bp, Homo sapiens
tttgaaaggaagttaatacttt

SEQ ID NO: 7911756 - DNA, 22 bp, Homo sapiens
tttgaaaggaattaggatgaca

SEQ ID NO: 7911757 - DNA, 22 bp, Homo sapiens
tttgaaaggaattaggatgaca

SEQ ID NO: 7911758 - DNA, 21 bp, Homo sapiens
tttgaaagctacatctatagc

SEQ ID NO: 7911759 - DNA, 22 bp, Homo sapiens
tttgaagactactgggagtgaa

SEQ ID NO: 7911760 - DNA, 22 bp, Homo sapiens
tttgaagagccacagtgaaatt

SEQ ID NO: 7911761 - DNA, 22 bp, Homo sapiens
tttgaagactactgggagtgaa

SEQ ID NO: 7911762 - DNA, 19 bp, Homo sapiens
tttgaatataatgcagcta

SEQ ID NO: 7911763 - DNA, 23 bp, Homo sapiens
tttgaagcattttgtatcttagt

SEQ ID NO: 7911764 - DNA, 22 bp, Homo sapiens
tttgaatagcataggattacat

SEQ ID NO: 7911765 - DNA, 22 bp, Homo sapiens
tttgaagataaatatggagaaa

SEQ ID NO: 7911766 - DNA, 22 bp, Homo sapiens
tttgaagataaatatggagaaa

SEQ ID NO: 7911767 - DNA, 22 bp, Homo sapiens
tttgaagcaccaaaggagaaaa

SEQ ID NO: 7911768 - DNA, 22 bp, Homo sapiens
tttgaatatgtgcttgttaaat

SEQ ID NO: 7911769 - DNA, 22 bp, Homo sapiens
tttgaatatcacaaactttcaa

SEQ ID NO: 7911770 - DNA, 22 bp, Homo sapiens
tttgaatatgtgcttgttaaat

SEQ ID NO: 7911771 - DNA, 22 bp, Homo sapiens
tttgaatatgtgcttgttaaat

SEQ ID NO: 7911772 - DNA, 22 bp, Homo sapiens
tttgaatgaaattgacatttgg

SEQ ID NO: 7911773 - DNA, 22 bp, Homo sapiens
tttgaatgaaattgacatttgg

SEQ ID NO: 7911774 - DNA, 22 bp, Homo sapiens
tttgaatgagaattattgtcat

SEQ ID NO: 7911775 - DNA, 22 bp, Homo sapiens
tttgaatatcacaaactttcaa

SEQ ID NO: 7911776 - DNA, 22 bp, Homo sapiens
tttgaatatacttcaaacaaag

SEQ ID NO: 7911777 - DNA, 19 bp, Homo sapiens
tttgaatataatgcagcta

SEQ ID NO: 7911778 - DNA, 22 bp, Homo sapiens
tttgaatatacttcaaacaaag

SEQ ID NO: 7911779 - DNA, 22 bp, Homo sapiens
tttgaatatacttcaaacaaag

SEQ ID NO: 7911780 - DNA, 22 bp, Homo sapiens
tttgaatatacttcaaacaaag

SEQ ID NO: 7911781 - DNA, 22 bp, Homo sapiens
tttgacaaaggaaaaatgcaca

SEQ ID NO: 7911782 - DNA, 22 bp, Homo sapiens
tttgacaaataggggaataagg

SEQ ID NO: 7911783 - DNA, 22 bp, Homo sapiens
tttgacaaatatttattggcac

SEQ ID NO: 7911784 - DNA, 22 bp, Homo sapiens
tttgacaaatccttcagcaatg

SEQ ID NO: 7911785 - DNA, 22 bp, Homo sapiens
tttgacaaatccttcagcaatg

SEQ ID NO: 7911786 - DNA, 22 bp, Homo sapiens
tttgacaaatccttcagcaatg

SEQ ID NO: 7911787 - DNA, 22 bp, Homo sapiens
tttgacaaatccttcagcaatg

SEQ ID NO: 7911788 - DNA, 22 bp, Homo sapiens
tttgaatgagaattattgtcat

SEQ ID NO: 7911789 - DNA, 22 bp, Homo sapiens
tttgaatggactgagaatcttg

SEQ ID NO: 7911790 - DNA, 22 bp, Homo sapiens
tttgaatgattatctttcggca

SEQ ID NO: 7911791 - DNA, 23 bp, Homo sapiens
tttgaatgggtctatttttctta

SEQ ID NO: 7911792 - DNA, 22 bp, Homo sapiens
tttgaatggactgagaatcttg

SEQ ID NO: 7911793 - DNA, 22 bp, Homo sapiens
tttgaatgtgtgagttaacttt

SEQ ID NO: 7911794 - DNA, 20 bp, Homo sapiens
tttgaatgtaaagcatgtca

SEQ ID NO: 7911795 - DNA, 23 bp, Homo sapiens
tttgaatgggtctatttttctta

SEQ ID NO: 7911796 - DNA, 23 bp, Homo sapiens
tttgaatgggtctatttttctta

SEQ ID NO: 7911797 - DNA, 20 bp, Homo sapiens
tttgaatgtaaagcatgtca

SEQ ID NO: 7911798 - DNA, 22 bp, Homo sapiens
tttgaatgttggattgacttag

SEQ ID NO: 7911799 - DNA, 22 bp, Homo sapiens
tttgaatgttttaggtacttaa

SEQ ID NO: 7911800 - DNA, 22 bp, Homo sapiens
tttgaattattccttgagttga

SEQ ID NO: 7911801 - DNA, 22 bp, Homo sapiens
tttgaatgttttaggtacttaa

SEQ ID NO: 7911802 - DNA, 22 bp, Homo sapiens
tttgacagacatttactacatt

SEQ ID NO: 7911803 - DNA, 20 bp, Homo sapiens
tttgacaccttgggagagac

SEQ ID NO: 7911804 - DNA, 22 bp, Homo sapiens
tttgacaattcatgacatttat

SEQ ID NO: 7911805 - DNA, 22 bp, Homo sapiens
tttgacaccaggagagaaaaca

SEQ ID NO: 7911806 - DNA, 22 bp, Homo sapiens
tttgacagagttgtgaggattt

SEQ ID NO: 7911807 - DNA, 22 bp, Homo sapiens
tttgacaattaggtagaaaaag

SEQ ID NO: 7911808 - DNA, 22 bp, Homo sapiens
tttgacaattaggtagaaaaag

SEQ ID NO: 7911809 - DNA, 22 bp, Homo sapiens
tttgacaattaggtagaaaaag

SEQ ID NO: 7911810 - DNA, 22 bp, Homo sapiens
tttgacaattaggtagaaaaag

SEQ ID NO: 7911811 - DNA, 22 bp, Homo sapiens
tttgacaactgtgcagtttgta

SEQ ID NO: 7911812 - DNA, 22 bp, Homo sapiens
tttgacaacgttgttgtgagga

SEQ ID NO: 7911813 - DNA, 22 bp, Homo sapiens
tttgacaaccaggcaggtaaga

SEQ ID NO: 7911814 - DNA, 22 bp, Homo sapiens
tttctttgttgttatcacatca

SEQ ID NO: 7911815 - DNA, 22 bp, Homo sapiens
tttcttttacagtgtggctatt

SEQ ID NO: 7911816 - DNA, 22 bp, Homo sapiens
tttcttttacagtgtggctatt

SEQ ID NO: 7911817 - DNA, 22 bp, Homo sapiens
tttcttttacagtgtggctatt

SEQ ID NO: 7911818 - DNA, 22 bp, Homo sapiens
tttcttttacagtgtggctatt

SEQ ID NO: 7911819 - DNA, 22 bp, Homo sapiens
tttctttgtagtagcataatca

SEQ ID NO: 7911820 - DNA, 22 bp, Homo sapiens
tttctttgtagtagcataatca

SEQ ID NO: 7911821 - DNA, 22 bp, Homo sapiens
tttctttgttgttatcacatca

SEQ ID NO: 7911822 - DNA, 21 bp, Homo sapiens
tttctttctggctctcacagt

SEQ ID NO: 7911823 - DNA, 21 bp, Homo sapiens
tttctttctggctctcacagt

SEQ ID NO: 7911824 - DNA, 22 bp, Homo sapiens
tttcctctgatgctgacttgga

SEQ ID NO: 7911825 - DNA, 22 bp, Homo sapiens
tttcctctgatgctgacttgga

SEQ ID NO: 7911826 - DNA, 22 bp, Homo sapiens
tttcctctgatgctgacttgga

SEQ ID NO: 7911827 - DNA, 18 bp, Homo sapiens
tttctttctgcctggggc

SEQ ID NO: 7911828 - DNA, 18 bp, Homo sapiens
tttctttctgcctggggc

SEQ ID NO: 7911829 - DNA, 21 bp, Homo sapiens
tttctttctggctctcacagt

SEQ ID NO: 7911830 - DNA, 21 bp, Homo sapiens
tttctttctggctctcacagt

SEQ ID NO: 7911831 - DNA, 21 bp, Homo sapiens
tttctttctggctctcacagt

SEQ ID NO: 7911832 - DNA, 21 bp, Homo sapiens
tttctttctggctctcacagt

SEQ ID NO: 7911833 - DNA, 22 bp, Homo sapiens
tttctttgagtctcagtttgct

SEQ ID NO: 7911834 - DNA, 22 bp, Homo sapiens
tttcttttgccctgtgggttag

SEQ ID NO: 7911835 - DNA, 22 bp, Homo sapiens
tttcttttgccctgtgggttag

SEQ ID NO: 7911836 - DNA, 22 bp, Homo sapiens
tttcttttgccctgtgggttag

SEQ ID NO: 7911837 - DNA, 22 bp, Homo sapiens
tttcttttgccctgtgggttag

SEQ ID NO: 7911838 - DNA, 22 bp, Homo sapiens
tttgaaaaaggcctttggtatg

SEQ ID NO: 7911839 - DNA, 22 bp, Homo sapiens
tttcttttgccctgtgggttag

SEQ ID NO: 7911840 - DNA, 22 bp, Homo sapiens
tttcttttgctgagaggggcac

SEQ ID NO: 7911841 - DNA, 19 bp, Homo sapiens
tttcttttcccctcagcac

SEQ ID NO: 7911842 - DNA, 22 bp, Homo sapiens
tttcttttccaatatccctact

SEQ ID NO: 7911843 - DNA, 22 bp, Homo sapiens
tttcttttgaatagtgtgtggt

SEQ ID NO: 7911844 - DNA, 22 bp, Homo sapiens
tttcttttgaatagtgtgtggt

SEQ ID NO: 7911845 - DNA, 22 bp, Homo sapiens
tttcctcatttatctgctggga

SEQ ID NO: 7911846 - DNA, 22 bp, Homo sapiens
tttcctcacttcatgagagttt

SEQ ID NO: 7911847 - DNA, 22 bp, Homo sapiens
tttcctaacacaatgcatgaga

SEQ ID NO: 7911848 - DNA, 22 bp, Homo sapiens
tttcctcagaagtgtctactat

SEQ ID NO: 7911849 - DNA, 22 bp, Homo sapiens
tttcctctccaccaggaggtct

SEQ ID NO: 7911850 - DNA, 22 bp, Homo sapiens
tttcctctaaacgcatttgctt

SEQ ID NO: 7911851 - DNA, 22 bp, Homo sapiens
tttcctctgagtgagctgggag

SEQ ID NO: 7911852 - DNA, 22 bp, Homo sapiens
tttcctctgactgctcccctgc

SEQ ID NO: 7911853 - DNA, 22 bp, Homo sapiens
tttcctctgactgctcccctgc

SEQ ID NO: 7911854 - DNA, 22 bp, Homo sapiens
tttcctctccggggcctccagg

SEQ ID NO: 7911855 - DNA, 22 bp, Homo sapiens
tttcctctccaccaggaggtct

SEQ ID NO: 7911856 - DNA, 22 bp, Homo sapiens
tttcctctccggggcctccagg

SEQ ID NO: 7911857 - DNA, 22 bp, Homo sapiens
tttcctctccggggcctccagg

SEQ ID NO: 7911858 - DNA, 22 bp, Homo sapiens
tttcctctccggggcctccagg

SEQ ID NO: 7911859 - DNA, 22 bp, Homo sapiens
tttcccttctttcctgagtaat

SEQ ID NO: 7911860 - DNA, 22 bp, Homo sapiens
tttccctgtgaatatttaaaga

SEQ ID NO: 7911861 - DNA, 22 bp, Homo sapiens
tttccctctgtgccagcttctc

SEQ ID NO: 7911862 - DNA, 22 bp, Homo sapiens
tttccctctgtgccagcttctc

SEQ ID NO: 7911863 - DNA, 17 bp, Homo sapiens
tttccctccttccactc

SEQ ID NO: 7911864 - DNA, 17 bp, Homo sapiens
tttccctccttccactc

SEQ ID NO: 7911865 - DNA, 22 bp, Homo sapiens
tttccctctcatctctattatt

SEQ ID NO: 7911866 - DNA, 22 bp, Homo sapiens
tttccctacttgtaactggaaa

SEQ ID NO: 7911867 - DNA, 22 bp, Homo sapiens
tttccctacttgtaactggaaa

SEQ ID NO: 7911868 - DNA, 22 bp, Homo sapiens
tttcccttgaataaagatatct

SEQ ID NO: 7911869 - DNA, 22 bp, Homo sapiens
tttcccttgaataaagatatct

SEQ ID NO: 7911870 - DNA, 22 bp, Homo sapiens
tttcccttctttcctgagtaat

SEQ ID NO: 7911871 - DNA, 22 bp, Homo sapiens
tttcccttgaataaagatatct

SEQ ID NO: 7911872 - DNA, 22 bp, Homo sapiens
tttcccttctttcctgagtaat

SEQ ID NO: 7911873 - DNA, 22 bp, Homo sapiens
tttccctgtgaatatttaaaga

SEQ ID NO: 7911874 - DNA, 22 bp, Homo sapiens
tttcccttgttccttcctctga

SEQ ID NO: 7911875 - DNA, 22 bp, Homo sapiens
tttcccttgttccttcctctga

SEQ ID NO: 7911876 - DNA, 22 bp, Homo sapiens
tttcccttgttccttcctctga

SEQ ID NO: 7911877 - DNA, 22 bp, Homo sapiens
tttccctttagcctgagaatcc

SEQ ID NO: 7911878 - DNA, 22 bp, Homo sapiens
tttccctttgcactctacaatt

SEQ ID NO: 7911879 - DNA, 22 bp, Homo sapiens
tttccctttgcactctacaatt

SEQ ID NO: 7911880 - DNA, 22 bp, Homo sapiens
tttccctttgcactctacaatt

SEQ ID NO: 7911881 - DNA, 22 bp, Homo sapiens
tttccctttgcactctacaatt

SEQ ID NO: 7911882 - DNA, 22 bp, Homo sapiens
tttcctaacacaatgcatgaga

SEQ ID NO: 7911883 - DNA, 19 bp, Homo sapiens
tttcctaaaaagctgtgct

SEQ ID NO: 7911884 - DNA, 22 bp, Homo sapiens
tttccgacagaagctgggcgct

SEQ ID NO: 7911885 - DNA, 22 bp, Homo sapiens
tttgataatacacaagagaaag

SEQ ID NO: 7911886 - DNA, 22 bp, Homo sapiens
tttgataatacacaagagaaag

SEQ ID NO: 7911887 - DNA, 22 bp, Homo sapiens
tttgataatacacaagagaaag

SEQ ID NO: 7911888 - DNA, 22 bp, Homo sapiens
tttgataacagtgaatatcatg

SEQ ID NO: 7911889 - DNA, 22 bp, Homo sapiens
tttgataagagctgctgaaact

SEQ ID NO: 7911890 - DNA, 22 bp, Homo sapiens
tttgataagagctgctgaaact

SEQ ID NO: 7911891 - DNA, 22 bp, Homo sapiens
tttgataagagctgctgaaact

SEQ ID NO: 7911892 - DNA, 22 bp, Homo sapiens
tttgataacagtgaatatcatg

SEQ ID NO: 7911893 - DNA, 22 bp, Homo sapiens
tttgataacagtgaatatcatg

SEQ ID NO: 7911894 - DNA, 22 bp, Homo sapiens
tttgataacagtgaatatcatg

SEQ ID NO: 7911895 - DNA, 22 bp, Homo sapiens
tttgataacagtgaatatcatg

SEQ ID NO: 7911896 - DNA, 22 bp, Homo sapiens
tttgagttttacctgtattact

SEQ ID NO: 7911897 - DNA, 22 bp, Homo sapiens
tttgataacagtgaatatcatg

SEQ ID NO: 7911898 - DNA, 22 bp, Homo sapiens
tttgagtagtgagactaggcag

SEQ ID NO: 7911899 - DNA, 22 bp, Homo sapiens
tttgagtaggcttatattttgg

SEQ ID NO: 7911900 - DNA, 22 bp, Homo sapiens
tttgagtcccagctgtgtggct

SEQ ID NO: 7911901 - DNA, 22 bp, Homo sapiens
tttgagtctgcttccattttca

SEQ ID NO: 7911902 - DNA, 22 bp, Homo sapiens
tttgagttgcttatttaatagg

SEQ ID NO: 7911903 - DNA, 22 bp, Homo sapiens
tttgaggttagctagcagatca

SEQ ID NO: 7911904 - DNA, 22 bp, Homo sapiens
tttgaggttagctagcagatca

SEQ ID NO: 7911905 - DNA, 22 bp, Homo sapiens
tttgaggttagctagcagatca

SEQ ID NO: 7911906 - DNA, 22 bp, Homo sapiens
tttgaggttagctagcagatca

SEQ ID NO: 7911907 - DNA, 22 bp, Homo sapiens
tttgagtaggcttatattttgg

SEQ ID NO: 7911908 - DNA, 22 bp, Homo sapiens
tttgagcttgtagcattgctat

SEQ ID NO: 7911909 - DNA, 22 bp, Homo sapiens
tttgagtaggcttatattttgg

SEQ ID NO: 7911910 - DNA, 22 bp, Homo sapiens
tttgaggttagctagcagatca

SEQ ID NO: 7911911 - DNA, 22 bp, Homo sapiens
tttgacagatctcagagcattt

SEQ ID NO: 7911912 - DNA, 22 bp, Homo sapiens
tttgacagatccttaactcagc

SEQ ID NO: 7911913 - DNA, 22 bp, Homo sapiens
tttgacagcagataaaataaaa

SEQ ID NO: 7911914 - DNA, 18 bp, Homo sapiens
tttgaggaaatgtcctga

SEQ ID NO: 7911915 - DNA, 22 bp, Homo sapiens
tttgaggaagatcggagggaaa

SEQ ID NO: 7911916 - DNA, 22 bp, Homo sapiens
tttgaggacattttagaaagtt

SEQ ID NO: 7911917 - DNA, 22 bp, Homo sapiens
tttgaggaagatcggagggaaa

SEQ ID NO: 7911918 - DNA, 22 bp, Homo sapiens
tttgataattaaaaattgtagt

SEQ ID NO: 7911919 - DNA, 22 bp, Homo sapiens
tttgataattaaaaattgtagt

SEQ ID NO: 7911920 - DNA, 22 bp, Homo sapiens
tttgataattaaaaattgtagt

SEQ ID NO: 7911921 - DNA, 22 bp, Homo sapiens
tttgataattaaaaattgtagt

SEQ ID NO: 7911922 - DNA, 22 bp, Homo sapiens
tttgatactttgtgcaatttct

SEQ ID NO: 7911923 - DNA, 22 bp, Homo sapiens
tttgatactgagaaaaacaaat

SEQ ID NO: 7911924 - DNA, 17 bp, Homo sapiens
tttgatagaatcagagt

SEQ ID NO: 7911925 - DNA, 19 bp, Homo sapiens
tttgatagggcataatata

SEQ ID NO: 7911926 - DNA, 19 bp, Homo sapiens
tttgatagggcataatata

SEQ ID NO: 7911927 - DNA, 22 bp, Homo sapiens
tttgatagttgattaaattcca

SEQ ID NO: 7911928 - DNA, 22 bp, Homo sapiens
tttgatagttgattaaattcca

SEQ ID NO: 7911929 - DNA, 22 bp, Homo sapiens
tttgatatcctatacaagtaaa

SEQ ID NO: 7911930 - DNA, 19 bp, Homo sapiens
tttgatatctgaattatgc

SEQ ID NO: 7911931 - DNA, 19 bp, Homo sapiens
tttgatatctgaattatgc

SEQ ID NO: 7911932 - DNA, 22 bp, Homo sapiens
tttgatatcttggtatacagat

SEQ ID NO: 7911933 - DNA, 22 bp, Homo sapiens
tttgatcagcaagataaataga

SEQ ID NO: 7911934 - DNA, 22 bp, Homo sapiens
tttgatcatgaagaggataaac

SEQ ID NO: 7911935 - DNA, 22 bp, Homo sapiens
tttgatcagcaagataaataga

SEQ ID NO: 7911936 - DNA, 22 bp, Homo sapiens
tttgatctcccagactaaggag

SEQ ID NO: 7911937 - DNA, 22 bp, Homo sapiens
tttgatctatgcgtggtttccc

SEQ ID NO: 7911938 - DNA, 22 bp, Homo sapiens
tttgatgaaagctactatttac

SEQ ID NO: 7911939 - DNA, 22 bp, Homo sapiens
tttgatgaaagctactatttac

SEQ ID NO: 7911940 - DNA, 22 bp, Homo sapiens
tttgatgaaagctactatttac

SEQ ID NO: 7911941 - DNA, 22 bp, Homo sapiens
tttgatccgttgctggtgagga

SEQ ID NO: 7911942 - DNA, 22 bp, Homo sapiens
tttgatcatgaagaggataaac

SEQ ID NO: 7911943 - DNA, 22 bp, Homo sapiens
tttgatcatgaagaggataaac

SEQ ID NO: 7911944 - DNA, 22 bp, Homo sapiens
tttgatccgttgctggtgagga

SEQ ID NO: 7911945 - DNA, 22 bp, Homo sapiens
tttgatccagggcttacacata

SEQ ID NO: 7911946 - DNA, 22 bp, Homo sapiens
tttgctttcttgattcagatta

SEQ ID NO: 7911947 - DNA, 22 bp, Homo sapiens
tttgctttgactgtcagcaagt

SEQ ID NO: 7911948 - DNA, 22 bp, Homo sapiens
tttgctttcttgattcagatta

SEQ ID NO: 7911949 - DNA, 22 bp, Homo sapiens
tttgctttctgttgaacagagt

SEQ ID NO: 7911950 - DNA, 22 bp, Homo sapiens
tttgctttgggaggttgtctgg

SEQ ID NO: 7911951 - DNA, 22 bp, Homo sapiens
tttgctttgggaggttgtctgg

SEQ ID NO: 7911952 - DNA, 22 bp, Homo sapiens
tttgctttgactgtcagcaagt

SEQ ID NO: 7911953 - DNA, 22 bp, Homo sapiens
tttgctttgactgtcagcaagt

SEQ ID NO: 7911954 - DNA, 22 bp, Homo sapiens
tttgctttgactgtcagcaagt

SEQ ID NO: 7911955 - DNA, 18 bp, Homo sapiens
tttgctttccttcttcag

SEQ ID NO: 7911956 - DNA, 18 bp, Homo sapiens
tttgctttccttcttcag

SEQ ID NO: 7911957 - DNA, 22 bp, Homo sapiens
tttgatttactataagcagcac

SEQ ID NO: 7911958 - DNA, 22 bp, Homo sapiens
tttgcttgttcaagatttctgt

SEQ ID NO: 7911959 - DNA, 22 bp, Homo sapiens
tttgatttactggatattctca

SEQ ID NO: 7911960 - DNA, 22 bp, Homo sapiens
tttgatttactggatattctca

SEQ ID NO: 7911961 - DNA, 22 bp, Homo sapiens
tttgatttactataagcagcac

SEQ ID NO: 7911962 - DNA, 22 bp, Homo sapiens
tttgattctggcctctgagaag

SEQ ID NO: 7911963 - DNA, 22 bp, Homo sapiens
tttgattgcaatagttttatga

SEQ ID NO: 7911964 - DNA, 22 bp, Homo sapiens
tttgattgcaatagttttatga

SEQ ID NO: 7911965 - DNA, 22 bp, Homo sapiens
tttgattctgtaaaataacagg

SEQ ID NO: 7911966 - DNA, 22 bp, Homo sapiens
tttgatgaaagctactatttac

SEQ ID NO: 7911967 - DNA, 22 bp, Homo sapiens
tttgatgaacctatataatttg

SEQ ID NO: 7911968 - DNA, 22 bp, Homo sapiens
tttgatgaacctatataatttg

SEQ ID NO: 7911969 - DNA, 22 bp, Homo sapiens
tttgatgacctgtatctttttc

SEQ ID NO: 7911970 - DNA, 19 bp, Homo sapiens
tttgatgagaatttaagca

SEQ ID NO: 7911971 - DNA, 22 bp, Homo sapiens
tttgatgatgatgataaagttt

SEQ ID NO: 7911972 - DNA, 22 bp, Homo sapiens
tttgatgagtttaataacagcc

SEQ ID NO: 7911973 - DNA, 22 bp, Homo sapiens
tttgatgagtttaataacagcc

SEQ ID NO: 7911974 - DNA, 22 bp, Homo sapiens
tttgatgtcaaaatatcctgtt

SEQ ID NO: 7911975 - DNA, 22 bp, Homo sapiens
tttgatgctaagatttaataaa

SEQ ID NO: 7911976 - DNA, 22 bp, Homo sapiens
tttgcttttgtgctctagtggt

SEQ ID NO: 7911977 - DNA, 22 bp, Homo sapiens
tttggaaaaagacagcttatga

SEQ ID NO: 7911978 - DNA, 22 bp, Homo sapiens
tttgctttgtttaaaagtggta

SEQ ID NO: 7911979 - DNA, 22 bp, Homo sapiens
tttgcttttgtgctctagtggt

SEQ ID NO: 7911980 - DNA, 22 bp, Homo sapiens
tttgctttgtttaaaagtggta

SEQ ID NO: 7911981 - DNA, 22 bp, Homo sapiens
tttgctttgggaggttgtctgg

SEQ ID NO: 7911982 - DNA, 22 bp, Homo sapiens
tttggaaaatattgaactggtt

SEQ ID NO: 7911983 - DNA, 22 bp, Homo sapiens
tttggaaaatattgaactggtt

SEQ ID NO: 7911984 - DNA, 22 bp, Homo sapiens
tttggaaaaagcctgaacatag

SEQ ID NO: 7911985 - DNA, 22 bp, Homo sapiens
tttggaaaaagacagcttatga

SEQ ID NO: 7911986 - DNA, 22 bp, Homo sapiens
tttgcttttgtgctctagtggt

SEQ ID NO: 7911987 - DNA, 22 bp, Homo sapiens
tttggaaaaagacagcttatga

SEQ ID NO: 7911988 - DNA, 22 bp, Homo sapiens
tttggaaaaagcctgaacatag

SEQ ID NO: 7911989 - DNA, 22 bp, Homo sapiens
tttggaaaaagacagcttatga

SEQ ID NO: 7911990 - DNA, 22 bp, Homo sapiens
tttggaaaaagcctgaacatag

SEQ ID NO: 7911991 - DNA, 22 bp, Homo sapiens
tttggaaactgcctcagctctt

SEQ ID NO: 7911992 - DNA, 22 bp, Homo sapiens
tttggaaactgcctcagctctt

SEQ ID NO: 7911993 - DNA, 22 bp, Homo sapiens
tttggaaactgcctcagctctt

SEQ ID NO: 7911994 - DNA, 22 bp, Homo sapiens
tttggaaactgcctcagctctt

SEQ ID NO: 7911995 - DNA, 22 bp, Homo sapiens
tttggaaagacacacagtttta

SEQ ID NO: 7911996 - DNA, 22 bp, Homo sapiens
tttggaaacatctcagaaaata

SEQ ID NO: 7911997 - DNA, 22 bp, Homo sapiens
tttggaaacatctcagaaaata

SEQ ID NO: 7911998 - DNA, 22 bp, Homo sapiens
tttggaaactgatggtacattc

SEQ ID NO: 7911999 - DNA, 22 bp, Homo sapiens
tttggaaactgatggtacattc

SEQ ID NO: 7912000 - DNA, 22 bp, Homo sapiens
tttggaaactgatggtacattc

SEQ ID NO: 7912001 - DNA, 22 bp, Homo sapiens
tttggaaaattttctaagtctg

SEQ ID NO: 7912002 - DNA, 22 bp, Homo sapiens
tttggaaacacggtcatcttcc

SEQ ID NO: 7912003 - DNA, 22 bp, Homo sapiens
tttggaaacacggtcatcttcc

SEQ ID NO: 7912004 - DNA, 22 bp, Homo sapiens
tttggaaacacggtcatcttcc

SEQ ID NO: 7912005 - DNA, 22 bp, Homo sapiens
tttggaaacacggtcatcttcc

SEQ ID NO: 7912006 - DNA, 22 bp, Homo sapiens
tttggaaacatctcagaaaata

SEQ ID NO: 7912007 - DNA, 22 bp, Homo sapiens
tttggaaagtgtacaaatttga

SEQ ID NO: 7912008 - DNA, 22 bp, Homo sapiens
tttggaaagacacacagtttta

SEQ ID NO: 7912009 - DNA, 22 bp, Homo sapiens
tttggaaagacacacagtttta

SEQ ID NO: 7912010 - DNA, 22 bp, Homo sapiens
tttggaaaggtttggccattat

SEQ ID NO: 7912011 - DNA, 17 bp, Homo sapiens
tttggaaagtgatcatt

SEQ ID NO: 7912012 - DNA, 22 bp, Homo sapiens
tttggaaagtgtgatttcaagg

SEQ ID NO: 7912013 - DNA, 22 bp, Homo sapiens
tttggaaagtgtgatttcaagg

SEQ ID NO: 7912014 - DNA, 22 bp, Homo sapiens
tttggaaagtgtgatttcaagg

SEQ ID NO: 7912015 - DNA, 22 bp, Homo sapiens
tttggaaagttgtcactttaga

SEQ ID NO: 7912016 - DNA, 22 bp, Homo sapiens
tttggaaagttgtcactttaga

SEQ ID NO: 7912017 - DNA, 22 bp, Homo sapiens
tttggaaatacgcgtaggcaga

SEQ ID NO: 7912018 - DNA, 22 bp, Homo sapiens
tttggaaatgaccccgtctaag

SEQ ID NO: 7912019 - DNA, 22 bp, Homo sapiens
tttggaaatacgcgtaggcaga

SEQ ID NO: 7912020 - DNA, 22 bp, Homo sapiens
tttggaaataattccatctcat

SEQ ID NO: 7912021 - DNA, 22 bp, Homo sapiens
tttggaaataattccatctcat

SEQ ID NO: 7912022 - DNA, 22 bp, Homo sapiens
tttggaaataattccatctcat

SEQ ID NO: 7912023 - DNA, 22 bp, Homo sapiens
tttggaaagttgtcactttaga

SEQ ID NO: 7912024 - DNA, 22 bp, Homo sapiens
tttggaaataattccatctcat

SEQ ID NO: 7912025 - DNA, 22 bp, Homo sapiens
tttggaaattactcattgtcct

SEQ ID NO: 7912026 - DNA, 22 bp, Homo sapiens
tttggaaatttcatcaatagcc

SEQ ID NO: 7912027 - DNA, 22 bp, Homo sapiens
tttggaaattactcattgtcct

SEQ ID NO: 7912028 - DNA, 22 bp, Homo sapiens
tttggaaatgagaagccacctt

SEQ ID NO: 7912029 - DNA, 22 bp, Homo sapiens
tttggaaatttcatcaatagcc

SEQ ID NO: 7912030 - DNA, 22 bp, Homo sapiens
tttggaaattttcatccagaca

SEQ ID NO: 7912031 - DNA, 22 bp, Homo sapiens
tttggtaagtacccacctgggt

SEQ ID NO: 7912032 - DNA, 22 bp, Homo sapiens
tttggtaagtacccacctgggt

SEQ ID NO: 7912033 - DNA, 22 bp, Homo sapiens
tttggaaattttcatccagaca

SEQ ID NO: 7912034 - DNA, 17 bp, Homo sapiens
tttggtaatatattaag

SEQ ID NO: 7912035 - DNA, 17 bp, Homo sapiens
tttggtaatatattaag

SEQ ID NO: 7912036 - DNA, 22 bp, Homo sapiens
tttggtaagtcaggaatgcttc

SEQ ID NO: 7912037 - DNA, 22 bp, Homo sapiens
tttggtaagtcaggaatgcttc

SEQ ID NO: 7912038 - DNA, 22 bp, Homo sapiens
tttggtaagtatgaatgcagta

SEQ ID NO: 7912039 - DNA, 22 bp, Homo sapiens
tttggtaagtatgaatgcagta

SEQ ID NO: 7912040 - DNA, 22 bp, Homo sapiens
tttggtaagtatgaatgcagta

SEQ ID NO: 7912041 - DNA, 22 bp, Homo sapiens
tttggtcaaatattatcctgag

SEQ ID NO: 7912042 - DNA, 22 bp, Homo sapiens
tttggtattgcacactgtcttc

SEQ ID NO: 7912043 - DNA, 22 bp, Homo sapiens
tttggtattgcacactgtcttc

SEQ ID NO: 7912044 - DNA, 22 bp, Homo sapiens
tttggtattgcacactgtcttc

SEQ ID NO: 7912045 - DNA, 22 bp, Homo sapiens
tttggtattgcacactgtcttc

SEQ ID NO: 7912046 - DNA, 17 bp, Homo sapiens
tttggtaatatattaag

SEQ ID NO: 7912047 - DNA, 22 bp, Homo sapiens
tttggtcagggtaggacagttg

SEQ ID NO: 7912048 - DNA, 22 bp, Homo sapiens
tttggtcagcaatattgtgggg

SEQ ID NO: 7912049 - DNA, 22 bp, Homo sapiens
tttggtcagcagttggtggcgt

SEQ ID NO: 7912050 - DNA, 22 bp, Homo sapiens
tttggtcagcaatattgtgggg

SEQ ID NO: 7912051 - DNA, 18 bp, Homo sapiens
tttggtcctttataaaca

SEQ ID NO: 7912052 - DNA, 22 bp, Homo sapiens
tttggtctcattcactcatggg

SEQ ID NO: 7912053 - DNA, 22 bp, Homo sapiens
tttggtccagcagtcccacttc

SEQ ID NO: 7912054 - DNA, 22 bp, Homo sapiens
tttggtccctccctgcagctca

SEQ ID NO: 7912055 - DNA, 22 bp, Homo sapiens
tttggtttagggtcatttaaca

SEQ ID NO: 7912056 - DNA, 22 bp, Homo sapiens
tttggttgtatcattctatgaa

SEQ ID NO: 7912057 - DNA, 22 bp, Homo sapiens
tttggttaatttaggcttgcat

SEQ ID NO: 7912058 - DNA, 22 bp, Homo sapiens
tttggtgtctggctgtatggac

SEQ ID NO: 7912059 - DNA, 22 bp, Homo sapiens
tttggtgagctgcgagtgagga

SEQ ID NO: 7912060 - DNA, 22 bp, Homo sapiens
tttggtcttttatttaaagcag

SEQ ID NO: 7912061 - DNA, 22 bp, Homo sapiens
tttggtctctgtgcatcctcct

SEQ ID NO: 7912062 - DNA, 22 bp, Homo sapiens
tttggtctggaatcttcagggt

SEQ ID NO: 7912063 - DNA, 22 bp, Homo sapiens
tttggtgatagtgcagagaaat

SEQ ID NO: 7912064 - DNA, 22 bp, Homo sapiens
tttggtgagctgcgagtgagga

SEQ ID NO: 7912065 - DNA, 22 bp, Homo sapiens
tttggtgatagtgcagagaaat

SEQ ID NO: 7912066 - DNA, 22 bp, Homo sapiens
tttggtgagctgcgagtgagga

SEQ ID NO: 7912067 - DNA, 22 bp, Homo sapiens
tttgtaaaagcccaagctgtag

SEQ ID NO: 7912068 - DNA, 22 bp, Homo sapiens
tttgtaaaagcccaagctgtag

SEQ ID NO: 7912069 - DNA, 22 bp, Homo sapiens
tttggtttgcctgagtaccctc

SEQ ID NO: 7912070 - DNA, 22 bp, Homo sapiens
tttggtttttaatacaaagtac

SEQ ID NO: 7912071 - DNA, 22 bp, Homo sapiens
tttggtttattaaattgtaggc

SEQ ID NO: 7912072 - DNA, 22 bp, Homo sapiens
tttttatctacagattctcagc

SEQ ID NO: 7912073 - DNA, 22 bp, Homo sapiens
tttttatctacagattctcagc

SEQ ID NO: 7912074 - DNA, 22 bp, Homo sapiens
tttttatctacagattctcagc

SEQ ID NO: 7912075 - DNA, 22 bp, Homo sapiens
tttttatctacagattctcagc

SEQ ID NO: 7912076 - DNA, 22 bp, Homo sapiens
tttttatctacagattctcagc

SEQ ID NO: 7912077 - DNA, 22 bp, Homo sapiens
tttttatcttgtatgtgtctct

SEQ ID NO: 7912078 - DNA, 22 bp, Homo sapiens
tttttatatgaaggatagtgcg

SEQ ID NO: 7912079 - DNA, 22 bp, Homo sapiens
tttttataggtcagggcaagtc

SEQ ID NO: 7912080 - DNA, 22 bp, Homo sapiens
tttttatctacagattctcagc

SEQ ID NO: 7912081 - DNA, 22 bp, Homo sapiens
tttttatatgaaggatagtgcg

SEQ ID NO: 7912082 - DNA, 22 bp, Homo sapiens
tttttcaagacaacctgcatgt

SEQ ID NO: 7912083 - DNA, 22 bp, Homo sapiens
tttttcaagacaacctgcatgt

SEQ ID NO: 7912084 - DNA, 22 bp, Homo sapiens
tttttcaagacaacctgcatgt

SEQ ID NO: 7912085 - DNA, 22 bp, Homo sapiens
tttttatcttgtatgtgtctct

SEQ ID NO: 7912086 - DNA, 22 bp, Homo sapiens
tttttatcttgtatgtgtctct

SEQ ID NO: 7912087 - DNA, 22 bp, Homo sapiens
tttttatctacagattctcagc

SEQ ID NO: 7912088 - DNA, 22 bp, Homo sapiens
tttttatgcctacgctgaaaag

SEQ ID NO: 7912089 - DNA, 22 bp, Homo sapiens
tttttataggtcagggcaagtc

SEQ ID NO: 7912090 - DNA, 22 bp, Homo sapiens
tttttatatgaaggatagtgcg

SEQ ID NO: 7912091 - DNA, 22 bp, Homo sapiens
tttttatatgaaggatagtgcg

SEQ ID NO: 7912092 - DNA, 22 bp, Homo sapiens
tttttatatgaaggatagtgcg

SEQ ID NO: 7912093 - DNA, 22 bp, Homo sapiens
tttttatactttgctcaagatt

SEQ ID NO: 7912094 - DNA, 22 bp, Homo sapiens
tttttataggtcagggcaagtc

SEQ ID NO: 7912095 - DNA, 22 bp, Homo sapiens
tttttataggtcagggcaagtc

SEQ ID NO: 7912096 - DNA, 22 bp, Homo sapiens
tttttatactttgctcaagatt

SEQ ID NO: 7912097 - DNA, 22 bp, Homo sapiens
tttttatactttgctcaagatt

SEQ ID NO: 7912098 - DNA, 22 bp, Homo sapiens
tttttatactttgctcaagatt

SEQ ID NO: 7912099 - DNA, 22 bp, Homo sapiens
tttttatactttgctcaagatt

SEQ ID NO: 7912100 - DNA, 22 bp, Homo sapiens
tttttataccacctctcactta

SEQ ID NO: 7912101 - DNA, 22 bp, Homo sapiens
tttttatactttgctcaagatt

SEQ ID NO: 7912102 - DNA, 22 bp, Homo sapiens
tttttataccacctctcactta

SEQ ID NO: 7912103 - DNA, 22 bp, Homo sapiens
tttttataccacctctcactta

SEQ ID NO: 7912104 - DNA, 22 bp, Homo sapiens
tttttcacacatgtggcttgat

SEQ ID NO: 7912105 - DNA, 22 bp, Homo sapiens
tttttcatattcccctctctgg

SEQ ID NO: 7912106 - DNA, 22 bp, Homo sapiens
tttttcatattcccctctctgg

SEQ ID NO: 7912107 - DNA, 22 bp, Homo sapiens
tttttcatattcccctctctgg

SEQ ID NO: 7912108 - DNA, 22 bp, Homo sapiens
tttttcatctgattgataactc

SEQ ID NO: 7912109 - DNA, 22 bp, Homo sapiens
tttttcatctgattgataactc

SEQ ID NO: 7912110 - DNA, 22 bp, Homo sapiens
tttttcatctgattgataactc

SEQ ID NO: 7912111 - DNA, 22 bp, Homo sapiens
tttttcatctgattgataactc

SEQ ID NO: 7912112 - DNA, 22 bp, Homo sapiens
ttttcttcctggattttggcat

SEQ ID NO: 7912113 - DNA, 22 bp, Homo sapiens
ttttcttcctggattttggcat

SEQ ID NO: 7912114 - DNA, 22 bp, Homo sapiens
ttttgtttgtgtccactgcagt

SEQ ID NO: 7912115 - DNA, 22 bp, Homo sapiens
ttttgtttaaaatcctggatgg

SEQ ID NO: 7912116 - DNA, 22 bp, Homo sapiens
ttttgttgtaatatacctatcc

SEQ ID NO: 7912117 - DNA, 22 bp, Homo sapiens
ttttgtttaaaatcctggatgg

SEQ ID NO: 7912118 - DNA, 22 bp, Homo sapiens
ttttgtttaaaatcctggatgg

SEQ ID NO: 7912119 - DNA, 22 bp, Homo sapiens
ttttgtttaaaatcctggatgg

SEQ ID NO: 7912120 - DNA, 22 bp, Homo sapiens
tttttacagtcatggtcactca

SEQ ID NO: 7912121 - DNA, 22 bp, Homo sapiens
tttttacagtcatggtcactca

SEQ ID NO: 7912122 - DNA, 22 bp, Homo sapiens
tttttacagtcatggtcactca

SEQ ID NO: 7912123 - DNA, 22 bp, Homo sapiens
tttttacacttagcattgagcg

SEQ ID NO: 7912124 - DNA, 22 bp, Homo sapiens
tttttacacttagcattgagcg

SEQ ID NO: 7912125 - DNA, 22 bp, Homo sapiens
tttttacacttagcattgagcg

SEQ ID NO: 7912126 - DNA, 22 bp, Homo sapiens
tttttacacttagcattgagcg

SEQ ID NO: 7912127 - DNA, 22 bp, Homo sapiens
tttttacacttagcattgagcg

SEQ ID NO: 7912128 - DNA, 22 bp, Homo sapiens
tttttacacttagcattgagcg

SEQ ID NO: 7912129 - DNA, 22 bp, Homo sapiens
ttttgtttgtgtccactgcagt

SEQ ID NO: 7912130 - DNA, 22 bp, Homo sapiens
ttttgtttgtgtccactgcagt

SEQ ID NO: 7912131 - DNA, 19 bp, Homo sapiens
tttttacaagtaggtgtga

SEQ ID NO: 7912132 - DNA, 22 bp, Homo sapiens
tttttacctggaggataaatgt

SEQ ID NO: 7912133 - DNA, 22 bp, Homo sapiens
tttttacagtcatggtcactca

SEQ ID NO: 7912134 - DNA, 22 bp, Homo sapiens
tttttagaattggctgagaatt

SEQ ID NO: 7912135 - DNA, 22 bp, Homo sapiens
tttttagaattggctgagaatt

SEQ ID NO: 7912136 - DNA, 22 bp, Homo sapiens
tttttagattactcagccacca

SEQ ID NO: 7912137 - DNA, 22 bp, Homo sapiens
tttttagagtgttaccagtata

SEQ ID NO: 7912138 - DNA, 22 bp, Homo sapiens
tttttagagtgttaccagtata

SEQ ID NO: 7912139 - DNA, 22 bp, Homo sapiens
tttttataactcttttgtgaca

SEQ ID NO: 7912140 - DNA, 22 bp, Homo sapiens
tttttataactcttttgtgaca

SEQ ID NO: 7912141 - DNA, 22 bp, Homo sapiens
tttttataactcttttgtgaca

SEQ ID NO: 7912142 - DNA, 22 bp, Homo sapiens
tttttataccacctctcactta

SEQ ID NO: 7912143 - DNA, 22 bp, Homo sapiens
tttttataccacctctcactta

SEQ ID NO: 7912144 - DNA, 22 bp, Homo sapiens
tttttataccacctctcactta

SEQ ID NO: 7912145 - DNA, 22 bp, Homo sapiens
tttttataccacctctcactta

SEQ ID NO: 7912146 - DNA, 22 bp, Homo sapiens
tttttataactcttttgtgaca

SEQ ID NO: 7912147 - DNA, 22 bp, Homo sapiens
tttttataccacctctcactta

SEQ ID NO: 7912148 - DNA, 22 bp, Homo sapiens
ttatatatatgtagaggtcacg

SEQ ID NO: 7912149 - DNA, 22 bp, Homo sapiens
ttatatatatgtagaggtcacg

SEQ ID NO: 7912150 - DNA, 19 bp, Homo sapiens
ttatatacttggtttctct

SEQ ID NO: 7912151 - DNA, 22 bp, Homo sapiens
ttatatatatgtagaggtcacg

SEQ ID NO: 7912152 - DNA, 22 bp, Homo sapiens
ttatatatcttgatttgttcca

SEQ ID NO: 7912153 - DNA, 22 bp, Homo sapiens
ttatatatcttgatttgttcca

SEQ ID NO: 7912154 - DNA, 22 bp, Homo sapiens
ttatatatcttgatttgttcca

SEQ ID NO: 7912155 - DNA, 22 bp, Homo sapiens
ttatatatcttgatttgttcca

SEQ ID NO: 7912156 - DNA, 22 bp, Homo sapiens
ttatatcagaaggtgagattga

SEQ ID NO: 7912157 - DNA, 22 bp, Homo sapiens
ttattaaaatgcggatttggct

SEQ ID NO: 7912158 - DNA, 22 bp, Homo sapiens
ttatatgattgaagtgcataag

SEQ ID NO: 7912159 - DNA, 22 bp, Homo sapiens
ttattaaaatgcggatttggct

SEQ ID NO: 7912160 - DNA, 22 bp, Homo sapiens
ttattaaaatgcggatttggct

SEQ ID NO: 7912161 - DNA, 22 bp, Homo sapiens
ttattaaaatgcggatttggct

SEQ ID NO: 7912162 - DNA, 22 bp, Homo sapiens
ttatatgattgaagtgcataag

SEQ ID NO: 7912163 - DNA, 22 bp, Homo sapiens
ttatatgagtatcatatcactt

SEQ ID NO: 7912164 - DNA, 22 bp, Homo sapiens
ttatatgattgaagtgcataag

SEQ ID NO: 7912165 - DNA, 22 bp, Homo sapiens
ttatatgattgaagtgcataag

SEQ ID NO: 7912166 - DNA, 22 bp, Homo sapiens
ttatatgaactggactttagga

SEQ ID NO: 7912167 - DNA, 22 bp, Homo sapiens
ttatatgagtatcatatcactt

SEQ ID NO: 7912168 - DNA, 22 bp, Homo sapiens
ttatatgagtatcatatcactt

SEQ ID NO: 7912169 - DNA, 22 bp, Homo sapiens
ttatatgagtatcatatcactt

SEQ ID NO: 7912170 - DNA, 20 bp, Homo sapiens
ttatatcataatgtgccaat

SEQ ID NO: 7912171 - DNA, 22 bp, Homo sapiens
ttatatctttttacatctctcc

SEQ ID NO: 7912172 - DNA, 22 bp, Homo sapiens
ttatatgaactggactttagga

SEQ ID NO: 7912173 - DNA, 22 bp, Homo sapiens
ttattaagtgcgtactgtatgc

SEQ ID NO: 7912174 - DNA, 22 bp, Homo sapiens
ttattaagtgcgtactgtatgc

SEQ ID NO: 7912175 - DNA, 22 bp, Homo sapiens
ttattaagtgcgtactgtatgc

SEQ ID NO: 7912176 - DNA, 22 bp, Homo sapiens
ttattaaaatgcggatttggct

SEQ ID NO: 7912177 - DNA, 22 bp, Homo sapiens
ttattaagtgcctacaataaag

SEQ ID NO: 7912178 - DNA, 22 bp, Homo sapiens
ttattaagtgcctacaataaag

SEQ ID NO: 7912179 - DNA, 22 bp, Homo sapiens
ttattaagtgcctacaataaag

SEQ ID NO: 7912180 - DNA, 22 bp, Homo sapiens
ttattaatacatgcacctgcat

SEQ ID NO: 7912181 - DNA, 22 bp, Homo sapiens
ttattaatacatgcacctgcat

SEQ ID NO: 7912182 - DNA, 22 bp, Homo sapiens
ttattaatcttatctttggaaa

SEQ ID NO: 7912183 - DNA, 22 bp, Homo sapiens
ttattaatcttatctttggaaa

SEQ ID NO: 7912184 - DNA, 22 bp, Homo sapiens
ttattaataaagtggcatagcc

SEQ ID NO: 7912185 - DNA, 22 bp, Homo sapiens
ttattaatacatgcacctgcat

SEQ ID NO: 7912186 - DNA, 22 bp, Homo sapiens
ttattaataaagtggcatagcc

SEQ ID NO: 7912187 - DNA, 22 bp, Homo sapiens
ttattaataaagtggcatagcc

SEQ ID NO: 7912188 - DNA, 22 bp, Homo sapiens
ttattaatgagtacaagttatt

SEQ ID NO: 7912189 - DNA, 22 bp, Homo sapiens
ttattaatcttatctttggaaa

SEQ ID NO: 7912190 - DNA, 22 bp, Homo sapiens
ttattaatcttatctttggaaa

SEQ ID NO: 7912191 - DNA, 22 bp, Homo sapiens
ttattaatgagtacaagttatt

SEQ ID NO: 7912192 - DNA, 22 bp, Homo sapiens
ttattaatgagtacaagttatt

SEQ ID NO: 7912193 - DNA, 22 bp, Homo sapiens
ttattacaatgcagaaaataga

SEQ ID NO: 7912194 - DNA, 22 bp, Homo sapiens
ttattacaatgcagaaaataga

SEQ ID NO: 7912195 - DNA, 22 bp, Homo sapiens
ttattacaatgcagaaaataga

SEQ ID NO: 7912196 - DNA, 22 bp, Homo sapiens
ttattacaatgcagaaaataga

SEQ ID NO: 7912197 - DNA, 22 bp, Homo sapiens
ttattacaatgcagaaaataga

SEQ ID NO: 7912198 - DNA, 22 bp, Homo sapiens
ttattacaatgcagaaaataga

SEQ ID NO: 7912199 - DNA, 22 bp, Homo sapiens
ttattctttaaacatatatgtt

SEQ ID NO: 7912200 - DNA, 22 bp, Homo sapiens
ttattctttaaacatatatgtt

SEQ ID NO: 7912201 - DNA, 22 bp, Homo sapiens
ttattcttttctccagaatccc

SEQ ID NO: 7912202 - DNA, 22 bp, Homo sapiens
ttattctttaaacatatatgtt

SEQ ID NO: 7912203 - DNA, 22 bp, Homo sapiens
ttattctttaaacatatatgtt

SEQ ID NO: 7912204 - DNA, 22 bp, Homo sapiens
ttattatgtggatgaaagatgt

SEQ ID NO: 7912205 - DNA, 22 bp, Homo sapiens
ttattatgtggatgaaagatgt

SEQ ID NO: 7912206 - DNA, 22 bp, Homo sapiens
ttattatagattatgcaagatt

SEQ ID NO: 7912207 - DNA, 22 bp, Homo sapiens
ttattatagattatgcaagatt

SEQ ID NO: 7912208 - DNA, 22 bp, Homo sapiens
ttattataatgagggataaaaa

SEQ ID NO: 7912209 - DNA, 22 bp, Homo sapiens
ttattatagattatgcaagatt

SEQ ID NO: 7912210 - DNA, 22 bp, Homo sapiens
ttattatagattatgcaagatt

SEQ ID NO: 7912211 - DNA, 22 bp, Homo sapiens
ttattatggtatttctttgcag

SEQ ID NO: 7912212 - DNA, 22 bp, Homo sapiens
ttattagatctgttagggatcc

SEQ ID NO: 7912213 - DNA, 22 bp, Homo sapiens
ttattaggaaaaggtcagatgt

SEQ ID NO: 7912214 - DNA, 22 bp, Homo sapiens
ttattaggaaaaggtcagatgt

SEQ ID NO: 7912215 - DNA, 22 bp, Homo sapiens
ttattataatgagggataaaaa

SEQ ID NO: 7912216 - DNA, 22 bp, Homo sapiens
ttattataatgagggataaaaa

SEQ ID NO: 7912217 - DNA, 22 bp, Homo sapiens
ttattataatgagggataaaaa

SEQ ID NO: 7912218 - DNA, 22 bp, Homo sapiens
ttattacaatgcagaaaataga

SEQ ID NO: 7912219 - DNA, 22 bp, Homo sapiens
ttattacaatgcagaaaataga

SEQ ID NO: 7912220 - DNA, 22 bp, Homo sapiens
ttattacactgaaagaattgcg

SEQ ID NO: 7912221 - DNA, 22 bp, Homo sapiens
ttattacactgaaagaattgcg

SEQ ID NO: 7912222 - DNA, 22 bp, Homo sapiens
ttattacactgaaagaattgcg

SEQ ID NO: 7912223 - DNA, 22 bp, Homo sapiens
ttattacactgaaagaattgcg

SEQ ID NO: 7912224 - DNA, 22 bp, Homo sapiens
ttattagagtgctttgagaaag

SEQ ID NO: 7912225 - DNA, 22 bp, Homo sapiens
ttattagagatatttggttagg

SEQ ID NO: 7912226 - DNA, 22 bp, Homo sapiens
ttattactgtattaatccagag

SEQ ID NO: 7912227 - DNA, 22 bp, Homo sapiens
ttattacagtcccagggagtag

SEQ ID NO: 7912228 - DNA, 22 bp, Homo sapiens
ttattacagtcccagggagtag

SEQ ID NO: 7912229 - DNA, 22 bp, Homo sapiens
ttattgacttgtttgtcctggt

SEQ ID NO: 7912230 - DNA, 21 bp, Homo sapiens
ttattgagacatttgtggaaa

SEQ ID NO: 7912231 - DNA, 22 bp, Homo sapiens
ttattgacttgtttgtcctggt

SEQ ID NO: 7912232 - DNA, 22 bp, Homo sapiens
ttattgactgaaatgagagtga

SEQ ID NO: 7912233 - DNA, 22 bp, Homo sapiens
ttattgagaccgtaagtcaggt

SEQ ID NO: 7912234 - DNA, 21 bp, Homo sapiens
ttattgagacatttgtggaaa

SEQ ID NO: 7912235 - DNA, 22 bp, Homo sapiens
ttattgagaccgtaagtcaggt

SEQ ID NO: 7912236 - DNA, 22 bp, Homo sapiens
ttattgagagctgttttatggc

SEQ ID NO: 7912237 - DNA, 22 bp, Homo sapiens
ttattgagcaactctggggctc

SEQ ID NO: 7912238 - DNA, 22 bp, Homo sapiens
ttattcttttctccagaatccc

SEQ ID NO: 7912239 - DNA, 22 bp, Homo sapiens
ttattgaaatggaagctataac

SEQ ID NO: 7912240 - DNA, 22 bp, Homo sapiens
ttattgaagcaagcttttctga

SEQ ID NO: 7912241 - DNA, 22 bp, Homo sapiens
ttattgaaggaactgaaataaa

SEQ ID NO: 7912242 - DNA, 22 bp, Homo sapiens
ttattgactcccagcttttcca

SEQ ID NO: 7912243 - DNA, 21 bp, Homo sapiens
ttattgaatgtttaccgtgtg

SEQ ID NO: 7912244 - DNA, 22 bp, Homo sapiens
ttattgaaggaactgaaataaa

SEQ ID NO: 7912245 - DNA, 22 bp, Homo sapiens
ttattgaaggaactgaaataaa

SEQ ID NO: 7912246 - DNA, 22 bp, Homo sapiens
ttattgaaggaactgaaataaa

SEQ ID NO: 7912247 - DNA, 22 bp, Homo sapiens
ttattgaaggaactgaaataaa

SEQ ID NO: 7912248 - DNA, 22 bp, Homo sapiens
ttattgggtcccaacaagttgc

SEQ ID NO: 7912249 - DNA, 22 bp, Homo sapiens
ttattggccaactgccttggag

SEQ ID NO: 7912250 - DNA, 22 bp, Homo sapiens
ttattgggtcccaacaagttgc

SEQ ID NO: 7912251 - DNA, 22 bp, Homo sapiens
ttattgtagcactttggcagtg

SEQ ID NO: 7912252 - DNA, 22 bp, Homo sapiens
ttattgtagcactttggcagtg

SEQ ID NO: 7912253 - DNA, 22 bp, Homo sapiens
ttattgtcttaaatttggtctt

SEQ ID NO: 7912254 - DNA, 22 bp, Homo sapiens
ttattgtcctacttattgtctt

SEQ ID NO: 7912255 - DNA, 22 bp, Homo sapiens
ttattgtaggcctattgtagaa

SEQ ID NO: 7912256 - DNA, 22 bp, Homo sapiens
ttattgtaggcctattgtagaa

SEQ ID NO: 7912257 - DNA, 22 bp, Homo sapiens
ttattgtaggcctattgtagaa

SEQ ID NO: 7912258 - DNA, 22 bp, Homo sapiens
ttattgtaggcctattgtagaa

SEQ ID NO: 7912259 - DNA, 22 bp, Homo sapiens
ttattgcttttgtgcaggtgag

SEQ ID NO: 7912260 - DNA, 22 bp, Homo sapiens
ttattggaaaagggctgtaatt

SEQ ID NO: 7912261 - DNA, 22 bp, Homo sapiens
ttattggagctggaggctgttt

SEQ ID NO: 7912262 - DNA, 22 bp, Homo sapiens
ttattgctgctaacattttatg

SEQ ID NO: 7912263 - DNA, 22 bp, Homo sapiens
ttattgctgctaacattttatg

SEQ ID NO: 7912264 - DNA, 22 bp, Homo sapiens
ttattgctttggaaaacactca

SEQ ID NO: 7912265 - DNA, 22 bp, Homo sapiens
ttattgcttatgattaggtgtt

SEQ ID NO: 7912266 - DNA, 22 bp, Homo sapiens
ttattgctgatagtgtttataa

SEQ ID NO: 7912267 - DNA, 22 bp, Homo sapiens
ttattgctgctaacattttatg

SEQ ID NO: 7912268 - DNA, 22 bp, Homo sapiens
ttattgagcacatagtatgtgg

SEQ ID NO: 7912269 - DNA, 22 bp, Homo sapiens
ttattgagcacatagtatgtgg

SEQ ID NO: 7912270 - DNA, 22 bp, Homo sapiens
ttattgagcaactctggggctc

SEQ ID NO: 7912271 - DNA, 22 bp, Homo sapiens
ttattgagcacctactatgtgt

SEQ ID NO: 7912272 - DNA, 22 bp, Homo sapiens
ttcaaacagatgactctgctct

SEQ ID NO: 7912273 - DNA, 23 bp, Homo sapiens
ttcaaacagctacaagggggtgg

SEQ ID NO: 7912274 - DNA, 22 bp, Homo sapiens
ttcaaacaggggtcagggagat

SEQ ID NO: 7912275 - DNA, 22 bp, Homo sapiens
ttcaaacagatgactctgctct

SEQ ID NO: 7912276 - DNA, 22 bp, Homo sapiens
ttcaaacagatgactctgctct

SEQ ID NO: 7912277 - DNA, 22 bp, Homo sapiens
ttcaaacagatgactctgctct

SEQ ID NO: 7912278 - DNA, 22 bp, Homo sapiens
ttcaaacagatgactctgctct

SEQ ID NO: 7912279 - DNA, 22 bp, Homo sapiens
ttcaaacactgttggcactggg

SEQ ID NO: 7912280 - DNA, 22 bp, Homo sapiens
ttcaaacactgttggcactggg

SEQ ID NO: 7912281 - DNA, 22 bp, Homo sapiens
ttcaaacactgctttgagaggg

SEQ ID NO: 7912282 - DNA, 22 bp, Homo sapiens
ttcaaacactggcttagccaat

SEQ ID NO: 7912283 - DNA, 22 bp, Homo sapiens
ttattgtggcagaggtatggtt

SEQ ID NO: 7912284 - DNA, 22 bp, Homo sapiens
ttattgtggcagaggtatggtt

SEQ ID NO: 7912285 - DNA, 22 bp, Homo sapiens
ttattgtggactactgttctgg

SEQ ID NO: 7912286 - DNA, 22 bp, Homo sapiens
ttattgtggactactgttctgg

SEQ ID NO: 7912287 - DNA, 22 bp, Homo sapiens
ttattgtgaggaataagtgaga

SEQ ID NO: 7912288 - DNA, 22 bp, Homo sapiens
ttattgtcttaaatttggtctt

SEQ ID NO: 7912289 - DNA, 22 bp, Homo sapiens
ttattgtggcagaggtatggtt

SEQ ID NO: 7912290 - DNA, 18 bp, Homo sapiens
ttattgtggtcacagcac

SEQ ID NO: 7912291 - DNA, 22 bp, Homo sapiens
ttattgtgtgcgttagcctatg

SEQ ID NO: 7912292 - DNA, 22 bp, Homo sapiens
ttattgtgtgcgttagcctatg

SEQ ID NO: 7912293 - DNA, 22 bp, Homo sapiens
ttattgtgtgcgttagcctatg

SEQ ID NO: 7912294 - DNA, 22 bp, Homo sapiens
ttcaaacacagacagcagcatg

SEQ ID NO: 7912295 - DNA, 22 bp, Homo sapiens
ttcaaacacagacagcagcatg

SEQ ID NO: 7912296 - DNA, 22 bp, Homo sapiens
ttcaaacacagacagcagcatg

SEQ ID NO: 7912297 - DNA, 22 bp, Homo sapiens
ttcaaacagttgcacaacttat

SEQ ID NO: 7912298 - DNA, 22 bp, Homo sapiens
ttcaaacattcaaataaaccgg

SEQ ID NO: 7912299 - DNA, 22 bp, Homo sapiens
ttcaaacattcaaataaaccgg

SEQ ID NO: 7912300 - DNA, 22 bp, Homo sapiens
ttcaaacagttgcacaacttat

SEQ ID NO: 7912301 - DNA, 22 bp, Homo sapiens
ttcaaacagttgcacaacttat

SEQ ID NO: 7912302 - DNA, 22 bp, Homo sapiens
ttcaaacagttgcacaacttat

SEQ ID NO: 7912303 - DNA, 22 bp, Homo sapiens
ttcaaacagttgcacaacttat

SEQ ID NO: 7912304 - DNA, 22 bp, Homo sapiens
ttcaaacagtgtagaatatatg

SEQ ID NO: 7912305 - DNA, 22 bp, Homo sapiens
ttcaaactagttaaaagtcaga

SEQ ID NO: 7912306 - DNA, 22 bp, Homo sapiens
ttcaaactagttaaaagtcaga

SEQ ID NO: 7912307 - DNA, 22 bp, Homo sapiens
ttcaaaccatggcacaggaagg

SEQ ID NO: 7912308 - DNA, 22 bp, Homo sapiens
ttcaaaccatggcacaggaagg

SEQ ID NO: 7912309 - DNA, 22 bp, Homo sapiens
ttcaaactctgagtagttctgc

SEQ ID NO: 7912310 - DNA, 22 bp, Homo sapiens
ttcaaactatgacttcagctac

SEQ ID NO: 7912311 - DNA, 22 bp, Homo sapiens
ttcaaactatgacttcagctac

SEQ ID NO: 7912312 - DNA, 22 bp, Homo sapiens
ttcaaactcttgctctgctagt

SEQ ID NO: 7912313 - DNA, 22 bp, Homo sapiens
ttcaaaccttcacttgcagagt

SEQ ID NO: 7912314 - DNA, 22 bp, Homo sapiens
ttaggaaacgctgctattgact

SEQ ID NO: 7912315 - DNA, 19 bp, Homo sapiens
ttaggaaaccactttcctt

SEQ ID NO: 7912316 - DNA, 19 bp, Homo sapiens
ttaggaaaccactttcctt

SEQ ID NO: 7912317 - DNA, 22 bp, Homo sapiens
ttaggaaacagtagcctttgct

SEQ ID NO: 7912318 - DNA, 22 bp, Homo sapiens
ttaggaaaagaagacatttcta

SEQ ID NO: 7912319 - DNA, 22 bp, Homo sapiens
ttaggaaaagaagacatttcta

SEQ ID NO: 7912320 - DNA, 22 bp, Homo sapiens
ttaggaaaatgaaattacctgt

SEQ ID NO: 7912321 - DNA, 22 bp, Homo sapiens
ttaggaaaatggagtcctttta

SEQ ID NO: 7912322 - DNA, 22 bp, Homo sapiens
ttagctttcatgaacctggtcg

SEQ ID NO: 7912323 - DNA, 22 bp, Homo sapiens
ttagcttttcacttgcattatc

SEQ ID NO: 7912324 - DNA, 22 bp, Homo sapiens
ttagcttttaagtgtgctacat

SEQ ID NO: 7912325 - DNA, 22 bp, Homo sapiens
ttaggaaaggaacattgaaacg

SEQ ID NO: 7912326 - DNA, 22 bp, Homo sapiens
ttaggaaagggttttctaacag

SEQ ID NO: 7912327 - DNA, 22 bp, Homo sapiens
ttaggaaagggttttctaacag

SEQ ID NO: 7912328 - DNA, 22 bp, Homo sapiens
ttaggaaagtctcttggctggg

SEQ ID NO: 7912329 - DNA, 22 bp, Homo sapiens
ttaggaaagtctcttggctggg

SEQ ID NO: 7912330 - DNA, 22 bp, Homo sapiens
ttaggaaagttcttcagacatg

SEQ ID NO: 7912331 - DNA, 22 bp, Homo sapiens
ttaggaaagttcttcagacatg

SEQ ID NO: 7912332 - DNA, 22 bp, Homo sapiens
ttaggaaacgctgctattgact

SEQ ID NO: 7912333 - DNA, 22 bp, Homo sapiens
ttaggaaacgctgctattgact

SEQ ID NO: 7912334 - DNA, 22 bp, Homo sapiens
ttaggaaagaagcagctaggag

SEQ ID NO: 7912335 - DNA, 22 bp, Homo sapiens
ttaggaaaggaacattgaaacg

SEQ ID NO: 7912336 - DNA, 22 bp, Homo sapiens
ttaggaaagcattgtgtaaaag

SEQ ID NO: 7912337 - DNA, 22 bp, Homo sapiens
ttaggaaagcattgtgtaaaag

SEQ ID NO: 7912338 - DNA, 22 bp, Homo sapiens
ttatacatgtgttttgagatga

SEQ ID NO: 7912339 - DNA, 21 bp, Homo sapiens
ttatacatatgttctctgcct

SEQ ID NO: 7912340 - DNA, 22 bp, Homo sapiens
ttaggaaatcactttgctcacc

SEQ ID NO: 7912341 - DNA, 22 bp, Homo sapiens
ttatacatgtgttttgagatga

SEQ ID NO: 7912342 - DNA, 22 bp, Homo sapiens
ttatacatgtgttttgagatga

SEQ ID NO: 7912343 - DNA, 22 bp, Homo sapiens
ttatacatgtgttttgagatga

SEQ ID NO: 7912344 - DNA, 22 bp, Homo sapiens
ttatacatgtgttttgagatga

SEQ ID NO: 7912345 - DNA, 22 bp, Homo sapiens
ttatacagtttatacttagaat

SEQ ID NO: 7912346 - DNA, 22 bp, Homo sapiens
ttatacatgtttataaggttga

SEQ ID NO: 7912347 - DNA, 22 bp, Homo sapiens
ttatacatgtttataaggttga

SEQ ID NO: 7912348 - DNA, 22 bp, Homo sapiens
ttatacatgtttataaggttga

SEQ ID NO: 7912349 - DNA, 22 bp, Homo sapiens
ttatacatgtttataaggttga

SEQ ID NO: 7912350 - DNA, 22 bp, Homo sapiens
ttatacatgtgttttgagatga

SEQ ID NO: 7912351 - DNA, 22 bp, Homo sapiens
ttatatactgtggtagtactgt

SEQ ID NO: 7912352 - DNA, 19 bp, Homo sapiens
ttatatacttggtttctct

SEQ ID NO: 7912353 - DNA, 22 bp, Homo sapiens
ttatatactgtggtagtactgt

SEQ ID NO: 7912354 - DNA, 22 bp, Homo sapiens
ttatataactcaggtgggctca

SEQ ID NO: 7912355 - DNA, 22 bp, Homo sapiens
ttatataactcaggtgggctca

SEQ ID NO: 7912356 - DNA, 22 bp, Homo sapiens
ttatataaagataacttttctt

SEQ ID NO: 7912357 - DNA, 22 bp, Homo sapiens
ttatataaagataacttttctt

SEQ ID NO: 7912358 - DNA, 22 bp, Homo sapiens
ttatataaagataacttttctt

SEQ ID NO: 7912359 - DNA, 22 bp, Homo sapiens
ttatataaagataacttttctt

SEQ ID NO: 7912360 - DNA, 22 bp, Homo sapiens
ttatataaagataacttttctt

SEQ ID NO: 7912361 - DNA, 22 bp, Homo sapiens
ttatataaagataacttttctt

SEQ ID NO: 7912362 - DNA, 22 bp, Homo sapiens
ttatagtgcataattaacatgg

SEQ ID NO: 7912363 - DNA, 22 bp, Homo sapiens
ttatagttagtaggtcattaaa

SEQ ID NO: 7912364 - DNA, 22 bp, Homo sapiens
ttatagttagtaggtcattaaa

SEQ ID NO: 7912365 - DNA, 22 bp, Homo sapiens
ttatagtgggcccaacatggcg

SEQ ID NO: 7912366 - DNA, 22 bp, Homo sapiens
ttatagtgcataattaacatgg

SEQ ID NO: 7912367 - DNA, 22 bp, Homo sapiens
ttatagtgattaaaattgctca

SEQ ID NO: 7912368 - DNA, 22 bp, Homo sapiens
ttatagtattaggtactcaaca

SEQ ID NO: 7912369 - DNA, 22 bp, Homo sapiens
ttatagtattaggtactcaaca

SEQ ID NO: 7912370 - DNA, 22 bp, Homo sapiens
ttatagtattaggtactcaaca

SEQ ID NO: 7912371 - DNA, 22 bp, Homo sapiens
ttatagggtttctgggagtggg

SEQ ID NO: 7912372 - DNA, 22 bp, Homo sapiens
ttataggccatctaagtaattt

SEQ ID NO: 7912373 - DNA, 22 bp, Homo sapiens
ttatagtatgtgcatatgtgtg

SEQ ID NO: 7912374 - DNA, 22 bp, Homo sapiens
ttatagggtttctgggagtggg

SEQ ID NO: 7912375 - DNA, 22 bp, Homo sapiens
ttataggaaaagttctagaaaa

SEQ ID NO: 7912376 - DNA, 17 bp, Homo sapiens
ttatactcgtaggtgga

SEQ ID NO: 7912377 - DNA, 22 bp, Homo sapiens
ttatactttatactacatcatt

SEQ ID NO: 7912378 - DNA, 22 bp, Homo sapiens
ttatagaaaatgtgggaaatga

SEQ ID NO: 7912379 - DNA, 22 bp, Homo sapiens
ttatagaaggagcattcactta

SEQ ID NO: 7912380 - DNA, 22 bp, Homo sapiens
ttatagaaggagcattcactta

SEQ ID NO: 7912381 - DNA, 22 bp, Homo sapiens
ttatagaaggagcattcactta

SEQ ID NO: 7912382 - DNA, 22 bp, Homo sapiens
ttatagaacagcctcctctaga

SEQ ID NO: 7912383 - DNA, 22 bp, Homo sapiens
ttatagaacggttctgtgcaaa

SEQ ID NO: 7912384 - DNA, 22 bp, Homo sapiens
ttatagaatccagttgttgtat

SEQ ID NO: 7912385 - DNA, 22 bp, Homo sapiens
ttatagaatggtggattttctg

SEQ ID NO: 7912386 - DNA, 22 bp, Homo sapiens
ttatagaatgtttccaatgcct

SEQ ID NO: 7912387 - DNA, 22 bp, Homo sapiens
ttatagatctaaatgtgaaggg

SEQ ID NO: 7912388 - DNA, 22 bp, Homo sapiens
ttatagatgccttgagtaaatg

SEQ ID NO: 7912389 - DNA, 22 bp, Homo sapiens
ttatagcaggtgactaatgagt

SEQ ID NO: 7912390 - DNA, 22 bp, Homo sapiens
ttatagcagcatgatttatagt

SEQ ID NO: 7912391 - DNA, 22 bp, Homo sapiens
ttatagcagcatgatttatagt

SEQ ID NO: 7912392 - DNA, 22 bp, Homo sapiens
ttatagcagcatgatttatagt

SEQ ID NO: 7912393 - DNA, 22 bp, Homo sapiens
ttatagcagcatgatttacaat

SEQ ID NO: 7912394 - DNA, 22 bp, Homo sapiens
ttatagcagcatgatttataat

SEQ ID NO: 7912395 - DNA, 22 bp, Homo sapiens
ttatagcagcatgatttataat

SEQ ID NO: 7912396 - DNA, 22 bp, Homo sapiens
ttatagcagcatgatttataat

SEQ ID NO: 7912397 - DNA, 22 bp, Homo sapiens
ttatagatgccttgagtaaatg

SEQ ID NO: 7912398 - DNA, 22 bp, Homo sapiens
ttatagcagcatgatttacaat

SEQ ID NO: 7912399 - DNA, 22 bp, Homo sapiens
ttagcttgtgccatatgaaact

SEQ ID NO: 7912400 - DNA, 22 bp, Homo sapiens
ttagcttcttacatttcatcct

SEQ ID NO: 7912401 - DNA, 22 bp, Homo sapiens
ttagcttcctacaactgctgca

SEQ ID NO: 7912402 - DNA, 22 bp, Homo sapiens
ttagctttagagccattactgg

SEQ ID NO: 7912403 - DNA, 22 bp, Homo sapiens
ttagctttcagcctttctcacc

SEQ ID NO: 7912404 - DNA, 22 bp, Homo sapiens
ttagctttcagcctttctcacc

SEQ ID NO: 7912405 - DNA, 22 bp, Homo sapiens
ttagctgctgagataattatat

SEQ ID NO: 7912406 - DNA, 22 bp, Homo sapiens
ttagcttaattaaataatcagt

SEQ ID NO: 7912407 - DNA, 22 bp, Homo sapiens
ttagctgtggaagcttcagcca

SEQ ID NO: 7912408 - DNA, 22 bp, Homo sapiens
ttagctgtggaagcttcagcca

SEQ ID NO: 7912409 - DNA, 22 bp, Homo sapiens
ttagctgaaaaaattcatgcaa

SEQ ID NO: 7912410 - DNA, 22 bp, Homo sapiens
ttagctgagattaagtgaactt

SEQ ID NO: 7912411 - DNA, 22 bp, Homo sapiens
ttagctgaaaaaattcatgcaa

SEQ ID NO: 7912412 - DNA, 22 bp, Homo sapiens
ttagctcagaaaatttaaactt

SEQ ID NO: 7912413 - DNA, 22 bp, Homo sapiens
ttagctcagaaaatttaaactt

SEQ ID NO: 7912414 - DNA, 22 bp, Homo sapiens
ttagctcatcaggtgtatatag

SEQ ID NO: 7912415 - DNA, 22 bp, Homo sapiens
ttagctaaaccacagagattct

SEQ ID NO: 7912416 - DNA, 22 bp, Homo sapiens
ttagctcagaaaatttaaactt

SEQ ID NO: 7912417 - DNA, 22 bp, Homo sapiens
ttagctcagaaaatttaaactt

SEQ ID NO: 7912418 - DNA, 22 bp, Homo sapiens
ttagctcagaaaatttaaactt

SEQ ID NO: 7912419 - DNA, 22 bp, Homo sapiens
ttagctaaactgtaactagaat

SEQ ID NO: 7912420 - DNA, 22 bp, Homo sapiens
ttagcgggaatgttcagaagct

SEQ ID NO: 7912421 - DNA, 22 bp, Homo sapiens
ttagcgcacatcacagggggaa

SEQ ID NO: 7912422 - DNA, 22 bp, Homo sapiens
ttagccatttgaggtcttcatt

SEQ ID NO: 7912423 - DNA, 21 bp, Homo sapiens
ttagccattgggacattcagc

SEQ ID NO: 7912424 - DNA, 22 bp, Homo sapiens
ttagccatgttgaagatttaga

SEQ ID NO: 7912425 - DNA, 22 bp, Homo sapiens
ttagccataattgtttttccca

SEQ ID NO: 7912426 - DNA, 22 bp, Homo sapiens
ttagccagtgaaatggagaaat

SEQ ID NO: 7912427 - DNA, 22 bp, Homo sapiens
ttagccatatagaaaaagagct

SEQ ID NO: 7912428 - DNA, 22 bp, Homo sapiens
ttagccatgccctagaagagga

SEQ ID NO: 7912429 - DNA, 22 bp, Homo sapiens
tcctgctgctcttgggaaacct

SEQ ID NO: 7912430 - DNA, 21 bp, Homo sapiens
tcctgctgctcctgtcgtgtt

SEQ ID NO: 7912431 - DNA, 21 bp, Homo sapiens
tcctgctgctcctgtcgtgtt

SEQ ID NO: 7912432 - DNA, 22 bp, Homo sapiens
tcctgctggaagtagggaatga

SEQ ID NO: 7912433 - DNA, 22 bp, Homo sapiens
tcctgctggaaacttcctcttg

SEQ ID NO: 7912434 - DNA, 22 bp, Homo sapiens
ttagccaaacaggtgaaattga

SEQ ID NO: 7912435 - DNA, 22 bp, Homo sapiens
tcctgctggactctgagtacaa

SEQ ID NO: 7912436 - DNA, 22 bp, Homo sapiens
ttagccaggggagcagcttgtc

SEQ ID NO: 7912437 - DNA, 22 bp, Homo sapiens
ttagccaggggagcagcttgtc

SEQ ID NO: 7912438 - DNA, 22 bp, Homo sapiens
tcctgctggaatggaaaatgaa

SEQ ID NO: 7912439 - DNA, 22 bp, Homo sapiens
tcctgctggaagtagggaatga

SEQ ID NO: 7912440 - DNA, 22 bp, Homo sapiens
tcctgctggaagtagggaatga

SEQ ID NO: 7912441 - DNA, 22 bp, Homo sapiens
tcctgctggaagtagggaatga

SEQ ID NO: 7912442 - DNA, 22 bp, Homo sapiens
tcctgctggaagtagggaatga

SEQ ID NO: 7912443 - DNA, 18 bp, Homo sapiens
tcctgcctgtgccccagg

SEQ ID NO: 7912444 - DNA, 18 bp, Homo sapiens
tcctgcctgtgccccagg

SEQ ID NO: 7912445 - DNA, 19 bp, Homo sapiens
tcctgcctggggccgcctg

SEQ ID NO: 7912446 - DNA, 19 bp, Homo sapiens
tcctgcctggggccgcctg

SEQ ID NO: 7912447 - DNA, 18 bp, Homo sapiens
tcctgcctgtgccccagg

SEQ ID NO: 7912448 - DNA, 18 bp, Homo sapiens
tcctgcctgtgccccagg

SEQ ID NO: 7912449 - DNA, 22 bp, Homo sapiens
tcctgcctgtttacctgtactt

SEQ ID NO: 7912450 - DNA, 18 bp, Homo sapiens
tcctgcctgtgccccagg

SEQ ID NO: 7912451 - DNA, 22 bp, Homo sapiens
tcctgcctgtttacctgtactt

SEQ ID NO: 7912452 - DNA, 22 bp, Homo sapiens
tcctgcctgtttacctgtactt

SEQ ID NO: 7912453 - DNA, 18 bp, Homo sapiens
tcctgcctgcgggctccc

SEQ ID NO: 7912454 - DNA, 18 bp, Homo sapiens
tcctgcctgcgggctccc

SEQ ID NO: 7912455 - DNA, 18 bp, Homo sapiens
tcctgcctgcgggctccc

SEQ ID NO: 7912456 - DNA, 22 bp, Homo sapiens
tcctgcctgcaatcccagcact

SEQ ID NO: 7912457 - DNA, 22 bp, Homo sapiens
tcctgcctgcaatcccagcact

SEQ ID NO: 7912458 - DNA, 22 bp, Homo sapiens
tcctgcctgcaatcccagcact

SEQ ID NO: 7912459 - DNA, 19 bp, Homo sapiens
tcctgcctggggccgcctg

SEQ ID NO: 7912460 - DNA, 19 bp, Homo sapiens
tcctgcctggggccgcctg

SEQ ID NO: 7912461 - DNA, 19 bp, Homo sapiens
tcctgcctggggccgcctg

SEQ ID NO: 7912462 - DNA, 18 bp, Homo sapiens
tcctgcctgcgggctccc

SEQ ID NO: 7912463 - DNA, 18 bp, Homo sapiens
tcctgcctgcgggctccc

SEQ ID NO: 7912464 - DNA, 22 bp, Homo sapiens
tcctgcctgtttacctgtactt

SEQ ID NO: 7912465 - DNA, 22 bp, Homo sapiens
tcctgccttagagcaaggaaaa

SEQ ID NO: 7912466 - DNA, 22 bp, Homo sapiens
tcctgcctgtttacctgtactt

SEQ ID NO: 7912467 - DNA, 22 bp, Homo sapiens
tcctgcctgtttacctgtactt

SEQ ID NO: 7912468 - DNA, 22 bp, Homo sapiens
tcctgccttagagcaaggaaaa

SEQ ID NO: 7912469 - DNA, 23 bp, Homo sapiens
tcctgctgaaagctccagctggc

SEQ ID NO: 7912470 - DNA, 20 bp, Homo sapiens
tcctgctgaccttcacaagc

SEQ ID NO: 7912471 - DNA, 22 bp, Homo sapiens
tcctgctgaccagtaaatgaat

SEQ ID NO: 7912472 - DNA, 22 bp, Homo sapiens
tcctgctgacaaggaaagcatg

SEQ ID NO: 7912473 - DNA, 21 bp, Homo sapiens
tcctgctgagaaacagatggt

SEQ ID NO: 7912474 - DNA, 21 bp, Homo sapiens
tcctgctgagaaacagatggt

SEQ ID NO: 7912475 - DNA, 21 bp, Homo sapiens
tcctgctgagaaacagatggt

SEQ ID NO: 7912476 - DNA, 20 bp, Homo sapiens
tcctgctgaccttcacaagc

SEQ ID NO: 7912477 - DNA, 20 bp, Homo sapiens
tcctgctgaccttcacaagc

SEQ ID NO: 7912478 - DNA, 22 bp, Homo sapiens
tcctgctgccatttcaagtgct

SEQ ID NO: 7912479 - DNA, 22 bp, Homo sapiens
tcctgctgccatttcaagtgct

SEQ ID NO: 7912480 - DNA, 22 bp, Homo sapiens
tcctgctgctacctggcccacg

SEQ ID NO: 7912481 - DNA, 22 bp, Homo sapiens
tcctgctgccatttcaagtgct

SEQ ID NO: 7912482 - DNA, 20 bp, Homo sapiens
tcctgctgccacctcttctt

SEQ ID NO: 7912483 - DNA, 22 bp, Homo sapiens
tcctgctgccatttcaagtgct

SEQ ID NO: 7912484 - DNA, 22 bp, Homo sapiens
tcctgctgctcacctttttgtc

SEQ ID NO: 7912485 - DNA, 22 bp, Homo sapiens
tcctgctgctacctggcccacg

SEQ ID NO: 7912486 - DNA, 22 bp, Homo sapiens
tcctgctgctacctggcccacg

SEQ ID NO: 7912487 - DNA, 20 bp, Homo sapiens
tcctgctgccacctcttctt

SEQ ID NO: 7912488 - DNA, 20 bp, Homo sapiens
tcctgctgccacctcttctt

SEQ ID NO: 7912489 - DNA, 22 bp, Homo sapiens
tcctgctgagcgtctgtcattt

SEQ ID NO: 7912490 - DNA, 22 bp, Homo sapiens
tcctgctgagcatgttctgccc

SEQ ID NO: 7912491 - DNA, 22 bp, Homo sapiens
tcctgctgagcgtctgtcattt

SEQ ID NO: 7912492 - DNA, 22 bp, Homo sapiens
tcctgctgagcatgttctgccc

SEQ ID NO: 7912493 - DNA, 22 bp, Homo sapiens
tcctgctgagcatgttctgccc

SEQ ID NO: 7912494 - DNA, 22 bp, Homo sapiens
ttcatttttaccgcgtgtcaaa

SEQ ID NO: 7912495 - DNA, 22 bp, Homo sapiens
ttcatttttaccgcgtgtcaaa

SEQ ID NO: 7912496 - DNA, 22 bp, Homo sapiens
ttcattttctttcacgctgctg

SEQ ID NO: 7912497 - DNA, 22 bp, Homo sapiens
ttcattttctttcacgctgctg

SEQ ID NO: 7912498 - DNA, 22 bp, Homo sapiens
ttcattttctttcacgctgctg

SEQ ID NO: 7912499 - DNA, 22 bp, Homo sapiens
ttcattttctttcacgctgctg

SEQ ID NO: 7912500 - DNA, 22 bp, Homo sapiens
ttcatttgttgacagagacatg

SEQ ID NO: 7912501 - DNA, 20 bp, Homo sapiens
ttcatttgttgagcaccttc

SEQ ID NO: 7912502 - DNA, 22 bp, Homo sapiens
ttcattttataaaccctgctga

SEQ ID NO: 7912503 - DNA, 22 bp, Homo sapiens
ttcattttataaaccctgctga

SEQ ID NO: 7912504 - DNA, 22 bp, Homo sapiens
ttcatttgttgacagagacatg

SEQ ID NO: 7912505 - DNA, 22 bp, Homo sapiens
ttcatttgtgtgcctgatgcaa

SEQ ID NO: 7912506 - DNA, 21 bp, Homo sapiens
ttcatttgttatagacaaagt

SEQ ID NO: 7912507 - DNA, 22 bp, Homo sapiens
ttccaggaattcagctctcagt

SEQ ID NO: 7912508 - DNA, 22 bp, Homo sapiens
ttccaggaattcagctctcagt

SEQ ID NO: 7912509 - DNA, 22 bp, Homo sapiens
ttccaggaagctctcggcctct

SEQ ID NO: 7912510 - DNA, 22 bp, Homo sapiens
ttccaggaagctctcggcctct

SEQ ID NO: 7912511 - DNA, 22 bp, Homo sapiens
ttccaggaagtgactatgtcat

SEQ ID NO: 7912512 - DNA, 22 bp, Homo sapiens
ttccaggaattcagctctcagt

SEQ ID NO: 7912513 - DNA, 22 bp, Homo sapiens
ttccaggaagacatctcaggaa

SEQ ID NO: 7912514 - DNA, 22 bp, Homo sapiens
ttccaggaagacatctcaggaa

SEQ ID NO: 7912515 - DNA, 22 bp, Homo sapiens
ttccaggaagattcaacaaaag

SEQ ID NO: 7912516 - DNA, 22 bp, Homo sapiens
ttccaggaagcagttagcagcc

SEQ ID NO: 7912517 - DNA, 22 bp, Homo sapiens
ttccaggaagcagttagcagcc

SEQ ID NO: 7912518 - DNA, 22 bp, Homo sapiens
ttccaggaacactctgtgtccc

SEQ ID NO: 7912519 - DNA, 22 bp, Homo sapiens
ttccaggaacactctgtgtccc

SEQ ID NO: 7912520 - DNA, 22 bp, Homo sapiens
ttccaggaacagatgaaggttg

SEQ ID NO: 7912521 - DNA, 22 bp, Homo sapiens
ttcatttgccatcagtgtaatg

SEQ ID NO: 7912522 - DNA, 22 bp, Homo sapiens
ttcatttgccatcagtgtaatg

SEQ ID NO: 7912523 - DNA, 22 bp, Homo sapiens
ttcatttggatgcgtgtttaag

SEQ ID NO: 7912524 - DNA, 22 bp, Homo sapiens
ttcatttgccatcagtgtaatg

SEQ ID NO: 7912525 - DNA, 20 bp, Homo sapiens
ttcatttgggaaaatctgcg

SEQ ID NO: 7912526 - DNA, 20 bp, Homo sapiens
ttcatttgggaaaatctgcg

SEQ ID NO: 7912527 - DNA, 22 bp, Homo sapiens
ttcatttggcctctgcttaaaa

SEQ ID NO: 7912528 - DNA, 22 bp, Homo sapiens
ttcatttggcctctgcttaaaa

SEQ ID NO: 7912529 - DNA, 22 bp, Homo sapiens
ttcatttggcctctgcttaaaa

SEQ ID NO: 7912530 - DNA, 22 bp, Homo sapiens
ttcatttgggatgagtcagaag

SEQ ID NO: 7912531 - DNA, 20 bp, Homo sapiens
ttcatttgggaaaatctgcg

SEQ ID NO: 7912532 - DNA, 22 bp, Homo sapiens
ttcatttgtaactctgttaggg

SEQ ID NO: 7912533 - DNA, 22 bp, Homo sapiens
ttcatttgggatgagtcagaag

SEQ ID NO: 7912534 - DNA, 19 bp, Homo sapiens
ttcatttgtatctgctcac

SEQ ID NO: 7912535 - DNA, 22 bp, Homo sapiens
ttcatttgtaactctgttaggg

SEQ ID NO: 7912536 - DNA, 22 bp, Homo sapiens
ttcatttgtccaaatactatgt

SEQ ID NO: 7912537 - DNA, 22 bp, Homo sapiens
ttcatttgtggtgaatgaagtg

SEQ ID NO: 7912538 - DNA, 22 bp, Homo sapiens
ttcatttgtctgctatagatcc

SEQ ID NO: 7912539 - DNA, 22 bp, Homo sapiens
ttcatttgtctgctatagatcc

SEQ ID NO: 7912540 - DNA, 22 bp, Homo sapiens
ttcatttgtggttatttacaat

SEQ ID NO: 7912541 - DNA, 22 bp, Homo sapiens
ttcatttgtggttatttacaat

SEQ ID NO: 7912542 - DNA, 22 bp, Homo sapiens
ttcatttgtggttatttacaat

SEQ ID NO: 7912543 - DNA, 22 bp, Homo sapiens
ttcatttgtggtgaatgaagtg

SEQ ID NO: 7912544 - DNA, 22 bp, Homo sapiens
ttcatttgtggttatttacaat

SEQ ID NO: 7912545 - DNA, 22 bp, Homo sapiens
ttcatttgtggttatttacaat

SEQ ID NO: 7912546 - DNA, 22 bp, Homo sapiens
ttcatttgtctgctatagatcc

SEQ ID NO: 7912547 - DNA, 22 bp, Homo sapiens
ttcatttgtctgctatagatcc

SEQ ID NO: 7912548 - DNA, 22 bp, Homo sapiens
ttcatttgtctgctatagatcc

SEQ ID NO: 7912549 - DNA, 22 bp, Homo sapiens
ttcatttgtctgctatagatcc

SEQ ID NO: 7912550 - DNA, 22 bp, Homo sapiens
ttcatttgtccaaatactatgt

SEQ ID NO: 7912551 - DNA, 23 bp, Homo sapiens
ttcatttgtctacttcacttgtt

SEQ ID NO: 7912552 - DNA, 22 bp, Homo sapiens
ttcatttgtccaaatactatgt

SEQ ID NO: 7912553 - DNA, 22 bp, Homo sapiens
ttcatttgtccaaatactatgt

SEQ ID NO: 7912554 - DNA, 22 bp, Homo sapiens
ttccagtcgcttaaacctgagc

SEQ ID NO: 7912555 - DNA, 22 bp, Homo sapiens
ttccagtctagtacctggatgc

SEQ ID NO: 7912556 - DNA, 22 bp, Homo sapiens
ttccagtctggcctgtgcttag

SEQ ID NO: 7912557 - DNA, 22 bp, Homo sapiens
ttccagtgaaacatgaggtgtg

SEQ ID NO: 7912558 - DNA, 22 bp, Homo sapiens
ttccagtctttccaacatttca

SEQ ID NO: 7912559 - DNA, 22 bp, Homo sapiens
ttccagtgaaacatgaggtgtg

SEQ ID NO: 7912560 - DNA, 22 bp, Homo sapiens
ttccagtgaaacatgaggtgtg

SEQ ID NO: 7912561 - DNA, 22 bp, Homo sapiens
ttccagtcgcttaaacctgagc

SEQ ID NO: 7912562 - DNA, 22 bp, Homo sapiens
ttccagtccagggctgtttcca

SEQ ID NO: 7912563 - DNA, 22 bp, Homo sapiens
ttccagtcagtgtgagtttatt

SEQ ID NO: 7912564 - DNA, 22 bp, Homo sapiens
ttccagtcagggcaaactgcca

SEQ ID NO: 7912565 - DNA, 22 bp, Homo sapiens
ttccagtcacaaaacatattaa

SEQ ID NO: 7912566 - DNA, 22 bp, Homo sapiens
ttccagtcaagtaagaatatct

SEQ ID NO: 7912567 - DNA, 22 bp, Homo sapiens
ttccagtcaagtaagaatatct

SEQ ID NO: 7912568 - DNA, 22 bp, Homo sapiens
ttccagtaatgtgactttgagc

SEQ ID NO: 7912569 - DNA, 22 bp, Homo sapiens
ttccagtaatgtgactttgagc

SEQ ID NO: 7912570 - DNA, 22 bp, Homo sapiens
ttccaggtgttgctgtcttcct

SEQ ID NO: 7912571 - DNA, 19 bp, Homo sapiens
ttccaggtgctgtggggag

SEQ ID NO: 7912572 - DNA, 19 bp, Homo sapiens
ttccagtagattagatagc

SEQ ID NO: 7912573 - DNA, 22 bp, Homo sapiens
ttccagtacccagcgaaggcac

SEQ ID NO: 7912574 - DNA, 18 bp, Homo sapiens
ttccagtagctgtatcac

SEQ ID NO: 7912575 - DNA, 22 bp, Homo sapiens
ttccagttaaggaagctattct

SEQ ID NO: 7912576 - DNA, 22 bp, Homo sapiens
ttccagtgtgcttttatgttag

SEQ ID NO: 7912577 - DNA, 22 bp, Homo sapiens
ttccagtgatgggcaatttggt

SEQ ID NO: 7912578 - DNA, 23 bp, Homo sapiens
ttccagtgagactgagaggtctt

SEQ ID NO: 7912579 - DNA, 22 bp, Homo sapiens
ttccagtgactaagcttctgct

SEQ ID NO: 7912580 - DNA, 19 bp, Homo sapiens
ttccagttctaatctcttc

SEQ ID NO: 7912581 - DNA, 19 bp, Homo sapiens
ttccagttctaatctcttc

SEQ ID NO: 7912582 - DNA, 19 bp, Homo sapiens
ttccagttctaatctcttc

SEQ ID NO: 7912583 - DNA, 22 bp, Homo sapiens
ttccagggaagagcaaggcagt

SEQ ID NO: 7912584 - DNA, 22 bp, Homo sapiens
ttccagggaagagcaaggcagt

SEQ ID NO: 7912585 - DNA, 22 bp, Homo sapiens
ttccagggctaattcctgtgga

SEQ ID NO: 7912586 - DNA, 22 bp, Homo sapiens
ttccaggctgcacagttgggac

SEQ ID NO: 7912587 - DNA, 22 bp, Homo sapiens
ttccaggcttctctggggcgtc

SEQ ID NO: 7912588 - DNA, 19 bp, Homo sapiens
ttccaggtgctgtggggag

SEQ ID NO: 7912589 - DNA, 19 bp, Homo sapiens
ttccaggtgctgtggggag

SEQ ID NO: 7912590 - DNA, 22 bp, Homo sapiens
ttccaggggcagcagtgatggt

SEQ ID NO: 7912591 - DNA, 22 bp, Homo sapiens
ttccagggctaattcctgtgga

SEQ ID NO: 7912592 - DNA, 22 bp, Homo sapiens
ttccaggccagaatggtcacat

SEQ ID NO: 7912593 - DNA, 22 bp, Homo sapiens
ttccaggctatccggtgaaggg

SEQ ID NO: 7912594 - DNA, 22 bp, Homo sapiens
ttccaggctcccttggaggtgt

SEQ ID NO: 7912595 - DNA, 22 bp, Homo sapiens
ttccaggctcttccaggctgtc

SEQ ID NO: 7912596 - DNA, 22 bp, Homo sapiens
ttccaggctcctgcagtttcta

SEQ ID NO: 7912597 - DNA, 22 bp, Homo sapiens
ttccaggctgatgggccacagg

SEQ ID NO: 7912598 - DNA, 22 bp, Homo sapiens
ttccaggctgatgggccacagg

SEQ ID NO: 7912599 - DNA, 22 bp, Homo sapiens
ttccaggctcttccaggctgtc

SEQ ID NO: 7912600 - DNA, 22 bp, Homo sapiens
ttccaggctcttccaggctgtc

SEQ ID NO: 7912601 - DNA, 22 bp, Homo sapiens
ttcatacaatgggatattatga

SEQ ID NO: 7912602 - DNA, 22 bp, Homo sapiens
ttcatacaatgggatattatga

SEQ ID NO: 7912603 - DNA, 22 bp, Homo sapiens
ttcatacaatgggatattatga

SEQ ID NO: 7912604 - DNA, 22 bp, Homo sapiens
ttcataatcaccaaaaactgga

SEQ ID NO: 7912605 - DNA, 22 bp, Homo sapiens
ttcataagttggtgttgacttt

SEQ ID NO: 7912606 - DNA, 22 bp, Homo sapiens
ttcataagggtggccatataaa

SEQ ID NO: 7912607 - DNA, 19 bp, Homo sapiens
ttcataagtttagtgaggg

SEQ ID NO: 7912608 - DNA, 22 bp, Homo sapiens
ttcattgcattccagcctgggt

SEQ ID NO: 7912609 - DNA, 22 bp, Homo sapiens
ttcattgcattccagcctgggt

SEQ ID NO: 7912610 - DNA, 22 bp, Homo sapiens
ttcattggcacaggggcaggtt

SEQ ID NO: 7912611 - DNA, 22 bp, Homo sapiens
ttcattggcacaggggcaggtt

SEQ ID NO: 7912612 - DNA, 22 bp, Homo sapiens
ttcattggctaaagacctggga

SEQ ID NO: 7912613 - DNA, 22 bp, Homo sapiens
ttcattggtactaggacaggac

SEQ ID NO: 7912614 - DNA, 22 bp, Homo sapiens
ttcattggctaaagacctggga

SEQ ID NO: 7912615 - DNA, 22 bp, Homo sapiens
ttcattgtagcttgactaatta

SEQ ID NO: 7912616 - DNA, 22 bp, Homo sapiens
ttcattgtagcttgactaatta

SEQ ID NO: 7912617 - DNA, 22 bp, Homo sapiens
ttcattgtactttaagagatgc

SEQ ID NO: 7912618 - DNA, 22 bp, Homo sapiens
ttcattgtagcttgactaatta

SEQ ID NO: 7912619 - DNA, 22 bp, Homo sapiens
ttcattggtcctgctcctggac

SEQ ID NO: 7912620 - DNA, 22 bp, Homo sapiens
ttcattgtactttaagagatgc

SEQ ID NO: 7912621 - DNA, 22 bp, Homo sapiens
ttcattggtcctgctcctggac

SEQ ID NO: 7912622 - DNA, 22 bp, Homo sapiens
ttcattggtactaggacaggac

SEQ ID NO: 7912623 - DNA, 22 bp, Homo sapiens
ttcatttaatcagaatctctaa

SEQ ID NO: 7912624 - DNA, 22 bp, Homo sapiens
ttcattgtgtctatttttatct

SEQ ID NO: 7912625 - DNA, 22 bp, Homo sapiens
ttcattgttggctagctacctc

SEQ ID NO: 7912626 - DNA, 22 bp, Homo sapiens
ttcattgtcttggaaaacccat

SEQ ID NO: 7912627 - DNA, 22 bp, Homo sapiens
ttcattgtgaacacattctgcc

SEQ ID NO: 7912628 - DNA, 22 bp, Homo sapiens
ttcattgtgtctatttttatct

SEQ ID NO: 7912629 - DNA, 22 bp, Homo sapiens
ttcattgtgtctatttttatct

SEQ ID NO: 7912630 - DNA, 22 bp, Homo sapiens
ttcatttaatcagaatctctaa

SEQ ID NO: 7912631 - DNA, 22 bp, Homo sapiens
ttcatttaatcagaatctctaa

SEQ ID NO: 7912632 - DNA, 22 bp, Homo sapiens
ttcatttaatcagaatctctaa

SEQ ID NO: 7912633 - DNA, 22 bp, Homo sapiens
ttcatttaatttgtgtattaac

SEQ ID NO: 7912634 - DNA, 22 bp, Homo sapiens
ttcatttaatttgtgtattaac

SEQ ID NO: 7912635 - DNA, 23 bp, Homo sapiens
ttcatttaggagttcataagagc

SEQ ID NO: 7912636 - DNA, 22 bp, Homo sapiens
ttcatttgagtttatagttgct

SEQ ID NO: 7912637 - DNA, 22 bp, Homo sapiens
ttcatttgagtttatagttgct

SEQ ID NO: 7912638 - DNA, 22 bp, Homo sapiens
ttcatttgcactggattactgg

SEQ ID NO: 7912639 - DNA, 22 bp, Homo sapiens
ttcatttgagtttatagttgct

SEQ ID NO: 7912640 - DNA, 22 bp, Homo sapiens
ttcatttgatggtgggagagaa

SEQ ID NO: 7912641 - DNA, 22 bp, Homo sapiens
ttcatttgccatcagtgtaatg

SEQ ID NO: 7912642 - DNA, 22 bp, Homo sapiens
ttcatttgccatcagtgtaatg

SEQ ID NO: 7912643 - DNA, 22 bp, Homo sapiens
ttcatttgccatcagtgtaatg

SEQ ID NO: 7912644 - DNA, 22 bp, Homo sapiens
ttcatttgcactggattactgg

SEQ ID NO: 7912645 - DNA, 22 bp, Homo sapiens
ttcatttgcactggattactgg

SEQ ID NO: 7912646 - DNA, 23 bp, Homo sapiens
ttcatttaggagttcataagagc

SEQ ID NO: 7912647 - DNA, 22 bp, Homo sapiens
ttcagttttgcttttaatcatg

SEQ ID NO: 7912648 - DNA, 21 bp, Homo sapiens
ttcataaaccattctcatgca

SEQ ID NO: 7912649 - DNA, 21 bp, Homo sapiens
ttcataaaccattctcatgca

SEQ ID NO: 7912650 - DNA, 22 bp, Homo sapiens
ttcataaacaactgatggtaat

SEQ ID NO: 7912651 - DNA, 22 bp, Homo sapiens
ttcagtttcaaatcctgtgaag

SEQ ID NO: 7912652 - DNA, 22 bp, Homo sapiens
ttcagtttgtttgactgttaga

SEQ ID NO: 7912653 - DNA, 22 bp, Homo sapiens
ttcagttttctttagaatgtag

SEQ ID NO: 7912654 - DNA, 22 bp, Homo sapiens
ttcagttttattgtactgctat

SEQ ID NO: 7912655 - DNA, 22 bp, Homo sapiens
ttcagttttattgtactgctat

SEQ ID NO: 7912656 - DNA, 22 bp, Homo sapiens
ttcagttccatttcaggtgggt

SEQ ID NO: 7912657 - DNA, 22 bp, Homo sapiens
ttcagtgtttgtagagataact

SEQ ID NO: 7912658 - DNA, 22 bp, Homo sapiens
ttcagtgtttgtagagataact

SEQ ID NO: 7912659 - DNA, 22 bp, Homo sapiens
ttcagtgtttgtagagataact

SEQ ID NO: 7912660 - DNA, 22 bp, Homo sapiens
ttcagtgttaatcttgggagaa

SEQ ID NO: 7912661 - DNA, 22 bp, Homo sapiens
ttcagtgttaatcttgggagaa

SEQ ID NO: 7912662 - DNA, 22 bp, Homo sapiens
ttcagtgttactcaaggggcag

SEQ ID NO: 7912663 - DNA, 22 bp, Homo sapiens
ttcagtgttaatcttgggagaa

SEQ ID NO: 7912664 - DNA, 22 bp, Homo sapiens
ttcagtgttcttttctgttagc

SEQ ID NO: 7912665 - DNA, 22 bp, Homo sapiens
ttcagtgttcttttctgttagc

SEQ ID NO: 7912666 - DNA, 22 bp, Homo sapiens
ttcagtgttactcaaggggcag

SEQ ID NO: 7912667 - DNA, 22 bp, Homo sapiens
ttcagtgttactcaaggggcag

SEQ ID NO: 7912668 - DNA, 22 bp, Homo sapiens
ttcagtgttcttttctgttagc

SEQ ID NO: 7912669 - DNA, 22 bp, Homo sapiens
ttcagtgttcttttctgttagc

SEQ ID NO: 7912670 - DNA, 22 bp, Homo sapiens
ttcagtgtggtgcacagttttg

SEQ ID NO: 7912671 - DNA, 22 bp, Homo sapiens
ttcagtgtgtcagtttcagcag

SEQ ID NO: 7912672 - DNA, 22 bp, Homo sapiens
ttcagtgtgtgatacctgctgt

SEQ ID NO: 7912673 - DNA, 22 bp, Homo sapiens
ttcagtgtgtcagtttcagcag

SEQ ID NO: 7912674 - DNA, 22 bp, Homo sapiens
ttcagtgttaaattcaaagagt

SEQ ID NO: 7912675 - DNA, 22 bp, Homo sapiens
ttcagtgttaaattcaaagagt

SEQ ID NO: 7912676 - DNA, 22 bp, Homo sapiens
ttcagtgttaaattcaaagagt

SEQ ID NO: 7912677 - DNA, 22 bp, Homo sapiens
ttcagtgttaaattcaaagagt

SEQ ID NO: 7912678 - DNA, 22 bp, Homo sapiens
ttcagtgttaaattcaaagagt

SEQ ID NO: 7912679 - DNA, 22 bp, Homo sapiens
ttcagtgtgtgatacctgctgt

SEQ ID NO: 7912680 - DNA, 22 bp, Homo sapiens
ttcagtgtgtgatacctgctgt

SEQ ID NO: 7912681 - DNA, 22 bp, Homo sapiens
ttcagtgtggaatgtgaactgc

SEQ ID NO: 7912682 - DNA, 22 bp, Homo sapiens
ttcagtgtggaatgtgaactgc

SEQ ID NO: 7912683 - DNA, 22 bp, Homo sapiens
ttcagtgtggaatgtgaactgc

SEQ ID NO: 7912684 - DNA, 22 bp, Homo sapiens
ttcagtgtggcccatgaagagg

SEQ ID NO: 7912685 - DNA, 22 bp, Homo sapiens
ttcagtgtgcttcaggacgtta

SEQ ID NO: 7912686 - DNA, 22 bp, Homo sapiens
ttcagtgtggtgcacagttttg

SEQ ID NO: 7912687 - DNA, 22 bp, Homo sapiens
ttcagtgtggtgcacagttttg

SEQ ID NO: 7912688 - DNA, 22 bp, Homo sapiens
ttcagtgtggcccatgaagagg

SEQ ID NO: 7912689 - DNA, 22 bp, Homo sapiens
ttcagtgtggcccatgaagagg

SEQ ID NO: 7912690 - DNA, 22 bp, Homo sapiens
ttcagtgtggcccatgaagagg

SEQ ID NO: 7912691 - DNA, 22 bp, Homo sapiens
ttcagcaactcaaacctattag

SEQ ID NO: 7912692 - DNA, 22 bp, Homo sapiens
ttcagcaactgagtgtctttta

SEQ ID NO: 7912693 - DNA, 22 bp, Homo sapiens
ttcagcaactcaaacctattag

SEQ ID NO: 7912694 - DNA, 22 bp, Homo sapiens
ttcagcaagaatttactgagct

SEQ ID NO: 7912695 - DNA, 22 bp, Homo sapiens
ttcagcaagtgtctctactgtc

SEQ ID NO: 7912696 - DNA, 21 bp, Homo sapiens
ttcagcaagcactctggacac

SEQ ID NO: 7912697 - DNA, 22 bp, Homo sapiens
ttcagcaaggcatgtgcaggag

SEQ ID NO: 7912698 - DNA, 22 bp, Homo sapiens
ttcagcaaatggcttgagataa

SEQ ID NO: 7912699 - DNA, 22 bp, Homo sapiens
ttcagaggacaaccagccatct

SEQ ID NO: 7912700 - DNA, 22 bp, Homo sapiens
ttcagagccagcaacactaggc

SEQ ID NO: 7912701 - DNA, 22 bp, Homo sapiens
ttcagagctggtgtctacagct

SEQ ID NO: 7912702 - DNA, 22 bp, Homo sapiens
ttcagtgtgcttcaggacgtta

SEQ ID NO: 7912703 - DNA, 22 bp, Homo sapiens
ttcagtgtgcttcaggacgtta

SEQ ID NO: 7912704 - DNA, 19 bp, Homo sapiens
ttcagtgtgctggctcctg

SEQ ID NO: 7912705 - DNA, 19 bp, Homo sapiens
ttcagtgtgctggctcctg

SEQ ID NO: 7912706 - DNA, 22 bp, Homo sapiens
ttcagtgtgcctaagtcagttg

SEQ ID NO: 7912707 - DNA, 22 bp, Homo sapiens
ttcagtgtgcctaagtcagttg

SEQ ID NO: 7912708 - DNA, 22 bp, Homo sapiens
ttcagtgtgaagcttctgaaag

SEQ ID NO: 7912709 - DNA, 22 bp, Homo sapiens
ttcagtgtgaagcttctgaaag

SEQ ID NO: 7912710 - DNA, 22 bp, Homo sapiens
ttcagtgtccctagtagaagtt

SEQ ID NO: 7912711 - DNA, 22 bp, Homo sapiens
ttcagtgtgcctaagtcagttg

SEQ ID NO: 7912712 - DNA, 22 bp, Homo sapiens
ttcagtgtccctagtagaagtt

SEQ ID NO: 7912713 - DNA, 22 bp, Homo sapiens
ttcagtgtcacaagagcaagcc

SEQ ID NO: 7912714 - DNA, 22 bp, Homo sapiens
ttcagtgtccctagtagaagtt

SEQ ID NO: 7912715 - DNA, 22 bp, Homo sapiens
ttcagtgtcacaagagcaagcc

SEQ ID NO: 7912716 - DNA, 21 bp, Homo sapiens
ttcagcagcatgttgtctgtt

SEQ ID NO: 7912717 - DNA, 18 bp, Homo sapiens
ttcagcagcagacacact

SEQ ID NO: 7912718 - DNA, 18 bp, Homo sapiens
ttcagcagcagacacact

SEQ ID NO: 7912719 - DNA, 22 bp, Homo sapiens
ttcagcactgttatggatttgc

SEQ ID NO: 7912720 - DNA, 22 bp, Homo sapiens
ttcagcagagaaattacataat

SEQ ID NO: 7912721 - DNA, 18 bp, Homo sapiens
ttcagcagcagacacact

SEQ ID NO: 7912722 - DNA, 18 bp, Homo sapiens
ttcagcagcagacacact

SEQ ID NO: 7912723 - DNA, 22 bp, Homo sapiens
ttcagcagatccctaagtcctg

SEQ ID NO: 7912724 - DNA, 22 bp, Homo sapiens
ttcagcagatccctaagtcctg

SEQ ID NO: 7912725 - DNA, 22 bp, Homo sapiens
ttcagcaccacttccagagaag

SEQ ID NO: 7912726 - DNA, 22 bp, Homo sapiens
ttcagcacaagactagacaggt

SEQ ID NO: 7912727 - DNA, 22 bp, Homo sapiens
ttcagagagtccagtatgcagt

SEQ ID NO: 7912728 - DNA, 22 bp, Homo sapiens
ttcagagagtccagtatgcagt

SEQ ID NO: 7912729 - DNA, 22 bp, Homo sapiens
ttcagagagtttgtgagtcctt

SEQ ID NO: 7912730 - DNA, 22 bp, Homo sapiens
ttcagagagtttgtgagtcctt

SEQ ID NO: 7912731 - DNA, 20 bp, Homo sapiens
ttcagagatagggtctttaa

SEQ ID NO: 7912732 - DNA, 20 bp, Homo sapiens
ttcagagatagggtctttaa

SEQ ID NO: 7912733 - DNA, 22 bp, Homo sapiens
ttcagagagtttgtgagtcctt

SEQ ID NO: 7912734 - DNA, 20 bp, Homo sapiens
ttcagagatagggtctttaa

SEQ ID NO: 7912735 - DNA, 22 bp, Homo sapiens
ttcagagatggaaggcagaatg

SEQ ID NO: 7912736 - DNA, 22 bp, Homo sapiens
ttcagagatggaaggcagaatg

SEQ ID NO: 7912737 - DNA, 22 bp, Homo sapiens
ttcagagatggaaggcagaatg

SEQ ID NO: 7912738 - DNA, 22 bp, Homo sapiens
ttcagagatgacacctggtgtt

SEQ ID NO: 7912739 - DNA, 22 bp, Homo sapiens
ttcagagatgacacctggtgtt

SEQ ID NO: 7912740 - DNA, 22 bp, Homo sapiens
ttcagagatggaaggcagaatg

SEQ ID NO: 7912741 - DNA, 22 bp, Homo sapiens
ttcagagatggaaggcagaatg

SEQ ID NO: 7912742 - DNA, 22 bp, Homo sapiens
ttcagagagaaaccagtgggaa

SEQ ID NO: 7912743 - DNA, 22 bp, Homo sapiens
ttcagagacatgttctagatca

SEQ ID NO: 7912744 - DNA, 22 bp, Homo sapiens
ttcagagacatgttctagatca

SEQ ID NO: 7912745 - DNA, 22 bp, Homo sapiens
ttcagagagaaaccagtgggaa

SEQ ID NO: 7912746 - DNA, 22 bp, Homo sapiens
ttcagagagaccaagtggcgtg

SEQ ID NO: 7912747 - DNA, 22 bp, Homo sapiens
ttcagagagaccaagtggcgtg

SEQ ID NO: 7912748 - DNA, 22 bp, Homo sapiens
ttcagagagtacagttgctggc

SEQ ID NO: 7912749 - DNA, 22 bp, Homo sapiens
ttcagagagtacagttgctggc

SEQ ID NO: 7912750 - DNA, 22 bp, Homo sapiens
ttcagagaattggataattcgt

SEQ ID NO: 7912751 - DNA, 22 bp, Homo sapiens
ttcagagacatgttctagatca

SEQ ID NO: 7912752 - DNA, 22 bp, Homo sapiens
ttcagagacagcaaccaggaca

SEQ ID NO: 7912753 - DNA, 22 bp, Homo sapiens
ttcagagacagcaaccaggaca

SEQ ID NO: 7912754 - DNA, 22 bp, Homo sapiens
ttcagagaagcaaaggcagatt

SEQ ID NO: 7912755 - DNA, 22 bp, Homo sapiens
ttcagagaagcaaaggcagatt

SEQ ID NO: 7912756 - DNA, 22 bp, Homo sapiens
ttcagagaagtgcacaaaatca

SEQ ID NO: 7912757 - DNA, 22 bp, Homo sapiens
ttcagagaacttcatggaagag

SEQ ID NO: 7912758 - DNA, 22 bp, Homo sapiens
ttcagagaacttcatggaagag

SEQ ID NO: 7912759 - DNA, 22 bp, Homo sapiens
ttcagagaagcaaaggcagatt

SEQ ID NO: 7912760 - DNA, 22 bp, Homo sapiens
ttcagagaaagcagatttactc

SEQ ID NO: 7912761 - DNA, 22 bp, Homo sapiens
ttcagagaaaggaaagccggat

SEQ ID NO: 7912762 - DNA, 22 bp, Homo sapiens
ttcagagaaagcagatttactc

SEQ ID NO: 7912763 - DNA, 22 bp, Homo sapiens
ttcagagaaagcagatttactc

SEQ ID NO: 7912764 - DNA, 22 bp, Homo sapiens
ttcagagaacttcatggaagag

SEQ ID NO: 7912765 - DNA, 22 bp, Homo sapiens
ttcagagaaactgaggtttaga

SEQ ID NO: 7912766 - DNA, 22 bp, Homo sapiens
ttcagagaaactgaggtttaga

SEQ ID NO: 7912767 - DNA, 22 bp, Homo sapiens
ttcagactagacacatttcaag

SEQ ID NO: 7912768 - DNA, 22 bp, Homo sapiens
ttcagactgctggtgcttccct

SEQ ID NO: 7912769 - DNA, 22 bp, Homo sapiens
ttcagactagacacatttcaag

SEQ ID NO: 7912770 - DNA, 22 bp, Homo sapiens
ttcacagggcagcagctgagcc

SEQ ID NO: 7912771 - DNA, 22 bp, Homo sapiens
ttcacagggcagatcatttctg

SEQ ID NO: 7912772 - DNA, 22 bp, Homo sapiens
ttcacaggaatgtaggggtctt

SEQ ID NO: 7912773 - DNA, 22 bp, Homo sapiens
ttcacaggagggtggatgcatg

SEQ ID NO: 7912774 - DNA, 22 bp, Homo sapiens
ttcacaggatatatgtgcaggg

SEQ ID NO: 7912775 - DNA, 22 bp, Homo sapiens
ttcacaggatatatgtgcaggg

SEQ ID NO: 7912776 - DNA, 22 bp, Homo sapiens
ttcacaattaactttatactta

SEQ ID NO: 7912777 - DNA, 22 bp, Homo sapiens
ttcacaattaactttatactta

SEQ ID NO: 7912778 - DNA, 22 bp, Homo sapiens
ttcacaatctggcttagcattg

SEQ ID NO: 7912779 - DNA, 22 bp, Homo sapiens
ttcacaatggcaaaccattaaa

SEQ ID NO: 7912780 - DNA, 22 bp, Homo sapiens
ttcacagactttccatagattg

SEQ ID NO: 7912781 - DNA, 22 bp, Homo sapiens
ttcacaattaactttatactta

SEQ ID NO: 7912782 - DNA, 22 bp, Homo sapiens
ttcacagactttccatagattg

SEQ ID NO: 7912783 - DNA, 22 bp, Homo sapiens
ttcacagactttccatagattg

SEQ ID NO: 7912784 - DNA, 22 bp, Homo sapiens
ttcacaataggagcatgcaaat

SEQ ID NO: 7912785 - DNA, 23 bp, Homo sapiens
ttcaaagcttaagctctttccac

SEQ ID NO: 7912786 - DNA, 22 bp, Homo sapiens
ttcacaatctggcttagcattg

SEQ ID NO: 7912787 - DNA, 22 bp, Homo sapiens
ttcacaatggcaaaccattaaa

SEQ ID NO: 7912788 - DNA, 22 bp, Homo sapiens
ttcacaatgccttgttgatggt

SEQ ID NO: 7912789 - DNA, 22 bp, Homo sapiens
ttcacaatgccagcaaccactt

SEQ ID NO: 7912790 - DNA, 22 bp, Homo sapiens
ttcacaatctggcttagcattg

SEQ ID NO: 7912791 - DNA, 23 bp, Homo sapiens
ttcaaagatcttctgaaatctgt

SEQ ID NO: 7912792 - DNA, 22 bp, Homo sapiens
ttcaaagatggagggatagatt

SEQ ID NO: 7912793 - DNA, 22 bp, Homo sapiens
ttcaaagattagcatacgcaat

SEQ ID NO: 7912794 - DNA, 22 bp, Homo sapiens
ttcaaagatggagggatagatt

SEQ ID NO: 7912795 - DNA, 22 bp, Homo sapiens
ttcaaagcaatagaaagagtga

SEQ ID NO: 7912796 - DNA, 22 bp, Homo sapiens
ttcaaagcaatagaaagagtga

SEQ ID NO: 7912797 - DNA, 22 bp, Homo sapiens
ttcaaagagttgggtgtctggg

SEQ ID NO: 7912798 - DNA, 22 bp, Homo sapiens
ttcaaagagttgggtgtctggg

SEQ ID NO: 7912799 - DNA, 22 bp, Homo sapiens
ttcaaagataatgtagcatttt

SEQ ID NO: 7912800 - DNA, 22 bp, Homo sapiens
ttcaaagataatgtagcatttt

SEQ ID NO: 7912801 - DNA, 22 bp, Homo sapiens
ttcaaagataatgtagcatttt

SEQ ID NO: 7912802 - DNA, 22 bp, Homo sapiens
ttcaaagagaaattgtattttc

SEQ ID NO: 7912803 - DNA, 22 bp, Homo sapiens
ttcaaagagaaattgtattttc

SEQ ID NO: 7912804 - DNA, 22 bp, Homo sapiens
ttcaaagaccttacttggcaaa

SEQ ID NO: 7912805 - DNA, 21 bp, Homo sapiens
ttcaaagacttgatgctgacc

SEQ ID NO: 7912806 - DNA, 21 bp, Homo sapiens
ttcaaagacttgatgctgacc

SEQ ID NO: 7912807 - DNA, 22 bp, Homo sapiens
ttcaaacttaaggagcagcaga

SEQ ID NO: 7912808 - DNA, 20 bp, Homo sapiens
ttcaaagaccctcaggtcca

SEQ ID NO: 7912809 - DNA, 22 bp, Homo sapiens
ttcacagatgagaaaattgagg

SEQ ID NO: 7912810 - DNA, 22 bp, Homo sapiens
ttcacagatgagaaaattgagg

SEQ ID NO: 7912811 - DNA, 18 bp, Homo sapiens
ttcacagatccacaggaa

SEQ ID NO: 7912812 - DNA, 22 bp, Homo sapiens
ttcacagataacacaggcaaat

SEQ ID NO: 7912813 - DNA, 22 bp, Homo sapiens
ttcacagataacacaggcaaat

SEQ ID NO: 7912814 - DNA, 22 bp, Homo sapiens
ttcacagagttatttttatgct

SEQ ID NO: 7912815 - DNA, 21 bp, Homo sapiens
ttcacagatgggaaaactgag

SEQ ID NO: 7912816 - DNA, 21 bp, Homo sapiens
ttcacagatgggaaaactgag

SEQ ID NO: 7912817 - DNA, 21 bp, Homo sapiens
ttcacagatgggaaaactgag

SEQ ID NO: 7912818 - DNA, 21 bp, Homo sapiens
ttcacagatgggaaaactgag

SEQ ID NO: 7912819 - DNA, 22 bp, Homo sapiens
ttcacagatgagaaaattgagg

SEQ ID NO: 7912820 - DNA, 22 bp, Homo sapiens
ttcacagatgcctgatgtgtgg

SEQ ID NO: 7912821 - DNA, 20 bp, Homo sapiens
ttcacagaggactcaggtca

SEQ ID NO: 7912822 - DNA, 22 bp, Homo sapiens
ttcacagagcttgttcatggcc

SEQ ID NO: 7912823 - DNA, 22 bp, Homo sapiens
ttcacagagcttgttcatggcc

SEQ ID NO: 7912824 - DNA, 22 bp, Homo sapiens
ttcacagagttatttttatgct

SEQ ID NO: 7912825 - DNA, 22 bp, Homo sapiens
ttcacagagttatttttatgct

SEQ ID NO: 7912826 - DNA, 22 bp, Homo sapiens
ttcacagagttatttttatgct

SEQ ID NO: 7912827 - DNA, 20 bp, Homo sapiens
ttcacagaggactcaggtca

SEQ ID NO: 7912828 - DNA, 22 bp, Homo sapiens
ttcacagagcactgccaagtac

SEQ ID NO: 7912829 - DNA, 22 bp, Homo sapiens
ttcacagagagtatgcagagaa

SEQ ID NO: 7912830 - DNA, 22 bp, Homo sapiens
ttcacagagcgggatgctggga

SEQ ID NO: 7912831 - DNA, 22 bp, Homo sapiens
ttcacagagagaactcaaacca

SEQ ID NO: 7912832 - DNA, 22 bp, Homo sapiens
ttcacagagagtatgcagagaa

SEQ ID NO: 7912833 - DNA, 22 bp, Homo sapiens
ttcacagagagtatgcagagaa

SEQ ID NO: 7912834 - DNA, 22 bp, Homo sapiens
ttcacagatttccctgcacatg

SEQ ID NO: 7912835 - DNA, 22 bp, Homo sapiens
ttcacagattgactggattcct

SEQ ID NO: 7912836 - DNA, 22 bp, Homo sapiens
ttcacagattgactggattcct

SEQ ID NO: 7912837 - DNA, 22 bp, Homo sapiens
ttcacagatttccctgcacatg

SEQ ID NO: 7912838 - DNA, 22 bp, Homo sapiens
ttcacagatttccctgcacatg

SEQ ID NO: 7912839 - DNA, 22 bp, Homo sapiens
ttcacagatttccctgcacatg

SEQ ID NO: 7912840 - DNA, 22 bp, Homo sapiens
ttcacagatgtattggaactcc

SEQ ID NO: 7912841 - DNA, 22 bp, Homo sapiens
ttcacagatgtattggaactcc

SEQ ID NO: 7912842 - DNA, 22 bp, Homo sapiens
ttcacagatgtattggaactcc

SEQ ID NO: 7912843 - DNA, 22 bp, Homo sapiens
ttcacagatgtattggaactcc

SEQ ID NO: 7912844 - DNA, 22 bp, Homo sapiens
ttcacagatgtattggaactcc

SEQ ID NO: 7912845 - DNA, 23 bp, Homo sapiens
ttcacagattaaatatttcttct

SEQ ID NO: 7912846 - DNA, 18 bp, Homo sapiens
ttcacaggaaatgtcttt

SEQ ID NO: 7912847 - DNA, 22 bp, Homo sapiens
ttcacagcttaataaggctcag

SEQ ID NO: 7912848 - DNA, 19 bp, Homo sapiens
ttcacagctctgtgtcagt

SEQ ID NO: 7912849 - DNA, 19 bp, Homo sapiens
ttcacagctctgtgtcagt

SEQ ID NO: 7912850 - DNA, 22 bp, Homo sapiens
ttcacagctaagagctaagtaa

SEQ ID NO: 7912851 - DNA, 22 bp, Homo sapiens
ttcacagctcatactgttctca

SEQ ID NO: 7912852 - DNA, 22 bp, Homo sapiens
ttctggaagtgttagaatctgg

SEQ ID NO: 7912853 - DNA, 22 bp, Homo sapiens
ttctggaagttggaaatagcag

SEQ ID NO: 7912854 - DNA, 22 bp, Homo sapiens
ttctggaagtggaatttttgta

SEQ ID NO: 7912855 - DNA, 22 bp, Homo sapiens
ttctggaatatttgacacaatt

SEQ ID NO: 7912856 - DNA, 22 bp, Homo sapiens
ttctggaatatttgacacaatt

SEQ ID NO: 7912857 - DNA, 22 bp, Homo sapiens
ttctggaatactaagttccttt

SEQ ID NO: 7912858 - DNA, 22 bp, Homo sapiens
ttctggaagttttctcctgtgg

SEQ ID NO: 7912859 - DNA, 22 bp, Homo sapiens
ttctggaatactaagttccttt

SEQ ID NO: 7912860 - DNA, 22 bp, Homo sapiens
ttctggaatactaagttccttt

SEQ ID NO: 7912861 - DNA, 22 bp, Homo sapiens
ttctggaatactaagttccttt

SEQ ID NO: 7912862 - DNA, 22 bp, Homo sapiens
ttctggaacatagcaagaagtt

SEQ ID NO: 7912863 - DNA, 22 bp, Homo sapiens
ttctggaacatagcaagaagtt

SEQ ID NO: 7912864 - DNA, 22 bp, Homo sapiens
ttctggaaatgttgctgaggcc

SEQ ID NO: 7912865 - DNA, 22 bp, Homo sapiens
ttctggaaatgttgctgaggcc

SEQ ID NO: 7912866 - DNA, 22 bp, Homo sapiens
ttctggaaatgggtatagagca

SEQ ID NO: 7912867 - DNA, 22 bp, Homo sapiens
ttctggaaatgggtatagagca

SEQ ID NO: 7912868 - DNA, 22 bp, Homo sapiens
ttctggaaatgggtatagagca

SEQ ID NO: 7912869 - DNA, 22 bp, Homo sapiens
ttctggaaatgcacaactaatt

SEQ ID NO: 7912870 - DNA, 22 bp, Homo sapiens
ttctggaaatgggtatagagca

SEQ ID NO: 7912871 - DNA, 22 bp, Homo sapiens
ttctggaaatgaatgctaggaa

SEQ ID NO: 7912872 - DNA, 22 bp, Homo sapiens
ttctggaaatgcacaactaatt

SEQ ID NO: 7912873 - DNA, 21 bp, Homo sapiens
ttctctggtcaagcacacata

SEQ ID NO: 7912874 - DNA, 21 bp, Homo sapiens
ttctctggtcaagcacacata

SEQ ID NO: 7912875 - DNA, 18 bp, Homo sapiens
ttctctggtggatgttat

SEQ ID NO: 7912876 - DNA, 22 bp, Homo sapiens
ttctctgggacaggaacagttt

SEQ ID NO: 7912877 - DNA, 22 bp, Homo sapiens
ttctctgggacaggaacagttt

SEQ ID NO: 7912878 - DNA, 19 bp, Homo sapiens
ttctctggactagatgctg

SEQ ID NO: 7912879 - DNA, 22 bp, Homo sapiens
ttctctggacagtgaagagagg

SEQ ID NO: 7912880 - DNA, 22 bp, Homo sapiens
ttctctggacagtgaagagagg

SEQ ID NO: 7912881 - DNA, 22 bp, Homo sapiens
ttctctggggactgtctctatt

SEQ ID NO: 7912882 - DNA, 22 bp, Homo sapiens
ttctctgggcttttcggatccg

SEQ ID NO: 7912883 - DNA, 22 bp, Homo sapiens
ttctctgggatctggcaaaagg

SEQ ID NO: 7912884 - DNA, 22 bp, Homo sapiens
ttctctgggatctggcaaaagg

SEQ ID NO: 7912885 - DNA, 22 bp, Homo sapiens
ttctctgggacaggaacagttt

SEQ ID NO: 7912886 - DNA, 22 bp, Homo sapiens
ttctctgggttaggggaactat

SEQ ID NO: 7912887 - DNA, 22 bp, Homo sapiens
ttctctgggttaggggaactat

SEQ ID NO: 7912888 - DNA, 16 bp, Homo sapiens
ttctctggggttgtgc

SEQ ID NO: 7912889 - DNA, 16 bp, Homo sapiens
ttctctggggttgtgc

SEQ ID NO: 7912890 - DNA, 22 bp, Homo sapiens
ttctctggtaaacacatgcgta

SEQ ID NO: 7912891 - DNA, 22 bp, Homo sapiens
ttctctggtaaacacatgcgta

SEQ ID NO: 7912892 - DNA, 22 bp, Homo sapiens
ttctctgggttaggggaactat

SEQ ID NO: 7912893 - DNA, 22 bp, Homo sapiens
ttctctgggttaggggaactat

SEQ ID NO: 7912894 - DNA, 22 bp, Homo sapiens
ttctctggggacttggttggag

SEQ ID NO: 7912895 - DNA, 22 bp, Homo sapiens
ttctctggggacttggttggag

SEQ ID NO: 7912896 - DNA, 22 bp, Homo sapiens
ttctctggggttcagtatctct

SEQ ID NO: 7912897 - DNA, 22 bp, Homo sapiens
ttctctggggttcagtatctct

SEQ ID NO: 7912898 - DNA, 22 bp, Homo sapiens
ttctctggggttcagtatctct

SEQ ID NO: 7912899 - DNA, 22 bp, Homo sapiens
ttctgtaagctaccaagtttgt

SEQ ID NO: 7912900 - DNA, 22 bp, Homo sapiens
ttctgtaaacatcaagtgcctg

SEQ ID NO: 7912901 - DNA, 22 bp, Homo sapiens
ttctgtaagctaccaagtttgt

SEQ ID NO: 7912902 - DNA, 22 bp, Homo sapiens
ttctgtaagctaccaagtttgt

SEQ ID NO: 7912903 - DNA, 19 bp, Homo sapiens
ttctgtaaggacattaatc

SEQ ID NO: 7912904 - DNA, 22 bp, Homo sapiens
ttctggagctctcgaccccact

SEQ ID NO: 7912905 - DNA, 22 bp, Homo sapiens
ttctggagccccaagatctgta

SEQ ID NO: 7912906 - DNA, 22 bp, Homo sapiens
ttctggagccccaagatctgta

SEQ ID NO: 7912907 - DNA, 22 bp, Homo sapiens
ttctggagccgggcctgggcag

SEQ ID NO: 7912908 - DNA, 22 bp, Homo sapiens
ttctggagctaaagtccactct

SEQ ID NO: 7912909 - DNA, 22 bp, Homo sapiens
ttctggagccgggcctgggcag

SEQ ID NO: 7912910 - DNA, 22 bp, Homo sapiens
ttctggagccgggcctgggcag

SEQ ID NO: 7912911 - DNA, 22 bp, Homo sapiens
ttctggagaggaacagaaaggt

SEQ ID NO: 7912912 - DNA, 22 bp, Homo sapiens
ttctggagaggaacagaaaggt

SEQ ID NO: 7912913 - DNA, 22 bp, Homo sapiens
ttctggagaggaacagaaaggt

SEQ ID NO: 7912914 - DNA, 22 bp, Homo sapiens
ttctggagaggaacagaaaggt

SEQ ID NO: 7912915 - DNA, 22 bp, Homo sapiens
ttctggagatagtcaggcatta

SEQ ID NO: 7912916 - DNA, 22 bp, Homo sapiens
ttctggagatagtcaggcatta

SEQ ID NO: 7912917 - DNA, 22 bp, Homo sapiens
ttctggagatagtcaggcatta

SEQ ID NO: 7912918 - DNA, 22 bp, Homo sapiens
ttctggagatctgcctatggga

SEQ ID NO: 7912919 - DNA, 22 bp, Homo sapiens
ttctggagattgagaaggcatt

SEQ ID NO: 7912920 - DNA, 22 bp, Homo sapiens
ttctggagatgacttttagaaa

SEQ ID NO: 7912921 - DNA, 22 bp, Homo sapiens
ttctggagatctgcctatggga

SEQ ID NO: 7912922 - DNA, 22 bp, Homo sapiens
ttctggagattgagaaggcatt

SEQ ID NO: 7912923 - DNA, 22 bp, Homo sapiens
ttctggagattgagaaggcatt

SEQ ID NO: 7912924 - DNA, 22 bp, Homo sapiens
ttctggagattgagaaggcatt

SEQ ID NO: 7912925 - DNA, 22 bp, Homo sapiens
ttctggagacccagcaacaggg

SEQ ID NO: 7912926 - DNA, 22 bp, Homo sapiens
ttctggagacccagcaacaggg

SEQ ID NO: 7912927 - DNA, 22 bp, Homo sapiens
ttctggagacccagcaacaggg

SEQ ID NO: 7912928 - DNA, 22 bp, Homo sapiens
ttctggagacccagcaacaggg

SEQ ID NO: 7912929 - DNA, 22 bp, Homo sapiens
ttctggagacccagcaacaggg

SEQ ID NO: 7912930 - DNA, 22 bp, Homo sapiens
ttctggagagaaaccttacaaa

SEQ ID NO: 7912931 - DNA, 22 bp, Homo sapiens
ttctggagagaagaccagtgtg

SEQ ID NO: 7912932 - DNA, 22 bp, Homo sapiens
ttctggagaataatcagcattg

SEQ ID NO: 7912933 - DNA, 22 bp, Homo sapiens
ttctggagaatcaccaccaggc

SEQ ID NO: 7912934 - DNA, 23 bp, Homo sapiens
ttctggagaaaggaccatagctt

SEQ ID NO: 7912935 - DNA, 22 bp, Homo sapiens
ttctggaattcttgcagccact

SEQ ID NO: 7912936 - DNA, 22 bp, Homo sapiens
ttctggaattcttgcagccact

SEQ ID NO: 7912937 - DNA, 19 bp, Homo sapiens
ttctggacagcagaaacca

SEQ ID NO: 7912938 - DNA, 19 bp, Homo sapiens
ttctggacagcagaaacca

SEQ ID NO: 7912939 - DNA, 22 bp, Homo sapiens
ttctggagaaaattctgtcatt

SEQ ID NO: 7912940 - DNA, 22 bp, Homo sapiens
ttctggagaaaattctgtcatt

SEQ ID NO: 7912941 - DNA, 22 bp, Homo sapiens
ttctggaattcttgcagccact

SEQ ID NO: 7912942 - DNA, 22 bp, Homo sapiens
ttctggacttgccttgctgatg

SEQ ID NO: 7912943 - DNA, 22 bp, Homo sapiens
ttctggaatatttgacacaatt

SEQ ID NO: 7912944 - DNA, 22 bp, Homo sapiens
ttctggaattcttgcagccact

SEQ ID NO: 7912945 - DNA, 22 bp, Homo sapiens
ttctggaatgcctgttctaatt

SEQ ID NO: 7912946 - DNA, 22 bp, Homo sapiens
ttcttatattgggtcatggata

SEQ ID NO: 7912947 - DNA, 22 bp, Homo sapiens
ttcttatattgggtcatggata

SEQ ID NO: 7912948 - DNA, 22 bp, Homo sapiens
ttcttatgttcacataattcca

SEQ ID NO: 7912949 - DNA, 22 bp, Homo sapiens
ttcttatgttcacataattcca

SEQ ID NO: 7912950 - DNA, 22 bp, Homo sapiens
ttcttatgttcacataattcca

SEQ ID NO: 7912951 - DNA, 22 bp, Homo sapiens
ttcttatgttcacataattcca

SEQ ID NO: 7912952 - DNA, 22 bp, Homo sapiens
ttcttatagaagcaaccattgt

SEQ ID NO: 7912953 - DNA, 22 bp, Homo sapiens
ttcttatagaagcaaccattgt

SEQ ID NO: 7912954 - DNA, 22 bp, Homo sapiens
ttcttatattgggtcatggata

SEQ ID NO: 7912955 - DNA, 22 bp, Homo sapiens
ttcttatagaagcaaccattgt

SEQ ID NO: 7912956 - DNA, 22 bp, Homo sapiens
ttcttataagttaatatttcca

SEQ ID NO: 7912957 - DNA, 22 bp, Homo sapiens
ttcttataagttaatatttcca

SEQ ID NO: 7912958 - DNA, 22 bp, Homo sapiens
ttcttataagttaatatttcca

SEQ ID NO: 7912959 - DNA, 22 bp, Homo sapiens
ttcttataagataggcctcagg

SEQ ID NO: 7912960 - DNA, 22 bp, Homo sapiens
ttcttagtggtagtcatctttg

SEQ ID NO: 7912961 - DNA, 22 bp, Homo sapiens
ttcttagtggtagtcatctttg

SEQ ID NO: 7912962 - DNA, 19 bp, Homo sapiens
ttcttagtctcatgcatga

SEQ ID NO: 7912963 - DNA, 20 bp, Homo sapiens
ttcttagtagagcatgtatt

SEQ ID NO: 7912964 - DNA, 22 bp, Homo sapiens
ttcttaggactagtatagcatg

SEQ ID NO: 7912965 - DNA, 22 bp, Homo sapiens
ttcttaggagcattagtaattt

SEQ ID NO: 7912966 - DNA, 22 bp, Homo sapiens
ttcttactatgatttgagcctc

SEQ ID NO: 7912967 - DNA, 22 bp, Homo sapiens
ttcttactatgatttgagcctc

SEQ ID NO: 7912968 - DNA, 22 bp, Homo sapiens
ttcttagagatggttaaaaata

SEQ ID NO: 7912969 - DNA, 22 bp, Homo sapiens
ttcttagatgattaatgatggg

SEQ ID NO: 7912970 - DNA, 22 bp, Homo sapiens
ttcttagatgattaatgatggg

SEQ ID NO: 7912971 - DNA, 22 bp, Homo sapiens
ttcttagatgattaatgatggg

SEQ ID NO: 7912972 - DNA, 22 bp, Homo sapiens
ttcttagagatggttaaaaata

SEQ ID NO: 7912973 - DNA, 22 bp, Homo sapiens
ttcttagagatggttaaaaata

SEQ ID NO: 7912974 - DNA, 22 bp, Homo sapiens
ttcttagagatggttaaaaata

SEQ ID NO: 7912975 - DNA, 22 bp, Homo sapiens
ttctgtgttgtgacattctaga

SEQ ID NO: 7912976 - DNA, 22 bp, Homo sapiens
ttctgtgttgtgacattctaga

SEQ ID NO: 7912977 - DNA, 22 bp, Homo sapiens
ttctgttacaagtgaaaaaatg

SEQ ID NO: 7912978 - DNA, 22 bp, Homo sapiens
ttctgtgttctgtgcaatgagc

SEQ ID NO: 7912979 - DNA, 19 bp, Homo sapiens
ttctgtgttaattccttta

SEQ ID NO: 7912980 - DNA, 22 bp, Homo sapiens
ttcttacattagtctgtgcttt

SEQ ID NO: 7912981 - DNA, 22 bp, Homo sapiens
ttcttactacatttgcaggcta

SEQ ID NO: 7912982 - DNA, 22 bp, Homo sapiens
ttcttactacatttgcaggcta

SEQ ID NO: 7912983 - DNA, 22 bp, Homo sapiens
ttcttactagtatgtttcagca

SEQ ID NO: 7912984 - DNA, 22 bp, Homo sapiens
ttctgtgttgtgacattctaga

SEQ ID NO: 7912985 - DNA, 22 bp, Homo sapiens
ttctgttacaagtgaaaaaatg

SEQ ID NO: 7912986 - DNA, 22 bp, Homo sapiens
ttcttacattactttacatgtg

SEQ ID NO: 7912987 - DNA, 22 bp, Homo sapiens
ttctgtgtgtctcagcaagctg

SEQ ID NO: 7912988 - DNA, 19 bp, Homo sapiens
ttctgtgttaattccttta

SEQ ID NO: 7912989 - DNA, 19 bp, Homo sapiens
ttctgtgttaattccttta

SEQ ID NO: 7912990 - DNA, 22 bp, Homo sapiens
ttctgtgtgcttactggtgttc

SEQ ID NO: 7912991 - DNA, 22 bp, Homo sapiens
ttctgtgtgcttactggtgttc

SEQ ID NO: 7912992 - DNA, 22 bp, Homo sapiens
ttctgtgtgctgtcttggcttt

SEQ ID NO: 7912993 - DNA, 22 bp, Homo sapiens
ttctgtgtgctgtcttggcttt

SEQ ID NO: 7912994 - DNA, 22 bp, Homo sapiens
ttctgtgtgccagagttgtgct

SEQ ID NO: 7912995 - DNA, 22 bp, Homo sapiens
ttctgtgtgccagagttgtgct

SEQ ID NO: 7912996 - DNA, 22 bp, Homo sapiens
ttctgtgtcttcttgttctgtg

SEQ ID NO: 7912997 - DNA, 22 bp, Homo sapiens
ttctgtgtcttcttgttctgtg

SEQ ID NO: 7912998 - DNA, 22 bp, Homo sapiens
ttctgtgtcttcttgttctgtg

SEQ ID NO: 7912999 - DNA, 22 bp, Homo sapiens
ttctgtgtgccagagttgtgct

SEQ ID NO: 7913000 - DNA, 22 bp, Homo sapiens
ttctgtgtgccagagttgtgct

SEQ ID NO: 7913001 - DNA, 22 bp, Homo sapiens
ttctgtggtctcccatgtctgt

SEQ ID NO: 7913002 - DNA, 22 bp, Homo sapiens
ttctgtgactcctcagagattt

SEQ ID NO: 7913003 - DNA, 22 bp, Homo sapiens
ttctgtgaatggccatgacaag

SEQ ID NO: 7913004 - DNA, 22 bp, Homo sapiens
ttctgtgaatggccatgacaag

SEQ ID NO: 7913005 - DNA, 22 bp, Homo sapiens
ttctgtgattagttgtctggct

SEQ ID NO: 7913006 - DNA, 22 bp, Homo sapiens
ttctgtggaatatgaactagca

SEQ ID NO: 7913007 - DNA, 17 bp, Homo sapiens
ttctgtgcttcctggct

SEQ ID NO: 7913008 - DNA, 22 bp, Homo sapiens
ttctgtctgtaaacttctcaat

SEQ ID NO: 7913009 - DNA, 22 bp, Homo sapiens
ttctgtcttcccactgaggagc

SEQ ID NO: 7913010 - DNA, 22 bp, Homo sapiens
ttctgtctgtaaacttctcaat

SEQ ID NO: 7913011 - DNA, 22 bp, Homo sapiens
ttctgtcttcccactgaggagc

SEQ ID NO: 7913012 - DNA, 22 bp, Homo sapiens
ttctgtctgtaaacttctcaat

SEQ ID NO: 7913013 - DNA, 22 bp, Homo sapiens
ttctgtctgtaaacttctcaat

SEQ ID NO: 7913014 - DNA, 22 bp, Homo sapiens
ttctgtctgtaaacttctcaat

SEQ ID NO: 7913015 - DNA, 22 bp, Homo sapiens
ttctgtctgtaaacttctcaat

SEQ ID NO: 7913016 - DNA, 22 bp, Homo sapiens
ttctgtctgtaaacttctcaat

SEQ ID NO: 7913017 - DNA, 23 bp, Homo sapiens
ttctgtcttgctgtcagctttct

SEQ ID NO: 7913018 - DNA, 22 bp, Homo sapiens
ttctgtgaaactaaagagagga

SEQ ID NO: 7913019 - DNA, 22 bp, Homo sapiens
ttctgtcttcccactgaggagc

SEQ ID NO: 7913020 - DNA, 22 bp, Homo sapiens
ttctgtcttctcggttgtttac

SEQ ID NO: 7913021 - DNA, 22 bp, Homo sapiens
ttctgtctctgtgtttacatta

SEQ ID NO: 7913022 - DNA, 22 bp, Homo sapiens
ttctgtctgatggtgccagaac

SEQ ID NO: 7913023 - DNA, 22 bp, Homo sapiens
ttctgtctctgtgtttacatta

SEQ ID NO: 7913024 - DNA, 22 bp, Homo sapiens
ttctgtctgatggtgccagaac

SEQ ID NO: 7913025 - DNA, 22 bp, Homo sapiens
ttctgtctgatggtgccagaac

SEQ ID NO: 7913026 - DNA, 22 bp, Homo sapiens
ttctgtctgatggtgccagaac

SEQ ID NO: 7913027 - DNA, 22 bp, Homo sapiens
ttctgtctggaaaaggacatag

SEQ ID NO: 7913028 - DNA, 22 bp, Homo sapiens
ttctgtctgatggtgccagaac

SEQ ID NO: 7913029 - DNA, 22 bp, Homo sapiens
ttctgtaattctgttagtttca

SEQ ID NO: 7913030 - DNA, 22 bp, Homo sapiens
ttctgtacccaacatttttact

SEQ ID NO: 7913031 - DNA, 22 bp, Homo sapiens
ttctgtaccctcgcgattctcc

SEQ ID NO: 7913032 - DNA, 22 bp, Homo sapiens
ttctgtaagggatttattctga

SEQ ID NO: 7913033 - DNA, 19 bp, Homo sapiens
ttctgtaaggacattaatc

SEQ ID NO: 7913034 - DNA, 22 bp, Homo sapiens
ttcttcaaagatgtctgttgga

SEQ ID NO: 7913035 - DNA, 22 bp, Homo sapiens
ttcttcaaagatgtctgttgga

SEQ ID NO: 7913036 - DNA, 22 bp, Homo sapiens
ttcttcaaagtaatagagacta

SEQ ID NO: 7913037 - DNA, 22 bp, Homo sapiens
ttcttcaaagtaatagagacta

SEQ ID NO: 7913038 - DNA, 22 bp, Homo sapiens
ttcttcaaacaaaagtggcatg

SEQ ID NO: 7913039 - DNA, 22 bp, Homo sapiens
ttcttcaaacaaaagtggcatg

SEQ ID NO: 7913040 - DNA, 22 bp, Homo sapiens
ttcttcaaaatccagcatgatt

SEQ ID NO: 7913041 - DNA, 22 bp, Homo sapiens
ttcttcaaaatccagcatgatt

SEQ ID NO: 7913042 - DNA, 22 bp, Homo sapiens
ttcttcaaaacaacactggcct

SEQ ID NO: 7913043 - DNA, 22 bp, Homo sapiens
ttcttcaaaatccagcatgatt

SEQ ID NO: 7913044 - DNA, 23 bp, Homo sapiens
ttcttatttactttggaatctcc

SEQ ID NO: 7913045 - DNA, 22 bp, Homo sapiens
ttcttatttcccccttcatcat

SEQ ID NO: 7913046 - DNA, 22 bp, Homo sapiens
ttcttattttcctgaggaagaa

SEQ ID NO: 7913047 - DNA, 22 bp, Homo sapiens
ttcttattcttgaaatgtggga

SEQ ID NO: 7913048 - DNA, 22 bp, Homo sapiens
ttcttattcttgaaatgtggga

SEQ ID NO: 7913049 - DNA, 22 bp, Homo sapiens
ttcttattgggagaccttttct

SEQ ID NO: 7913050 - DNA, 22 bp, Homo sapiens
ttcttattatgtgctctgtgaa

SEQ ID NO: 7913051 - DNA, 22 bp, Homo sapiens
ttcttcaaagtccttattcctt

SEQ ID NO: 7913052 - DNA, 22 bp, Homo sapiens
ttcttcaacaaggacactgtta

SEQ ID NO: 7913053 - DNA, 22 bp, Homo sapiens
ttcttcaaccatctacataaac

SEQ ID NO: 7913054 - DNA, 22 bp, Homo sapiens
ttcttcaaccatctacataaac

SEQ ID NO: 7913055 - DNA, 22 bp, Homo sapiens
ttcttcagactactgatgattg

SEQ ID NO: 7913056 - DNA, 22 bp, Homo sapiens
ttctttggtgggagattgaggt

SEQ ID NO: 7913057 - DNA, 22 bp, Homo sapiens
ttctttggtgggagattgaggt

SEQ ID NO: 7913058 - DNA, 22 bp, Homo sapiens
ttcttcaattttccatatactg

SEQ ID NO: 7913059 - DNA, 22 bp, Homo sapiens
ttcttcaattttccatatactg

SEQ ID NO: 7913060 - DNA, 22 bp, Homo sapiens
ttcttcaatgtgccctgttttc

SEQ ID NO: 7913061 - DNA, 22 bp, Homo sapiens
ttcttcaataaattcccataag

SEQ ID NO: 7913062 - DNA, 20 bp, Homo sapiens
ttctttgttccttacatttg

SEQ ID NO: 7913063 - DNA, 20 bp, Homo sapiens
ttctttgttccttacatttg

SEQ ID NO: 7913064 - DNA, 22 bp, Homo sapiens
ttctttgtggcagtgagctggg

SEQ ID NO: 7913065 - DNA, 22 bp, Homo sapiens
ttctttgttgagcaagtaggac

SEQ ID NO: 7913066 - DNA, 22 bp, Homo sapiens
ttctttgttgagcaagtaggac

SEQ ID NO: 7913067 - DNA, 20 bp, Homo sapiens
ttctttgttccttacatttg

SEQ ID NO: 7913068 - DNA, 20 bp, Homo sapiens
ttctttgttccttacatttg

SEQ ID NO: 7913069 - DNA, 22 bp, Homo sapiens
ttctttgttgtactttcctaca

SEQ ID NO: 7913070 - DNA, 22 bp, Homo sapiens
ttctttgttgtactttcctaca

SEQ ID NO: 7913071 - DNA, 22 bp, Homo sapiens
ttctttgtttgataagtatgct

SEQ ID NO: 7913072 - DNA, 22 bp, Homo sapiens
ttctttgtttgataagtatgct

SEQ ID NO: 7913073 - DNA, 19 bp, Homo sapiens
ttctttggtggtggtgacc

SEQ ID NO: 7913074 - DNA, 19 bp, Homo sapiens
ttctttggtggtggtgacc

SEQ ID NO: 7913075 - DNA, 19 bp, Homo sapiens
ttctttggtggtggtgacc

SEQ ID NO: 7913076 - DNA, 22 bp, Homo sapiens
ttctttggtgttacccagctca

SEQ ID NO: 7913077 - DNA, 19 bp, Homo sapiens
ttctttggtggtggtgacc

SEQ ID NO: 7913078 - DNA, 22 bp, Homo sapiens
ttctttggtgttacccagctca

SEQ ID NO: 7913079 - DNA, 22 bp, Homo sapiens
ttctttgtaacctttgggaact

SEQ ID NO: 7913080 - DNA, 22 bp, Homo sapiens
ttctttgtaaagccacagtcct

SEQ ID NO: 7913081 - DNA, 22 bp, Homo sapiens
ttctttgtaaagccacagtcct

SEQ ID NO: 7913082 - DNA, 22 bp, Homo sapiens
ttctttgtgcatccaattttct

SEQ ID NO: 7913083 - DNA, 22 bp, Homo sapiens
ttctttgtgctgaagaagccct

SEQ ID NO: 7913084 - DNA, 22 bp, Homo sapiens
ttctttgtagcaaaacgtgtat

SEQ ID NO: 7913085 - DNA, 22 bp, Homo sapiens
ttctttgtgcatccaattttct

SEQ ID NO: 7913086 - DNA, 23 bp, Homo sapiens
ttctttgtggataatctccagtg

SEQ ID NO: 7913087 - DNA, 23 bp, Homo sapiens
ttctttgtggataatctccagtg

SEQ ID NO: 7913088 - DNA, 22 bp, Homo sapiens
ttctttgtggcagtgagctggg

SEQ ID NO: 7913089 - DNA, 23 bp, Homo sapiens
ttctttgtggataatctccagtg

SEQ ID NO: 7913090 - DNA, 22 bp, Homo sapiens
ttcttttaatgttctgaagttt

SEQ ID NO: 7913091 - DNA, 17 bp, Homo sapiens
ttcttttctgagccttg

SEQ ID NO: 7913092 - DNA, 17 bp, Homo sapiens
ttcttttctgagccttg

SEQ ID NO: 7913093 - DNA, 22 bp, Homo sapiens
ttcttttctgcagctggtattt

SEQ ID NO: 7913094 - DNA, 22 bp, Homo sapiens
ttcttttctgcagctggtattt

SEQ ID NO: 7913095 - DNA, 22 bp, Homo sapiens
ttcttttcttggcaggagtaga

SEQ ID NO: 7913096 - DNA, 22 bp, Homo sapiens
ttcttttcttggcaggagtaga

SEQ ID NO: 7913097 - DNA, 22 bp, Homo sapiens
ttcttttctgcagctggtattt

SEQ ID NO: 7913098 - DNA, 22 bp, Homo sapiens
ttcttttctgcagctggtattt

SEQ ID NO: 7913099 - DNA, 22 bp, Homo sapiens
ttcttttaatgttctgaagttt

SEQ ID NO: 7913100 - DNA, 22 bp, Homo sapiens
ttcttttaatgtctggctttca

SEQ ID NO: 7913101 - DNA, 22 bp, Homo sapiens
ttgaacaatttggtatacaaac

SEQ ID NO: 7913102 - DNA, 22 bp, Homo sapiens
ttgaacaatttggtatacaaac

SEQ ID NO: 7913103 - DNA, 22 bp, Homo sapiens
ttgaacaatcaaaagaattcat

SEQ ID NO: 7913104 - DNA, 19 bp, Homo sapiens
ttgaaattgtttgatatgg

SEQ ID NO: 7913105 - DNA, 19 bp, Homo sapiens
ttgaaattgtttgatatgg

SEQ ID NO: 7913106 - DNA, 22 bp, Homo sapiens
ttgaacattaacttcagtctat

SEQ ID NO: 7913107 - DNA, 22 bp, Homo sapiens
ttgaacattaacttcagtctat

SEQ ID NO: 7913108 - DNA, 19 bp, Homo sapiens
ttgaacactttcttcaagg

SEQ ID NO: 7913109 - DNA, 22 bp, Homo sapiens
ttgaacagtcctaagagaccct

SEQ ID NO: 7913110 - DNA, 20 bp, Homo sapiens
ttgaaattggatggtagcta

SEQ ID NO: 7913111 - DNA, 22 bp, Homo sapiens
ttgaaatgtagtcctgccttca

SEQ ID NO: 7913112 - DNA, 22 bp, Homo sapiens
ttgaaatggcagcagctgacct

SEQ ID NO: 7913113 - DNA, 22 bp, Homo sapiens
ttgaaatggcagcagctgacct

SEQ ID NO: 7913114 - DNA, 22 bp, Homo sapiens
ttgaaatggcagcagctgacct

SEQ ID NO: 7913115 - DNA, 22 bp, Homo sapiens
ttgaaatggcagcagctgacct

SEQ ID NO: 7913116 - DNA, 22 bp, Homo sapiens
ttgaaattgggtgtggctgtca

SEQ ID NO: 7913117 - DNA, 22 bp, Homo sapiens
ttgaaattgggtgtggctgtca

SEQ ID NO: 7913118 - DNA, 19 bp, Homo sapiens
ttgaaattgtttgatatgg

SEQ ID NO: 7913119 - DNA, 19 bp, Homo sapiens
ttgaaattgtttgatatgg

SEQ ID NO: 7913120 - DNA, 19 bp, Homo sapiens
ttgaaattgtttgatatgg

SEQ ID NO: 7913121 - DNA, 19 bp, Homo sapiens
ttgaaattgtttgatatgg

SEQ ID NO: 7913122 - DNA, 19 bp, Homo sapiens
ttgaaattgtttgatatgg

SEQ ID NO: 7913123 - DNA, 19 bp, Homo sapiens
ttgaaattgtttgatatgg

SEQ ID NO: 7913124 - DNA, 20 bp, Homo sapiens
ttgaaattggatggtagcta

SEQ ID NO: 7913125 - DNA, 23 bp, Homo sapiens
ttgaatttctcttgcaatattta

SEQ ID NO: 7913126 - DNA, 22 bp, Homo sapiens
ttgaatttagattgtatgttga

SEQ ID NO: 7913127 - DNA, 23 bp, Homo sapiens
ttgaatttctcttgcaatattta

SEQ ID NO: 7913128 - DNA, 22 bp, Homo sapiens
ttgaagaaagtcatatataatg

SEQ ID NO: 7913129 - DNA, 18 bp, Homo sapiens
ttgaattcttctacatgt

SEQ ID NO: 7913130 - DNA, 22 bp, Homo sapiens
ttgaattatttgtttgcaagct

SEQ ID NO: 7913131 - DNA, 22 bp, Homo sapiens
ttgaacattaacttcagtctat

SEQ ID NO: 7913132 - DNA, 22 bp, Homo sapiens
ttgaaccaggaacaattagctc

SEQ ID NO: 7913133 - DNA, 22 bp, Homo sapiens
ttgaacattggcaatttcatat

SEQ ID NO: 7913134 - DNA, 22 bp, Homo sapiens
ttgaactaataggtatcttgta

SEQ ID NO: 7913135 - DNA, 22 bp, Homo sapiens
ttgaactagaagctttggaact

SEQ ID NO: 7913136 - DNA, 22 bp, Homo sapiens
ttgaagaaagtcatatataatg

SEQ ID NO: 7913137 - DNA, 22 bp, Homo sapiens
ttgaactgtaagcatgtctgcc

SEQ ID NO: 7913138 - DNA, 22 bp, Homo sapiens
ttgaactggtagttggaaatct

SEQ ID NO: 7913139 - DNA, 22 bp, Homo sapiens
ttgaactgtaagcatgtctgcc

SEQ ID NO: 7913140 - DNA, 17 bp, Homo sapiens
ttgaactgctgagtcag

SEQ ID NO: 7913141 - DNA, 17 bp, Homo sapiens
ttgaactgctgagtcag

SEQ ID NO: 7913142 - DNA, 22 bp, Homo sapiens
ttgaaatcaccactagcatttg

SEQ ID NO: 7913143 - DNA, 22 bp, Homo sapiens
ttgaaatcaccactagcatttg

SEQ ID NO: 7913144 - DNA, 22 bp, Homo sapiens
ttgaaatcaggaaagttccagg

SEQ ID NO: 7913145 - DNA, 22 bp, Homo sapiens
ttgaaatcaccactagcatttg

SEQ ID NO: 7913146 - DNA, 22 bp, Homo sapiens
ttgaaatgaaatatttaagctc

SEQ ID NO: 7913147 - DNA, 22 bp, Homo sapiens
ttgaaatcttccacagcccaag

SEQ ID NO: 7913148 - DNA, 22 bp, Homo sapiens
ttgaaagggatatatctttctg

SEQ ID NO: 7913149 - DNA, 22 bp, Homo sapiens
ttgaaatgagcaaactgtcagc

SEQ ID NO: 7913150 - DNA, 22 bp, Homo sapiens
ttgaaatgagcaaactgtcagc

SEQ ID NO: 7913151 - DNA, 22 bp, Homo sapiens
ttgaaatgagcaaactgtcagc

SEQ ID NO: 7913152 - DNA, 22 bp, Homo sapiens
ttgaaatgatctatttcagtag

SEQ ID NO: 7913153 - DNA, 22 bp, Homo sapiens
ttgaaatgatctatttcagtag

SEQ ID NO: 7913154 - DNA, 22 bp, Homo sapiens
ttgaaatgagactaattgattg

SEQ ID NO: 7913155 - DNA, 22 bp, Homo sapiens
ttgaaatggaagtgaaaattct

SEQ ID NO: 7913156 - DNA, 22 bp, Homo sapiens
ttgaaatgctctttggaatcta

SEQ ID NO: 7913157 - DNA, 22 bp, Homo sapiens
ttgaaatgcagattccaatcca

SEQ ID NO: 7913158 - DNA, 22 bp, Homo sapiens
ttgaaatgcagattccaatcca

SEQ ID NO: 7913159 - DNA, 22 bp, Homo sapiens
ttgaaatgcatcatcatttaga

SEQ ID NO: 7913160 - DNA, 22 bp, Homo sapiens
ttctttttaaagtgtgtatgca

SEQ ID NO: 7913161 - DNA, 22 bp, Homo sapiens
ttctttttaaagtgtgtatgca

SEQ ID NO: 7913162 - DNA, 22 bp, Homo sapiens
ttctttttaaagtgtgtatgca

SEQ ID NO: 7913163 - DNA, 22 bp, Homo sapiens
ttctttttaaagtgtgtatgca

SEQ ID NO: 7913164 - DNA, 22 bp, Homo sapiens
ttcttttggactcaaagagaac

SEQ ID NO: 7913165 - DNA, 22 bp, Homo sapiens
ttcttttggactcaaagagaac

SEQ ID NO: 7913166 - DNA, 22 bp, Homo sapiens
ttcttttggactcaaagagaac

SEQ ID NO: 7913167 - DNA, 22 bp, Homo sapiens
ttcttttgggaattacgtatgc

SEQ ID NO: 7913168 - DNA, 22 bp, Homo sapiens
ttcttttgggaattacgtatgc

SEQ ID NO: 7913169 - DNA, 22 bp, Homo sapiens
ttctttttaaagtgtgtatgca

SEQ ID NO: 7913170 - DNA, 22 bp, Homo sapiens
ttctttttaaagtgtgtatgca

SEQ ID NO: 7913171 - DNA, 22 bp, Homo sapiens
ttctttttaaagtgtgtatgca

SEQ ID NO: 7913172 - DNA, 22 bp, Homo sapiens
ttctttttaaagtgtgtatgca

SEQ ID NO: 7913173 - DNA, 22 bp, Homo sapiens
ttcttttctttaggcattgtgt

SEQ ID NO: 7913174 - DNA, 22 bp, Homo sapiens
ttcttttctttaggcattgtgt

SEQ ID NO: 7913175 - DNA, 22 bp, Homo sapiens
ttcttttcttggcaggagtaga

SEQ ID NO: 7913176 - DNA, 22 bp, Homo sapiens
ttcttttctttaggcattgtgt

SEQ ID NO: 7913177 - DNA, 22 bp, Homo sapiens
ttcttttcttggcaggagtaga

SEQ ID NO: 7913178 - DNA, 22 bp, Homo sapiens
ttcttttgcaagactattgatt

SEQ ID NO: 7913179 - DNA, 22 bp, Homo sapiens
ttcttttggactcaaagagaac

SEQ ID NO: 7913180 - DNA, 22 bp, Homo sapiens
ttcttttgcaagactattgatt

SEQ ID NO: 7913181 - DNA, 22 bp, Homo sapiens
ttcttttggactcaaagagaac

SEQ ID NO: 7913182 - DNA, 22 bp, Homo sapiens
ttcttttgcaagactattgatt

SEQ ID NO: 7913183 - DNA, 20 bp, Homo sapiens
ttcttttgataagcttgaca

SEQ ID NO: 7913184 - DNA, 20 bp, Homo sapiens
ttcttttgataagcttgaca

SEQ ID NO: 7913185 - DNA, 20 bp, Homo sapiens
ttcttttgataagcttgaca

SEQ ID NO: 7913186 - DNA, 20 bp, Homo sapiens
ttcttttgataagcttgaca

SEQ ID NO: 7913187 - DNA, 22 bp, Homo sapiens
ttcctggggcgactgtatctga

SEQ ID NO: 7913188 - DNA, 22 bp, Homo sapiens
ttcctggctcacagcagtgggg

SEQ ID NO: 7913189 - DNA, 22 bp, Homo sapiens
ttcctggctcacagcagtgggg

SEQ ID NO: 7913190 - DNA, 21 bp, Homo sapiens
ttcctggcggcagaaacgtga

SEQ ID NO: 7913191 - DNA, 22 bp, Homo sapiens
ttcctggcctctctctgagcag

SEQ ID NO: 7913192 - DNA, 22 bp, Homo sapiens
ttcctggcctctctctgagcag

SEQ ID NO: 7913193 - DNA, 22 bp, Homo sapiens
ttcctggcctaaggtaggtgac

SEQ ID NO: 7913194 - DNA, 22 bp, Homo sapiens
ttcctggccagctgtggtgagt

SEQ ID NO: 7913195 - DNA, 22 bp, Homo sapiens
ttcctggccaagcagagtggaa

SEQ ID NO: 7913196 - DNA, 22 bp, Homo sapiens
ttcctggccaagcagagtggaa

SEQ ID NO: 7913197 - DNA, 22 bp, Homo sapiens
ttcctggcattatgggaggctg

SEQ ID NO: 7913198 - DNA, 22 bp, Homo sapiens
ttcctggcattatgggaggctg

SEQ ID NO: 7913199 - DNA, 22 bp, Homo sapiens
ttcctggcatagagagggcaca

SEQ ID NO: 7913200 - DNA, 22 bp, Homo sapiens
ttcctggcatagagagggcaca

SEQ ID NO: 7913201 - DNA, 22 bp, Homo sapiens
ttcctggcatagagagggcaca

SEQ ID NO: 7913202 - DNA, 22 bp, Homo sapiens
ttcctgcctacatgccttatgc

SEQ ID NO: 7913203 - DNA, 22 bp, Homo sapiens
ttcctgcctacatgccttatgc

SEQ ID NO: 7913204 - DNA, 22 bp, Homo sapiens
ttcctgcatggattgaggctat

SEQ ID NO: 7913205 - DNA, 22 bp, Homo sapiens
ttcctgcccctgagagctccca

SEQ ID NO: 7913206 - DNA, 22 bp, Homo sapiens
ttcctggaaattatgctcacct

SEQ ID NO: 7913207 - DNA, 22 bp, Homo sapiens
ttcctggaaattatgctcacct

SEQ ID NO: 7913208 - DNA, 22 bp, Homo sapiens
ttcctgcttcctggcctcacaa

SEQ ID NO: 7913209 - DNA, 22 bp, Homo sapiens
ttcctgctccatttgctgagct

SEQ ID NO: 7913210 - DNA, 22 bp, Homo sapiens
ttcctgctccatttgctgagct

SEQ ID NO: 7913211 - DNA, 22 bp, Homo sapiens
ttcctgcgcccttctcgcccgc

SEQ ID NO: 7913212 - DNA, 22 bp, Homo sapiens
ttcctggcaccaccacttctag

SEQ ID NO: 7913213 - DNA, 22 bp, Homo sapiens
ttcctggcaccctggacccggc

SEQ ID NO: 7913214 - DNA, 22 bp, Homo sapiens
ttcctggcacatagttagtgct

SEQ ID NO: 7913215 - DNA, 22 bp, Homo sapiens
ttcctggcacactcctgaatgt

SEQ ID NO: 7913216 - DNA, 22 bp, Homo sapiens
ttcctggcaaagtgagcatcac

SEQ ID NO: 7913217 - DNA, 22 bp, Homo sapiens
ttcctggagagttttcccaaag

SEQ ID NO: 7913218 - DNA, 22 bp, Homo sapiens
ttcctggagagttttcccaaag

SEQ ID NO: 7913219 - DNA, 17 bp, Homo sapiens
ttcctggaagtcattcc

SEQ ID NO: 7913220 - DNA, 22 bp, Homo sapiens
ttcctgagaacatggcagctta

SEQ ID NO: 7913221 - DNA, 22 bp, Homo sapiens
ttcctgagaccctcacagtgat

SEQ ID NO: 7913222 - DNA, 22 bp, Homo sapiens
ttcctgagaccctcacagtgat

SEQ ID NO: 7913223 - DNA, 22 bp, Homo sapiens
ttcctgagaacatggcagctta

SEQ ID NO: 7913224 - DNA, 22 bp, Homo sapiens
ttcctgagcaccagacactgca

SEQ ID NO: 7913225 - DNA, 22 bp, Homo sapiens
ttcctgagaccctcacagtgat

SEQ ID NO: 7913226 - DNA, 22 bp, Homo sapiens
ttcctgagaaatttgtacctgg

SEQ ID NO: 7913227 - DNA, 22 bp, Homo sapiens
ttcctgagaaatttgtacctgg

SEQ ID NO: 7913228 - DNA, 22 bp, Homo sapiens
ttcctgagaacatggcagctta

SEQ ID NO: 7913229 - DNA, 22 bp, Homo sapiens
ttcctgagaacatggcagctta

SEQ ID NO: 7913230 - DNA, 22 bp, Homo sapiens
ttcctgagaaatttgtacctgg

SEQ ID NO: 7913231 - DNA, 22 bp, Homo sapiens
ttcctgagaaatttgtacctgg

SEQ ID NO: 7913232 - DNA, 22 bp, Homo sapiens
ttcctgaatcccaaggagagct

SEQ ID NO: 7913233 - DNA, 22 bp, Homo sapiens
ttcctgaatcccaaggagagct

SEQ ID NO: 7913234 - DNA, 22 bp, Homo sapiens
ttcctgaatcccaaggagagct

SEQ ID NO: 7913235 - DNA, 22 bp, Homo sapiens
ttcctgaatgctgttgtgctgt

SEQ ID NO: 7913236 - DNA, 17 bp, Homo sapiens
ttccagtttagtattgt

SEQ ID NO: 7913237 - DNA, 22 bp, Homo sapiens
ttccagttgtcataaagctagg

SEQ ID NO: 7913238 - DNA, 22 bp, Homo sapiens
ttcctgaatataaagacactag

SEQ ID NO: 7913239 - DNA, 22 bp, Homo sapiens
ttccagttggagcctgccttta

SEQ ID NO: 7913240 - DNA, 22 bp, Homo sapiens
ttccagttggtagaatgtaagg

SEQ ID NO: 7913241 - DNA, 22 bp, Homo sapiens
ttccagttctggctttgccact

SEQ ID NO: 7913242 - DNA, 22 bp, Homo sapiens
ttccagttctggctttgccact

SEQ ID NO: 7913243 - DNA, 22 bp, Homo sapiens
ttccagttcttctgtaagcact

SEQ ID NO: 7913244 - DNA, 22 bp, Homo sapiens
ttcctgagggccccagaggagg

SEQ ID NO: 7913245 - DNA, 22 bp, Homo sapiens
ttcctgagggccccagaggagg

SEQ ID NO: 7913246 - DNA, 22 bp, Homo sapiens
ttcctgagggccccagaggagg

SEQ ID NO: 7913247 - DNA, 22 bp, Homo sapiens
ttcctgagtcccgggtaaagat

SEQ ID NO: 7913248 - DNA, 22 bp, Homo sapiens
ttcctgaggtgattctaatgtg

SEQ ID NO: 7913249 - DNA, 22 bp, Homo sapiens
ttcctgaggtgattctaatgtg

SEQ ID NO: 7913250 - DNA, 22 bp, Homo sapiens
ttcctgagggacttttgagatt

SEQ ID NO: 7913251 - DNA, 22 bp, Homo sapiens
ttcctgagggacttttgagatt

SEQ ID NO: 7913252 - DNA, 22 bp, Homo sapiens
ttcctgaggctcatcggagtcg

SEQ ID NO: 7913253 - DNA, 22 bp, Homo sapiens
ttcctgaggaggaccaggacca

SEQ ID NO: 7913254 - DNA, 22 bp, Homo sapiens
ttcctgagcaccagacactgca

SEQ ID NO: 7913255 - DNA, 22 bp, Homo sapiens
ttcctgaggaggaccaggacca

SEQ ID NO: 7913256 - DNA, 22 bp, Homo sapiens
ttcctgagcttttaacctagtc

SEQ ID NO: 7913257 - DNA, 22 bp, Homo sapiens
ttcctgaggaggaccaggacca

SEQ ID NO: 7913258 - DNA, 22 bp, Homo sapiens
ttcctgagtcgccgagtctatg

SEQ ID NO: 7913259 - DNA, 22 bp, Homo sapiens
ttcctgagtcgccgagtctatg

SEQ ID NO: 7913260 - DNA, 22 bp, Homo sapiens
ttcctgagtcgccgagtctatg

SEQ ID NO: 7913261 - DNA, 23 bp, Homo sapiens
ttcctgagtgctggagagagtgc

SEQ ID NO: 7913262 - DNA, 22 bp, Homo sapiens
ttcctgatagaacactttccaa

SEQ ID NO: 7913263 - DNA, 22 bp, Homo sapiens
ttcctgataatgagattttccc

SEQ ID NO: 7913264 - DNA, 22 bp, Homo sapiens
ttcctgatagaacactttccaa

SEQ ID NO: 7913265 - DNA, 22 bp, Homo sapiens
ttcctgatcaggttcccatgtg

SEQ ID NO: 7913266 - DNA, 22 bp, Homo sapiens
ttcctgataatgagattttccc

SEQ ID NO: 7913267 - DNA, 22 bp, Homo sapiens
ttcctgatcccccaggacaaag

SEQ ID NO: 7913268 - DNA, 18 bp, Homo sapiens
ttcctgatcctctgctga

SEQ ID NO: 7913269 - DNA, 22 bp, Homo sapiens
ttcctgatcccccaggacaaag

SEQ ID NO: 7913270 - DNA, 22 bp, Homo sapiens
ttcctgcacagttaagtgctca

SEQ ID NO: 7913271 - DNA, 22 bp, Homo sapiens
ttcctgcagcaaggagaagctg

SEQ ID NO: 7913272 - DNA, 22 bp, Homo sapiens
ttcctgcacagcccttcctgag

SEQ ID NO: 7913273 - DNA, 22 bp, Homo sapiens
ttcctgatgcacacagtcattt

SEQ ID NO: 7913274 - DNA, 22 bp, Homo sapiens
ttcctgatgcacacagtcattt

SEQ ID NO: 7913275 - DNA, 22 bp, Homo sapiens
ttcctgcaaagccagatgtcga

SEQ ID NO: 7913276 - DNA, 20 bp, Homo sapiens
ttcctgattgtcatttctgc

SEQ ID NO: 7913277 - DNA, 22 bp, Homo sapiens
ttcctgattttgatagcggggc

SEQ ID NO: 7913278 - DNA, 22 bp, Homo sapiens
ttcctgggtggtcctggtagag

SEQ ID NO: 7913279 - DNA, 19 bp, Homo sapiens
ttcctggggttccattgtg

SEQ ID NO: 7913280 - DNA, 22 bp, Homo sapiens
ttcctgggttgtgcattgtaca

SEQ ID NO: 7913281 - DNA, 22 bp, Homo sapiens
ttcctgggttccctctcattct

SEQ ID NO: 7913282 - DNA, 22 bp, Homo sapiens
ttcctggggcttagcaatggag

SEQ ID NO: 7913283 - DNA, 22 bp, Homo sapiens
ttcctgggggcagcagtcttga

SEQ ID NO: 7913284 - DNA, 22 bp, Homo sapiens
ttcctgggggcagcagtcttga

SEQ ID NO: 7913285 - DNA, 22 bp, Homo sapiens
ttcctggggtactggagaaaat

SEQ ID NO: 7913286 - DNA, 22 bp, Homo sapiens
ttcctggggtgaagatattttt

SEQ ID NO: 7913287 - DNA, 22 bp, Homo sapiens
ttcctggggtactggagaaaat

SEQ ID NO: 7913288 - DNA, 22 bp, Homo sapiens
ttcctggggtactggagaaaat

SEQ ID NO: 7913289 - DNA, 22 bp, Homo sapiens
ttcctggggggatagatttcac

SEQ ID NO: 7913290 - DNA, 22 bp, Homo sapiens
ttcctggtaacaatctcaaagt

SEQ ID NO: 7913291 - DNA, 22 bp, Homo sapiens
ttcctggtaaattatgtccagg

SEQ ID NO: 7913292 - DNA, 22 bp, Homo sapiens
ttcctggtaaattatgtccagg

SEQ ID NO: 7913293 - DNA, 22 bp, Homo sapiens
ttcctggtagtaagacatctgg

SEQ ID NO: 7913294 - DNA, 22 bp, Homo sapiens
ttcctggtctatttagaattgc

SEQ ID NO: 7913295 - DNA, 22 bp, Homo sapiens
ttcctggtctatttagaattgc

SEQ ID NO: 7913296 - DNA, 22 bp, Homo sapiens
ttcctggtctgtgccattcaga

SEQ ID NO: 7913297 - DNA, 22 bp, Homo sapiens
ttcctggtcctattatatacac

SEQ ID NO: 7913298 - DNA, 22 bp, Homo sapiens
ttcctggtcctattatatacac

SEQ ID NO: 7913299 - DNA, 22 bp, Homo sapiens
ttcctggtcccgttcttcactg

SEQ ID NO: 7913300 - DNA, 22 bp, Homo sapiens
ttcctggtgacctcactggtag

SEQ ID NO: 7913301 - DNA, 22 bp, Homo sapiens
ttcctggtgacctcactggtag

SEQ ID NO: 7913302 - DNA, 22 bp, Homo sapiens
ttcctggtgacctcactggtag

SEQ ID NO: 7913303 - DNA, 22 bp, Homo sapiens
ttcctggtgagatttcgttctg

SEQ ID NO: 7913304 - DNA, 22 bp, Homo sapiens
ttcctggtggctttgccaactg

SEQ ID NO: 7913305 - DNA, 22 bp, Homo sapiens
ttcctggtgacctcactggtag

SEQ ID NO: 7913306 - DNA, 22 bp, Homo sapiens
ttcctggtggtggtgacagcac

SEQ ID NO: 7913307 - DNA, 22 bp, Homo sapiens
ttcctggtttatggaaagcatg

SEQ ID NO: 7913308 - DNA, 22 bp, Homo sapiens
ttcctgtagttgtgcaatgtac

SEQ ID NO: 7913309 - DNA, 22 bp, Homo sapiens
ttcctggttggattctgattaa

SEQ ID NO: 7913310 - DNA, 22 bp, Homo sapiens
ttcctggtttatggaaagcatg

SEQ ID NO: 7913311 - DNA, 22 bp, Homo sapiens
ttcctggtttatacctgtatca

SEQ ID NO: 7913312 - DNA, 22 bp, Homo sapiens
ttccttcttttacaccataaat

SEQ ID NO: 7913313 - DNA, 22 bp, Homo sapiens
ttccttcttttacaccataaat

SEQ ID NO: 7913314 - DNA, 22 bp, Homo sapiens
ttccttctttgtggtagaaagt

SEQ ID NO: 7913315 - DNA, 22 bp, Homo sapiens
ttccttctttgtggtagaaagt

SEQ ID NO: 7913316 - DNA, 22 bp, Homo sapiens
ttccttcttttacaccataaat

SEQ ID NO: 7913317 - DNA, 22 bp, Homo sapiens
ttccttgaaagctggacatggg

SEQ ID NO: 7913318 - DNA, 22 bp, Homo sapiens
ttccttgaaagtttgaactgac

SEQ ID NO: 7913319 - DNA, 22 bp, Homo sapiens
ttccttgaaagtttgaactgac

SEQ ID NO: 7913320 - DNA, 22 bp, Homo sapiens
ttccttgaatgagtcatggaaa

SEQ ID NO: 7913321 - DNA, 22 bp, Homo sapiens
ttccttgaccactgcataatga

SEQ ID NO: 7913322 - DNA, 22 bp, Homo sapiens
ttccttgagaaaggcacaagtt

SEQ ID NO: 7913323 - DNA, 22 bp, Homo sapiens
ttccttgagaaaggcacaagtt

SEQ ID NO: 7913324 - DNA, 22 bp, Homo sapiens
ttccttgagaaaggcacaagtt

SEQ ID NO: 7913325 - DNA, 22 bp, Homo sapiens
ttccttgagaaaggcacaagtt

SEQ ID NO: 7913326 - DNA, 22 bp, Homo sapiens
ttccttgagatgactgtcttgt

SEQ ID NO: 7913327 - DNA, 18 bp, Homo sapiens
ttccttgattagagagaa

SEQ ID NO: 7913328 - DNA, 22 bp, Homo sapiens
ttccttggaagggtaattgcaa

SEQ ID NO: 7913329 - DNA, 22 bp, Homo sapiens
ttccttggaaagagacgtcgct

SEQ ID NO: 7913330 - DNA, 22 bp, Homo sapiens
ttccttggagcgctaaagctct

SEQ ID NO: 7913331 - DNA, 22 bp, Homo sapiens
ttccttgccctctgggatcttg

SEQ ID NO: 7913332 - DNA, 18 bp, Homo sapiens
ttccttgattagagagaa

SEQ ID NO: 7913333 - DNA, 22 bp, Homo sapiens
ttccttgattagtacatgaagg

SEQ ID NO: 7913334 - DNA, 22 bp, Homo sapiens
ttccttggccacactggtgctt

SEQ ID NO: 7913335 - DNA, 22 bp, Homo sapiens
ttccttggccccatgcccaggg

SEQ ID NO: 7913336 - DNA, 22 bp, Homo sapiens
ttccttggccccatgcccaggg

SEQ ID NO: 7913337 - DNA, 22 bp, Homo sapiens
ttccttggccacactggtgctt

SEQ ID NO: 7913338 - DNA, 22 bp, Homo sapiens
ttccttggagtcaaacagggag

SEQ ID NO: 7913339 - DNA, 22 bp, Homo sapiens
ttccttctggaggctccagggg

SEQ ID NO: 7913340 - DNA, 22 bp, Homo sapiens
ttccttctggaggctccagggg

SEQ ID NO: 7913341 - DNA, 22 bp, Homo sapiens
ttccttctggaggctccagggg

SEQ ID NO: 7913342 - DNA, 22 bp, Homo sapiens
ttccttcttcattgtgttacag

SEQ ID NO: 7913343 - DNA, 22 bp, Homo sapiens
ttccttcttcattgtgttacag

SEQ ID NO: 7913344 - DNA, 22 bp, Homo sapiens
ttccttctggagcccggggagc

SEQ ID NO: 7913345 - DNA, 22 bp, Homo sapiens
ttccttctggaagcttcagggg

SEQ ID NO: 7913346 - DNA, 22 bp, Homo sapiens
ttccttctggaagcttcagggg

SEQ ID NO: 7913347 - DNA, 22 bp, Homo sapiens
ttcctgtatctgcttcttacta

SEQ ID NO: 7913348 - DNA, 22 bp, Homo sapiens
ttcctgtagttgtgcaatgtac

SEQ ID NO: 7913349 - DNA, 20 bp, Homo sapiens
ttcctgtatacaaagagttc

SEQ ID NO: 7913350 - DNA, 22 bp, Homo sapiens
ttccttcttgtaatgatctgcc

SEQ ID NO: 7913351 - DNA, 22 bp, Homo sapiens
ttccttcttgtaatgatctgcc

SEQ ID NO: 7913352 - DNA, 22 bp, Homo sapiens
ttccttcttccagaggctgccc

SEQ ID NO: 7913353 - DNA, 22 bp, Homo sapiens
ttccttcttgtaatgatctgcc

SEQ ID NO: 7913354 - DNA, 22 bp, Homo sapiens
ttccttcttccagaggctgccc

SEQ ID NO: 7913355 - DNA, 22 bp, Homo sapiens
ttccttcttcctttagtaacca

SEQ ID NO: 7913356 - DNA, 22 bp, Homo sapiens
ttccttcttcctttagtaacca

SEQ ID NO: 7913357 - DNA, 22 bp, Homo sapiens
ttccttcttccagaggctgccc

SEQ ID NO: 7913358 - DNA, 22 bp, Homo sapiens
ttccttcttccagaggctgccc

SEQ ID NO: 7913359 - DNA, 22 bp, Homo sapiens
ttccttcttccaaacccatcat

SEQ ID NO: 7913360 - DNA, 22 bp, Homo sapiens
ttccttcttccaaacccatcat

SEQ ID NO: 7913361 - DNA, 22 bp, Homo sapiens
ttccttcttccaaacccatcat

SEQ ID NO: 7913362 - DNA, 22 bp, Homo sapiens
ttccttggtagggacaactctg

SEQ ID NO: 7913363 - DNA, 22 bp, Homo sapiens
ttccttggtacagagtagcttt

SEQ ID NO: 7913364 - DNA, 22 bp, Homo sapiens
ttccttggtacagagtagcttt

SEQ ID NO: 7913365 - DNA, 22 bp, Homo sapiens
ttccttggtacagagtagcttt

SEQ ID NO: 7913366 - DNA, 22 bp, Homo sapiens
ttccttggtgcgcctgctgcag

SEQ ID NO: 7913367 - DNA, 22 bp, Homo sapiens
ttccttggtgtaactgctccta

SEQ ID NO: 7913368 - DNA, 22 bp, Homo sapiens
ttccttgggtgcctacttagag

SEQ ID NO: 7913369 - DNA, 17 bp, Homo sapiens
ttccttgggtgctgggt

SEQ ID NO: 7913370 - DNA, 18 bp, Homo sapiens
ttccttggtaacatatgc

SEQ ID NO: 7913371 - DNA, 22 bp, Homo sapiens
ttccttgggttctgatgtgttt

SEQ ID NO: 7913372 - DNA, 21 bp, Homo sapiens
ttctcagatcgagtagtgaga

SEQ ID NO: 7913373 - DNA, 21 bp, Homo sapiens
ttctcagatcgagtagtgaga

SEQ ID NO: 7913374 - DNA, 21 bp, Homo sapiens
ttctcagatcgagtagtgaga

SEQ ID NO: 7913375 - DNA, 22 bp, Homo sapiens
ttctcagatccatcagaagtcc

SEQ ID NO: 7913376 - DNA, 21 bp, Homo sapiens
ttctcagatcgagtagtgaga

SEQ ID NO: 7913377 - DNA, 22 bp, Homo sapiens
ttccttgttctacatccctgcc

SEQ ID NO: 7913378 - DNA, 22 bp, Homo sapiens
ttctcagatccatcagaagtcc

SEQ ID NO: 7913379 - DNA, 22 bp, Homo sapiens
ttccttgtaagacctatttttg

SEQ ID NO: 7913380 - DNA, 22 bp, Homo sapiens
ttccttgtggaaactatggacg

SEQ ID NO: 7913381 - DNA, 22 bp, Homo sapiens
ttccttgtggaaactatggacg

SEQ ID NO: 7913382 - DNA, 22 bp, Homo sapiens
ttccttgtggaaactatggacg

SEQ ID NO: 7913383 - DNA, 22 bp, Homo sapiens
ttccttgtgagggctctcttcc

SEQ ID NO: 7913384 - DNA, 22 bp, Homo sapiens
ttccttgtgtaaactctccatc

SEQ ID NO: 7913385 - DNA, 22 bp, Homo sapiens
ttccttgtgtaaactctccatc

SEQ ID NO: 7913386 - DNA, 22 bp, Homo sapiens
ttccttgtggaaactatggacg

SEQ ID NO: 7913387 - DNA, 22 bp, Homo sapiens
ttccttgttaatagtgtctgga

SEQ ID NO: 7913388 - DNA, 22 bp, Homo sapiens
ttccttgttcctaggagatcaa

SEQ ID NO: 7913389 - DNA, 22 bp, Homo sapiens
ttccttgttaatagtgtctgga

SEQ ID NO: 7913390 - DNA, 22 bp, Homo sapiens
ttctcaggcccctgcctggact

SEQ ID NO: 7913391 - DNA, 23 bp, Homo sapiens
ttctcaggagcccccaggtcagg

SEQ ID NO: 7913392 - DNA, 22 bp, Homo sapiens
ttctcaggaactcagtgtcagc

SEQ ID NO: 7913393 - DNA, 22 bp, Homo sapiens
ttctcaggactcctgcctgctt

SEQ ID NO: 7913394 - DNA, 22 bp, Homo sapiens
ttctcaggaactcagtgtcagc

SEQ ID NO: 7913395 - DNA, 22 bp, Homo sapiens
ttctcaggaactcagtgtcagc

SEQ ID NO: 7913396 - DNA, 22 bp, Homo sapiens
ttctcaggaactcagtgtcagc

SEQ ID NO: 7913397 - DNA, 22 bp, Homo sapiens
ttctcagattccccttttaata

SEQ ID NO: 7913398 - DNA, 22 bp, Homo sapiens
ttctcagctttccttgcagtta

SEQ ID NO: 7913399 - DNA, 22 bp, Homo sapiens
ttctcagctttccttgcagtta

SEQ ID NO: 7913400 - DNA, 22 bp, Homo sapiens
ttctcagatgattcagataaac

SEQ ID NO: 7913401 - DNA, 22 bp, Homo sapiens
ttctcagatgattcagataaac

SEQ ID NO: 7913402 - DNA, 22 bp, Homo sapiens
ttctcagatgattcagataaac

SEQ ID NO: 7913403 - DNA, 22 bp, Homo sapiens
ttctcagatgattcagataaac

SEQ ID NO: 7913404 - DNA, 22 bp, Homo sapiens
ttctcagggtctggatggcctg

SEQ ID NO: 7913405 - DNA, 22 bp, Homo sapiens
ttctcagggtagaggtgacact

SEQ ID NO: 7913406 - DNA, 22 bp, Homo sapiens
ttctcagggtctggatggcctg

SEQ ID NO: 7913407 - DNA, 22 bp, Homo sapiens
ttctcagggtctggatggcctg

SEQ ID NO: 7913408 - DNA, 22 bp, Homo sapiens
ttctcagggtagaggtgacact

SEQ ID NO: 7913409 - DNA, 22 bp, Homo sapiens
ttctcagggtctggatggcctg

SEQ ID NO: 7913410 - DNA, 22 bp, Homo sapiens
ttctcagggccctgtgttagct

SEQ ID NO: 7913411 - DNA, 22 bp, Homo sapiens
ttctcagggcatctcatgaccc

SEQ ID NO: 7913412 - DNA, 22 bp, Homo sapiens
ttctcaggctgtggagccgtct

SEQ ID NO: 7913413 - DNA, 22 bp, Homo sapiens
ttctcaggcctttgggatggga

SEQ ID NO: 7913414 - DNA, 22 bp, Homo sapiens
ttctcaggcctttgggatggga

SEQ ID NO: 7913415 - DNA, 22 bp, Homo sapiens
ttctcaggcctttgggatggga

SEQ ID NO: 7913416 - DNA, 22 bp, Homo sapiens
ttctcaggcccctgcctggact

SEQ ID NO: 7913417 - DNA, 22 bp, Homo sapiens
ttctccagaccctcctgcagac

SEQ ID NO: 7913418 - DNA, 22 bp, Homo sapiens
ttctccagaccactgcctctgt

SEQ ID NO: 7913419 - DNA, 22 bp, Homo sapiens
ttctccagaccactgcctctgt

SEQ ID NO: 7913420 - DNA, 22 bp, Homo sapiens
ttctccagaccactgcctctgt

SEQ ID NO: 7913421 - DNA, 22 bp, Homo sapiens
ttctccagaccactgcctctgt

SEQ ID NO: 7913422 - DNA, 22 bp, Homo sapiens
ttctccagaccactgcctctgt

SEQ ID NO: 7913423 - DNA, 22 bp, Homo sapiens
ttctccagaccctcctgcagac

SEQ ID NO: 7913424 - DNA, 22 bp, Homo sapiens
ttctccagaccctcctgcagac

SEQ ID NO: 7913425 - DNA, 22 bp, Homo sapiens
ttctccagaccttgtgactatg

SEQ ID NO: 7913426 - DNA, 22 bp, Homo sapiens
ttctccagaccttgtgactatg

SEQ ID NO: 7913427 - DNA, 22 bp, Homo sapiens
ttctccagaccttgtgactatg

SEQ ID NO: 7913428 - DNA, 22 bp, Homo sapiens
ttctccagagggctctgcagga

SEQ ID NO: 7913429 - DNA, 22 bp, Homo sapiens
ttctccagagggctctgcagga

SEQ ID NO: 7913430 - DNA, 22 bp, Homo sapiens
ttctctaagagttatatgaatt

SEQ ID NO: 7913431 - DNA, 22 bp, Homo sapiens
ttctctaagagttatatgaatt

SEQ ID NO: 7913432 - DNA, 22 bp, Homo sapiens
ttctctaagagatgcagaagtt

SEQ ID NO: 7913433 - DNA, 23 bp, Homo sapiens
ttctcctgaggaagcagggactg

SEQ ID NO: 7913434 - DNA, 22 bp, Homo sapiens
ttctcctgagttcccaggtcta

SEQ ID NO: 7913435 - DNA, 22 bp, Homo sapiens
ttctccagagggctctgcagga

SEQ ID NO: 7913436 - DNA, 22 bp, Homo sapiens
ttctccagagggctctgcagga

SEQ ID NO: 7913437 - DNA, 22 bp, Homo sapiens
ttctccagagggctctgcagga

SEQ ID NO: 7913438 - DNA, 22 bp, Homo sapiens
ttctccagaggtggctagagtt

SEQ ID NO: 7913439 - DNA, 22 bp, Homo sapiens
ttctcctctgttggccttccct

SEQ ID NO: 7913440 - DNA, 22 bp, Homo sapiens
ttctcctctgttggccttccct

SEQ ID NO: 7913441 - DNA, 22 bp, Homo sapiens
ttctcaggtcaccagggtgcca

SEQ ID NO: 7913442 - DNA, 22 bp, Homo sapiens
ttctcaggtcaccagggtgcca

SEQ ID NO: 7913443 - DNA, 22 bp, Homo sapiens
ttctcaggtcaccagggtgcca

SEQ ID NO: 7913444 - DNA, 22 bp, Homo sapiens
ttctcaggtagtgctgatgctg

SEQ ID NO: 7913445 - DNA, 22 bp, Homo sapiens
ttctccaagatgaagctgtgta

SEQ ID NO: 7913446 - DNA, 22 bp, Homo sapiens
ttctccaagatgaagctgtgta

SEQ ID NO: 7913447 - DNA, 22 bp, Homo sapiens
ttctcaggtagtgctgatgctg

SEQ ID NO: 7913448 - DNA, 22 bp, Homo sapiens
ttctcaggtagtgctgatgctg

SEQ ID NO: 7913449 - DNA, 22 bp, Homo sapiens
ttctcagggtttgtgcaggctt

SEQ ID NO: 7913450 - DNA, 22 bp, Homo sapiens
ttctcagggtctggatggcctg

SEQ ID NO: 7913451 - DNA, 22 bp, Homo sapiens
ttctcagggtcttgtgcaaggg

SEQ ID NO: 7913452 - DNA, 22 bp, Homo sapiens
ttctcagggtcttgtgcaaggg

SEQ ID NO: 7913453 - DNA, 22 bp, Homo sapiens
ttctcagggtcttgtgcaaggg

SEQ ID NO: 7913454 - DNA, 22 bp, Homo sapiens
ttctccaagtagaagctaagtt

SEQ ID NO: 7913455 - DNA, 22 bp, Homo sapiens
ttctccaagtagaagctaagtt

SEQ ID NO: 7913456 - DNA, 22 bp, Homo sapiens
ttctccaaggttcatatttatc

SEQ ID NO: 7913457 - DNA, 20 bp, Homo sapiens
ttctccacagggtggaggag

SEQ ID NO: 7913458 - DNA, 22 bp, Homo sapiens
ttctccaatagctgctcatggc

SEQ ID NO: 7913459 - DNA, 22 bp, Homo sapiens
ttctccaatagctgctcatggc

SEQ ID NO: 7913460 - DNA, 22 bp, Homo sapiens
ttctccaagggatttctgcctt

SEQ ID NO: 7913461 - DNA, 22 bp, Homo sapiens
ttctccaaggatacagtcctgt

SEQ ID NO: 7913462 - DNA, 22 bp, Homo sapiens
ttctccaagggatttctgcctt

SEQ ID NO: 7913463 - DNA, 22 bp, Homo sapiens
ttctccaaggatacagtcctgt

SEQ ID NO: 7913464 - DNA, 22 bp, Homo sapiens
ttctccaaggatacagtcctgt

SEQ ID NO: 7913465 - DNA, 18 bp, Homo sapiens
ttctccagaaaacatagc

SEQ ID NO: 7913466 - DNA, 18 bp, Homo sapiens
ttctccagaaaacatagc

SEQ ID NO: 7913467 - DNA, 22 bp, Homo sapiens
ttctccacccactcttttgttg

SEQ ID NO: 7913468 - DNA, 22 bp, Homo sapiens
ttctccacatggtgtgctgtga

SEQ ID NO: 7913469 - DNA, 22 bp, Homo sapiens
ttctccagacaacagagggtga

SEQ ID NO: 7913470 - DNA, 22 bp, Homo sapiens
ttctccagacaacagagggtga

SEQ ID NO: 7913471 - DNA, 22 bp, Homo sapiens
ttctccagacacaaaatctaag

SEQ ID NO: 7913472 - DNA, 22 bp, Homo sapiens
ttctccagacacaaaatctaag

SEQ ID NO: 7913473 - DNA, 22 bp, Homo sapiens
ttctccagacacaaaatctaag

SEQ ID NO: 7913474 - DNA, 22 bp, Homo sapiens
ttctccagacaggcagagggaa

SEQ ID NO: 7913475 - DNA, 22 bp, Homo sapiens
ttctccagacaggcagagggaa

SEQ ID NO: 7913476 - DNA, 22 bp, Homo sapiens
ttctctgatcttgctagactga

SEQ ID NO: 7913477 - DNA, 22 bp, Homo sapiens
ttctctgatcttgctagactga

SEQ ID NO: 7913478 - DNA, 22 bp, Homo sapiens
ttctctgatcttgctagactga

SEQ ID NO: 7913479 - DNA, 22 bp, Homo sapiens
ttctctgagatagactaagtgg

SEQ ID NO: 7913480 - DNA, 22 bp, Homo sapiens
ttctctgacccccttaaatatt

SEQ ID NO: 7913481 - DNA, 22 bp, Homo sapiens
ttctctgacccccttaaatatt

SEQ ID NO: 7913482 - DNA, 22 bp, Homo sapiens
ttctctgaaggccatgctcact

SEQ ID NO: 7913483 - DNA, 22 bp, Homo sapiens
ttctctgagtacgtttcagtgt

SEQ ID NO: 7913484 - DNA, 17 bp, Homo sapiens
ttctctgagctgtattg

SEQ ID NO: 7913485 - DNA, 22 bp, Homo sapiens
ttctctgagatagactaagtgg

SEQ ID NO: 7913486 - DNA, 22 bp, Homo sapiens
ttctctggaactgaaacaagat

SEQ ID NO: 7913487 - DNA, 22 bp, Homo sapiens
ttctctggaactgaaacaagat

SEQ ID NO: 7913488 - DNA, 22 bp, Homo sapiens
ttctctggaactgaaacaagat

SEQ ID NO: 7913489 - DNA, 22 bp, Homo sapiens
ttctctggaactgaaacaagat

SEQ ID NO: 7913490 - DNA, 22 bp, Homo sapiens
ttctctgctctcacatacagaa

SEQ ID NO: 7913491 - DNA, 22 bp, Homo sapiens
ttctctggaaggctctacggga

SEQ ID NO: 7913492 - DNA, 22 bp, Homo sapiens
ttctctgctacatactagggct

SEQ ID NO: 7913493 - DNA, 22 bp, Homo sapiens
ttctctgctctcacatacagaa

SEQ ID NO: 7913494 - DNA, 22 bp, Homo sapiens
ttctctgcattgtaaagagcca

SEQ ID NO: 7913495 - DNA, 22 bp, Homo sapiens
ttctctgcctcacaggtctaag

SEQ ID NO: 7913496 - DNA, 22 bp, Homo sapiens
ttctctgaaggccatgctcact

SEQ ID NO: 7913497 - DNA, 22 bp, Homo sapiens
ttctctgaaggccatgctcact

SEQ ID NO: 7913498 - DNA, 22 bp, Homo sapiens
ttctctcttttgggtaggaggt

SEQ ID NO: 7913499 - DNA, 22 bp, Homo sapiens
ttctctgaaggccatgctcact

SEQ ID NO: 7913500 - DNA, 22 bp, Homo sapiens
ttctctcttccagttcccactt

SEQ ID NO: 7913501 - DNA, 22 bp, Homo sapiens
ttctctcttccagttcccactt

SEQ ID NO: 7913502 - DNA, 22 bp, Homo sapiens
ttctctcttactgccatgctgt

SEQ ID NO: 7913503 - DNA, 22 bp, Homo sapiens
ttctctcttccagttcccactt

SEQ ID NO: 7913504 - DNA, 22 bp, Homo sapiens
ttctctcttttgggtaggaggt

SEQ ID NO: 7913505 - DNA, 22 bp, Homo sapiens
ttctctcttactgccatgctgt

SEQ ID NO: 7913506 - DNA, 22 bp, Homo sapiens
ttctctcttactgccatgctgt

SEQ ID NO: 7913507 - DNA, 22 bp, Homo sapiens
ttctctctgttatggattttac

SEQ ID NO: 7913508 - DNA, 22 bp, Homo sapiens
ttctctcttactgccatgctgt

SEQ ID NO: 7913509 - DNA, 22 bp, Homo sapiens
ttctctcttactgccatgctgt

SEQ ID NO: 7913510 - DNA, 22 bp, Homo sapiens
ttctctctgtggtcccattttg

SEQ ID NO: 7913511 - DNA, 22 bp, Homo sapiens
ttctctctggacctgggatgcg

SEQ ID NO: 7913512 - DNA, 22 bp, Homo sapiens
ttctctctggacctgggatgcg

SEQ ID NO: 7913513 - DNA, 22 bp, Homo sapiens
ttctctctgtgtcattatggac

SEQ ID NO: 7913514 - DNA, 22 bp, Homo sapiens
ttctctctgtggtcccattttg

SEQ ID NO: 7913515 - DNA, 22 bp, Homo sapiens
ttctctctgtggtcccattttg

SEQ ID NO: 7913516 - DNA, 22 bp, Homo sapiens
ttctctagttttgacgaggatt

SEQ ID NO: 7913517 - DNA, 22 bp, Homo sapiens
ttctctatgtgtgttgtagttt

SEQ ID NO: 7913518 - DNA, 22 bp, Homo sapiens
ttctctagtgcaaattgtttga

SEQ ID NO: 7913519 - DNA, 22 bp, Homo sapiens
ttctctagttttgacgaggatt

SEQ ID NO: 7913520 - DNA, 22 bp, Homo sapiens
ttctctattacagaaatggaat

SEQ ID NO: 7913521 - DNA, 22 bp, Homo sapiens
ttctctaggagttctgggatca

SEQ ID NO: 7913522 - DNA, 22 bp, Homo sapiens
ttctctagcagatcataatgaa

SEQ ID NO: 7913523 - DNA, 22 bp, Homo sapiens
ttctctaggttttagatgaaga

SEQ ID NO: 7913524 - DNA, 22 bp, Homo sapiens
ttctctaggactttggagtcct

SEQ ID NO: 7913525 - DNA, 22 bp, Homo sapiens
ttctctaggactttggagtcct

SEQ ID NO: 7913526 - DNA, 22 bp, Homo sapiens
ttctctaggagttctgggatca

SEQ ID NO: 7913527 - DNA, 23 bp, Homo sapiens
ttctctagatgaggtgaagatgg

SEQ ID NO: 7913528 - DNA, 22 bp, Homo sapiens
ttctctagcaaaaccagctagt

SEQ ID NO: 7913529 - DNA, 20 bp, Homo sapiens
ttctctagccttcccctggg

SEQ ID NO: 7913530 - DNA, 20 bp, Homo sapiens
ttctctagccttcccctggg

SEQ ID NO: 7913531 - DNA, 22 bp, Homo sapiens
ttctctaagagttatatgaatt

SEQ ID NO: 7913532 - DNA, 22 bp, Homo sapiens
ttctctaagccttagtttcttc

SEQ ID NO: 7913533 - DNA, 22 bp, Homo sapiens
ttctctaagccttagtttcttc

SEQ ID NO: 7913534 - DNA, 22 bp, Homo sapiens
ttctctaagccttagtttcttc

SEQ ID NO: 7913535 - DNA, 22 bp, Homo sapiens
ttctctaatggtgatgattaga

SEQ ID NO: 7913536 - DNA, 22 bp, Homo sapiens
ttctctaatggtgatgattaga

SEQ ID NO: 7913537 - DNA, 22 bp, Homo sapiens
ttctctaatacattttgacaaa

SEQ ID NO: 7913538 - DNA, 22 bp, Homo sapiens
ttctctaatacattttgacaaa

SEQ ID NO: 7913539 - DNA, 22 bp, Homo sapiens
ttctctacttcacaagggatgg

SEQ ID NO: 7913540 - DNA, 22 bp, Homo sapiens
ttctctaatggtgatgattaga

SEQ ID NO: 7913541 - DNA, 23 bp, Homo sapiens
ttctctagatgaggtgaagatgg

SEQ ID NO: 7913542 - DNA, 22 bp, Homo sapiens
ttctctaatggtgatgattaga

SEQ ID NO: 7913543 - DNA, 22 bp, Homo sapiens
ttctctctgagagcatctggaa

SEQ ID NO: 7913544 - DNA, 22 bp, Homo sapiens
ttctctctgagagcatctggaa

SEQ ID NO: 7913545 - DNA, 22 bp, Homo sapiens
ttctctcctcctagaggctttt

SEQ ID NO: 7913546 - DNA, 22 bp, Homo sapiens
ttctctctgagagcatctggaa

SEQ ID NO: 7913547 - DNA, 22 bp, Homo sapiens
ttctctcctacccagtatccat

SEQ ID NO: 7913548 - DNA, 22 bp, Homo sapiens
ttctctcctacccagtatccat

SEQ ID NO: 7913549 - DNA, 22 bp, Homo sapiens
ttctctcccatgaagcttctat

SEQ ID NO: 7913550 - DNA, 22 bp, Homo sapiens
ttctctcccatgaagcttctat

SEQ ID NO: 7913551 - DNA, 22 bp, Homo sapiens
ttctctcccatgaagcttctat

SEQ ID NO: 7913552 - DNA, 22 bp, Homo sapiens
ttctctcccatgaagcttctat

SEQ ID NO: 7913553 - DNA, 22 bp, Homo sapiens
ttctctcccatgaagcttctat

SEQ ID NO: 7913554 - DNA, 22 bp, Homo sapiens
ttctctcccatgaagcttctat

SEQ ID NO: 7913555 - DNA, 21 bp, Homo sapiens
ttctctccatatgcccagccc

SEQ ID NO: 7913556 - DNA, 22 bp, Homo sapiens
ttctctccagactgcagtgggt

SEQ ID NO: 7913557 - DNA, 21 bp, Homo sapiens
ttctctccatatgcccagccc

SEQ ID NO: 7913558 - DNA, 21 bp, Homo sapiens
ttctctccatatgcccagccc

SEQ ID NO: 7913559 - DNA, 22 bp, Homo sapiens
ttctctccagtcctggattctg

SEQ ID NO: 7913560 - DNA, 22 bp, Homo sapiens
ttctctccagtcctggattctg

SEQ ID NO: 7913561 - DNA, 22 bp, Homo sapiens
ttctctccagtcctggattctg

SEQ ID NO: 7913562 - DNA, 22 bp, Homo sapiens
ttctctccagactgcagtgggt

SEQ ID NO: 7913563 - DNA, 22 bp, Homo sapiens
ttctctccagactgcagtgggt

SEQ ID NO: 7913564 - DNA, 22 bp, Homo sapiens
ttctctcattcaaattaaagtg

SEQ ID NO: 7913565 - DNA, 22 bp, Homo sapiens
ttctctccagactgcagtgggt

SEQ ID NO: 7913566 - DNA, 22 bp, Homo sapiens
ttctctcagttaaactttgtga

SEQ ID NO: 7913567 - DNA, 22 bp, Homo sapiens
ttctctcattcaaattaaagtg

SEQ ID NO: 7913568 - DNA, 22 bp, Homo sapiens
ttgtaacaatctgtcataaatg

SEQ ID NO: 7913569 - DNA, 22 bp, Homo sapiens
ttgtaacaaagacactccaaaa

SEQ ID NO: 7913570 - DNA, 22 bp, Homo sapiens
ttgtaacaatctgtcataaatg

SEQ ID NO: 7913571 - DNA, 22 bp, Homo sapiens
ttgtaacaatctgtcataaatg

SEQ ID NO: 7913572 - DNA, 22 bp, Homo sapiens
ttgtaacagctgtttatatagt

SEQ ID NO: 7913573 - DNA, 22 bp, Homo sapiens
ttgtaacagctgtttatatagt

SEQ ID NO: 7913574 - DNA, 22 bp, Homo sapiens
ttgtaacacttttctattaata

SEQ ID NO: 7913575 - DNA, 22 bp, Homo sapiens
ttgtaacacttttctattaata

SEQ ID NO: 7913576 - DNA, 22 bp, Homo sapiens
ttgtaacagctgcttaatagag

SEQ ID NO: 7913577 - DNA, 22 bp, Homo sapiens
ttgtaacagctgcttaatagag

SEQ ID NO: 7913578 - DNA, 22 bp, Homo sapiens
ttgtaagaatatgaatacaaat

SEQ ID NO: 7913579 - DNA, 22 bp, Homo sapiens
ttgtaagactgtagaatgcaaa

SEQ ID NO: 7913580 - DNA, 22 bp, Homo sapiens
ttgtaacatcaccatcaaaatc

SEQ ID NO: 7913581 - DNA, 22 bp, Homo sapiens
ttgtaacatcaccatcaaaatc

SEQ ID NO: 7913582 - DNA, 22 bp, Homo sapiens
ttgtaacagtagctgtcagctc

SEQ ID NO: 7913583 - DNA, 22 bp, Homo sapiens
ttgtaacctgtgatttaatcaa

SEQ ID NO: 7913584 - DNA, 22 bp, Homo sapiens
ttgtaacaggtactaaataact

SEQ ID NO: 7913585 - DNA, 22 bp, Homo sapiens
ttgtaacaggtactaaataact

SEQ ID NO: 7913586 - DNA, 22 bp, Homo sapiens
ttgtaacaggtactaaataact

SEQ ID NO: 7913587 - DNA, 22 bp, Homo sapiens
ttgtaacaggtactaaataact

SEQ ID NO: 7913588 - DNA, 22 bp, Homo sapiens
ttgtaacagtagctgtcagctc

SEQ ID NO: 7913589 - DNA, 22 bp, Homo sapiens
ttgtaacaggtactaaataact

SEQ ID NO: 7913590 - DNA, 22 bp, Homo sapiens
ttgtaacatcaccatcaaaatc

SEQ ID NO: 7913591 - DNA, 22 bp, Homo sapiens
ttgtaaatgaccttttctaatt

SEQ ID NO: 7913592 - DNA, 22 bp, Homo sapiens
ttgtaaatagtagtaagatgcc

SEQ ID NO: 7913593 - DNA, 22 bp, Homo sapiens
ttgtaaatagtagtaagatgcc

SEQ ID NO: 7913594 - DNA, 22 bp, Homo sapiens
ttgtaaatagtagtaagatgcc

SEQ ID NO: 7913595 - DNA, 21 bp, Homo sapiens
ttgtaaaggtttagaagaatg

SEQ ID NO: 7913596 - DNA, 22 bp, Homo sapiens
ttgtaaagttcttaggaagctc

SEQ ID NO: 7913597 - DNA, 22 bp, Homo sapiens
ttgtaaagatgcttcccattct

SEQ ID NO: 7913598 - DNA, 22 bp, Homo sapiens
ttgtaaactgttaaaagccaga

SEQ ID NO: 7913599 - DNA, 22 bp, Homo sapiens
ttgtaaactggatagacctatt

SEQ ID NO: 7913600 - DNA, 22 bp, Homo sapiens
ttgtaaacttgtttgaaggtat

SEQ ID NO: 7913601 - DNA, 22 bp, Homo sapiens
ttgtaaactgctgcaggagtgc

SEQ ID NO: 7913602 - DNA, 20 bp, Homo sapiens
ttgggcctgtcagcactccc

SEQ ID NO: 7913603 - DNA, 20 bp, Homo sapiens
ttgggcctgtcagcactccc

SEQ ID NO: 7913604 - DNA, 22 bp, Homo sapiens
ttgggcctgatcggaataagga

SEQ ID NO: 7913605 - DNA, 22 bp, Homo sapiens
ttgggcctgatcggaataagga

SEQ ID NO: 7913606 - DNA, 22 bp, Homo sapiens
ttgggcctggggtagtgtcgga

SEQ ID NO: 7913607 - DNA, 22 bp, Homo sapiens
ttgggcctggggtagtgtcgga

SEQ ID NO: 7913608 - DNA, 22 bp, Homo sapiens
ttgggcctctcaaagtgctggg

SEQ ID NO: 7913609 - DNA, 22 bp, Homo sapiens
ttgggcctctcaaagtgctggg

SEQ ID NO: 7913610 - DNA, 22 bp, Homo sapiens
ttgggcctctcaaagtgctggg

SEQ ID NO: 7913611 - DNA, 22 bp, Homo sapiens
ttgggcctctcaaagtgctggg

SEQ ID NO: 7913612 - DNA, 22 bp, Homo sapiens
ttgggcctgatcggaataagga

SEQ ID NO: 7913613 - DNA, 22 bp, Homo sapiens
ttgggccctgctctgagttgct

SEQ ID NO: 7913614 - DNA, 22 bp, Homo sapiens
ttgggccctgctctgagttgct

SEQ ID NO: 7913615 - DNA, 22 bp, Homo sapiens
ttgggcctcactctagaaggca

SEQ ID NO: 7913616 - DNA, 22 bp, Homo sapiens
ttgggcctcactctagaaggca

SEQ ID NO: 7913617 - DNA, 22 bp, Homo sapiens
ttgggcctcggccaaggacggg

SEQ ID NO: 7913618 - DNA, 22 bp, Homo sapiens
ttgggcctcggccaaggacggg

SEQ ID NO: 7913619 - DNA, 22 bp, Homo sapiens
ttgggcctcactctagaaggca

SEQ ID NO: 7913620 - DNA, 22 bp, Homo sapiens
ttgtaagtcacaccagggcagg

SEQ ID NO: 7913621 - DNA, 22 bp, Homo sapiens
ttgtaaggtccttctgctgcag

SEQ ID NO: 7913622 - DNA, 22 bp, Homo sapiens
ttgtaagtcacaccagggcagg

SEQ ID NO: 7913623 - DNA, 22 bp, Homo sapiens
ttgtaagatggataggaacagc

SEQ ID NO: 7913624 - DNA, 22 bp, Homo sapiens
ttgtaagagagaattgcaaatt

SEQ ID NO: 7913625 - DNA, 22 bp, Homo sapiens
ttgtaaggaatgcagaatctca

SEQ ID NO: 7913626 - DNA, 22 bp, Homo sapiens
ttgtacaagttttgagcttaag

SEQ ID NO: 7913627 - DNA, 22 bp, Homo sapiens
ttgtacaagttttgagcttaag

SEQ ID NO: 7913628 - DNA, 22 bp, Homo sapiens
ttgtacaagttttgagcttaag

SEQ ID NO: 7913629 - DNA, 22 bp, Homo sapiens
ttgtacaagttttgagcttaag

SEQ ID NO: 7913630 - DNA, 22 bp, Homo sapiens
ttgtacaagttttgagcttaag

SEQ ID NO: 7913631 - DNA, 22 bp, Homo sapiens
ttgtacaagtattatgtgaaca

SEQ ID NO: 7913632 - DNA, 22 bp, Homo sapiens
ttgtacaagtattatgtgaaca

SEQ ID NO: 7913633 - DNA, 22 bp, Homo sapiens
ttgtacaagtattatgtgaaca

SEQ ID NO: 7913634 - DNA, 21 bp, Homo sapiens
ttgtacacccacagatcagcc

SEQ ID NO: 7913635 - DNA, 21 bp, Homo sapiens
ttgtacacccacagatcagcc

SEQ ID NO: 7913636 - DNA, 22 bp, Homo sapiens
ttgtacacacaggaacaaacgt

SEQ ID NO: 7913637 - DNA, 22 bp, Homo sapiens
ttgtacacacaacaggaggtaa

SEQ ID NO: 7913638 - DNA, 22 bp, Homo sapiens
ttgtacacaattcttaacatac

SEQ ID NO: 7913639 - DNA, 22 bp, Homo sapiens
ttgtacaatggatgccagatga

SEQ ID NO: 7913640 - DNA, 22 bp, Homo sapiens
ttgtacaatggatgccagatga

SEQ ID NO: 7913641 - DNA, 22 bp, Homo sapiens
ttgtacaatggatgccagatga

SEQ ID NO: 7913642 - DNA, 22 bp, Homo sapiens
ttgtacactctttttattccgt

SEQ ID NO: 7913643 - DNA, 22 bp, Homo sapiens
ttgtacactgttgatgggaatg

SEQ ID NO: 7913644 - DNA, 22 bp, Homo sapiens
ttgtacagaaactgcatttgga

SEQ ID NO: 7913645 - DNA, 22 bp, Homo sapiens
ttgtatttcgatgcacgtgtag

SEQ ID NO: 7913646 - DNA, 22 bp, Homo sapiens
ttgtatttcctataacctttct

SEQ ID NO: 7913647 - DNA, 22 bp, Homo sapiens
ttgtatttcctataacctttct

SEQ ID NO: 7913648 - DNA, 22 bp, Homo sapiens
ttgtatttcgatgcacgtgtag

SEQ ID NO: 7913649 - DNA, 22 bp, Homo sapiens
ttgtatttctccactttctgtt

SEQ ID NO: 7913650 - DNA, 22 bp, Homo sapiens
ttgtatttcgatgcacgtgtag

SEQ ID NO: 7913651 - DNA, 22 bp, Homo sapiens
ttgtatttctccactttctgtt

SEQ ID NO: 7913652 - DNA, 22 bp, Homo sapiens
ttgtattttttcctggcggtgg

SEQ ID NO: 7913653 - DNA, 22 bp, Homo sapiens
ttgtcaaatccttgtcatctgc

SEQ ID NO: 7913654 - DNA, 23 bp, Homo sapiens
ttgtatttttagtagagacaggg

SEQ ID NO: 7913655 - DNA, 23 bp, Homo sapiens
ttgtatttttagtagagacaggg

SEQ ID NO: 7913656 - DNA, 23 bp, Homo sapiens
ttgtatttttagtagagacaggg

SEQ ID NO: 7913657 - DNA, 22 bp, Homo sapiens
ttgtatttctccactttctgtt

SEQ ID NO: 7913658 - DNA, 23 bp, Homo sapiens
ttgtacctaattactagttccag

SEQ ID NO: 7913659 - DNA, 21 bp, Homo sapiens
ttgtaccttagagcacaccct

SEQ ID NO: 7913660 - DNA, 22 bp, Homo sapiens
ttgtactatcaccatgtcatgt

SEQ ID NO: 7913661 - DNA, 22 bp, Homo sapiens
ttgtacattctatgggtttgga

SEQ ID NO: 7913662 - DNA, 22 bp, Homo sapiens
ttgtaccaacctaatagttcat

SEQ ID NO: 7913663 - DNA, 22 bp, Homo sapiens
ttgtaccagctcatttcagaac

SEQ ID NO: 7913664 - DNA, 22 bp, Homo sapiens
ttgtacataatgaaaggaggct

SEQ ID NO: 7913665 - DNA, 22 bp, Homo sapiens
ttgtacattctatgggtttgga

SEQ ID NO: 7913666 - DNA, 22 bp, Homo sapiens
ttgtacataatgaaaggaggct

SEQ ID NO: 7913667 - DNA, 22 bp, Homo sapiens
ttgtacagggaagtaatacaag

SEQ ID NO: 7913668 - DNA, 22 bp, Homo sapiens
ttgtacagggaagtaatacaag

SEQ ID NO: 7913669 - DNA, 22 bp, Homo sapiens
ttgtacagggaagtaatacaag

SEQ ID NO: 7913670 - DNA, 22 bp, Homo sapiens
ttgtacagggaagtaatacaag

SEQ ID NO: 7913671 - DNA, 22 bp, Homo sapiens
ttgtcacagcagcaaaggctct

SEQ ID NO: 7913672 - DNA, 20 bp, Homo sapiens
ttgtcagattttgcttgatg

SEQ ID NO: 7913673 - DNA, 22 bp, Homo sapiens
ttgtcacattcaagttttatat

SEQ ID NO: 7913674 - DNA, 17 bp, Homo sapiens
ttgtcacaggtggtggt

SEQ ID NO: 7913675 - DNA, 22 bp, Homo sapiens
ttgtcacatgtagttcattctc

SEQ ID NO: 7913676 - DNA, 20 bp, Homo sapiens
ttgtcacagctttccatcag

SEQ ID NO: 7913677 - DNA, 22 bp, Homo sapiens
ttgtcacaggaaagggtgcaag

SEQ ID NO: 7913678 - DNA, 22 bp, Homo sapiens
ttgtcacacccttttttatacc

SEQ ID NO: 7913679 - DNA, 20 bp, Homo sapiens
ttgtcacagctttccatcag

SEQ ID NO: 7913680 - DNA, 22 bp, Homo sapiens
ttgtcacagacatcccaggtga

SEQ ID NO: 7913681 - DNA, 19 bp, Homo sapiens
ttgtcacaattcatcaggt

SEQ ID NO: 7913682 - DNA, 22 bp, Homo sapiens
ttgtcaagtaaggctgacattt

SEQ ID NO: 7913683 - DNA, 22 bp, Homo sapiens
ttgtcaagattgagagatgact

SEQ ID NO: 7913684 - DNA, 22 bp, Homo sapiens
ttgtattttttcctggcggtgg

SEQ ID NO: 7913685 - DNA, 22 bp, Homo sapiens
ttgtcaagaaaaatggatgaag

SEQ ID NO: 7913686 - DNA, 22 bp, Homo sapiens
ttgtcatagcttcatgggtagc

SEQ ID NO: 7913687 - DNA, 22 bp, Homo sapiens
ttgtcaggcctatgagagatct

SEQ ID NO: 7913688 - DNA, 22 bp, Homo sapiens
ttgtcattggggttatttgtta

SEQ ID NO: 7913689 - DNA, 22 bp, Homo sapiens
ttgtcattggggttatttgtta

SEQ ID NO: 7913690 - DNA, 22 bp, Homo sapiens
ttgtcattggggttatttgtta

SEQ ID NO: 7913691 - DNA, 22 bp, Homo sapiens
ttgtccagaaaaaagccaaggg

SEQ ID NO: 7913692 - DNA, 22 bp, Homo sapiens
ttgtccagaaaaaagccaaggg

SEQ ID NO: 7913693 - DNA, 22 bp, Homo sapiens
ttgtccaaagtaacacatctag

SEQ ID NO: 7913694 - DNA, 22 bp, Homo sapiens
ttgtccaaggtcccacagttag

SEQ ID NO: 7913695 - DNA, 22 bp, Homo sapiens
ttgtcccttcagtaagagtgga

SEQ ID NO: 7913696 - DNA, 22 bp, Homo sapiens
ttgtccctgcccctgcttgctt

SEQ ID NO: 7913697 - DNA, 22 bp, Homo sapiens
ttgtcccttcagtaagagtgga

SEQ ID NO: 7913698 - DNA, 22 bp, Homo sapiens
ttgtcctaatttatggcctgga

SEQ ID NO: 7913699 - DNA, 22 bp, Homo sapiens
ttgtcctgagataaggaacaga

SEQ ID NO: 7913700 - DNA, 22 bp, Homo sapiens
ttgtccattttattggatggtg

SEQ ID NO: 7913701 - DNA, 22 bp, Homo sapiens
ttgtccagagccaggctgtcgg

SEQ ID NO: 7913702 - DNA, 22 bp, Homo sapiens
ttgtccagagccaggctgtcgg

SEQ ID NO: 7913703 - DNA, 19 bp, Homo sapiens
ttgtccagaaaggcattgc

SEQ ID NO: 7913704 - DNA, 22 bp, Homo sapiens
ttgtccagaacatcggggttgc

SEQ ID NO: 7913705 - DNA, 22 bp, Homo sapiens
ttgtccagcagctcagtctacg

SEQ ID NO: 7913706 - DNA, 22 bp, Homo sapiens
ttgtccagcgaccaggctctgt

SEQ ID NO: 7913707 - DNA, 22 bp, Homo sapiens
ttgtccagcgaccaggctctgt

SEQ ID NO: 7913708 - DNA, 23 bp, Homo sapiens
ttgtccagctggtttgggccaca

SEQ ID NO: 7913709 - DNA, 23 bp, Homo sapiens
ttgtccagctggtttgggccaca

SEQ ID NO: 7913710 - DNA, 22 bp, Homo sapiens
ttgtccagcagctcagtctacg

SEQ ID NO: 7913711 - DNA, 23 bp, Homo sapiens
ttgtccagctggtttgggccaca

SEQ ID NO: 7913712 - DNA, 22 bp, Homo sapiens
ttgtccatctgtatttcccatg

SEQ ID NO: 7913713 - DNA, 22 bp, Homo sapiens
ttgtccagtttctagaggcctc

SEQ ID NO: 7913714 - DNA, 22 bp, Homo sapiens
ttgtccagtttctagaggcctc

SEQ ID NO: 7913715 - DNA, 23 bp, Homo sapiens
ttgtccagctggtttgggccaca

SEQ ID NO: 7913716 - DNA, 22 bp, Homo sapiens
ttgtcctggaggttaatagagt

SEQ ID NO: 7913717 - DNA, 22 bp, Homo sapiens
ttgtcctggaggttaatagagt

SEQ ID NO: 7913718 - DNA, 23 bp, Homo sapiens
ttgtcctgccgatctctgagaat

SEQ ID NO: 7913719 - DNA, 22 bp, Homo sapiens
ttgtcctgtgatttcagggcct

SEQ ID NO: 7913720 - DNA, 16 bp, Homo sapiens
ttgtcctgtctcactg

SEQ ID NO: 7913721 - DNA, 22 bp, Homo sapiens
ttgtcctgtcaggctgggggct

SEQ ID NO: 7913722 - DNA, 22 bp, Homo sapiens
ttgtcctgtcaggctgggggct

SEQ ID NO: 7913723 - DNA, 22 bp, Homo sapiens
ttgtcctggcccaaatgtcaac

SEQ ID NO: 7913724 - DNA, 22 bp, Homo sapiens
ttgtcctggaggttaatagagt

SEQ ID NO: 7913725 - DNA, 22 bp, Homo sapiens
ttgtcctgcaacctcacatggc

SEQ ID NO: 7913726 - DNA, 22 bp, Homo sapiens
ttgtcctgcaacctcacatggc

SEQ ID NO: 7913727 - DNA, 23 bp, Homo sapiens
ttgtcctgccgatctctgagaat

SEQ ID NO: 7913728 - DNA, 22 bp, Homo sapiens
ttgtcctgcaggtggctgggag

SEQ ID NO: 7913729 - DNA, 22 bp, Homo sapiens
ttgtcctgcaacctcacatggc

SEQ ID NO: 7913730 - DNA, 22 bp, Homo sapiens
ttgtcctgattttgcaacttct

SEQ ID NO: 7913731 - DNA, 22 bp, Homo sapiens
ttgtcctgatttataaaatgaa

SEQ ID NO: 7913732 - DNA, 22 bp, Homo sapiens
ttgtcctgaggactgttatcag

SEQ ID NO: 7913733 - DNA, 22 bp, Homo sapiens
ttgtgtcaggggcccatactca

SEQ ID NO: 7913734 - DNA, 22 bp, Homo sapiens
ttgtgtagctaaaaccaagaaa

SEQ ID NO: 7913735 - DNA, 20 bp, Homo sapiens
ttgtgtaggtctaatgcata

SEQ ID NO: 7913736 - DNA, 20 bp, Homo sapiens
ttgtgtaggtctaatgcata

SEQ ID NO: 7913737 - DNA, 20 bp, Homo sapiens
ttgtgtaggtctaatgcata

SEQ ID NO: 7913738 - DNA, 16 bp, Homo sapiens
ttgtggcttttgcaca

SEQ ID NO: 7913739 - DNA, 22 bp, Homo sapiens
ttgtgtagctaaaaccaagaaa

SEQ ID NO: 7913740 - DNA, 22 bp, Homo sapiens
ttgtgtcatgttccattgaaaa

SEQ ID NO: 7913741 - DNA, 22 bp, Homo sapiens
ttgtgtcatgttccattgaaaa

SEQ ID NO: 7913742 - DNA, 22 bp, Homo sapiens
ttgtgtccaaggctatggtgat

SEQ ID NO: 7913743 - DNA, 22 bp, Homo sapiens
ttgtgtccatttgagtcatgtg

SEQ ID NO: 7913744 - DNA, 22 bp, Homo sapiens
ttgtcctgtttagggataagga

SEQ ID NO: 7913745 - DNA, 22 bp, Homo sapiens
ttgtcctgttacttgtttggat

SEQ ID NO: 7913746 - DNA, 22 bp, Homo sapiens
ttgtggcatgtgagaactagaa

SEQ ID NO: 7913747 - DNA, 22 bp, Homo sapiens
ttgtcctgtttagggataagga

SEQ ID NO: 7913748 - DNA, 22 bp, Homo sapiens
ttgtggctcatcttcagctccc

SEQ ID NO: 7913749 - DNA, 22 bp, Homo sapiens
ttgtggctcatcttcagctccc

SEQ ID NO: 7913750 - DNA, 22 bp, Homo sapiens
ttgtcctgttacttgtttggat

SEQ ID NO: 7913751 - DNA, 22 bp, Homo sapiens
ttgtcctgtgtctgtttggatt

SEQ ID NO: 7913752 - DNA, 22 bp, Homo sapiens
ttgtcctgtgtctgtttggatt

SEQ ID NO: 7913753 - DNA, 22 bp, Homo sapiens
ttgtcctgtgatttcagggcct

SEQ ID NO: 7913754 - DNA, 22 bp, Homo sapiens
ttgtggctcttgaggctctcgt

SEQ ID NO: 7913755 - DNA, 22 bp, Homo sapiens
ttgtggctcttgaggctctcgt

SEQ ID NO: 7913756 - DNA, 22 bp, Homo sapiens
ttgtggctcgtgagatgttagg

SEQ ID NO: 7913757 - DNA, 22 bp, Homo sapiens
ttgtggcttctacgcccacagg

SEQ ID NO: 7913758 - DNA, 22 bp, Homo sapiens
ttgtggctgtgcaccgctgcct

SEQ ID NO: 7913759 - DNA, 22 bp, Homo sapiens
ttgtggctgtcgagaattgagg

SEQ ID NO: 7913760 - DNA, 22 bp, Homo sapiens
ttgtggctgtcgagaattgagg

SEQ ID NO: 7913761 - DNA, 22 bp, Homo sapiens
ttgtgtcctgatttgacacaat

SEQ ID NO: 7913762 - DNA, 21 bp, Homo sapiens
ttgtgtccttctaaagggcca

SEQ ID NO: 7913763 - DNA, 22 bp, Homo sapiens
ttgtgtctaaataaggagacct

SEQ ID NO: 7913764 - DNA, 22 bp, Homo sapiens
ttgtgtcctaagcaccagatgg

SEQ ID NO: 7913765 - DNA, 22 bp, Homo sapiens
ttgtgtcctctaatctcaccac

SEQ ID NO: 7913766 - DNA, 22 bp, Homo sapiens
ttgtgtcctatatgcatgttct

SEQ ID NO: 7913767 - DNA, 22 bp, Homo sapiens
ttgtgtcccctgttctacctgt

SEQ ID NO: 7913768 - DNA, 22 bp, Homo sapiens
ttgtgtccccctttgagagcca

SEQ ID NO: 7913769 - DNA, 22 bp, Homo sapiens
ttgtgtccctgcggctgaggag

SEQ ID NO: 7913770 - DNA, 22 bp, Homo sapiens
ttgtgtccctggagcttctgtg

SEQ ID NO: 7913771 - DNA, 22 bp, Homo sapiens
ttgtgtccctgtaagacaaagc

SEQ ID NO: 7913772 - DNA, 22 bp, Homo sapiens
ttgtgtcctaacatctagttaa

SEQ ID NO: 7913773 - DNA, 22 bp, Homo sapiens
ttgtgtctatggtttgagcatc

SEQ ID NO: 7913774 - DNA, 22 bp, Homo sapiens
ttgtgtctggaatgcgtggagc

SEQ ID NO: 7913775 - DNA, 22 bp, Homo sapiens
ttgtgtctggatttcagctttc

SEQ ID NO: 7913776 - DNA, 22 bp, Homo sapiens
ttgtgtctggatttcagctttc

SEQ ID NO: 7913777 - DNA, 22 bp, Homo sapiens
ttgtgtctggaatgcgtggagc

SEQ ID NO: 7913778 - DNA, 22 bp, Homo sapiens
ttgtgtctgggggagtgacatc

SEQ ID NO: 7913779 - DNA, 22 bp, Homo sapiens
ttgtgtctggatttcagctttc

SEQ ID NO: 7913780 - DNA, 22 bp, Homo sapiens
ttgtgtctgggggagtgacatc

SEQ ID NO: 7913781 - DNA, 22 bp, Homo sapiens
ttgtgtctgggggagtgacatc

SEQ ID NO: 7913782 - DNA, 22 bp, Homo sapiens
ttgtgtcttaaagattaaatgg

SEQ ID NO: 7913783 - DNA, 22 bp, Homo sapiens
ttgtgtctaaataaggagacct

SEQ ID NO: 7913784 - DNA, 22 bp, Homo sapiens
ttgtgtctaaataaggagacct

SEQ ID NO: 7913785 - DNA, 23 bp, Homo sapiens
ttgtgtctacttcctatctaggg

SEQ ID NO: 7913786 - DNA, 23 bp, Homo sapiens
ttgtgtctacttcctatctaggg

SEQ ID NO: 7913787 - DNA, 23 bp, Homo sapiens
ttgtgtctacttcctatctaggg

SEQ ID NO: 7913788 - DNA, 23 bp, Homo sapiens
ttgtgtctacttcctatctaggg

SEQ ID NO: 7913789 - DNA, 22 bp, Homo sapiens
ttgtgtctatggtttgagcatc

SEQ ID NO: 7913790 - DNA, 22 bp, Homo sapiens
ttgtgtctggaatgcgtggagc

SEQ ID NO: 7913791 - DNA, 22 bp, Homo sapiens
ttgtgtctatggtttgagcatc

SEQ ID NO: 7913792 - DNA, 22 bp, Homo sapiens
ttgggaagtttaatgacagact

SEQ ID NO: 7913793 - DNA, 22 bp, Homo sapiens
ttgggaagtttaatgacagact

SEQ ID NO: 7913794 - DNA, 22 bp, Homo sapiens
ttgggacagaaaaggagaagat

SEQ ID NO: 7913795 - DNA, 22 bp, Homo sapiens
ttgggacagagctggggctgga

SEQ ID NO: 7913796 - DNA, 22 bp, Homo sapiens
ttggcccactctcagaatgtgg

SEQ ID NO: 7913797 - DNA, 22 bp, Homo sapiens
ttggcccacagtaccatgctgt

SEQ ID NO: 7913798 - DNA, 22 bp, Homo sapiens
ttggccatgacaggacaggaag

SEQ ID NO: 7913799 - DNA, 22 bp, Homo sapiens
ttggccatctaagcccagccac

SEQ ID NO: 7913800 - DNA, 22 bp, Homo sapiens
ttgggaaggcgtggaagcagaa

SEQ ID NO: 7913801 - DNA, 22 bp, Homo sapiens
ttgggaaggcgtggaagcagaa

SEQ ID NO: 7913802 - DNA, 22 bp, Homo sapiens
ttgggaaggcgtggaagcagaa

SEQ ID NO: 7913803 - DNA, 22 bp, Homo sapiens
ttggccatctaagcccagccac

SEQ ID NO: 7913804 - DNA, 22 bp, Homo sapiens
ttggccagtggaaagaggagga

SEQ ID NO: 7913805 - DNA, 22 bp, Homo sapiens
ttggccatctaagcccagccac

SEQ ID NO: 7913806 - DNA, 22 bp, Homo sapiens
ttggccagtggaaagaggagga

SEQ ID NO: 7913807 - DNA, 22 bp, Homo sapiens
ttggccagtggaaagaggagga

SEQ ID NO: 7913808 - DNA, 22 bp, Homo sapiens
ttggccagtggaaagaggagga

SEQ ID NO: 7913809 - DNA, 22 bp, Homo sapiens
ttggccagtggaaagaggagga

SEQ ID NO: 7913810 - DNA, 22 bp, Homo sapiens
ttggccaggtgtaggtcacacc

SEQ ID NO: 7913811 - DNA, 22 bp, Homo sapiens
ttggccaggtgtccagcccagg

SEQ ID NO: 7913812 - DNA, 22 bp, Homo sapiens
ttggccaggtgtccagcccagg

SEQ ID NO: 7913813 - DNA, 22 bp, Homo sapiens
ttggccaggtgtccagcccagg

SEQ ID NO: 7913814 - DNA, 22 bp, Homo sapiens
ttggccagtgaaccaggcctgg

SEQ ID NO: 7913815 - DNA, 22 bp, Homo sapiens
ttggccagtgcttgtgattttc

SEQ ID NO: 7913816 - DNA, 22 bp, Homo sapiens
ttggccagtgaaccaggcctgg

SEQ ID NO: 7913817 - DNA, 22 bp, Homo sapiens
ttggccagtgcttgtgattttc

SEQ ID NO: 7913818 - DNA, 22 bp, Homo sapiens
ttggccagtgaaccaggcctgg

SEQ ID NO: 7913819 - DNA, 22 bp, Homo sapiens
ttggccagtgaaccaggcctgg

SEQ ID NO: 7913820 - DNA, 22 bp, Homo sapiens
ttggcataccttagtggtggag

SEQ ID NO: 7913821 - DNA, 22 bp, Homo sapiens
ttggcataccttagtggtggag

SEQ ID NO: 7913822 - DNA, 17 bp, Homo sapiens
ttggcagtttggcggcc

SEQ ID NO: 7913823 - DNA, 22 bp, Homo sapiens
ttggcataaaactcttcaaaat

SEQ ID NO: 7913824 - DNA, 22 bp, Homo sapiens
ttggcataccttagtggtggag

SEQ ID NO: 7913825 - DNA, 22 bp, Homo sapiens
ttggcatcagtgtaggacctgt

SEQ ID NO: 7913826 - DNA, 22 bp, Homo sapiens
ttggcataccttagtggtggag

SEQ ID NO: 7913827 - DNA, 22 bp, Homo sapiens
ttggccagcagctctggcttag

SEQ ID NO: 7913828 - DNA, 22 bp, Homo sapiens
ttggccagcagctctggcttag

SEQ ID NO: 7913829 - DNA, 22 bp, Homo sapiens
ttggcatccactttgcaagttt

SEQ ID NO: 7913830 - DNA, 22 bp, Homo sapiens
ttggccagcgacgaccttctta

SEQ ID NO: 7913831 - DNA, 22 bp, Homo sapiens
ttggccagcagctctggcttag

SEQ ID NO: 7913832 - DNA, 22 bp, Homo sapiens
ttggccagcagctctggcttag

SEQ ID NO: 7913833 - DNA, 22 bp, Homo sapiens
ttggccagcgacgaccttctta

SEQ ID NO: 7913834 - DNA, 22 bp, Homo sapiens
ttggccagcgacgaccttctta

SEQ ID NO: 7913835 - DNA, 22 bp, Homo sapiens
ttggccagctctggaaagtggt

SEQ ID NO: 7913836 - DNA, 22 bp, Homo sapiens
ttggccaggtccatttctccat

SEQ ID NO: 7913837 - DNA, 17 bp, Homo sapiens
ttgggagagaaaggtat

SEQ ID NO: 7913838 - DNA, 22 bp, Homo sapiens
ttgggagatagggtaatttagc

SEQ ID NO: 7913839 - DNA, 22 bp, Homo sapiens
ttgggagagtttacatcctttt

SEQ ID NO: 7913840 - DNA, 22 bp, Homo sapiens
ttgggagatattgttctttaca

SEQ ID NO: 7913841 - DNA, 22 bp, Homo sapiens
ttgggagatattgttctttaca

SEQ ID NO: 7913842 - DNA, 22 bp, Homo sapiens
ttgggagatggggagataatat

SEQ ID NO: 7913843 - DNA, 22 bp, Homo sapiens
ttgggagctggaagcaaggcct

SEQ ID NO: 7913844 - DNA, 22 bp, Homo sapiens
ttgggagcatttagaaaagacg

SEQ ID NO: 7913845 - DNA, 22 bp, Homo sapiens
ttgggagcaaataggaaagagg

SEQ ID NO: 7913846 - DNA, 22 bp, Homo sapiens
ttgggagctggaagcaaggcct

SEQ ID NO: 7913847 - DNA, 22 bp, Homo sapiens
ttgggagattcattgagccaag

SEQ ID NO: 7913848 - DNA, 22 bp, Homo sapiens
ttgggagattcattgagccaag

SEQ ID NO: 7913849 - DNA, 22 bp, Homo sapiens
ttgggagattcattgagccaag

SEQ ID NO: 7913850 - DNA, 22 bp, Homo sapiens
ttgggagattcattgagccaag

SEQ ID NO: 7913851 - DNA, 17 bp, Homo sapiens
ttgggagagaaaggtat

SEQ ID NO: 7913852 - DNA, 17 bp, Homo sapiens
ttgggagagaaaggtat

SEQ ID NO: 7913853 - DNA, 22 bp, Homo sapiens
ttgggagacaaaggctctgtct

SEQ ID NO: 7913854 - DNA, 22 bp, Homo sapiens
ttgggagacaaaggctctgtct

SEQ ID NO: 7913855 - DNA, 22 bp, Homo sapiens
ttgggagaaatagttgatccgc

SEQ ID NO: 7913856 - DNA, 22 bp, Homo sapiens
ttgggagaaggctgggacttta

SEQ ID NO: 7913857 - DNA, 22 bp, Homo sapiens
ttgggagaaatagttgatccgc

SEQ ID NO: 7913858 - DNA, 22 bp, Homo sapiens
ttgggagacaaaggctctgtct

SEQ ID NO: 7913859 - DNA, 22 bp, Homo sapiens
ttgggacatctggcatacagtt

SEQ ID NO: 7913860 - DNA, 22 bp, Homo sapiens
ttgggacattatcagtctgcag

SEQ ID NO: 7913861 - DNA, 22 bp, Homo sapiens
ttgggagcttggccgagatgta

SEQ ID NO: 7913862 - DNA, 22 bp, Homo sapiens
ttgggaggtaatggagccaagt

SEQ ID NO: 7913863 - DNA, 22 bp, Homo sapiens
ttgggaggtaatggagccaagt

SEQ ID NO: 7913864 - DNA, 22 bp, Homo sapiens
ttgggaggtaatggagccaagt

SEQ ID NO: 7913865 - DNA, 22 bp, Homo sapiens
ttgggcagggaaaggacaggca

SEQ ID NO: 7913866 - DNA, 22 bp, Homo sapiens
ttgggaggtaatggagccaagt

SEQ ID NO: 7913867 - DNA, 22 bp, Homo sapiens
ttgggcagggaaaggacaggca

SEQ ID NO: 7913868 - DNA, 22 bp, Homo sapiens
ttgggcaggtgaagagagggct

SEQ ID NO: 7913869 - DNA, 22 bp, Homo sapiens
ttgggcaggtgtggctctcctt

SEQ ID NO: 7913870 - DNA, 22 bp, Homo sapiens
ttgggcaggtgtggctctcctt

SEQ ID NO: 7913871 - DNA, 22 bp, Homo sapiens
ttgggcaggtgaagagagggct

SEQ ID NO: 7913872 - DNA, 22 bp, Homo sapiens
ttgggcaggtgaagagagggct

SEQ ID NO: 7913873 - DNA, 22 bp, Homo sapiens
ttgggcccatggggctaagcta

SEQ ID NO: 7913874 - DNA, 22 bp, Homo sapiens
ttgggcccatggggctaagcta

SEQ ID NO: 7913875 - DNA, 22 bp, Homo sapiens
ttgggcagtgattagttcatga

SEQ ID NO: 7913876 - DNA, 22 bp, Homo sapiens
ttgggcagtgattagttcatga

SEQ ID NO: 7913877 - DNA, 22 bp, Homo sapiens
ttgggcagtctggctgcagagt

SEQ ID NO: 7913878 - DNA, 22 bp, Homo sapiens
ttgggcagtctggctgcagagt

SEQ ID NO: 7913879 - DNA, 22 bp, Homo sapiens
ttggagagtgatattcagatgc

SEQ ID NO: 7913880 - DNA, 22 bp, Homo sapiens
ttggagagtgatattcagatgc

SEQ ID NO: 7913881 - DNA, 23 bp, Homo sapiens
ttggagagggtgagtagtgtcag

SEQ ID NO: 7913882 - DNA, 22 bp, Homo sapiens
ttggagagcagtaaaccacact

SEQ ID NO: 7913883 - DNA, 22 bp, Homo sapiens
ttggagagatttaggtctcagt

SEQ ID NO: 7913884 - DNA, 22 bp, Homo sapiens
ttggagagggcttggatcacac

SEQ ID NO: 7913885 - DNA, 22 bp, Homo sapiens
ttggagagggcttggatcacac

SEQ ID NO: 7913886 - DNA, 22 bp, Homo sapiens
ttggagaggcagtcttgctctg

SEQ ID NO: 7913887 - DNA, 22 bp, Homo sapiens
ttggagatatcacaccttcaca

SEQ ID NO: 7913888 - DNA, 22 bp, Homo sapiens
ttggagatatcacaccttcaca

SEQ ID NO: 7913889 - DNA, 22 bp, Homo sapiens
ttggagatatgtgaaaaaaaca

SEQ ID NO: 7913890 - DNA, 22 bp, Homo sapiens
ttggagccctgaggatctggat

SEQ ID NO: 7913891 - DNA, 22 bp, Homo sapiens
ttggagatgtaaaattcagaga

SEQ ID NO: 7913892 - DNA, 22 bp, Homo sapiens
ttggagccatgcccagctctct

SEQ ID NO: 7913893 - DNA, 22 bp, Homo sapiens
ttggagccctgaggatctggat

SEQ ID NO: 7913894 - DNA, 22 bp, Homo sapiens
ttggagagttaattgacagtta

SEQ ID NO: 7913895 - DNA, 22 bp, Homo sapiens
ttggagagttaattgacagtta

SEQ ID NO: 7913896 - DNA, 22 bp, Homo sapiens
ttggagagttaattgacagtta

SEQ ID NO: 7913897 - DNA, 20 bp, Homo sapiens
ttggagatacaacctttaag

SEQ ID NO: 7913898 - DNA, 22 bp, Homo sapiens
ttggagatatcacaccttcaca

SEQ ID NO: 7913899 - DNA, 22 bp, Homo sapiens
ttggagatatcacaccttcaca

SEQ ID NO: 7913900 - DNA, 22 bp, Homo sapiens
ttggagaatgttttcctgcagt

SEQ ID NO: 7913901 - DNA, 22 bp, Homo sapiens
ttggagaactggcatttttaat

SEQ ID NO: 7913902 - DNA, 21 bp, Homo sapiens
ttggagaagtgctatcagtat

SEQ ID NO: 7913903 - DNA, 22 bp, Homo sapiens
ttggagagaggctgctcaggct

SEQ ID NO: 7913904 - DNA, 22 bp, Homo sapiens
ttggagagaggctgctcaggct

SEQ ID NO: 7913905 - DNA, 22 bp, Homo sapiens
ttggagagattatcagaccagc

SEQ ID NO: 7913906 - DNA, 22 bp, Homo sapiens
ttggagagattatcagaccagc

SEQ ID NO: 7913907 - DNA, 22 bp, Homo sapiens
ttggagagatttaggtctcagt

SEQ ID NO: 7913908 - DNA, 22 bp, Homo sapiens
ttggagagattatcagaccagc

SEQ ID NO: 7913909 - DNA, 22 bp, Homo sapiens
ttggagagaggctgctcaggct

SEQ ID NO: 7913910 - DNA, 22 bp, Homo sapiens
ttggagagaggctgctcaggct

SEQ ID NO: 7913911 - DNA, 22 bp, Homo sapiens
ttggacataggtggtaatagtg

SEQ ID NO: 7913912 - DNA, 22 bp, Homo sapiens
ttggacagtgcagatctacacg

SEQ ID NO: 7913913 - DNA, 22 bp, Homo sapiens
ttggacagtaaattgtgcttaa

SEQ ID NO: 7913914 - DNA, 22 bp, Homo sapiens
ttggaccagtggattatggtgg

SEQ ID NO: 7913915 - DNA, 17 bp, Homo sapiens
ttggaccagattctaaa

SEQ ID NO: 7913916 - DNA, 22 bp, Homo sapiens
ttggaccaattcctgatatttt

SEQ ID NO: 7913917 - DNA, 23 bp, Homo sapiens
ttggaccactactgttttctctt

SEQ ID NO: 7913918 - DNA, 22 bp, Homo sapiens
ttggaccaaggtctgctctttc

SEQ ID NO: 7913919 - DNA, 22 bp, Homo sapiens
ttggacggtggaggcaacttgg

SEQ ID NO: 7913920 - DNA, 18 bp, Homo sapiens
ttggacctgtgtcagggc

SEQ ID NO: 7913921 - DNA, 22 bp, Homo sapiens
ttggacctcagttattctatca

SEQ ID NO: 7913922 - DNA, 22 bp, Homo sapiens
ttggaccatggtagggaacttg

SEQ ID NO: 7913923 - DNA, 21 bp, Homo sapiens
ttggaccatacaagttatgca

SEQ ID NO: 7913924 - DNA, 22 bp, Homo sapiens
ttggaccattgacctgatctac

SEQ ID NO: 7913925 - DNA, 18 bp, Homo sapiens
ttggacctgtgtcagggc

SEQ ID NO: 7913926 - DNA, 22 bp, Homo sapiens
ttggcagtaaaagaaaatgctt

SEQ ID NO: 7913927 - DNA, 22 bp, Homo sapiens
ttggcagtagtctcggctaccc

SEQ ID NO: 7913928 - DNA, 22 bp, Homo sapiens
ttggcagggctgcttgtctagg

SEQ ID NO: 7913929 - DNA, 22 bp, Homo sapiens
ttggcagtaaaagaaaatgctt

SEQ ID NO: 7913930 - DNA, 22 bp, Homo sapiens
ttggcagggccaggctctctct

SEQ ID NO: 7913931 - DNA, 22 bp, Homo sapiens
ttggcagggcatcagacacgtg

SEQ ID NO: 7913932 - DNA, 22 bp, Homo sapiens
ttggcagggccaggctctctct

SEQ ID NO: 7913933 - DNA, 22 bp, Homo sapiens
ttggcaggaggcttcagttcct

SEQ ID NO: 7913934 - DNA, 22 bp, Homo sapiens
ttggcaggaatattgcagaggt

SEQ ID NO: 7913935 - DNA, 22 bp, Homo sapiens
ttggcaggaatattgcagaggt

SEQ ID NO: 7913936 - DNA, 22 bp, Homo sapiens
ttggcaggaatattgcagaggt

SEQ ID NO: 7913937 - DNA, 22 bp, Homo sapiens
ttggcagggcatcagacacgtg

SEQ ID NO: 7913938 - DNA, 22 bp, Homo sapiens
ttggcagggcatcagacacgtg

SEQ ID NO: 7913939 - DNA, 22 bp, Homo sapiens
ttggcaggatgatagctttgtg

SEQ ID NO: 7913940 - DNA, 22 bp, Homo sapiens
ttggcagggcatcagacacgtg

SEQ ID NO: 7913941 - DNA, 22 bp, Homo sapiens
ttggcagtgctttaatttccag

SEQ ID NO: 7913942 - DNA, 22 bp, Homo sapiens
ttggcagtgatgcagcttgttc

SEQ ID NO: 7913943 - DNA, 22 bp, Homo sapiens
ttggcagtgatgcagcttgttc

SEQ ID NO: 7913944 - DNA, 22 bp, Homo sapiens
ttggcagtgatgcagcttgttc

SEQ ID NO: 7913945 - DNA, 22 bp, Homo sapiens
ttggcagtgatgcagcttgttc

SEQ ID NO: 7913946 - DNA, 22 bp, Homo sapiens
ttggcagtgtcactagggagcc

SEQ ID NO: 7913947 - DNA, 22 bp, Homo sapiens
ttggcagtgtctgcaaaatgga

SEQ ID NO: 7913948 - DNA, 20 bp, Homo sapiens
ttggcagttaagaatcttac

SEQ ID NO: 7913949 - DNA, 20 bp, Homo sapiens
ttggcagttaagaatcttac

SEQ ID NO: 7913950 - DNA, 22 bp, Homo sapiens
ttggcagtgtctgcaaaatgga

SEQ ID NO: 7913951 - DNA, 20 bp, Homo sapiens
ttggcagttaagaatcttac

SEQ ID NO: 7913952 - DNA, 22 bp, Homo sapiens
ttggcagtgactgcgggccccg

SEQ ID NO: 7913953 - DNA, 22 bp, Homo sapiens
ttggcagtctcagtcagatggc

SEQ ID NO: 7913954 - DNA, 22 bp, Homo sapiens
ttggcagtccaggattaatata

SEQ ID NO: 7913955 - DNA, 22 bp, Homo sapiens
ttggcagtcagtcttggtgctt

SEQ ID NO: 7913956 - DNA, 22 bp, Homo sapiens
ttggcagtcagtcttggtgctt

SEQ ID NO: 7913957 - DNA, 22 bp, Homo sapiens
ttggcagtagtggtagtacatt

SEQ ID NO: 7913958 - DNA, 22 bp, Homo sapiens
ttggcagtcaccatcgtgtaga

SEQ ID NO: 7913959 - DNA, 22 bp, Homo sapiens
ttggcagtcaccatcgtgtaga

SEQ ID NO: 7913960 - DNA, 21 bp, Homo sapiens
ttggcagtcagaaatgtgagg

SEQ ID NO: 7913961 - DNA, 21 bp, Homo sapiens
ttggcagtcagaaatgtgagg

SEQ ID NO: 7913962 - DNA, 22 bp, Homo sapiens
ttggcagtcagtcttggtgctt

SEQ ID NO: 7913963 - DNA, 22 bp, Homo sapiens
ttggaggactagttaagagacc

SEQ ID NO: 7913964 - DNA, 22 bp, Homo sapiens
ttggaggactagttaagagacc

SEQ ID NO: 7913965 - DNA, 22 bp, Homo sapiens
ttggaggaagctcatgggggat

SEQ ID NO: 7913966 - DNA, 22 bp, Homo sapiens
ttggaggaggcattggaggatt

SEQ ID NO: 7913967 - DNA, 22 bp, Homo sapiens
ttggaggaaattgcttttgtgg

SEQ ID NO: 7913968 - DNA, 22 bp, Homo sapiens
ttggaggaagctcatgggggat

SEQ ID NO: 7913969 - DNA, 22 bp, Homo sapiens
ttggagctaccaggaagggctg

SEQ ID NO: 7913970 - DNA, 22 bp, Homo sapiens
ttggcagcattccagccaagca

SEQ ID NO: 7913971 - DNA, 22 bp, Homo sapiens
ttggcagcatccaagtctcggg

SEQ ID NO: 7913972 - DNA, 22 bp, Homo sapiens
ttggcagcatacagttggattg

SEQ ID NO: 7913973 - DNA, 22 bp, Homo sapiens
ttggcagcagggagttggccgc

SEQ ID NO: 7913974 - DNA, 20 bp, Homo sapiens
ttggcagcagttccaagtga

SEQ ID NO: 7913975 - DNA, 22 bp, Homo sapiens
ttggaggaggcattggaggatt

SEQ ID NO: 7913976 - DNA, 22 bp, Homo sapiens
ttggcagctacttccccagtgc

SEQ ID NO: 7913977 - DNA, 22 bp, Homo sapiens
ttggcagctacttccccagtgc

SEQ ID NO: 7913978 - DNA, 23 bp, Homo sapiens
ttggcagcgggtcaggctgtggg

SEQ ID NO: 7913979 - DNA, 22 bp, Homo sapiens
ttggcagcggggaccctggctg

SEQ ID NO: 7913980 - DNA, 22 bp, Homo sapiens
ttggcagccctgacccaatggg

SEQ ID NO: 7913981 - DNA, 22 bp, Homo sapiens
ttggcagcccagcttactagca

SEQ ID NO: 7913982 - DNA, 22 bp, Homo sapiens
ttggcagccaggacccgcctgg

SEQ ID NO: 7913983 - DNA, 20 bp, Homo sapiens
ttggcagcttcagggtacta

SEQ ID NO: 7913984 - DNA, 22 bp, Homo sapiens
ttggcagctgttggaccttgac

SEQ ID NO: 7913985 - DNA, 22 bp, Homo sapiens
ttggcaggaatattgcagaggt

SEQ ID NO: 7913986 - DNA, 22 bp, Homo sapiens
ttggcaggaatattgcagaggt

SEQ ID NO: 7913987 - DNA, 22 bp, Homo sapiens
ttggcagctgcacagactccat

SEQ ID NO: 7913988 - DNA, 22 bp, Homo sapiens
ttggcagctgcacagactccat

SEQ ID NO: 7913989 - DNA, 19 bp, Homo sapiens
ttggcagctgagatcctgc

SEQ ID NO: 7913990 - DNA, 22 bp, Homo sapiens
ttggcagctcttgatggcaccc

SEQ ID NO: 7913991 - DNA, 19 bp, Homo sapiens
ttggcagctgagatcctgc

SEQ ID NO: 7913992 - DNA, 21 bp, Homo sapiens
ttggaacaagcagcagtttgc

SEQ ID NO: 7913993 - DNA, 22 bp, Homo sapiens
ttggaacaatcacatccttgct

SEQ ID NO: 7913994 - DNA, 22 bp, Homo sapiens
ttggaaattgcaagtgatttgc

SEQ ID NO: 7913995 - DNA, 22 bp, Homo sapiens
ttggaaattgcaagtgatttgc

SEQ ID NO: 7913996 - DNA, 22 bp, Homo sapiens
ttggaaattgcaagtgatttgc

SEQ ID NO: 7913997 - DNA, 22 bp, Homo sapiens
ttggaaatgcatttgttattat

SEQ ID NO: 7913998 - DNA, 22 bp, Homo sapiens
ttggaaatggctgtagttatga

SEQ ID NO: 7913999 - DNA, 22 bp, Homo sapiens
ttggaaatgcatttgttattat

SEQ ID NO: 7914000 - DNA, 23 bp, Homo sapiens
ttggaaatggggagaacagattc

SEQ ID NO: 7914001 - DNA, 22 bp, Homo sapiens
ttggaaatggctgtagttatga

SEQ ID NO: 7914002 - DNA, 23 bp, Homo sapiens
ttggaaatggggagaacagattc

SEQ ID NO: 7914003 - DNA, 23 bp, Homo sapiens
ttggaaatggggagaacagattc

SEQ ID NO: 7914004 - DNA, 22 bp, Homo sapiens
ttggaaatgtagaaaagcagat

SEQ ID NO: 7914005 - DNA, 22 bp, Homo sapiens
ttggaaagtttttactgaagac

SEQ ID NO: 7914006 - DNA, 22 bp, Homo sapiens
ttggaaagtttttactgaagac

SEQ ID NO: 7914007 - DNA, 22 bp, Homo sapiens
ttggaaatacagcagttacttt

SEQ ID NO: 7914008 - DNA, 22 bp, Homo sapiens
ttggaaatacagcagttacttt

SEQ ID NO: 7914009 - DNA, 22 bp, Homo sapiens
ttggaaatacagcagttacttt

SEQ ID NO: 7914010 - DNA, 22 bp, Homo sapiens
ttggaaatacgagtagtatcat

SEQ ID NO: 7914011 - DNA, 22 bp, Homo sapiens
ttggaaatacgagtagtatcat

SEQ ID NO: 7914012 - DNA, 22 bp, Homo sapiens
ttggaaatacgagtagtatcat

SEQ ID NO: 7914013 - DNA, 22 bp, Homo sapiens
ttggaaatgcaaatatattgaa

SEQ ID NO: 7914014 - DNA, 22 bp, Homo sapiens
ttggaaatgatttctattatta

SEQ ID NO: 7914015 - DNA, 22 bp, Homo sapiens
ttggaaatgatttctattatta

SEQ ID NO: 7914016 - DNA, 22 bp, Homo sapiens
ttggaaatgatttctattatta

SEQ ID NO: 7914017 - DNA, 22 bp, Homo sapiens
ttggaaatgcaaatatattgaa

SEQ ID NO: 7914018 - DNA, 22 bp, Homo sapiens
ttggaaatgcaaatatattgaa

SEQ ID NO: 7914019 - DNA, 22 bp, Homo sapiens
ttggaaatgcaaatatattgaa

SEQ ID NO: 7914020 - DNA, 22 bp, Homo sapiens
ttggaatttgagaccaagaaaa

SEQ ID NO: 7914021 - DNA, 22 bp, Homo sapiens
ttggaatttcatgtaagtgact

SEQ ID NO: 7914022 - DNA, 22 bp, Homo sapiens
ttggaatttgcttcagctaata

SEQ ID NO: 7914023 - DNA, 22 bp, Homo sapiens
ttggaattttccaggtacagtg

SEQ ID NO: 7914024 - DNA, 22 bp, Homo sapiens
ttggacacaaaatccgtgtgat

SEQ ID NO: 7914025 - DNA, 22 bp, Homo sapiens
ttggacacactgattggccagg

SEQ ID NO: 7914026 - DNA, 22 bp, Homo sapiens
ttggacaaaagaatattccagg

SEQ ID NO: 7914027 - DNA, 22 bp, Homo sapiens
ttggaattttccaggtacagtg

SEQ ID NO: 7914028 - DNA, 22 bp, Homo sapiens
ttggaatttgcttcagctaata

SEQ ID NO: 7914029 - DNA, 22 bp, Homo sapiens
ttggacactgagactagcaagc

SEQ ID NO: 7914030 - DNA, 22 bp, Homo sapiens
ttggacagaatttatcttcagt

SEQ ID NO: 7914031 - DNA, 22 bp, Homo sapiens
ttggacagaatttatcttcagt

SEQ ID NO: 7914032 - DNA, 22 bp, Homo sapiens
ttggacacagctggcctttcca

SEQ ID NO: 7914033 - DNA, 21 bp, Homo sapiens
ttggacactccctgtgctgtg

SEQ ID NO: 7914034 - DNA, 22 bp, Homo sapiens
ttggaattgaggatttacatag

SEQ ID NO: 7914035 - DNA, 22 bp, Homo sapiens
ttggaacacaatgtttctttca

SEQ ID NO: 7914036 - DNA, 22 bp, Homo sapiens
ttggaattggacatgttgaagg

SEQ ID NO: 7914037 - DNA, 22 bp, Homo sapiens
ttggaatttagtaaaataatgc

SEQ ID NO: 7914038 - DNA, 22 bp, Homo sapiens
ttggaatttagtaaaataatgc

SEQ ID NO: 7914039 - DNA, 22 bp, Homo sapiens
ttggaatttcatgtaagtgact

SEQ ID NO: 7914040 - DNA, 22 bp, Homo sapiens
ttggaattgctattgataacaa

SEQ ID NO: 7914041 - DNA, 22 bp, Homo sapiens
ttggaattgctcataagagaga

SEQ ID NO: 7914042 - DNA, 22 bp, Homo sapiens
ttggaattgctattgataacaa

SEQ ID NO: 7914043 - DNA, 22 bp, Homo sapiens
ttggaaagcagccgcagccaat

SEQ ID NO: 7914044 - DNA, 22 bp, Homo sapiens
ttggaaagattattattatgaa

SEQ ID NO: 7914045 - DNA, 22 bp, Homo sapiens
ttggaaactttcaagcataatg

SEQ ID NO: 7914046 - DNA, 22 bp, Homo sapiens
ttggaaactttcaagcataatg

SEQ ID NO: 7914047 - DNA, 22 bp, Homo sapiens
ttggaaagaagggctgagcaag

SEQ ID NO: 7914048 - DNA, 22 bp, Homo sapiens
ttggaaagaagggctgagcaag

SEQ ID NO: 7914049 - DNA, 22 bp, Homo sapiens
ttggaaacgtcaccttttcctt

SEQ ID NO: 7914050 - DNA, 22 bp, Homo sapiens
ttggaaagcccattatttggac

SEQ ID NO: 7914051 - DNA, 22 bp, Homo sapiens
ttggaaaggagattctattgtg

SEQ ID NO: 7914052 - DNA, 22 bp, Homo sapiens
ttggaaaggagattctattgtg

SEQ ID NO: 7914053 - DNA, 22 bp, Homo sapiens
ttggaaagggaggaatgtagac

SEQ ID NO: 7914054 - DNA, 22 bp, Homo sapiens
ttggaaagggaggaatgtagac

SEQ ID NO: 7914055 - DNA, 22 bp, Homo sapiens
ttggaaagggaggaatgtagac

SEQ ID NO: 7914056 - DNA, 22 bp, Homo sapiens
ttggaaagtttttactgaagac

SEQ ID NO: 7914057 - DNA, 22 bp, Homo sapiens
ttgcttatttgattaaatgtct

SEQ ID NO: 7914058 - DNA, 22 bp, Homo sapiens
ttgcttatttgattaaatgtct

SEQ ID NO: 7914059 - DNA, 22 bp, Homo sapiens
ttgcttcactacttctaggctc

SEQ ID NO: 7914060 - DNA, 22 bp, Homo sapiens
ttgcttcaccccaccttgttgc

SEQ ID NO: 7914061 - DNA, 22 bp, Homo sapiens
ttgcttcagagggagacacttt

SEQ ID NO: 7914062 - DNA, 22 bp, Homo sapiens
ttgcttcagagggagacacttt

SEQ ID NO: 7914063 - DNA, 22 bp, Homo sapiens
ttgctttatttggcatgccact

SEQ ID NO: 7914064 - DNA, 23 bp, Homo sapiens
ttgctttcatcatgagatgctcc

SEQ ID NO: 7914065 - DNA, 23 bp, Homo sapiens
ttgctttcatcatgagatgctcc

SEQ ID NO: 7914066 - DNA, 22 bp, Homo sapiens
ttgctttatttggcatgccact

SEQ ID NO: 7914067 - DNA, 22 bp, Homo sapiens
ttgctttattgggtttactgcc

SEQ ID NO: 7914068 - DNA, 22 bp, Homo sapiens
ttgctttattgggtttactgcc

SEQ ID NO: 7914069 - DNA, 22 bp, Homo sapiens
ttgctttattgggtttactgcc

SEQ ID NO: 7914070 - DNA, 22 bp, Homo sapiens
ttgctttattgggtttactgcc

SEQ ID NO: 7914071 - DNA, 22 bp, Homo sapiens
ttggaaaatgtatttctagaag

SEQ ID NO: 7914072 - DNA, 23 bp, Homo sapiens
ttggaaacctgttttagctgttt

SEQ ID NO: 7914073 - DNA, 23 bp, Homo sapiens
ttggaaacctgttttagctgttt

SEQ ID NO: 7914074 - DNA, 22 bp, Homo sapiens
ttggaaaccaggctttgagacg

SEQ ID NO: 7914075 - DNA, 22 bp, Homo sapiens
ttggaaaccaggctttgagacg

SEQ ID NO: 7914076 - DNA, 22 bp, Homo sapiens
ttggaaacaagatttctactta

SEQ ID NO: 7914077 - DNA, 22 bp, Homo sapiens
ttggaaacaagatttctactta

SEQ ID NO: 7914078 - DNA, 22 bp, Homo sapiens
ttggaaacaattgctttcttcc

SEQ ID NO: 7914079 - DNA, 22 bp, Homo sapiens
ttggaaacaattgctttcttcc

SEQ ID NO: 7914080 - DNA, 22 bp, Homo sapiens
ttgcatttaagtagatgttaca

SEQ ID NO: 7914081 - DNA, 22 bp, Homo sapiens
ttgcattgcttggtcttcaaga

SEQ ID NO: 7914082 - DNA, 22 bp, Homo sapiens
ttgcatgtttttgtaatacacc

SEQ ID NO: 7914083 - DNA, 22 bp, Homo sapiens
ttgcatgttgggctcatcctct

SEQ ID NO: 7914084 - DNA, 22 bp, Homo sapiens
ttgcatgttatttaatctgtat

SEQ ID NO: 7914085 - DNA, 22 bp, Homo sapiens
ttgcatgttccaaagaattttg

SEQ ID NO: 7914086 - DNA, 22 bp, Homo sapiens
ttgctctatgtttgtaaacaga

SEQ ID NO: 7914087 - DNA, 22 bp, Homo sapiens
ttgctctcagaggaggaggccg

SEQ ID NO: 7914088 - DNA, 22 bp, Homo sapiens
ttgctctatgtttgtaaacaga

SEQ ID NO: 7914089 - DNA, 22 bp, Homo sapiens
ttgctctatgtttgtaaacaga

SEQ ID NO: 7914090 - DNA, 22 bp, Homo sapiens
ttgctctccagaggctcacagc

SEQ ID NO: 7914091 - DNA, 22 bp, Homo sapiens
ttgctctcggggaggctgcagg

SEQ ID NO: 7914092 - DNA, 22 bp, Homo sapiens
ttgcatttactgcaccgtgagt

SEQ ID NO: 7914093 - DNA, 22 bp, Homo sapiens
ttgctccaggctgcagactctg

SEQ ID NO: 7914094 - DNA, 22 bp, Homo sapiens
ttgctcattccgtgagaagatc

SEQ ID NO: 7914095 - DNA, 22 bp, Homo sapiens
ttgctcatatttgcatgtgttt

SEQ ID NO: 7914096 - DNA, 22 bp, Homo sapiens
ttgctcttgaaaattgatgctg

SEQ ID NO: 7914097 - DNA, 22 bp, Homo sapiens
ttgctctgtccagccagcaggt

SEQ ID NO: 7914098 - DNA, 22 bp, Homo sapiens
ttgctctgtccagccagcaggt

SEQ ID NO: 7914099 - DNA, 22 bp, Homo sapiens
ttgctctgtcagggcctcagtc

SEQ ID NO: 7914100 - DNA, 22 bp, Homo sapiens
ttgctctgtaataatctggggt

SEQ ID NO: 7914101 - DNA, 22 bp, Homo sapiens
ttgctctgtcagggcctcagtc

SEQ ID NO: 7914102 - DNA, 22 bp, Homo sapiens
ttgctctgattaggtggaaaca

SEQ ID NO: 7914103 - DNA, 22 bp, Homo sapiens
ttgctctgactggagtgcagtg

SEQ ID NO: 7914104 - DNA, 22 bp, Homo sapiens
ttgctctgcagtccagacagta

SEQ ID NO: 7914105 - DNA, 22 bp, Homo sapiens
ttgctctgtaataatctggggt

SEQ ID NO: 7914106 - DNA, 22 bp, Homo sapiens
ttgctctgcagtccagacagta

SEQ ID NO: 7914107 - DNA, 21 bp, Homo sapiens
ttgcttatggcactgctttgc

SEQ ID NO: 7914108 - DNA, 22 bp, Homo sapiens
ttgcttatgcctcttgacaaag

SEQ ID NO: 7914109 - DNA, 22 bp, Homo sapiens
ttgcttatttgattaaatgtct

SEQ ID NO: 7914110 - DNA, 22 bp, Homo sapiens
ttgcttagagccaatcttgatt

SEQ ID NO: 7914111 - DNA, 22 bp, Homo sapiens
ttgctgttttacatctggtggg

SEQ ID NO: 7914112 - DNA, 22 bp, Homo sapiens
ttgctgtttaatgatgtcttat

SEQ ID NO: 7914113 - DNA, 22 bp, Homo sapiens
ttgctgaattgaatcctttggt

SEQ ID NO: 7914114 - DNA, 22 bp, Homo sapiens
ttgctgagagcgtgtcaacaag

SEQ ID NO: 7914115 - DNA, 22 bp, Homo sapiens
ttgctgacctttgctctccgtt

SEQ ID NO: 7914116 - DNA, 23 bp, Homo sapiens
ttgctgagataaagaatgcaggg

SEQ ID NO: 7914117 - DNA, 22 bp, Homo sapiens
ttgctgtgaaaccatgggaagt

SEQ ID NO: 7914118 - DNA, 22 bp, Homo sapiens
ttgctgttacaattatttaccc

SEQ ID NO: 7914119 - DNA, 22 bp, Homo sapiens
ttgctgtgtctgatggctgaga

SEQ ID NO: 7914120 - DNA, 20 bp, Homo sapiens
ttgctgttgccaagattttg

SEQ ID NO: 7914121 - DNA, 22 bp, Homo sapiens
ttgctgttacaattatttaccc

SEQ ID NO: 7914122 - DNA, 22 bp, Homo sapiens
ttgctgtgtcatttgtttaatc

SEQ ID NO: 7914123 - DNA, 22 bp, Homo sapiens
ttgctgtgaaaccatgggaagt

SEQ ID NO: 7914124 - DNA, 22 bp, Homo sapiens
ttgctgtgtaactcctggcctg

SEQ ID NO: 7914125 - DNA, 22 bp, Homo sapiens
ttgctgaagttgctcagctcca

SEQ ID NO: 7914126 - DNA, 22 bp, Homo sapiens
ttgctgaagttgctcagctcca

SEQ ID NO: 7914127 - DNA, 22 bp, Homo sapiens
ttgctgaatgcaagttggatag

SEQ ID NO: 7914128 - DNA, 22 bp, Homo sapiens
ttgctgaagttaatgcttgcaa

SEQ ID NO: 7914129 - DNA, 22 bp, Homo sapiens
ttgctgaagtgaaggtatgttt

SEQ ID NO: 7914130 - DNA, 22 bp, Homo sapiens
ttgctgaagtattgtgaatcct

SEQ ID NO: 7914131 - DNA, 22 bp, Homo sapiens
ttgctgaagtatgaaaaagaca

SEQ ID NO: 7914132 - DNA, 19 bp, Homo sapiens
ttgctgaaggaagcctctg

SEQ ID NO: 7914133 - DNA, 22 bp, Homo sapiens
ttgctgaaggcctcttggggtt

SEQ ID NO: 7914134 - DNA, 22 bp, Homo sapiens
ttgctgaagctgccaaaccagt

SEQ ID NO: 7914135 - DNA, 22 bp, Homo sapiens
ttgctgaaccctgccctctaat

SEQ ID NO: 7914136 - DNA, 22 bp, Homo sapiens
ttgctgaagaaaaaatatgtta

SEQ ID NO: 7914137 - DNA, 22 bp, Homo sapiens
ttgctgaaagtggcaagaagta

SEQ ID NO: 7914138 - DNA, 22 bp, Homo sapiens
ttgctgaaaggtagctgtgtgg

SEQ ID NO: 7914139 - DNA, 22 bp, Homo sapiens
ttgctgaaagtggcaagaagta

SEQ ID NO: 7914140 - DNA, 22 bp, Homo sapiens
ttgctgaaatctatgacatcct

SEQ ID NO: 7914141 - DNA, 22 bp, Homo sapiens
ttgctgaaaacagtgggtattg

SEQ ID NO: 7914142 - DNA, 22 bp, Homo sapiens
ttgctgaaaagctggcctttgt

SEQ ID NO: 7914143 - DNA, 22 bp, Homo sapiens
ttgctgaaaggtagctgtgtgg

SEQ ID NO: 7914144 - DNA, 22 bp, Homo sapiens
ttgctgaaaacaggtcatcagg

SEQ ID NO: 7914145 - DNA, 22 bp, Homo sapiens
ttgctgaaaacaggtcatcagg

SEQ ID NO: 7914146 - DNA, 22 bp, Homo sapiens
ttgctgaaaacaggtcatcagg

SEQ ID NO: 7914147 - DNA, 22 bp, Homo sapiens
ttgcacaaaaaattgttgaata

SEQ ID NO: 7914148 - DNA, 22 bp, Homo sapiens
ttgcaattgctatggagagcgt

SEQ ID NO: 7914149 - DNA, 22 bp, Homo sapiens
ttgcaattgctatggagagcgt

SEQ ID NO: 7914150 - DNA, 22 bp, Homo sapiens
ttgcaattgctatggagagcgt

SEQ ID NO: 7914151 - DNA, 22 bp, Homo sapiens
ttgcaattgctatggagagcgt

SEQ ID NO: 7914152 - DNA, 22 bp, Homo sapiens
ttgacaggaaatatggtggcag

SEQ ID NO: 7914153 - DNA, 22 bp, Homo sapiens
ttgacaggatataaagacataa

SEQ ID NO: 7914154 - DNA, 22 bp, Homo sapiens
ttgacaggctattattaaaatg

SEQ ID NO: 7914155 - DNA, 23 bp, Homo sapiens
ttgacagtaggtggttttcattg

SEQ ID NO: 7914156 - DNA, 23 bp, Homo sapiens
ttgacagtaggtggttttcattg

SEQ ID NO: 7914157 - DNA, 22 bp, Homo sapiens
ttgacagggccaagaatggacc

SEQ ID NO: 7914158 - DNA, 22 bp, Homo sapiens
ttgacacagttttctcattaag

SEQ ID NO: 7914159 - DNA, 22 bp, Homo sapiens
ttgacacagtcaacttgatttt

SEQ ID NO: 7914160 - DNA, 22 bp, Homo sapiens
ttgacacattagagcttgtaaa

SEQ ID NO: 7914161 - DNA, 22 bp, Homo sapiens
ttgacacattagagcttgtaaa

SEQ ID NO: 7914162 - DNA, 22 bp, Homo sapiens
ttgacactaagatttccaaaca

SEQ ID NO: 7914163 - DNA, 22 bp, Homo sapiens
ttgacagaaatgtatttgcatg

SEQ ID NO: 7914164 - DNA, 22 bp, Homo sapiens
ttgacagaaatgtatttgcatg

SEQ ID NO: 7914165 - DNA, 22 bp, Homo sapiens
ttgacagaatgttacatataga

SEQ ID NO: 7914166 - DNA, 22 bp, Homo sapiens
ttgacagaatgttacatataga

SEQ ID NO: 7914167 - DNA, 22 bp, Homo sapiens
ttgacagagctaggtcaactct

SEQ ID NO: 7914168 - DNA, 22 bp, Homo sapiens
ttgacagatgtgaaagtgagca

SEQ ID NO: 7914169 - DNA, 22 bp, Homo sapiens
ttgcagagatcagcaggtttga

SEQ ID NO: 7914170 - DNA, 22 bp, Homo sapiens
ttgcagagaggttaggaactca

SEQ ID NO: 7914171 - DNA, 22 bp, Homo sapiens
ttgcagagcagtaggaatatag

SEQ ID NO: 7914172 - DNA, 22 bp, Homo sapiens
ttgcagagccatgaggctggct

SEQ ID NO: 7914173 - DNA, 22 bp, Homo sapiens
ttgcagatatttccgatgctat

SEQ ID NO: 7914174 - DNA, 22 bp, Homo sapiens
ttgcagatatatggagtgcatt

SEQ ID NO: 7914175 - DNA, 22 bp, Homo sapiens
ttgcagaggcaaaaatgaactc

SEQ ID NO: 7914176 - DNA, 22 bp, Homo sapiens
ttgcagaacttaaagacagagt

SEQ ID NO: 7914177 - DNA, 22 bp, Homo sapiens
ttgcagaagcctgttgttcctg

SEQ ID NO: 7914178 - DNA, 22 bp, Homo sapiens
ttgcagaagggcacagtgatca

SEQ ID NO: 7914179 - DNA, 22 bp, Homo sapiens
ttgcagaatacttattctgtat

SEQ ID NO: 7914180 - DNA, 22 bp, Homo sapiens
ttgcagaatctcaggaaggaga

SEQ ID NO: 7914181 - DNA, 22 bp, Homo sapiens
ttgcagaattaagcagagagcc

SEQ ID NO: 7914182 - DNA, 22 bp, Homo sapiens
ttgcagacttacttcgagaaat

SEQ ID NO: 7914183 - DNA, 23 bp, Homo sapiens
ttgaatttctcttgcaatattta

SEQ ID NO: 7914184 - DNA, 22 bp, Homo sapiens
ttgacaaaaacctcatttcacc

SEQ ID NO: 7914185 - DNA, 22 bp, Homo sapiens
ttgacaaaaacctcatttcacc

SEQ ID NO: 7914186 - DNA, 22 bp, Homo sapiens
ttgacaaaaacctcatttcacc

SEQ ID NO: 7914187 - DNA, 22 bp, Homo sapiens
ttgacaaaaataacacagcata

SEQ ID NO: 7914188 - DNA, 22 bp, Homo sapiens
ttgacaaaaataacacagcata

SEQ ID NO: 7914189 - DNA, 22 bp, Homo sapiens
ttgacaaaaataacacagcata

SEQ ID NO: 7914190 - DNA, 22 bp, Homo sapiens
ttgacaaaacaacacagatttc

SEQ ID NO: 7914191 - DNA, 22 bp, Homo sapiens
ttgacaaaacaacacagatttc

SEQ ID NO: 7914192 - DNA, 22 bp, Homo sapiens
ttgacaaaacaacacagatttc

SEQ ID NO: 7914193 - DNA, 22 bp, Homo sapiens
ttgacaaaacaacacagatttc

SEQ ID NO: 7914194 - DNA, 22 bp, Homo sapiens
ttgacaaaacaacacagatttc

SEQ ID NO: 7914195 - DNA, 22 bp, Homo sapiens
ttgacaaaaacctcatttcacc

SEQ ID NO: 7914196 - DNA, 22 bp, Homo sapiens
ttgacaaagatatattcatgct

SEQ ID NO: 7914197 - DNA, 22 bp, Homo sapiens
ttgacaaagatatattcatgct

SEQ ID NO: 7914198 - DNA, 22 bp, Homo sapiens
ttgacaaagatatattcatgct

SEQ ID NO: 7914199 - DNA, 22 bp, Homo sapiens
ttgacaaagatatattcatgct

SEQ ID NO: 7914200 - DNA, 22 bp, Homo sapiens
ttgacaaaggaattgaatctct

SEQ ID NO: 7914201 - DNA, 22 bp, Homo sapiens
ttgacaaagatatattcatgct

SEQ ID NO: 7914202 - DNA, 22 bp, Homo sapiens
ttgacaaaggaattgaatctct

SEQ ID NO: 7914203 - DNA, 22 bp, Homo sapiens
ttgacaaaggaattgaatctct

SEQ ID NO: 7914204 - DNA, 22 bp, Homo sapiens
ttgacaaaggctgagaggaaaa

SEQ ID NO: 7914205 - DNA, 22 bp, Homo sapiens
ttgacaaaggaccttgctattt

SEQ ID NO: 7914206 - DNA, 22 bp, Homo sapiens
ttgacaaaggaccttgctattt

SEQ ID NO: 7914207 - DNA, 22 bp, Homo sapiens
ttgacaatgtcctttgaatttc

SEQ ID NO: 7914208 - DNA, 22 bp, Homo sapiens
ttgacaatgtcctttgaatttc

SEQ ID NO: 7914209 - DNA, 22 bp, Homo sapiens
ttgacacaatgtatattttcaa

SEQ ID NO: 7914210 - DNA, 22 bp, Homo sapiens
ttgacacagatcaatattcaac

SEQ ID NO: 7914211 - DNA, 22 bp, Homo sapiens
ttgacacagatcaatattcaac

SEQ ID NO: 7914212 - DNA, 22 bp, Homo sapiens
ttgacacagatcaatattcaac

SEQ ID NO: 7914213 - DNA, 22 bp, Homo sapiens
ttgacaagcgaagtaccataat

SEQ ID NO: 7914214 - DNA, 22 bp, Homo sapiens
ttgacaagtggagatatttaag

SEQ ID NO: 7914215 - DNA, 22 bp, Homo sapiens
ttgacaaagtttagtaataatc

SEQ ID NO: 7914216 - DNA, 22 bp, Homo sapiens
ttgacaaagtttagtaataatc

SEQ ID NO: 7914217 - DNA, 22 bp, Homo sapiens
ttgacaaagtttagtaataatc

SEQ ID NO: 7914218 - DNA, 22 bp, Homo sapiens
ttgacaaagtttagtaataatc

SEQ ID NO: 7914219 - DNA, 22 bp, Homo sapiens
ttgacaaatacccattagacca

SEQ ID NO: 7914220 - DNA, 22 bp, Homo sapiens
ttgacaagaacaccggtttgag

SEQ ID NO: 7914221 - DNA, 22 bp, Homo sapiens
ttgcatgtagaatactcaactt

SEQ ID NO: 7914222 - DNA, 22 bp, Homo sapiens
ttgcatgggcaacaggaggtgg

SEQ ID NO: 7914223 - DNA, 22 bp, Homo sapiens
ttgcatgtacgtacagagagag

SEQ ID NO: 7914224 - DNA, 22 bp, Homo sapiens
ttgcaggttgaatcagcagact

SEQ ID NO: 7914225 - DNA, 22 bp, Homo sapiens
ttgcaggttttgccattagaag

SEQ ID NO: 7914226 - DNA, 22 bp, Homo sapiens
ttgcagttaaaaatcattagtt

SEQ ID NO: 7914227 - DNA, 23 bp, Homo sapiens
ttgcatggagcctgggattcctc

SEQ ID NO: 7914228 - DNA, 22 bp, Homo sapiens
ttgcagttgctgtatttaagga

SEQ ID NO: 7914229 - DNA, 22 bp, Homo sapiens
ttgcagttgcatatgcccctac

SEQ ID NO: 7914230 - DNA, 22 bp, Homo sapiens
ttgcagttgctgtatttaagga

SEQ ID NO: 7914231 - DNA, 22 bp, Homo sapiens
ttgcaggttcaagaaactgatt

SEQ ID NO: 7914232 - DNA, 22 bp, Homo sapiens
ttgcaggttagagacctgtgga

SEQ ID NO: 7914233 - DNA, 22 bp, Homo sapiens
ttgcaggtggtttggccataga

SEQ ID NO: 7914234 - DNA, 22 bp, Homo sapiens
ttgcaggtgaaatgggcctggc

SEQ ID NO: 7914235 - DNA, 22 bp, Homo sapiens
ttgcaggtgagggaaatgactg

SEQ ID NO: 7914236 - DNA, 22 bp, Homo sapiens
ttgcaggtctgggggtcctggt

SEQ ID NO: 7914237 - DNA, 22 bp, Homo sapiens
ttgcaggtctccatgagtgcga

SEQ ID NO: 7914238 - DNA, 22 bp, Homo sapiens
ttgcaggtccggaacctcgccg

SEQ ID NO: 7914239 - DNA, 22 bp, Homo sapiens
ttgcaggtatatttacttttcc

SEQ ID NO: 7914240 - DNA, 18 bp, Homo sapiens
ttgcaggtacctctatct

SEQ ID NO: 7914241 - DNA, 22 bp, Homo sapiens
ttgcagggttgacactgcctgc

SEQ ID NO: 7914242 - DNA, 22 bp, Homo sapiens
ttgcagggttgaccaataggct

SEQ ID NO: 7914243 - DNA, 22 bp, Homo sapiens
ttgcaggggaaggagcagagct

SEQ ID NO: 7914244 - DNA, 22 bp, Homo sapiens
ttgcaggggaaggagcagagct

SEQ ID NO: 7914245 - DNA, 22 bp, Homo sapiens
ttgcaggggagaggaacaaaca

SEQ ID NO: 7914246 - DNA, 22 bp, Homo sapiens
ttgcagggtacattcttagaat

SEQ ID NO: 7914247 - DNA, 22 bp, Homo sapiens
ttgcagggtcctgtggctctcc

SEQ ID NO: 7914248 - DNA, 22 bp, Homo sapiens
ttgcagggttaaagtaaggtag

SEQ ID NO: 7914249 - DNA, 22 bp, Homo sapiens
ttgcagggtcccagaggcctgg

SEQ ID NO: 7914250 - DNA, 22 bp, Homo sapiens
ttgcagggtcccagaggcctgg

SEQ ID NO: 7914251 - DNA, 22 bp, Homo sapiens
ttgcagggctggaacatggaat

SEQ ID NO: 7914252 - DNA, 22 bp, Homo sapiens
ttgcaggggaaggagcagagct

SEQ ID NO: 7914253 - DNA, 22 bp, Homo sapiens
ttgcagggcatctatgtctggt

SEQ ID NO: 7914254 - DNA, 22 bp, Homo sapiens
ttgcagctgtgagctttacacg

SEQ ID NO: 7914255 - DNA, 22 bp, Homo sapiens
ttgcagctgtgagctttacacg

SEQ ID NO: 7914256 - DNA, 22 bp, Homo sapiens
ttgcagctgctgttcctcatgg

SEQ ID NO: 7914257 - DNA, 22 bp, Homo sapiens
ttgcagctgcagtaaatgttca

SEQ ID NO: 7914258 - DNA, 22 bp, Homo sapiens
ttgcagcttagtgatgttatct

SEQ ID NO: 7914259 - DNA, 22 bp, Homo sapiens
ttgcagctgttgcaaagtctct

SEQ ID NO: 7914260 - DNA, 22 bp, Homo sapiens
ttgcagcttcaagcaggttgac

SEQ ID NO: 7914261 - DNA, 22 bp, Homo sapiens
ttgcagcttcaagcaggttgac

SEQ ID NO: 7914262 - DNA, 22 bp, Homo sapiens
ttgcagcttctaacagcttcag

SEQ ID NO: 7914263 - DNA, 22 bp, Homo sapiens
ttgcagcttcgagtctatctgt

SEQ ID NO: 7914264 - DNA, 22 bp, Homo sapiens
ttgcagattaaaacactgagct

SEQ ID NO: 7914265 - DNA, 22 bp, Homo sapiens
ttgcagatgaagaaactgaagc

SEQ ID NO: 7914266 - DNA, 22 bp, Homo sapiens
ttgcagattcggctgctcagga

SEQ ID NO: 7914267 - DNA, 22 bp, Homo sapiens
ttgcagatcagctttcattgtc

SEQ ID NO: 7914268 - DNA, 22 bp, Homo sapiens
ttgcagatgaagaaagtggtag

SEQ ID NO: 7914269 - DNA, 22 bp, Homo sapiens
ttgcagattaaaacactgagct

SEQ ID NO: 7914270 - DNA, 22 bp, Homo sapiens
ttgcagcaaggtcatgaaatgt

SEQ ID NO: 7914271 - DNA, 22 bp, Homo sapiens
ttgcagatttcttcttacctgt

SEQ ID NO: 7914272 - DNA, 19 bp, Homo sapiens
ttgcagcaaagttaggacc

SEQ ID NO: 7914273 - DNA, 22 bp, Homo sapiens
ttgcagcagggtgaattcactc

SEQ ID NO: 7914274 - DNA, 22 bp, Homo sapiens
ttgcagctagaagattcactgt

SEQ ID NO: 7914275 - DNA, 22 bp, Homo sapiens
ttgcagctagaagattcactgt

SEQ ID NO: 7914276 - DNA, 22 bp, Homo sapiens
ttgcagcatattgatctcctgt

SEQ ID NO: 7914277 - DNA, 22 bp, Homo sapiens
ttgcagctctgatccagggacc

SEQ ID NO: 7914278 - DNA, 22 bp, Homo sapiens
ttgcagctctgatccagggacc

SEQ ID NO: 7914279 - DNA, 22 bp, Homo sapiens
ttgcagctgaggaaattgaagc

SEQ ID NO: 7914280 - DNA, 22 bp, Homo sapiens
ttgcagcttctaccactgtttc

SEQ ID NO: 7914281 - DNA, 22 bp, Homo sapiens
ttgcagcttctaacagcttcag

SEQ ID NO: 7914282 - DNA, 22 bp, Homo sapiens
ttgcagcttctaccactgtttc

SEQ ID NO: 7914283 - DNA, 22 bp, Homo sapiens
ttgcagcttcttgcatcagaaa

SEQ ID NO: 7914284 - DNA, 22 bp, Homo sapiens
ttgcagcttcttgcatcagaaa

SEQ ID NO: 7914285 - DNA, 22 bp, Homo sapiens
ttgcaggaaactgagtgtgagc

SEQ ID NO: 7914286 - DNA, 22 bp, Homo sapiens
ttgcaggattttagagatgaca

SEQ ID NO: 7914287 - DNA, 22 bp, Homo sapiens
ttgcagggaaacagtttaggaa

SEQ ID NO: 7914288 - DNA, 22 bp, Homo sapiens
ttgcaggacaatgatggtccct

SEQ ID NO: 7914289 - DNA, 22 bp, Homo sapiens
ttgcaggaagcacaagtctgag

SEQ ID NO: 7914290 - DNA, 22 bp, Homo sapiens
ttgcaggaagcacaagtctgag

SEQ ID NO: 7914291 - DNA, 22 bp, Homo sapiens
ttgcagggaaatagaaataaac

SEQ ID NO: 7914292 - DNA, 22 bp, Homo sapiens
ttgcagggaaatagaaataaac

SEQ ID NO: 7914293 - DNA, 22 bp, Homo sapiens
ttgcagggcaaatggtcagata

SEQ ID NO: 7914294 - DNA, 22 bp, Homo sapiens
ttgcagggataaaacaagtgaa

SEQ ID NO: 7914295 - DNA, 22 bp, Homo sapiens
ttgcagggataaaacaagtgaa

SEQ ID NO: 7914296 - DNA, 23 bp, Homo sapiens
ttgcagggatggagttcaaaatg

SEQ ID NO: 7914297 - DNA, 22 bp, Homo sapiens
ttgcagggacctgcagaaagct

SEQ ID NO: 7914298 - DNA, 22 bp, Homo sapiens
ttgcagggaaatcagtgaggat

SEQ ID NO: 7914299 - DNA, 22 bp, Homo sapiens
ttgcagggaaatcagtgaggat

SEQ ID NO: 7914300 - DNA, 22 bp, Homo sapiens
tttatatagagatttgtgcatg

SEQ ID NO: 7914301 - DNA, 22 bp, Homo sapiens
tttatatagagatttgtgcatg

SEQ ID NO: 7914302 - DNA, 22 bp, Homo sapiens
tttatataacagagactgctat

SEQ ID NO: 7914303 - DNA, 22 bp, Homo sapiens
tttagcatcgaagtaaatttag

SEQ ID NO: 7914304 - DNA, 22 bp, Homo sapiens
tttagcatccaaggttatgact

SEQ ID NO: 7914305 - DNA, 22 bp, Homo sapiens
tttagcatatttaaggaatgat

SEQ ID NO: 7914306 - DNA, 22 bp, Homo sapiens
tttagcagtgaagtgaagtgaa

SEQ ID NO: 7914307 - DNA, 22 bp, Homo sapiens
tttagcagctggtgttaccata

SEQ ID NO: 7914308 - DNA, 22 bp, Homo sapiens
tttagcagtatatttaaagcca

SEQ ID NO: 7914309 - DNA, 22 bp, Homo sapiens
tttagcagagcatatgatatcc

SEQ ID NO: 7914310 - DNA, 22 bp, Homo sapiens
tttagcagatctatgtatgtga

SEQ ID NO: 7914311 - DNA, 22 bp, Homo sapiens
tttagcagagcatatgatatcc

SEQ ID NO: 7914312 - DNA, 22 bp, Homo sapiens
tttagcaccttcactttctctg

SEQ ID NO: 7914313 - DNA, 20 bp, Homo sapiens
tttagcacattgtacaaaac

SEQ ID NO: 7914314 - DNA, 22 bp, Homo sapiens
tttagcactaatcagctgtggc

SEQ ID NO: 7914315 - DNA, 23 bp, Homo sapiens
tttagcacgtcgcccagggaggc

SEQ ID NO: 7914316 - DNA, 22 bp, Homo sapiens
tttagcacggtaacacataaag

SEQ ID NO: 7914317 - DNA, 16 bp, Homo sapiens
tttagcactggcatac

SEQ ID NO: 7914318 - DNA, 22 bp, Homo sapiens
tttagcactgaaagtccaggaa

SEQ ID NO: 7914319 - DNA, 22 bp, Homo sapiens
tttagcagaatttctctagaag

SEQ ID NO: 7914320 - DNA, 22 bp, Homo sapiens
tttagcagagcatatgatatcc

SEQ ID NO: 7914321 - DNA, 22 bp, Homo sapiens
tttagcacagaactccactcac

SEQ ID NO: 7914322 - DNA, 22 bp, Homo sapiens
tttagcaatttctaaaagtgtt

SEQ ID NO: 7914323 - DNA, 22 bp, Homo sapiens
tttagcaagtatttactgacta

SEQ ID NO: 7914324 - DNA, 22 bp, Homo sapiens
tttagcaatatcataaggaaga

SEQ ID NO: 7914325 - DNA, 23 bp, Homo sapiens
tttatattcctaatgtcttgagc

SEQ ID NO: 7914326 - DNA, 22 bp, Homo sapiens
tttatatatggctggtctggat

SEQ ID NO: 7914327 - DNA, 22 bp, Homo sapiens
tttatattgggagtcgttttga

SEQ ID NO: 7914328 - DNA, 22 bp, Homo sapiens
tttatattgggagtcgttttga

SEQ ID NO: 7914329 - DNA, 22 bp, Homo sapiens
tttatattgggagtcgttttga

SEQ ID NO: 7914330 - DNA, 22 bp, Homo sapiens
tttatattgggagtcgttttga

SEQ ID NO: 7914331 - DNA, 22 bp, Homo sapiens
tttatatagagatttgtgcatg

SEQ ID NO: 7914332 - DNA, 22 bp, Homo sapiens
tttatatatggctggtctggat

SEQ ID NO: 7914333 - DNA, 22 bp, Homo sapiens
tttatattgtaaaaatggttct

SEQ ID NO: 7914334 - DNA, 22 bp, Homo sapiens
tttatattgtaaaaatggttct

SEQ ID NO: 7914335 - DNA, 22 bp, Homo sapiens
tttatattgggagtcgttttga

SEQ ID NO: 7914336 - DNA, 22 bp, Homo sapiens
tttatattgtaaaaatggttct

SEQ ID NO: 7914337 - DNA, 22 bp, Homo sapiens
tttatcatcttgtttttaaagc

SEQ ID NO: 7914338 - DNA, 22 bp, Homo sapiens
tttatcatcttgtttttaaagc

SEQ ID NO: 7914339 - DNA, 22 bp, Homo sapiens
tttatccagaatcaggattttt

SEQ ID NO: 7914340 - DNA, 22 bp, Homo sapiens
tttatccacagtatccaaaatc

SEQ ID NO: 7914341 - DNA, 22 bp, Homo sapiens
tttatcagaagttagagaaaga

SEQ ID NO: 7914342 - DNA, 22 bp, Homo sapiens
tttatcagaagttagagaaaga

SEQ ID NO: 7914343 - DNA, 22 bp, Homo sapiens
tttatcaaacaaattatccagc

SEQ ID NO: 7914344 - DNA, 22 bp, Homo sapiens
tttatcaaacaaattatccagc

SEQ ID NO: 7914345 - DNA, 20 bp, Homo sapiens
tttatcaggcacttactatt

SEQ ID NO: 7914346 - DNA, 22 bp, Homo sapiens
tttatctgacctcacttcttaa

SEQ ID NO: 7914347 - DNA, 22 bp, Homo sapiens
tttatctgagctgatagatagt

SEQ ID NO: 7914348 - DNA, 22 bp, Homo sapiens
tttatctgagctgatagatagt

SEQ ID NO: 7914349 - DNA, 22 bp, Homo sapiens
tttatctgagctgatagatagt

SEQ ID NO: 7914350 - DNA, 22 bp, Homo sapiens
tttatctgagctgatagatagt

SEQ ID NO: 7914351 - DNA, 22 bp, Homo sapiens
tttattcaagatgaggttcatg

SEQ ID NO: 7914352 - DNA, 22 bp, Homo sapiens
tttattcaagatgaggttcatg

SEQ ID NO: 7914353 - DNA, 22 bp, Homo sapiens
tttatctgaggaaagcagacaa

SEQ ID NO: 7914354 - DNA, 22 bp, Homo sapiens
tttatctgaggaaagcagacaa

SEQ ID NO: 7914355 - DNA, 22 bp, Homo sapiens
tttatctgaggaaagcagacaa

SEQ ID NO: 7914356 - DNA, 22 bp, Homo sapiens
tttatctcttttgaccaagatt

SEQ ID NO: 7914357 - DNA, 22 bp, Homo sapiens
tttatctattgtattgttgatg

SEQ ID NO: 7914358 - DNA, 22 bp, Homo sapiens
tttatctattgtattgttgatg

SEQ ID NO: 7914359 - DNA, 22 bp, Homo sapiens
tttatccatcatctgctgaagg

SEQ ID NO: 7914360 - DNA, 22 bp, Homo sapiens
tttatccatcatctgctgaagg

SEQ ID NO: 7914361 - DNA, 22 bp, Homo sapiens
tttatccatatcattaaaatct

SEQ ID NO: 7914362 - DNA, 22 bp, Homo sapiens
tttatccagtgttggaattttt

SEQ ID NO: 7914363 - DNA, 22 bp, Homo sapiens
tttatccagcagctattcaaaa

SEQ ID NO: 7914364 - DNA, 22 bp, Homo sapiens
tttagagagaaataaatgagat

SEQ ID NO: 7914365 - DNA, 22 bp, Homo sapiens
tttagagaccctctgctatttt

SEQ ID NO: 7914366 - DNA, 22 bp, Homo sapiens
tttagagagaattttcaaagtg

SEQ ID NO: 7914367 - DNA, 22 bp, Homo sapiens
tttagagagaaataaatgagat

SEQ ID NO: 7914368 - DNA, 22 bp, Homo sapiens
tttagagagcactgtagacact

SEQ ID NO: 7914369 - DNA, 22 bp, Homo sapiens
tttagagaggctctgtaaaatg

SEQ ID NO: 7914370 - DNA, 22 bp, Homo sapiens
tttagagaggctctgtaaaatg

SEQ ID NO: 7914371 - DNA, 22 bp, Homo sapiens
tttagagagtgtaaaaatatat

SEQ ID NO: 7914372 - DNA, 22 bp, Homo sapiens
tttagagaggctctgtaaaatg

SEQ ID NO: 7914373 - DNA, 22 bp, Homo sapiens
tttagagaccctctgctatttt

SEQ ID NO: 7914374 - DNA, 22 bp, Homo sapiens
tttagagaattagaacagtact

SEQ ID NO: 7914375 - DNA, 22 bp, Homo sapiens
tttagagaattagaacagtact

SEQ ID NO: 7914376 - DNA, 22 bp, Homo sapiens
tttagaggggaaagtggctggt

SEQ ID NO: 7914377 - DNA, 22 bp, Homo sapiens
tttagaggttagaggctgatag

SEQ ID NO: 7914378 - DNA, 22 bp, Homo sapiens
tttagaggttagaggctgatag

SEQ ID NO: 7914379 - DNA, 22 bp, Homo sapiens
tttagaggttggggactttgca

SEQ ID NO: 7914380 - DNA, 22 bp, Homo sapiens
tttagagcagggtgtggcacat

SEQ ID NO: 7914381 - DNA, 22 bp, Homo sapiens
tttagagagtgtaaaaatatat

SEQ ID NO: 7914382 - DNA, 22 bp, Homo sapiens
tttagagctgtgctgccacatg

SEQ ID NO: 7914383 - DNA, 22 bp, Homo sapiens
tttagagcccatgtgagtgtga

SEQ ID NO: 7914384 - DNA, 22 bp, Homo sapiens
tttagattgtgacctcccccca

SEQ ID NO: 7914385 - DNA, 22 bp, Homo sapiens
tttagattgtgacctcccccca

SEQ ID NO: 7914386 - DNA, 22 bp, Homo sapiens
tttagcaaaaaagctctgcgta

SEQ ID NO: 7914387 - DNA, 22 bp, Homo sapiens
tttagagtttctaaatggaatt

SEQ ID NO: 7914388 - DNA, 22 bp, Homo sapiens
tttagataatgctcaagcaatt

SEQ ID NO: 7914389 - DNA, 22 bp, Homo sapiens
tttagatgctgtatgttatttc

SEQ ID NO: 7914390 - DNA, 22 bp, Homo sapiens
tttagatgctgtatgttatttc

SEQ ID NO: 7914391 - DNA, 22 bp, Homo sapiens
tttagagttgagtattcattgg

SEQ ID NO: 7914392 - DNA, 22 bp, Homo sapiens
tttagagttgagtattcattgg

SEQ ID NO: 7914393 - DNA, 22 bp, Homo sapiens
tttagcaaattagcacctctaa

SEQ ID NO: 7914394 - DNA, 22 bp, Homo sapiens
tttagcaaattagcacctctaa

SEQ ID NO: 7914395 - DNA, 22 bp, Homo sapiens
tttagcaaatatttctgttgat

SEQ ID NO: 7914396 - DNA, 22 bp, Homo sapiens
tttagcaaatatttctgttgat

SEQ ID NO: 7914397 - DNA, 22 bp, Homo sapiens
tttagcaaaggtgtcttgggca

SEQ ID NO: 7914398 - DNA, 22 bp, Homo sapiens
tttagcaaaacattatgtctgt

SEQ ID NO: 7914399 - DNA, 22 bp, Homo sapiens
tttagcaaaggtagggttcaga

SEQ ID NO: 7914400 - DNA, 21 bp, Homo sapiens
tttagcaagagtatagtgcat

SEQ ID NO: 7914401 - DNA, 22 bp, Homo sapiens
tttagcaagatgccctggcttt

SEQ ID NO: 7914402 - DNA, 22 bp, Homo sapiens
tttagcaagattgagccgtctt

SEQ ID NO: 7914403 - DNA, 22 bp, Homo sapiens
tttagcaaggagaaataatcct

SEQ ID NO: 7914404 - DNA, 22 bp, Homo sapiens
tttagcaaggtaggtccatgga

SEQ ID NO: 7914405 - DNA, 22 bp, Homo sapiens
tttaccaaagtactctgaggca

SEQ ID NO: 7914406 - DNA, 20 bp, Homo sapiens
tttacattttgaaacagtga

SEQ ID NO: 7914407 - DNA, 20 bp, Homo sapiens
tttacattttgaaacagtga

SEQ ID NO: 7914408 - DNA, 20 bp, Homo sapiens
tttacattttgaaacagtga

SEQ ID NO: 7914409 - DNA, 20 bp, Homo sapiens
tttacattttgaaacagtga

SEQ ID NO: 7914410 - DNA, 20 bp, Homo sapiens
tttacattttgaaacagtga

SEQ ID NO: 7914411 - DNA, 20 bp, Homo sapiens
tttacattttgaaacagtga

SEQ ID NO: 7914412 - DNA, 20 bp, Homo sapiens
tttacattttgaaacagtga

SEQ ID NO: 7914413 - DNA, 20 bp, Homo sapiens
tttacattttgaaacagtga

SEQ ID NO: 7914414 - DNA, 22 bp, Homo sapiens
tttacagtctgtctagcaatgt

SEQ ID NO: 7914415 - DNA, 22 bp, Homo sapiens
tttacagtgagagcttagtgag

SEQ ID NO: 7914416 - DNA, 22 bp, Homo sapiens
tttacagtgagagcttagtgag

SEQ ID NO: 7914417 - DNA, 22 bp, Homo sapiens
tttacagtctgtctagcaatgt

SEQ ID NO: 7914418 - DNA, 22 bp, Homo sapiens
tttacagtctgtctagcaatgt

SEQ ID NO: 7914419 - DNA, 22 bp, Homo sapiens
tttacagtctgtctagcaatgt

SEQ ID NO: 7914420 - DNA, 22 bp, Homo sapiens
tttacagtctgtctagcaatgt

SEQ ID NO: 7914421 - DNA, 22 bp, Homo sapiens
tttacagtgagagcttagtgag

SEQ ID NO: 7914422 - DNA, 22 bp, Homo sapiens
tttacagtctgtctagcaatgt

SEQ ID NO: 7914423 - DNA, 22 bp, Homo sapiens
tttacatttccctctgtcagtt

SEQ ID NO: 7914424 - DNA, 22 bp, Homo sapiens
tttacagtgtcttgttgactgt

SEQ ID NO: 7914425 - DNA, 22 bp, Homo sapiens
tttacagtgtcttgttgactgt

SEQ ID NO: 7914426 - DNA, 22 bp, Homo sapiens
tttacagtgagagcttagtgag

SEQ ID NO: 7914427 - DNA, 22 bp, Homo sapiens
tttacagtgtcttgttgactgt

SEQ ID NO: 7914428 - DNA, 22 bp, Homo sapiens
tttaccacaattttaaacaatg

SEQ ID NO: 7914429 - DNA, 22 bp, Homo sapiens
tttaccacaattttaaacaatg

SEQ ID NO: 7914430 - DNA, 22 bp, Homo sapiens
tttaccacaataatcatcacaa

SEQ ID NO: 7914431 - DNA, 22 bp, Homo sapiens
tttaccaaggcatagtaatctc

SEQ ID NO: 7914432 - DNA, 22 bp, Homo sapiens
tttaccaagctttaattacata

SEQ ID NO: 7914433 - DNA, 22 bp, Homo sapiens
tttaccaagctttaattacata

SEQ ID NO: 7914434 - DNA, 22 bp, Homo sapiens
tttaccaagatagcatctggtt

SEQ ID NO: 7914435 - DNA, 22 bp, Homo sapiens
tttaccaagctttaattacata

SEQ ID NO: 7914436 - DNA, 22 bp, Homo sapiens
tttaccaagagttgtcactgtt

SEQ ID NO: 7914437 - DNA, 20 bp, Homo sapiens
tttaccaactcaccagtatc

SEQ ID NO: 7914438 - DNA, 22 bp, Homo sapiens
tttaccaaatgagactattgtt

SEQ ID NO: 7914439 - DNA, 22 bp, Homo sapiens
tttaccaaatgagactattgtt

SEQ ID NO: 7914440 - DNA, 22 bp, Homo sapiens
tttaccaaagtactctgaggca

SEQ ID NO: 7914441 - DNA, 17 bp, Homo sapiens
tttagaatacaatgttt

SEQ ID NO: 7914442 - DNA, 19 bp, Homo sapiens
tttagaagttgaaactctg

SEQ ID NO: 7914443 - DNA, 22 bp, Homo sapiens
tttagaagttcacacatttaaa

SEQ ID NO: 7914444 - DNA, 22 bp, Homo sapiens
tttagaagttcacacatttaaa

SEQ ID NO: 7914445 - DNA, 22 bp, Homo sapiens
tttagaagttcacacatttaaa

SEQ ID NO: 7914446 - DNA, 22 bp, Homo sapiens
tttagaagacagatgcacagcc

SEQ ID NO: 7914447 - DNA, 22 bp, Homo sapiens
tttagaaggactacagtgtgat

SEQ ID NO: 7914448 - DNA, 22 bp, Homo sapiens
tttagaaggactacagtgtgat

SEQ ID NO: 7914449 - DNA, 23 bp, Homo sapiens
tttaccagaatagcaggggagag

SEQ ID NO: 7914450 - DNA, 21 bp, Homo sapiens
tttaccacatggtcctcattt

SEQ ID NO: 7914451 - DNA, 22 bp, Homo sapiens
tttaccacagaaaaaagtaact

SEQ ID NO: 7914452 - DNA, 21 bp, Homo sapiens
tttaccacatggtcctcattt

SEQ ID NO: 7914453 - DNA, 23 bp, Homo sapiens
tttaccactatgtttcacaagtt

SEQ ID NO: 7914454 - DNA, 22 bp, Homo sapiens
tttaccactgcttgcaggaagt

SEQ ID NO: 7914455 - DNA, 22 bp, Homo sapiens
tttaaatgttcatgatactgaa

SEQ ID NO: 7914456 - DNA, 22 bp, Homo sapiens
tttaaatgttcatgatactgaa

SEQ ID NO: 7914457 - DNA, 22 bp, Homo sapiens
tttaaatgttcatgatactgaa

SEQ ID NO: 7914458 - DNA, 22 bp, Homo sapiens
tttaaatgtgttcttagtagct

SEQ ID NO: 7914459 - DNA, 22 bp, Homo sapiens
tttaaatgtgttcttagtagct

SEQ ID NO: 7914460 - DNA, 22 bp, Homo sapiens
tttaaatgtgttcttagtagct

SEQ ID NO: 7914461 - DNA, 22 bp, Homo sapiens
tttaaatgtgttcttagtagct

SEQ ID NO: 7914462 - DNA, 22 bp, Homo sapiens
tttaaatgtgttcttagtagct

SEQ ID NO: 7914463 - DNA, 22 bp, Homo sapiens
tttaaatgtgttcttagtagct

SEQ ID NO: 7914464 - DNA, 22 bp, Homo sapiens
tttaaatgtgttcttagtagct

SEQ ID NO: 7914465 - DNA, 22 bp, Homo sapiens
tttaaatgtgttcttagtagct

SEQ ID NO: 7914466 - DNA, 22 bp, Homo sapiens
tttaaatggcattttcccagat

SEQ ID NO: 7914467 - DNA, 22 bp, Homo sapiens
tttaaatggcattttcccagat

SEQ ID NO: 7914468 - DNA, 22 bp, Homo sapiens
tttaaatgtgttcttagtagct

SEQ ID NO: 7914469 - DNA, 22 bp, Homo sapiens
tttaaatggcattttcccagat

SEQ ID NO: 7914470 - DNA, 22 bp, Homo sapiens
tttaaatggcattttcccagat

SEQ ID NO: 7914471 - DNA, 22 bp, Homo sapiens
tttaaatggcattttcccagat

SEQ ID NO: 7914472 - DNA, 22 bp, Homo sapiens
tttaaatgctttaagcaagggt

SEQ ID NO: 7914473 - DNA, 22 bp, Homo sapiens
tttaaatgcagacgttgattca

SEQ ID NO: 7914474 - DNA, 22 bp, Homo sapiens
tttaaatgtttatagagagtac

SEQ ID NO: 7914475 - DNA, 22 bp, Homo sapiens
tttaaatgtttatagagagtac

SEQ ID NO: 7914476 - DNA, 22 bp, Homo sapiens
tttaagatggtattttataaag

SEQ ID NO: 7914477 - DNA, 22 bp, Homo sapiens
tttaaatgtttatagagagtac

SEQ ID NO: 7914478 - DNA, 22 bp, Homo sapiens
tttaagatggtattttataaag

SEQ ID NO: 7914479 - DNA, 22 bp, Homo sapiens
tttaagatggtattttataaag

SEQ ID NO: 7914480 - DNA, 22 bp, Homo sapiens
tttaaatgtttaaaactcgtga

SEQ ID NO: 7914481 - DNA, 22 bp, Homo sapiens
tttaaatgtttaaaactcgtga

SEQ ID NO: 7914482 - DNA, 22 bp, Homo sapiens
tttaaatgtttaaaactcgtga

SEQ ID NO: 7914483 - DNA, 22 bp, Homo sapiens
tttaaatgttcatgatactgaa

SEQ ID NO: 7914484 - DNA, 22 bp, Homo sapiens
tttaaatgttcatgatactgaa

SEQ ID NO: 7914485 - DNA, 22 bp, Homo sapiens
tttaaatgtttatagagagtac

SEQ ID NO: 7914486 - DNA, 22 bp, Homo sapiens
tttaaatgtttaaaactcgtga

SEQ ID NO: 7914487 - DNA, 22 bp, Homo sapiens
tttaaatgtttaaaactcgtga

SEQ ID NO: 7914488 - DNA, 19 bp, Homo sapiens
tttaaagtgactggtattt

SEQ ID NO: 7914489 - DNA, 19 bp, Homo sapiens
tttaaagtgactggtattt

SEQ ID NO: 7914490 - DNA, 22 bp, Homo sapiens
tttaaagtgctgctcctatcct

SEQ ID NO: 7914491 - DNA, 22 bp, Homo sapiens
tttaaataggactcctgggggt

SEQ ID NO: 7914492 - DNA, 22 bp, Homo sapiens
tttaaataggactcctgggggt

SEQ ID NO: 7914493 - DNA, 22 bp, Homo sapiens
tttaaataggactcctgggggt

SEQ ID NO: 7914494 - DNA, 22 bp, Homo sapiens
tttaaataggactcctgggggt

SEQ ID NO: 7914495 - DNA, 22 bp, Homo sapiens
tttaaataggactcctgggggt

SEQ ID NO: 7914496 - DNA, 22 bp, Homo sapiens
tttaaataggactcctgggggt

SEQ ID NO: 7914497 - DNA, 22 bp, Homo sapiens
tttaaataggactcctgggggt

SEQ ID NO: 7914498 - DNA, 22 bp, Homo sapiens
tttaaatgctttaagcaagggt

SEQ ID NO: 7914499 - DNA, 22 bp, Homo sapiens
tttaaatgctttaagcaagggt

SEQ ID NO: 7914500 - DNA, 22 bp, Homo sapiens
tttaaatgcagacgttgattca

SEQ ID NO: 7914501 - DNA, 22 bp, Homo sapiens
tttaaatgctttaagcaagggt

SEQ ID NO: 7914502 - DNA, 22 bp, Homo sapiens
tttaaatgcagacgttgattca

SEQ ID NO: 7914503 - DNA, 22 bp, Homo sapiens
tttaaatgcagacgttgattca

SEQ ID NO: 7914504 - DNA, 22 bp, Homo sapiens
tttaaatgcagacgttgattca

SEQ ID NO: 7914505 - DNA, 22 bp, Homo sapiens
tttaaatgcagacgttgattca

SEQ ID NO: 7914506 - DNA, 22 bp, Homo sapiens
tttaaatgcagacgttgattca

SEQ ID NO: 7914507 - DNA, 22 bp, Homo sapiens
ttgtgtgtagactcagccattg

SEQ ID NO: 7914508 - DNA, 22 bp, Homo sapiens
ttgtgtgtagactcagccattg

SEQ ID NO: 7914509 - DNA, 22 bp, Homo sapiens
ttgtgtgtagactcagccattg

SEQ ID NO: 7914510 - DNA, 22 bp, Homo sapiens
ttgtgtgtactggttatgggca

SEQ ID NO: 7914511 - DNA, 22 bp, Homo sapiens
ttgtgtgtactggttatgggca

SEQ ID NO: 7914512 - DNA, 22 bp, Homo sapiens
ttgtgtgtactggttatgggca

SEQ ID NO: 7914513 - DNA, 22 bp, Homo sapiens
ttgtgtcttaaagattaaatgg

SEQ ID NO: 7914514 - DNA, 22 bp, Homo sapiens
ttgtgtcttaaagattaaatgg

SEQ ID NO: 7914515 - DNA, 22 bp, Homo sapiens
ttgtgtctgggggagtgacatc

SEQ ID NO: 7914516 - DNA, 22 bp, Homo sapiens
ttgtgtgctgagggcctgctgt

SEQ ID NO: 7914517 - DNA, 22 bp, Homo sapiens
ttgtgtgcataaattctgatgt

SEQ ID NO: 7914518 - DNA, 22 bp, Homo sapiens
ttgtgtgtactggttatgggca

SEQ ID NO: 7914519 - DNA, 22 bp, Homo sapiens
ttgtgtgctgagggcctgctgt

SEQ ID NO: 7914520 - DNA, 17 bp, Homo sapiens
ttgtgtgtagttctgat

SEQ ID NO: 7914521 - DNA, 17 bp, Homo sapiens
ttgtgtgtagttctgat

SEQ ID NO: 7914522 - DNA, 22 bp, Homo sapiens
ttgtgtgtagactcagccattg

SEQ ID NO: 7914523 - DNA, 17 bp, Homo sapiens
ttgtgtgtagttctgat

SEQ ID NO: 7914524 - DNA, 22 bp, Homo sapiens
tttaaacatcttgttgccttaa

SEQ ID NO: 7914525 - DNA, 22 bp, Homo sapiens
tttaaacatcttgttgccttaa

SEQ ID NO: 7914526 - DNA, 22 bp, Homo sapiens
tttaaacatcttgttgccttaa

SEQ ID NO: 7914527 - DNA, 17 bp, Homo sapiens
ttgtgtgtagttctgat

SEQ ID NO: 7914528 - DNA, 17 bp, Homo sapiens
tttaaactactacaagg

SEQ ID NO: 7914529 - DNA, 22 bp, Homo sapiens
tttaaactaacagtacacgttg

SEQ ID NO: 7914530 - DNA, 22 bp, Homo sapiens
tttaaacatcttgttgccttaa

SEQ ID NO: 7914531 - DNA, 22 bp, Homo sapiens
tttaaacctatctaagaaatag

SEQ ID NO: 7914532 - DNA, 22 bp, Homo sapiens
tttaaacctatctaagaaatag

SEQ ID NO: 7914533 - DNA, 22 bp, Homo sapiens
tttaaacctcctgattcagcta

SEQ ID NO: 7914534 - DNA, 22 bp, Homo sapiens
tttaaacctcctgattcagcta

SEQ ID NO: 7914535 - DNA, 22 bp, Homo sapiens
tttaaacctatctaagaaatag

SEQ ID NO: 7914536 - DNA, 17 bp, Homo sapiens
tttaaactactacaagg

SEQ ID NO: 7914537 - DNA, 17 bp, Homo sapiens
tttaaactactacaagg

SEQ ID NO: 7914538 - DNA, 17 bp, Homo sapiens
tttaaactactacaagg

SEQ ID NO: 7914539 - DNA, 22 bp, Homo sapiens
tttaaagagaatgtgaaggagt

SEQ ID NO: 7914540 - DNA, 22 bp, Homo sapiens
tttaaagagaatgtgaaggagt

SEQ ID NO: 7914541 - DNA, 22 bp, Homo sapiens
tttaaagagaatgtgaaggagt

SEQ ID NO: 7914542 - DNA, 22 bp, Homo sapiens
tttaaagagaatgtgaaggagt

SEQ ID NO: 7914543 - DNA, 21 bp, Homo sapiens
tttaaagaataggaagggagg

SEQ ID NO: 7914544 - DNA, 22 bp, Homo sapiens
tttaaagagaatgtgaaggagt

SEQ ID NO: 7914545 - DNA, 22 bp, Homo sapiens
tttaaagaaattcctcatcttt

SEQ ID NO: 7914546 - DNA, 22 bp, Homo sapiens
tttaaagaaattcctcatcttt

SEQ ID NO: 7914547 - DNA, 22 bp, Homo sapiens
tttaagcacagggataaagtta

SEQ ID NO: 7914548 - DNA, 22 bp, Homo sapiens
tttaagcacagggataaagtta

SEQ ID NO: 7914549 - DNA, 22 bp, Homo sapiens
tttaagcacagggataaagtta

SEQ ID NO: 7914550 - DNA, 22 bp, Homo sapiens
tttaagatttcttctcctgaga

SEQ ID NO: 7914551 - DNA, 19 bp, Homo sapiens
tttaagcaatagtatcttg

SEQ ID NO: 7914552 - DNA, 22 bp, Homo sapiens
tttaagcaagttgacatagcat

SEQ ID NO: 7914553 - DNA, 22 bp, Homo sapiens
tttaagatggtattttataaag

SEQ ID NO: 7914554 - DNA, 22 bp, Homo sapiens
tttaagattcagtaaggcaaac

SEQ ID NO: 7914555 - DNA, 22 bp, Homo sapiens
tttaagattcagtaaggcaaac

SEQ ID NO: 7914556 - DNA, 22 bp, Homo sapiens
tttaagattcagtaaggcaaac

SEQ ID NO: 7914557 - DNA, 22 bp, Homo sapiens
tttaagattcagtaaggcaaac

SEQ ID NO: 7914558 - DNA, 22 bp, Homo sapiens
tttaagattcagtaaggcaaac

SEQ ID NO: 7914559 - DNA, 22 bp, Homo sapiens
tttaagatttcttctcctgaga

SEQ ID NO: 7914560 - DNA, 22 bp, Homo sapiens
tttaagatttcttctcctgaga

SEQ ID NO: 7914561 - DNA, 22 bp, Homo sapiens
tttaagctaatgtcataattag

SEQ ID NO: 7914562 - DNA, 22 bp, Homo sapiens
tttaagcacagggataaagtta

SEQ ID NO: 7914563 - DNA, 22 bp, Homo sapiens
tttaagcagagaaatgatgtat

SEQ ID NO: 7914564 - DNA, 22 bp, Homo sapiens
tttaaggaaaaaatgtacttag

SEQ ID NO: 7914565 - DNA, 22 bp, Homo sapiens
tttaaggagctactcaccgtca

SEQ ID NO: 7914566 - DNA, 22 bp, Homo sapiens
tttaaggatgatgtgatatata

SEQ ID NO: 7914567 - DNA, 22 bp, Homo sapiens
tttaaggaggggctcacgtggg

SEQ ID NO: 7914568 - DNA, 22 bp, Homo sapiens
tttaaggaaaaaatgtacttag

SEQ ID NO: 7914569 - DNA, 22 bp, Homo sapiens
tttaagtcatggagaattgtgg

SEQ ID NO: 7914570 - DNA, 22 bp, Homo sapiens
tttaagtgaaatgtaatacagt

SEQ ID NO: 7914571 - DNA, 22 bp, Homo sapiens
tttaagtgatgaaatgcagata

SEQ ID NO: 7914572 - DNA, 22 bp, Homo sapiens
tttaatctattccctaaacacc

SEQ ID NO: 7914573 - DNA, 22 bp, Homo sapiens
tttaatctcccactctcagcct

SEQ ID NO: 7914574 - DNA, 22 bp, Homo sapiens
tttaatctattccctaaacacc

SEQ ID NO: 7914575 - DNA, 22 bp, Homo sapiens
tttaagtgatgaaatgcagata

SEQ ID NO: 7914576 - DNA, 22 bp, Homo sapiens
tttaatcttcaaaatagtctta

SEQ ID NO: 7914577 - DNA, 16 bp, Homo sapiens
tttaatctctcaggaa

SEQ ID NO: 7914578 - DNA, 22 bp, Homo sapiens
tttaaggcttgtcttgcggttt

SEQ ID NO: 7914579 - DNA, 16 bp, Homo sapiens
tttaatctctcaggaa

SEQ ID NO: 7914580 - DNA, 22 bp, Homo sapiens
tttaatgaataattcaaatctg

SEQ ID NO: 7914581 - DNA, 22 bp, Homo sapiens
tttaaggccttgagggaaattt

SEQ ID NO: 7914582 - DNA, 21 bp, Homo sapiens
tttaaggccagcaggaggtga

SEQ ID NO: 7914583 - DNA, 22 bp, Homo sapiens
tttaaggccttgagggaaattt

SEQ ID NO: 7914584 - DNA, 22 bp, Homo sapiens
tttaaggcttcaatttttggta

SEQ ID NO: 7914585 - DNA, 22 bp, Homo sapiens
tttaaggcttcaatttttggta

SEQ ID NO: 7914586 - DNA, 22 bp, Homo sapiens
tttaaggccttgagggaaattt

SEQ ID NO: 7914587 - DNA, 22 bp, Homo sapiens
tttaaggcttcaatttttggta

SEQ ID NO: 7914588 - DNA, 22 bp, Homo sapiens
tttaaggcttcactggagtggg

SEQ ID NO: 7914589 - DNA, 22 bp, Homo sapiens
tttaaggcttcactggagtggg

SEQ ID NO: 7914590 - DNA, 22 bp, Homo sapiens
tttaaggcttgtcttgcggttt

SEQ ID NO: 7914591 - DNA, 22 bp, Homo sapiens
tttaaggcttgtcttgcggttt

SEQ ID NO: 7914592 - DNA, 22 bp, Homo sapiens
tttaaggcttcactggagtggg

SEQ ID NO: 7914593 - DNA, 22 bp, Homo sapiens
tttaaggtggacatctaagtca

SEQ ID NO: 7914594 - DNA, 22 bp, Homo sapiens
tttaaggtacagctagcagcat

SEQ ID NO: 7914595 - DNA, 22 bp, Homo sapiens
tttaaggcaatatagaattcat

SEQ ID NO: 7914596 - DNA, 22 bp, Homo sapiens
tttaaggcagtgaaactattct

SEQ ID NO: 7914597 - DNA, 22 bp, Homo sapiens
tttaaggcagtgaaactattct

SEQ ID NO: 7914598 - DNA, 22 bp, Homo sapiens
tttaaggcaatatagaattcat

SEQ ID NO: 7914599 - DNA, 22 bp, Homo sapiens
tttaaggcaatatagaattcat

SEQ ID NO: 7914600 - DNA, 21 bp, Homo sapiens
tttaaggccagcaggaggtga

SEQ ID NO: 7914601 - DNA, 22 bp, Homo sapiens
tttaaggcagtgaaactattct

SEQ ID NO: 7914602 - DNA, 22 bp, Homo sapiens
tttaaggatgtaaaggaagaag

SEQ ID NO: 7914603 - DNA, 22 bp, Homo sapiens
tttacagggttcaagaatgaaa

SEQ ID NO: 7914604 - DNA, 23 bp, Homo sapiens
tttacagggcactcttatgcagc

SEQ ID NO: 7914605 - DNA, 22 bp, Homo sapiens
tttacagggttcaagaatgaaa

SEQ ID NO: 7914606 - DNA, 22 bp, Homo sapiens
tttacagtaaggtggatggtac

SEQ ID NO: 7914607 - DNA, 22 bp, Homo sapiens
tttacagtatagtaggactcat

SEQ ID NO: 7914608 - DNA, 22 bp, Homo sapiens
tttacagtaaggtggatggtac

SEQ ID NO: 7914609 - DNA, 22 bp, Homo sapiens
tttacagtccccaggtgaggat

SEQ ID NO: 7914610 - DNA, 22 bp, Homo sapiens
tttacagtccccaggtgaggat

SEQ ID NO: 7914611 - DNA, 22 bp, Homo sapiens
tttacagtatagtaggactcat

SEQ ID NO: 7914612 - DNA, 22 bp, Homo sapiens
tttacagtcaccaaactttgct

SEQ ID NO: 7914613 - DNA, 22 bp, Homo sapiens
tttacagtcaccaaactttgct

SEQ ID NO: 7914614 - DNA, 22 bp, Homo sapiens
tttacagtcaccaaactttgct

SEQ ID NO: 7914615 - DNA, 22 bp, Homo sapiens
tttacagtctatgttgaattaa

SEQ ID NO: 7914616 - DNA, 22 bp, Homo sapiens
tttacagtctatgttgaattaa

SEQ ID NO: 7914617 - DNA, 22 bp, Homo sapiens
tttacagtctatgttgaattaa

SEQ ID NO: 7914618 - DNA, 22 bp, Homo sapiens
tttacagtctctatagtcaaaa

SEQ ID NO: 7914619 - DNA, 22 bp, Homo sapiens
tttacagtctgtctagcaatgt

SEQ ID NO: 7914620 - DNA, 22 bp, Homo sapiens
tttacagtctgtctagcaatgt

SEQ ID NO: 7914621 - DNA, 22 bp, Homo sapiens
tttacagtctctatagtcaaaa

SEQ ID NO: 7914622 - DNA, 22 bp, Homo sapiens
tttacagtctctatagtcaaaa

SEQ ID NO: 7914623 - DNA, 22 bp, Homo sapiens
tttacagtctctatagtcaaaa

SEQ ID NO: 7914624 - DNA, 22 bp, Homo sapiens
tttacagtctctatagtcaaaa

SEQ ID NO: 7914625 - DNA, 22 bp, Homo sapiens
tttacagtctctatagtcaaaa

SEQ ID NO: 7914626 - DNA, 19 bp, Homo sapiens
tttacagggaatggagacc

SEQ ID NO: 7914627 - DNA, 22 bp, Homo sapiens
tttacaggattaccctggctgc

SEQ ID NO: 7914628 - DNA, 22 bp, Homo sapiens
tttaatgtagcgtgaaatgatt

SEQ ID NO: 7914629 - DNA, 22 bp, Homo sapiens
tttaatgtattctttggaacca

SEQ ID NO: 7914630 - DNA, 22 bp, Homo sapiens
tttacagcttctatactatgtg

SEQ ID NO: 7914631 - DNA, 22 bp, Homo sapiens
tttacagcttctatactatgtg

SEQ ID NO: 7914632 - DNA, 22 bp, Homo sapiens
tttaatgtgagtccctttcaag

SEQ ID NO: 7914633 - DNA, 22 bp, Homo sapiens
tttaatgatagtcttacgaaaa

SEQ ID NO: 7914634 - DNA, 22 bp, Homo sapiens
tttaatgatagctgtttcacat

SEQ ID NO: 7914635 - DNA, 22 bp, Homo sapiens
tttaatgatagctgtttcacat

SEQ ID NO: 7914636 - DNA, 22 bp, Homo sapiens
tttaatgatagctgtttcacat

SEQ ID NO: 7914637 - DNA, 22 bp, Homo sapiens
tttaatgatagctgtttcacat

SEQ ID NO: 7914638 - DNA, 22 bp, Homo sapiens
tttaatgtagcgtgaaatgatt

SEQ ID NO: 7914639 - DNA, 22 bp, Homo sapiens
tttaatgtagcgtgaaatgatt

SEQ ID NO: 7914640 - DNA, 22 bp, Homo sapiens
tttaatgtagcgtgaaatgatt

SEQ ID NO: 7914641 - DNA, 22 bp, Homo sapiens
tttaatgatagtcttacgaaaa

SEQ ID NO: 7914642 - DNA, 22 bp, Homo sapiens
tttaatggcaagaaggctgcag

SEQ ID NO: 7914643 - DNA, 22 bp, Homo sapiens
tttaatggcaagaaggctgcag

SEQ ID NO: 7914644 - DNA, 22 bp, Homo sapiens
tttcacctcagtctttttatat

SEQ ID NO: 7914645 - DNA, 22 bp, Homo sapiens
tttcacctcagtctttttatat

SEQ ID NO: 7914646 - DNA, 22 bp, Homo sapiens
tttcactggaattttaacattt

SEQ ID NO: 7914647 - DNA, 20 bp, Homo sapiens
tttcactggcttgataaggt

SEQ ID NO: 7914648 - DNA, 22 bp, Homo sapiens
tttcactgttaggagtatgcta

SEQ ID NO: 7914649 - DNA, 22 bp, Homo sapiens
tttcactgttaggagtatgcta

SEQ ID NO: 7914650 - DNA, 22 bp, Homo sapiens
tttcactgtgttggtcaggccg

SEQ ID NO: 7914651 - DNA, 20 bp, Homo sapiens
tttcactgtggtgctggaga

SEQ ID NO: 7914652 - DNA, 20 bp, Homo sapiens
tttcactgtggtgctggaga

SEQ ID NO: 7914653 - DNA, 22 bp, Homo sapiens
tttcactgggcttgcagaaatc

SEQ ID NO: 7914654 - DNA, 22 bp, Homo sapiens
tttcactgggcttgcagaaatc

SEQ ID NO: 7914655 - DNA, 23 bp, Homo sapiens
tttcacagcttttattctgcatc

SEQ ID NO: 7914656 - DNA, 23 bp, Homo sapiens
tttcacagcttttattctgcatc

SEQ ID NO: 7914657 - DNA, 22 bp, Homo sapiens
tttcacattttatacttaagcc

SEQ ID NO: 7914658 - DNA, 22 bp, Homo sapiens
tttcacattttatacttaagcc

SEQ ID NO: 7914659 - DNA, 22 bp, Homo sapiens
tttcacattttatacttaagcc

SEQ ID NO: 7914660 - DNA, 22 bp, Homo sapiens
tttcacattttatacttaagcc

SEQ ID NO: 7914661 - DNA, 22 bp, Homo sapiens
tttcaccacagaggcaagacaa

SEQ ID NO: 7914662 - DNA, 22 bp, Homo sapiens
tttcacagctgggtggcagagt

SEQ ID NO: 7914663 - DNA, 22 bp, Homo sapiens
tttcacagcttccacttaagga

SEQ ID NO: 7914664 - DNA, 22 bp, Homo sapiens
tttcacagctgtcttccgtctc

SEQ ID NO: 7914665 - DNA, 22 bp, Homo sapiens
tttcacagctgggtggcagagt

SEQ ID NO: 7914666 - DNA, 22 bp, Homo sapiens
tttcacagctgggtggcagagt

SEQ ID NO: 7914667 - DNA, 22 bp, Homo sapiens
tttcacagctgggtggcagagt

SEQ ID NO: 7914668 - DNA, 22 bp, Homo sapiens
tttcacagctgggaagagatat

SEQ ID NO: 7914669 - DNA, 22 bp, Homo sapiens
tttcacagctgggtggcagagt

SEQ ID NO: 7914670 - DNA, 22 bp, Homo sapiens
tttcacagctgatacctcttcc

SEQ ID NO: 7914671 - DNA, 22 bp, Homo sapiens
tttcacagctagtgagcttcta

SEQ ID NO: 7914672 - DNA, 22 bp, Homo sapiens
tttcacagcagaatttctgagg

SEQ ID NO: 7914673 - DNA, 22 bp, Homo sapiens
tttcacagcagtgtgctgcttt

SEQ ID NO: 7914674 - DNA, 22 bp, Homo sapiens
tttcacagcaacactgtctgca

SEQ ID NO: 7914675 - DNA, 22 bp, Homo sapiens
tttcacagcagtgtgctgcttt

SEQ ID NO: 7914676 - DNA, 22 bp, Homo sapiens
tttcagagcctttatctctcta

SEQ ID NO: 7914677 - DNA, 22 bp, Homo sapiens
tttcagagcctttatctctcta

SEQ ID NO: 7914678 - DNA, 22 bp, Homo sapiens
tttcagagcctgcaatcccaat

SEQ ID NO: 7914679 - DNA, 22 bp, Homo sapiens
tttcagagatgtctagcctatt

SEQ ID NO: 7914680 - DNA, 22 bp, Homo sapiens
tttcagagatgcagaattcagg

SEQ ID NO: 7914681 - DNA, 22 bp, Homo sapiens
tttcagagatgcagaattcagg

SEQ ID NO: 7914682 - DNA, 22 bp, Homo sapiens
tttcagagatgtctagcctatt

SEQ ID NO: 7914683 - DNA, 22 bp, Homo sapiens
tttcagagatgtctagcctatt

SEQ ID NO: 7914684 - DNA, 22 bp, Homo sapiens
tttcagagaactgagtccttgc

SEQ ID NO: 7914685 - DNA, 22 bp, Homo sapiens
tttcagagaattagaagctgat

SEQ ID NO: 7914686 - DNA, 22 bp, Homo sapiens
tttcagagaattagaagctgat

SEQ ID NO: 7914687 - DNA, 22 bp, Homo sapiens
tttcagagaattagaagctgat

SEQ ID NO: 7914688 - DNA, 22 bp, Homo sapiens
tttcagagaattagaagctgat

SEQ ID NO: 7914689 - DNA, 22 bp, Homo sapiens
tttcagagagatcaacatagct

SEQ ID NO: 7914690 - DNA, 22 bp, Homo sapiens
tttcagagagatcaacatagct

SEQ ID NO: 7914691 - DNA, 22 bp, Homo sapiens
tttcagagagatcaacatagct

SEQ ID NO: 7914692 - DNA, 22 bp, Homo sapiens
tttcagagaggcttcaaatctt

SEQ ID NO: 7914693 - DNA, 22 bp, Homo sapiens
tttcagagaggcttcaaatctt

SEQ ID NO: 7914694 - DNA, 22 bp, Homo sapiens
tttcagagaggcttcaaatctt

SEQ ID NO: 7914695 - DNA, 19 bp, Homo sapiens
tttcagacatttcaaattt

SEQ ID NO: 7914696 - DNA, 19 bp, Homo sapiens
tttcagacatttcaaattt

SEQ ID NO: 7914697 - DNA, 22 bp, Homo sapiens
tttcagacaggacttcatatgt

SEQ ID NO: 7914698 - DNA, 22 bp, Homo sapiens
tttcagactccaaattcataag

SEQ ID NO: 7914699 - DNA, 19 bp, Homo sapiens
tttcagactcatctccagc

SEQ ID NO: 7914700 - DNA, 22 bp, Homo sapiens
tttcagagaactgagtccttgc

SEQ ID NO: 7914701 - DNA, 22 bp, Homo sapiens
tttcagagaactgagtccttgc

SEQ ID NO: 7914702 - DNA, 22 bp, Homo sapiens
tttcagagaaagcccaaagact

SEQ ID NO: 7914703 - DNA, 22 bp, Homo sapiens
tttcagaaagcatcatcaaagt

SEQ ID NO: 7914704 - DNA, 22 bp, Homo sapiens
tttcagaaagcatcatcaaagt

SEQ ID NO: 7914705 - DNA, 22 bp, Homo sapiens
tttcagaaagcatcatcaaagt

SEQ ID NO: 7914706 - DNA, 22 bp, Homo sapiens
tttcagaaagcatcatcaaagt

SEQ ID NO: 7914707 - DNA, 22 bp, Homo sapiens
tttcagaaagctgaacatatga

SEQ ID NO: 7914708 - DNA, 22 bp, Homo sapiens
tttcagaaacgattatgaacac

SEQ ID NO: 7914709 - DNA, 22 bp, Homo sapiens
tttcagaaacgattatgaacac

SEQ ID NO: 7914710 - DNA, 22 bp, Homo sapiens
tttcagaaaacttatcatcagt

SEQ ID NO: 7914711 - DNA, 22 bp, Homo sapiens
tttcagaaaacttatcatcagt

SEQ ID NO: 7914712 - DNA, 22 bp, Homo sapiens
tttcagaaaacttatcatcagt

SEQ ID NO: 7914713 - DNA, 22 bp, Homo sapiens
tttcagaaagctgaacatatga

SEQ ID NO: 7914714 - DNA, 22 bp, Homo sapiens
tttcagaaagctgaacatatga

SEQ ID NO: 7914715 - DNA, 22 bp, Homo sapiens
tttcagaaagctgaacatatga

SEQ ID NO: 7914716 - DNA, 22 bp, Homo sapiens
tttcagaaatcaaaaccagggt

SEQ ID NO: 7914717 - DNA, 22 bp, Homo sapiens
tttcagaaatcaaaaccagggt

SEQ ID NO: 7914718 - DNA, 22 bp, Homo sapiens
tttcagaaatggcactgaaatc

SEQ ID NO: 7914719 - DNA, 22 bp, Homo sapiens
tttcagaaatggcactgaaatc

SEQ ID NO: 7914720 - DNA, 22 bp, Homo sapiens
tttcagacaggacttcatatgt

SEQ ID NO: 7914721 - DNA, 22 bp, Homo sapiens
tttcagacagattcttctcagt

SEQ ID NO: 7914722 - DNA, 22 bp, Homo sapiens
tttcagaaatggcactgaaatc

SEQ ID NO: 7914723 - DNA, 22 bp, Homo sapiens
tttcatgtctgaattctttagt

SEQ ID NO: 7914724 - DNA, 22 bp, Homo sapiens
tttcatgtgcaattagcaatat

SEQ ID NO: 7914725 - DNA, 22 bp, Homo sapiens
tttcatgtctgaattctttagt

SEQ ID NO: 7914726 - DNA, 22 bp, Homo sapiens
tttcatgtctgaattctttagt

SEQ ID NO: 7914727 - DNA, 22 bp, Homo sapiens
tttcatgtcattccatttcaga

SEQ ID NO: 7914728 - DNA, 22 bp, Homo sapiens
tttcatgtcattccatttcaga

SEQ ID NO: 7914729 - DNA, 22 bp, Homo sapiens
tttcatgtcattccatttcaga

SEQ ID NO: 7914730 - DNA, 22 bp, Homo sapiens
tttcatgtatttcccaaagctt

SEQ ID NO: 7914731 - DNA, 22 bp, Homo sapiens
tttcatgtatttcccaaagctt

SEQ ID NO: 7914732 - DNA, 22 bp, Homo sapiens
tttcatgtacttttttgataga

SEQ ID NO: 7914733 - DNA, 22 bp, Homo sapiens
tttcatgtacttttttgataga

SEQ ID NO: 7914734 - DNA, 22 bp, Homo sapiens
tttcatgtacttttttgataga

SEQ ID NO: 7914735 - DNA, 22 bp, Homo sapiens
tttcatgtaatcatttaggtgg

SEQ ID NO: 7914736 - DNA, 22 bp, Homo sapiens
tttcatgtgcaattagcaatat

SEQ ID NO: 7914737 - DNA, 22 bp, Homo sapiens
tttcatgtgcaattagcaatat

SEQ ID NO: 7914738 - DNA, 22 bp, Homo sapiens
tttcatgtggcgatgtctctgg

SEQ ID NO: 7914739 - DNA, 22 bp, Homo sapiens
tttcatgtggcgatgtctctgg

SEQ ID NO: 7914740 - DNA, 22 bp, Homo sapiens
tttcatgtggcgatgtctctgg

SEQ ID NO: 7914741 - DNA, 22 bp, Homo sapiens
tttcatgtgttgaatgtgtaca

SEQ ID NO: 7914742 - DNA, 22 bp, Homo sapiens
tttcatgtgttgaatgtgtaca

SEQ ID NO: 7914743 - DNA, 22 bp, Homo sapiens
tttcatgttacagtgtaaaagt

SEQ ID NO: 7914744 - DNA, 22 bp, Homo sapiens
tttcatgttacagtgtaaaagt

SEQ ID NO: 7914745 - DNA, 22 bp, Homo sapiens
tttcatgagattcctccacatc

SEQ ID NO: 7914746 - DNA, 22 bp, Homo sapiens
tttcatgagattcctccacatc

SEQ ID NO: 7914747 - DNA, 22 bp, Homo sapiens
tttcatcttgattctatatggc

SEQ ID NO: 7914748 - DNA, 22 bp, Homo sapiens
tttcatgaggggcaaaatctca

SEQ ID NO: 7914749 - DNA, 22 bp, Homo sapiens
tttcatgaggggcaaaatctca

SEQ ID NO: 7914750 - DNA, 22 bp, Homo sapiens
tttcagagctcagcagctagag

SEQ ID NO: 7914751 - DNA, 22 bp, Homo sapiens
tttcagagctcagcagctagag

SEQ ID NO: 7914752 - DNA, 22 bp, Homo sapiens
tttcagagctcagcagctagag

SEQ ID NO: 7914753 - DNA, 22 bp, Homo sapiens
tttcagagctcagcagctagag

SEQ ID NO: 7914754 - DNA, 22 bp, Homo sapiens
tttcagagctctaggctctcag

SEQ ID NO: 7914755 - DNA, 22 bp, Homo sapiens
tttcagagctcagcagctagag

SEQ ID NO: 7914756 - DNA, 22 bp, Homo sapiens
tttcagagctgagatgccacag

SEQ ID NO: 7914757 - DNA, 22 bp, Homo sapiens
tttcatcttgattctatatggc

SEQ ID NO: 7914758 - DNA, 22 bp, Homo sapiens
tttcatcttgattctatatggc

SEQ ID NO: 7914759 - DNA, 22 bp, Homo sapiens
tttcatcttccttggcataggt

SEQ ID NO: 7914760 - DNA, 22 bp, Homo sapiens
tttcatgagtggaagaagtgta

SEQ ID NO: 7914761 - DNA, 22 bp, Homo sapiens
tttcatgatccatttacaaaat

SEQ ID NO: 7914762 - DNA, 22 bp, Homo sapiens
tttcatgatccatttacaaaat

SEQ ID NO: 7914763 - DNA, 22 bp, Homo sapiens
tttcatgatccatttacaaaat

SEQ ID NO: 7914764 - DNA, 22 bp, Homo sapiens
tttcatgattaacttagtgaat

SEQ ID NO: 7914765 - DNA, 22 bp, Homo sapiens
tttcatgattaacttagtgaat

SEQ ID NO: 7914766 - DNA, 22 bp, Homo sapiens
tttcatgattaacttagtgaat

SEQ ID NO: 7914767 - DNA, 22 bp, Homo sapiens
tttcatgcacaaatgagcaagg

SEQ ID NO: 7914768 - DNA, 22 bp, Homo sapiens
tttcatgattaacttagtgaat

SEQ ID NO: 7914769 - DNA, 22 bp, Homo sapiens
tttcatgctcatggaacacagc

SEQ ID NO: 7914770 - DNA, 22 bp, Homo sapiens
tttcatgctacctggcagtgac

SEQ ID NO: 7914771 - DNA, 22 bp, Homo sapiens
tttcatgcctgtggtgcagtgt

SEQ ID NO: 7914772 - DNA, 22 bp, Homo sapiens
tttcatgcctcttgagaaagat

SEQ ID NO: 7914773 - DNA, 22 bp, Homo sapiens
tttcatgcacaaatgagcaagg

SEQ ID NO: 7914774 - DNA, 22 bp, Homo sapiens
tttcatgcctcttgagaaagat

SEQ ID NO: 7914775 - DNA, 22 bp, Homo sapiens
tttcatgcctggaattgccctt

SEQ ID NO: 7914776 - DNA, 22 bp, Homo sapiens
tttcatgcctggaattgccctt

SEQ ID NO: 7914777 - DNA, 22 bp, Homo sapiens
tttcatgctcatggaacacagc

SEQ ID NO: 7914778 - DNA, 21 bp, Homo sapiens
tttcattgaatgagataaggt

SEQ ID NO: 7914779 - DNA, 22 bp, Homo sapiens
tttcattcattatacagtagag

SEQ ID NO: 7914780 - DNA, 22 bp, Homo sapiens
tttcattcattatacagtagag

SEQ ID NO: 7914781 - DNA, 22 bp, Homo sapiens
tttcattcattatacagtagag

SEQ ID NO: 7914782 - DNA, 22 bp, Homo sapiens
tttcattatgttcctggaagag

SEQ ID NO: 7914783 - DNA, 22 bp, Homo sapiens
tttcattcagcaccctgaggtg

SEQ ID NO: 7914784 - DNA, 22 bp, Homo sapiens
tttcattcagcaccctgaggtg

SEQ ID NO: 7914785 - DNA, 22 bp, Homo sapiens
tttcattgagactatagacatc

SEQ ID NO: 7914786 - DNA, 22 bp, Homo sapiens
tttcattgagactatagacatc

SEQ ID NO: 7914787 - DNA, 22 bp, Homo sapiens
tttcattgagactatagacatc

SEQ ID NO: 7914788 - DNA, 22 bp, Homo sapiens
tttcattgatgggtgatagaaa

SEQ ID NO: 7914789 - DNA, 18 bp, Homo sapiens
tttcattgagtgtgatat

SEQ ID NO: 7914790 - DNA, 22 bp, Homo sapiens
tttcattgagactatagacatc

SEQ ID NO: 7914791 - DNA, 18 bp, Homo sapiens
tttcattgagtgtgatat

SEQ ID NO: 7914792 - DNA, 21 bp, Homo sapiens
tttcattgaatgagataaggt

SEQ ID NO: 7914793 - DNA, 21 bp, Homo sapiens
tttcattgaatgagataaggt

SEQ ID NO: 7914794 - DNA, 22 bp, Homo sapiens
tttcattgacagttgggggaaa

SEQ ID NO: 7914795 - DNA, 21 bp, Homo sapiens
tttcattgaatgagataaggt

SEQ ID NO: 7914796 - DNA, 22 bp, Homo sapiens
tttcattgagaatataagattt

SEQ ID NO: 7914797 - DNA, 22 bp, Homo sapiens
tttcccaggccctcagggctgc

SEQ ID NO: 7914798 - DNA, 22 bp, Homo sapiens
tttcccaggccctcagggctgc

SEQ ID NO: 7914799 - DNA, 22 bp, Homo sapiens
tttcccaggccctcagggctgc

SEQ ID NO: 7914800 - DNA, 22 bp, Homo sapiens
tttcccaggccctcagggctgc

SEQ ID NO: 7914801 - DNA, 22 bp, Homo sapiens
tttcccaggctggaatgcagtg

SEQ ID NO: 7914802 - DNA, 22 bp, Homo sapiens
tttcccaggctggaatgcagtg

SEQ ID NO: 7914803 - DNA, 19 bp, Homo sapiens
tttcccagtcccaggagtg

SEQ ID NO: 7914804 - DNA, 22 bp, Homo sapiens
tttcattgatgggtgatagaaa

SEQ ID NO: 7914805 - DNA, 22 bp, Homo sapiens
tttcattgatgggtgatagaaa

SEQ ID NO: 7914806 - DNA, 22 bp, Homo sapiens
tttcattgcagagtctgtgtgc

SEQ ID NO: 7914807 - DNA, 22 bp, Homo sapiens
tttcattgatgggtgatagaaa

SEQ ID NO: 7914808 - DNA, 19 bp, Homo sapiens
tttcccagcccttgctgtg

SEQ ID NO: 7914809 - DNA, 19 bp, Homo sapiens
tttcccagcccttgctgtg

SEQ ID NO: 7914810 - DNA, 19 bp, Homo sapiens
tttcccagcccttgctgtg

SEQ ID NO: 7914811 - DNA, 21 bp, Homo sapiens
tttcccagcagagatagctgg

SEQ ID NO: 7914812 - DNA, 21 bp, Homo sapiens
tttcccagcagagatagctgg

SEQ ID NO: 7914813 - DNA, 22 bp, Homo sapiens
tttcccagttccctgctctata

SEQ ID NO: 7914814 - DNA, 22 bp, Homo sapiens
tttcccagttccctgctctata

SEQ ID NO: 7914815 - DNA, 22 bp, Homo sapiens
tttcccagttagtgaagacatg

SEQ ID NO: 7914816 - DNA, 22 bp, Homo sapiens
tttcccagttagtgaagacatg

SEQ ID NO: 7914817 - DNA, 19 bp, Homo sapiens
tttcccagtcccaggagtg

SEQ ID NO: 7914818 - DNA, 19 bp, Homo sapiens
tttcccagtcccaggagtg

SEQ ID NO: 7914819 - DNA, 22 bp, Homo sapiens
tttcccatccatagccctgcaa

SEQ ID NO: 7914820 - DNA, 22 bp, Homo sapiens
tttcccatccatagccctgcaa

SEQ ID NO: 7914821 - DNA, 22 bp, Homo sapiens
tttcccagttccctgctctata

SEQ ID NO: 7914822 - DNA, 22 bp, Homo sapiens
tttcccatccatagccctgcaa

SEQ ID NO: 7914823 - DNA, 22 bp, Homo sapiens
tttcccatggcagaagccctgt

SEQ ID NO: 7914824 - DNA, 22 bp, Homo sapiens
tttcccatcttagcagattaaa

SEQ ID NO: 7914825 - DNA, 22 bp, Homo sapiens
tttcccatcttagcagattaaa

SEQ ID NO: 7914826 - DNA, 22 bp, Homo sapiens
tttcccattctaattactcatt

SEQ ID NO: 7914827 - DNA, 22 bp, Homo sapiens
tttcccatggcagaagccctgt

SEQ ID NO: 7914828 - DNA, 22 bp, Homo sapiens
tttcccatggcagaagccctgt

SEQ ID NO: 7914829 - DNA, 22 bp, Homo sapiens
tttccccaggtagatagataat

SEQ ID NO: 7914830 - DNA, 22 bp, Homo sapiens
tttcaacatataccataatgcc

SEQ ID NO: 7914831 - DNA, 22 bp, Homo sapiens
tttcaacatcacctagcagttc

SEQ ID NO: 7914832 - DNA, 22 bp, Homo sapiens
tttcaacatcacctagcagttc

SEQ ID NO: 7914833 - DNA, 22 bp, Homo sapiens
tttcaacatcacctagcagttc

SEQ ID NO: 7914834 - DNA, 22 bp, Homo sapiens
tttcaacatcacctagcagttc

SEQ ID NO: 7914835 - DNA, 22 bp, Homo sapiens
tttcaacatacctcagtgtatg

SEQ ID NO: 7914836 - DNA, 22 bp, Homo sapiens
tttcaacataatgcctgctagg

SEQ ID NO: 7914837 - DNA, 22 bp, Homo sapiens
tttcaacatataccataatgcc

SEQ ID NO: 7914838 - DNA, 22 bp, Homo sapiens
tttcaacatataccataatgcc

SEQ ID NO: 7914839 - DNA, 22 bp, Homo sapiens
tttcaacatataccataatgcc

SEQ ID NO: 7914840 - DNA, 22 bp, Homo sapiens
tttcaacagctctcaaatgatc

SEQ ID NO: 7914841 - DNA, 22 bp, Homo sapiens
tttcaacagctctcaaatgatc

SEQ ID NO: 7914842 - DNA, 22 bp, Homo sapiens
tttcaacagctctcaaatgatc

SEQ ID NO: 7914843 - DNA, 22 bp, Homo sapiens
tttcaacaggatgataataggc

SEQ ID NO: 7914844 - DNA, 22 bp, Homo sapiens
tttcaacaggatgataataggc

SEQ ID NO: 7914845 - DNA, 23 bp, Homo sapiens
tttcaacaggcagagaagactta

SEQ ID NO: 7914846 - DNA, 22 bp, Homo sapiens
tttcaacaggatgataataggc

SEQ ID NO: 7914847 - DNA, 22 bp, Homo sapiens
tttcaacaggatgataataggc

SEQ ID NO: 7914848 - DNA, 22 bp, Homo sapiens
tttcaacagggcacaggtgcca

SEQ ID NO: 7914849 - DNA, 22 bp, Homo sapiens
tttcaacataatgcctgctagg

SEQ ID NO: 7914850 - DNA, 23 bp, Homo sapiens
tttcaacaggcagagaagactta

SEQ ID NO: 7914851 - DNA, 22 bp, Homo sapiens
tttcaagaagcaaattaaagtc

SEQ ID NO: 7914852 - DNA, 22 bp, Homo sapiens
tttcaagaacagcagcattcca

SEQ ID NO: 7914853 - DNA, 22 bp, Homo sapiens
tttcaacttgtttgcttccata

SEQ ID NO: 7914854 - DNA, 22 bp, Homo sapiens
tttcaagaacaacattcattca

SEQ ID NO: 7914855 - DNA, 22 bp, Homo sapiens
tttcaacttgaagaattgatac

SEQ ID NO: 7914856 - DNA, 22 bp, Homo sapiens
tttcaacttgaagaattgatac

SEQ ID NO: 7914857 - DNA, 23 bp, Homo sapiens
tttcaactcctgccattatttct

SEQ ID NO: 7914858 - DNA, 22 bp, Homo sapiens
tttcaactcatgctaaaggaag

SEQ ID NO: 7914859 - DNA, 22 bp, Homo sapiens
tttcaactcatgctaaaggaag

SEQ ID NO: 7914860 - DNA, 23 bp, Homo sapiens
tttcaactcctgccattatttct

SEQ ID NO: 7914861 - DNA, 22 bp, Homo sapiens
tttcaactagcccctaagtcct

SEQ ID NO: 7914862 - DNA, 22 bp, Homo sapiens
tttcaactagcccctaagtcct

SEQ ID NO: 7914863 - DNA, 22 bp, Homo sapiens
tttcaactagcccctaagtcct

SEQ ID NO: 7914864 - DNA, 22 bp, Homo sapiens
tttcaactcatgctaaaggaag

SEQ ID NO: 7914865 - DNA, 22 bp, Homo sapiens
tttcaagactcattgagtattg

SEQ ID NO: 7914866 - DNA, 22 bp, Homo sapiens
tttcaagagaaaactaacctat

SEQ ID NO: 7914867 - DNA, 22 bp, Homo sapiens
tttcaagactcattgagtattg

SEQ ID NO: 7914868 - DNA, 22 bp, Homo sapiens
tttcaagagggaactgaacaca

SEQ ID NO: 7914869 - DNA, 22 bp, Homo sapiens
tttcaagagggaactgaacaca

SEQ ID NO: 7914870 - DNA, 22 bp, Homo sapiens
tttcaagcagcgtgaaaaacga

SEQ ID NO: 7914871 - DNA, 22 bp, Homo sapiens
tttcaagagcaggaaaaaggtc

SEQ ID NO: 7914872 - DNA, 22 bp, Homo sapiens
tttcaagagaaaactaacctat

SEQ ID NO: 7914873 - DNA, 22 bp, Homo sapiens
tttcaagagcaggaaaaaggtc

SEQ ID NO: 7914874 - DNA, 22 bp, Homo sapiens
tttcacacaacgtgaatatact

SEQ ID NO: 7914875 - DNA, 22 bp, Homo sapiens
tttcacaattttaaggagcaaa

SEQ ID NO: 7914876 - DNA, 22 bp, Homo sapiens
tttcacactgcagcatcagaga

SEQ ID NO: 7914877 - DNA, 22 bp, Homo sapiens
tttcacactgcagcatcagaga

SEQ ID NO: 7914878 - DNA, 22 bp, Homo sapiens
tttcacactgcagcatcagaga

SEQ ID NO: 7914879 - DNA, 22 bp, Homo sapiens
tttcacacccactaggactgtt

SEQ ID NO: 7914880 - DNA, 23 bp, Homo sapiens
tttcacaatgagcattacagaat

SEQ ID NO: 7914881 - DNA, 23 bp, Homo sapiens
tttcacaatgagcattacagaat

SEQ ID NO: 7914882 - DNA, 23 bp, Homo sapiens
tttcacaatgagcattacagaat

SEQ ID NO: 7914883 - DNA, 20 bp, Homo sapiens
tttcacaatgaacatgtctc

SEQ ID NO: 7914884 - DNA, 22 bp, Homo sapiens
tttcacagaaaggataacatta

SEQ ID NO: 7914885 - DNA, 22 bp, Homo sapiens
tttcacagaaagacaacagata

SEQ ID NO: 7914886 - DNA, 22 bp, Homo sapiens
tttcacagaaagacaacagata

SEQ ID NO: 7914887 - DNA, 22 bp, Homo sapiens
tttcacagaaagacaacagata

SEQ ID NO: 7914888 - DNA, 22 bp, Homo sapiens
tttcacagaaagacaacagata

SEQ ID NO: 7914889 - DNA, 22 bp, Homo sapiens
tttcacagaaagaagctagttt

SEQ ID NO: 7914890 - DNA, 22 bp, Homo sapiens
tttcacagaaagaagctagttt

SEQ ID NO: 7914891 - DNA, 22 bp, Homo sapiens
tttcacagaaaggataacatta

SEQ ID NO: 7914892 - DNA, 22 bp, Homo sapiens
tttcacagaaaggataacatta

SEQ ID NO: 7914893 - DNA, 22 bp, Homo sapiens
tttcacagaactcactaaggag

SEQ ID NO: 7914894 - DNA, 22 bp, Homo sapiens
tttcacagaggaggaagctgag

SEQ ID NO: 7914895 - DNA, 22 bp, Homo sapiens
tttcacagagaaatataacagg

SEQ ID NO: 7914896 - DNA, 22 bp, Homo sapiens
tttcacagagaaatataacagg

SEQ ID NO: 7914897 - DNA, 22 bp, Homo sapiens
tttcacagatcctacagcttgt

SEQ ID NO: 7914898 - DNA, 22 bp, Homo sapiens
tttcacagatcctacagcttgt

SEQ ID NO: 7914899 - DNA, 22 bp, Homo sapiens
tttcacagatcctacagcttgt

SEQ ID NO: 7914900 - DNA, 22 bp, Homo sapiens
tttcacagaggaggaagctgag

SEQ ID NO: 7914901 - DNA, 22 bp, Homo sapiens
tttattgacccaaagcgagagt

SEQ ID NO: 7914902 - DNA, 22 bp, Homo sapiens
tttattgacccaaagcgagagt

SEQ ID NO: 7914903 - DNA, 22 bp, Homo sapiens
tttattgacccaaagcgagagt

SEQ ID NO: 7914904 - DNA, 22 bp, Homo sapiens
tttattgacccaaagcgagagt

SEQ ID NO: 7914905 - DNA, 22 bp, Homo sapiens
tttattgacccaaagcgagagt

SEQ ID NO: 7914906 - DNA, 22 bp, Homo sapiens
tttattgacttcagtgagtctt

SEQ ID NO: 7914907 - DNA, 22 bp, Homo sapiens
tttattgacttcagtgagtctt

SEQ ID NO: 7914908 - DNA, 22 bp, Homo sapiens
tttattgacttcagtgagtctt

SEQ ID NO: 7914909 - DNA, 22 bp, Homo sapiens
tttattgacttcagtgagtctt

SEQ ID NO: 7914910 - DNA, 22 bp, Homo sapiens
tttattgagcacccgttgtgcg

SEQ ID NO: 7914911 - DNA, 22 bp, Homo sapiens
tttattgagcacccgttgtgcg

SEQ ID NO: 7914912 - DNA, 22 bp, Homo sapiens
tttcaaaggtggaagagtgaat

SEQ ID NO: 7914913 - DNA, 22 bp, Homo sapiens
tttattgcatacacaaatgtca

SEQ ID NO: 7914914 - DNA, 22 bp, Homo sapiens
tttattgcactgtctcaatacc

SEQ ID NO: 7914915 - DNA, 22 bp, Homo sapiens
tttattgcatacacaaatgtca

SEQ ID NO: 7914916 - DNA, 22 bp, Homo sapiens
tttattgagtatctactatgtg

SEQ ID NO: 7914917 - DNA, 22 bp, Homo sapiens
tttattgagtatctactatgtg

SEQ ID NO: 7914918 - DNA, 22 bp, Homo sapiens
tttattgagtatctactatgtg

SEQ ID NO: 7914919 - DNA, 22 bp, Homo sapiens
tttattgagtatctactatgtg

SEQ ID NO: 7914920 - DNA, 22 bp, Homo sapiens
tttattgagtatctactatgtg

SEQ ID NO: 7914921 - DNA, 22 bp, Homo sapiens
tttattgagtatctactatgtg

SEQ ID NO: 7914922 - DNA, 20 bp, Homo sapiens
tttattgagcacgtactgtg

SEQ ID NO: 7914923 - DNA, 20 bp, Homo sapiens
tttattgagcacgtactgtg

SEQ ID NO: 7914924 - DNA, 20 bp, Homo sapiens
tttattgagcacgtactgtg

SEQ ID NO: 7914925 - DNA, 22 bp, Homo sapiens
tttcaacaccagagaccatgcg

SEQ ID NO: 7914926 - DNA, 22 bp, Homo sapiens
tttcaacagaatatgatcagag

SEQ ID NO: 7914927 - DNA, 22 bp, Homo sapiens
tttcaacagaatatgatcagag

SEQ ID NO: 7914928 - DNA, 22 bp, Homo sapiens
tttcaacagaatatgatcagag

SEQ ID NO: 7914929 - DNA, 22 bp, Homo sapiens
tttcaacaccagagaccatgcg

SEQ ID NO: 7914930 - DNA, 22 bp, Homo sapiens
tttcaacaccagagaccatgcg

SEQ ID NO: 7914931 - DNA, 22 bp, Homo sapiens
tttcaacagctctcaaatgatc

SEQ ID NO: 7914932 - DNA, 22 bp, Homo sapiens
tttcaacagctctcaaatgatc

SEQ ID NO: 7914933 - DNA, 22 bp, Homo sapiens
tttcaacagatctgtcttcagg

SEQ ID NO: 7914934 - DNA, 22 bp, Homo sapiens
tttcaacagaatatgatcagag

SEQ ID NO: 7914935 - DNA, 23 bp, Homo sapiens
tttcaacaatgcttagagaaaac

SEQ ID NO: 7914936 - DNA, 23 bp, Homo sapiens
tttcaacaatgcttagagaaaac

SEQ ID NO: 7914937 - DNA, 22 bp, Homo sapiens
tttcaaaggtggaagagtgaat

SEQ ID NO: 7914938 - DNA, 22 bp, Homo sapiens
tttcaaaggttttgtcatgtct

SEQ ID NO: 7914939 - DNA, 22 bp, Homo sapiens
tttcaaaggttttgtcatgtct

SEQ ID NO: 7914940 - DNA, 22 bp, Homo sapiens
tttcaaaggttttgtcatgtct

SEQ ID NO: 7914941 - DNA, 22 bp, Homo sapiens
tttattctgtgctacatgaaga

SEQ ID NO: 7914942 - DNA, 22 bp, Homo sapiens
tttattctgtgctacatgaaga

SEQ ID NO: 7914943 - DNA, 22 bp, Homo sapiens
tttattctgtgctacatgaaga

SEQ ID NO: 7914944 - DNA, 22 bp, Homo sapiens
tttattctgtgctacatgaaga

SEQ ID NO: 7914945 - DNA, 22 bp, Homo sapiens
tttattctgtgctacatgaaga

SEQ ID NO: 7914946 - DNA, 22 bp, Homo sapiens
tttattctctagttggtcagat

SEQ ID NO: 7914947 - DNA, 23 bp, Homo sapiens
tttattctcagatacataggtct

SEQ ID NO: 7914948 - DNA, 21 bp, Homo sapiens
tttattctcagatacagggag

SEQ ID NO: 7914949 - DNA, 22 bp, Homo sapiens
tttattgaattgtaaccctatt

SEQ ID NO: 7914950 - DNA, 22 bp, Homo sapiens
tttattgaattgtaaccctatt

SEQ ID NO: 7914951 - DNA, 22 bp, Homo sapiens
tttattgaattgtaaccctatt

SEQ ID NO: 7914952 - DNA, 22 bp, Homo sapiens
tttattgaacacttgcactggc

SEQ ID NO: 7914953 - DNA, 22 bp, Homo sapiens
tttattgaacacttgcactggc

SEQ ID NO: 7914954 - DNA, 22 bp, Homo sapiens
tttattgaacacttgcactggc

SEQ ID NO: 7914955 - DNA, 22 bp, Homo sapiens
tttattgaacacttgcactggc

SEQ ID NO: 7914956 - DNA, 22 bp, Homo sapiens
tttattgaacacttgcactggc

SEQ ID NO: 7914957 - DNA, 22 bp, Homo sapiens
tttattcttgagagtgagaaga

SEQ ID NO: 7914958 - DNA, 22 bp, Homo sapiens
tttattcttgagagtgagaaga

SEQ ID NO: 7914959 - DNA, 22 bp, Homo sapiens
tttattcttgagagtgagaaga

SEQ ID NO: 7914960 - DNA, 22 bp, Homo sapiens
tttattctagctcagaatagtt

SEQ ID NO: 7914961 - DNA, 22 bp, Homo sapiens
tttattctagctcagaatagtt

SEQ ID NO: 7914962 - DNA, 22 bp, Homo sapiens
tttattctagctcagaatagtt

SEQ ID NO: 7914963 - DNA, 22 bp, Homo sapiens
tttattctagctcagaatagtt

SEQ ID NO: 7914964 - DNA, 20 bp, Homo sapiens
tttattcacagagaagagtt

SEQ ID NO: 7914965 - DNA, 20 bp, Homo sapiens
tttattcacagagaagagtt

SEQ ID NO: 7914966 - DNA, 20 bp, Homo sapiens
tttattcacagagaagagtt

SEQ ID NO: 7914967 - DNA, 20 bp, Homo sapiens
tttattcacagagaagagtt

SEQ ID NO: 7914968 - DNA, 21 bp, Homo sapiens
tttattctcagatacagggag

SEQ ID NO: 7914969 - DNA, 21 bp, Homo sapiens
tttattctcagatacagggag

SEQ ID NO: 7914970 - DNA, 22 bp, Homo sapiens
tttattctataggcattaagca

SEQ ID NO: 7914971 - DNA, 22 bp, Homo sapiens
tttattctataggcattaagca

SEQ ID NO: 7914972 - DNA, 22 bp, Homo sapiens
tttattctataggcattaagca

SEQ ID NO: 7914973 - DNA, 22 bp, Homo sapiens
tttattctataggcattaagca

SEQ ID NO: 7914974 - DNA, 22 bp, Homo sapiens
tttattctagctcagaatagtt

SEQ ID NO: 7914975 - DNA, 22 bp, Homo sapiens
cactgcctccccaggctccaca

SEQ ID NO: 7914976 - DNA, 22 bp, Homo sapiens
cactgcccttacatgccctgca

SEQ ID NO: 7914977 - DNA, 22 bp, Homo sapiens
cactgcccttacatgccctgca

SEQ ID NO: 7914978 - DNA, 22 bp, Homo sapiens
cactgcccttacatgccctgca

SEQ ID NO: 7914979 - DNA, 22 bp, Homo sapiens
cactgcccttacatgccctgca

SEQ ID NO: 7914980 - DNA, 22 bp, Homo sapiens
cactgccctgggggttgccatc

SEQ ID NO: 7914981 - DNA, 22 bp, Homo sapiens
cactgccctgggggttgccatc

SEQ ID NO: 7914982 - DNA, 20 bp, Homo sapiens
cactgccctccagcctgagc

SEQ ID NO: 7914983 - DNA, 20 bp, Homo sapiens
cactgccctccagcctgagc

SEQ ID NO: 7914984 - DNA, 20 bp, Homo sapiens
cactgccctccagcctgagc

SEQ ID NO: 7914985 - DNA, 20 bp, Homo sapiens
cactgccctccagcctgagc

SEQ ID NO: 7914986 - DNA, 20 bp, Homo sapiens
cactgccctccagcctgagc

SEQ ID NO: 7914987 - DNA, 22 bp, Homo sapiens
cactgccctcactgtggttctc

SEQ ID NO: 7914988 - DNA, 22 bp, Homo sapiens
cactgcccaggcacccatcttg

SEQ ID NO: 7914989 - DNA, 22 bp, Homo sapiens
cactgcccagcgtcttaggcac

SEQ ID NO: 7914990 - DNA, 19 bp, Homo sapiens
ggctcctgtggctgcagcc

SEQ ID NO: 7914991 - DNA, 19 bp, Homo sapiens
ggctcctgtggctgcagcc

SEQ ID NO: 7914992 - DNA, 19 bp, Homo sapiens
ggctcctgtggctgcagcc

SEQ ID NO: 7914993 - DNA, 19 bp, Homo sapiens
ggctcctgtggctgcagcc

SEQ ID NO: 7914994 - DNA, 19 bp, Homo sapiens
ggctcctgtggctgcagcc

SEQ ID NO: 7914995 - DNA, 22 bp, Homo sapiens
cactgcccagcgtcttaggcac

SEQ ID NO: 7914996 - DNA, 22 bp, Homo sapiens
cactgcccagcgtcttaggcac

SEQ ID NO: 7914997 - DNA, 22 bp, Homo sapiens
cactgcccaggacctgccaccc

SEQ ID NO: 7914998 - DNA, 22 bp, Homo sapiens
cactgcccaggacctgccaccc

SEQ ID NO: 7914999 - DNA, 22 bp, Homo sapiens
cactgcccaggacctgccaccc

SEQ ID NO: 7915000 - DNA, 22 bp, Homo sapiens
cactgcccaggacctgccaccc

SEQ ID NO: 7915001 - DNA, 22 bp, Homo sapiens
cactgcccaggcacccatcttg

SEQ ID NO: 7915002 - DNA, 22 bp, Homo sapiens
cactgcccaggcacccatcttg

SEQ ID NO: 7915003 - DNA, 22 bp, Homo sapiens
cactgcccaggcacccatcttg

SEQ ID NO: 7915004 - DNA, 22 bp, Homo sapiens
ggctcctgtcccctcagctgct

SEQ ID NO: 7915005 - DNA, 22 bp, Homo sapiens
ggctcctgtcccctcagctgct

SEQ ID NO: 7915006 - DNA, 22 bp, Homo sapiens
ggctcctgtcccctcagctgct

SEQ ID NO: 7915007 - DNA, 22 bp, Homo sapiens
ggctcctgtcccctcagctgct

SEQ ID NO: 7915008 - DNA, 22 bp, Homo sapiens
ggctcctgtcccctcagctgct

SEQ ID NO: 7915009 - DNA, 22 bp, Homo sapiens
ggctcctgggggtgctcctgcc

SEQ ID NO: 7915010 - DNA, 16 bp, Homo sapiens
ggctcctggttccttc

SEQ ID NO: 7915011 - DNA, 22 bp, Homo sapiens
ggctcctgggggtgctcctgcc

SEQ ID NO: 7915012 - DNA, 22 bp, Homo sapiens
ggctcctgggggtgctcctgcc

SEQ ID NO: 7915013 - DNA, 22 bp, Homo sapiens
ggctcctgtcctcctggagctc

SEQ ID NO: 7915014 - DNA, 22 bp, Homo sapiens
ggctcctgtcctcctggagctc

SEQ ID NO: 7915015 - DNA, 22 bp, Homo sapiens
ggctcctgtcctcctggagctc

SEQ ID NO: 7915016 - DNA, 22 bp, Homo sapiens
ggctcctgtcctcctggagctc

SEQ ID NO: 7915017 - DNA, 22 bp, Homo sapiens
ggctcctgtggcaagacagctt

SEQ ID NO: 7915018 - DNA, 22 bp, Homo sapiens
ggctcctgtggcaagacagctt

SEQ ID NO: 7915019 - DNA, 22 bp, Homo sapiens
ggctcctgtggcaagacagctt

SEQ ID NO: 7915020 - DNA, 19 bp, Homo sapiens
ggctcctgtggctgcagcc

SEQ ID NO: 7915021 - DNA, 19 bp, Homo sapiens
ggctcctgtggctgcagcc

SEQ ID NO: 7915022 - DNA, 22 bp, Homo sapiens
cactgattaagtctgctagagg

SEQ ID NO: 7915023 - DNA, 22 bp, Homo sapiens
cactgcaaaggggaaagaagca

SEQ ID NO: 7915024 - DNA, 22 bp, Homo sapiens
cactgatttagtttgtgttacc

SEQ ID NO: 7915025 - DNA, 22 bp, Homo sapiens
cactgcaacctccacctcctgg

SEQ ID NO: 7915026 - DNA, 20 bp, Homo sapiens
cactgaggtgcagctcatgc

SEQ ID NO: 7915027 - DNA, 22 bp, Homo sapiens
cactgagttagtacgcaaacat

SEQ ID NO: 7915028 - DNA, 20 bp, Homo sapiens
cactgaggtgcagctcatgc

SEQ ID NO: 7915029 - DNA, 21 bp, Homo sapiens
cactgaggtcaggggtagggt

SEQ ID NO: 7915030 - DNA, 20 bp, Homo sapiens
cactgaggtgcagctcatgc

SEQ ID NO: 7915031 - DNA, 19 bp, Homo sapiens
ggctcctggggctcagccc

SEQ ID NO: 7915032 - DNA, 22 bp, Homo sapiens
ggctcctgggggtgctcctgcc

SEQ ID NO: 7915033 - DNA, 22 bp, Homo sapiens
ggctccagtttgtgccttcagc

SEQ ID NO: 7915034 - DNA, 19 bp, Homo sapiens
ggctcctggggctcagccc

SEQ ID NO: 7915035 - DNA, 19 bp, Homo sapiens
ggctcctggggctcagccc

SEQ ID NO: 7915036 - DNA, 22 bp, Homo sapiens
ggctccagtttgtgccttcagc

SEQ ID NO: 7915037 - DNA, 22 bp, Homo sapiens
ggctccagtttgtgccttcagc

SEQ ID NO: 7915038 - DNA, 22 bp, Homo sapiens
ggctccagtttgtgccttcagc

SEQ ID NO: 7915039 - DNA, 22 bp, Homo sapiens
cactgcaacctccacctcctgg

SEQ ID NO: 7915040 - DNA, 22 bp, Homo sapiens
cactgcaacctccacctcctgg

SEQ ID NO: 7915041 - DNA, 22 bp, Homo sapiens
cactgcaacctccacctcctgg

SEQ ID NO: 7915042 - DNA, 22 bp, Homo sapiens
cactgcaacctccacctcctgg

SEQ ID NO: 7915043 - DNA, 22 bp, Homo sapiens
cactgcaacctccacctcctgg

SEQ ID NO: 7915044 - DNA, 22 bp, Homo sapiens
cactgcaacctccacctcctgg

SEQ ID NO: 7915045 - DNA, 22 bp, Homo sapiens
cactgcaacctccacctcctgg

SEQ ID NO: 7915046 - DNA, 22 bp, Homo sapiens
ggctccagtttccccttggggc

SEQ ID NO: 7915047 - DNA, 22 bp, Homo sapiens
ggctccagtttccccttggggc

SEQ ID NO: 7915048 - DNA, 22 bp, Homo sapiens
ggctccagtttccccttggggc

SEQ ID NO: 7915049 - DNA, 22 bp, Homo sapiens
ggctccagtttgtgccttcagc

SEQ ID NO: 7915050 - DNA, 22 bp, Homo sapiens
cactgaggcttccttaggcaat

SEQ ID NO: 7915051 - DNA, 22 bp, Homo sapiens
cactgaggcttccttaggcaat

SEQ ID NO: 7915052 - DNA, 22 bp, Homo sapiens
cactgagggagggtttcttctg

SEQ ID NO: 7915053 - DNA, 22 bp, Homo sapiens
cactgagggcggagcccaggga

SEQ ID NO: 7915054 - DNA, 22 bp, Homo sapiens
cactgagggggtggtttcagga

SEQ ID NO: 7915055 - DNA, 22 bp, Homo sapiens
cactgagggcggagcccaggga

SEQ ID NO: 7915056 - DNA, 22 bp, Homo sapiens
cactgagggggtggtttcagga

SEQ ID NO: 7915057 - DNA, 22 bp, Homo sapiens
cactgaggtatctgtctctcct

SEQ ID NO: 7915058 - DNA, 22 bp, Homo sapiens
cactgaggtatctgtctctcct

SEQ ID NO: 7915059 - DNA, 22 bp, Homo sapiens
cactgaggtatctgtctctcct

SEQ ID NO: 7915060 - DNA, 22 bp, Homo sapiens
cactgaggtatctgtctctcct

SEQ ID NO: 7915061 - DNA, 22 bp, Homo sapiens
cactgaggctgggggagaaggt

SEQ ID NO: 7915062 - DNA, 22 bp, Homo sapiens
ggcgctggccacggtggctctg

SEQ ID NO: 7915063 - DNA, 22 bp, Homo sapiens
ggcgctggccacggtggctctg

SEQ ID NO: 7915064 - DNA, 22 bp, Homo sapiens
ggcgctcagtgttgccccagag

SEQ ID NO: 7915065 - DNA, 22 bp, Homo sapiens
ggcgctcagtgttgccccagag

SEQ ID NO: 7915066 - DNA, 22 bp, Homo sapiens
ggcgctcagtgttgccccagag

SEQ ID NO: 7915067 - DNA, 22 bp, Homo sapiens
ggcgctcagtgttgccccagag

SEQ ID NO: 7915068 - DNA, 22 bp, Homo sapiens
ggcgcggcctctgggtcggttt

SEQ ID NO: 7915069 - DNA, 22 bp, Homo sapiens
ggcgcggcctctgggtcggttt

SEQ ID NO: 7915070 - DNA, 22 bp, Homo sapiens
ggcgcggagctggcttttggcc

SEQ ID NO: 7915071 - DNA, 22 bp, Homo sapiens
ggcgccgcactcggtgcagccg

SEQ ID NO: 7915072 - DNA, 22 bp, Homo sapiens
ggcgccgcactcggtgcagccg

SEQ ID NO: 7915073 - DNA, 22 bp, Homo sapiens
ggcgccgcactcggtgcagccg

SEQ ID NO: 7915074 - DNA, 22 bp, Homo sapiens
ggcgccgcactcggtgcagccg

SEQ ID NO: 7915075 - DNA, 20 bp, Homo sapiens
ggcgcctggcctcatggctg

SEQ ID NO: 7915076 - DNA, 22 bp, Homo sapiens
ggctgcggccgcgggtctgtgc

SEQ ID NO: 7915077 - DNA, 22 bp, Homo sapiens
ggctgcggccgcgggtctgtgc

SEQ ID NO: 7915078 - DNA, 22 bp, Homo sapiens
ggctgcggccgcgggtctgtgc

SEQ ID NO: 7915079 - DNA, 22 bp, Homo sapiens
ggctgcggatctaaggctggga

SEQ ID NO: 7915080 - DNA, 22 bp, Homo sapiens
ggctgcggatctaaggctggga

SEQ ID NO: 7915081 - DNA, 23 bp, Homo sapiens
ggctgcgagtgcctgggcctgtg

SEQ ID NO: 7915082 - DNA, 22 bp, Homo sapiens
ggctgcggatctaaggctggga

SEQ ID NO: 7915083 - DNA, 23 bp, Homo sapiens
ggctgcgagtgcctgggcctgtg

SEQ ID NO: 7915084 - DNA, 22 bp, Homo sapiens
ggctgcggatctaaggctggga

SEQ ID NO: 7915085 - DNA, 22 bp, Homo sapiens
ggctgcctttagaacggatgct

SEQ ID NO: 7915086 - DNA, 22 bp, Homo sapiens
ggctgccttgggggttgtcatt

SEQ ID NO: 7915087 - DNA, 22 bp, Homo sapiens
ggctgcctttagaacggatgct

SEQ ID NO: 7915088 - DNA, 22 bp, Homo sapiens
ggctgcctttagaacggatgct

SEQ ID NO: 7915089 - DNA, 22 bp, Homo sapiens
ggctgcctttagaacggatgct

SEQ ID NO: 7915090 - DNA, 19 bp, Homo sapiens
ggctgcctttccttaccag

SEQ ID NO: 7915091 - DNA, 22 bp, Homo sapiens
ggctgctcaaggactctgatcg

SEQ ID NO: 7915092 - DNA, 18 bp, Homo sapiens
ggctgctcctctccctac

SEQ ID NO: 7915093 - DNA, 18 bp, Homo sapiens
ggctgctcgctctccccg

SEQ ID NO: 7915094 - DNA, 22 bp, Homo sapiens
ggctgctgggtcatgatgcaga

SEQ ID NO: 7915095 - DNA, 22 bp, Homo sapiens
ggctgctcggagcctcctgtga

SEQ ID NO: 7915096 - DNA, 22 bp, Homo sapiens
cactgtcttgattactatgggt

SEQ ID NO: 7915097 - DNA, 22 bp, Homo sapiens
cactgtcttttgtgaagacaat

SEQ ID NO: 7915098 - DNA, 22 bp, Homo sapiens
cactgtcttgattactatgggt

SEQ ID NO: 7915099 - DNA, 22 bp, Homo sapiens
cactgtcttcagtttcactgca

SEQ ID NO: 7915100 - DNA, 22 bp, Homo sapiens
cactgtcttgattactatgggt

SEQ ID NO: 7915101 - DNA, 22 bp, Homo sapiens
cactgtcttcagtttcactgca

SEQ ID NO: 7915102 - DNA, 22 bp, Homo sapiens
cactgtcttcagtttcactgca

SEQ ID NO: 7915103 - DNA, 22 bp, Homo sapiens
cactgtctgtgtgtccttgggg

SEQ ID NO: 7915104 - DNA, 22 bp, Homo sapiens
cactgtcttcagtttcactgca

SEQ ID NO: 7915105 - DNA, 22 bp, Homo sapiens
cactgtctgcttcgactcttca

SEQ ID NO: 7915106 - DNA, 22 bp, Homo sapiens
cactgtctgcttcgactcttca

SEQ ID NO: 7915107 - DNA, 22 bp, Homo sapiens
cactgtctgcttcgactcttca

SEQ ID NO: 7915108 - DNA, 22 bp, Homo sapiens
cactgtctgggacatgtggtct

SEQ ID NO: 7915109 - DNA, 22 bp, Homo sapiens
cactgtctgggacatgtggtct

SEQ ID NO: 7915110 - DNA, 22 bp, Homo sapiens
cactgtctgtgtgtccttgggg

SEQ ID NO: 7915111 - DNA, 22 bp, Homo sapiens
cactgtctgcttcgactcttca

SEQ ID NO: 7915112 - DNA, 22 bp, Homo sapiens
cactgtctgagctggtgattag

SEQ ID NO: 7915113 - DNA, 22 bp, Homo sapiens
cactgtctgagctggtgattag

SEQ ID NO: 7915114 - DNA, 22 bp, Homo sapiens
cactgtctcctagggggacttc

SEQ ID NO: 7915115 - DNA, 22 bp, Homo sapiens
cactgtctcctagggggacttc

SEQ ID NO: 7915116 - DNA, 22 bp, Homo sapiens
cactgtctgagctggtgattag

SEQ ID NO: 7915117 - DNA, 22 bp, Homo sapiens
ggctgccttgaccctggctccg

SEQ ID NO: 7915118 - DNA, 22 bp, Homo sapiens
ggctgcctcagatttgctgact

SEQ ID NO: 7915119 - DNA, 22 bp, Homo sapiens
ggctgcctcaattaatcttaca

SEQ ID NO: 7915120 - DNA, 22 bp, Homo sapiens
ggctgccttgaccctggctccg

SEQ ID NO: 7915121 - DNA, 22 bp, Homo sapiens
ggctgccttgaccctggctccg

SEQ ID NO: 7915122 - DNA, 22 bp, Homo sapiens
ggctgccttgaccctggctccg

SEQ ID NO: 7915123 - DNA, 22 bp, Homo sapiens
cactgtcttttgtgaagacaat

SEQ ID NO: 7915124 - DNA, 22 bp, Homo sapiens
cactgtcttttgtgaagacaat

SEQ ID NO: 7915125 - DNA, 22 bp, Homo sapiens
cactgtgaaaaatggagtggtc

SEQ ID NO: 7915126 - DNA, 22 bp, Homo sapiens
cactgtgaaaaatggagtggtc

SEQ ID NO: 7915127 - DNA, 22 bp, Homo sapiens
cactgtcttttgtgaagacaat

SEQ ID NO: 7915128 - DNA, 22 bp, Homo sapiens
ggctgcctcaaagctcaagctc

SEQ ID NO: 7915129 - DNA, 22 bp, Homo sapiens
ggctgcagatagccagccacca

SEQ ID NO: 7915130 - DNA, 22 bp, Homo sapiens
ggctgcagaggtcactttatag

SEQ ID NO: 7915131 - DNA, 22 bp, Homo sapiens
ggctgcagaggcgatctgaggt

SEQ ID NO: 7915132 - DNA, 22 bp, Homo sapiens
ggctgcagatagccagccacca

SEQ ID NO: 7915133 - DNA, 22 bp, Homo sapiens
ggctgcagatagccagccacca

SEQ ID NO: 7915134 - DNA, 22 bp, Homo sapiens
ggctgcagatagccagccacca

SEQ ID NO: 7915135 - DNA, 22 bp, Homo sapiens
ggctgcagattgtagtctgtta

SEQ ID NO: 7915136 - DNA, 22 bp, Homo sapiens
ggctgcagattgtagtctgtta

SEQ ID NO: 7915137 - DNA, 22 bp, Homo sapiens
ggctgcagattgtagtctgtta

SEQ ID NO: 7915138 - DNA, 22 bp, Homo sapiens
ggctgcagattgtagtctgtta

SEQ ID NO: 7915139 - DNA, 22 bp, Homo sapiens
ggctgcagattgtagtctgtta

SEQ ID NO: 7915140 - DNA, 22 bp, Homo sapiens
ggctgcagatagccagccacca

SEQ ID NO: 7915141 - DNA, 22 bp, Homo sapiens
cactgcctccccaggctccaca

SEQ ID NO: 7915142 - DNA, 22 bp, Homo sapiens
cactgcctccccaggctccaca

SEQ ID NO: 7915143 - DNA, 22 bp, Homo sapiens
cactgcctctgcctcctgggtt

SEQ ID NO: 7915144 - DNA, 22 bp, Homo sapiens
cactgcctctgcctcctgggtt

SEQ ID NO: 7915145 - DNA, 22 bp, Homo sapiens
cactgcctgctggctgtcactt

SEQ ID NO: 7915146 - DNA, 22 bp, Homo sapiens
cactgcctctgcctcctgggtt

SEQ ID NO: 7915147 - DNA, 22 bp, Homo sapiens
ggctgaggctcatgccatcttg

SEQ ID NO: 7915148 - DNA, 22 bp, Homo sapiens
ggctgaggctcatgccatcttg

SEQ ID NO: 7915149 - DNA, 22 bp, Homo sapiens
ggctgaggctcatgccatcttg

SEQ ID NO: 7915150 - DNA, 22 bp, Homo sapiens
ggctgcagaggcgatctgaggt

SEQ ID NO: 7915151 - DNA, 22 bp, Homo sapiens
cactgtccaatagatacataat

SEQ ID NO: 7915152 - DNA, 22 bp, Homo sapiens
ggctgcagcggattggggattg

SEQ ID NO: 7915153 - DNA, 22 bp, Homo sapiens
ggctgcagcggattggggattg

SEQ ID NO: 7915154 - DNA, 22 bp, Homo sapiens
ggctgcagccctcgcctagcca

SEQ ID NO: 7915155 - DNA, 22 bp, Homo sapiens
ggctgcagcggattggggattg

SEQ ID NO: 7915156 - DNA, 22 bp, Homo sapiens
cactgtccatgcttgctaaccc

SEQ ID NO: 7915157 - DNA, 22 bp, Homo sapiens
cactgtccctgtttcctggaaa

SEQ ID NO: 7915158 - DNA, 22 bp, Homo sapiens
cactgtccctgtttcctggaaa

SEQ ID NO: 7915159 - DNA, 22 bp, Homo sapiens
cactgtccctgtttcctggaaa

SEQ ID NO: 7915160 - DNA, 19 bp, Homo sapiens
cactgtcctagtcgaggcc

SEQ ID NO: 7915161 - DNA, 22 bp, Homo sapiens
cactgtctattaatataactta

SEQ ID NO: 7915162 - DNA, 22 bp, Homo sapiens
cactgtctattaatataactta

SEQ ID NO: 7915163 - DNA, 22 bp, Homo sapiens
cactgtctattaatataactta

SEQ ID NO: 7915164 - DNA, 22 bp, Homo sapiens
ggctgcagcagagggactcacg

SEQ ID NO: 7915165 - DNA, 22 bp, Homo sapiens
ggctgcagccctcgcctagcca

SEQ ID NO: 7915166 - DNA, 22 bp, Homo sapiens
ggctgcagcagagggactcacg

SEQ ID NO: 7915167 - DNA, 22 bp, Homo sapiens
ggctgcagcagagggactcacg

SEQ ID NO: 7915168 - DNA, 22 bp, Homo sapiens
ggctgcagcagagggactcacg

SEQ ID NO: 7915169 - DNA, 22 bp, Homo sapiens
ggctgcagccctcgcctagcca

SEQ ID NO: 7915170 - DNA, 22 bp, Homo sapiens
ggctgcagccctcgcctagcca

SEQ ID NO: 7915171 - DNA, 22 bp, Homo sapiens
ggctgcagccctcgcctagcca

SEQ ID NO: 7915172 - DNA, 22 bp, Homo sapiens
ggctgcagccctcgcctagcca

SEQ ID NO: 7915173 - DNA, 22 bp, Homo sapiens
ggctgcagccctcgcctagcca

SEQ ID NO: 7915174 - DNA, 22 bp, Homo sapiens
cagaagaggactgggtagctca

SEQ ID NO: 7915175 - DNA, 22 bp, Homo sapiens
cagaagaggactgggtagctca

SEQ ID NO: 7915176 - DNA, 22 bp, Homo sapiens
cagaagaggactgggtagctca

SEQ ID NO: 7915177 - DNA, 22 bp, Homo sapiens
cagaagagtagctgaacaagtt

SEQ ID NO: 7915178 - DNA, 22 bp, Homo sapiens
cagaagagtagctgaacaagtt

SEQ ID NO: 7915179 - DNA, 22 bp, Homo sapiens
cagaagagtagctgaacaagtt

SEQ ID NO: 7915180 - DNA, 22 bp, Homo sapiens
cagaagagtagctgaacaagtt

SEQ ID NO: 7915181 - DNA, 22 bp, Homo sapiens
cagaagaggactgggtagctca

SEQ ID NO: 7915182 - DNA, 22 bp, Homo sapiens
cagaagagatgaaatagtatta

SEQ ID NO: 7915183 - DNA, 22 bp, Homo sapiens
cagaagaggactgggtagctca

SEQ ID NO: 7915184 - DNA, 22 bp, Homo sapiens
cagaagaggactgggtagctca

SEQ ID NO: 7915185 - DNA, 22 bp, Homo sapiens
cagaacattccatgtgccctgc

SEQ ID NO: 7915186 - DNA, 22 bp, Homo sapiens
cagaacattgttttctcatctg

SEQ ID NO: 7915187 - DNA, 20 bp, Homo sapiens
cagaacatgagcatcgagcc

SEQ ID NO: 7915188 - DNA, 22 bp, Homo sapiens
cagaacattcactcatatgtgg

SEQ ID NO: 7915189 - DNA, 20 bp, Homo sapiens
cagaacagtctgagaggcca

SEQ ID NO: 7915190 - DNA, 20 bp, Homo sapiens
cagaacagtctgagaggcca

SEQ ID NO: 7915191 - DNA, 20 bp, Homo sapiens
cagaacagtctgagaggcca

SEQ ID NO: 7915192 - DNA, 20 bp, Homo sapiens
cagaacagtctgagaggcca

SEQ ID NO: 7915193 - DNA, 20 bp, Homo sapiens
cagaacagtctgagaggcca

SEQ ID NO: 7915194 - DNA, 22 bp, Homo sapiens
cagaacagtcgcctgcatggat

SEQ ID NO: 7915195 - DNA, 22 bp, Homo sapiens
cagaacagtcgcctgcatggat

SEQ ID NO: 7915196 - DNA, 22 bp, Homo sapiens
cagaacaggtcatgcttgctgt

SEQ ID NO: 7915197 - DNA, 22 bp, Homo sapiens
cagaacaggtcatgcttgctgt

SEQ ID NO: 7915198 - DNA, 23 bp, Homo sapiens
cagaacagtaaaagatgccatgg

SEQ ID NO: 7915199 - DNA, 23 bp, Homo sapiens
cagaacagtaaaagatgccatgg

SEQ ID NO: 7915200 - DNA, 23 bp, Homo sapiens
cagaacagtaaaagatgccatgg

SEQ ID NO: 7915201 - DNA, 23 bp, Homo sapiens
cagaacagtaaaagatgccatgg

SEQ ID NO: 7915202 - DNA, 22 bp, Homo sapiens
cagaacagtcgcctgcatggat

SEQ ID NO: 7915203 - DNA, 22 bp, Homo sapiens
cagaacagtacctagcacatag

SEQ ID NO: 7915204 - DNA, 22 bp, Homo sapiens
cagaacagtacctagcacatag

SEQ ID NO: 7915205 - DNA, 22 bp, Homo sapiens
cagaacagtacctagcacatag

SEQ ID NO: 7915206 - DNA, 23 bp, Homo sapiens
cagaacagtaaaagatgccatgg

SEQ ID NO: 7915207 - DNA, 22 bp, Homo sapiens
cagaacagtacctagcacatag

SEQ ID NO: 7915208 - DNA, 22 bp, Homo sapiens
cagaacagtacctagcacatag

SEQ ID NO: 7915209 - DNA, 22 bp, Homo sapiens
cagaacagagtcaaaagtatgt

SEQ ID NO: 7915210 - DNA, 19 bp, Homo sapiens
cagaacagaggtcatggcc

SEQ ID NO: 7915211 - DNA, 19 bp, Homo sapiens
cagaacagaggtcatggcc

SEQ ID NO: 7915212 - DNA, 22 bp, Homo sapiens
cagaacagagcctgaatctctc

SEQ ID NO: 7915213 - DNA, 19 bp, Homo sapiens
cagaacagaggtcatggcc

SEQ ID NO: 7915214 - DNA, 19 bp, Homo sapiens
cagaacaggaccaggggcc

SEQ ID NO: 7915215 - DNA, 19 bp, Homo sapiens
cagaacagctgggaagaga

SEQ ID NO: 7915216 - DNA, 19 bp, Homo sapiens
cagaacagctgggaagaga

SEQ ID NO: 7915217 - DNA, 22 bp, Homo sapiens
cagaacagagtcaaaagtatgt

SEQ ID NO: 7915218 - DNA, 22 bp, Homo sapiens
cagaacagagtcaaaagtatgt

SEQ ID NO: 7915219 - DNA, 22 bp, Homo sapiens
cagaacagagtcaaaagtatgt

SEQ ID NO: 7915220 - DNA, 23 bp, Homo sapiens
ggcttggccctcaagggccctgc

SEQ ID NO: 7915221 - DNA, 22 bp, Homo sapiens
cagaacagacttaacagggctg

SEQ ID NO: 7915222 - DNA, 22 bp, Homo sapiens
cagaacagacttaacagggctg

SEQ ID NO: 7915223 - DNA, 22 bp, Homo sapiens
cagaacagacttaacagggctg

SEQ ID NO: 7915224 - DNA, 22 bp, Homo sapiens
cagaacagacttaacagggctg

SEQ ID NO: 7915225 - DNA, 22 bp, Homo sapiens
cagaacagacttaacagggctg

SEQ ID NO: 7915226 - DNA, 22 bp, Homo sapiens
cagaacagacttaacagggctg

SEQ ID NO: 7915227 - DNA, 22 bp, Homo sapiens
cagaacagagcctgaatctctc

SEQ ID NO: 7915228 - DNA, 22 bp, Homo sapiens
ggcttggaaattgcaggacaca

SEQ ID NO: 7915229 - DNA, 22 bp, Homo sapiens
ggcttggaccagtcacagtggt

SEQ ID NO: 7915230 - DNA, 22 bp, Homo sapiens
ggcttggaattggtaggatgta

SEQ ID NO: 7915231 - DNA, 22 bp, Homo sapiens
ggcttggcagaggtgggtgctt

SEQ ID NO: 7915232 - DNA, 22 bp, Homo sapiens
ggcttggcccaggcctcactcc

SEQ ID NO: 7915233 - DNA, 23 bp, Homo sapiens
ggcttggccctcaagggccctgc

SEQ ID NO: 7915234 - DNA, 22 bp, Homo sapiens
ggcttgcacacagcctcagttt

SEQ ID NO: 7915235 - DNA, 22 bp, Homo sapiens
ggcttggaaactagagtgtgca

SEQ ID NO: 7915236 - DNA, 22 bp, Homo sapiens
ggcttggaaattgcaggacaca

SEQ ID NO: 7915237 - DNA, 20 bp, Homo sapiens
ggcttgagtcagatcttgga

SEQ ID NO: 7915238 - DNA, 23 bp, Homo sapiens
ggcttgagctggaacagcttggt

SEQ ID NO: 7915239 - DNA, 23 bp, Homo sapiens
ggcttgagctggaacagcttggt

SEQ ID NO: 7915240 - DNA, 22 bp, Homo sapiens
ggcttgagacccgggagccaga

SEQ ID NO: 7915241 - DNA, 22 bp, Homo sapiens
ggcttgagacccgggagccaga

SEQ ID NO: 7915242 - DNA, 22 bp, Homo sapiens
ggctgggagctggacaggccgg

SEQ ID NO: 7915243 - DNA, 22 bp, Homo sapiens
ggctgggagctggacaggccgg

SEQ ID NO: 7915244 - DNA, 22 bp, Homo sapiens
ggctgggagctggacaggccgg

SEQ ID NO: 7915245 - DNA, 22 bp, Homo sapiens
ggctgggagctggacaggccgg

SEQ ID NO: 7915246 - DNA, 22 bp, Homo sapiens
ggctgggagctggacaggccgg

SEQ ID NO: 7915247 - DNA, 17 bp, Homo sapiens
ggcttcagggagctggg

SEQ ID NO: 7915248 - DNA, 20 bp, Homo sapiens
ggcttcttcaggtgtctatt

SEQ ID NO: 7915249 - DNA, 22 bp, Homo sapiens
ggcttcaggggcccagtcagca

SEQ ID NO: 7915250 - DNA, 22 bp, Homo sapiens
ggcttcaggggcccagtcagca

SEQ ID NO: 7915251 - DNA, 19 bp, Homo sapiens
ggcttcagggagttagcat

SEQ ID NO: 7915252 - DNA, 22 bp, Homo sapiens
ggcttcaggggcccagtcagca

SEQ ID NO: 7915253 - DNA, 22 bp, Homo sapiens
ggcttcttcctgtgaacatgtt

SEQ ID NO: 7915254 - DNA, 22 bp, Homo sapiens
ggcttcttcctggctcctatta

SEQ ID NO: 7915255 - DNA, 20 bp, Homo sapiens
ggcttcttcaggtgtctatt

SEQ ID NO: 7915256 - DNA, 22 bp, Homo sapiens
ggcttcttcctggctcctatta

SEQ ID NO: 7915257 - DNA, 22 bp, Homo sapiens
ggcttcttcctggctcctatta

SEQ ID NO: 7915258 - DNA, 22 bp, Homo sapiens
ggcttcttgtgtgtcaggctct

SEQ ID NO: 7915259 - DNA, 22 bp, Homo sapiens
ggcttcttgtgtgtcaggctct

SEQ ID NO: 7915260 - DNA, 22 bp, Homo sapiens
ggcttcttgtgtgtcaggctct

SEQ ID NO: 7915261 - DNA, 22 bp, Homo sapiens
ggcttcttgctattttccaatg

SEQ ID NO: 7915262 - DNA, 23 bp, Homo sapiens
ggcttcttgcctgtcttggtgct

SEQ ID NO: 7915263 - DNA, 23 bp, Homo sapiens
ggcttcttgcctgtcttggtgct

SEQ ID NO: 7915264 - DNA, 22 bp, Homo sapiens
ggcttcttctttctcaaacccc

SEQ ID NO: 7915265 - DNA, 22 bp, Homo sapiens
ggcttcttctctgtgtccagca

SEQ ID NO: 7915266 - DNA, 22 bp, Homo sapiens
ggcttcttctctgtgtccagca

SEQ ID NO: 7915267 - DNA, 20 bp, Homo sapiens
ggcttctttacatctgtgtt

SEQ ID NO: 7915268 - DNA, 22 bp, Homo sapiens
ggcttctttcactaagtagaga

SEQ ID NO: 7915269 - DNA, 20 bp, Homo sapiens
ggcttctttacatctgtgtt

SEQ ID NO: 7915270 - DNA, 20 bp, Homo sapiens
ggcttctttacatctgtgtt

SEQ ID NO: 7915271 - DNA, 20 bp, Homo sapiens
ggcttctttacatctgtgtt

SEQ ID NO: 7915272 - DNA, 22 bp, Homo sapiens
ggcttctttcagagtgaataga

SEQ ID NO: 7915273 - DNA, 22 bp, Homo sapiens
ggcttctttgtaacgtgccagc

SEQ ID NO: 7915274 - DNA, 22 bp, Homo sapiens
ggcttctttcagagtgaataga

SEQ ID NO: 7915275 - DNA, 22 bp, Homo sapiens
ggcttctttttagtaaatgtca

SEQ ID NO: 7915276 - DNA, 22 bp, Homo sapiens
ggcttctttttagtaaatgtca

SEQ ID NO: 7915277 - DNA, 22 bp, Homo sapiens
ggcttctttgtaacgtgccagc

SEQ ID NO: 7915278 - DNA, 22 bp, Homo sapiens
ggcttgaagactatgacatttc

SEQ ID NO: 7915279 - DNA, 22 bp, Homo sapiens
ggcttgaactcccaatcattta

SEQ ID NO: 7915280 - DNA, 22 bp, Homo sapiens
cagaacacattttcagagtcaa

SEQ ID NO: 7915281 - DNA, 22 bp, Homo sapiens
cagaacacaggctaaactgaga

SEQ ID NO: 7915282 - DNA, 22 bp, Homo sapiens
cagaacacaggctaaactgaga

SEQ ID NO: 7915283 - DNA, 22 bp, Homo sapiens
cagaaatgtttgttaatattgt

SEQ ID NO: 7915284 - DNA, 22 bp, Homo sapiens
cagaaattcccatttcagattc

SEQ ID NO: 7915285 - DNA, 22 bp, Homo sapiens
cagaaattggaatagagaaata

SEQ ID NO: 7915286 - DNA, 22 bp, Homo sapiens
cagaacagaagtaaaatttacc

SEQ ID NO: 7915287 - DNA, 22 bp, Homo sapiens
cagaacagaaacgttgttccat

SEQ ID NO: 7915288 - DNA, 22 bp, Homo sapiens
cagaacacattttcagagtcaa

SEQ ID NO: 7915289 - DNA, 22 bp, Homo sapiens
cagaacacattttcagagtcaa

SEQ ID NO: 7915290 - DNA, 22 bp, Homo sapiens
cagaacacattttcagagtcaa

SEQ ID NO: 7915291 - DNA, 22 bp, Homo sapiens
cagaacagaaacgttgttccat

SEQ ID NO: 7915292 - DNA, 22 bp, Homo sapiens
cagaacagaaacgttgttccat

SEQ ID NO: 7915293 - DNA, 22 bp, Homo sapiens
cagaacagaagtaaaatttacc

SEQ ID NO: 7915294 - DNA, 22 bp, Homo sapiens
cagaacagaagtaaaatttacc

SEQ ID NO: 7915295 - DNA, 22 bp, Homo sapiens
cagaacagaatcgtgtggtgag

SEQ ID NO: 7915296 - DNA, 22 bp, Homo sapiens
cagaaatgtgatgtacacacac

SEQ ID NO: 7915297 - DNA, 22 bp, Homo sapiens
cagaaatgtgatgtacacacac

SEQ ID NO: 7915298 - DNA, 22 bp, Homo sapiens
cagaaatgtttatatgtggtgt

SEQ ID NO: 7915299 - DNA, 22 bp, Homo sapiens
cagaaatgtttatatgtggtgt

SEQ ID NO: 7915300 - DNA, 22 bp, Homo sapiens
cagaaatgtttatatgtggtgt

SEQ ID NO: 7915301 - DNA, 22 bp, Homo sapiens
cagaaatgttctaatgattcag

SEQ ID NO: 7915302 - DNA, 22 bp, Homo sapiens
cagaaatgtttatgcttttgaa

SEQ ID NO: 7915303 - DNA, 22 bp, Homo sapiens
cagaaatgtttgttaatattgt

SEQ ID NO: 7915304 - DNA, 22 bp, Homo sapiens
cagaaatgtttgttaatattgt

SEQ ID NO: 7915305 - DNA, 22 bp, Homo sapiens
cagaaattcccatttcagattc

SEQ ID NO: 7915306 - DNA, 22 bp, Homo sapiens
ggctgggagccccacagagtca

SEQ ID NO: 7915307 - DNA, 23 bp, Homo sapiens
ggctgggagctccgggtgcacgt

SEQ ID NO: 7915308 - DNA, 23 bp, Homo sapiens
ggctgggagctccgggtgcacgt

SEQ ID NO: 7915309 - DNA, 23 bp, Homo sapiens
ggctgggagctccgggtgcacgt

SEQ ID NO: 7915310 - DNA, 23 bp, Homo sapiens
ggctgggagctccgggtgcacgt

SEQ ID NO: 7915311 - DNA, 23 bp, Homo sapiens
ggctgggagctccgggtgcacgt

SEQ ID NO: 7915312 - DNA, 23 bp, Homo sapiens
ggctgggagctccgggtgcacgt

SEQ ID NO: 7915313 - DNA, 23 bp, Homo sapiens
ggctgggagctccgggtgcacgt

SEQ ID NO: 7915314 - DNA, 23 bp, Homo sapiens
ggctgggagctccgggtgcacgt

SEQ ID NO: 7915315 - DNA, 22 bp, Homo sapiens
ggctgggacgatgaggattagt

SEQ ID NO: 7915316 - DNA, 22 bp, Homo sapiens
ggctgggacgatgaggattagt

SEQ ID NO: 7915317 - DNA, 22 bp, Homo sapiens
ggctgggagccccacagagtca

SEQ ID NO: 7915318 - DNA, 22 bp, Homo sapiens
ggctgggacgatgaggattagt

SEQ ID NO: 7915319 - DNA, 22 bp, Homo sapiens
ggctgggagccccacagagtca

SEQ ID NO: 7915320 - DNA, 22 bp, Homo sapiens
ggctgggagccccacagagtca

SEQ ID NO: 7915321 - DNA, 22 bp, Homo sapiens
ggctgggagccccacagagtca

SEQ ID NO: 7915322 - DNA, 22 bp, Homo sapiens
ggctgggagccccacagagtca

SEQ ID NO: 7915323 - DNA, 22 bp, Homo sapiens
ggctgggacgatgaggattagt

SEQ ID NO: 7915324 - DNA, 22 bp, Homo sapiens
ggctgggacgatgaggattagt

SEQ ID NO: 7915325 - DNA, 22 bp, Homo sapiens
ggctgggacgatgaggattagt

SEQ ID NO: 7915326 - DNA, 22 bp, Homo sapiens
ggctggctttctctccgcacct

SEQ ID NO: 7915327 - DNA, 22 bp, Homo sapiens
ggctggctttctctccgcacct

SEQ ID NO: 7915328 - DNA, 22 bp, Homo sapiens
ggctggctttctctccgcacct

SEQ ID NO: 7915329 - DNA, 22 bp, Homo sapiens
ggctgctgtgacctcaggtgat

SEQ ID NO: 7915330 - DNA, 22 bp, Homo sapiens
ggctgctgtgacctcaggtgat

SEQ ID NO: 7915331 - DNA, 22 bp, Homo sapiens
ggctgctgtgacctcaggtgat

SEQ ID NO: 7915332 - DNA, 21 bp, Homo sapiens
ggctgctgtcaccgctgtcac

SEQ ID NO: 7915333 - DNA, 22 bp, Homo sapiens
cagaaatagacaatggcagtgg

SEQ ID NO: 7915334 - DNA, 22 bp, Homo sapiens
cagaaatagacaatggcagtgg

SEQ ID NO: 7915335 - DNA, 22 bp, Homo sapiens
ggctgctgtgacctcaggtgat

SEQ ID NO: 7915336 - DNA, 23 bp, Homo sapiens
cagaaatgacagtaagcaccctg

SEQ ID NO: 7915337 - DNA, 19 bp, Homo sapiens
cagaaatagcgaagtgtaa

SEQ ID NO: 7915338 - DNA, 19 bp, Homo sapiens
cagaaatagcgaagtgtaa

SEQ ID NO: 7915339 - DNA, 19 bp, Homo sapiens
cagaaatagcgaagtgtaa

SEQ ID NO: 7915340 - DNA, 22 bp, Homo sapiens
cagaaatgcctgcttctctctc

SEQ ID NO: 7915341 - DNA, 22 bp, Homo sapiens
cagaaatggaagttctggttta

SEQ ID NO: 7915342 - DNA, 22 bp, Homo sapiens
cagaaatgcctgcttctctctc

SEQ ID NO: 7915343 - DNA, 22 bp, Homo sapiens
cagaaatgtactgacatgcagt

SEQ ID NO: 7915344 - DNA, 22 bp, Homo sapiens
cagaaatgtactgacatgcagt

SEQ ID NO: 7915345 - DNA, 22 bp, Homo sapiens
cagaaatgtactgacatgcagt

SEQ ID NO: 7915346 - DNA, 22 bp, Homo sapiens
cagaaatgtactgacatgcagt

SEQ ID NO: 7915347 - DNA, 22 bp, Homo sapiens
cagaaatgtactgacatgcagt

SEQ ID NO: 7915348 - DNA, 22 bp, Homo sapiens
cagaaatggtctgttcagctta

SEQ ID NO: 7915349 - DNA, 22 bp, Homo sapiens
cagaaatggtctgttcagctta

SEQ ID NO: 7915350 - DNA, 22 bp, Homo sapiens
cagaaatggagcccaggaatct

SEQ ID NO: 7915351 - DNA, 22 bp, Homo sapiens
cagaaatggaattttccatcac

SEQ ID NO: 7915352 - DNA, 22 bp, Homo sapiens
cagaaatggaattttccatcac

SEQ ID NO: 7915353 - DNA, 22 bp, Homo sapiens
cagaaatggaagttctggttta

SEQ ID NO: 7915354 - DNA, 22 bp, Homo sapiens
ggctgctggtaggggtaggaag

SEQ ID NO: 7915355 - DNA, 22 bp, Homo sapiens
ggctgctggtaggggtaggaag

SEQ ID NO: 7915356 - DNA, 22 bp, Homo sapiens
ggctgctggtaggggtaggaag

SEQ ID NO: 7915357 - DNA, 22 bp, Homo sapiens
ggctgctgggtcatgatgcaga

SEQ ID NO: 7915358 - DNA, 22 bp, Homo sapiens
ggctgctgggtcatgatgcaga

SEQ ID NO: 7915359 - DNA, 19 bp, Homo sapiens
ggctgctggttacagaggc

SEQ ID NO: 7915360 - DNA, 19 bp, Homo sapiens
ggctgctggttacagaggc

SEQ ID NO: 7915361 - DNA, 19 bp, Homo sapiens
ggctgctggttacagaggc

SEQ ID NO: 7915362 - DNA, 19 bp, Homo sapiens
ggctgctggttacagaggc

SEQ ID NO: 7915363 - DNA, 19 bp, Homo sapiens
ggctgctggttacagaggc

SEQ ID NO: 7915364 - DNA, 22 bp, Homo sapiens
ggctgctggtggaatggtaggc

SEQ ID NO: 7915365 - DNA, 22 bp, Homo sapiens
ggctgctggtggaatggtaggc

SEQ ID NO: 7915366 - DNA, 21 bp, Homo sapiens
ggctgctgtcaccgctgtcac

SEQ ID NO: 7915367 - DNA, 21 bp, Homo sapiens
ggctgctgtcaccgctgtcac

SEQ ID NO: 7915368 - DNA, 21 bp, Homo sapiens
ggctgctgtcaccgctgtcac

SEQ ID NO: 7915369 - DNA, 21 bp, Homo sapiens
ggctgctgtcaccgctgtcac

SEQ ID NO: 7915370 - DNA, 21 bp, Homo sapiens
ggctgctgtcaccgctgtcac

SEQ ID NO: 7915371 - DNA, 22 bp, Homo sapiens
ggctgctgtactgatgtcagtt

SEQ ID NO: 7915372 - DNA, 22 bp, Homo sapiens
ggctgctgtactgatgtcagtt

SEQ ID NO: 7915373 - DNA, 22 bp, Homo sapiens
ggctgctgtactgatgtcagtt

SEQ ID NO: 7915374 - DNA, 22 bp, Homo sapiens
ggctgctgtactgatgtcagtt

SEQ ID NO: 7915375 - DNA, 22 bp, Homo sapiens
ggctgctgtactgatgtcagtt

SEQ ID NO: 7915376 - DNA, 22 bp, Homo sapiens
ggctgctgtactgatgtcagtt

SEQ ID NO: 7915377 - DNA, 20 bp, Homo sapiens
ggctgctggtttggctctgt

SEQ ID NO: 7915378 - DNA, 22 bp, Homo sapiens
ggctgctgtactgatgtcagtt

SEQ ID NO: 7915379 - DNA, 20 bp, Homo sapiens
ggctgctggtttggctctgt

SEQ ID NO: 7915380 - DNA, 20 bp, Homo sapiens
ggctgctggtttggctctgt

SEQ ID NO: 7915381 - DNA, 19 bp, Homo sapiens
ggctgctggttacagaggc

SEQ ID NO: 7915382 - DNA, 20 bp, Homo sapiens
ggctgctggtttggctctgt

SEQ ID NO: 7915383 - DNA, 22 bp, Homo sapiens
ggcgcccccttcaaacagagca

SEQ ID NO: 7915384 - DNA, 22 bp, Homo sapiens
ggcgcccccttcaaacagagca

SEQ ID NO: 7915385 - DNA, 22 bp, Homo sapiens
ggcgcccccttcaaacagagca

SEQ ID NO: 7915386 - DNA, 22 bp, Homo sapiens
ggcgcccatcggtgcagagggc

SEQ ID NO: 7915387 - DNA, 22 bp, Homo sapiens
ggcgccccatatagttcttaat

SEQ ID NO: 7915388 - DNA, 22 bp, Homo sapiens
ggcgccagcactgcagcgcctc

SEQ ID NO: 7915389 - DNA, 22 bp, Homo sapiens
ggcgccagcactgcagcgcctc

SEQ ID NO: 7915390 - DNA, 22 bp, Homo sapiens
ggcgcagttgagcgtgctgttc

SEQ ID NO: 7915391 - DNA, 22 bp, Homo sapiens
ggcgccagcggtaagtaagaca

SEQ ID NO: 7915392 - DNA, 22 bp, Homo sapiens
ggcgccagcggtaagtaagaca

SEQ ID NO: 7915393 - DNA, 22 bp, Homo sapiens
ggcgagggagcagtgcggtggg

SEQ ID NO: 7915394 - DNA, 22 bp, Homo sapiens
ggcgagggagcagtgcggtggg

SEQ ID NO: 7915395 - DNA, 22 bp, Homo sapiens
ggcgagggagcagtgcggtggg

SEQ ID NO: 7915396 - DNA, 22 bp, Homo sapiens
ggcgagggagcagtgcggtggg

SEQ ID NO: 7915397 - DNA, 23 bp, Homo sapiens
ggcctgtgttttgtctgaagtac

SEQ ID NO: 7915398 - DNA, 22 bp, Homo sapiens
ggcgagggaagtttactgtgag

SEQ ID NO: 7915399 - DNA, 22 bp, Homo sapiens
ggcgagggaagtttactgtgag

SEQ ID NO: 7915400 - DNA, 22 bp, Homo sapiens
ggccccagggaagaaggtggtc

SEQ ID NO: 7915401 - DNA, 22 bp, Homo sapiens
ggcgcaggccttggatcctggt

SEQ ID NO: 7915402 - DNA, 22 bp, Homo sapiens
ggcgcaggccttggatcctggt

SEQ ID NO: 7915403 - DNA, 22 bp, Homo sapiens
ggcgagggagcagtgcggtggg

SEQ ID NO: 7915404 - DNA, 22 bp, Homo sapiens
ggcgagggagcagtgcggtggg

SEQ ID NO: 7915405 - DNA, 22 bp, Homo sapiens
ggcgagggagcagtgcggtggg

SEQ ID NO: 7915406 - DNA, 22 bp, Homo sapiens
ggccccaggcctttggtctggc

SEQ ID NO: 7915407 - DNA, 22 bp, Homo sapiens
ggccccaggcctttggtctggc

SEQ ID NO: 7915408 - DNA, 22 bp, Homo sapiens
ggccccagggaagaaggtggtc

SEQ ID NO: 7915409 - DNA, 22 bp, Homo sapiens
ggccccagggaagaaggtggtc

SEQ ID NO: 7915410 - DNA, 22 bp, Homo sapiens
ggccccagggattaggccaacc

SEQ ID NO: 7915411 - DNA, 22 bp, Homo sapiens
ggccccagggattaggccaacc

SEQ ID NO: 7915412 - DNA, 22 bp, Homo sapiens
ggccccagggattaggccaacc

SEQ ID NO: 7915413 - DNA, 22 bp, Homo sapiens
ggccccagggattaggccaacc

SEQ ID NO: 7915414 - DNA, 17 bp, Homo sapiens
ggcctgtgtggctgcag

SEQ ID NO: 7915415 - DNA, 17 bp, Homo sapiens
ggcctgtgtggctgcag

SEQ ID NO: 7915416 - DNA, 22 bp, Homo sapiens
ggccccagggattaggccaacc

SEQ ID NO: 7915417 - DNA, 22 bp, Homo sapiens
ggccccagggattaggccaacc

SEQ ID NO: 7915418 - DNA, 22 bp, Homo sapiens
ggccccaggcctttggtctggc

SEQ ID NO: 7915419 - DNA, 22 bp, Homo sapiens
ggccccaggcctttggtctggc

SEQ ID NO: 7915420 - DNA, 22 bp, Homo sapiens
ggccccaggcctttggtctggc

SEQ ID NO: 7915421 - DNA, 22 bp, Homo sapiens
ggccccaggcctttggtctggc

SEQ ID NO: 7915422 - DNA, 22 bp, Homo sapiens
ggccccaggacctccacggtcc

SEQ ID NO: 7915423 - DNA, 22 bp, Homo sapiens
ggccccaggacctccacggtcc

SEQ ID NO: 7915424 - DNA, 22 bp, Homo sapiens
ggccccaggacctccacggtcc

SEQ ID NO: 7915425 - DNA, 22 bp, Homo sapiens
ggccccagctgtggtgaataga

SEQ ID NO: 7915426 - DNA, 22 bp, Homo sapiens
ggccccagctgtggtgaataga

SEQ ID NO: 7915427 - DNA, 22 bp, Homo sapiens
ggccccagcctcagtcccctga

SEQ ID NO: 7915428 - DNA, 22 bp, Homo sapiens
ggccccagcttcaaccccgtgg

SEQ ID NO: 7915429 - DNA, 22 bp, Homo sapiens
ggccccaggacctccacggtcc

SEQ ID NO: 7915430 - DNA, 22 bp, Homo sapiens
ggccccagcttcaaccccgtgg

SEQ ID NO: 7915431 - DNA, 22 bp, Homo sapiens
ggcccagagctccctggcacct

SEQ ID NO: 7915432 - DNA, 22 bp, Homo sapiens
ggcccagagctccctggcacct

SEQ ID NO: 7915433 - DNA, 22 bp, Homo sapiens
ggcccagagctccctggcacct

SEQ ID NO: 7915434 - DNA, 22 bp, Homo sapiens
ggcccagagacgtgcaatgtac

SEQ ID NO: 7915435 - DNA, 22 bp, Homo sapiens
ggcccagacccaagagtggtgg

SEQ ID NO: 7915436 - DNA, 22 bp, Homo sapiens
ggccagggcctggggactgtcc

SEQ ID NO: 7915437 - DNA, 22 bp, Homo sapiens
ggccagggcctggggactgtcc

SEQ ID NO: 7915438 - DNA, 22 bp, Homo sapiens
ggcccagaagccagaagcctcc

SEQ ID NO: 7915439 - DNA, 22 bp, Homo sapiens
ggcccagaagccagaagcctcc

SEQ ID NO: 7915440 - DNA, 22 bp, Homo sapiens
ggcccagaatacatgaagtata

SEQ ID NO: 7915441 - DNA, 22 bp, Homo sapiens
ggcccagaatactttgtaaaat

SEQ ID NO: 7915442 - DNA, 22 bp, Homo sapiens
ggcccagaatacatgaagtata

SEQ ID NO: 7915443 - DNA, 22 bp, Homo sapiens
ggcccagacccaagagtggtgg

SEQ ID NO: 7915444 - DNA, 22 bp, Homo sapiens
ggcccagcacagtgcttggggg

SEQ ID NO: 7915445 - DNA, 22 bp, Homo sapiens
ggcccagcacagtgcttggggg

SEQ ID NO: 7915446 - DNA, 22 bp, Homo sapiens
ggcccagagtctgcaatggagt

SEQ ID NO: 7915447 - DNA, 22 bp, Homo sapiens
ggcccagattagaagctgaatg

SEQ ID NO: 7915448 - DNA, 22 bp, Homo sapiens
ggcccagcacagtgcttggggg

SEQ ID NO: 7915449 - DNA, 22 bp, Homo sapiens
ggcccagattagaagctgaatg

SEQ ID NO: 7915450 - DNA, 22 bp, Homo sapiens
ggcccagaggggttgagcatct

SEQ ID NO: 7915451 - DNA, 22 bp, Homo sapiens
ggcccagagctctgggggagct

SEQ ID NO: 7915452 - DNA, 22 bp, Homo sapiens
ggcccagaggggttgagcatct

SEQ ID NO: 7915453 - DNA, 22 bp, Homo sapiens
ggcccagagggtcaggagctga

SEQ ID NO: 7915454 - DNA, 22 bp, Homo sapiens
ggcccagagggtcaggagctga

SEQ ID NO: 7915455 - DNA, 22 bp, Homo sapiens
ggcccagagtctgcaatggagt

SEQ ID NO: 7915456 - DNA, 22 bp, Homo sapiens
ggcccagagggtcaggagctga

SEQ ID NO: 7915457 - DNA, 22 bp, Homo sapiens
ggcccagagtctgcaatggagt

SEQ ID NO: 7915458 - DNA, 22 bp, Homo sapiens
ggcccagagggtcaggagctga

SEQ ID NO: 7915459 - DNA, 22 bp, Homo sapiens
ggcccagagtctgcaatggagt

SEQ ID NO: 7915460 - DNA, 22 bp, Homo sapiens
ggcccagcatcttgtgaagttt

SEQ ID NO: 7915461 - DNA, 22 bp, Homo sapiens
ggcccagcatcttgtgaagttt

SEQ ID NO: 7915462 - DNA, 22 bp, Homo sapiens
ggcccagcatcttgtgaagttt

SEQ ID NO: 7915463 - DNA, 22 bp, Homo sapiens
ggcccagcccgagtcagccttc

SEQ ID NO: 7915464 - DNA, 22 bp, Homo sapiens
ggcccagcacagtgcttggggg

SEQ ID NO: 7915465 - DNA, 22 bp, Homo sapiens
ggcccagcatcttgtgaagttt

SEQ ID NO: 7915466 - DNA, 22 bp, Homo sapiens
ggcccagcatcttgtgaagttt

SEQ ID NO: 7915467 - DNA, 22 bp, Homo sapiens
ggcccagcccgagtcagccttc

SEQ ID NO: 7915468 - DNA, 22 bp, Homo sapiens
ggcccagcccgagtcagccttc

SEQ ID NO: 7915469 - DNA, 22 bp, Homo sapiens
ggcccagcccgagtcagccttc

SEQ ID NO: 7915470 - DNA, 22 bp, Homo sapiens
ggcccagcccgagtcagccttc

SEQ ID NO: 7915471 - DNA, 22 bp, Homo sapiens
ggcccagcccgagtcagccttc

SEQ ID NO: 7915472 - DNA, 22 bp, Homo sapiens
ggccccagcagaccctcctctg

SEQ ID NO: 7915473 - DNA, 22 bp, Homo sapiens
ggccccagcagaccctcctctg

SEQ ID NO: 7915474 - DNA, 22 bp, Homo sapiens
ggccccagcagaccctcctctg

SEQ ID NO: 7915475 - DNA, 22 bp, Homo sapiens
ggccccagcctcagtcccctga

SEQ ID NO: 7915476 - DNA, 21 bp, Homo sapiens
ggccccagcccatgggttctc

SEQ ID NO: 7915477 - DNA, 22 bp, Homo sapiens
ggccccagcctcagtcccctga

SEQ ID NO: 7915478 - DNA, 22 bp, Homo sapiens
ggccccagcctcagtcccctga

SEQ ID NO: 7915479 - DNA, 21 bp, Homo sapiens
ggccccagcccatgggttctc

SEQ ID NO: 7915480 - DNA, 21 bp, Homo sapiens
ggccccagcccatgggttctc

SEQ ID NO: 7915481 - DNA, 21 bp, Homo sapiens
ggccccagcccatgggttctc

SEQ ID NO: 7915482 - DNA, 22 bp, Homo sapiens
ggccccagcagtgcttgtttat

SEQ ID NO: 7915483 - DNA, 22 bp, Homo sapiens
ggccccagcagtgcttgtttat

SEQ ID NO: 7915484 - DNA, 22 bp, Homo sapiens
ggccccagcagaccctcctctg

SEQ ID NO: 7915485 - DNA, 19 bp, Homo sapiens
ggccccagccagggtatca

SEQ ID NO: 7915486 - DNA, 19 bp, Homo sapiens
ggccccagccagggtatca

SEQ ID NO: 7915487 - DNA, 22 bp, Homo sapiens
ggccagctccttggcagtgcct

SEQ ID NO: 7915488 - DNA, 22 bp, Homo sapiens
cacccagccttcacacaggagt

SEQ ID NO: 7915489 - DNA, 22 bp, Homo sapiens
cacccagcattggctaagagag

SEQ ID NO: 7915490 - DNA, 22 bp, Homo sapiens
cacccagccttcacacaggagt

SEQ ID NO: 7915491 - DNA, 22 bp, Homo sapiens
cacccaggacaaaatatggaat

SEQ ID NO: 7915492 - DNA, 22 bp, Homo sapiens
cacccagcttttgcatcctccg

SEQ ID NO: 7915493 - DNA, 22 bp, Homo sapiens
ggccagctcagggtccttgggc

SEQ ID NO: 7915494 - DNA, 22 bp, Homo sapiens
ggccagctacccatctgcgtca

SEQ ID NO: 7915495 - DNA, 22 bp, Homo sapiens
ggccagctcagactccacttgc

SEQ ID NO: 7915496 - DNA, 22 bp, Homo sapiens
ggccagctcagggtccttgggc

SEQ ID NO: 7915497 - DNA, 22 bp, Homo sapiens
ggccagctcagggtccttgggc

SEQ ID NO: 7915498 - DNA, 22 bp, Homo sapiens
ggccagctccttggcagtgcct

SEQ ID NO: 7915499 - DNA, 22 bp, Homo sapiens
ggccagctccttggcagtgcct

SEQ ID NO: 7915500 - DNA, 22 bp, Homo sapiens
ggccagctccttggcagtgcct

SEQ ID NO: 7915501 - DNA, 18 bp, Homo sapiens
ggccagctcctgaggcag

SEQ ID NO: 7915502 - DNA, 18 bp, Homo sapiens
ggccagctcctgaggcag

SEQ ID NO: 7915503 - DNA, 22 bp, Homo sapiens
cacccaggacaggccagatgtg

SEQ ID NO: 7915504 - DNA, 22 bp, Homo sapiens
cacccaggacaggccagatgtg

SEQ ID NO: 7915505 - DNA, 22 bp, Homo sapiens
cacccaggaggttgggaagggc

SEQ ID NO: 7915506 - DNA, 22 bp, Homo sapiens
cacccaggacaggccagatgtg

SEQ ID NO: 7915507 - DNA, 22 bp, Homo sapiens
cacccaggacaggccagatgtg

SEQ ID NO: 7915508 - DNA, 22 bp, Homo sapiens
cacccaggacaggccagatgtg

SEQ ID NO: 7915509 - DNA, 22 bp, Homo sapiens
cacccaggcaggtggctgagaa

SEQ ID NO: 7915510 - DNA, 22 bp, Homo sapiens
cacccaggcaggtggctgagaa

SEQ ID NO: 7915511 - DNA, 22 bp, Homo sapiens
cacccaggcaggtggctgagaa

SEQ ID NO: 7915512 - DNA, 22 bp, Homo sapiens
cacccaggcaggtggctgagaa

SEQ ID NO: 7915513 - DNA, 22 bp, Homo sapiens
cacccaggcaaggattctgcaa

SEQ ID NO: 7915514 - DNA, 22 bp, Homo sapiens
cacccaggcaggtggctgagaa

SEQ ID NO: 7915515 - DNA, 22 bp, Homo sapiens
cacccaggctagagtgcagtgg

SEQ ID NO: 7915516 - DNA, 22 bp, Homo sapiens
cacccaggctagagtgcagtgg

SEQ ID NO: 7915517 - DNA, 22 bp, Homo sapiens
cacccaggcatgggttgagatg

SEQ ID NO: 7915518 - DNA, 22 bp, Homo sapiens
cacccaggcatgggttgagatg

SEQ ID NO: 7915519 - DNA, 22 bp, Homo sapiens
cacccaggcaggtggctgagaa

SEQ ID NO: 7915520 - DNA, 22 bp, Homo sapiens
cacccaggcaggtggctgagaa

SEQ ID NO: 7915521 - DNA, 22 bp, Homo sapiens
cacccaggcaggtggctgagaa

SEQ ID NO: 7915522 - DNA, 22 bp, Homo sapiens
cacccaggcaggtggctgagaa

SEQ ID NO: 7915523 - DNA, 22 bp, Homo sapiens
cacccaggctagagtgcagtgg

SEQ ID NO: 7915524 - DNA, 22 bp, Homo sapiens
cacccaggctagagtgcagtgg

SEQ ID NO: 7915525 - DNA, 22 bp, Homo sapiens
ggccagggccaaggctttccca

SEQ ID NO: 7915526 - DNA, 22 bp, Homo sapiens
ggccagggcctggggactgtcc

SEQ ID NO: 7915527 - DNA, 22 bp, Homo sapiens
ggccagggcctggggactgtcc

SEQ ID NO: 7915528 - DNA, 22 bp, Homo sapiens
ggccagggcctggggactgtcc

SEQ ID NO: 7915529 - DNA, 22 bp, Homo sapiens
caccacagcatccactagaagg

SEQ ID NO: 7915530 - DNA, 22 bp, Homo sapiens
caccacagcatccactagaagg

SEQ ID NO: 7915531 - DNA, 22 bp, Homo sapiens
caccacagcatccactagaagg

SEQ ID NO: 7915532 - DNA, 22 bp, Homo sapiens
caccactgaattgttcactttc

SEQ ID NO: 7915533 - DNA, 22 bp, Homo sapiens
caccactgaattgttcactttc

SEQ ID NO: 7915534 - DNA, 22 bp, Homo sapiens
caccactgaattgttcactttc

SEQ ID NO: 7915535 - DNA, 22 bp, Homo sapiens
caccaccaggcaggacaccgaa

SEQ ID NO: 7915536 - DNA, 22 bp, Homo sapiens
caccaccaggcaggacaccgaa

SEQ ID NO: 7915537 - DNA, 22 bp, Homo sapiens
caccaaagtcgcttctgtcgtc

SEQ ID NO: 7915538 - DNA, 22 bp, Homo sapiens
cacatttttactgccaacttaa

SEQ ID NO: 7915539 - DNA, 22 bp, Homo sapiens
caccaagactgtataccaggca

SEQ ID NO: 7915540 - DNA, 19 bp, Homo sapiens
caccaagatggctctagtc

SEQ ID NO: 7915541 - DNA, 20 bp, Homo sapiens
caccacagaattggggacag

SEQ ID NO: 7915542 - DNA, 22 bp, Homo sapiens
caccaataattttatatcacat

SEQ ID NO: 7915543 - DNA, 22 bp, Homo sapiens
cacatttttactgccaacttaa

SEQ ID NO: 7915544 - DNA, 22 bp, Homo sapiens
cacatttttactgccaacttaa

SEQ ID NO: 7915545 - DNA, 22 bp, Homo sapiens
cacatttttactgccaacttaa

SEQ ID NO: 7915546 - DNA, 19 bp, Homo sapiens
cacattttgagtctgagat

SEQ ID NO: 7915547 - DNA, 19 bp, Homo sapiens
cacattttgagtctgagat

SEQ ID NO: 7915548 - DNA, 19 bp, Homo sapiens
cacattttgagtctgagat

SEQ ID NO: 7915549 - DNA, 19 bp, Homo sapiens
cacattttgagtctgagat

SEQ ID NO: 7915550 - DNA, 19 bp, Homo sapiens
cacattttgagtctgagat

SEQ ID NO: 7915551 - DNA, 19 bp, Homo sapiens
cacattttgagtctgagat

SEQ ID NO: 7915552 - DNA, 21 bp, Homo sapiens
cacatttgaacctcacagcaa

SEQ ID NO: 7915553 - DNA, 19 bp, Homo sapiens
cacattttgagtctgagat

SEQ ID NO: 7915554 - DNA, 22 bp, Homo sapiens
cacatttgaaggaattagcatt

SEQ ID NO: 7915555 - DNA, 22 bp, Homo sapiens
ggccagcctggggctcccagac

SEQ ID NO: 7915556 - DNA, 22 bp, Homo sapiens
ggccagcctggggctcccagac

SEQ ID NO: 7915557 - DNA, 22 bp, Homo sapiens
ggccagcctggggctcccagac

SEQ ID NO: 7915558 - DNA, 22 bp, Homo sapiens
ggccagcctggggctcccagac

SEQ ID NO: 7915559 - DNA, 22 bp, Homo sapiens
ggccagccctcctccctgggtt

SEQ ID NO: 7915560 - DNA, 22 bp, Homo sapiens
ggccagccctcctccctgggtt

SEQ ID NO: 7915561 - DNA, 22 bp, Homo sapiens
ggccagccctcctccctgggtt

SEQ ID NO: 7915562 - DNA, 22 bp, Homo sapiens
ggccagcctggggctcccagac

SEQ ID NO: 7915563 - DNA, 22 bp, Homo sapiens
ggccagcctggggctcccagac

SEQ ID NO: 7915564 - DNA, 22 bp, Homo sapiens
ggccagcctggggctcccagac

SEQ ID NO: 7915565 - DNA, 22 bp, Homo sapiens
ggccagcctggggctcccagac

SEQ ID NO: 7915566 - DNA, 22 bp, Homo sapiens
ggccagcggcacagcctggccc

SEQ ID NO: 7915567 - DNA, 18 bp, Homo sapiens
ggccagccccaggccagc

SEQ ID NO: 7915568 - DNA, 18 bp, Homo sapiens
ggccagccccaggccagc

SEQ ID NO: 7915569 - DNA, 18 bp, Homo sapiens
ggccagccccaggccagc

SEQ ID NO: 7915570 - DNA, 18 bp, Homo sapiens
ggccagccccaggccagc

SEQ ID NO: 7915571 - DNA, 22 bp, Homo sapiens
ggccagccctcctccctgggtt

SEQ ID NO: 7915572 - DNA, 23 bp, Homo sapiens
ggccactttgtgtcagtatgtgc

SEQ ID NO: 7915573 - DNA, 23 bp, Homo sapiens
ggccactttgtgtcagtatgtgc

SEQ ID NO: 7915574 - DNA, 22 bp, Homo sapiens
ggccactgtttcctgggcagtt

SEQ ID NO: 7915575 - DNA, 22 bp, Homo sapiens
ggccactgtttcctgggcagtt

SEQ ID NO: 7915576 - DNA, 22 bp, Homo sapiens
ggccactgtttcctgggcagtt

SEQ ID NO: 7915577 - DNA, 22 bp, Homo sapiens
ggagtgactcacagctgggaca

SEQ ID NO: 7915578 - DNA, 22 bp, Homo sapiens
ggagtgactcacagctgggaca

SEQ ID NO: 7915579 - DNA, 22 bp, Homo sapiens
ggagtgactcacagctgggaca

SEQ ID NO: 7915580 - DNA, 22 bp, Homo sapiens
ggagtgactcacagctgggaca

SEQ ID NO: 7915581 - DNA, 22 bp, Homo sapiens
ggagtgactcacagctgggaca

SEQ ID NO: 7915582 - DNA, 22 bp, Homo sapiens
ggagtgactcacagctgggaca

SEQ ID NO: 7915583 - DNA, 22 bp, Homo sapiens
ggagtgactcacagctgggaca

SEQ ID NO: 7915584 - DNA, 22 bp, Homo sapiens
ggagtgaatcactagatgcaga

SEQ ID NO: 7915585 - DNA, 22 bp, Homo sapiens
ggagtgaatcactagatgcaga

SEQ ID NO: 7915586 - DNA, 22 bp, Homo sapiens
ggagtgaataagtagggggaaa

SEQ ID NO: 7915587 - DNA, 22 bp, Homo sapiens
ggagtgaagtggcgcgatctcg

SEQ ID NO: 7915588 - DNA, 22 bp, Homo sapiens
ggagtgaatcactagatgcaga

SEQ ID NO: 7915589 - DNA, 22 bp, Homo sapiens
ggagtgaagtggcgcgatctcg

SEQ ID NO: 7915590 - DNA, 22 bp, Homo sapiens
ggagtgaagcaaataatgctgg

SEQ ID NO: 7915591 - DNA, 22 bp, Homo sapiens
ggagtgaagcaaataatgctgg

SEQ ID NO: 7915592 - DNA, 22 bp, Homo sapiens
ggagtgactctcggggccacta

SEQ ID NO: 7915593 - DNA, 22 bp, Homo sapiens
ggagtgactctcggggccacta

SEQ ID NO: 7915594 - DNA, 22 bp, Homo sapiens
ggagtgactctcggggccacta

SEQ ID NO: 7915595 - DNA, 22 bp, Homo sapiens
ggagtttgcctattgcttttgg

SEQ ID NO: 7915596 - DNA, 21 bp, Homo sapiens
ggagtttttctggaagggact

SEQ ID NO: 7915597 - DNA, 21 bp, Homo sapiens
ggagtttttctggaagggact

SEQ ID NO: 7915598 - DNA, 23 bp, Homo sapiens
ggataaatctcagcttcttccat

SEQ ID NO: 7915599 - DNA, 23 bp, Homo sapiens
ggataaatctcagcttcttccat

SEQ ID NO: 7915600 - DNA, 22 bp, Homo sapiens
ggagtctgctcccagacatgat

SEQ ID NO: 7915601 - DNA, 22 bp, Homo sapiens
ggagtctgctcccagacatgat

SEQ ID NO: 7915602 - DNA, 22 bp, Homo sapiens
ggagtctgggaattggagagaa

SEQ ID NO: 7915603 - DNA, 22 bp, Homo sapiens
ggagtctggagtggggcccaag

SEQ ID NO: 7915604 - DNA, 22 bp, Homo sapiens
ggagtctgcggcagacactgta

SEQ ID NO: 7915605 - DNA, 22 bp, Homo sapiens
ggagtctgcggcagacactgta

SEQ ID NO: 7915606 - DNA, 22 bp, Homo sapiens
ggaggtggaggttgcagtgagc

SEQ ID NO: 7915607 - DNA, 22 bp, Homo sapiens
ggaggtggaggttgcagtgagc

SEQ ID NO: 7915608 - DNA, 22 bp, Homo sapiens
ggaggtggaggttgcagtgagc

SEQ ID NO: 7915609 - DNA, 22 bp, Homo sapiens
cacaggagattgatctattggt

SEQ ID NO: 7915610 - DNA, 22 bp, Homo sapiens
ggaggtggaggttgcagtgagc

SEQ ID NO: 7915611 - DNA, 22 bp, Homo sapiens
ggaggtggaggttgcagtgagc

SEQ ID NO: 7915612 - DNA, 22 bp, Homo sapiens
ggaggtggaggttgcagtgagc

SEQ ID NO: 7915613 - DNA, 22 bp, Homo sapiens
ggaggtggaggttgcagtgagc

SEQ ID NO: 7915614 - DNA, 21 bp, Homo sapiens
ggagtctgtggatgctgtttc

SEQ ID NO: 7915615 - DNA, 22 bp, Homo sapiens
ggagtctgtgtcttgaagcagt

SEQ ID NO: 7915616 - DNA, 22 bp, Homo sapiens
ggagtctgtgtcttgaagcagt

SEQ ID NO: 7915617 - DNA, 22 bp, Homo sapiens
ggagtctgtcacctgtttctct

SEQ ID NO: 7915618 - DNA, 22 bp, Homo sapiens
ggagtctgggaattggagagaa

SEQ ID NO: 7915619 - DNA, 22 bp, Homo sapiens
ggagtctgggaattggagagaa

SEQ ID NO: 7915620 - DNA, 22 bp, Homo sapiens
ggagtctgttttacatgcagga

SEQ ID NO: 7915621 - DNA, 22 bp, Homo sapiens
ggagtctgttttacatgcagga

SEQ ID NO: 7915622 - DNA, 22 bp, Homo sapiens
ggagtcttggcctgctgagaaa

SEQ ID NO: 7915623 - DNA, 22 bp, Homo sapiens
ggagtgaaaggtaagttgagct

SEQ ID NO: 7915624 - DNA, 22 bp, Homo sapiens
ggatcaggctgaagctaggact

SEQ ID NO: 7915625 - DNA, 19 bp, Homo sapiens
ggatccagaggatctgcca

SEQ ID NO: 7915626 - DNA, 22 bp, Homo sapiens
ggatcagggctggggatattct

SEQ ID NO: 7915627 - DNA, 22 bp, Homo sapiens
ggatcaagaaagtcagatgaag

SEQ ID NO: 7915628 - DNA, 22 bp, Homo sapiens
ggatcagaacgtgatggctgtg

SEQ ID NO: 7915629 - DNA, 22 bp, Homo sapiens
ggatcagaggatcagggacagt

SEQ ID NO: 7915630 - DNA, 22 bp, Homo sapiens
ggatcagaatctctgagagttt

SEQ ID NO: 7915631 - DNA, 20 bp, Homo sapiens
ggatcagatggagcctctgc

SEQ ID NO: 7915632 - DNA, 22 bp, Homo sapiens
ggatcaaagggaacctgttagg

SEQ ID NO: 7915633 - DNA, 22 bp, Homo sapiens
ggatattaatctgtgtcatttc

SEQ ID NO: 7915634 - DNA, 22 bp, Homo sapiens
ggatattctttatagatacagt

SEQ ID NO: 7915635 - DNA, 22 bp, Homo sapiens
ggatatatgcatgttatcattt

SEQ ID NO: 7915636 - DNA, 22 bp, Homo sapiens
ggataggaattgagatgctatt

SEQ ID NO: 7915637 - DNA, 22 bp, Homo sapiens
ggataagaaaattgtaataact

SEQ ID NO: 7915638 - DNA, 19 bp, Homo sapiens
ggataaggttggagtgatc

SEQ ID NO: 7915639 - DNA, 22 bp, Homo sapiens
ggatacaaggtgttctatcact

SEQ ID NO: 7915640 - DNA, 22 bp, Homo sapiens
ggcagctgcaaatctgctctgt

SEQ ID NO: 7915641 - DNA, 22 bp, Homo sapiens
ggcagctgcaaatctgctctgt

SEQ ID NO: 7915642 - DNA, 22 bp, Homo sapiens
ggatcctgatatgtgtttctca

SEQ ID NO: 7915643 - DNA, 22 bp, Homo sapiens
ggcagctgcaaatctgctctgt

SEQ ID NO: 7915644 - DNA, 22 bp, Homo sapiens
ggcagctgcaaatctgctctgt

SEQ ID NO: 7915645 - DNA, 22 bp, Homo sapiens
ggcagctgcaaatctgctctgt

SEQ ID NO: 7915646 - DNA, 22 bp, Homo sapiens
ggcaggaaaacaatgagccagg

SEQ ID NO: 7915647 - DNA, 22 bp, Homo sapiens
ggcaggaaaacaatgagccagg

SEQ ID NO: 7915648 - DNA, 22 bp, Homo sapiens
ggcagctgcaaatctgctctgt

SEQ ID NO: 7915649 - DNA, 22 bp, Homo sapiens
ggcagcttttatccctgacaga

SEQ ID NO: 7915650 - DNA, 22 bp, Homo sapiens
ggcaggaaatgggataagggct

SEQ ID NO: 7915651 - DNA, 22 bp, Homo sapiens
ggcaggaaaacaatgagccagg

SEQ ID NO: 7915652 - DNA, 22 bp, Homo sapiens
ggcaggaaaacaatgagccagg

SEQ ID NO: 7915653 - DNA, 22 bp, Homo sapiens
ggcaggaaaacaatgagccagg

SEQ ID NO: 7915654 - DNA, 22 bp, Homo sapiens
ggcaggaaaacaatgagccagg

SEQ ID NO: 7915655 - DNA, 22 bp, Homo sapiens
ggcaggaagaggagggtgaact

SEQ ID NO: 7915656 - DNA, 22 bp, Homo sapiens
ggcaggaacacagatggtgccg

SEQ ID NO: 7915657 - DNA, 22 bp, Homo sapiens
ggcaggaagctcatgtggactg

SEQ ID NO: 7915658 - DNA, 22 bp, Homo sapiens
ggcaggaagcattaaaacgatt

SEQ ID NO: 7915659 - DNA, 22 bp, Homo sapiens
ggcaggaagctcatgtggactg

SEQ ID NO: 7915660 - DNA, 22 bp, Homo sapiens
ggcaggaagctcatgtggactg

SEQ ID NO: 7915661 - DNA, 22 bp, Homo sapiens
ggcaggaagctcatgtggactg

SEQ ID NO: 7915662 - DNA, 22 bp, Homo sapiens
ggcaggaagtagcagtctgagc

SEQ ID NO: 7915663 - DNA, 22 bp, Homo sapiens
ggcaggaataaattatggactt

SEQ ID NO: 7915664 - DNA, 22 bp, Homo sapiens
ggcaggaagtagcagtctgagc

SEQ ID NO: 7915665 - DNA, 22 bp, Homo sapiens
ggcaggaagtagcagtctgagc

SEQ ID NO: 7915666 - DNA, 22 bp, Homo sapiens
ggcaggtgccttctgtgctagc

SEQ ID NO: 7915667 - DNA, 22 bp, Homo sapiens
ggcaggtgccttctgtgctagc

SEQ ID NO: 7915668 - DNA, 22 bp, Homo sapiens
ggcaggtgcgcatgttgcatta

SEQ ID NO: 7915669 - DNA, 22 bp, Homo sapiens
ggcaggtgtgagatcgaggcca

SEQ ID NO: 7915670 - DNA, 22 bp, Homo sapiens
cacatgctcattggcactgttc

SEQ ID NO: 7915671 - DNA, 22 bp, Homo sapiens
cacatgccttcctcaggcctct

SEQ ID NO: 7915672 - DNA, 22 bp, Homo sapiens
ggcaggtgtggtgaccagagat

SEQ ID NO: 7915673 - DNA, 22 bp, Homo sapiens
ggcaggtgtggtgaccagagat

SEQ ID NO: 7915674 - DNA, 22 bp, Homo sapiens
ggcaggtgtggagtgttatttt

SEQ ID NO: 7915675 - DNA, 22 bp, Homo sapiens
ggcaggtgtgagctgtaaagga

SEQ ID NO: 7915676 - DNA, 22 bp, Homo sapiens
ggcaggtgtgagatcgaggcca

SEQ ID NO: 7915677 - DNA, 22 bp, Homo sapiens
ggcaggtgtgagctgtaaagga

SEQ ID NO: 7915678 - DNA, 22 bp, Homo sapiens
ggcaggtgtgagatcgaggcca

SEQ ID NO: 7915679 - DNA, 22 bp, Homo sapiens
ggcaggtgtgagctgtaaagga

SEQ ID NO: 7915680 - DNA, 22 bp, Homo sapiens
cacatttctctacctcacacaa

SEQ ID NO: 7915681 - DNA, 22 bp, Homo sapiens
cacatttctggaattgacttgg

SEQ ID NO: 7915682 - DNA, 22 bp, Homo sapiens
cacatttctggaattgacttgg

SEQ ID NO: 7915683 - DNA, 22 bp, Homo sapiens
cacatttctgtgagtcaatatt

SEQ ID NO: 7915684 - DNA, 22 bp, Homo sapiens
cacatttctgtgagtcaatatt

SEQ ID NO: 7915685 - DNA, 22 bp, Homo sapiens
cacatttctgtgagtcaatatt

SEQ ID NO: 7915686 - DNA, 22 bp, Homo sapiens
cacatttcttatggatgttggc

SEQ ID NO: 7915687 - DNA, 22 bp, Homo sapiens
ggcagtcacaggggagactggg

SEQ ID NO: 7915688 - DNA, 19 bp, Homo sapiens
ggcagtcacggtcaggagc

SEQ ID NO: 7915689 - DNA, 22 bp, Homo sapiens
ggcagtcacaggggagactggg

SEQ ID NO: 7915690 - DNA, 22 bp, Homo sapiens
ggcagtcacaggggagactggg

SEQ ID NO: 7915691 - DNA, 22 bp, Homo sapiens
cacatttctaggaaattaaatg

SEQ ID NO: 7915692 - DNA, 19 bp, Homo sapiens
ggcagtcacggtcaggagc

SEQ ID NO: 7915693 - DNA, 22 bp, Homo sapiens
ggcagtatgagttcaaataatt

SEQ ID NO: 7915694 - DNA, 22 bp, Homo sapiens
ggcagtcaagagggagtctgaa

SEQ ID NO: 7915695 - DNA, 22 bp, Homo sapiens
ggcagtcaagagggagtctgaa

SEQ ID NO: 7915696 - DNA, 22 bp, Homo sapiens
ggcaggttggatgctgtagtga

SEQ ID NO: 7915697 - DNA, 22 bp, Homo sapiens
ggcaggttggatgctgtagtga

SEQ ID NO: 7915698 - DNA, 22 bp, Homo sapiens
ggcaggtgtggtgaccagagat

SEQ ID NO: 7915699 - DNA, 22 bp, Homo sapiens
ggcaggtgtggtgaccagagat

SEQ ID NO: 7915700 - DNA, 22 bp, Homo sapiens
ggcaggtgtggtgaccagagat

SEQ ID NO: 7915701 - DNA, 22 bp, Homo sapiens
ggcaggtgtggtgaccagagat

SEQ ID NO: 7915702 - DNA, 22 bp, Homo sapiens
ggcaggtgtggtgaccagagat

SEQ ID NO: 7915703 - DNA, 22 bp, Homo sapiens
cacatgcattggcaaaagtgta

SEQ ID NO: 7915704 - DNA, 22 bp, Homo sapiens
cacatgcattggcaaaagtgta

SEQ ID NO: 7915705 - DNA, 22 bp, Homo sapiens
cacatgcattggcaaaagtgta

SEQ ID NO: 7915706 - DNA, 22 bp, Homo sapiens
cacatgcattggcaaaagtgta

SEQ ID NO: 7915707 - DNA, 22 bp, Homo sapiens
cacatgcatgccaggctcacag

SEQ ID NO: 7915708 - DNA, 22 bp, Homo sapiens
cacatgcatgccaggctcacag

SEQ ID NO: 7915709 - DNA, 22 bp, Homo sapiens
cacatgcatgccaggctcacag

SEQ ID NO: 7915710 - DNA, 22 bp, Homo sapiens
cacatgcatgccaggctcacag

SEQ ID NO: 7915711 - DNA, 22 bp, Homo sapiens
cacatgcatgccaggctcacag

SEQ ID NO: 7915712 - DNA, 21 bp, Homo sapiens
cacatgcatgcacaggttgta

SEQ ID NO: 7915713 - DNA, 21 bp, Homo sapiens
cacatgcatgcacaggttgta

SEQ ID NO: 7915714 - DNA, 22 bp, Homo sapiens
cacatgcatctgtcatgtttgg

SEQ ID NO: 7915715 - DNA, 22 bp, Homo sapiens
cacatgcatcacgacttccttt

SEQ ID NO: 7915716 - DNA, 22 bp, Homo sapiens
cacatgcatcacgacttccttt

SEQ ID NO: 7915717 - DNA, 22 bp, Homo sapiens
cacatgcatcacgacttccttt

SEQ ID NO: 7915718 - DNA, 22 bp, Homo sapiens
cacatgcatctgtcatgtttgg

SEQ ID NO: 7915719 - DNA, 22 bp, Homo sapiens
cacatgcatctgtcatgtttgg

SEQ ID NO: 7915720 - DNA, 22 bp, Homo sapiens
cacatgcatacctatgtgtata

SEQ ID NO: 7915721 - DNA, 22 bp, Homo sapiens
cacatgcatacctatgtgtata

SEQ ID NO: 7915722 - DNA, 22 bp, Homo sapiens
cacatgcatcacgacttccttt

SEQ ID NO: 7915723 - DNA, 22 bp, Homo sapiens
cacatgcatcacgacttccttt

SEQ ID NO: 7915724 - DNA, 22 bp, Homo sapiens
cacatgcatacctatgtgtata

SEQ ID NO: 7915725 - DNA, 22 bp, Homo sapiens
cacatgcatacctatgtgtata

SEQ ID NO: 7915726 - DNA, 22 bp, Homo sapiens
cacatgcagttttccagcagtc

SEQ ID NO: 7915727 - DNA, 22 bp, Homo sapiens
cacatgcagttttccagcagtc

SEQ ID NO: 7915728 - DNA, 22 bp, Homo sapiens
cacatgcataaggataattact

SEQ ID NO: 7915729 - DNA, 22 bp, Homo sapiens
cacatgcataaggataattact

SEQ ID NO: 7915730 - DNA, 22 bp, Homo sapiens
cacatgcagtttacgtcactga

SEQ ID NO: 7915731 - DNA, 22 bp, Homo sapiens
cacatgcagtttacgtcactga

SEQ ID NO: 7915732 - DNA, 22 bp, Homo sapiens
cacatgcagtttacgtcactga

SEQ ID NO: 7915733 - DNA, 22 bp, Homo sapiens
cacatgcagttttccagcagtc

SEQ ID NO: 7915734 - DNA, 22 bp, Homo sapiens
cacatgcagttttccagcagtc

SEQ ID NO: 7915735 - DNA, 22 bp, Homo sapiens
cacatgcagttttccagcagtc

SEQ ID NO: 7915736 - DNA, 22 bp, Homo sapiens
ggcaggagaaaggtctcttctt

SEQ ID NO: 7915737 - DNA, 22 bp, Homo sapiens
ggcaggagaaaggtctcttctt

SEQ ID NO: 7915738 - DNA, 22 bp, Homo sapiens
ggcaggactcttctgtgggccg

SEQ ID NO: 7915739 - DNA, 23 bp, Homo sapiens
cacatgcaggcagtggccttcaa

SEQ ID NO: 7915740 - DNA, 23 bp, Homo sapiens
cacatgcaggcagtggccttcaa

SEQ ID NO: 7915741 - DNA, 22 bp, Homo sapiens
cacatgcagtttacgtcactga

SEQ ID NO: 7915742 - DNA, 22 bp, Homo sapiens
cacatgcagtttacgtcactga

SEQ ID NO: 7915743 - DNA, 22 bp, Homo sapiens
cacatgcagtttacgtcactga

SEQ ID NO: 7915744 - DNA, 22 bp, Homo sapiens
cacatgcagtttacgtcactga

SEQ ID NO: 7915745 - DNA, 22 bp, Homo sapiens
cacatgcaggagccaatgtaca

SEQ ID NO: 7915746 - DNA, 22 bp, Homo sapiens
ggcaggagaaaggtctcttctt

SEQ ID NO: 7915747 - DNA, 23 bp, Homo sapiens
cacatgcaggcagtggccttcaa

SEQ ID NO: 7915748 - DNA, 23 bp, Homo sapiens
cacatgcaggcagtggccttcaa

SEQ ID NO: 7915749 - DNA, 22 bp, Homo sapiens
ggcaggactctcaggaccaagc

SEQ ID NO: 7915750 - DNA, 22 bp, Homo sapiens
ggcaggactcttctgtgggccg

SEQ ID NO: 7915751 - DNA, 20 bp, Homo sapiens
ggcaggacccggtagggagc

SEQ ID NO: 7915752 - DNA, 20 bp, Homo sapiens
ggcaggacccggtagggagc

SEQ ID NO: 7915753 - DNA, 20 bp, Homo sapiens
ggcaggaccccagtggcatc

SEQ ID NO: 7915754 - DNA, 20 bp, Homo sapiens
ggcaggacccggtagggagc

SEQ ID NO: 7915755 - DNA, 22 bp, Homo sapiens
ggcaggacaggggaatgtttgg

SEQ ID NO: 7915756 - DNA, 22 bp, Homo sapiens
ggcaggacagtcccagttcaaa

SEQ ID NO: 7915757 - DNA, 22 bp, Homo sapiens
ggcaggaataaattatggactt

SEQ ID NO: 7915758 - DNA, 22 bp, Homo sapiens
ggcaggaataaattatggactt

SEQ ID NO: 7915759 - DNA, 22 bp, Homo sapiens
ggcaggaataaattatggactt

SEQ ID NO: 7915760 - DNA, 22 bp, Homo sapiens
ggcaggacaggggaatgtttgg

SEQ ID NO: 7915761 - DNA, 20 bp, Homo sapiens
ggcaggaccccagtggcatc

SEQ ID NO: 7915762 - DNA, 20 bp, Homo sapiens
ggcaggaccccagtggcatc

SEQ ID NO: 7915763 - DNA, 22 bp, Homo sapiens
ggaaggggtcacctcctgatga

SEQ ID NO: 7915764 - DNA, 22 bp, Homo sapiens
ggaaggggtcacctcctgatga

SEQ ID NO: 7915765 - DNA, 22 bp, Homo sapiens
ggaaggggccttgagcaaactg

SEQ ID NO: 7915766 - DNA, 22 bp, Homo sapiens
ggaaggggtcacctcctgatga

SEQ ID NO: 7915767 - DNA, 22 bp, Homo sapiens
ggacaaagggtggagcctctga

SEQ ID NO: 7915768 - DNA, 22 bp, Homo sapiens
ggacaaagggtggagcctctga

SEQ ID NO: 7915769 - DNA, 22 bp, Homo sapiens
ggacaaaggtagacagtctctg

SEQ ID NO: 7915770 - DNA, 22 bp, Homo sapiens
ggacaagcctgtgagtgggttt

SEQ ID NO: 7915771 - DNA, 22 bp, Homo sapiens
ggacaagcctgtgagtgggttt

SEQ ID NO: 7915772 - DNA, 22 bp, Homo sapiens
ggacaagtggcccggtgtgtta

SEQ ID NO: 7915773 - DNA, 22 bp, Homo sapiens
ggacaagtggcccggtgtgtta

SEQ ID NO: 7915774 - DNA, 22 bp, Homo sapiens
ggacaagcctgtgagtgggttt

SEQ ID NO: 7915775 - DNA, 22 bp, Homo sapiens
ggacaagcctgtgagtgggttt

SEQ ID NO: 7915776 - DNA, 22 bp, Homo sapiens
ggacaagcctgtgagtgggttt

SEQ ID NO: 7915777 - DNA, 22 bp, Homo sapiens
ggacaacatgttttaattaagg

SEQ ID NO: 7915778 - DNA, 22 bp, Homo sapiens
ggacaagcctcagacaaaactc

SEQ ID NO: 7915779 - DNA, 22 bp, Homo sapiens
ggacaacatgttttaattaagg

SEQ ID NO: 7915780 - DNA, 22 bp, Homo sapiens
ggacaacacttcattccagcta

SEQ ID NO: 7915781 - DNA, 22 bp, Homo sapiens
ggacaaattccctatttgcatg

SEQ ID NO: 7915782 - DNA, 22 bp, Homo sapiens
ggacaacacttcattccagcta

SEQ ID NO: 7915783 - DNA, 22 bp, Homo sapiens
ggacaaaggtctggggaacctg

SEQ ID NO: 7915784 - DNA, 19 bp, Homo sapiens
ggacacagaaagctgcatt

SEQ ID NO: 7915785 - DNA, 19 bp, Homo sapiens
ggacacagaaagctgcatt

SEQ ID NO: 7915786 - DNA, 19 bp, Homo sapiens
ggacacagaaagctgcatt

SEQ ID NO: 7915787 - DNA, 22 bp, Homo sapiens
ggacacaaaagtgaataaaata

SEQ ID NO: 7915788 - DNA, 22 bp, Homo sapiens
ggacacacaagttatctaatga

SEQ ID NO: 7915789 - DNA, 22 bp, Homo sapiens
ggacacaagctccggggctgca

SEQ ID NO: 7915790 - DNA, 21 bp, Homo sapiens
ggacaattgttcattttcttt

SEQ ID NO: 7915791 - DNA, 19 bp, Homo sapiens
ggacacagaaagctgcatt

SEQ ID NO: 7915792 - DNA, 22 bp, Homo sapiens
ggacacagacctttctgttcta

SEQ ID NO: 7915793 - DNA, 23 bp, Homo sapiens
ggacacagagataagtgagacaa

SEQ ID NO: 7915794 - DNA, 23 bp, Homo sapiens
ggacacagagataagtgagacaa

SEQ ID NO: 7915795 - DNA, 23 bp, Homo sapiens
ggacacagagataagtgagacaa

SEQ ID NO: 7915796 - DNA, 19 bp, Homo sapiens
ggacacagaaagctgcatt

SEQ ID NO: 7915797 - DNA, 19 bp, Homo sapiens
ggacacagaaagctgcatt

SEQ ID NO: 7915798 - DNA, 19 bp, Homo sapiens
ggacacagaaagctgcatt

SEQ ID NO: 7915799 - DNA, 22 bp, Homo sapiens
ggacacagataatcacacagat

SEQ ID NO: 7915800 - DNA, 22 bp, Homo sapiens
ggacagagggttgacagagtat

SEQ ID NO: 7915801 - DNA, 22 bp, Homo sapiens
ggacacagataatcacacagat

SEQ ID NO: 7915802 - DNA, 22 bp, Homo sapiens
ggacacagataatcacacagat

SEQ ID NO: 7915803 - DNA, 23 bp, Homo sapiens
ggacacagagataagtgagacaa

SEQ ID NO: 7915804 - DNA, 23 bp, Homo sapiens
ggacacagagataagtgagacaa

SEQ ID NO: 7915805 - DNA, 19 bp, Homo sapiens
ggacacagaaagctgcatt

SEQ ID NO: 7915806 - DNA, 22 bp, Homo sapiens
ggacacagataatcacacagat

SEQ ID NO: 7915807 - DNA, 22 bp, Homo sapiens
ggacagcacagctcttgacaac

SEQ ID NO: 7915808 - DNA, 22 bp, Homo sapiens
ggacagcacagctcttgacaac

SEQ ID NO: 7915809 - DNA, 22 bp, Homo sapiens
ggacagcacagctcttgacaac

SEQ ID NO: 7915810 - DNA, 22 bp, Homo sapiens
ggacagattgagctaggcgttt

SEQ ID NO: 7915811 - DNA, 22 bp, Homo sapiens
ggacagagggttgacagagtat

SEQ ID NO: 7915812 - DNA, 22 bp, Homo sapiens
ggaacagggatttggcctggtt

SEQ ID NO: 7915813 - DNA, 22 bp, Homo sapiens
ggaacagggatttggcctggtt

SEQ ID NO: 7915814 - DNA, 22 bp, Homo sapiens
ggaacagggatttggcctggtt

SEQ ID NO: 7915815 - DNA, 22 bp, Homo sapiens
ggaagacagaagcctacagctt

SEQ ID NO: 7915816 - DNA, 22 bp, Homo sapiens
ggaagactagtgttttaagtta

SEQ ID NO: 7915817 - DNA, 22 bp, Homo sapiens
ggaagactagtgttttaagtta

SEQ ID NO: 7915818 - DNA, 22 bp, Homo sapiens
ggaagacatctgcttgcaccag

SEQ ID NO: 7915819 - DNA, 22 bp, Homo sapiens
ggaagagaaatgagtcaagact

SEQ ID NO: 7915820 - DNA, 22 bp, Homo sapiens
ggaagagaaatgagtcaagact

SEQ ID NO: 7915821 - DNA, 22 bp, Homo sapiens
ggaagactgcatggcatagtga

SEQ ID NO: 7915822 - DNA, 22 bp, Homo sapiens
ggaagactgcatggcatagtga

SEQ ID NO: 7915823 - DNA, 22 bp, Homo sapiens
ggaagagaaatgagtcaagact

SEQ ID NO: 7915824 - DNA, 22 bp, Homo sapiens
ggaagagaaatgagtcaagact

SEQ ID NO: 7915825 - DNA, 22 bp, Homo sapiens
ggaagagaaatgagtcaagact

SEQ ID NO: 7915826 - DNA, 22 bp, Homo sapiens
ggaagagaatgatggctatggg

SEQ ID NO: 7915827 - DNA, 22 bp, Homo sapiens
ggaagagaatgatggctatggg

SEQ ID NO: 7915828 - DNA, 22 bp, Homo sapiens
ggaagagaatgatggctatggg

SEQ ID NO: 7915829 - DNA, 22 bp, Homo sapiens
ggaacaggaaaggagggatgct

SEQ ID NO: 7915830 - DNA, 22 bp, Homo sapiens
ggaacaggaaaggagggatgct

SEQ ID NO: 7915831 - DNA, 22 bp, Homo sapiens
ggaacaggaaaggagggatgct

SEQ ID NO: 7915832 - DNA, 22 bp, Homo sapiens
ggaacaggaaaggagggatgct

SEQ ID NO: 7915833 - DNA, 22 bp, Homo sapiens
ggaacaggaaaggagggatgct

SEQ ID NO: 7915834 - DNA, 22 bp, Homo sapiens
ggaacactggctcaattatatc

SEQ ID NO: 7915835 - DNA, 22 bp, Homo sapiens
ggaacaggaaaggagggatgct

SEQ ID NO: 7915836 - DNA, 22 bp, Homo sapiens
ggaacagggatttggcctggtt

SEQ ID NO: 7915837 - DNA, 22 bp, Homo sapiens
ggaacagggatttggcctggtt

SEQ ID NO: 7915838 - DNA, 22 bp, Homo sapiens
ggaacagggatttggcctggtt

SEQ ID NO: 7915839 - DNA, 22 bp, Homo sapiens
ggaagagaatttctctcttttt

SEQ ID NO: 7915840 - DNA, 22 bp, Homo sapiens
ggaagagagatcccatagatgt

SEQ ID NO: 7915841 - DNA, 22 bp, Homo sapiens
ggaagagaatgatggctatggg

SEQ ID NO: 7915842 - DNA, 22 bp, Homo sapiens
ggaagagaatgatggctatggg

SEQ ID NO: 7915843 - DNA, 19 bp, Homo sapiens
ggaagagaggaaaggtgga

SEQ ID NO: 7915844 - DNA, 19 bp, Homo sapiens
ggaagagaggaaaggtgga

SEQ ID NO: 7915845 - DNA, 19 bp, Homo sapiens
ggaagagaggaaaggtgga

SEQ ID NO: 7915846 - DNA, 19 bp, Homo sapiens
ggaagagaggaaaggtgga

SEQ ID NO: 7915847 - DNA, 19 bp, Homo sapiens
ggaagagaggaaaggtgga

SEQ ID NO: 7915848 - DNA, 19 bp, Homo sapiens
ggaagagaggaaaggtgga

SEQ ID NO: 7915849 - DNA, 22 bp, Homo sapiens
ggaagagagatcccatagatgt

SEQ ID NO: 7915850 - DNA, 22 bp, Homo sapiens
ggaagagagatcccatagatgt

SEQ ID NO: 7915851 - DNA, 22 bp, Homo sapiens
ggaagagagatcccatagatgt

SEQ ID NO: 7915852 - DNA, 22 bp, Homo sapiens
ggaagagagggctgggcctcaa

SEQ ID NO: 7915853 - DNA, 22 bp, Homo sapiens
ggaagagagggctgggcctcaa

SEQ ID NO: 7915854 - DNA, 22 bp, Homo sapiens
ggaagagagggctgggcctcaa

SEQ ID NO: 7915855 - DNA, 22 bp, Homo sapiens
ggaagagagggctgggcctcaa

SEQ ID NO: 7915856 - DNA, 19 bp, Homo sapiens
ggaagagaggaaaggtgga

SEQ ID NO: 7915857 - DNA, 22 bp, Homo sapiens
ggaagagattctttacattcat

SEQ ID NO: 7915858 - DNA, 22 bp, Homo sapiens
ggaagagattctttacattcat

SEQ ID NO: 7915859 - DNA, 22 bp, Homo sapiens
ggaagagcctggggtgtcaggc

SEQ ID NO: 7915860 - DNA, 22 bp, Homo sapiens
ggaagagattctttacattcat

SEQ ID NO: 7915861 - DNA, 22 bp, Homo sapiens
ggaagagattctttacattcat

SEQ ID NO: 7915862 - DNA, 22 bp, Homo sapiens
ggaagagaggttcagccctaag

SEQ ID NO: 7915863 - DNA, 22 bp, Homo sapiens
ggaagagaggttcagccctaag

SEQ ID NO: 7915864 - DNA, 22 bp, Homo sapiens
ggaagagaggttcagccctaag

SEQ ID NO: 7915865 - DNA, 22 bp, Homo sapiens
ggaagagaggttcagccctaag

SEQ ID NO: 7915866 - DNA, 22 bp, Homo sapiens
ggaagagaggttcagccctaag

SEQ ID NO: 7915867 - DNA, 22 bp, Homo sapiens
ggaagagaggttcagccctaag

SEQ ID NO: 7915868 - DNA, 22 bp, Homo sapiens
ggacagcattcctagttccaaa

SEQ ID NO: 7915869 - DNA, 22 bp, Homo sapiens
ggacagcattctactgtaggca

SEQ ID NO: 7915870 - DNA, 22 bp, Homo sapiens
ggacagcatatcagcagggcag

SEQ ID NO: 7915871 - DNA, 22 bp, Homo sapiens
ggacagcatatcagcagggcag

SEQ ID NO: 7915872 - DNA, 22 bp, Homo sapiens
ggacagcatatcagcagggcag

SEQ ID NO: 7915873 - DNA, 22 bp, Homo sapiens
ggacagcatatcagcagggcag

SEQ ID NO: 7915874 - DNA, 22 bp, Homo sapiens
ggacagcagcctcttacatgaa

SEQ ID NO: 7915875 - DNA, 22 bp, Homo sapiens
ggacagcagcctcttacatgaa

SEQ ID NO: 7915876 - DNA, 22 bp, Homo sapiens
ggacagctcctgcacttgagta

SEQ ID NO: 7915877 - DNA, 22 bp, Homo sapiens
ggacagctcctgcacttgagta

SEQ ID NO: 7915878 - DNA, 22 bp, Homo sapiens
ggacagcgtggctggtggaggg

SEQ ID NO: 7915879 - DNA, 22 bp, Homo sapiens
ggacagcccatacacatgtctg

SEQ ID NO: 7915880 - DNA, 21 bp, Homo sapiens
ggacagctgcgcgcagggctc

SEQ ID NO: 7915881 - DNA, 21 bp, Homo sapiens
ggacagctgcgcgcagggctc

SEQ ID NO: 7915882 - DNA, 22 bp, Homo sapiens
ggacagctctgccaggagctca

SEQ ID NO: 7915883 - DNA, 22 bp, Homo sapiens
ggacagctctgccaggagctca

SEQ ID NO: 7915884 - DNA, 22 bp, Homo sapiens
ggacagctcctgcacttgagta

SEQ ID NO: 7915885 - DNA, 22 bp, Homo sapiens
ggacagctgctttcaggccaca

SEQ ID NO: 7915886 - DNA, 22 bp, Homo sapiens
ggacagctgctttcaggccaca

SEQ ID NO: 7915887 - DNA, 22 bp, Homo sapiens
ggacagctgctttcaggccaca

SEQ ID NO: 7915888 - DNA, 22 bp, Homo sapiens
ggacagctgctttcaggccaca

SEQ ID NO: 7915889 - DNA, 21 bp, Homo sapiens
ggacagctgcgcgcagggctc

SEQ ID NO: 7915890 - DNA, 21 bp, Homo sapiens
ggacagctgcgcgcagggctc

SEQ ID NO: 7915891 - DNA, 22 bp, Homo sapiens
ggagagtggattccagctgtat

SEQ ID NO: 7915892 - DNA, 22 bp, Homo sapiens
ggagagtggattccagctgtat

SEQ ID NO: 7915893 - DNA, 17 bp, Homo sapiens
ggagagtgggaatggcc

SEQ ID NO: 7915894 - DNA, 17 bp, Homo sapiens
ggagagtgggaatggcc

SEQ ID NO: 7915895 - DNA, 22 bp, Homo sapiens
ggagagttcatgtggagtgggg

SEQ ID NO: 7915896 - DNA, 16 bp, Homo sapiens
ggagagtgtctgcaaa

SEQ ID NO: 7915897 - DNA, 16 bp, Homo sapiens
ggagagtgtctgcaaa

SEQ ID NO: 7915898 - DNA, 22 bp, Homo sapiens
ggagagctgaagcatggacagg

SEQ ID NO: 7915899 - DNA, 22 bp, Homo sapiens
ggacagctgctttcaggccaca

SEQ ID NO: 7915900 - DNA, 22 bp, Homo sapiens
ggacagctgctttcaggccaca

SEQ ID NO: 7915901 - DNA, 22 bp, Homo sapiens
ggagagctgacatcatgatgtt

SEQ ID NO: 7915902 - DNA, 22 bp, Homo sapiens
ggagagctgacatcatgatgtt

SEQ ID NO: 7915903 - DNA, 22 bp, Homo sapiens
ggagaggttatccgtgttatgt

SEQ ID NO: 7915904 - DNA, 22 bp, Homo sapiens
ggagagtctgagcctgctggag

SEQ ID NO: 7915905 - DNA, 18 bp, Homo sapiens
ggagagtgacagagtcgt

SEQ ID NO: 7915906 - DNA, 18 bp, Homo sapiens
ggagagtgacagagtcgt

SEQ ID NO: 7915907 - DNA, 22 bp, Homo sapiens
ggagagtctgccgagccagccc

SEQ ID NO: 7915908 - DNA, 22 bp, Homo sapiens
ggagagtctgctggccacagtg

SEQ ID NO: 7915909 - DNA, 22 bp, Homo sapiens
cacagagaattcccatatgtga

SEQ ID NO: 7915910 - DNA, 22 bp, Homo sapiens
cacagagaattcccatatgtga

SEQ ID NO: 7915911 - DNA, 22 bp, Homo sapiens
cacagagaattcccatatgtga

SEQ ID NO: 7915912 - DNA, 22 bp, Homo sapiens
cacagagacagaagcacttatg

SEQ ID NO: 7915913 - DNA, 22 bp, Homo sapiens
cacagagacagatctattttgc

SEQ ID NO: 7915914 - DNA, 22 bp, Homo sapiens
cacagagaatactgctcttgct

SEQ ID NO: 7915915 - DNA, 22 bp, Homo sapiens
cacagagacagaagcacttatg

SEQ ID NO: 7915916 - DNA, 22 bp, Homo sapiens
cacagagacagaagcacttatg

SEQ ID NO: 7915917 - DNA, 22 bp, Homo sapiens
cacagcaaagacactctcaact

SEQ ID NO: 7915918 - DNA, 22 bp, Homo sapiens
cacagcaaaggcttcggctgat

SEQ ID NO: 7915919 - DNA, 22 bp, Homo sapiens
cacagcaggcactatacagggc

SEQ ID NO: 7915920 - DNA, 22 bp, Homo sapiens
cacagcaggcactatacagggc

SEQ ID NO: 7915921 - DNA, 22 bp, Homo sapiens
cacagcaaagacactctcaact

SEQ ID NO: 7915922 - DNA, 22 bp, Homo sapiens
cacagagaccccttctggggcc

SEQ ID NO: 7915923 - DNA, 22 bp, Homo sapiens
cacagagaccccttctggggcc

SEQ ID NO: 7915924 - DNA, 22 bp, Homo sapiens
cacagagaccccttctggggcc

SEQ ID NO: 7915925 - DNA, 22 bp, Homo sapiens
cacagagacagatctattttgc

SEQ ID NO: 7915926 - DNA, 22 bp, Homo sapiens
cacagagacatgatgtcattgc

SEQ ID NO: 7915927 - DNA, 22 bp, Homo sapiens
cacagagacatgatgtcattgc

SEQ ID NO: 7915928 - DNA, 22 bp, Homo sapiens
cacagagacatgatgtcattgc

SEQ ID NO: 7915929 - DNA, 22 bp, Homo sapiens
cacagagaatgatgagtcactg

SEQ ID NO: 7915930 - DNA, 22 bp, Homo sapiens
cacagagaatgatgagtcactg

SEQ ID NO: 7915931 - DNA, 22 bp, Homo sapiens
cacagagaatgatgagtcactg

SEQ ID NO: 7915932 - DNA, 22 bp, Homo sapiens
cacagagaatgatgagtcactg

SEQ ID NO: 7915933 - DNA, 22 bp, Homo sapiens
cacagagaatgatgagtcactg

SEQ ID NO: 7915934 - DNA, 22 bp, Homo sapiens
cacagagaatactgctcttgct

SEQ ID NO: 7915935 - DNA, 22 bp, Homo sapiens
cacagagaatactgctcttgct

SEQ ID NO: 7915936 - DNA, 22 bp, Homo sapiens
cacagagaatactgctcttgct

SEQ ID NO: 7915937 - DNA, 22 bp, Homo sapiens
cacagagaactgtgggagtgtg

SEQ ID NO: 7915938 - DNA, 22 bp, Homo sapiens
cacagagaatactgctcttgct

SEQ ID NO: 7915939 - DNA, 22 bp, Homo sapiens
cacagagaactgtgggagtgtg

SEQ ID NO: 7915940 - DNA, 22 bp, Homo sapiens
cacagagaactgtgggagtgtg

SEQ ID NO: 7915941 - DNA, 22 bp, Homo sapiens
cacagagaactgtgggagtgtg

SEQ ID NO: 7915942 - DNA, 22 bp, Homo sapiens
cacagagaactgtgggagtgtg

SEQ ID NO: 7915943 - DNA, 22 bp, Homo sapiens
cacagagaactgtgggagtgtg

SEQ ID NO: 7915944 - DNA, 22 bp, Homo sapiens
ggagatctgagagctggaagtg

SEQ ID NO: 7915945 - DNA, 22 bp, Homo sapiens
cacagagaactgtgggagtgtg

SEQ ID NO: 7915946 - DNA, 22 bp, Homo sapiens
ggagataatccagggagggact

SEQ ID NO: 7915947 - DNA, 22 bp, Homo sapiens
ggagatacaaaagtagtgcagg

SEQ ID NO: 7915948 - DNA, 22 bp, Homo sapiens
ggagatagacttggtgagccac

SEQ ID NO: 7915949 - DNA, 22 bp, Homo sapiens
ggagatagacttggtgagccac

SEQ ID NO: 7915950 - DNA, 22 bp, Homo sapiens
ggagatagtccaggtgaaggga

SEQ ID NO: 7915951 - DNA, 22 bp, Homo sapiens
ggagatatggtctagtatagag

SEQ ID NO: 7915952 - DNA, 22 bp, Homo sapiens
ggagatagtccaggtgaaggga

SEQ ID NO: 7915953 - DNA, 23 bp, Homo sapiens
ggagatcagagactagggcagtt

SEQ ID NO: 7915954 - DNA, 22 bp, Homo sapiens
ggagatccaggcaaggccgcag

SEQ ID NO: 7915955 - DNA, 22 bp, Homo sapiens
ggagatccaggctgagtctttc

SEQ ID NO: 7915956 - DNA, 19 bp, Homo sapiens
ggagatcccgctgcagatg

SEQ ID NO: 7915957 - DNA, 23 bp, Homo sapiens
ggagatcagagactagggcagtt

SEQ ID NO: 7915958 - DNA, 21 bp, Homo sapiens
cacagcagggttcctgggctc

SEQ ID NO: 7915959 - DNA, 22 bp, Homo sapiens
cacagcaggtgcttaatgatta

SEQ ID NO: 7915960 - DNA, 22 bp, Homo sapiens
cacagcaggtgcttaatgatta

SEQ ID NO: 7915961 - DNA, 22 bp, Homo sapiens
cacagcagtctttcactaaata

SEQ ID NO: 7915962 - DNA, 22 bp, Homo sapiens
cacagcagtctttcactaaata

SEQ ID NO: 7915963 - DNA, 22 bp, Homo sapiens
cacagcataatgaaatatactt

SEQ ID NO: 7915964 - DNA, 22 bp, Homo sapiens
cacagcagggcatggctgttgt

SEQ ID NO: 7915965 - DNA, 21 bp, Homo sapiens
cacagcagggttcctgggctc

SEQ ID NO: 7915966 - DNA, 21 bp, Homo sapiens
cacagcagggttcctgggctc

SEQ ID NO: 7915967 - DNA, 21 bp, Homo sapiens
cacagcagggttcctgggctc

SEQ ID NO: 7915968 - DNA, 21 bp, Homo sapiens
cacagcagggttcctgggctc

SEQ ID NO: 7915969 - DNA, 22 bp, Homo sapiens
cacagcagggatgaatggagtg

SEQ ID NO: 7915970 - DNA, 22 bp, Homo sapiens
cacagcagggcatggctgttgt

SEQ ID NO: 7915971 - DNA, 22 bp, Homo sapiens
cacagcagggatgaatggagtg

SEQ ID NO: 7915972 - DNA, 22 bp, Homo sapiens
cacagcagggatgaatggagtg

SEQ ID NO: 7915973 - DNA, 22 bp, Homo sapiens
cacagcagggatgaatggagtg

SEQ ID NO: 7915974 - DNA, 22 bp, Homo sapiens
cacagcaggcagaacgtgggca

SEQ ID NO: 7915975 - DNA, 22 bp, Homo sapiens
cacagcaggcagaacgtgggca

SEQ ID NO: 7915976 - DNA, 22 bp, Homo sapiens
cacagcattgccttccaaaagg

SEQ ID NO: 7915977 - DNA, 22 bp, Homo sapiens
cacagccatgtcctcattcttc

SEQ ID NO: 7915978 - DNA, 22 bp, Homo sapiens
cacagccatgtcctcattcttc

SEQ ID NO: 7915979 - DNA, 22 bp, Homo sapiens
cacagccctgcgccccagtttg

SEQ ID NO: 7915980 - DNA, 22 bp, Homo sapiens
cacagccctgcgccccagtttg

SEQ ID NO: 7915981 - DNA, 22 bp, Homo sapiens
cacagccctgcgccccagtttg

SEQ ID NO: 7915982 - DNA, 22 bp, Homo sapiens
cacagcccccttgacactctgg

SEQ ID NO: 7915983 - DNA, 22 bp, Homo sapiens
cacagccatgtcctcattcttc

SEQ ID NO: 7915984 - DNA, 22 bp, Homo sapiens
cacagcccccttgacactctgg

SEQ ID NO: 7915985 - DNA, 22 bp, Homo sapiens
cacagcccccttgacactctgg

SEQ ID NO: 7915986 - DNA, 22 bp, Homo sapiens
ggagcagccacgtctcagggca

SEQ ID NO: 7915987 - DNA, 22 bp, Homo sapiens
ggagcagccacgtctcagggca

SEQ ID NO: 7915988 - DNA, 22 bp, Homo sapiens
ggagcagccacgtctcagggca

SEQ ID NO: 7915989 - DNA, 22 bp, Homo sapiens
ggagcagcactgccacacagag

SEQ ID NO: 7915990 - DNA, 22 bp, Homo sapiens
ggagcagccacgtctcagggca

SEQ ID NO: 7915991 - DNA, 22 bp, Homo sapiens
ggagcagccacgtctcagggca

SEQ ID NO: 7915992 - DNA, 22 bp, Homo sapiens
cacagcctcctctggctcacgg

SEQ ID NO: 7915993 - DNA, 22 bp, Homo sapiens
ggagcagccacgtctcagggca

SEQ ID NO: 7915994 - DNA, 22 bp, Homo sapiens
ggagcagccgcgtctcagggca

SEQ ID NO: 7915995 - DNA, 22 bp, Homo sapiens
ggagcagccgcgtctcagggca

SEQ ID NO: 7915996 - DNA, 22 bp, Homo sapiens
ggagcagccgcgtctcagggca

SEQ ID NO: 7915997 - DNA, 22 bp, Homo sapiens
ggagcagccgcgtctcagggca

SEQ ID NO: 7915998 - DNA, 22 bp, Homo sapiens
ggagcagccgcgtctcagggca

SEQ ID NO: 7915999 - DNA, 22 bp, Homo sapiens
ggagcagcctgtgtagacgggg

SEQ ID NO: 7916000 - DNA, 22 bp, Homo sapiens
ggagcagccgcgtctcagggca

SEQ ID NO: 7916001 - DNA, 22 bp, Homo sapiens
ggagcagcctgtgtagacgggg

SEQ ID NO: 7916002 - DNA, 22 bp, Homo sapiens
ggagcagcttgcatgctcaggg

SEQ ID NO: 7916003 - DNA, 22 bp, Homo sapiens
ggagcagcttgcatgctcaggg

SEQ ID NO: 7916004 - DNA, 22 bp, Homo sapiens
ggagcagcttgcatgctcaggg

SEQ ID NO: 7916005 - DNA, 22 bp, Homo sapiens
ggagcagcttgcatgctcaggg

SEQ ID NO: 7916006 - DNA, 22 bp, Homo sapiens
ggagcagcttgcatgctcaggg

SEQ ID NO: 7916007 - DNA, 22 bp, Homo sapiens
ggagcagcttgcatgctcaggg

SEQ ID NO: 7916008 - DNA, 22 bp, Homo sapiens
ggagcagcttgcatgctcaggg

SEQ ID NO: 7916009 - DNA, 22 bp, Homo sapiens
ggagcagcttgcatgctcaggg

SEQ ID NO: 7916010 - DNA, 22 bp, Homo sapiens
ggagcagcttgcatgctcaggg

SEQ ID NO: 7916011 - DNA, 22 bp, Homo sapiens
ggagcagcttgcatgctcaggg

SEQ ID NO: 7916012 - DNA, 22 bp, Homo sapiens
ggagcaggagtctcttgaattt

SEQ ID NO: 7916013 - DNA, 22 bp, Homo sapiens
ggagctggccgcctatgtgcag

SEQ ID NO: 7916014 - DNA, 22 bp, Homo sapiens
ggagctggccgcctatgtgcag

SEQ ID NO: 7916015 - DNA, 22 bp, Homo sapiens
ggagctggccctctgagtttgt

SEQ ID NO: 7916016 - DNA, 22 bp, Homo sapiens
ggagctggccctctgagtttgt

SEQ ID NO: 7916017 - DNA, 22 bp, Homo sapiens
ggagctggccctctgagtttgt

SEQ ID NO: 7916018 - DNA, 20 bp, Homo sapiens
ggagctggcatccagcctct

SEQ ID NO: 7916019 - DNA, 22 bp, Homo sapiens
ggagctggccctctgagtttgt

SEQ ID NO: 7916020 - DNA, 22 bp, Homo sapiens
ggagcaggagtctcttgaattt

SEQ ID NO: 7916021 - DNA, 22 bp, Homo sapiens
ggaggagacagtaaaaagcacg

SEQ ID NO: 7916022 - DNA, 22 bp, Homo sapiens
ggaggagacagtaaaaagcacg

SEQ ID NO: 7916023 - DNA, 22 bp, Homo sapiens
ggagctggccgcctatgtgcag

SEQ ID NO: 7916024 - DNA, 22 bp, Homo sapiens
ggagctggccgcctatgtgcag

SEQ ID NO: 7916025 - DNA, 22 bp, Homo sapiens
ggaggactcaggtctggccatg

SEQ ID NO: 7916026 - DNA, 22 bp, Homo sapiens
ggaggagcacttctgagctcag

SEQ ID NO: 7916027 - DNA, 22 bp, Homo sapiens
ggaggagcacttctgagctcag

SEQ ID NO: 7916028 - DNA, 22 bp, Homo sapiens
ggaggagcacttctgagctcag

SEQ ID NO: 7916029 - DNA, 22 bp, Homo sapiens
ggaggagcacttctgagctcag

SEQ ID NO: 7916030 - DNA, 22 bp, Homo sapiens
ggaggagcacttctgagctcag

SEQ ID NO: 7916031 - DNA, 22 bp, Homo sapiens
ggaggagcacttctgagctcag

SEQ ID NO: 7916032 - DNA, 22 bp, Homo sapiens
ggaggagcacttctgagctcag

SEQ ID NO: 7916033 - DNA, 22 bp, Homo sapiens
ggaggagattcccctctcactt

SEQ ID NO: 7916034 - DNA, 22 bp, Homo sapiens
ggaggagattcccctctcactt

SEQ ID NO: 7916035 - DNA, 22 bp, Homo sapiens
ggaggagcacttgacggggtct

SEQ ID NO: 7916036 - DNA, 22 bp, Homo sapiens
ggaggagcacttgacggggtct

SEQ ID NO: 7916037 - DNA, 22 bp, Homo sapiens
ggaggagcacttgacggggtct

SEQ ID NO: 7916038 - DNA, 22 bp, Homo sapiens
ggaggagcatgagagggtagtg

SEQ ID NO: 7916039 - DNA, 22 bp, Homo sapiens
ggaggagcacttctgagctcag

SEQ ID NO: 7916040 - DNA, 22 bp, Homo sapiens
ggaggagcacttgacggggtct

SEQ ID NO: 7916041 - DNA, 22 bp, Homo sapiens
ggaggagagaggttgcaaacac

SEQ ID NO: 7916042 - DNA, 22 bp, Homo sapiens
ggaggagattcccctctcactt

SEQ ID NO: 7916043 - DNA, 22 bp, Homo sapiens
ggaggagagaggttgcaaacac

SEQ ID NO: 7916044 - DNA, 22 bp, Homo sapiens
ggaggagaccctgtgtcagttt

SEQ ID NO: 7916045 - DNA, 22 bp, Homo sapiens
ggaggagacggagtgattagtg

SEQ ID NO: 7916046 - DNA, 22 bp, Homo sapiens
ggaggagacggagtgattagtg

SEQ ID NO: 7916047 - DNA, 22 bp, Homo sapiens
ggaggagacggagtgattagtg

SEQ ID NO: 7916048 - DNA, 22 bp, Homo sapiens
cacaggagagctgggaggtgcc

SEQ ID NO: 7916049 - DNA, 22 bp, Homo sapiens
cacaggagagctgggaggtgcc

SEQ ID NO: 7916050 - DNA, 22 bp, Homo sapiens
cacaggagagctgggaggtgcc

SEQ ID NO: 7916051 - DNA, 22 bp, Homo sapiens
cacaggagagctgggaggtgcc

SEQ ID NO: 7916052 - DNA, 22 bp, Homo sapiens
cacaggagaacccacagattct

SEQ ID NO: 7916053 - DNA, 22 bp, Homo sapiens
cacaggagaacccacagattct

SEQ ID NO: 7916054 - DNA, 22 bp, Homo sapiens
cacaggagaaaggggaagctcg

SEQ ID NO: 7916055 - DNA, 22 bp, Homo sapiens
cacaggagaaaggggaagctcg

SEQ ID NO: 7916056 - DNA, 18 bp, Homo sapiens
cacaggagatgacctgac

SEQ ID NO: 7916057 - DNA, 18 bp, Homo sapiens
cacaggagatgacctgac

SEQ ID NO: 7916058 - DNA, 18 bp, Homo sapiens
cacaggagatgacctgac

SEQ ID NO: 7916059 - DNA, 22 bp, Homo sapiens
cacaggagattgatctattggt

SEQ ID NO: 7916060 - DNA, 18 bp, Homo sapiens
cacaggagatgacctgac

SEQ ID NO: 7916061 - DNA, 18 bp, Homo sapiens
cacaggagatgacctgac

SEQ ID NO: 7916062 - DNA, 22 bp, Homo sapiens
cacaggagaggttaatgggggc

SEQ ID NO: 7916063 - DNA, 22 bp, Homo sapiens
cacaggagaaaggggaagctcg

SEQ ID NO: 7916064 - DNA, 22 bp, Homo sapiens
ggaggggccggctgcctgccac

SEQ ID NO: 7916065 - DNA, 22 bp, Homo sapiens
ggaggggccggctgcctgccac

SEQ ID NO: 7916066 - DNA, 22 bp, Homo sapiens
ggaggggccggctgcctgccac

SEQ ID NO: 7916067 - DNA, 22 bp, Homo sapiens
ggaggggcatagttcaccatca

SEQ ID NO: 7916068 - DNA, 22 bp, Homo sapiens
ggaggggcatagttcaccatca

SEQ ID NO: 7916069 - DNA, 22 bp, Homo sapiens
ggaggggatttagtagatgcta

SEQ ID NO: 7916070 - DNA, 22 bp, Homo sapiens
ggaggggatttagtagatgcta

SEQ ID NO: 7916071 - DNA, 22 bp, Homo sapiens
ggaggggcagccatggaactcc

SEQ ID NO: 7916072 - DNA, 22 bp, Homo sapiens
ggaggggcagccatggaactcc

SEQ ID NO: 7916073 - DNA, 22 bp, Homo sapiens
ggaggggcagccatggaactcc

SEQ ID NO: 7916074 - DNA, 22 bp, Homo sapiens
ggaggggcagccatggaactcc

SEQ ID NO: 7916075 - DNA, 22 bp, Homo sapiens
ggaggggcagccatggaactcc

SEQ ID NO: 7916076 - DNA, 22 bp, Homo sapiens
ggaggggcagccatggaactcc

SEQ ID NO: 7916077 - DNA, 22 bp, Homo sapiens
ggaggggatttagtagatgcta

SEQ ID NO: 7916078 - DNA, 22 bp, Homo sapiens
ggaggggcaggtcccaagttgt

SEQ ID NO: 7916079 - DNA, 22 bp, Homo sapiens
ggaggggcatagttcaccatca

SEQ ID NO: 7916080 - DNA, 22 bp, Homo sapiens
cacagcctttagggtacacaca

SEQ ID NO: 7916081 - DNA, 22 bp, Homo sapiens
cacagccttgagcgaggacaag

SEQ ID NO: 7916082 - DNA, 22 bp, Homo sapiens
cacagccttgagcgaggacaag

SEQ ID NO: 7916083 - DNA, 22 bp, Homo sapiens
cacagccttgagcgaggacaag

SEQ ID NO: 7916084 - DNA, 22 bp, Homo sapiens
cacagcctttagggtacacaca

SEQ ID NO: 7916085 - DNA, 22 bp, Homo sapiens
cacagcctttagggtacacaca

SEQ ID NO: 7916086 - DNA, 19 bp, Homo sapiens
cacagcgaagacaaggtgg

SEQ ID NO: 7916087 - DNA, 22 bp, Homo sapiens
cacagcggcctccgatgctgat

SEQ ID NO: 7916088 - DNA, 22 bp, Homo sapiens
cacagcggcctccgatgctgat

SEQ ID NO: 7916089 - DNA, 22 bp, Homo sapiens
cacagcggcctccgatgctgat

SEQ ID NO: 7916090 - DNA, 22 bp, Homo sapiens
cacagctacctgcatgcctgct

SEQ ID NO: 7916091 - DNA, 22 bp, Homo sapiens
cacagctacctgcatgcctgct

SEQ ID NO: 7916092 - DNA, 22 bp, Homo sapiens
cacagctacctgcatgcctgct

SEQ ID NO: 7916093 - DNA, 22 bp, Homo sapiens
cacagctagactaattgctggg

SEQ ID NO: 7916094 - DNA, 22 bp, Homo sapiens
cacagctagatggatagataga

SEQ ID NO: 7916095 - DNA, 22 bp, Homo sapiens
cacagctaactttcactgagca

SEQ ID NO: 7916096 - DNA, 22 bp, Homo sapiens
cacagctaactttcactgagca

SEQ ID NO: 7916097 - DNA, 22 bp, Homo sapiens
cacagctaatggaagtggaatc

SEQ ID NO: 7916098 - DNA, 22 bp, Homo sapiens
cacagctacctgcatgcctgct

SEQ ID NO: 7916099 - DNA, 22 bp, Homo sapiens
cacagctaatggaagtggaatc

SEQ ID NO: 7916100 - DNA, 22 bp, Homo sapiens
cacagccttactgagatccact

SEQ ID NO: 7916101 - DNA, 22 bp, Homo sapiens
cacagcctgctgcactcaagaa

SEQ ID NO: 7916102 - DNA, 22 bp, Homo sapiens
cacagccttactgagatccact

SEQ ID NO: 7916103 - DNA, 22 bp, Homo sapiens
cacagccttactgagatccact

SEQ ID NO: 7916104 - DNA, 22 bp, Homo sapiens
cacagccttgagcgaggacaag

SEQ ID NO: 7916105 - DNA, 22 bp, Homo sapiens
cacagcctcctctggctcacgg

SEQ ID NO: 7916106 - DNA, 22 bp, Homo sapiens
cacagcctcctctggctcacgg

SEQ ID NO: 7916107 - DNA, 22 bp, Homo sapiens
cacagcctccttcagagagcat

SEQ ID NO: 7916108 - DNA, 22 bp, Homo sapiens
cacagcctcctctggctcacgg

SEQ ID NO: 7916109 - DNA, 22 bp, Homo sapiens
cacagcctccttcagagagcat

SEQ ID NO: 7916110 - DNA, 22 bp, Homo sapiens
cacagcctccttcagagagcat

SEQ ID NO: 7916111 - DNA, 22 bp, Homo sapiens
ggagggcaacttttcagtaggt

SEQ ID NO: 7916112 - DNA, 22 bp, Homo sapiens
cacagctgaagtagccatgtgg

SEQ ID NO: 7916113 - DNA, 22 bp, Homo sapiens
ggagggcaacttttcagtaggt

SEQ ID NO: 7916114 - DNA, 22 bp, Homo sapiens
ggagggcaacttttcagtaggt

SEQ ID NO: 7916115 - DNA, 22 bp, Homo sapiens
ggagggcacaggaccagaaatc

SEQ ID NO: 7916116 - DNA, 22 bp, Homo sapiens
ggagggcacaggaccagaaatc

SEQ ID NO: 7916117 - DNA, 22 bp, Homo sapiens
cacagctgaagtagccatgtgg

SEQ ID NO: 7916118 - DNA, 22 bp, Homo sapiens
cacagctgaagtagccatgtgg

SEQ ID NO: 7916119 - DNA, 22 bp, Homo sapiens
cacagctgaagtagccatgtgg

SEQ ID NO: 7916120 - DNA, 22 bp, Homo sapiens
cacagctgaagtagccatgtgg

SEQ ID NO: 7916121 - DNA, 19 bp, Homo sapiens
cacagctctgctcagggaa

SEQ ID NO: 7916122 - DNA, 19 bp, Homo sapiens
cacagctctgctcagggaa

SEQ ID NO: 7916123 - DNA, 22 bp, Homo sapiens
cacagctatggggctgtagcct

SEQ ID NO: 7916124 - DNA, 22 bp, Homo sapiens
cacagctaggaggaaagcagag

SEQ ID NO: 7916125 - DNA, 22 bp, Homo sapiens
ggaggggatttagtagatgcta

SEQ ID NO: 7916126 - DNA, 22 bp, Homo sapiens
ggaggggatttagtagatgcta

SEQ ID NO: 7916127 - DNA, 22 bp, Homo sapiens
ggaggggatggtttgaccctgg

SEQ ID NO: 7916128 - DNA, 22 bp, Homo sapiens
ggaggggatttagtagatgcta

SEQ ID NO: 7916129 - DNA, 22 bp, Homo sapiens
ggaggggatttagtagatgcta

SEQ ID NO: 7916130 - DNA, 22 bp, Homo sapiens
ggaggggatggtttgaccctgg

SEQ ID NO: 7916131 - DNA, 22 bp, Homo sapiens
ggaggggatggtttgaccctgg

SEQ ID NO: 7916132 - DNA, 22 bp, Homo sapiens
ggaggggatggtttgaccctgg

SEQ ID NO: 7916133 - DNA, 22 bp, Homo sapiens
ggaggggatggtttgaccctgg

SEQ ID NO: 7916134 - DNA, 22 bp, Homo sapiens
ggaggggatggtttgaccctgg

SEQ ID NO: 7916135 - DNA, 22 bp, Homo sapiens
gcttccagcaaacactggctgc

SEQ ID NO: 7916136 - DNA, 22 bp, Homo sapiens
gcttccagcaaacactggctgc

SEQ ID NO: 7916137 - DNA, 22 bp, Homo sapiens
gcttccagcaaacactggctgc

SEQ ID NO: 7916138 - DNA, 22 bp, Homo sapiens
gcttccagcaaacactggctgc

SEQ ID NO: 7916139 - DNA, 22 bp, Homo sapiens
gcttccagatcccatgctctta

SEQ ID NO: 7916140 - DNA, 22 bp, Homo sapiens
gcttccagatcccatgctctta

SEQ ID NO: 7916141 - DNA, 22 bp, Homo sapiens
gcttccagatcccatgctctta

SEQ ID NO: 7916142 - DNA, 22 bp, Homo sapiens
gcttccagatcccatgctctta

SEQ ID NO: 7916143 - DNA, 20 bp, Homo sapiens
gcttccagaggaggccccgt

SEQ ID NO: 7916144 - DNA, 20 bp, Homo sapiens
gcttccagaggaggccccgt

SEQ ID NO: 7916145 - DNA, 22 bp, Homo sapiens
gcttccagatcccatgctctta

SEQ ID NO: 7916146 - DNA, 22 bp, Homo sapiens
gcttccagatcccatgctctta

SEQ ID NO: 7916147 - DNA, 20 bp, Homo sapiens
gcttccagaggaggccccgt

SEQ ID NO: 7916148 - DNA, 20 bp, Homo sapiens
gcttccagaggaggccccgt

SEQ ID NO: 7916149 - DNA, 20 bp, Homo sapiens
gcttccagaggaggccccgt

SEQ ID NO: 7916150 - DNA, 22 bp, Homo sapiens
gcttccagacgatcatgtaaga

SEQ ID NO: 7916151 - DNA, 22 bp, Homo sapiens
gcttccagacgatcatgtaaga

SEQ ID NO: 7916152 - DNA, 22 bp, Homo sapiens
gcttccagagactgagctcttc

SEQ ID NO: 7916153 - DNA, 22 bp, Homo sapiens
gcttccagacgatcatgtaaga

SEQ ID NO: 7916154 - DNA, 22 bp, Homo sapiens
gcttccagagagccccgcctgg

SEQ ID NO: 7916155 - DNA, 22 bp, Homo sapiens
gcttccagagagccccgcctgg

SEQ ID NO: 7916156 - DNA, 20 bp, Homo sapiens
gcttccagaggaggccccgt

SEQ ID NO: 7916157 - DNA, 22 bp, Homo sapiens
gcttccagagagccccgcctgg

SEQ ID NO: 7916158 - DNA, 22 bp, Homo sapiens
gcttccagagactgagctcttc

SEQ ID NO: 7916159 - DNA, 22 bp, Homo sapiens
gcttccagagactgagctcttc

SEQ ID NO: 7916160 - DNA, 22 bp, Homo sapiens
gcttccagagactgagctcttc

SEQ ID NO: 7916161 - DNA, 22 bp, Homo sapiens
gcttccagagactgagctcttc

SEQ ID NO: 7916162 - DNA, 22 bp, Homo sapiens
gcttccagaccccagtccctca

SEQ ID NO: 7916163 - DNA, 22 bp, Homo sapiens
gcttccagaccccagtccctca

SEQ ID NO: 7916164 - DNA, 22 bp, Homo sapiens
gcttccagaccccagtccctca

SEQ ID NO: 7916165 - DNA, 22 bp, Homo sapiens
gcttccagaccccagtccctca

SEQ ID NO: 7916166 - DNA, 22 bp, Homo sapiens
gcttccagaatgactaggatgt

SEQ ID NO: 7916167 - DNA, 22 bp, Homo sapiens
gcttccagaatgactaggatgt

SEQ ID NO: 7916168 - DNA, 22 bp, Homo sapiens
gcttccagaatgactaggatgt

SEQ ID NO: 7916169 - DNA, 22 bp, Homo sapiens
gcttccagaatgactaggatgt

SEQ ID NO: 7916170 - DNA, 23 bp, Homo sapiens
gcttccagaagactcattgacat

SEQ ID NO: 7916171 - DNA, 23 bp, Homo sapiens
gcttccagaagactcattgacat

SEQ ID NO: 7916172 - DNA, 23 bp, Homo sapiens
gcttccagaagactcattgacat

SEQ ID NO: 7916173 - DNA, 22 bp, Homo sapiens
gcttccacttgggaacctctct

SEQ ID NO: 7916174 - DNA, 22 bp, Homo sapiens
gcttccacttgggaacctctct

SEQ ID NO: 7916175 - DNA, 22 bp, Homo sapiens
caatgtacaaaataattacaca

SEQ ID NO: 7916176 - DNA, 22 bp, Homo sapiens
caatggttgaaccctgtcatga

SEQ ID NO: 7916177 - DNA, 22 bp, Homo sapiens
caatgtaaatattttctaatca

SEQ ID NO: 7916178 - DNA, 22 bp, Homo sapiens
caatgtacaaaataattacaca

SEQ ID NO: 7916179 - DNA, 22 bp, Homo sapiens
caatgtactacaaagattgtca

SEQ ID NO: 7916180 - DNA, 22 bp, Homo sapiens
caatgcttctgagggaattaca

SEQ ID NO: 7916181 - DNA, 22 bp, Homo sapiens
caatgcttctgagggaattaca

SEQ ID NO: 7916182 - DNA, 22 bp, Homo sapiens
caatgctttatttcctcccctt

SEQ ID NO: 7916183 - DNA, 22 bp, Homo sapiens
caatgcttgctgactccctgtc

SEQ ID NO: 7916184 - DNA, 22 bp, Homo sapiens
caatgcttctgagggaattaca

SEQ ID NO: 7916185 - DNA, 22 bp, Homo sapiens
caatgcttttagcttcagcttg

SEQ ID NO: 7916186 - DNA, 22 bp, Homo sapiens
caatgcttttagcttcagcttg

SEQ ID NO: 7916187 - DNA, 22 bp, Homo sapiens
caatgcttcaggctccttatag

SEQ ID NO: 7916188 - DNA, 22 bp, Homo sapiens
caatgctgtgctcctcatgagg

SEQ ID NO: 7916189 - DNA, 22 bp, Homo sapiens
caatgctgtgctcctcatgagg

SEQ ID NO: 7916190 - DNA, 22 bp, Homo sapiens
caatgcttctcattagccaatg

SEQ ID NO: 7916191 - DNA, 22 bp, Homo sapiens
caatggcactgcccaaagagaa

SEQ ID NO: 7916192 - DNA, 22 bp, Homo sapiens
caatggcactgcccaaagagaa

SEQ ID NO: 7916193 - DNA, 21 bp, Homo sapiens
caatggcgagatcttggctca

SEQ ID NO: 7916194 - DNA, 21 bp, Homo sapiens
caatggcgagatcttggctca

SEQ ID NO: 7916195 - DNA, 22 bp, Homo sapiens
caatggaggtttactctgcagc

SEQ ID NO: 7916196 - DNA, 22 bp, Homo sapiens
caatggaggtttactctgcagc

SEQ ID NO: 7916197 - DNA, 22 bp, Homo sapiens
caatggaggtttactctgcagc

SEQ ID NO: 7916198 - DNA, 22 bp, Homo sapiens
caatggatattttatgtgagaa

SEQ ID NO: 7916199 - DNA, 22 bp, Homo sapiens
caatgcttttgttctttactca

SEQ ID NO: 7916200 - DNA, 22 bp, Homo sapiens
caatgggagcagaaattgtttg

SEQ ID NO: 7916201 - DNA, 22 bp, Homo sapiens
caatgggcctggagagagctgg

SEQ ID NO: 7916202 - DNA, 22 bp, Homo sapiens
caatggctctagagggttgtgt

SEQ ID NO: 7916203 - DNA, 22 bp, Homo sapiens
caatggctggagacaatctgct

SEQ ID NO: 7916204 - DNA, 22 bp, Homo sapiens
caatgggcggaatcgggaggcg

SEQ ID NO: 7916205 - DNA, 22 bp, Homo sapiens
caatggtggtgtcagaagagat

SEQ ID NO: 7916206 - DNA, 20 bp, Homo sapiens
gcttccaggagggctgatat

SEQ ID NO: 7916207 - DNA, 20 bp, Homo sapiens
gcttccaggagggctgatat

SEQ ID NO: 7916208 - DNA, 20 bp, Homo sapiens
gcttccaggagggctgatat

SEQ ID NO: 7916209 - DNA, 22 bp, Homo sapiens
gcttccaggcttcctacctttg

SEQ ID NO: 7916210 - DNA, 22 bp, Homo sapiens
gcttccaggcttcctacctttg

SEQ ID NO: 7916211 - DNA, 22 bp, Homo sapiens
gcttccaggcttcctacctttg

SEQ ID NO: 7916212 - DNA, 20 bp, Homo sapiens
gcttccaggcccggaaaacc

SEQ ID NO: 7916213 - DNA, 20 bp, Homo sapiens
gcttccaggcccggaaaacc

SEQ ID NO: 7916214 - DNA, 20 bp, Homo sapiens
gcttccaggcccggaaaacc

SEQ ID NO: 7916215 - DNA, 22 bp, Homo sapiens
gcttccagggctcagtcactgc

SEQ ID NO: 7916216 - DNA, 22 bp, Homo sapiens
gcttccagggctcagtcactgc

SEQ ID NO: 7916217 - DNA, 22 bp, Homo sapiens
gcttccagggctcagtcactgc

SEQ ID NO: 7916218 - DNA, 22 bp, Homo sapiens
gcttccagggctcagtcactgc

SEQ ID NO: 7916219 - DNA, 22 bp, Homo sapiens
gcttccagggctcagtcactgc

SEQ ID NO: 7916220 - DNA, 22 bp, Homo sapiens
gcttccaggcttcctacctttg

SEQ ID NO: 7916221 - DNA, 22 bp, Homo sapiens
ggaaatgcataggagtttagaa

SEQ ID NO: 7916222 - DNA, 22 bp, Homo sapiens
ggaaatgacttggtgcttcgtt

SEQ ID NO: 7916223 - DNA, 22 bp, Homo sapiens
gcttccaggggctgtgggctga

SEQ ID NO: 7916224 - DNA, 22 bp, Homo sapiens
ggaaaatttccttcaaaatgtg

SEQ ID NO: 7916225 - DNA, 22 bp, Homo sapiens
gcttccagcaccagcagagggg

SEQ ID NO: 7916226 - DNA, 22 bp, Homo sapiens
gcttccagcaccagcagagggg

SEQ ID NO: 7916227 - DNA, 22 bp, Homo sapiens
gcttccagcaccagcagagggg

SEQ ID NO: 7916228 - DNA, 22 bp, Homo sapiens
gcttccagcaccagcagagggg

SEQ ID NO: 7916229 - DNA, 22 bp, Homo sapiens
gcttccagcaccagcagagggg

SEQ ID NO: 7916230 - DNA, 22 bp, Homo sapiens
gcttccagcaaacactggctgc

SEQ ID NO: 7916231 - DNA, 19 bp, Homo sapiens
gcttccagcactgcaggag

SEQ ID NO: 7916232 - DNA, 19 bp, Homo sapiens
gcttccagcactgcaggag

SEQ ID NO: 7916233 - DNA, 19 bp, Homo sapiens
gcttccagcactgcaggag

SEQ ID NO: 7916234 - DNA, 19 bp, Homo sapiens
gcttccagcactgcaggag

SEQ ID NO: 7916235 - DNA, 19 bp, Homo sapiens
gcttccagcactgcaggag

SEQ ID NO: 7916236 - DNA, 19 bp, Homo sapiens
gcttccagcactgcaggag

SEQ ID NO: 7916237 - DNA, 22 bp, Homo sapiens
gcttccagccttttctcctctg

SEQ ID NO: 7916238 - DNA, 22 bp, Homo sapiens
gcttccagccttttctcctctg

SEQ ID NO: 7916239 - DNA, 22 bp, Homo sapiens
gcttccagccttttctcctctg

SEQ ID NO: 7916240 - DNA, 20 bp, Homo sapiens
gcttccaggagggctgatat

SEQ ID NO: 7916241 - DNA, 20 bp, Homo sapiens
gcttccaggagggctgatat

SEQ ID NO: 7916242 - DNA, 20 bp, Homo sapiens
gcttccaggagggctgatat

SEQ ID NO: 7916243 - DNA, 20 bp, Homo sapiens
gcttccaggagggctgatat

SEQ ID NO: 7916244 - DNA, 19 bp, Homo sapiens
gcttccagcactgcaggag

SEQ ID NO: 7916245 - DNA, 19 bp, Homo sapiens
gcttccagcactgcaggag

SEQ ID NO: 7916246 - DNA, 19 bp, Homo sapiens
gcttccagcactgcaggag

SEQ ID NO: 7916247 - DNA, 19 bp, Homo sapiens
gcttccagcactgcaggag

SEQ ID NO: 7916248 - DNA, 22 bp, Homo sapiens
ggaacacagtgccttacaaact

SEQ ID NO: 7916249 - DNA, 22 bp, Homo sapiens
ggaacacagtgccttacaaact

SEQ ID NO: 7916250 - DNA, 22 bp, Homo sapiens
ggaacacagtgccttacaaact

SEQ ID NO: 7916251 - DNA, 22 bp, Homo sapiens
ggaacacaaatgggagagctgg

SEQ ID NO: 7916252 - DNA, 22 bp, Homo sapiens
ggaacacaaatgggagagctgg

SEQ ID NO: 7916253 - DNA, 22 bp, Homo sapiens
ggaacacagaagggctgaaaaa

SEQ ID NO: 7916254 - DNA, 17 bp, Homo sapiens
ggaacaaatactatgca

SEQ ID NO: 7916255 - DNA, 17 bp, Homo sapiens
ggaacaaatactatgca

SEQ ID NO: 7916256 - DNA, 22 bp, Homo sapiens
ggaaatggtggaggaaggctta

SEQ ID NO: 7916257 - DNA, 22 bp, Homo sapiens
ggaaatgtaatcacagagggtt

SEQ ID NO: 7916258 - DNA, 22 bp, Homo sapiens
ggaaatgtaatcacagagggtt

SEQ ID NO: 7916259 - DNA, 22 bp, Homo sapiens
ggaaatgtatgtattaagcacc

SEQ ID NO: 7916260 - DNA, 17 bp, Homo sapiens
ggaaatgtacctctttt

SEQ ID NO: 7916261 - DNA, 22 bp, Homo sapiens
ggaaatgtatgattctcatcag

SEQ ID NO: 7916262 - DNA, 19 bp, Homo sapiens
ggaaatgtggaaacatcct

SEQ ID NO: 7916263 - DNA, 19 bp, Homo sapiens
ggaaatgtggaaacatcct

SEQ ID NO: 7916264 - DNA, 22 bp, Homo sapiens
ggaaatgtcatagaaatataag

SEQ ID NO: 7916265 - DNA, 22 bp, Homo sapiens
ggaaatgtcatagaaatataag

SEQ ID NO: 7916266 - DNA, 18 bp, Homo sapiens
ggaaatgtttggtactag

SEQ ID NO: 7916267 - DNA, 22 bp, Homo sapiens
gctggtggcagagacatcaggt

SEQ ID NO: 7916268 - DNA, 22 bp, Homo sapiens
gctggtggcagagacatcaggt

SEQ ID NO: 7916269 - DNA, 22 bp, Homo sapiens
gctggtgctctgggccctgagg

SEQ ID NO: 7916270 - DNA, 22 bp, Homo sapiens
gctggtggcagagacatcaggt

SEQ ID NO: 7916271 - DNA, 22 bp, Homo sapiens
gctggtgctctgggccctgagg

SEQ ID NO: 7916272 - DNA, 22 bp, Homo sapiens
gctggtgctctgggccctgagg

SEQ ID NO: 7916273 - DNA, 22 bp, Homo sapiens
gctggtgctctgggccctgagg

SEQ ID NO: 7916274 - DNA, 22 bp, Homo sapiens
gctggtgcattagctgcagttc

SEQ ID NO: 7916275 - DNA, 22 bp, Homo sapiens
gctggtgcattagctgcagttc

SEQ ID NO: 7916276 - DNA, 22 bp, Homo sapiens
gctggtggtaaggaggaaaaag

SEQ ID NO: 7916277 - DNA, 20 bp, Homo sapiens
gctggtgggggcttgacatg

SEQ ID NO: 7916278 - DNA, 22 bp, Homo sapiens
gctggtggcagagacatcaggt

SEQ ID NO: 7916279 - DNA, 22 bp, Homo sapiens
gctggtggcagagacatcaggt

SEQ ID NO: 7916280 - DNA, 22 bp, Homo sapiens
gctggtggcagagctccgcggc

SEQ ID NO: 7916281 - DNA, 20 bp, Homo sapiens
gctggtgggggcttgacatg

SEQ ID NO: 7916282 - DNA, 20 bp, Homo sapiens
gctggtgggggcttgacatg

SEQ ID NO: 7916283 - DNA, 22 bp, Homo sapiens
gctggtggcagagctccgcggc

SEQ ID NO: 7916284 - DNA, 22 bp, Homo sapiens
gctggtggcagagctccgcggc

SEQ ID NO: 7916285 - DNA, 22 bp, Homo sapiens
gctggtgattgcctcaggaggc

SEQ ID NO: 7916286 - DNA, 22 bp, Homo sapiens
gctggtgattgcctcaggaggc

SEQ ID NO: 7916287 - DNA, 22 bp, Homo sapiens
gctggtgcattagctgcagttc

SEQ ID NO: 7916288 - DNA, 22 bp, Homo sapiens
gctggtctccgccgctccctga

SEQ ID NO: 7916289 - DNA, 22 bp, Homo sapiens
gctggtctccgccgctccctga

SEQ ID NO: 7916290 - DNA, 22 bp, Homo sapiens
gctggtcctcaagggcacagcc

SEQ ID NO: 7916291 - DNA, 22 bp, Homo sapiens
gctggtcctcaagggcacagcc

SEQ ID NO: 7916292 - DNA, 22 bp, Homo sapiens
caagtttaaggcactgataagt

SEQ ID NO: 7916293 - DNA, 22 bp, Homo sapiens
caagtttaaagtgaggtttgaa

SEQ ID NO: 7916294 - DNA, 22 bp, Homo sapiens
gctggtctagggatgggcgtat

SEQ ID NO: 7916295 - DNA, 22 bp, Homo sapiens
gctggtctagggatgggcgtat

SEQ ID NO: 7916296 - DNA, 22 bp, Homo sapiens
gctggtctccgccgctccctga

SEQ ID NO: 7916297 - DNA, 22 bp, Homo sapiens
gctggtcctggggttgcagcat

SEQ ID NO: 7916298 - DNA, 22 bp, Homo sapiens
gctggtcctcaagggcacagcc

SEQ ID NO: 7916299 - DNA, 17 bp, Homo sapiens
gctggtccttggtaact

SEQ ID NO: 7916300 - DNA, 22 bp, Homo sapiens
gctggtcctggggttgcagcat

SEQ ID NO: 7916301 - DNA, 17 bp, Homo sapiens
gctggtccttggtaact

SEQ ID NO: 7916302 - DNA, 22 bp, Homo sapiens
caatgattgctatttacataaa

SEQ ID NO: 7916303 - DNA, 22 bp, Homo sapiens
caatgcaatgcaatgcaatgca

SEQ ID NO: 7916304 - DNA, 22 bp, Homo sapiens
gctggtggtgggccagttctgt

SEQ ID NO: 7916305 - DNA, 22 bp, Homo sapiens
gctggtggtgggccagttctgt

SEQ ID NO: 7916306 - DNA, 22 bp, Homo sapiens
gctggtggttaccgtgctaatg

SEQ ID NO: 7916307 - DNA, 22 bp, Homo sapiens
gctggtggttaccgtgctaatg

SEQ ID NO: 7916308 - DNA, 22 bp, Homo sapiens
gctggtgtgtgaacctagggac

SEQ ID NO: 7916309 - DNA, 22 bp, Homo sapiens
gctggtgtctaacctggctctt

SEQ ID NO: 7916310 - DNA, 22 bp, Homo sapiens
gctggtgtgtgaacctagggac

SEQ ID NO: 7916311 - DNA, 22 bp, Homo sapiens
gctgtaaagaacattaggaatc

SEQ ID NO: 7916312 - DNA, 22 bp, Homo sapiens
gctggtttccttatctataaag

SEQ ID NO: 7916313 - DNA, 22 bp, Homo sapiens
gctggttcacctggctcctccc

SEQ ID NO: 7916314 - DNA, 22 bp, Homo sapiens
gctggttcacctggctcctccc

SEQ ID NO: 7916315 - DNA, 22 bp, Homo sapiens
gctggtttcacccaaccgatgt

SEQ ID NO: 7916316 - DNA, 22 bp, Homo sapiens
caagtggggcagattctcttcc

SEQ ID NO: 7916317 - DNA, 23 bp, Homo sapiens
caagtgcaccagatatacaggtc

SEQ ID NO: 7916318 - DNA, 22 bp, Homo sapiens
caagtgcatggtggcaaagaat

SEQ ID NO: 7916319 - DNA, 22 bp, Homo sapiens
gctgggctcaccaggccactag

SEQ ID NO: 7916320 - DNA, 22 bp, Homo sapiens
gctgggctcaccaggccactag

SEQ ID NO: 7916321 - DNA, 22 bp, Homo sapiens
caagtcaatgattataagagtc

SEQ ID NO: 7916322 - DNA, 22 bp, Homo sapiens
caagtcacatggccaactgatg

SEQ ID NO: 7916323 - DNA, 22 bp, Homo sapiens
caagtcacatggccaactgatg

SEQ ID NO: 7916324 - DNA, 22 bp, Homo sapiens
caagtgtgactattttttcata

SEQ ID NO: 7916325 - DNA, 22 bp, Homo sapiens
caagtgtcttcaaaggctaaaa

SEQ ID NO: 7916326 - DNA, 22 bp, Homo sapiens
caagtgtgactattttttcata

SEQ ID NO: 7916327 - DNA, 21 bp, Homo sapiens
caagtgtggatgtggaaggta

SEQ ID NO: 7916328 - DNA, 22 bp, Homo sapiens
caagtgtccatgatagtcttag

SEQ ID NO: 7916329 - DNA, 22 bp, Homo sapiens
caagtgtctatatcagtgcttg

SEQ ID NO: 7916330 - DNA, 22 bp, Homo sapiens
caagtgtcttcaaaggctaaaa

SEQ ID NO: 7916331 - DNA, 22 bp, Homo sapiens
caagttaattggtattttgatc

SEQ ID NO: 7916332 - DNA, 22 bp, Homo sapiens
caagttaatatatagaattttg

SEQ ID NO: 7916333 - DNA, 22 bp, Homo sapiens
caagttaatatatagaattttg

SEQ ID NO: 7916334 - DNA, 22 bp, Homo sapiens
caagttaaatttgcatttcaga

SEQ ID NO: 7916335 - DNA, 22 bp, Homo sapiens
caagttaaatttgcatttcaga

SEQ ID NO: 7916336 - DNA, 20 bp, Homo sapiens
caagtgttattgtgcattta

SEQ ID NO: 7916337 - DNA, 19 bp, Homo sapiens
caagttaaaatgaggtcat

SEQ ID NO: 7916338 - DNA, 22 bp, Homo sapiens
caagttgtgaatgacagacttc

SEQ ID NO: 7916339 - DNA, 22 bp, Homo sapiens
caagttgtacagattgtattag

SEQ ID NO: 7916340 - DNA, 22 bp, Homo sapiens
caagttgtttaggaggtgttgt

SEQ ID NO: 7916341 - DNA, 22 bp, Homo sapiens
caagttgttgggagggttggtt

SEQ ID NO: 7916342 - DNA, 21 bp, Homo sapiens
caagttctgtgtcttactcct

SEQ ID NO: 7916343 - DNA, 22 bp, Homo sapiens
caagttggtctcctgtagcaac

SEQ ID NO: 7916344 - DNA, 22 bp, Homo sapiens
caagttcattgtagcattattg

SEQ ID NO: 7916345 - DNA, 22 bp, Homo sapiens
caagttcattgtagcattattg

SEQ ID NO: 7916346 - DNA, 22 bp, Homo sapiens
caagttcattgtagcattattg

SEQ ID NO: 7916347 - DNA, 22 bp, Homo sapiens
caagttcacttgtctacaaggg

SEQ ID NO: 7916348 - DNA, 22 bp, Homo sapiens
caagttcacttgtctacaaggg

SEQ ID NO: 7916349 - DNA, 21 bp, Homo sapiens
caagttcagaaggttgggctg

SEQ ID NO: 7916350 - DNA, 21 bp, Homo sapiens
caagttctgctgaatcttctt

SEQ ID NO: 7916351 - DNA, 22 bp, Homo sapiens
caagttctactgggacatcagt

SEQ ID NO: 7916352 - DNA, 22 bp, Homo sapiens
caagttattcctttacactata

SEQ ID NO: 7916353 - DNA, 22 bp, Homo sapiens
caagttattcctttacactata

SEQ ID NO: 7916354 - DNA, 22 bp, Homo sapiens
caagttagtattggttttggga

SEQ ID NO: 7916355 - DNA, 22 bp, Homo sapiens
caagttcacgttgctttttgag

SEQ ID NO: 7916356 - DNA, 22 bp, Homo sapiens
caagttcacgttgctttttgag

SEQ ID NO: 7916357 - DNA, 22 bp, Homo sapiens
caagttcacttgtctacaaggg

SEQ ID NO: 7916358 - DNA, 22 bp, Homo sapiens
caagttcaagtcctggctctgc

SEQ ID NO: 7916359 - DNA, 22 bp, Homo sapiens
gctgggagccgtacctgtcacg

SEQ ID NO: 7916360 - DNA, 22 bp, Homo sapiens
gctgggagccgtacctgtcacg

SEQ ID NO: 7916361 - DNA, 22 bp, Homo sapiens
gctgggagccctggtctgctcc

SEQ ID NO: 7916362 - DNA, 22 bp, Homo sapiens
gctgggagccctggtctgctcc

SEQ ID NO: 7916363 - DNA, 22 bp, Homo sapiens
gctgggaggaatttggggaata

SEQ ID NO: 7916364 - DNA, 22 bp, Homo sapiens
gctgggaggaatttggggaata

SEQ ID NO: 7916365 - DNA, 22 bp, Homo sapiens
gctgggaggaatttggggaata

SEQ ID NO: 7916366 - DNA, 22 bp, Homo sapiens
gctgggaggaatttggggaata

SEQ ID NO: 7916367 - DNA, 22 bp, Homo sapiens
gctgggaggaatttggggaata

SEQ ID NO: 7916368 - DNA, 22 bp, Homo sapiens
gctgggagccgtacctgtcacg

SEQ ID NO: 7916369 - DNA, 22 bp, Homo sapiens
gctgggagccgtacctgtcacg

SEQ ID NO: 7916370 - DNA, 22 bp, Homo sapiens
gctgggccagagcagcagcact

SEQ ID NO: 7916371 - DNA, 22 bp, Homo sapiens
gctgggccagagcagcagcact

SEQ ID NO: 7916372 - DNA, 22 bp, Homo sapiens
gctgggaggaatttggggaata

SEQ ID NO: 7916373 - DNA, 22 bp, Homo sapiens
gctgggccagccagacatgtga

SEQ ID NO: 7916374 - DNA, 22 bp, Homo sapiens
gctgggccagccagacatgtga

SEQ ID NO: 7916375 - DNA, 22 bp, Homo sapiens
gctgggccagccagacatgtga

SEQ ID NO: 7916376 - DNA, 22 bp, Homo sapiens
gctgggcccagatcccaggatc

SEQ ID NO: 7916377 - DNA, 22 bp, Homo sapiens
gctgggccagccagacatgtga

SEQ ID NO: 7916378 - DNA, 22 bp, Homo sapiens
gctgggcccagatcccaggatc

SEQ ID NO: 7916379 - DNA, 22 bp, Homo sapiens
gctgggcccagatcccaggatc

SEQ ID NO: 7916380 - DNA, 22 bp, Homo sapiens
gctgggcccagatcccaggatc

SEQ ID NO: 7916381 - DNA, 22 bp, Homo sapiens
gctgggcccagatcccaggatc

SEQ ID NO: 7916382 - DNA, 22 bp, Homo sapiens
gctgggcccagatcccaggatc

SEQ ID NO: 7916383 - DNA, 22 bp, Homo sapiens
gctgggccccatccctcgagca

SEQ ID NO: 7916384 - DNA, 22 bp, Homo sapiens
gctgggccccatccctcgagca

SEQ ID NO: 7916385 - DNA, 22 bp, Homo sapiens
gctgggccccatccctcgagca

SEQ ID NO: 7916386 - DNA, 22 bp, Homo sapiens
gctgggccccatccctcgagca

SEQ ID NO: 7916387 - DNA, 22 bp, Homo sapiens
gctgggccccttgaaaggcgtc

SEQ ID NO: 7916388 - DNA, 22 bp, Homo sapiens
gctgggccccatccctcgagca

SEQ ID NO: 7916389 - DNA, 22 bp, Homo sapiens
gctgggccccatccctcgagca

SEQ ID NO: 7916390 - DNA, 22 bp, Homo sapiens
gctgggccccatccctcgagca

SEQ ID NO: 7916391 - DNA, 22 bp, Homo sapiens
gctgggccccttgaaaggcgtc

SEQ ID NO: 7916392 - DNA, 22 bp, Homo sapiens
gctgggccccttgaaaggcgtc

SEQ ID NO: 7916393 - DNA, 22 bp, Homo sapiens
gctgggccccttgaaaggcgtc

SEQ ID NO: 7916394 - DNA, 22 bp, Homo sapiens
gctgggccctgggtgccctagc

SEQ ID NO: 7916395 - DNA, 22 bp, Homo sapiens
gctgggccctgggtgccctagc

SEQ ID NO: 7916396 - DNA, 22 bp, Homo sapiens
gctgggccgacctgggctgcag

SEQ ID NO: 7916397 - DNA, 22 bp, Homo sapiens
gctgggccgacctgggctgcag

SEQ ID NO: 7916398 - DNA, 22 bp, Homo sapiens
gctgggccgacctgggctgcag

SEQ ID NO: 7916399 - DNA, 22 bp, Homo sapiens
gctgggccgacctgggctgcag

SEQ ID NO: 7916400 - DNA, 22 bp, Homo sapiens
gctgggccgacctgggctgcag

SEQ ID NO: 7916401 - DNA, 22 bp, Homo sapiens
gctgggccgacctgggctgcag

SEQ ID NO: 7916402 - DNA, 22 bp, Homo sapiens
gctgggccctgggtgccctagc

SEQ ID NO: 7916403 - DNA, 22 bp, Homo sapiens
gctgggccctgggtgccctagc

SEQ ID NO: 7916404 - DNA, 22 bp, Homo sapiens
gctgggccctgggtgccctagc

SEQ ID NO: 7916405 - DNA, 22 bp, Homo sapiens
gctgggccctgggtgccctagc

SEQ ID NO: 7916406 - DNA, 22 bp, Homo sapiens
gctgggccgacctgggctgcag

SEQ ID NO: 7916407 - DNA, 20 bp, Homo sapiens
gctgggctaccactggccct

SEQ ID NO: 7916408 - DNA, 20 bp, Homo sapiens
gctgggctaccactggccct

SEQ ID NO: 7916409 - DNA, 20 bp, Homo sapiens
gctgggctaccactggccct

SEQ ID NO: 7916410 - DNA, 20 bp, Homo sapiens
gctgggctaccactggccct

SEQ ID NO: 7916411 - DNA, 22 bp, Homo sapiens
gctgggccttccgattctcaag

SEQ ID NO: 7916412 - DNA, 22 bp, Homo sapiens
gctgggccttccgattctcaag

SEQ ID NO: 7916413 - DNA, 22 bp, Homo sapiens
gctgggccttccgattctcaag

SEQ ID NO: 7916414 - DNA, 22 bp, Homo sapiens
gctgggccttccgattctcaag

SEQ ID NO: 7916415 - DNA, 20 bp, Homo sapiens
gctgggctaccactggccct

SEQ ID NO: 7916416 - DNA, 20 bp, Homo sapiens
gctgggctaccactggccct

SEQ ID NO: 7916417 - DNA, 21 bp, Homo sapiens
gctgggcctgtacttgccctg

SEQ ID NO: 7916418 - DNA, 21 bp, Homo sapiens
gctgggcctgtacttgccctg

SEQ ID NO: 7916419 - DNA, 21 bp, Homo sapiens
gctgggcctgtacttgccctg

SEQ ID NO: 7916420 - DNA, 21 bp, Homo sapiens
gctgggcctgtacttgccctg

SEQ ID NO: 7916421 - DNA, 21 bp, Homo sapiens
gctgggcctgtacttgccctg

SEQ ID NO: 7916422 - DNA, 22 bp, Homo sapiens
gctgggccgacctgggctgcag

SEQ ID NO: 7916423 - DNA, 22 bp, Homo sapiens
gctgggagccctggtctgctcc

SEQ ID NO: 7916424 - DNA, 22 bp, Homo sapiens
gctgggagccctggtctgctcc

SEQ ID NO: 7916425 - DNA, 22 bp, Homo sapiens
gctgggagccccgagccagcgc

SEQ ID NO: 7916426 - DNA, 22 bp, Homo sapiens
gctgggagccccgagccagcgc

SEQ ID NO: 7916427 - DNA, 22 bp, Homo sapiens
gctgggagccccgagccagcgc

SEQ ID NO: 7916428 - DNA, 22 bp, Homo sapiens
gctgggagccccgagccagcgc

SEQ ID NO: 7916429 - DNA, 22 bp, Homo sapiens
gctgggagccccgagccagcgc

SEQ ID NO: 7916430 - DNA, 22 bp, Homo sapiens
gctgggagccccgagccagcgc

SEQ ID NO: 7916431 - DNA, 22 bp, Homo sapiens
gctgggagcaaagccatgcata

SEQ ID NO: 7916432 - DNA, 22 bp, Homo sapiens
gctggctgtgattttgccaaca

SEQ ID NO: 7916433 - DNA, 22 bp, Homo sapiens
gctggctgtgattttgccaaca

SEQ ID NO: 7916434 - DNA, 22 bp, Homo sapiens
gctgggagcaagtactcatctt

SEQ ID NO: 7916435 - DNA, 22 bp, Homo sapiens
gctgggagcaagtactcatctt

SEQ ID NO: 7916436 - DNA, 22 bp, Homo sapiens
gctgggagcaaagccatgcata

SEQ ID NO: 7916437 - DNA, 22 bp, Homo sapiens
gctggccatagaagccaaagag

SEQ ID NO: 7916438 - DNA, 22 bp, Homo sapiens
gctggccagtgtggtgaccacc

SEQ ID NO: 7916439 - DNA, 22 bp, Homo sapiens
gctggccatagaagccaaagag

SEQ ID NO: 7916440 - DNA, 22 bp, Homo sapiens
gctggccatggcctgcgccatc

SEQ ID NO: 7916441 - DNA, 22 bp, Homo sapiens
gctggccatggggagtgaggag

SEQ ID NO: 7916442 - DNA, 22 bp, Homo sapiens
gctggccatatattttgctgtt

SEQ ID NO: 7916443 - DNA, 22 bp, Homo sapiens
gctggccatggcctgcgccatc

SEQ ID NO: 7916444 - DNA, 22 bp, Homo sapiens
gctggccatggcctgcgccatc

SEQ ID NO: 7916445 - DNA, 22 bp, Homo sapiens
gctggccatggggagtgaggag

SEQ ID NO: 7916446 - DNA, 22 bp, Homo sapiens
gctggccatggggagtgaggag

SEQ ID NO: 7916447 - DNA, 22 bp, Homo sapiens
gctggccatggggagtgaggag

SEQ ID NO: 7916448 - DNA, 22 bp, Homo sapiens
gctggcccagcgcccagggcag

SEQ ID NO: 7916449 - DNA, 22 bp, Homo sapiens
gctggcccagcgcccagggcag

SEQ ID NO: 7916450 - DNA, 22 bp, Homo sapiens
gctggcccagcgcccagggcag

SEQ ID NO: 7916451 - DNA, 22 bp, Homo sapiens
gctggcccagcgcccagggcag

SEQ ID NO: 7916452 - DNA, 22 bp, Homo sapiens
gctggcccagcgcccagggcag

SEQ ID NO: 7916453 - DNA, 22 bp, Homo sapiens
gctggcccagcgcccagggcag

SEQ ID NO: 7916454 - DNA, 20 bp, Homo sapiens
gctgaggtcattatgcctca

SEQ ID NO: 7916455 - DNA, 22 bp, Homo sapiens
gctgaggtccagcattcgccta

SEQ ID NO: 7916456 - DNA, 20 bp, Homo sapiens
gctgaggtccctgtggtttt

SEQ ID NO: 7916457 - DNA, 20 bp, Homo sapiens
gctgaggtccctgtggtttt

SEQ ID NO: 7916458 - DNA, 20 bp, Homo sapiens
gctgaggtccctgtggtttt

SEQ ID NO: 7916459 - DNA, 22 bp, Homo sapiens
gctgaggtggagattgcagtga

SEQ ID NO: 7916460 - DNA, 22 bp, Homo sapiens
gctgaggtgaggctggaaagga

SEQ ID NO: 7916461 - DNA, 23 bp, Homo sapiens
gctgaggtcctgctgagtggtgg

SEQ ID NO: 7916462 - DNA, 23 bp, Homo sapiens
gctgaggtcctgctgagtggtgg

SEQ ID NO: 7916463 - DNA, 22 bp, Homo sapiens
caaatttaggtaacagtctgta

SEQ ID NO: 7916464 - DNA, 22 bp, Homo sapiens
caaatttaggtaacagtctgta

SEQ ID NO: 7916465 - DNA, 22 bp, Homo sapiens
caaatttaggtaacagtctgta

SEQ ID NO: 7916466 - DNA, 22 bp, Homo sapiens
caaatttaggtaacagtctgta

SEQ ID NO: 7916467 - DNA, 22 bp, Homo sapiens
caaatttaggtaacagtctgta

SEQ ID NO: 7916468 - DNA, 23 bp, Homo sapiens
gctgaggtacatttacaggaaga

SEQ ID NO: 7916469 - DNA, 22 bp, Homo sapiens
gctgaggtaggaggttgcagtg

SEQ ID NO: 7916470 - DNA, 22 bp, Homo sapiens
gctgaggtaggaggttgcagtg

SEQ ID NO: 7916471 - DNA, 22 bp, Homo sapiens
gctgaggtcaggagctgtgggg

SEQ ID NO: 7916472 - DNA, 22 bp, Homo sapiens
gctgaggtcaggagctgtgggg

SEQ ID NO: 7916473 - DNA, 22 bp, Homo sapiens
gctgaggtcaggagctgtgggg

SEQ ID NO: 7916474 - DNA, 22 bp, Homo sapiens
caaattcagaaaattggtagag

SEQ ID NO: 7916475 - DNA, 22 bp, Homo sapiens
caaattcagaaaattggtagag

SEQ ID NO: 7916476 - DNA, 18 bp, Homo sapiens
caaattcagtgctggaag

SEQ ID NO: 7916477 - DNA, 18 bp, Homo sapiens
caaattcagtgctggaag

SEQ ID NO: 7916478 - DNA, 23 bp, Homo sapiens
caaattctaggcaggctcttttg

SEQ ID NO: 7916479 - DNA, 22 bp, Homo sapiens
caaattcctcagaatcagaaaa

SEQ ID NO: 7916480 - DNA, 18 bp, Homo sapiens
caaattcagtgctggaag

SEQ ID NO: 7916481 - DNA, 22 bp, Homo sapiens
caaattctcttactgtttgaca

SEQ ID NO: 7916482 - DNA, 20 bp, Homo sapiens
caaattctgttgaatacacc

SEQ ID NO: 7916483 - DNA, 22 bp, Homo sapiens
caaattctcaccctgtttgatt

SEQ ID NO: 7916484 - DNA, 18 bp, Homo sapiens
caaattctcattgatttc

SEQ ID NO: 7916485 - DNA, 22 bp, Homo sapiens
caaatttaagtgaggtctttgt

SEQ ID NO: 7916486 - DNA, 20 bp, Homo sapiens
caaattctgttgaatacacc

SEQ ID NO: 7916487 - DNA, 22 bp, Homo sapiens
caaattgctaactgtcagacta

SEQ ID NO: 7916488 - DNA, 22 bp, Homo sapiens
caaatttaagttagaaagcaat

SEQ ID NO: 7916489 - DNA, 22 bp, Homo sapiens
caaatttaagttagaaagcaat

SEQ ID NO: 7916490 - DNA, 22 bp, Homo sapiens
caaatttaagttagaaagcaat

SEQ ID NO: 7916491 - DNA, 22 bp, Homo sapiens
caaatttaagttagaaagcaat

SEQ ID NO: 7916492 - DNA, 22 bp, Homo sapiens
caaatttaggtaacagtctgta

SEQ ID NO: 7916493 - DNA, 22 bp, Homo sapiens
gctggcagagagctggtgagga

SEQ ID NO: 7916494 - DNA, 22 bp, Homo sapiens
gctggcagagctctgggctggg

SEQ ID NO: 7916495 - DNA, 22 bp, Homo sapiens
gctggcagagctctgggctggg

SEQ ID NO: 7916496 - DNA, 22 bp, Homo sapiens
gctggcagagagctggtgagga

SEQ ID NO: 7916497 - DNA, 22 bp, Homo sapiens
gctggcagagagctggtgagga

SEQ ID NO: 7916498 - DNA, 22 bp, Homo sapiens
gctggcagagctctgggctggg

SEQ ID NO: 7916499 - DNA, 20 bp, Homo sapiens
gctggcagatgtcttgagat

SEQ ID NO: 7916500 - DNA, 22 bp, Homo sapiens
gctggcagagctctgggctggg

SEQ ID NO: 7916501 - DNA, 22 bp, Homo sapiens
gctggcagagctctgggctggg

SEQ ID NO: 7916502 - DNA, 22 bp, Homo sapiens
gctggcagagctctgggctggg

SEQ ID NO: 7916503 - DNA, 22 bp, Homo sapiens
gctggcagagctctgggctggg

SEQ ID NO: 7916504 - DNA, 22 bp, Homo sapiens
gctggaggctggagtgcagtgg

SEQ ID NO: 7916505 - DNA, 16 bp, Homo sapiens
gctggagggaggggtt

SEQ ID NO: 7916506 - DNA, 22 bp, Homo sapiens
gctggaggctggagtgcagtgg

SEQ ID NO: 7916507 - DNA, 16 bp, Homo sapiens
gctggagggaggggtt

SEQ ID NO: 7916508 - DNA, 16 bp, Homo sapiens
gctggagggaggggtt

SEQ ID NO: 7916509 - DNA, 22 bp, Homo sapiens
gctggcagagagctggtgagga

SEQ ID NO: 7916510 - DNA, 22 bp, Homo sapiens
gctggcagagagctggtgagga

SEQ ID NO: 7916511 - DNA, 22 bp, Homo sapiens
gctggcagagagctggtgagga

SEQ ID NO: 7916512 - DNA, 16 bp, Homo sapiens
gctggagggaggggtt

SEQ ID NO: 7916513 - DNA, 22 bp, Homo sapiens
gctggcagagagctggtgagga

SEQ ID NO: 7916514 - DNA, 22 bp, Homo sapiens
gctggcagagagctggtgagga

SEQ ID NO: 7916515 - DNA, 19 bp, Homo sapiens
gctgaggtggaggaaggag

SEQ ID NO: 7916516 - DNA, 19 bp, Homo sapiens
gctgaggtggaggaaggag

SEQ ID NO: 7916517 - DNA, 22 bp, Homo sapiens
gctgaggtggagattgcagtga

SEQ ID NO: 7916518 - DNA, 19 bp, Homo sapiens
gctggcagatgtggccgtg

SEQ ID NO: 7916519 - DNA, 22 bp, Homo sapiens
gctggcagcattagaccctggg

SEQ ID NO: 7916520 - DNA, 22 bp, Homo sapiens
gctggcagcattagaccctggg

SEQ ID NO: 7916521 - DNA, 22 bp, Homo sapiens
gctggcagcattagaccctggg

SEQ ID NO: 7916522 - DNA, 22 bp, Homo sapiens
gctggcagcattagaccctggg

SEQ ID NO: 7916523 - DNA, 22 bp, Homo sapiens
gctggcagcattagaccctggg

SEQ ID NO: 7916524 - DNA, 19 bp, Homo sapiens
gctggcagatgtggccgtg

SEQ ID NO: 7916525 - DNA, 19 bp, Homo sapiens
gctggcagatgtggccgtg

SEQ ID NO: 7916526 - DNA, 20 bp, Homo sapiens
gctggcagatgtcttgagat

SEQ ID NO: 7916527 - DNA, 20 bp, Homo sapiens
gctggcagatgtcttgagat

SEQ ID NO: 7916528 - DNA, 20 bp, Homo sapiens
gctggcagatgtcttgagat

SEQ ID NO: 7916529 - DNA, 19 bp, Homo sapiens
gctggcagatgtggccgtg

SEQ ID NO: 7916530 - DNA, 22 bp, Homo sapiens
gctggcagcattagaccctggg

SEQ ID NO: 7916531 - DNA, 22 bp, Homo sapiens
gctggcagccaagtgaagaggg

SEQ ID NO: 7916532 - DNA, 22 bp, Homo sapiens
gctggcagccaagtgaagaggg

SEQ ID NO: 7916533 - DNA, 22 bp, Homo sapiens
gctggcagccaagtgaagaggg

SEQ ID NO: 7916534 - DNA, 22 bp, Homo sapiens
gctggcagccaagtgaagaggg

SEQ ID NO: 7916535 - DNA, 22 bp, Homo sapiens
gctggcagccaagtgaagaggg

SEQ ID NO: 7916536 - DNA, 22 bp, Homo sapiens
gctggccagtgtggtgaccacc

SEQ ID NO: 7916537 - DNA, 22 bp, Homo sapiens
gctggccagtgtcccagggatc

SEQ ID NO: 7916538 - DNA, 22 bp, Homo sapiens
gctggccagtgtggtgaccacc

SEQ ID NO: 7916539 - DNA, 22 bp, Homo sapiens
gctggccagtgtggtgaccacc

SEQ ID NO: 7916540 - DNA, 22 bp, Homo sapiens
gtctctgtcttaggccaggcct

SEQ ID NO: 7916541 - DNA, 22 bp, Homo sapiens
gtctctgtcttaggccaggcct

SEQ ID NO: 7916542 - DNA, 22 bp, Homo sapiens
gtctctgtcatttcaccttccc

SEQ ID NO: 7916543 - DNA, 22 bp, Homo sapiens
gtctctgtcacaactactcatc

SEQ ID NO: 7916544 - DNA, 22 bp, Homo sapiens
gtctctgggttaagcagtgcat

SEQ ID NO: 7916545 - DNA, 22 bp, Homo sapiens
gtctctgggttaagcagtgcat

SEQ ID NO: 7916546 - DNA, 22 bp, Homo sapiens
gtctctgggttaagcagtgcat

SEQ ID NO: 7916547 - DNA, 22 bp, Homo sapiens
gtctctgggttaagcagtgcat

SEQ ID NO: 7916548 - DNA, 22 bp, Homo sapiens
gtctctggctttatgctggttt

SEQ ID NO: 7916549 - DNA, 22 bp, Homo sapiens
gtctctggctttatgctggttt

SEQ ID NO: 7916550 - DNA, 22 bp, Homo sapiens
gtctctggctttatgctggttt

SEQ ID NO: 7916551 - DNA, 22 bp, Homo sapiens
gtctccagaagcctagacagcc

SEQ ID NO: 7916552 - DNA, 22 bp, Homo sapiens
gtctctgggtgtgtgatgccaa

SEQ ID NO: 7916553 - DNA, 22 bp, Homo sapiens
gtctctgggttaagcagtgcat

SEQ ID NO: 7916554 - DNA, 22 bp, Homo sapiens
gtctctgggttaagcagtgcat

SEQ ID NO: 7916555 - DNA, 22 bp, Homo sapiens
gtctctgggtgtgtgatgccaa

SEQ ID NO: 7916556 - DNA, 22 bp, Homo sapiens
gtctctgtggtacgtttcatcc

SEQ ID NO: 7916557 - DNA, 22 bp, Homo sapiens
gtctctgtgtctgagagagccc

SEQ ID NO: 7916558 - DNA, 22 bp, Homo sapiens
gtctcttagaatcgcatattgt

SEQ ID NO: 7916559 - DNA, 22 bp, Homo sapiens
gtctctgtggtacgtttcatcc

SEQ ID NO: 7916560 - DNA, 22 bp, Homo sapiens
gtctctgtggctggctccttcc

SEQ ID NO: 7916561 - DNA, 22 bp, Homo sapiens
gtctctgtggctggctccttcc

SEQ ID NO: 7916562 - DNA, 22 bp, Homo sapiens
gtctctgtgccttctccccacc

SEQ ID NO: 7916563 - DNA, 22 bp, Homo sapiens
gtctctgtgcccccatttccgt

SEQ ID NO: 7916564 - DNA, 17 bp, Homo sapiens
gtctctgtcttgctttt

SEQ ID NO: 7916565 - DNA, 22 bp, Homo sapiens
gtctcagtaagaaaggctcctg

SEQ ID NO: 7916566 - DNA, 22 bp, Homo sapiens
gtctcaggttcgagcctcctta

SEQ ID NO: 7916567 - DNA, 22 bp, Homo sapiens
gtctcaggtattgaatgggaac

SEQ ID NO: 7916568 - DNA, 22 bp, Homo sapiens
gtctcagggctgagggcagtgg

SEQ ID NO: 7916569 - DNA, 22 bp, Homo sapiens
gtctcagtaagaaaggctcctg

SEQ ID NO: 7916570 - DNA, 22 bp, Homo sapiens
gtctcagtgcccaatgccataa

SEQ ID NO: 7916571 - DNA, 22 bp, Homo sapiens
gtctcagtgggagggtgatggg

SEQ ID NO: 7916572 - DNA, 22 bp, Homo sapiens
gtctcagtgggagggtgatggg

SEQ ID NO: 7916573 - DNA, 22 bp, Homo sapiens
gtctcaggtattgaatgggaac

SEQ ID NO: 7916574 - DNA, 22 bp, Homo sapiens
gtctcagggactgcttctgggg

SEQ ID NO: 7916575 - DNA, 22 bp, Homo sapiens
gtctcagggactgcttctgggg

SEQ ID NO: 7916576 - DNA, 22 bp, Homo sapiens
gtctcagggactgcttctgggg

SEQ ID NO: 7916577 - DNA, 22 bp, Homo sapiens
gtctcagattcagacatctaca

SEQ ID NO: 7916578 - DNA, 22 bp, Homo sapiens
gtctcagattcagacatctaca

SEQ ID NO: 7916579 - DNA, 22 bp, Homo sapiens
gtctcagattcagacatctaca

SEQ ID NO: 7916580 - DNA, 22 bp, Homo sapiens
gtctcagattcagacatctaca

SEQ ID NO: 7916581 - DNA, 18 bp, Homo sapiens
gtctcaggagtggcacgt

SEQ ID NO: 7916582 - DNA, 22 bp, Homo sapiens
gtctcagataacatgtattcta

SEQ ID NO: 7916583 - DNA, 22 bp, Homo sapiens
gtctcagataacatgtattcta

SEQ ID NO: 7916584 - DNA, 22 bp, Homo sapiens
gtctcagagtcctacttattcc

SEQ ID NO: 7916585 - DNA, 22 bp, Homo sapiens
gtctcagagagctactctctta

SEQ ID NO: 7916586 - DNA, 22 bp, Homo sapiens
gtctcagagtcctacttattcc

SEQ ID NO: 7916587 - DNA, 22 bp, Homo sapiens
gtctccacagcccagctgccac

SEQ ID NO: 7916588 - DNA, 22 bp, Homo sapiens
gtctccacagcccagctgccac

SEQ ID NO: 7916589 - DNA, 22 bp, Homo sapiens
gtctcattggttctgccagagt

SEQ ID NO: 7916590 - DNA, 22 bp, Homo sapiens
gtctcagtttgaagtgatgcca

SEQ ID NO: 7916591 - DNA, 22 bp, Homo sapiens
gtctcagtttgaagtgatgcca

SEQ ID NO: 7916592 - DNA, 22 bp, Homo sapiens
gtctcatatgatataaatgcag

SEQ ID NO: 7916593 - DNA, 22 bp, Homo sapiens
gtctcagttactctccctggta

SEQ ID NO: 7916594 - DNA, 22 bp, Homo sapiens
gtctcagttactctccctggta

SEQ ID NO: 7916595 - DNA, 22 bp, Homo sapiens
gtctcagtgtcacctccagctg

SEQ ID NO: 7916596 - DNA, 22 bp, Homo sapiens
gtctcagttgtatcacctggtt

SEQ ID NO: 7916597 - DNA, 22 bp, Homo sapiens
gtctcagtttgaagtgatgcca

SEQ ID NO: 7916598 - DNA, 20 bp, Homo sapiens
gtctccactgggggttaacc

SEQ ID NO: 7916599 - DNA, 20 bp, Homo sapiens
gtctccactgggggttaacc

SEQ ID NO: 7916600 - DNA, 22 bp, Homo sapiens
gtctccagaagcctagacagcc

SEQ ID NO: 7916601 - DNA, 22 bp, Homo sapiens
gtctccagaagcctagacagcc

SEQ ID NO: 7916602 - DNA, 22 bp, Homo sapiens
gtctccactaaaaactttcacg

SEQ ID NO: 7916603 - DNA, 20 bp, Homo sapiens
gtctccactgggggttaacc

SEQ ID NO: 7916604 - DNA, 22 bp, Homo sapiens
gtctttctgccatgtgaagaga

SEQ ID NO: 7916605 - DNA, 22 bp, Homo sapiens
gtctttctctggaacagtaaaa

SEQ ID NO: 7916606 - DNA, 22 bp, Homo sapiens
gtctttctctggaacagtaaaa

SEQ ID NO: 7916607 - DNA, 22 bp, Homo sapiens
gtctttctatgcatagagcaga

SEQ ID NO: 7916608 - DNA, 22 bp, Homo sapiens
gtctttcttaaacaacagaaca

SEQ ID NO: 7916609 - DNA, 22 bp, Homo sapiens
gtctttcttaaacaacagaaca

SEQ ID NO: 7916610 - DNA, 22 bp, Homo sapiens
gtctttcttaattcaagtgctt

SEQ ID NO: 7916611 - DNA, 22 bp, Homo sapiens
gtctttcttaattcaagtgctt

SEQ ID NO: 7916612 - DNA, 22 bp, Homo sapiens
gtctttcttaaacaacagaaca

SEQ ID NO: 7916613 - DNA, 19 bp, Homo sapiens
gtcttacaggcaacatgag

SEQ ID NO: 7916614 - DNA, 22 bp, Homo sapiens
gtcttacccacagcatctagaa

SEQ ID NO: 7916615 - DNA, 22 bp, Homo sapiens
gtctgttagtgataactgtttt

SEQ ID NO: 7916616 - DNA, 22 bp, Homo sapiens
gtctgtttggggacctgtggcc

SEQ ID NO: 7916617 - DNA, 22 bp, Homo sapiens
gtctgttttctcttctgtggga

SEQ ID NO: 7916618 - DNA, 22 bp, Homo sapiens
gtcttaaaatcagaggatatag

SEQ ID NO: 7916619 - DNA, 17 bp, Homo sapiens
gtctcttagcaccgtat

SEQ ID NO: 7916620 - DNA, 22 bp, Homo sapiens
gtctcttagtcaatattttctg

SEQ ID NO: 7916621 - DNA, 22 bp, Homo sapiens
gtctcttatgggcaggagcaca

SEQ ID NO: 7916622 - DNA, 22 bp, Homo sapiens
gtctcttatgggcaggagcaca

SEQ ID NO: 7916623 - DNA, 22 bp, Homo sapiens
gtctttggatgtaagataaagt

SEQ ID NO: 7916624 - DNA, 18 bp, Homo sapiens
gtctttggagtggaggta

SEQ ID NO: 7916625 - DNA, 22 bp, Homo sapiens
gtctttggatgtaagataaagt

SEQ ID NO: 7916626 - DNA, 18 bp, Homo sapiens
gtctttggagtggaggta

SEQ ID NO: 7916627 - DNA, 22 bp, Homo sapiens
gtctttggatgtaagataaagt

SEQ ID NO: 7916628 - DNA, 22 bp, Homo sapiens
gtgaagtgcaaagcagccagtt

SEQ ID NO: 7916629 - DNA, 22 bp, Homo sapiens
gtgaaggtgtgagccagctgca

SEQ ID NO: 7916630 - DNA, 22 bp, Homo sapiens
gtgaagtaagtactattaagat

SEQ ID NO: 7916631 - DNA, 22 bp, Homo sapiens
gtctttggagaggtgccatttc

SEQ ID NO: 7916632 - DNA, 22 bp, Homo sapiens
gtctttggagaggtgccatttc

SEQ ID NO: 7916633 - DNA, 22 bp, Homo sapiens
gtctttggagaggtgccatttc

SEQ ID NO: 7916634 - DNA, 22 bp, Homo sapiens
gtctttggagaggtgccatttc

SEQ ID NO: 7916635 - DNA, 22 bp, Homo sapiens
gtctttggaggcactgttgagt

SEQ ID NO: 7916636 - DNA, 18 bp, Homo sapiens
gtctttggagtggaggta

SEQ ID NO: 7916637 - DNA, 22 bp, Homo sapiens
gtctttggaggcactgttgagt

SEQ ID NO: 7916638 - DNA, 22 bp, Homo sapiens
gtctttggaaagacaaagttca

SEQ ID NO: 7916639 - DNA, 22 bp, Homo sapiens
gtctttggaaagacaaagttca

SEQ ID NO: 7916640 - DNA, 22 bp, Homo sapiens
gtctttcttcagagcttggact

SEQ ID NO: 7916641 - DNA, 22 bp, Homo sapiens
gtctttcttaattcaagtgctt

SEQ ID NO: 7916642 - DNA, 22 bp, Homo sapiens
gtctttcttcagagcttggact

SEQ ID NO: 7916643 - DNA, 22 bp, Homo sapiens
gtctttgccacacttctgtaca

SEQ ID NO: 7916644 - DNA, 22 bp, Homo sapiens
gtctttcttcagagcttggact

SEQ ID NO: 7916645 - DNA, 22 bp, Homo sapiens
gtctttgctgtctttgctctca

SEQ ID NO: 7916646 - DNA, 22 bp, Homo sapiens
gtgcagctgcccaagcctgagc

SEQ ID NO: 7916647 - DNA, 22 bp, Homo sapiens
gtgcagctgcccaagcctgagc

SEQ ID NO: 7916648 - DNA, 22 bp, Homo sapiens
gtgcagctgccgatcagatagg

SEQ ID NO: 7916649 - DNA, 16 bp, Homo sapiens
gtgcagctgcctggta

SEQ ID NO: 7916650 - DNA, 22 bp, Homo sapiens
gtgcagctggtggagtctgggg

SEQ ID NO: 7916651 - DNA, 22 bp, Homo sapiens
gtgcagctggtggagtctgggg

SEQ ID NO: 7916652 - DNA, 22 bp, Homo sapiens
gtgcagctgggcgctgaccttc

SEQ ID NO: 7916653 - DNA, 22 bp, Homo sapiens
gtgcagctgggcgctgaccttc

SEQ ID NO: 7916654 - DNA, 22 bp, Homo sapiens
gtgcagctgcttgcctggttag

SEQ ID NO: 7916655 - DNA, 22 bp, Homo sapiens
gtgcagctgcttgcctggttag

SEQ ID NO: 7916656 - DNA, 22 bp, Homo sapiens
gtgcagctgcaggagtcaggtc

SEQ ID NO: 7916657 - DNA, 22 bp, Homo sapiens
gtgcagctgagggcctcttcta

SEQ ID NO: 7916658 - DNA, 22 bp, Homo sapiens
gtgcagctgagggcctcttcta

SEQ ID NO: 7916659 - DNA, 22 bp, Homo sapiens
gtgcagctgcaggagtcaggtc

SEQ ID NO: 7916660 - DNA, 22 bp, Homo sapiens
gtgcagctgcccaagcctgagc

SEQ ID NO: 7916661 - DNA, 22 bp, Homo sapiens
gtgcagctgaaggctggccagc

SEQ ID NO: 7916662 - DNA, 22 bp, Homo sapiens
gtgcagctgagggcctcttcta

SEQ ID NO: 7916663 - DNA, 22 bp, Homo sapiens
gtgcagctcagttgaaatgcag

SEQ ID NO: 7916664 - DNA, 22 bp, Homo sapiens
gtgcagctgaaggctggccagc

SEQ ID NO: 7916665 - DNA, 22 bp, Homo sapiens
gtgcagctgtgtgagagctcca

SEQ ID NO: 7916666 - DNA, 22 bp, Homo sapiens
gtgcagctgtgtgagagctcca

SEQ ID NO: 7916667 - DNA, 22 bp, Homo sapiens
gtgcagcttcctggtctcagcc

SEQ ID NO: 7916668 - DNA, 22 bp, Homo sapiens
gtgcagcttcctggtctcagcc

SEQ ID NO: 7916669 - DNA, 22 bp, Homo sapiens
gtgcagcttcctggtctcagcc

SEQ ID NO: 7916670 - DNA, 22 bp, Homo sapiens
gtgcagctgtggtggagccagg

SEQ ID NO: 7916671 - DNA, 22 bp, Homo sapiens
gtgcagctgtggtggagccagg

SEQ ID NO: 7916672 - DNA, 22 bp, Homo sapiens
gtgcagctggtggagtctgggg

SEQ ID NO: 7916673 - DNA, 22 bp, Homo sapiens
gtgcagctggtggagtctgggg

SEQ ID NO: 7916674 - DNA, 22 bp, Homo sapiens
gtgcagctgtggtggagccagg

SEQ ID NO: 7916675 - DNA, 22 bp, Homo sapiens
gtgcaggagcaggagccatgtc

SEQ ID NO: 7916676 - DNA, 22 bp, Homo sapiens
gtgcaggagcaggagccatgtc

SEQ ID NO: 7916677 - DNA, 22 bp, Homo sapiens
gtgcaggagcaggagccatgtc

SEQ ID NO: 7916678 - DNA, 22 bp, Homo sapiens
gtgcaggagccaggggtaggaa

SEQ ID NO: 7916679 - DNA, 22 bp, Homo sapiens
gtgcaggagccaggggtaggaa

SEQ ID NO: 7916680 - DNA, 22 bp, Homo sapiens
gtgcaggagccaggggtaggaa

SEQ ID NO: 7916681 - DNA, 22 bp, Homo sapiens
gtgcaggagccaggggtaggaa

SEQ ID NO: 7916682 - DNA, 22 bp, Homo sapiens
gtgcaggagccaggggtaggaa

SEQ ID NO: 7916683 - DNA, 22 bp, Homo sapiens
gtgcaaaatttggccaataaca

SEQ ID NO: 7916684 - DNA, 22 bp, Homo sapiens
gtgcaaaatttggccaataaca

SEQ ID NO: 7916685 - DNA, 22 bp, Homo sapiens
gtgcaaaatttggccaataaca

SEQ ID NO: 7916686 - DNA, 22 bp, Homo sapiens
gtgcaaacatcatagagtgtac

SEQ ID NO: 7916687 - DNA, 23 bp, Homo sapiens
gtgcaaagatataccacatggct

SEQ ID NO: 7916688 - DNA, 22 bp, Homo sapiens
gtgcaaacatcatagagtgtac

SEQ ID NO: 7916689 - DNA, 16 bp, Homo sapiens
gtgcaaaagtgaggag

SEQ ID NO: 7916690 - DNA, 16 bp, Homo sapiens
gtgcaaaagtgaggag

SEQ ID NO: 7916691 - DNA, 16 bp, Homo sapiens
gtgcaaaagtgaggag

SEQ ID NO: 7916692 - DNA, 22 bp, Homo sapiens
gtgcaaaatgatatcctgaagc

SEQ ID NO: 7916693 - DNA, 22 bp, Homo sapiens
gtgcaaaatgatatcctgaagc

SEQ ID NO: 7916694 - DNA, 22 bp, Homo sapiens
gtgcaaagtgcatggggaaggg

SEQ ID NO: 7916695 - DNA, 22 bp, Homo sapiens
gtgcaaagtgcatggggaaggg

SEQ ID NO: 7916696 - DNA, 22 bp, Homo sapiens
gtgcaaatgtaattgcagtttt

SEQ ID NO: 7916697 - DNA, 22 bp, Homo sapiens
gtgcagcaggggccctctcacc

SEQ ID NO: 7916698 - DNA, 22 bp, Homo sapiens
gtgcagcagggggaagacagtg

SEQ ID NO: 7916699 - DNA, 23 bp, Homo sapiens
gtgcagcagtgtctgcagtcatg

SEQ ID NO: 7916700 - DNA, 23 bp, Homo sapiens
gtgcagcagtgtctgcagtcatg

SEQ ID NO: 7916701 - DNA, 22 bp, Homo sapiens
gtgcagctactccttggtccta

SEQ ID NO: 7916702 - DNA, 22 bp, Homo sapiens
gtgcagctcagttgaaatgcag

SEQ ID NO: 7916703 - DNA, 22 bp, Homo sapiens
gtgcagctactccttggtccta

SEQ ID NO: 7916704 - DNA, 22 bp, Homo sapiens
gtgcagccatttgcatgcttcc

SEQ ID NO: 7916705 - DNA, 22 bp, Homo sapiens
gtgcagcctgtcgccagtggat

SEQ ID NO: 7916706 - DNA, 22 bp, Homo sapiens
gtgcagcctgtcgccagtggat

SEQ ID NO: 7916707 - DNA, 20 bp, Homo sapiens
gtgcagccaagctgagccgc

SEQ ID NO: 7916708 - DNA, 22 bp, Homo sapiens
gtgcagccatttgcatgcttcc

SEQ ID NO: 7916709 - DNA, 20 bp, Homo sapiens
gtgcagccaagctgagccgc

SEQ ID NO: 7916710 - DNA, 20 bp, Homo sapiens
gtgcagccaagctgagccgc

SEQ ID NO: 7916711 - DNA, 20 bp, Homo sapiens
gtgcagccaagctgagccgc

SEQ ID NO: 7916712 - DNA, 23 bp, Homo sapiens
gtgaggtatattgaaatcatgct

SEQ ID NO: 7916713 - DNA, 22 bp, Homo sapiens
gtgaggtagcagagacagtgaa

SEQ ID NO: 7916714 - DNA, 22 bp, Homo sapiens
gtgcaaaagtaatggcagtttt

SEQ ID NO: 7916715 - DNA, 22 bp, Homo sapiens
gtgaggtcaccggccgttgcca

SEQ ID NO: 7916716 - DNA, 22 bp, Homo sapiens
gtgcaaaagtaatggcagtttt

SEQ ID NO: 7916717 - DNA, 22 bp, Homo sapiens
gtgaggtcaaagccttgggtat

SEQ ID NO: 7916718 - DNA, 22 bp, Homo sapiens
gtgcaaaagtaattacagtttt

SEQ ID NO: 7916719 - DNA, 22 bp, Homo sapiens
gtgcaaaagtaattacagtttt

SEQ ID NO: 7916720 - DNA, 22 bp, Homo sapiens
gtgcaaaagtaattacagtttt

SEQ ID NO: 7916721 - DNA, 22 bp, Homo sapiens
gtgcaaaagtaattgaggtttt

SEQ ID NO: 7916722 - DNA, 22 bp, Homo sapiens
gtgcaaaagtaattgaggtttt

SEQ ID NO: 7916723 - DNA, 22 bp, Homo sapiens
gtgcaaaagtaattgaggtttt

SEQ ID NO: 7916724 - DNA, 22 bp, Homo sapiens
gtgcaaaagtaattgcagtact

SEQ ID NO: 7916725 - DNA, 22 bp, Homo sapiens
gtgcaaaagtaattgcagtact

SEQ ID NO: 7916726 - DNA, 22 bp, Homo sapiens
gtgcaaaagtacttgcggattt

SEQ ID NO: 7916727 - DNA, 22 bp, Homo sapiens
gtgcaaaagtaattgtggtttt

SEQ ID NO: 7916728 - DNA, 22 bp, Homo sapiens
gtgcaaaagtaattgtggtttt

SEQ ID NO: 7916729 - DNA, 22 bp, Homo sapiens
gtgcaaaagtcattgtggtttt

SEQ ID NO: 7916730 - DNA, 22 bp, Homo sapiens
gtgcaaaagtacttgcggattt

SEQ ID NO: 7916731 - DNA, 22 bp, Homo sapiens
gtgcaaaagtcattgtggtttt

SEQ ID NO: 7916732 - DNA, 22 bp, Homo sapiens
gtgcaaaagtaattgctgtttt

SEQ ID NO: 7916733 - DNA, 22 bp, Homo sapiens
gtgcaaaagtaattgctgtttt

SEQ ID NO: 7916734 - DNA, 22 bp, Homo sapiens
gtgcaaaagtaattgcggtttt

SEQ ID NO: 7916735 - DNA, 22 bp, Homo sapiens
gtgcaaaagtaattgcggtttt

SEQ ID NO: 7916736 - DNA, 22 bp, Homo sapiens
gtgcaaaagtaattgcagtttt

SEQ ID NO: 7916737 - DNA, 22 bp, Homo sapiens
gtgcaaaagtaattgcagtttt

SEQ ID NO: 7916738 - DNA, 22 bp, Homo sapiens
gtgcaaaagtaattgcagtact

SEQ ID NO: 7916739 - DNA, 22 bp, Homo sapiens
gtgcaaaagtaattgcagtttt

SEQ ID NO: 7916740 - DNA, 22 bp, Homo sapiens
gtgcaaaagtaattgcagtact

SEQ ID NO: 7916741 - DNA, 22 bp, Homo sapiens
gtgcaaaagtaattgcagtact

SEQ ID NO: 7916742 - DNA, 21 bp, Homo sapiens
gtgaattaattatatgcctta

SEQ ID NO: 7916743 - DNA, 22 bp, Homo sapiens
gtgaggtaaactgtagttcaga

SEQ ID NO: 7916744 - DNA, 22 bp, Homo sapiens
gtgaattaaatatagccaggtc

SEQ ID NO: 7916745 - DNA, 22 bp, Homo sapiens
gtgaattaaatatagccaggtc

SEQ ID NO: 7916746 - DNA, 22 bp, Homo sapiens
gtgaatgtaaagtcatgtgact

SEQ ID NO: 7916747 - DNA, 22 bp, Homo sapiens
gtgaatggggcaggaaggatgg

SEQ ID NO: 7916748 - DNA, 22 bp, Homo sapiens
gtgaatggttgtgaacatcttt

SEQ ID NO: 7916749 - DNA, 17 bp, Homo sapiens
gtgaatggcatagtcgg

SEQ ID NO: 7916750 - DNA, 17 bp, Homo sapiens
gtgaatggcatagtcgg

SEQ ID NO: 7916751 - DNA, 22 bp, Homo sapiens
gtgaatggggcaggaaggatgg

SEQ ID NO: 7916752 - DNA, 22 bp, Homo sapiens
gtgaatgatagcttctctttgg

SEQ ID NO: 7916753 - DNA, 22 bp, Homo sapiens
gtgaatgacatattttgtactg

SEQ ID NO: 7916754 - DNA, 22 bp, Homo sapiens
gtgaatatgatcttatttggaa

SEQ ID NO: 7916755 - DNA, 21 bp, Homo sapiens
gtgaatatgcagcagaggcag

SEQ ID NO: 7916756 - DNA, 22 bp, Homo sapiens
gtgaataattttttagtataag

SEQ ID NO: 7916757 - DNA, 22 bp, Homo sapiens
gtgaataatcacccttctggat

SEQ ID NO: 7916758 - DNA, 22 bp, Homo sapiens
gtgaataatattgtttataaaa

SEQ ID NO: 7916759 - DNA, 22 bp, Homo sapiens
gtgaataactttctatgttaat

SEQ ID NO: 7916760 - DNA, 22 bp, Homo sapiens
gtgaataactttctatgttaat

SEQ ID NO: 7916761 - DNA, 22 bp, Homo sapiens
gtgaataaagggagttttcaaa

SEQ ID NO: 7916762 - DNA, 22 bp, Homo sapiens
gtgaagttttagtatatgtaga

SEQ ID NO: 7916763 - DNA, 22 bp, Homo sapiens
gtgaagttggccagtttagttt

SEQ ID NO: 7916764 - DNA, 22 bp, Homo sapiens
cagcaggtctcagcagctcctt

SEQ ID NO: 7916765 - DNA, 22 bp, Homo sapiens
cagcaggtctcagcagctcctt

SEQ ID NO: 7916766 - DNA, 22 bp, Homo sapiens
cagcaggtctgcatttgaggtc

SEQ ID NO: 7916767 - DNA, 22 bp, Homo sapiens
cagcaggtcctgggcgtggcct

SEQ ID NO: 7916768 - DNA, 22 bp, Homo sapiens
cagcaggtcccactgagggccc

SEQ ID NO: 7916769 - DNA, 22 bp, Homo sapiens
cagcaggtatgtttgttcagca

SEQ ID NO: 7916770 - DNA, 18 bp, Homo sapiens
cagcaggtagagtttggt

SEQ ID NO: 7916771 - DNA, 22 bp, Homo sapiens
cagcaggtcccactgagggccc

SEQ ID NO: 7916772 - DNA, 22 bp, Homo sapiens
cagcaggtcccactgagggccc

SEQ ID NO: 7916773 - DNA, 22 bp, Homo sapiens
cagcagggaagctgtgctgttt

SEQ ID NO: 7916774 - DNA, 22 bp, Homo sapiens
cagcagggaagctgtgctgttt

SEQ ID NO: 7916775 - DNA, 22 bp, Homo sapiens
cagcagggaagctgtgctgttt

SEQ ID NO: 7916776 - DNA, 22 bp, Homo sapiens
cagcagagctgtgtgggaaggg

SEQ ID NO: 7916777 - DNA, 22 bp, Homo sapiens
cagcagagctgtgtgggaaggg

SEQ ID NO: 7916778 - DNA, 22 bp, Homo sapiens
cagcagagctgtgtgggaaggg

SEQ ID NO: 7916779 - DNA, 22 bp, Homo sapiens
cagcagagctgtgtgggaaggg

SEQ ID NO: 7916780 - DNA, 22 bp, Homo sapiens
cagcagagctgtgtgggaaggg

SEQ ID NO: 7916781 - DNA, 22 bp, Homo sapiens
cagcagggaagctgtgctgttt

SEQ ID NO: 7916782 - DNA, 22 bp, Homo sapiens
cagcagggttaagtgactcacc

SEQ ID NO: 7916783 - DNA, 18 bp, Homo sapiens
cagcaggtagagtttggt

SEQ ID NO: 7916784 - DNA, 22 bp, Homo sapiens
cagcagagatgagattcctata

SEQ ID NO: 7916785 - DNA, 22 bp, Homo sapiens
cagcagagatgagattcctata

SEQ ID NO: 7916786 - DNA, 22 bp, Homo sapiens
cagcagagatgagattcctata

SEQ ID NO: 7916787 - DNA, 22 bp, Homo sapiens
cagcagagatgagattcctata

SEQ ID NO: 7916788 - DNA, 22 bp, Homo sapiens
cagcagagcatttggtaggagg

SEQ ID NO: 7916789 - DNA, 23 bp, Homo sapiens
cagcagagagcagacctttgtgt

SEQ ID NO: 7916790 - DNA, 23 bp, Homo sapiens
cagcagagagcagacctttgtgt

SEQ ID NO: 7916791 - DNA, 23 bp, Homo sapiens
cagcagagagcagacctttgtgt

SEQ ID NO: 7916792 - DNA, 23 bp, Homo sapiens
cagcagagagcagacctttgtgt

SEQ ID NO: 7916793 - DNA, 22 bp, Homo sapiens
cagcagagacggtaagcagaac

SEQ ID NO: 7916794 - DNA, 22 bp, Homo sapiens
cagcagagacggtaagcagaac

SEQ ID NO: 7916795 - DNA, 22 bp, Homo sapiens
cagcagagctgggctttgaatt

SEQ ID NO: 7916796 - DNA, 22 bp, Homo sapiens
cagcagagctgggctttgaatt

SEQ ID NO: 7916797 - DNA, 22 bp, Homo sapiens
cagcagagctgggctttgaatt

SEQ ID NO: 7916798 - DNA, 22 bp, Homo sapiens
cagcagagctgggaataaaatt

SEQ ID NO: 7916799 - DNA, 22 bp, Homo sapiens
cagcagagcatttggtaggagg

SEQ ID NO: 7916800 - DNA, 22 bp, Homo sapiens
cagcagagcatttggtaggagg

SEQ ID NO: 7916801 - DNA, 22 bp, Homo sapiens
cagcagagcatttggtaggagg

SEQ ID NO: 7916802 - DNA, 22 bp, Homo sapiens
cagcagagcatttggtaggagg

SEQ ID NO: 7916803 - DNA, 22 bp, Homo sapiens
cagcagagcatttggtaggagg

SEQ ID NO: 7916804 - DNA, 22 bp, Homo sapiens
cagcagtgcttcagtgtgagat

SEQ ID NO: 7916805 - DNA, 22 bp, Homo sapiens
cagcagtgcttcagtgtgagat

SEQ ID NO: 7916806 - DNA, 22 bp, Homo sapiens
cagcagtcttcccttccttttt

SEQ ID NO: 7916807 - DNA, 22 bp, Homo sapiens
cagcagtccctgcagtggggaa

SEQ ID NO: 7916808 - DNA, 22 bp, Homo sapiens
cagcagtccctgcagtggggaa

SEQ ID NO: 7916809 - DNA, 22 bp, Homo sapiens
cagcagtctgtttcaacaggtc

SEQ ID NO: 7916810 - DNA, 22 bp, Homo sapiens
cagcagtcaggcctgtgggaga

SEQ ID NO: 7916811 - DNA, 22 bp, Homo sapiens
cagcagtcaggcaaatgggagg

SEQ ID NO: 7916812 - DNA, 22 bp, Homo sapiens
cagcagtcaggcaaatgggagg

SEQ ID NO: 7916813 - DNA, 22 bp, Homo sapiens
cagcagtcaggcctgtgggaga

SEQ ID NO: 7916814 - DNA, 20 bp, Homo sapiens
cagcagtggatgagagtttt

SEQ ID NO: 7916815 - DNA, 20 bp, Homo sapiens
cagcagtggatgagagtttt

SEQ ID NO: 7916816 - DNA, 22 bp, Homo sapiens
cagcagtggccatctgtgtggt

SEQ ID NO: 7916817 - DNA, 22 bp, Homo sapiens
cagcagtggctgcaggcagctg

SEQ ID NO: 7916818 - DNA, 22 bp, Homo sapiens
cagcagtggctgcaggcagctg

SEQ ID NO: 7916819 - DNA, 22 bp, Homo sapiens
cagcagtggccatctgtgtggt

SEQ ID NO: 7916820 - DNA, 22 bp, Homo sapiens
cagcagtggctgcaggcagctg

SEQ ID NO: 7916821 - DNA, 22 bp, Homo sapiens
cagcagtgcttcagtgtgagat

SEQ ID NO: 7916822 - DNA, 22 bp, Homo sapiens
cagcagtggaactacccaggga

SEQ ID NO: 7916823 - DNA, 22 bp, Homo sapiens
cagcagtggaactacccaggga

SEQ ID NO: 7916824 - DNA, 22 bp, Homo sapiens
cagcagtggaactacccaggga

SEQ ID NO: 7916825 - DNA, 22 bp, Homo sapiens
cagcagtggaactacccaggga

SEQ ID NO: 7916826 - DNA, 22 bp, Homo sapiens
cagcagtggaactacccaggga

SEQ ID NO: 7916827 - DNA, 22 bp, Homo sapiens
cagcaggttaacagaggctggt

SEQ ID NO: 7916828 - DNA, 22 bp, Homo sapiens
cagcaggttaacagaggctggt

SEQ ID NO: 7916829 - DNA, 22 bp, Homo sapiens
cagcaggttctacgggtgagat

SEQ ID NO: 7916830 - DNA, 22 bp, Homo sapiens
cagcagtaactcccgtgcagca

SEQ ID NO: 7916831 - DNA, 22 bp, Homo sapiens
cagcagtagtctctgtggcttt

SEQ ID NO: 7916832 - DNA, 22 bp, Homo sapiens
cagcagtagtctctgtggcttt

SEQ ID NO: 7916833 - DNA, 22 bp, Homo sapiens
cagcagtcaggcaaatgggagg

SEQ ID NO: 7916834 - DNA, 22 bp, Homo sapiens
cagcagtcacacaaactctgga

SEQ ID NO: 7916835 - DNA, 22 bp, Homo sapiens
cagcagtacttctcagaggtat

SEQ ID NO: 7916836 - DNA, 22 bp, Homo sapiens
cagcagtaattagtgctgcatg

SEQ ID NO: 7916837 - DNA, 22 bp, Homo sapiens
cagcagtaattagtgctgcatg

SEQ ID NO: 7916838 - DNA, 22 bp, Homo sapiens
cagcagtaattagtgctgcatg

SEQ ID NO: 7916839 - DNA, 22 bp, Homo sapiens
cagcaggtgtctagcaagggtc

SEQ ID NO: 7916840 - DNA, 22 bp, Homo sapiens
cagcaggtgtctagcaagggtc

SEQ ID NO: 7916841 - DNA, 22 bp, Homo sapiens
cagcaggtgtctagcaagggtc

SEQ ID NO: 7916842 - DNA, 22 bp, Homo sapiens
cagcaggtgtccttttggtgga

SEQ ID NO: 7916843 - DNA, 22 bp, Homo sapiens
cagcaggtgggctttgcggatg

SEQ ID NO: 7916844 - DNA, 22 bp, Homo sapiens
cagcaggtgtccttttggtgga

SEQ ID NO: 7916845 - DNA, 21 bp, Homo sapiens
cagcaggtggagcctcttgtc

SEQ ID NO: 7916846 - DNA, 22 bp, Homo sapiens
cagcaggtgcaggtgcggccgc

SEQ ID NO: 7916847 - DNA, 22 bp, Homo sapiens
cagcaggtgcaggtgcggccgc

SEQ ID NO: 7916848 - DNA, 22 bp, Homo sapiens
cagcaggtcttgttgctgctga

SEQ ID NO: 7916849 - DNA, 22 bp, Homo sapiens
cagcaggtcttgttgctgctga

SEQ ID NO: 7916850 - DNA, 22 bp, Homo sapiens
cagcaggtgctgcctgtcaccc

SEQ ID NO: 7916851 - DNA, 22 bp, Homo sapiens
cagcaggtggacacactcacct

SEQ ID NO: 7916852 - DNA, 22 bp, Homo sapiens
cagcaggtggacacactcacct

SEQ ID NO: 7916853 - DNA, 22 bp, Homo sapiens
cagcaggtggacacactcacct

SEQ ID NO: 7916854 - DNA, 22 bp, Homo sapiens
gtcctgaatgccttcatagtcc

SEQ ID NO: 7916855 - DNA, 22 bp, Homo sapiens
gtcctcttgctcattggggcag

SEQ ID NO: 7916856 - DNA, 22 bp, Homo sapiens
gtcctgaatgcctttaggcaga

SEQ ID NO: 7916857 - DNA, 22 bp, Homo sapiens
gtcctgaatgcctttaggcaga

SEQ ID NO: 7916858 - DNA, 22 bp, Homo sapiens
gtcctgacggctgattggcctg

SEQ ID NO: 7916859 - DNA, 22 bp, Homo sapiens
gtcctgaatgcctttaggcaga

SEQ ID NO: 7916860 - DNA, 22 bp, Homo sapiens
gtcctgacggctgattggcctg

SEQ ID NO: 7916861 - DNA, 22 bp, Homo sapiens
gtcctgacggctgattggcctg

SEQ ID NO: 7916862 - DNA, 22 bp, Homo sapiens
gtcctgagatgtcacaaggttt

SEQ ID NO: 7916863 - DNA, 22 bp, Homo sapiens
gtcctgagatgtcacaaggttt

SEQ ID NO: 7916864 - DNA, 22 bp, Homo sapiens
gtcctgagagaggctccttgcc

SEQ ID NO: 7916865 - DNA, 22 bp, Homo sapiens
gtcctgagagaggctccttgcc

SEQ ID NO: 7916866 - DNA, 22 bp, Homo sapiens
gtcctgagatgtcacaaggttt

SEQ ID NO: 7916867 - DNA, 22 bp, Homo sapiens
gtcctgagaatactaggcacaa

SEQ ID NO: 7916868 - DNA, 22 bp, Homo sapiens
gtcctgaggcaggatgggtttc

SEQ ID NO: 7916869 - DNA, 18 bp, Homo sapiens
gtcctgagctctgctgta

SEQ ID NO: 7916870 - DNA, 18 bp, Homo sapiens
gtcctgagctctgctgta

SEQ ID NO: 7916871 - DNA, 22 bp, Homo sapiens
gtcctgagccctcagcacagca

SEQ ID NO: 7916872 - DNA, 22 bp, Homo sapiens
gtcctgagccctcagcacagca

SEQ ID NO: 7916873 - DNA, 22 bp, Homo sapiens
gtcctgagccctcagcacagca

SEQ ID NO: 7916874 - DNA, 22 bp, Homo sapiens
gtcctgagtcaagtgtgggcag

SEQ ID NO: 7916875 - DNA, 22 bp, Homo sapiens
gtcctgatagcccaacactgcc

SEQ ID NO: 7916876 - DNA, 19 bp, Homo sapiens
gtcctgcaactggctctcc

SEQ ID NO: 7916877 - DNA, 22 bp, Homo sapiens
cagcatctgtttttctgaccca

SEQ ID NO: 7916878 - DNA, 22 bp, Homo sapiens
gtcctgcaaagttcagcttgct

SEQ ID NO: 7916879 - DNA, 22 bp, Homo sapiens
gtcctgagtcaagtgtgggcag

SEQ ID NO: 7916880 - DNA, 22 bp, Homo sapiens
gtcctgagtcaagtgtgggcag

SEQ ID NO: 7916881 - DNA, 22 bp, Homo sapiens
gtcctgagtcaagtgtgggcag

SEQ ID NO: 7916882 - DNA, 22 bp, Homo sapiens
cagcagtggctgcaggcagctg

SEQ ID NO: 7916883 - DNA, 22 bp, Homo sapiens
cagcagtggctgcaggcagctg

SEQ ID NO: 7916884 - DNA, 22 bp, Homo sapiens
cagcagtggccatctgtgtggt

SEQ ID NO: 7916885 - DNA, 22 bp, Homo sapiens
cagcagtggctgcaggcagctg

SEQ ID NO: 7916886 - DNA, 22 bp, Homo sapiens
cagcagtggctgcaggcagctg

SEQ ID NO: 7916887 - DNA, 22 bp, Homo sapiens
gtcctaccatgaattcactcca

SEQ ID NO: 7916888 - DNA, 22 bp, Homo sapiens
gtcctagagatccgggagggga

SEQ ID NO: 7916889 - DNA, 22 bp, Homo sapiens
gtcctagagatccgggagggga

SEQ ID NO: 7916890 - DNA, 22 bp, Homo sapiens
cagcagtgtacaaggtgtcaga

SEQ ID NO: 7916891 - DNA, 22 bp, Homo sapiens
gtccgtagtggctgatgctttg

SEQ ID NO: 7916892 - DNA, 22 bp, Homo sapiens
cagcagtgtacaaggtgtcaga

SEQ ID NO: 7916893 - DNA, 22 bp, Homo sapiens
gtccgattggtatcggtgatca

SEQ ID NO: 7916894 - DNA, 22 bp, Homo sapiens
gtcctctgtgtaggctgcagac

SEQ ID NO: 7916895 - DNA, 22 bp, Homo sapiens
gtcctctgttagaaatgtgctt

SEQ ID NO: 7916896 - DNA, 22 bp, Homo sapiens
gtcctctgttagaaatgtgctt

SEQ ID NO: 7916897 - DNA, 22 bp, Homo sapiens
gtcctctgtttccatctgactt

SEQ ID NO: 7916898 - DNA, 22 bp, Homo sapiens
gtcctctgttagaaatgtgctt

SEQ ID NO: 7916899 - DNA, 22 bp, Homo sapiens
gtcctctgtttccatctgactt

SEQ ID NO: 7916900 - DNA, 22 bp, Homo sapiens
gtcctctgtgtaggctgcagac

SEQ ID NO: 7916901 - DNA, 22 bp, Homo sapiens
gtcctctgtgtaggctgcagac

SEQ ID NO: 7916902 - DNA, 22 bp, Homo sapiens
gtcctctgtgtaggctgcagac

SEQ ID NO: 7916903 - DNA, 22 bp, Homo sapiens
gtcctctgtgtaggctgcagac

SEQ ID NO: 7916904 - DNA, 22 bp, Homo sapiens
gtcctctgtgtaggctgcagac

SEQ ID NO: 7916905 - DNA, 22 bp, Homo sapiens
gtcctctgtgtaggctgcagac

SEQ ID NO: 7916906 - DNA, 22 bp, Homo sapiens
gtctcaaactcctaggctaaag

SEQ ID NO: 7916907 - DNA, 22 bp, Homo sapiens
gtctcaaactcctaggctaaag

SEQ ID NO: 7916908 - DNA, 22 bp, Homo sapiens
gtctcaagggggaactcactgt

SEQ ID NO: 7916909 - DNA, 22 bp, Homo sapiens
gtcctgtgggcccaccatgagc

SEQ ID NO: 7916910 - DNA, 22 bp, Homo sapiens
gtcctgtgtaagccaggacaat

SEQ ID NO: 7916911 - DNA, 22 bp, Homo sapiens
gtctcaatagcaactctatcct

SEQ ID NO: 7916912 - DNA, 21 bp, Homo sapiens
gtctcacaaggtggcttacgt

SEQ ID NO: 7916913 - DNA, 20 bp, Homo sapiens
gtctcagaatggatttgcat

SEQ ID NO: 7916914 - DNA, 22 bp, Homo sapiens
gtctcagaccaccctctttggc

SEQ ID NO: 7916915 - DNA, 22 bp, Homo sapiens
gtctcagagtcctacttattcc

SEQ ID NO: 7916916 - DNA, 22 bp, Homo sapiens
gtctcagagagctactctctta

SEQ ID NO: 7916917 - DNA, 22 bp, Homo sapiens
gtctcagagagctactctctta

SEQ ID NO: 7916918 - DNA, 22 bp, Homo sapiens
gtctcagaccaccctctttggc

SEQ ID NO: 7916919 - DNA, 22 bp, Homo sapiens
gtcctgtggaaagctagccgct

SEQ ID NO: 7916920 - DNA, 22 bp, Homo sapiens
gtcctgtgggagcattgctttg

SEQ ID NO: 7916921 - DNA, 22 bp, Homo sapiens
cagcatgcaggggcctgagcac

SEQ ID NO: 7916922 - DNA, 22 bp, Homo sapiens
cagcatgcaggggcctgagcac

SEQ ID NO: 7916923 - DNA, 22 bp, Homo sapiens
cagcatgcagcccctggcagct

SEQ ID NO: 7916924 - DNA, 22 bp, Homo sapiens
cagcatgcagcccctggcagct

SEQ ID NO: 7916925 - DNA, 22 bp, Homo sapiens
cagcatgcattttctctctttg

SEQ ID NO: 7916926 - DNA, 22 bp, Homo sapiens
cagcatgcagcccctggcagct

SEQ ID NO: 7916927 - DNA, 22 bp, Homo sapiens
cagcatgcagcccctggcagct

SEQ ID NO: 7916928 - DNA, 22 bp, Homo sapiens
cagcatgattggtgtctggtga

SEQ ID NO: 7916929 - DNA, 22 bp, Homo sapiens
cagcatgcaagtccagatgtgg

SEQ ID NO: 7916930 - DNA, 22 bp, Homo sapiens
cagcatcttcatgtgcatctcc

SEQ ID NO: 7916931 - DNA, 18 bp, Homo sapiens
cagcatcttcattaggcc

SEQ ID NO: 7916932 - DNA, 18 bp, Homo sapiens
cagcatcttcattaggcc

SEQ ID NO: 7916933 - DNA, 22 bp, Homo sapiens
cagcatcttctagatccaggct

SEQ ID NO: 7916934 - DNA, 22 bp, Homo sapiens
cagcatcttcatgtgcatctcc

SEQ ID NO: 7916935 - DNA, 22 bp, Homo sapiens
cagcatcttcatgtgcatctcc

SEQ ID NO: 7916936 - DNA, 22 bp, Homo sapiens
cagcatcttcatgtgcatctcc

SEQ ID NO: 7916937 - DNA, 22 bp, Homo sapiens
cagcatcttattttctatggaa

SEQ ID NO: 7916938 - DNA, 22 bp, Homo sapiens
cagcatcttattttctatggaa

SEQ ID NO: 7916939 - DNA, 22 bp, Homo sapiens
cagcatcttattttctatggaa

SEQ ID NO: 7916940 - DNA, 22 bp, Homo sapiens
cagcatcttgaagggtaaacca

SEQ ID NO: 7916941 - DNA, 22 bp, Homo sapiens
cagcatctttataaaaagtaaa

SEQ ID NO: 7916942 - DNA, 22 bp, Homo sapiens
cagcatctttctcttctggagt

SEQ ID NO: 7916943 - DNA, 22 bp, Homo sapiens
cagcatcttctccaaagctgcc

SEQ ID NO: 7916944 - DNA, 22 bp, Homo sapiens
cagcatcttctagatccaggct

SEQ ID NO: 7916945 - DNA, 22 bp, Homo sapiens
cagcatcttctagatccaggct

SEQ ID NO: 7916946 - DNA, 22 bp, Homo sapiens
cagcatgaccctggagcctgca

SEQ ID NO: 7916947 - DNA, 22 bp, Homo sapiens
cagcatgacagtctgcagcaga

SEQ ID NO: 7916948 - DNA, 22 bp, Homo sapiens
cagcatctttctcttctggagt

SEQ ID NO: 7916949 - DNA, 22 bp, Homo sapiens
cagcatctttctcttctggagt

SEQ ID NO: 7916950 - DNA, 22 bp, Homo sapiens
cagcatgactcactgtggtcac

SEQ ID NO: 7916951 - DNA, 22 bp, Homo sapiens
cagcatgagaaaatgaatcaga

SEQ ID NO: 7916952 - DNA, 22 bp, Homo sapiens
cagcatgagaaaatgaatcaga

SEQ ID NO: 7916953 - DNA, 21 bp, Homo sapiens
cagctctgagatttctactag

SEQ ID NO: 7916954 - DNA, 22 bp, Homo sapiens
cagctctgaggaacactccttt

SEQ ID NO: 7916955 - DNA, 22 bp, Homo sapiens
cagctctgaggaacactccttt

SEQ ID NO: 7916956 - DNA, 22 bp, Homo sapiens
cagctctgaggaacactccttt

SEQ ID NO: 7916957 - DNA, 22 bp, Homo sapiens
cagctctgaggaacactccttt

SEQ ID NO: 7916958 - DNA, 22 bp, Homo sapiens
cagctctgatgaaatgtaccag

SEQ ID NO: 7916959 - DNA, 17 bp, Homo sapiens
cagctctgcagacttcc

SEQ ID NO: 7916960 - DNA, 17 bp, Homo sapiens
cagctctgcagacttcc

SEQ ID NO: 7916961 - DNA, 22 bp, Homo sapiens
cagctctgaggaacactccttt

SEQ ID NO: 7916962 - DNA, 22 bp, Homo sapiens
cagctctgaggaacactccttt

SEQ ID NO: 7916963 - DNA, 22 bp, Homo sapiens
cagctctgagactgaggctatg

SEQ ID NO: 7916964 - DNA, 22 bp, Homo sapiens
cagctctgagactgaggctatg

SEQ ID NO: 7916965 - DNA, 22 bp, Homo sapiens
cagctcctgcagctggctccca

SEQ ID NO: 7916966 - DNA, 22 bp, Homo sapiens
cagctcctgcagctggctccca

SEQ ID NO: 7916967 - DNA, 22 bp, Homo sapiens
cagctcctgcagctgctgccgt

SEQ ID NO: 7916968 - DNA, 22 bp, Homo sapiens
cagctcctgcagctgctgccgt

SEQ ID NO: 7916969 - DNA, 22 bp, Homo sapiens
cagctcctgcagctggctccca

SEQ ID NO: 7916970 - DNA, 22 bp, Homo sapiens
cagctcctgaggactgctggga

SEQ ID NO: 7916971 - DNA, 22 bp, Homo sapiens
cagctcctgaggactgctggga

SEQ ID NO: 7916972 - DNA, 22 bp, Homo sapiens
cagctcctgaggactgctggga

SEQ ID NO: 7916973 - DNA, 22 bp, Homo sapiens
cagctcctgaggactgctggga

SEQ ID NO: 7916974 - DNA, 22 bp, Homo sapiens
cagctcctctgttagccctggg

SEQ ID NO: 7916975 - DNA, 22 bp, Homo sapiens
cagctcctgaggactgctggga

SEQ ID NO: 7916976 - DNA, 22 bp, Homo sapiens
cagctcctgcagctgctgccgt

SEQ ID NO: 7916977 - DNA, 22 bp, Homo sapiens
cagctcctgcagctgctgccgt

SEQ ID NO: 7916978 - DNA, 22 bp, Homo sapiens
cagctcctgcagctgctgccgt

SEQ ID NO: 7916979 - DNA, 22 bp, Homo sapiens
cagctcctcagccctgccttgg

SEQ ID NO: 7916980 - DNA, 22 bp, Homo sapiens
cagctcctctggccagccctgc

SEQ ID NO: 7916981 - DNA, 22 bp, Homo sapiens
cagctcctctgttagccctggg

SEQ ID NO: 7916982 - DNA, 22 bp, Homo sapiens
cagctcctctgttagccctggg

SEQ ID NO: 7916983 - DNA, 22 bp, Homo sapiens
cagctcctctgttagccctggg

SEQ ID NO: 7916984 - DNA, 22 bp, Homo sapiens
cagctcctctgttagccctggg

SEQ ID NO: 7916985 - DNA, 22 bp, Homo sapiens
cagctcctctgttagccctggg

SEQ ID NO: 7916986 - DNA, 22 bp, Homo sapiens
cagctcctctgttagccctggg

SEQ ID NO: 7916987 - DNA, 22 bp, Homo sapiens
cagctcctcacgagtcttgaaa

SEQ ID NO: 7916988 - DNA, 22 bp, Homo sapiens
cagctcctcacgagtcttgaaa

SEQ ID NO: 7916989 - DNA, 22 bp, Homo sapiens
cagctcctcagccctgccttgg

SEQ ID NO: 7916990 - DNA, 22 bp, Homo sapiens
cagctcctcacgagtcttgaaa

SEQ ID NO: 7916991 - DNA, 22 bp, Homo sapiens
cagctcctcagccctgccttgg

SEQ ID NO: 7916992 - DNA, 22 bp, Homo sapiens
cagctcctcagccctgccttgg

SEQ ID NO: 7916993 - DNA, 22 bp, Homo sapiens
cagctcctctggccagccctgc

SEQ ID NO: 7916994 - DNA, 22 bp, Homo sapiens
cagctcctctggccagccctgc

SEQ ID NO: 7916995 - DNA, 22 bp, Homo sapiens
cagctcccctctgtggggcagt

SEQ ID NO: 7916996 - DNA, 22 bp, Homo sapiens
cagctcccctctgtggggcagt

SEQ ID NO: 7916997 - DNA, 22 bp, Homo sapiens
cagctcccgccatcgggaggca

SEQ ID NO: 7916998 - DNA, 22 bp, Homo sapiens
cagctccctatggtgaggcgac

SEQ ID NO: 7916999 - DNA, 22 bp, Homo sapiens
cagctcctagatcggcgaagtg

SEQ ID NO: 7917000 - DNA, 22 bp, Homo sapiens
cagctcctagatcggcgaagtg

SEQ ID NO: 7917001 - DNA, 22 bp, Homo sapiens
cagctcctagatcggcgaagtg

SEQ ID NO: 7917002 - DNA, 22 bp, Homo sapiens
cagctcctagatcggcgaagtg

SEQ ID NO: 7917003 - DNA, 22 bp, Homo sapiens
cagctcctagatcggcgaagtg

SEQ ID NO: 7917004 - DNA, 22 bp, Homo sapiens
cagctcctattagacactgaat

SEQ ID NO: 7917005 - DNA, 22 bp, Homo sapiens
cagctcctatgagtatgattcc

SEQ ID NO: 7917006 - DNA, 22 bp, Homo sapiens
cagctcctatgagtatgattcc

SEQ ID NO: 7917007 - DNA, 22 bp, Homo sapiens
cagctcctatgagtatgattcc

SEQ ID NO: 7917008 - DNA, 17 bp, Homo sapiens
cagctctgcagacttcc

SEQ ID NO: 7917009 - DNA, 17 bp, Homo sapiens
cagctctgcagacttcc

SEQ ID NO: 7917010 - DNA, 22 bp, Homo sapiens
cagcccttttttggtacaaccg

SEQ ID NO: 7917011 - DNA, 22 bp, Homo sapiens
cagcccttttttggtacaaccg

SEQ ID NO: 7917012 - DNA, 22 bp, Homo sapiens
cagccctttccttctcagcttt

SEQ ID NO: 7917013 - DNA, 22 bp, Homo sapiens
cagccctttccttctcagcttt

SEQ ID NO: 7917014 - DNA, 20 bp, Homo sapiens
cagccctttatcctcctatg

SEQ ID NO: 7917015 - DNA, 22 bp, Homo sapiens
cagccctttccttctcagcttt

SEQ ID NO: 7917016 - DNA, 22 bp, Homo sapiens
cagccctttccttctcagcttt

SEQ ID NO: 7917017 - DNA, 22 bp, Homo sapiens
cagcccttgtttctaaagctgc

SEQ ID NO: 7917018 - DNA, 22 bp, Homo sapiens
cagcccttgtttgggaaggatg

SEQ ID NO: 7917019 - DNA, 22 bp, Homo sapiens
cagcccttgtttctaaagctgc

SEQ ID NO: 7917020 - DNA, 20 bp, Homo sapiens
cagccctttatcctcctatg

SEQ ID NO: 7917021 - DNA, 22 bp, Homo sapiens
cagcccttggcccagggcacag

SEQ ID NO: 7917022 - DNA, 22 bp, Homo sapiens
cagcccttggcccagggcacag

SEQ ID NO: 7917023 - DNA, 22 bp, Homo sapiens
cagcccttggctggctccttgc

SEQ ID NO: 7917024 - DNA, 22 bp, Homo sapiens
cagcccttgggccatcctagaa

SEQ ID NO: 7917025 - DNA, 22 bp, Homo sapiens
cagcccttgcgacaccctggct

SEQ ID NO: 7917026 - DNA, 20 bp, Homo sapiens
cagcccttgatttacaatcc

SEQ ID NO: 7917027 - DNA, 20 bp, Homo sapiens
cagcccttgatttacaatcc

SEQ ID NO: 7917028 - DNA, 22 bp, Homo sapiens
cagcccttcttccaaccagctt

SEQ ID NO: 7917029 - DNA, 22 bp, Homo sapiens
cagcccttgatgataatttatc

SEQ ID NO: 7917030 - DNA, 22 bp, Homo sapiens
cagcccttccttctgtttatac

SEQ ID NO: 7917031 - DNA, 23 bp, Homo sapiens
cagcccttcctgcatgtttttgt

SEQ ID NO: 7917032 - DNA, 23 bp, Homo sapiens
cagcccttcctgcatgtttttgt

SEQ ID NO: 7917033 - DNA, 22 bp, Homo sapiens
cagcccttccaggcagaattct

SEQ ID NO: 7917034 - DNA, 22 bp, Homo sapiens
cagcccttccaggcagaattct

SEQ ID NO: 7917035 - DNA, 22 bp, Homo sapiens
cagcccttcagggggctgcagg

SEQ ID NO: 7917036 - DNA, 22 bp, Homo sapiens
cagcccttcagggggctgcagg

SEQ ID NO: 7917037 - DNA, 22 bp, Homo sapiens
cagcccttaagagtcatccctc

SEQ ID NO: 7917038 - DNA, 22 bp, Homo sapiens
cagcccttaaatagatatacag

SEQ ID NO: 7917039 - DNA, 22 bp, Homo sapiens
cagcccttaaatagatatacag

SEQ ID NO: 7917040 - DNA, 22 bp, Homo sapiens
cagccctgttgcgcttccggcg

SEQ ID NO: 7917041 - DNA, 22 bp, Homo sapiens
cagccctgttgcgcttccggcg

SEQ ID NO: 7917042 - DNA, 22 bp, Homo sapiens
cagccctgttgcgcttccggcg

SEQ ID NO: 7917043 - DNA, 22 bp, Homo sapiens
gtgcctggggttgagctatgaa

SEQ ID NO: 7917044 - DNA, 22 bp, Homo sapiens
gtgcctggggttgagctatgaa

SEQ ID NO: 7917045 - DNA, 22 bp, Homo sapiens
gtgcctggggttgagctatgaa

SEQ ID NO: 7917046 - DNA, 22 bp, Homo sapiens
gtgcctggggttgagctatgaa

SEQ ID NO: 7917047 - DNA, 22 bp, Homo sapiens
gtgcctggggttgagctatgaa

SEQ ID NO: 7917048 - DNA, 22 bp, Homo sapiens
gtgcctgggggtaatgtaggat

SEQ ID NO: 7917049 - DNA, 22 bp, Homo sapiens
gtgcctgggggtaatgtaggat

SEQ ID NO: 7917050 - DNA, 22 bp, Homo sapiens
gtgcctgggacttgctccggat

SEQ ID NO: 7917051 - DNA, 22 bp, Homo sapiens
gtgcctgggacttgctccggat

SEQ ID NO: 7917052 - DNA, 22 bp, Homo sapiens
gtgcctgggacttgctccggat

SEQ ID NO: 7917053 - DNA, 22 bp, Homo sapiens
gtgcctgggacttgctccggat

SEQ ID NO: 7917054 - DNA, 22 bp, Homo sapiens
gtgcctgggacttgctccggat

SEQ ID NO: 7917055 - DNA, 22 bp, Homo sapiens
gtgcctgggcatgagcttgttg

SEQ ID NO: 7917056 - DNA, 22 bp, Homo sapiens
gtgcctgggcatgagcttgttg

SEQ ID NO: 7917057 - DNA, 22 bp, Homo sapiens
gtgcctgggcatgagcttgttg

SEQ ID NO: 7917058 - DNA, 20 bp, Homo sapiens
cagcctccactcactcagct

SEQ ID NO: 7917059 - DNA, 20 bp, Homo sapiens
cagcctccactcactcagct

SEQ ID NO: 7917060 - DNA, 22 bp, Homo sapiens
gtgccctgacacacctggtgtg

SEQ ID NO: 7917061 - DNA, 22 bp, Homo sapiens
gtgccctgacacacctggtgtg

SEQ ID NO: 7917062 - DNA, 22 bp, Homo sapiens
gtgccctgacacacctggtgtg

SEQ ID NO: 7917063 - DNA, 19 bp, Homo sapiens
cagcctcaatccctcgggc

SEQ ID NO: 7917064 - DNA, 19 bp, Homo sapiens
cagcctcaatccctcgggc

SEQ ID NO: 7917065 - DNA, 20 bp, Homo sapiens
cagcctccactcactcagct

SEQ ID NO: 7917066 - DNA, 22 bp, Homo sapiens
gtgcctgggacacgagattttc

SEQ ID NO: 7917067 - DNA, 22 bp, Homo sapiens
gtgcctgggacacagcagatac

SEQ ID NO: 7917068 - DNA, 22 bp, Homo sapiens
gtgcctgggacacagcagatac

SEQ ID NO: 7917069 - DNA, 22 bp, Homo sapiens
gtgcctgggacacagcagatac

SEQ ID NO: 7917070 - DNA, 22 bp, Homo sapiens
gtgcctgggacacagcagatac

SEQ ID NO: 7917071 - DNA, 22 bp, Homo sapiens
gtgccctgacacacctggtgtg

SEQ ID NO: 7917072 - DNA, 22 bp, Homo sapiens
gtgccctgacacacctggtgtg

SEQ ID NO: 7917073 - DNA, 22 bp, Homo sapiens
gtgcctgggacacagcagatac

SEQ ID NO: 7917074 - DNA, 22 bp, Homo sapiens
gtgcatggtaagatgcttcaca

SEQ ID NO: 7917075 - DNA, 22 bp, Homo sapiens
gtgcatgtcggggtgcatgtca

SEQ ID NO: 7917076 - DNA, 22 bp, Homo sapiens
gtgcatgtgcatccatgtgtac

SEQ ID NO: 7917077 - DNA, 22 bp, Homo sapiens
gtgcatgtgcgttgactgtcca

SEQ ID NO: 7917078 - DNA, 22 bp, Homo sapiens
gtgcatgttaatggtgtacaaa

SEQ ID NO: 7917079 - DNA, 22 bp, Homo sapiens
cagccctgtgcggagggccctg

SEQ ID NO: 7917080 - DNA, 22 bp, Homo sapiens
cagccctgtgctaagcaccctc

SEQ ID NO: 7917081 - DNA, 22 bp, Homo sapiens
cagccctgtgcggagggccctg

SEQ ID NO: 7917082 - DNA, 22 bp, Homo sapiens
cagccctgtgcggagggccctg

SEQ ID NO: 7917083 - DNA, 22 bp, Homo sapiens
cagccctgtgcggagggccctg

SEQ ID NO: 7917084 - DNA, 22 bp, Homo sapiens
cagccctgtgcggagggccctg

SEQ ID NO: 7917085 - DNA, 22 bp, Homo sapiens
cagccctgtgcggagggccctg

SEQ ID NO: 7917086 - DNA, 22 bp, Homo sapiens
gtgcattaggctggaatgttga

SEQ ID NO: 7917087 - DNA, 22 bp, Homo sapiens
gtgcatgaagcaggcagctcct

SEQ ID NO: 7917088 - DNA, 22 bp, Homo sapiens
gtgcatctgtaagtggctttgc

SEQ ID NO: 7917089 - DNA, 22 bp, Homo sapiens
gtgcatgaagactcagaaagtc

SEQ ID NO: 7917090 - DNA, 18 bp, Homo sapiens
gtgcatgcatgctctgcc

SEQ ID NO: 7917091 - DNA, 22 bp, Homo sapiens
gtgcatgcacacatgtgtgagg

SEQ ID NO: 7917092 - DNA, 22 bp, Homo sapiens
gtgcatggggagggaagcgctc

SEQ ID NO: 7917093 - DNA, 22 bp, Homo sapiens
gtgcatggccagggtggtctgg

SEQ ID NO: 7917094 - DNA, 21 bp, Homo sapiens
gtgcatggagaaaggcttgct

SEQ ID NO: 7917095 - DNA, 22 bp, Homo sapiens
gtgcatctgaatttgaaaatct

SEQ ID NO: 7917096 - DNA, 22 bp, Homo sapiens
gtgcatccagccatgagaacca

SEQ ID NO: 7917097 - DNA, 22 bp, Homo sapiens
gtgcatctgtaagtggctttgc

SEQ ID NO: 7917098 - DNA, 21 bp, Homo sapiens
gtgcatcagatcagtggagtc

SEQ ID NO: 7917099 - DNA, 22 bp, Homo sapiens
gtgcatcaggatctgaccagat

SEQ ID NO: 7917100 - DNA, 22 bp, Homo sapiens
gtgcatattttgcacacagatg

SEQ ID NO: 7917101 - DNA, 22 bp, Homo sapiens
gtgcaggaggtaacatagcaaa

SEQ ID NO: 7917102 - DNA, 22 bp, Homo sapiens
gtgcatatgtgtgtatacaaac

SEQ ID NO: 7917103 - DNA, 22 bp, Homo sapiens
gtgcaggagctcccgcagtggt

SEQ ID NO: 7917104 - DNA, 22 bp, Homo sapiens
gtgcaggagcttctggcctgac

SEQ ID NO: 7917105 - DNA, 22 bp, Homo sapiens
gtgcaggagccaggggtaggaa

SEQ ID NO: 7917106 - DNA, 22 bp, Homo sapiens
gtgcaggagctcccgcagtggt

SEQ ID NO: 7917107 - DNA, 22 bp, Homo sapiens
gtgcaggaggatgacaactgca

SEQ ID NO: 7917108 - DNA, 22 bp, Homo sapiens
gtgcaggaggatgacaactgca

SEQ ID NO: 7917109 - DNA, 22 bp, Homo sapiens
gtgcaggagcttctggcctgac

SEQ ID NO: 7917110 - DNA, 22 bp, Homo sapiens
gtgcaggagcttctggcctgac

SEQ ID NO: 7917111 - DNA, 22 bp, Homo sapiens
cagctccagcccaggcagctcc

SEQ ID NO: 7917112 - DNA, 22 bp, Homo sapiens
cagctccagcccaggcagctcc

SEQ ID NO: 7917113 - DNA, 22 bp, Homo sapiens
cagctccagcccaggcagctcc

SEQ ID NO: 7917114 - DNA, 22 bp, Homo sapiens
cagctccagccaccggggggtg

SEQ ID NO: 7917115 - DNA, 22 bp, Homo sapiens
cagctccagccaccggggggtg

SEQ ID NO: 7917116 - DNA, 22 bp, Homo sapiens
cagctccacttgagtggggcct

SEQ ID NO: 7917117 - DNA, 22 bp, Homo sapiens
cagctccacttgagtggggcct

SEQ ID NO: 7917118 - DNA, 22 bp, Homo sapiens
cagctccacttgagtggggcct

SEQ ID NO: 7917119 - DNA, 21 bp, Homo sapiens
cagctccactaaagcagctgt

SEQ ID NO: 7917120 - DNA, 22 bp, Homo sapiens
cagctccacttgagtggggcct

SEQ ID NO: 7917121 - DNA, 21 bp, Homo sapiens
cagctccactaaagcagctgt

SEQ ID NO: 7917122 - DNA, 21 bp, Homo sapiens
cagctccactaaagcagctgt

SEQ ID NO: 7917123 - DNA, 21 bp, Homo sapiens
cagctccactaaagcagctgt

SEQ ID NO: 7917124 - DNA, 22 bp, Homo sapiens
cagctcagcttcctgggtgtgt

SEQ ID NO: 7917125 - DNA, 22 bp, Homo sapiens
gtgctgaggtgggtgggcagcc

SEQ ID NO: 7917126 - DNA, 22 bp, Homo sapiens
cagctccaaagccccactgtcc

SEQ ID NO: 7917127 - DNA, 22 bp, Homo sapiens
cagctcaggaaggaaggccggc

SEQ ID NO: 7917128 - DNA, 21 bp, Homo sapiens
cagctccactaaagcagctgt

SEQ ID NO: 7917129 - DNA, 22 bp, Homo sapiens
cagctcaggaaggaaggccggc

SEQ ID NO: 7917130 - DNA, 22 bp, Homo sapiens
gtgctgaggtgggtgggcagcc

SEQ ID NO: 7917131 - DNA, 22 bp, Homo sapiens
gtgctgaggtgggtgggcagcc

SEQ ID NO: 7917132 - DNA, 22 bp, Homo sapiens
gtgctgaggtgggtgggcagcc

SEQ ID NO: 7917133 - DNA, 20 bp, Homo sapiens
gtgctgagggctgggcaatg

SEQ ID NO: 7917134 - DNA, 22 bp, Homo sapiens
gtgctgaggtgggtgggcagcc

SEQ ID NO: 7917135 - DNA, 22 bp, Homo sapiens
gtgctgaggtacacaaattcta

SEQ ID NO: 7917136 - DNA, 23 bp, Homo sapiens
cagctccagtgcactcaggtagc

SEQ ID NO: 7917137 - DNA, 22 bp, Homo sapiens
cagctccagctctgggcgcctc

SEQ ID NO: 7917138 - DNA, 23 bp, Homo sapiens
cagctccagtgcactcaggtagc

SEQ ID NO: 7917139 - DNA, 22 bp, Homo sapiens
cagctccatcttgcttatacca

SEQ ID NO: 7917140 - DNA, 22 bp, Homo sapiens
cagctccatcttgcttatacca

SEQ ID NO: 7917141 - DNA, 23 bp, Homo sapiens
cagctccagtgcactcaggtagc

SEQ ID NO: 7917142 - DNA, 22 bp, Homo sapiens
cagctccatcttgcttatacca

SEQ ID NO: 7917143 - DNA, 23 bp, Homo sapiens
cagctccagtgcactcaggtagc

SEQ ID NO: 7917144 - DNA, 22 bp, Homo sapiens
cagctccagctctgggcgcctc

SEQ ID NO: 7917145 - DNA, 22 bp, Homo sapiens
cagctccagctctgggcgcctc

SEQ ID NO: 7917146 - DNA, 22 bp, Homo sapiens
cagctccagctctgggcgcctc

SEQ ID NO: 7917147 - DNA, 22 bp, Homo sapiens
cagctccagctctgggcgcctc

SEQ ID NO: 7917148 - DNA, 22 bp, Homo sapiens
cagctccagccgactgtaagaa

SEQ ID NO: 7917149 - DNA, 22 bp, Homo sapiens
cagctccagccgactgtaagaa

SEQ ID NO: 7917150 - DNA, 22 bp, Homo sapiens
cagctccagcctgacaccaaga

SEQ ID NO: 7917151 - DNA, 22 bp, Homo sapiens
cagctccagcccaggcagctcc

SEQ ID NO: 7917152 - DNA, 22 bp, Homo sapiens
cagctccagcccaggcagctcc

SEQ ID NO: 7917153 - DNA, 22 bp, Homo sapiens
cagctccagccgactgtaagaa

SEQ ID NO: 7917154 - DNA, 22 bp, Homo sapiens
cagctcccagagtgaccagcag

SEQ ID NO: 7917155 - DNA, 22 bp, Homo sapiens
cagctcccagaactgaccatgt

SEQ ID NO: 7917156 - DNA, 22 bp, Homo sapiens
cagctcccagaactgaccatgt

SEQ ID NO: 7917157 - DNA, 22 bp, Homo sapiens
cagctcccagaactgaccatgt

SEQ ID NO: 7917158 - DNA, 22 bp, Homo sapiens
cagctcccagagtgaccagcag

SEQ ID NO: 7917159 - DNA, 22 bp, Homo sapiens
cagctcccagtggcagctcctt

SEQ ID NO: 7917160 - DNA, 22 bp, Homo sapiens
cagctcccagtggcagctcctt

SEQ ID NO: 7917161 - DNA, 22 bp, Homo sapiens
cagctccccatggttcctgaag

SEQ ID NO: 7917162 - DNA, 22 bp, Homo sapiens
cagctcccagtggcagctcctt

SEQ ID NO: 7917163 - DNA, 22 bp, Homo sapiens
cagctcccagtggcagctcctt

SEQ ID NO: 7917164 - DNA, 22 bp, Homo sapiens
cagctcccagtggcagctcctt

SEQ ID NO: 7917165 - DNA, 22 bp, Homo sapiens
gtgcctggtatgtaggtagcgg

SEQ ID NO: 7917166 - DNA, 22 bp, Homo sapiens
gtgcctggtatgtaggtagcgg

SEQ ID NO: 7917167 - DNA, 22 bp, Homo sapiens
gtgcctggtatgtaggtagcgg

SEQ ID NO: 7917168 - DNA, 22 bp, Homo sapiens
gtgcctggtatgtaggtagcgg

SEQ ID NO: 7917169 - DNA, 22 bp, Homo sapiens
gtgcctggggttgagctatgaa

SEQ ID NO: 7917170 - DNA, 22 bp, Homo sapiens
gtgcctggtatgtaggtagcgg

SEQ ID NO: 7917171 - DNA, 22 bp, Homo sapiens
gtgcctggggttgagctatgaa

SEQ ID NO: 7917172 - DNA, 22 bp, Homo sapiens
gtgcctggggttgagctatgaa

SEQ ID NO: 7917173 - DNA, 22 bp, Homo sapiens
gtgcctggtttggggaatgttc

SEQ ID NO: 7917174 - DNA, 22 bp, Homo sapiens
gtgctgagagtttattatgata

SEQ ID NO: 7917175 - DNA, 22 bp, Homo sapiens
gtgctgagaattgatgtccttg

SEQ ID NO: 7917176 - DNA, 17 bp, Homo sapiens
gtgcctgttgtcctgga

SEQ ID NO: 7917177 - DNA, 22 bp, Homo sapiens
gtgcctgtgcggactcagggaa

SEQ ID NO: 7917178 - DNA, 17 bp, Homo sapiens
gtgcctgttgtcctgga

SEQ ID NO: 7917179 - DNA, 22 bp, Homo sapiens
gtgcctggtttggggagtgttc

SEQ ID NO: 7917180 - DNA, 22 bp, Homo sapiens
gtgcctggtttggggagtgttc

SEQ ID NO: 7917181 - DNA, 22 bp, Homo sapiens
gtgcctgtaagttgtatgggct

SEQ ID NO: 7917182 - DNA, 22 bp, Homo sapiens
gtgcctgtaagttgtatgggct

SEQ ID NO: 7917183 - DNA, 22 bp, Homo sapiens
gtgcctgtgccaggggtgtgct

SEQ ID NO: 7917184 - DNA, 22 bp, Homo sapiens
gtgcctgtccattcccaggctc

SEQ ID NO: 7917185 - DNA, 22 bp, Homo sapiens
gtgcctgtgccaggggtgtgct

SEQ ID NO: 7917186 - DNA, 22 bp, Homo sapiens
gtgctgagattacaggtgtgag

SEQ ID NO: 7917187 - DNA, 22 bp, Homo sapiens
gtgctgagattacaggtgtgag

SEQ ID NO: 7917188 - DNA, 22 bp, Homo sapiens
gtgctgagatcttccctcactg

SEQ ID NO: 7917189 - DNA, 22 bp, Homo sapiens
gtgctgagcatcatgaggcact

SEQ ID NO: 7917190 - DNA, 22 bp, Homo sapiens
gtgctgagcacagctgcccagg

SEQ ID NO: 7917191 - DNA, 22 bp, Homo sapiens
gtgctgagcacaccttggagca

SEQ ID NO: 7917192 - DNA, 22 bp, Homo sapiens
gtgctgagcacaccttggagca

SEQ ID NO: 7917193 - DNA, 22 bp, Homo sapiens
gtgctgagcacaccttggagca

SEQ ID NO: 7917194 - DNA, 22 bp, Homo sapiens
gtgctgagcacaaggcccagag

SEQ ID NO: 7917195 - DNA, 22 bp, Homo sapiens
gtgctgagcatcatgaggcact

SEQ ID NO: 7917196 - DNA, 22 bp, Homo sapiens
gtgctgagcatcatgaggcact

SEQ ID NO: 7917197 - DNA, 22 bp, Homo sapiens
gtgctgagcatcatgaggcact

SEQ ID NO: 7917198 - DNA, 22 bp, Homo sapiens
gtgctgagctgcagatgcgctc

SEQ ID NO: 7917199 - DNA, 22 bp, Homo sapiens
gtgctgagctgcagatgcgctc

SEQ ID NO: 7917200 - DNA, 22 bp, Homo sapiens
gtgctgagctgcagatgcgctc

SEQ ID NO: 7917201 - DNA, 22 bp, Homo sapiens
gtgctgaggagagggggtggtc

SEQ ID NO: 7917202 - DNA, 22 bp, Homo sapiens
gtgctgaggagagggggtggtc

SEQ ID NO: 7917203 - DNA, 22 bp, Homo sapiens
gtgctgaggatacagctgtgaa

SEQ ID NO: 7917204 - DNA, 22 bp, Homo sapiens
gtgctgaggatacagctgtgaa

SEQ ID NO: 7917205 - DNA, 21 bp, Homo sapiens
gtgctgaggatacagtagtaa

SEQ ID NO: 7917206 - DNA, 22 bp, Homo sapiens
gtgctgaggatacagctgtgaa

SEQ ID NO: 7917207 - DNA, 22 bp, Homo sapiens
cagaggcagaggtcatctctgg

SEQ ID NO: 7917208 - DNA, 22 bp, Homo sapiens
cagaggcagccgggggagaacg

SEQ ID NO: 7917209 - DNA, 22 bp, Homo sapiens
cagaggcagccgggggagaacg

SEQ ID NO: 7917210 - DNA, 22 bp, Homo sapiens
cagaggcagccgggggagaacg

SEQ ID NO: 7917211 - DNA, 22 bp, Homo sapiens
cagaggcagccgggggagaacg

SEQ ID NO: 7917212 - DNA, 22 bp, Homo sapiens
cagaggcaggaagatgggcagt

SEQ ID NO: 7917213 - DNA, 22 bp, Homo sapiens
cagaggcaggaagatgggcagt

SEQ ID NO: 7917214 - DNA, 22 bp, Homo sapiens
cagaggcaggaagatgggcagt

SEQ ID NO: 7917215 - DNA, 22 bp, Homo sapiens
cagaggcaggaagatgggcagt

SEQ ID NO: 7917216 - DNA, 22 bp, Homo sapiens
cagaggcagaccctccagggcg

SEQ ID NO: 7917217 - DNA, 22 bp, Homo sapiens
cagaggcagaccctccagggcg

SEQ ID NO: 7917218 - DNA, 22 bp, Homo sapiens
cagaggcagaggtcatctctgg

SEQ ID NO: 7917219 - DNA, 22 bp, Homo sapiens
cagaggcagaggtcatctctgg

SEQ ID NO: 7917220 - DNA, 22 bp, Homo sapiens
cagaggcagaggtcatctctgg

SEQ ID NO: 7917221 - DNA, 22 bp, Homo sapiens
cagaggcagaggtcatctctgg

SEQ ID NO: 7917222 - DNA, 22 bp, Homo sapiens
cagaggcagaggtcatctctgg

SEQ ID NO: 7917223 - DNA, 22 bp, Homo sapiens
cagaggcagaccctccagggcg

SEQ ID NO: 7917224 - DNA, 22 bp, Homo sapiens
cagaggcagaatggagatttgg

SEQ ID NO: 7917225 - DNA, 22 bp, Homo sapiens
cagaggcagaatggagatttgg

SEQ ID NO: 7917226 - DNA, 19 bp, Homo sapiens
cagaggcactttctcttag

SEQ ID NO: 7917227 - DNA, 22 bp, Homo sapiens
cagaggcagaatggagatttgg

SEQ ID NO: 7917228 - DNA, 22 bp, Homo sapiens
gggggcagaatgtactcttgtc

SEQ ID NO: 7917229 - DNA, 22 bp, Homo sapiens
gggggcagaatgtactcttgtc

SEQ ID NO: 7917230 - DNA, 22 bp, Homo sapiens
gggggcagaatgtactcttgtc

SEQ ID NO: 7917231 - DNA, 22 bp, Homo sapiens
gggggcaggtctggaactttga

SEQ ID NO: 7917232 - DNA, 22 bp, Homo sapiens
gggggcaggtctggaactttga

SEQ ID NO: 7917233 - DNA, 22 bp, Homo sapiens
gggggcaggtctggaactttga

SEQ ID NO: 7917234 - DNA, 22 bp, Homo sapiens
gggggcaggtctggaactttga

SEQ ID NO: 7917235 - DNA, 22 bp, Homo sapiens
gggggcaggtctggaactttga

SEQ ID NO: 7917236 - DNA, 22 bp, Homo sapiens
gggggatgctcaggaggctgct

SEQ ID NO: 7917237 - DNA, 22 bp, Homo sapiens
gggggatgctcaggaggctgct

SEQ ID NO: 7917238 - DNA, 22 bp, Homo sapiens
gggggaggtgaatgcaataagg

SEQ ID NO: 7917239 - DNA, 22 bp, Homo sapiens
gggggatgctcaggaggctgct

SEQ ID NO: 7917240 - DNA, 22 bp, Homo sapiens
gggggatgctcaggaggctgct

SEQ ID NO: 7917241 - DNA, 22 bp, Homo sapiens
gggggatgctcaggaggctgct

SEQ ID NO: 7917242 - DNA, 22 bp, Homo sapiens
gggggatgctcaggaggctgct

SEQ ID NO: 7917243 - DNA, 22 bp, Homo sapiens
gggggatgctcaggaggctgct

SEQ ID NO: 7917244 - DNA, 22 bp, Homo sapiens
gggggcagtaacctcaaagtgt

SEQ ID NO: 7917245 - DNA, 22 bp, Homo sapiens
gggggcaggtctggaactttga

SEQ ID NO: 7917246 - DNA, 22 bp, Homo sapiens
gggggcagtaacctcaaagtgt

SEQ ID NO: 7917247 - DNA, 22 bp, Homo sapiens
gggggcagtaacctcaaagtgt

SEQ ID NO: 7917248 - DNA, 22 bp, Homo sapiens
gggggcagtaaggatatggaaa

SEQ ID NO: 7917249 - DNA, 22 bp, Homo sapiens
gggggcagtaaggatatggaaa

SEQ ID NO: 7917250 - DNA, 22 bp, Homo sapiens
gggggcagtaaggatatggaaa

SEQ ID NO: 7917251 - DNA, 22 bp, Homo sapiens
gggggcagtaacctcaaagtgt

SEQ ID NO: 7917252 - DNA, 19 bp, Homo sapiens
cagaggcactttctcttag

SEQ ID NO: 7917253 - DNA, 19 bp, Homo sapiens
cagaggcactttctcttag

SEQ ID NO: 7917254 - DNA, 19 bp, Homo sapiens
cagaggcactttctcttag

SEQ ID NO: 7917255 - DNA, 22 bp, Homo sapiens
cagaggaagttccttgatgaga

SEQ ID NO: 7917256 - DNA, 22 bp, Homo sapiens
cagaggacaactggggcaagga

SEQ ID NO: 7917257 - DNA, 22 bp, Homo sapiens
cagaggacaactggggcaagga

SEQ ID NO: 7917258 - DNA, 22 bp, Homo sapiens
cagaggacaactggggcaagga

SEQ ID NO: 7917259 - DNA, 22 bp, Homo sapiens
cagaggaaggctctgggaatgt

SEQ ID NO: 7917260 - DNA, 22 bp, Homo sapiens
cagaggaagggtgctgcgaaag

SEQ ID NO: 7917261 - DNA, 22 bp, Homo sapiens
cagaggaagcagacacatcttg

SEQ ID NO: 7917262 - DNA, 22 bp, Homo sapiens
cagaggaagctgggtgtggagt

SEQ ID NO: 7917263 - DNA, 22 bp, Homo sapiens
cagaggaagcagacacatcttg

SEQ ID NO: 7917264 - DNA, 22 bp, Homo sapiens
cagaggaagcagacacatcttg

SEQ ID NO: 7917265 - DNA, 22 bp, Homo sapiens
cagaggaagcagacacatcttg

SEQ ID NO: 7917266 - DNA, 22 bp, Homo sapiens
cagaggaagagatacaagccct

SEQ ID NO: 7917267 - DNA, 22 bp, Homo sapiens
cagaggaagcagacacatcttg

SEQ ID NO: 7917268 - DNA, 22 bp, Homo sapiens
cagaggaagctgggtgtggagt

SEQ ID NO: 7917269 - DNA, 22 bp, Homo sapiens
cagaggaagctgggtgtggagt

SEQ ID NO: 7917270 - DNA, 22 bp, Homo sapiens
cagaggaaggctctgggaatgt

SEQ ID NO: 7917271 - DNA, 22 bp, Homo sapiens
cagaggacctgtgtggccagag

SEQ ID NO: 7917272 - DNA, 22 bp, Homo sapiens
cagaggaccattgtatgtattg

SEQ ID NO: 7917273 - DNA, 22 bp, Homo sapiens
cagaggacctgtgtggccagag

SEQ ID NO: 7917274 - DNA, 22 bp, Homo sapiens
cagaggacctgtgtggccagag

SEQ ID NO: 7917275 - DNA, 22 bp, Homo sapiens
cagaggacctgtgtggccagag

SEQ ID NO: 7917276 - DNA, 22 bp, Homo sapiens
cagaggaccagaaaggggccca

SEQ ID NO: 7917277 - DNA, 22 bp, Homo sapiens
cagaggacaatagaatggaaag

SEQ ID NO: 7917278 - DNA, 22 bp, Homo sapiens
cagaggacatgaaaactcgctc

SEQ ID NO: 7917279 - DNA, 22 bp, Homo sapiens
cagaggaccagaaaggggccca

SEQ ID NO: 7917280 - DNA, 22 bp, Homo sapiens
ggggcgccccgagggtgcgcac

SEQ ID NO: 7917281 - DNA, 22 bp, Homo sapiens
ggggcggggctctgagaagcat

SEQ ID NO: 7917282 - DNA, 22 bp, Homo sapiens
cagaggacttcccactcatctg

SEQ ID NO: 7917283 - DNA, 22 bp, Homo sapiens
ggggcgccccgagggtgcgcac

SEQ ID NO: 7917284 - DNA, 22 bp, Homo sapiens
cagaggacttcccactcatctg

SEQ ID NO: 7917285 - DNA, 22 bp, Homo sapiens
ggggcggggctctgagaagcat

SEQ ID NO: 7917286 - DNA, 22 bp, Homo sapiens
ggggcggggctctgagaagcat

SEQ ID NO: 7917287 - DNA, 22 bp, Homo sapiens
ggggcggggctctgagaagcat

SEQ ID NO: 7917288 - DNA, 22 bp, Homo sapiens
ggggcggggctctgagaagcat

SEQ ID NO: 7917289 - DNA, 22 bp, Homo sapiens
ggggcggggctctgagaagcat

SEQ ID NO: 7917290 - DNA, 22 bp, Homo sapiens
ggggcggggctctgagaagcat

SEQ ID NO: 7917291 - DNA, 22 bp, Homo sapiens
ggggcggggctctgagaagcat

SEQ ID NO: 7917292 - DNA, 22 bp, Homo sapiens
gggggagctgttattggcaggg

SEQ ID NO: 7917293 - DNA, 22 bp, Homo sapiens
gggggagctagtccagctgagg

SEQ ID NO: 7917294 - DNA, 22 bp, Homo sapiens
gggggagctagtccagctgagg

SEQ ID NO: 7917295 - DNA, 23 bp, Homo sapiens
gggggagctggactcctagatcc

SEQ ID NO: 7917296 - DNA, 22 bp, Homo sapiens
gggggaggtgaatgcaataagg

SEQ ID NO: 7917297 - DNA, 22 bp, Homo sapiens
gggggaggtgaatgcaataagg

SEQ ID NO: 7917298 - DNA, 22 bp, Homo sapiens
gggggagctgttattggcaggg

SEQ ID NO: 7917299 - DNA, 22 bp, Homo sapiens
gggggaggtgaatgcaataagg

SEQ ID NO: 7917300 - DNA, 22 bp, Homo sapiens
gggggaggtgaatgcaataagg

SEQ ID NO: 7917301 - DNA, 22 bp, Homo sapiens
gggggaggtgaatgcaataagg

SEQ ID NO: 7917302 - DNA, 22 bp, Homo sapiens
gggggaggtgaatgcaataagg

SEQ ID NO: 7917303 - DNA, 22 bp, Homo sapiens
gggggaggtgaatgcaataagg

SEQ ID NO: 7917304 - DNA, 22 bp, Homo sapiens
gggggaggtgaatgcaataagg

SEQ ID NO: 7917305 - DNA, 22 bp, Homo sapiens
cagaggaaatgggaaggagata

SEQ ID NO: 7917306 - DNA, 22 bp, Homo sapiens
cagaggaaatgggaaggagata

SEQ ID NO: 7917307 - DNA, 22 bp, Homo sapiens
cagaggaaatgggaaggagata

SEQ ID NO: 7917308 - DNA, 22 bp, Homo sapiens
cagaggaaatgggaaggagata

SEQ ID NO: 7917309 - DNA, 22 bp, Homo sapiens
cagaggaacgtttggattgatt

SEQ ID NO: 7917310 - DNA, 22 bp, Homo sapiens
cagaggaaatgggaaggagata

SEQ ID NO: 7917311 - DNA, 22 bp, Homo sapiens
cagaggaagagatacaagccct

SEQ ID NO: 7917312 - DNA, 22 bp, Homo sapiens
cagaggaaatgggaaggagata

SEQ ID NO: 7917313 - DNA, 22 bp, Homo sapiens
cagaggaagagatacaagccct

SEQ ID NO: 7917314 - DNA, 22 bp, Homo sapiens
cagaggaagagatacaagccct

SEQ ID NO: 7917315 - DNA, 22 bp, Homo sapiens
cagagctttggctagatggttg

SEQ ID NO: 7917316 - DNA, 22 bp, Homo sapiens
cagagctttgtgtcagggctgt

SEQ ID NO: 7917317 - DNA, 22 bp, Homo sapiens
cagagcttgaatgtccatggtt

SEQ ID NO: 7917318 - DNA, 22 bp, Homo sapiens
cagagcttgaatgtccatggtt

SEQ ID NO: 7917319 - DNA, 21 bp, Homo sapiens
cagagcttgctgagaggcctg

SEQ ID NO: 7917320 - DNA, 22 bp, Homo sapiens
cagagcttggctgtggttgtga

SEQ ID NO: 7917321 - DNA, 22 bp, Homo sapiens
cagagcttttagatgttgaaca

SEQ ID NO: 7917322 - DNA, 22 bp, Homo sapiens
cagagctttttacattaatgat

SEQ ID NO: 7917323 - DNA, 22 bp, Homo sapiens
cagagctttttacattaatgat

SEQ ID NO: 7917324 - DNA, 22 bp, Homo sapiens
cagaggaaagtatttctggaag

SEQ ID NO: 7917325 - DNA, 22 bp, Homo sapiens
cagaggaaagtatttctggaag

SEQ ID NO: 7917326 - DNA, 22 bp, Homo sapiens
cagagctgtcatttgccagtga

SEQ ID NO: 7917327 - DNA, 22 bp, Homo sapiens
cagagctgtcatttgccagtga

SEQ ID NO: 7917328 - DNA, 22 bp, Homo sapiens
cagagctgtcatttgccagtga

SEQ ID NO: 7917329 - DNA, 22 bp, Homo sapiens
cagagctgtcatttgccagtga

SEQ ID NO: 7917330 - DNA, 22 bp, Homo sapiens
cagagctgtcatttgccagtga

SEQ ID NO: 7917331 - DNA, 22 bp, Homo sapiens
cagagcttctgacagctgctgc

SEQ ID NO: 7917332 - DNA, 22 bp, Homo sapiens
cagagctgtcatttgccagtga

SEQ ID NO: 7917333 - DNA, 22 bp, Homo sapiens
gggctctgcgctcagctccagc

SEQ ID NO: 7917334 - DNA, 22 bp, Homo sapiens
gggctctgcgctcagctccagc

SEQ ID NO: 7917335 - DNA, 22 bp, Homo sapiens
gggctctgcgctcagctccagc

SEQ ID NO: 7917336 - DNA, 22 bp, Homo sapiens
gggctctgcgctcagctccagc

SEQ ID NO: 7917337 - DNA, 22 bp, Homo sapiens
gggctctgcgctcagctccagc

SEQ ID NO: 7917338 - DNA, 22 bp, Homo sapiens
gggctctgcgctcagctccagc

SEQ ID NO: 7917339 - DNA, 22 bp, Homo sapiens
gggctctgcgggcccggactcc

SEQ ID NO: 7917340 - DNA, 22 bp, Homo sapiens
gggctctgcgctcagctccagc

SEQ ID NO: 7917341 - DNA, 20 bp, Homo sapiens
gggctctgcatccatcagcc

SEQ ID NO: 7917342 - DNA, 21 bp, Homo sapiens
gggctctgccctcctggagct

SEQ ID NO: 7917343 - DNA, 21 bp, Homo sapiens
gggctctgccctcctggagct

SEQ ID NO: 7917344 - DNA, 20 bp, Homo sapiens
gggctctgcatccatcagcc

SEQ ID NO: 7917345 - DNA, 20 bp, Homo sapiens
gggctctgcatccatcagcc

SEQ ID NO: 7917346 - DNA, 20 bp, Homo sapiens
gggctctgcatccatcagcc

SEQ ID NO: 7917347 - DNA, 20 bp, Homo sapiens
gggctctgcatccatcagcc

SEQ ID NO: 7917348 - DNA, 20 bp, Homo sapiens
gggctctgcatccatcagcc

SEQ ID NO: 7917349 - DNA, 20 bp, Homo sapiens
gggctctgcatccatcagcc

SEQ ID NO: 7917350 - DNA, 22 bp, Homo sapiens
gggctctgcctggctgggagta

SEQ ID NO: 7917351 - DNA, 22 bp, Homo sapiens
gggctctgcctggctgggagta

SEQ ID NO: 7917352 - DNA, 22 bp, Homo sapiens
gggctctgcctggctgggagta

SEQ ID NO: 7917353 - DNA, 22 bp, Homo sapiens
gggctctgcctggctgggagta

SEQ ID NO: 7917354 - DNA, 21 bp, Homo sapiens
gggctctgccctcctggagct

SEQ ID NO: 7917355 - DNA, 21 bp, Homo sapiens
gggctctgccctcctggagct

SEQ ID NO: 7917356 - DNA, 21 bp, Homo sapiens
gggctctgccctcctggagct

SEQ ID NO: 7917357 - DNA, 21 bp, Homo sapiens
gggctctgccctcctggagct

SEQ ID NO: 7917358 - DNA, 21 bp, Homo sapiens
gggctctgccctcctggagct

SEQ ID NO: 7917359 - DNA, 22 bp, Homo sapiens
gggctcagtcctggttctaccc

SEQ ID NO: 7917360 - DNA, 22 bp, Homo sapiens
gggctcagtcctggttctaccc

SEQ ID NO: 7917361 - DNA, 22 bp, Homo sapiens
gggctcaggtcagggcatcagc

SEQ ID NO: 7917362 - DNA, 22 bp, Homo sapiens
gggctcaggtcagggcatcagc

SEQ ID NO: 7917363 - DNA, 22 bp, Homo sapiens
gggctcaggtcagggcatcagc

SEQ ID NO: 7917364 - DNA, 22 bp, Homo sapiens
gggctcaggtcagggcatcagc

SEQ ID NO: 7917365 - DNA, 22 bp, Homo sapiens
gggctcaggtcagggcatcagc

SEQ ID NO: 7917366 - DNA, 22 bp, Homo sapiens
gggctcagggacacatgtgtgt

SEQ ID NO: 7917367 - DNA, 22 bp, Homo sapiens
gggctcagggacacatgtgtgt

SEQ ID NO: 7917368 - DNA, 22 bp, Homo sapiens
gggctcaggtcagggcatcagc

SEQ ID NO: 7917369 - DNA, 22 bp, Homo sapiens
gggctcagggacacatgtgtgt

SEQ ID NO: 7917370 - DNA, 22 bp, Homo sapiens
gggctcagggacacatgtgtgt

SEQ ID NO: 7917371 - DNA, 22 bp, Homo sapiens
gggctcaggcctggcctctcac

SEQ ID NO: 7917372 - DNA, 22 bp, Homo sapiens
gggctcaggcctggcctctcac

SEQ ID NO: 7917373 - DNA, 22 bp, Homo sapiens
gggctcaggcctggcctctcac

SEQ ID NO: 7917374 - DNA, 22 bp, Homo sapiens
gggctcaggcctggcctctcac

SEQ ID NO: 7917375 - DNA, 22 bp, Homo sapiens
gggctcaggcctggcctctcac

SEQ ID NO: 7917376 - DNA, 22 bp, Homo sapiens
gggctcaggagtttgaggctgc

SEQ ID NO: 7917377 - DNA, 22 bp, Homo sapiens
gggctcaggagtttgaggctgc

SEQ ID NO: 7917378 - DNA, 22 bp, Homo sapiens
gggctcaggagtttgaggctgc

SEQ ID NO: 7917379 - DNA, 22 bp, Homo sapiens
gggctcaggcctggcctctcac

SEQ ID NO: 7917380 - DNA, 22 bp, Homo sapiens
gggctcaggagtttgaggctgc

SEQ ID NO: 7917381 - DNA, 22 bp, Homo sapiens
gggctcaggagtttgaggctgc

SEQ ID NO: 7917382 - DNA, 22 bp, Homo sapiens
gggctctgcacgttctggcgtc

SEQ ID NO: 7917383 - DNA, 18 bp, Homo sapiens
gggctctgatccttcacc

SEQ ID NO: 7917384 - DNA, 18 bp, Homo sapiens
gggctctgatccttcacc

SEQ ID NO: 7917385 - DNA, 18 bp, Homo sapiens
gggctctgatccttcacc

SEQ ID NO: 7917386 - DNA, 22 bp, Homo sapiens
gggctctgatagagattattgc

SEQ ID NO: 7917387 - DNA, 21 bp, Homo sapiens
gggctcagtggaaaagagtgt

SEQ ID NO: 7917388 - DNA, 22 bp, Homo sapiens
gggctctgcagtgacttgaggg

SEQ ID NO: 7917389 - DNA, 22 bp, Homo sapiens
gggctctgcagtgacttgaggg

SEQ ID NO: 7917390 - DNA, 22 bp, Homo sapiens
gggctctgcagagaactggctc

SEQ ID NO: 7917391 - DNA, 22 bp, Homo sapiens
gggctctgcagagaactggctc

SEQ ID NO: 7917392 - DNA, 22 bp, Homo sapiens
gggctctgcacgttctggcgtc

SEQ ID NO: 7917393 - DNA, 21 bp, Homo sapiens
gggctcagtggaaaagagtgt

SEQ ID NO: 7917394 - DNA, 22 bp, Homo sapiens
gggctcagtctggcgtggaatg

SEQ ID NO: 7917395 - DNA, 22 bp, Homo sapiens
gggctcagtctggcgtggaatg

SEQ ID NO: 7917396 - DNA, 22 bp, Homo sapiens
gggctcagtctggcgtggaatg

SEQ ID NO: 7917397 - DNA, 22 bp, Homo sapiens
gggctcagtctgcggcgcgcgg

SEQ ID NO: 7917398 - DNA, 22 bp, Homo sapiens
gggctcagtctgcggcgcgcgg

SEQ ID NO: 7917399 - DNA, 22 bp, Homo sapiens
gggctcagtctgcggcgcgcgg

SEQ ID NO: 7917400 - DNA, 22 bp, Homo sapiens
gggctcagtcggcaagcccctt

SEQ ID NO: 7917401 - DNA, 22 bp, Homo sapiens
gggctcagtcggcaagcccctt

SEQ ID NO: 7917402 - DNA, 22 bp, Homo sapiens
gggctcagtcggcaagcccctt

SEQ ID NO: 7917403 - DNA, 22 bp, Homo sapiens
cagagagaggtgccgataatgg

SEQ ID NO: 7917404 - DNA, 22 bp, Homo sapiens
cagagagagtctgtccctgaag

SEQ ID NO: 7917405 - DNA, 22 bp, Homo sapiens
cagagagagtctgtccctgaag

SEQ ID NO: 7917406 - DNA, 22 bp, Homo sapiens
cagagagagtcaaatctttgct

SEQ ID NO: 7917407 - DNA, 22 bp, Homo sapiens
cagagagagtctgtccctgaag

SEQ ID NO: 7917408 - DNA, 22 bp, Homo sapiens
cagagagagtcaaatctttgct

SEQ ID NO: 7917409 - DNA, 22 bp, Homo sapiens
cagagagaggggctgcctggcc

SEQ ID NO: 7917410 - DNA, 22 bp, Homo sapiens
cagagagaggtgccgataatgg

SEQ ID NO: 7917411 - DNA, 22 bp, Homo sapiens
cagagagaggggctgcctggcc

SEQ ID NO: 7917412 - DNA, 22 bp, Homo sapiens
cagagagaggggctgcctggcc

SEQ ID NO: 7917413 - DNA, 22 bp, Homo sapiens
cagagagaggggctgcctggcc

SEQ ID NO: 7917414 - DNA, 22 bp, Homo sapiens
cagagagaggggctgcctggcc

SEQ ID NO: 7917415 - DNA, 22 bp, Homo sapiens
cagagagaggggctgcctggcc

SEQ ID NO: 7917416 - DNA, 22 bp, Homo sapiens
cagagagaggccactgctatta

SEQ ID NO: 7917417 - DNA, 22 bp, Homo sapiens
cagagagagcaggaaacctccg

SEQ ID NO: 7917418 - DNA, 22 bp, Homo sapiens
cagagagagcaggaaacctccg

SEQ ID NO: 7917419 - DNA, 22 bp, Homo sapiens
cagagagagcaggaaacctccg

SEQ ID NO: 7917420 - DNA, 22 bp, Homo sapiens
cagagagaggccactgctatta

SEQ ID NO: 7917421 - DNA, 22 bp, Homo sapiens
cagagagaggccactgctatta

SEQ ID NO: 7917422 - DNA, 22 bp, Homo sapiens
cagagagaggccactgctatta

SEQ ID NO: 7917423 - DNA, 22 bp, Homo sapiens
cagagagaggccactgctatta

SEQ ID NO: 7917424 - DNA, 22 bp, Homo sapiens
cagagagagcaggaaacctccg

SEQ ID NO: 7917425 - DNA, 19 bp, Homo sapiens
cagagagaccaaggcgcca

SEQ ID NO: 7917426 - DNA, 19 bp, Homo sapiens
cagagagaccaaggcgcca

SEQ ID NO: 7917427 - DNA, 22 bp, Homo sapiens
cagagagaatcttggcagctga

SEQ ID NO: 7917428 - DNA, 19 bp, Homo sapiens
cagagagaccaaggcgcca

SEQ ID NO: 7917429 - DNA, 22 bp, Homo sapiens
cagagagagcaggaaacctccg

SEQ ID NO: 7917430 - DNA, 19 bp, Homo sapiens
cagagagaccaaggcgcca

SEQ ID NO: 7917431 - DNA, 19 bp, Homo sapiens
cagagagaccaaggcgcca

SEQ ID NO: 7917432 - DNA, 20 bp, Homo sapiens
cagagacctgtcttcacaga

SEQ ID NO: 7917433 - DNA, 20 bp, Homo sapiens
cagagacctgtcttcacaga

SEQ ID NO: 7917434 - DNA, 22 bp, Homo sapiens
cagagacatccatgttagttgg

SEQ ID NO: 7917435 - DNA, 22 bp, Homo sapiens
cagagacctgcccatttacgct

SEQ ID NO: 7917436 - DNA, 18 bp, Homo sapiens
cagaagcaggcagtgcag

SEQ ID NO: 7917437 - DNA, 18 bp, Homo sapiens
cagaagcaggcagtgcag

SEQ ID NO: 7917438 - DNA, 18 bp, Homo sapiens
cagaagcaggcagtgcag

SEQ ID NO: 7917439 - DNA, 18 bp, Homo sapiens
cagaagcaggcagtgcag

SEQ ID NO: 7917440 - DNA, 18 bp, Homo sapiens
cagaagcaggcagtgcag

SEQ ID NO: 7917441 - DNA, 18 bp, Homo sapiens
cagaagcaggcagtgcag

SEQ ID NO: 7917442 - DNA, 22 bp, Homo sapiens
cagagacagtttcacagggtct

SEQ ID NO: 7917443 - DNA, 22 bp, Homo sapiens
cagagagaatatgtagtatgga

SEQ ID NO: 7917444 - DNA, 22 bp, Homo sapiens
cagagagaatatgtagtatgga

SEQ ID NO: 7917445 - DNA, 22 bp, Homo sapiens
cagagactggagtgcagtggcg

SEQ ID NO: 7917446 - DNA, 22 bp, Homo sapiens
cagagagaatatgtagtatgga

SEQ ID NO: 7917447 - DNA, 22 bp, Homo sapiens
cagagagaatcttggcagctga

SEQ ID NO: 7917448 - DNA, 22 bp, Homo sapiens
cagagagaatcttggcagctga

SEQ ID NO: 7917449 - DNA, 22 bp, Homo sapiens
cagagagaatcttggcagctga

SEQ ID NO: 7917450 - DNA, 22 bp, Homo sapiens
cagagagaatcttggcagctga

SEQ ID NO: 7917451 - DNA, 22 bp, Homo sapiens
cagagagaatcttggcagctga

SEQ ID NO: 7917452 - DNA, 22 bp, Homo sapiens
cagagagaatcttggcagctga

SEQ ID NO: 7917453 - DNA, 22 bp, Homo sapiens
cagagagaatcttggcagctga

SEQ ID NO: 7917454 - DNA, 22 bp, Homo sapiens
cagaagagtagctgaacaagtt

SEQ ID NO: 7917455 - DNA, 22 bp, Homo sapiens
cagaagagtagctgaacaagtt

SEQ ID NO: 7917456 - DNA, 22 bp, Homo sapiens
cagaagatctcttagtggaggg

SEQ ID NO: 7917457 - DNA, 22 bp, Homo sapiens
cagaagatgcagtgtctgagaa

SEQ ID NO: 7917458 - DNA, 22 bp, Homo sapiens
cagaagatgcagtgtctgagaa

SEQ ID NO: 7917459 - DNA, 22 bp, Homo sapiens
cagaagatgctttgtaaaatga

SEQ ID NO: 7917460 - DNA, 22 bp, Homo sapiens
cagaagatgctttgtaaaatga

SEQ ID NO: 7917461 - DNA, 22 bp, Homo sapiens
cagaagcaaatgccttgctgag

SEQ ID NO: 7917462 - DNA, 22 bp, Homo sapiens
cagaagcaaatgccttgctgag

SEQ ID NO: 7917463 - DNA, 22 bp, Homo sapiens
cagaagcaaatgccttgctgag

SEQ ID NO: 7917464 - DNA, 22 bp, Homo sapiens
cagaagcaagtagtgattcttt

SEQ ID NO: 7917465 - DNA, 22 bp, Homo sapiens
cagaagcaagtagtgattcttt

SEQ ID NO: 7917466 - DNA, 22 bp, Homo sapiens
cagaagcaagggccaaagtctt

SEQ ID NO: 7917467 - DNA, 22 bp, Homo sapiens
cagaagcaagggccaaagtctt

SEQ ID NO: 7917468 - DNA, 22 bp, Homo sapiens
cagaagcaagtagtgattcttt

SEQ ID NO: 7917469 - DNA, 22 bp, Homo sapiens
cagaagcaagtagtgattcttt

SEQ ID NO: 7917470 - DNA, 22 bp, Homo sapiens
cagaagcaagagccggagctag

SEQ ID NO: 7917471 - DNA, 22 bp, Homo sapiens
cagaagcaagagccggagctag

SEQ ID NO: 7917472 - DNA, 20 bp, Homo sapiens
cagaagcaaggcaggtacct

SEQ ID NO: 7917473 - DNA, 20 bp, Homo sapiens
cagaagcaaggcaggtacct

SEQ ID NO: 7917474 - DNA, 20 bp, Homo sapiens
cagaagcaaggcaggtacct

SEQ ID NO: 7917475 - DNA, 22 bp, Homo sapiens
cagaagcaagggccaaagtctt

SEQ ID NO: 7917476 - DNA, 22 bp, Homo sapiens
cagaagcaagggccaaagtctt

SEQ ID NO: 7917477 - DNA, 23 bp, Homo sapiens
cagaagcacctgttgactgctgc

SEQ ID NO: 7917478 - DNA, 22 bp, Homo sapiens
cagaagcactaggaggaaacgt

SEQ ID NO: 7917479 - DNA, 22 bp, Homo sapiens
cagaagcactaggaggaaacgt

SEQ ID NO: 7917480 - DNA, 23 bp, Homo sapiens
cagaagcacctgttgactgctgc

SEQ ID NO: 7917481 - DNA, 23 bp, Homo sapiens
cagaagcacctgttgactgctgc

SEQ ID NO: 7917482 - DNA, 23 bp, Homo sapiens
cagaagcacctgttgactgctgc

SEQ ID NO: 7917483 - DNA, 23 bp, Homo sapiens
cagaagcacctgttgactgctgc

SEQ ID NO: 7917484 - DNA, 23 bp, Homo sapiens
cagaagcacctgttgactgctgc

SEQ ID NO: 7917485 - DNA, 22 bp, Homo sapiens
cagaagcacatgtttacatgta

SEQ ID NO: 7917486 - DNA, 23 bp, Homo sapiens
cagaagcacctgttgactgctgc

SEQ ID NO: 7917487 - DNA, 22 bp, Homo sapiens
cagaagcacatgtttacatgta

SEQ ID NO: 7917488 - DNA, 22 bp, Homo sapiens
cagaagcacatgtttacatgta

SEQ ID NO: 7917489 - DNA, 22 bp, Homo sapiens
cagaagcacatgtttacatgta

SEQ ID NO: 7917490 - DNA, 22 bp, Homo sapiens
cagaagcaagtagtgattcttt

SEQ ID NO: 7917491 - DNA, 22 bp, Homo sapiens
cagaagcacatgtttacatgta

SEQ ID NO: 7917492 - DNA, 22 bp, Homo sapiens
cagaagcacatgtttacatgta

SEQ ID NO: 7917493 - DNA, 22 bp, Homo sapiens
cagaagcacatgtttacatgta

SEQ ID NO: 7917494 - DNA, 22 bp, Homo sapiens
cagaagcagattctaaagcaag

SEQ ID NO: 7917495 - DNA, 18 bp, Homo sapiens
cagaagcaggcagtgcag

SEQ ID NO: 7917496 - DNA, 22 bp, Homo sapiens
cagaagcagattctaaagcaag

SEQ ID NO: 7917497 - DNA, 22 bp, Homo sapiens
cagaagcagattctaaagcaag

SEQ ID NO: 7917498 - DNA, 22 bp, Homo sapiens
cagaagcagattctaaagcaag

SEQ ID NO: 7917499 - DNA, 22 bp, Homo sapiens
cagaagcagattctaaagcaag

SEQ ID NO: 7917500 - DNA, 22 bp, Homo sapiens
cagaagcagattctaaagcaag

SEQ ID NO: 7917501 - DNA, 22 bp, Homo sapiens
cagaagcagattctaaagcaag

SEQ ID NO: 7917502 - DNA, 22 bp, Homo sapiens
cagaagcagaacactagattta

SEQ ID NO: 7917503 - DNA, 22 bp, Homo sapiens
cagaagcagaacactagattta

SEQ ID NO: 7917504 - DNA, 22 bp, Homo sapiens
cagaagcagaacactagattta

SEQ ID NO: 7917505 - DNA, 22 bp, Homo sapiens
cagaagcagaacactagattta

SEQ ID NO: 7917506 - DNA, 22 bp, Homo sapiens
cagaagcagaacactagattta

SEQ ID NO: 7917507 - DNA, 22 bp, Homo sapiens
cagaagcactaggaggaaacgt

SEQ ID NO: 7917508 - DNA, 22 bp, Homo sapiens
cagaagcagaacactagattta

SEQ ID NO: 7917509 - DNA, 23 bp, Homo sapiens
cagaagcacctgttgactgctgc

SEQ ID NO: 7917510 - DNA, 21 bp, Homo sapiens
cagagcagcgttctgctgtgg

SEQ ID NO: 7917511 - DNA, 21 bp, Homo sapiens
cagagcagcgttctgctgtgg

SEQ ID NO: 7917512 - DNA, 21 bp, Homo sapiens
cagagcagcgttctgctgtgg

SEQ ID NO: 7917513 - DNA, 21 bp, Homo sapiens
cagagcagcgttctgctgtgg

SEQ ID NO: 7917514 - DNA, 21 bp, Homo sapiens
cagagcagcgttctgctgtgg

SEQ ID NO: 7917515 - DNA, 21 bp, Homo sapiens
cagagcagcgttctgctgtgg

SEQ ID NO: 7917516 - DNA, 22 bp, Homo sapiens
cagagcagcctccagggggagc

SEQ ID NO: 7917517 - DNA, 22 bp, Homo sapiens
cagagcagcctccagggggagc

SEQ ID NO: 7917518 - DNA, 22 bp, Homo sapiens
cagagcagcctccagggggagc

SEQ ID NO: 7917519 - DNA, 22 bp, Homo sapiens
cagagcagcctccagggggagc

SEQ ID NO: 7917520 - DNA, 22 bp, Homo sapiens
cagagcagcctccagggggagc

SEQ ID NO: 7917521 - DNA, 22 bp, Homo sapiens
cagagcagcagagcttccatgg

SEQ ID NO: 7917522 - DNA, 22 bp, Homo sapiens
cagagcagcagagcttccatgg

SEQ ID NO: 7917523 - DNA, 22 bp, Homo sapiens
cagagcagcctccagggggagc

SEQ ID NO: 7917524 - DNA, 22 bp, Homo sapiens
cagagcagcctccagggggagc

SEQ ID NO: 7917525 - DNA, 22 bp, Homo sapiens
cagagcagcctccagggggagc

SEQ ID NO: 7917526 - DNA, 22 bp, Homo sapiens
gggcgcgggaaggagcccgaga

SEQ ID NO: 7917527 - DNA, 17 bp, Homo sapiens
gggcgcgggtagagccc

SEQ ID NO: 7917528 - DNA, 22 bp, Homo sapiens
gggcgccgtgggaaacagccgg

SEQ ID NO: 7917529 - DNA, 22 bp, Homo sapiens
gggcgcgcacgccagacagcct

SEQ ID NO: 7917530 - DNA, 22 bp, Homo sapiens
gggcgccgtgggaaacagccgg

SEQ ID NO: 7917531 - DNA, 22 bp, Homo sapiens
cagagcaggcccactgccctcc

SEQ ID NO: 7917532 - DNA, 22 bp, Homo sapiens
cagagcaggcccactgccctcc

SEQ ID NO: 7917533 - DNA, 18 bp, Homo sapiens
gggcggaagggaagataa

SEQ ID NO: 7917534 - DNA, 17 bp, Homo sapiens
gggcgcgggtagagccc

SEQ ID NO: 7917535 - DNA, 17 bp, Homo sapiens
gggcgcgggtagagccc

SEQ ID NO: 7917536 - DNA, 22 bp, Homo sapiens
cagagcaggcccactgccctcc

SEQ ID NO: 7917537 - DNA, 22 bp, Homo sapiens
cagagcaggcccactgccctcc

SEQ ID NO: 7917538 - DNA, 22 bp, Homo sapiens
cagagcaggaatagggtgttga

SEQ ID NO: 7917539 - DNA, 22 bp, Homo sapiens
cagagcaggcccactgccctcc

SEQ ID NO: 7917540 - DNA, 22 bp, Homo sapiens
cagagcaggaatagggtgttga

SEQ ID NO: 7917541 - DNA, 22 bp, Homo sapiens
cagagcaggaatagggtgttga

SEQ ID NO: 7917542 - DNA, 22 bp, Homo sapiens
cagagcaggaatagggtgttga

SEQ ID NO: 7917543 - DNA, 21 bp, Homo sapiens
cagagcagcgttctgctgtgg

SEQ ID NO: 7917544 - DNA, 22 bp, Homo sapiens
gggccctggctttcctgttctt

SEQ ID NO: 7917545 - DNA, 20 bp, Homo sapiens
gggccctgggattcagagca

SEQ ID NO: 7917546 - DNA, 20 bp, Homo sapiens
gggccctgggattcagagca

SEQ ID NO: 7917547 - DNA, 22 bp, Homo sapiens
gggccctgggattcagagcaag

SEQ ID NO: 7917548 - DNA, 22 bp, Homo sapiens
gggccctgggattcagagcaag

SEQ ID NO: 7917549 - DNA, 22 bp, Homo sapiens
gggccctgggattcagagcaag

SEQ ID NO: 7917550 - DNA, 22 bp, Homo sapiens
gggccctgggattcagagcaag

SEQ ID NO: 7917551 - DNA, 18 bp, Homo sapiens
gggccctggcgtccgccc

SEQ ID NO: 7917552 - DNA, 22 bp, Homo sapiens
gggccctggctttcctgttctt

SEQ ID NO: 7917553 - DNA, 22 bp, Homo sapiens
gggccctggctttcctgttctt

SEQ ID NO: 7917554 - DNA, 18 bp, Homo sapiens
gggccctggcgtccgccc

SEQ ID NO: 7917555 - DNA, 18 bp, Homo sapiens
gggccctggcgtccgccc

SEQ ID NO: 7917556 - DNA, 18 bp, Homo sapiens
gggccctggcgtccgccc

SEQ ID NO: 7917557 - DNA, 22 bp, Homo sapiens
cagagcagcagagcttccatgg

SEQ ID NO: 7917558 - DNA, 22 bp, Homo sapiens
cagagcagcagagcttccatgg

SEQ ID NO: 7917559 - DNA, 22 bp, Homo sapiens
cagagcagcagagcttccatgg

SEQ ID NO: 7917560 - DNA, 22 bp, Homo sapiens
cagagcagcagagcttccatgg

SEQ ID NO: 7917561 - DNA, 22 bp, Homo sapiens
cagagcagatttctaagtattg

SEQ ID NO: 7917562 - DNA, 22 bp, Homo sapiens
cagagcagagtgattgttctgg

SEQ ID NO: 7917563 - DNA, 22 bp, Homo sapiens
cagagcagcagagcttccatgg

SEQ ID NO: 7917564 - DNA, 22 bp, Homo sapiens
cagagcagatttctaagtattg

SEQ ID NO: 7917565 - DNA, 22 bp, Homo sapiens
cagagcagatttctaagtattg

SEQ ID NO: 7917566 - DNA, 18 bp, Homo sapiens
cagagcagaggtggagcg

SEQ ID NO: 7917567 - DNA, 18 bp, Homo sapiens
cagagcagaggtggagcg

SEQ ID NO: 7917568 - DNA, 22 bp, Homo sapiens
cagagcagagtgattgttctgg

SEQ ID NO: 7917569 - DNA, 22 bp, Homo sapiens
cagagcagagtgattgttctgg

SEQ ID NO: 7917570 - DNA, 22 bp, Homo sapiens
cagagcagagtgattgttctgg

SEQ ID NO: 7917571 - DNA, 22 bp, Homo sapiens
cagagagcatgggaggcccgag

SEQ ID NO: 7917572 - DNA, 22 bp, Homo sapiens
cagagagcatgggaggcccgag

SEQ ID NO: 7917573 - DNA, 22 bp, Homo sapiens
cagagagcatgggaggcccgag

SEQ ID NO: 7917574 - DNA, 21 bp, Homo sapiens
cagagagctagaacttcatga

SEQ ID NO: 7917575 - DNA, 22 bp, Homo sapiens
cagagagcttagtgtgctgcat

SEQ ID NO: 7917576 - DNA, 21 bp, Homo sapiens
cagagagctagaacttcatga

SEQ ID NO: 7917577 - DNA, 16 bp, Homo sapiens
cagagaggacagaggc

SEQ ID NO: 7917578 - DNA, 16 bp, Homo sapiens
cagagaggacagaggc

SEQ ID NO: 7917579 - DNA, 22 bp, Homo sapiens
cagagagcttgcccttgtatat

SEQ ID NO: 7917580 - DNA, 22 bp, Homo sapiens
cagagagcttagtgtgctgcat

SEQ ID NO: 7917581 - DNA, 22 bp, Homo sapiens
cagagagcttagtgtgctgcat

SEQ ID NO: 7917582 - DNA, 22 bp, Homo sapiens
cagagagcttagtgtgctgcat

SEQ ID NO: 7917583 - DNA, 22 bp, Homo sapiens
cagagagcttagtgtgctgcat

SEQ ID NO: 7917584 - DNA, 22 bp, Homo sapiens
cagagagcttagtgtgctgcat

SEQ ID NO: 7917585 - DNA, 22 bp, Homo sapiens
cagagagcttagtgtgctgcat

SEQ ID NO: 7917586 - DNA, 22 bp, Homo sapiens
cagagagagtggggtgtggatt

SEQ ID NO: 7917587 - DNA, 22 bp, Homo sapiens
cagagagagtctgtccctgaag

SEQ ID NO: 7917588 - DNA, 22 bp, Homo sapiens
cagagagagtggggtgtggatt

SEQ ID NO: 7917589 - DNA, 22 bp, Homo sapiens
cagagagagtggggtgtggatt

SEQ ID NO: 7917590 - DNA, 22 bp, Homo sapiens
cagagagagtggggtgtggatt

SEQ ID NO: 7917591 - DNA, 22 bp, Homo sapiens
cagagagagtggggtgtggatt

SEQ ID NO: 7917592 - DNA, 22 bp, Homo sapiens
cagagagagtctgtccctgaag

SEQ ID NO: 7917593 - DNA, 22 bp, Homo sapiens
cagagagagtctgtccctgaag

SEQ ID NO: 7917594 - DNA, 22 bp, Homo sapiens
cagagagagtctgtccctgaag

SEQ ID NO: 7917595 - DNA, 22 bp, Homo sapiens
cagagagcacataggatacttt

SEQ ID NO: 7917596 - DNA, 22 bp, Homo sapiens
cagagagcacataggatacttt

SEQ ID NO: 7917597 - DNA, 22 bp, Homo sapiens
cagagagagtggggtgtggatt

SEQ ID NO: 7917598 - DNA, 22 bp, Homo sapiens
cagagagagtggggtgtggatt

SEQ ID NO: 7917599 - DNA, 22 bp, Homo sapiens
cagagagagtggggtgtggatt

SEQ ID NO: 7917600 - DNA, 22 bp, Homo sapiens
cagagagagtggggtgtggatt

SEQ ID NO: 7917601 - DNA, 22 bp, Homo sapiens
cagagagagtggggtgtggatt

SEQ ID NO: 7917602 - DNA, 22 bp, Homo sapiens
gggccctggatttaagcatgga

SEQ ID NO: 7917603 - DNA, 22 bp, Homo sapiens
gggccctggccgaatccctctg

SEQ ID NO: 7917604 - DNA, 22 bp, Homo sapiens
gggccctggatttaagcatgga

SEQ ID NO: 7917605 - DNA, 22 bp, Homo sapiens
gggccctggccgaatccctctg

SEQ ID NO: 7917606 - DNA, 22 bp, Homo sapiens
gggccctggccgaatccctctg

SEQ ID NO: 7917607 - DNA, 22 bp, Homo sapiens
gggccctggccgaatccctctg

SEQ ID NO: 7917608 - DNA, 22 bp, Homo sapiens
gggccctggacgtggcggcaga

SEQ ID NO: 7917609 - DNA, 22 bp, Homo sapiens
gggccctggatttaagcatgga

SEQ ID NO: 7917610 - DNA, 22 bp, Homo sapiens
gggccctggatttaagcatgga

SEQ ID NO: 7917611 - DNA, 22 bp, Homo sapiens
gggccctggacgtggcggcaga

SEQ ID NO: 7917612 - DNA, 22 bp, Homo sapiens
gggccctggacgtggcggcaga

SEQ ID NO: 7917613 - DNA, 22 bp, Homo sapiens
gggccctggacgtggcggcaga

SEQ ID NO: 7917614 - DNA, 22 bp, Homo sapiens
gggccctgcgtccggaagtctg

SEQ ID NO: 7917615 - DNA, 22 bp, Homo sapiens
gggccctggacgtggcggcaga

SEQ ID NO: 7917616 - DNA, 22 bp, Homo sapiens
gggccctggacgtggcggcaga

SEQ ID NO: 7917617 - DNA, 22 bp, Homo sapiens
gggccctggacgtggcggcaga

SEQ ID NO: 7917618 - DNA, 22 bp, Homo sapiens
gggccctggacgtggcggcaga

SEQ ID NO: 7917619 - DNA, 22 bp, Homo sapiens
gggccctggacgtggcggcaga

SEQ ID NO: 7917620 - DNA, 22 bp, Homo sapiens
gggccctgcgtccggaagtctg

SEQ ID NO: 7917621 - DNA, 22 bp, Homo sapiens
gggccctgcgtccggaagtctg

SEQ ID NO: 7917622 - DNA, 22 bp, Homo sapiens
gggccaggagtggagatatggg

SEQ ID NO: 7917623 - DNA, 22 bp, Homo sapiens
gggccagctctgtgatgtaggg

SEQ ID NO: 7917624 - DNA, 22 bp, Homo sapiens
gggccaggagtggagatatggg

SEQ ID NO: 7917625 - DNA, 22 bp, Homo sapiens
gggccctgcgactcgcggcgga

SEQ ID NO: 7917626 - DNA, 22 bp, Homo sapiens
ggggtagggtgattgtgaagta

SEQ ID NO: 7917627 - DNA, 22 bp, Homo sapiens
ggggtagggtgattgtgaagta

SEQ ID NO: 7917628 - DNA, 22 bp, Homo sapiens
ggggtcaagctcagaatcctag

SEQ ID NO: 7917629 - DNA, 22 bp, Homo sapiens
ggggtaggtcatagcccctcta

SEQ ID NO: 7917630 - DNA, 22 bp, Homo sapiens
cagaggctgctctgggtggcat

SEQ ID NO: 7917631 - DNA, 22 bp, Homo sapiens
cagaggctgctctgggtggcat

SEQ ID NO: 7917632 - DNA, 22 bp, Homo sapiens
cagaggctgctctgggtggcat

SEQ ID NO: 7917633 - DNA, 22 bp, Homo sapiens
cagaggctgctctgggtggcat

SEQ ID NO: 7917634 - DNA, 22 bp, Homo sapiens
ggggtagggtgattgtgaagta

SEQ ID NO: 7917635 - DNA, 22 bp, Homo sapiens
ggggtagggtgattgtgaagta

SEQ ID NO: 7917636 - DNA, 22 bp, Homo sapiens
ggggtagggtgattgtgaagta

SEQ ID NO: 7917637 - DNA, 22 bp, Homo sapiens
ggggtagggtgattgtgaagta

SEQ ID NO: 7917638 - DNA, 22 bp, Homo sapiens
cagaggctgccagccatgtgca

SEQ ID NO: 7917639 - DNA, 22 bp, Homo sapiens
cagaggctgccagccatgtgca

SEQ ID NO: 7917640 - DNA, 22 bp, Homo sapiens
cagaggctgccagccatgtgca

SEQ ID NO: 7917641 - DNA, 22 bp, Homo sapiens
cagaggctgccagccatgtgca

SEQ ID NO: 7917642 - DNA, 22 bp, Homo sapiens
cagaggctgccagccatgtgca

SEQ ID NO: 7917643 - DNA, 22 bp, Homo sapiens
cagaggctgccagccatgtgca

SEQ ID NO: 7917644 - DNA, 22 bp, Homo sapiens
cagaggctgatgtgggatgggc

SEQ ID NO: 7917645 - DNA, 22 bp, Homo sapiens
cagaggctgatgtgggatgggc

SEQ ID NO: 7917646 - DNA, 22 bp, Homo sapiens
cagaggctgaccctgctgttgt

SEQ ID NO: 7917647 - DNA, 22 bp, Homo sapiens
cagaggcctttctacagtgata

SEQ ID NO: 7917648 - DNA, 22 bp, Homo sapiens
cagaggcctttctacagtgata

SEQ ID NO: 7917649 - DNA, 22 bp, Homo sapiens
cagaggcctttctacagtgata

SEQ ID NO: 7917650 - DNA, 22 bp, Homo sapiens
cagaggcctttctacagtgata

SEQ ID NO: 7917651 - DNA, 22 bp, Homo sapiens
cagaggcaggataagaactgcg

SEQ ID NO: 7917652 - DNA, 22 bp, Homo sapiens
cagaggctgatggctgtagcca

SEQ ID NO: 7917653 - DNA, 22 bp, Homo sapiens
cagaggctgatggctgtagcca

SEQ ID NO: 7917654 - DNA, 21 bp, Homo sapiens
cagaggctgagagggcaatct

SEQ ID NO: 7917655 - DNA, 21 bp, Homo sapiens
cagaggctgagagggcaatct

SEQ ID NO: 7917656 - DNA, 22 bp, Homo sapiens
ggggtctgggcttagctggaat

SEQ ID NO: 7917657 - DNA, 22 bp, Homo sapiens
ggggtctgggcttagctggaat

SEQ ID NO: 7917658 - DNA, 22 bp, Homo sapiens
ggggtctgggttgctcggcctt

SEQ ID NO: 7917659 - DNA, 22 bp, Homo sapiens
ggggtgagatcaaggaagccct

SEQ ID NO: 7917660 - DNA, 22 bp, Homo sapiens
ggggtgagatcaaggaagccct

SEQ ID NO: 7917661 - DNA, 22 bp, Homo sapiens
ggggtgagatcaaggaagccct

SEQ ID NO: 7917662 - DNA, 22 bp, Homo sapiens
ggggtgagctgggcctgtgcct

SEQ ID NO: 7917663 - DNA, 22 bp, Homo sapiens
cagagtgaaaactgagctcaaa

SEQ ID NO: 7917664 - DNA, 22 bp, Homo sapiens
ggggtcctggaggccagctgga

SEQ ID NO: 7917665 - DNA, 22 bp, Homo sapiens
ggggtctcactatgttacccag

SEQ ID NO: 7917666 - DNA, 22 bp, Homo sapiens
ggggtctgctgcggagcagaga

SEQ ID NO: 7917667 - DNA, 22 bp, Homo sapiens
ggggtctgctgcggagcagaga

SEQ ID NO: 7917668 - DNA, 22 bp, Homo sapiens
ggggtctgcgccactgtctgcg

SEQ ID NO: 7917669 - DNA, 22 bp, Homo sapiens
ggggtccctgcaccagcatgtc

SEQ ID NO: 7917670 - DNA, 22 bp, Homo sapiens
ggggtccctgcaccagcatgtc

SEQ ID NO: 7917671 - DNA, 21 bp, Homo sapiens
ggggtcaagtgaatggtgttg

SEQ ID NO: 7917672 - DNA, 22 bp, Homo sapiens
ggggtcctggaggccagctgga

SEQ ID NO: 7917673 - DNA, 22 bp, Homo sapiens
ggggtcctcggagcctgggtct

SEQ ID NO: 7917674 - DNA, 22 bp, Homo sapiens
cagagtgaaaactgagctcaaa

SEQ ID NO: 7917675 - DNA, 18 bp, Homo sapiens
cagagtgggccaagagac

SEQ ID NO: 7917676 - DNA, 22 bp, Homo sapiens
cagagtgggctgtcagccacca

SEQ ID NO: 7917677 - DNA, 22 bp, Homo sapiens
cagagtgggctgtcagccacca

SEQ ID NO: 7917678 - DNA, 22 bp, Homo sapiens
cagagtgggctgtcagccacca

SEQ ID NO: 7917679 - DNA, 22 bp, Homo sapiens
cagagtggtgcaagggcagtgt

SEQ ID NO: 7917680 - DNA, 22 bp, Homo sapiens
cagagtggtgcaagggcagtgt

SEQ ID NO: 7917681 - DNA, 22 bp, Homo sapiens
cagagtggtgcaagggcagtgt

SEQ ID NO: 7917682 - DNA, 22 bp, Homo sapiens
cagagtttgcaagggcagaagc

SEQ ID NO: 7917683 - DNA, 19 bp, Homo sapiens
cagagtttgcaggcagagg

SEQ ID NO: 7917684 - DNA, 22 bp, Homo sapiens
cagagtttgcaagggcagaagc

SEQ ID NO: 7917685 - DNA, 19 bp, Homo sapiens
cagagtttgcaggcagagg

SEQ ID NO: 7917686 - DNA, 22 bp, Homo sapiens
cagagtttaaacaaatgaaata

SEQ ID NO: 7917687 - DNA, 22 bp, Homo sapiens
cagagtttaaacaaatgaaata

SEQ ID NO: 7917688 - DNA, 22 bp, Homo sapiens
cagagtttcggtaagcatagaa

SEQ ID NO: 7917689 - DNA, 22 bp, Homo sapiens
cagagttcaaagcctgctggga

SEQ ID NO: 7917690 - DNA, 22 bp, Homo sapiens
cagagtttaaacaaatgaaata

SEQ ID NO: 7917691 - DNA, 19 bp, Homo sapiens
cagagttacatggctgtgg

SEQ ID NO: 7917692 - DNA, 19 bp, Homo sapiens
cagagttacatggctgtgg

SEQ ID NO: 7917693 - DNA, 22 bp, Homo sapiens
cagataataatatgacttcact

SEQ ID NO: 7917694 - DNA, 22 bp, Homo sapiens
cagataactgaaatatcatacc

SEQ ID NO: 7917695 - DNA, 22 bp, Homo sapiens
cagataacacaaagaaatgggc

SEQ ID NO: 7917696 - DNA, 22 bp, Homo sapiens
cagataactgaaatatcatacc

SEQ ID NO: 7917697 - DNA, 22 bp, Homo sapiens
cagatacaggtttttgttagat

SEQ ID NO: 7917698 - DNA, 22 bp, Homo sapiens
cagataataatatgacttcact

SEQ ID NO: 7917699 - DNA, 22 bp, Homo sapiens
cagataaatagatagataaact

SEQ ID NO: 7917700 - DNA, 22 bp, Homo sapiens
cagataaatagacttggtcaga

SEQ ID NO: 7917701 - DNA, 22 bp, Homo sapiens
cagataaatagacttggtcaga

SEQ ID NO: 7917702 - DNA, 22 bp, Homo sapiens
cagataaatagacttggtcaga

SEQ ID NO: 7917703 - DNA, 22 bp, Homo sapiens
cagataaatagatagataaact

SEQ ID NO: 7917704 - DNA, 22 bp, Homo sapiens
cagataaatagatagataaact

SEQ ID NO: 7917705 - DNA, 22 bp, Homo sapiens
cagagttttgtgaacaacttgg

SEQ ID NO: 7917706 - DNA, 22 bp, Homo sapiens
cagataaaattaatattaccaa

SEQ ID NO: 7917707 - DNA, 22 bp, Homo sapiens
cagataaaattaatattaccaa

SEQ ID NO: 7917708 - DNA, 20 bp, Homo sapiens
cagataaacgggaaagaagc

SEQ ID NO: 7917709 - DNA, 22 bp, Homo sapiens
cagataaaattaatattaccaa

SEQ ID NO: 7917710 - DNA, 20 bp, Homo sapiens
cagataaacgggaaagaagc

SEQ ID NO: 7917711 - DNA, 22 bp, Homo sapiens
cagataaaggcttactagtagt

SEQ ID NO: 7917712 - DNA, 22 bp, Homo sapiens
cagataaaggcttactagtagt

SEQ ID NO: 7917713 - DNA, 22 bp, Homo sapiens
cagataaaggcttactagtagt

SEQ ID NO: 7917714 - DNA, 22 bp, Homo sapiens
cagataaaggcttactagtagt

SEQ ID NO: 7917715 - DNA, 20 bp, Homo sapiens
cagataaacgggaaagaagc

SEQ ID NO: 7917716 - DNA, 22 bp, Homo sapiens
ggtgagaggcagaggacagctt

SEQ ID NO: 7917717 - DNA, 22 bp, Homo sapiens
cagatatattttatttggtcaa

SEQ ID NO: 7917718 - DNA, 22 bp, Homo sapiens
cagatatattttccttattagg

SEQ ID NO: 7917719 - DNA, 22 bp, Homo sapiens
cagatatattttccttattagg

SEQ ID NO: 7917720 - DNA, 22 bp, Homo sapiens
cagatataaatggatgtggtag

SEQ ID NO: 7917721 - DNA, 22 bp, Homo sapiens
cagatataaatggatgtggtag

SEQ ID NO: 7917722 - DNA, 22 bp, Homo sapiens
cagatataagaaagctattgtc

SEQ ID NO: 7917723 - DNA, 22 bp, Homo sapiens
cagatataagaaagctattgtc

SEQ ID NO: 7917724 - DNA, 22 bp, Homo sapiens
cagatatattcatttgcagtgc

SEQ ID NO: 7917725 - DNA, 22 bp, Homo sapiens
cagatatagtggcttgcctggg

SEQ ID NO: 7917726 - DNA, 22 bp, Homo sapiens
cagatatatattcatcaggctg

SEQ ID NO: 7917727 - DNA, 22 bp, Homo sapiens
cagatagaatgcaagacctctc

SEQ ID NO: 7917728 - DNA, 22 bp, Homo sapiens
cagatagaatgcaagacctctc

SEQ ID NO: 7917729 - DNA, 22 bp, Homo sapiens
cagatagcaatttgggcagggg

SEQ ID NO: 7917730 - DNA, 22 bp, Homo sapiens
cagataggaaaagctaggcata

SEQ ID NO: 7917731 - DNA, 22 bp, Homo sapiens
cagatagctgtaaataaatgga

SEQ ID NO: 7917732 - DNA, 22 bp, Homo sapiens
cagatagctgtaaataaatgga

SEQ ID NO: 7917733 - DNA, 22 bp, Homo sapiens
cagataggaaaagctaggcata

SEQ ID NO: 7917734 - DNA, 22 bp, Homo sapiens
cagatagaatgcaagacctctc

SEQ ID NO: 7917735 - DNA, 22 bp, Homo sapiens
cagatacctgggtatcatttag

SEQ ID NO: 7917736 - DNA, 22 bp, Homo sapiens
cagatacaggtttttgttagat

SEQ ID NO: 7917737 - DNA, 22 bp, Homo sapiens
cagatacattaaaatgatgatt

SEQ ID NO: 7917738 - DNA, 22 bp, Homo sapiens
cagatacattaaaatgatgatt

SEQ ID NO: 7917739 - DNA, 22 bp, Homo sapiens
ggtgcaagagctccaggccctg

SEQ ID NO: 7917740 - DNA, 22 bp, Homo sapiens
ggtgcaaagggcctagagagtg

SEQ ID NO: 7917741 - DNA, 22 bp, Homo sapiens
ggtgagaggcagaggacagctt

SEQ ID NO: 7917742 - DNA, 22 bp, Homo sapiens
ggtgagaggcagaggacagctt

SEQ ID NO: 7917743 - DNA, 22 bp, Homo sapiens
ggtgagaggcagtgctgtggaa

SEQ ID NO: 7917744 - DNA, 22 bp, Homo sapiens
ggtgcagaagaaagcagtcatt

SEQ ID NO: 7917745 - DNA, 22 bp, Homo sapiens
ggtgcagaagaaagcagtcatt

SEQ ID NO: 7917746 - DNA, 22 bp, Homo sapiens
ggtgcaataaagttgtagaacc

SEQ ID NO: 7917747 - DNA, 22 bp, Homo sapiens
ggtgcacttcttgctagtcttt

SEQ ID NO: 7917748 - DNA, 22 bp, Homo sapiens
ggtgagaggcagaggacagctt

SEQ ID NO: 7917749 - DNA, 22 bp, Homo sapiens
ggtgcaagggttgagttgagtg

SEQ ID NO: 7917750 - DNA, 22 bp, Homo sapiens
ggtgcagaaggaagggagctgg

SEQ ID NO: 7917751 - DNA, 22 bp, Homo sapiens
ggtgcagaaggaagggagctgg

SEQ ID NO: 7917752 - DNA, 22 bp, Homo sapiens
ggtgcagaagaaagcagtcatt

SEQ ID NO: 7917753 - DNA, 22 bp, Homo sapiens
ggtgcagaagaaagcagtcatt

SEQ ID NO: 7917754 - DNA, 22 bp, Homo sapiens
ggtgcagaaggaagggagctgg

SEQ ID NO: 7917755 - DNA, 22 bp, Homo sapiens
ggtgcagaaggaagggagctgg

SEQ ID NO: 7917756 - DNA, 22 bp, Homo sapiens
ggtgcagagcagtgtcagagca

SEQ ID NO: 7917757 - DNA, 22 bp, Homo sapiens
ggtgcagagcagtgtcagagca

SEQ ID NO: 7917758 - DNA, 22 bp, Homo sapiens
ggtgcagaggagccagctgggg

SEQ ID NO: 7917759 - DNA, 22 bp, Homo sapiens
ggtgcagaggagccagctgggg

SEQ ID NO: 7917760 - DNA, 22 bp, Homo sapiens
ggtgcagaggagccagctgggg

SEQ ID NO: 7917761 - DNA, 20 bp, Homo sapiens
cagatgctggatcttggtcc

SEQ ID NO: 7917762 - DNA, 20 bp, Homo sapiens
cagatgctggatcttggtcc

SEQ ID NO: 7917763 - DNA, 22 bp, Homo sapiens
cagatgctggtatgggggaggt

SEQ ID NO: 7917764 - DNA, 22 bp, Homo sapiens
cagatgcttcgtgggtgagcac

SEQ ID NO: 7917765 - DNA, 22 bp, Homo sapiens
cagatgcttcgtgggtgagcac

SEQ ID NO: 7917766 - DNA, 22 bp, Homo sapiens
cagatgcttcgtgggtgagcac

SEQ ID NO: 7917767 - DNA, 16 bp, Homo sapiens
cagatgcttgctggca

SEQ ID NO: 7917768 - DNA, 22 bp, Homo sapiens
cagatgctgctcacctgattat

SEQ ID NO: 7917769 - DNA, 22 bp, Homo sapiens
cagatgctgctatttcaccctg

SEQ ID NO: 7917770 - DNA, 22 bp, Homo sapiens
cagatgctgcctgggaatgtct

SEQ ID NO: 7917771 - DNA, 22 bp, Homo sapiens
cagatgctatagtgctgccata

SEQ ID NO: 7917772 - DNA, 22 bp, Homo sapiens
cagatgctatagtgctgccata

SEQ ID NO: 7917773 - DNA, 22 bp, Homo sapiens
cagatgctatgtattatgtatg

SEQ ID NO: 7917774 - DNA, 22 bp, Homo sapiens
cagatgctatgtattatgtatg

SEQ ID NO: 7917775 - DNA, 22 bp, Homo sapiens
ggtgcagagtccacagaaagct

SEQ ID NO: 7917776 - DNA, 22 bp, Homo sapiens
ggtgcagcagtttgttcagctt

SEQ ID NO: 7917777 - DNA, 22 bp, Homo sapiens
ggtgcagatctttctcttcagg

SEQ ID NO: 7917778 - DNA, 22 bp, Homo sapiens
ggtgcagagtccacagaaagct

SEQ ID NO: 7917779 - DNA, 22 bp, Homo sapiens
ggtgcagcctttgtttctactt

SEQ ID NO: 7917780 - DNA, 22 bp, Homo sapiens
ggtgcagctgcagcctgggagc

SEQ ID NO: 7917781 - DNA, 22 bp, Homo sapiens
ggtgcagctgcagcctgggagc

SEQ ID NO: 7917782 - DNA, 22 bp, Homo sapiens
ggtgcagctggacagagaagcc

SEQ ID NO: 7917783 - DNA, 22 bp, Homo sapiens
ggtgcagctggacagagaagcc

SEQ ID NO: 7917784 - DNA, 18 bp, Homo sapiens
cagatgctaggcctccag

SEQ ID NO: 7917785 - DNA, 22 bp, Homo sapiens
cagatgctatagtgctgccata

SEQ ID NO: 7917786 - DNA, 18 bp, Homo sapiens
cagatgctaggcctccag

SEQ ID NO: 7917787 - DNA, 22 bp, Homo sapiens
ggtgcaggaaaattacctggag

SEQ ID NO: 7917788 - DNA, 22 bp, Homo sapiens
ggtgggacaggtaggagtggct

SEQ ID NO: 7917789 - DNA, 22 bp, Homo sapiens
ggtgggacaggtaggagtggct

SEQ ID NO: 7917790 - DNA, 22 bp, Homo sapiens
ggtgggacaggtaggagtggct

SEQ ID NO: 7917791 - DNA, 22 bp, Homo sapiens
cagcactcccaggagaaccagc

SEQ ID NO: 7917792 - DNA, 22 bp, Homo sapiens
ggtgggaaggggccagtgtgcg

SEQ ID NO: 7917793 - DNA, 22 bp, Homo sapiens
ggtgggaaggggccagtgtgcg

SEQ ID NO: 7917794 - DNA, 22 bp, Homo sapiens
ggtgggacaggtaggagtggct

SEQ ID NO: 7917795 - DNA, 22 bp, Homo sapiens
ggtgggaaggccactgaaggtt

SEQ ID NO: 7917796 - DNA, 22 bp, Homo sapiens
ggtgggaaggccactgaaggtt

SEQ ID NO: 7917797 - DNA, 18 bp, Homo sapiens
ggtgggaagccagggcct

SEQ ID NO: 7917798 - DNA, 22 bp, Homo sapiens
ggtgggaaggccactgaaggtt

SEQ ID NO: 7917799 - DNA, 22 bp, Homo sapiens
ggtgggaaggccactgaaggtt

SEQ ID NO: 7917800 - DNA, 22 bp, Homo sapiens
cagcactgctgctgtacacaca

SEQ ID NO: 7917801 - DNA, 20 bp, Homo sapiens
cagcagaaatggggtgggaa

SEQ ID NO: 7917802 - DNA, 20 bp, Homo sapiens
cagcagaaatggggtgggaa

SEQ ID NO: 7917803 - DNA, 22 bp, Homo sapiens
cagcagaacaggcagggaagct

SEQ ID NO: 7917804 - DNA, 22 bp, Homo sapiens
cagcagaacaggcagggaagct

SEQ ID NO: 7917805 - DNA, 22 bp, Homo sapiens
cagcagaacaggcagggaagct

SEQ ID NO: 7917806 - DNA, 22 bp, Homo sapiens
cagcagaacaggcagggaagct

SEQ ID NO: 7917807 - DNA, 22 bp, Homo sapiens
cagcactgctgctgtacacaca

SEQ ID NO: 7917808 - DNA, 22 bp, Homo sapiens
cagcactcccaggagaaccagc

SEQ ID NO: 7917809 - DNA, 22 bp, Homo sapiens
cagcagaagcaacattcaggct

SEQ ID NO: 7917810 - DNA, 22 bp, Homo sapiens
cagcagaagcaacattcaggct

SEQ ID NO: 7917811 - DNA, 22 bp, Homo sapiens
cagcagaagcaacattcaggct

SEQ ID NO: 7917812 - DNA, 21 bp, Homo sapiens
cagcagaagcatctatggaag

SEQ ID NO: 7917813 - DNA, 21 bp, Homo sapiens
cagcagaagcatctatggaag

SEQ ID NO: 7917814 - DNA, 21 bp, Homo sapiens
cagcagaagcatctatggaag

SEQ ID NO: 7917815 - DNA, 21 bp, Homo sapiens
cagcagaagcatctatggaag

SEQ ID NO: 7917816 - DNA, 22 bp, Homo sapiens
cagcagaacagttaaagaaacc

SEQ ID NO: 7917817 - DNA, 22 bp, Homo sapiens
cagcagaacagttaaagaaacc

SEQ ID NO: 7917818 - DNA, 22 bp, Homo sapiens
cagcagaacagttaaagaaacc

SEQ ID NO: 7917819 - DNA, 22 bp, Homo sapiens
cagcagaacagttaaagaaacc

SEQ ID NO: 7917820 - DNA, 22 bp, Homo sapiens
cagcagaacaggcagggaagct

SEQ ID NO: 7917821 - DNA, 22 bp, Homo sapiens
cagcagaacaggcagggaagct

SEQ ID NO: 7917822 - DNA, 22 bp, Homo sapiens
cagcagaacaggcagggaagct

SEQ ID NO: 7917823 - DNA, 22 bp, Homo sapiens
cagcagaacaggcagggaagct

SEQ ID NO: 7917824 - DNA, 22 bp, Homo sapiens
ggtggcagtggtctctgacaga

SEQ ID NO: 7917825 - DNA, 22 bp, Homo sapiens
ggtggcagtggtctctgacaga

SEQ ID NO: 7917826 - DNA, 22 bp, Homo sapiens
ggtggcagtggtctctgacaga

SEQ ID NO: 7917827 - DNA, 22 bp, Homo sapiens
ggtggcagttacaggggcaaat

SEQ ID NO: 7917828 - DNA, 22 bp, Homo sapiens
ggtggcagtggtctctgacaga

SEQ ID NO: 7917829 - DNA, 22 bp, Homo sapiens
ggtggcagtggtctctgacaga

SEQ ID NO: 7917830 - DNA, 22 bp, Homo sapiens
ggtggcagtggtctctgacaga

SEQ ID NO: 7917831 - DNA, 22 bp, Homo sapiens
ggtggctggaggagctgatgga

SEQ ID NO: 7917832 - DNA, 22 bp, Homo sapiens
ggtggctggaggagctgatgga

SEQ ID NO: 7917833 - DNA, 22 bp, Homo sapiens
ggtggctggaggagctgatgga

SEQ ID NO: 7917834 - DNA, 22 bp, Homo sapiens
ggtggctggaggagctgatgga

SEQ ID NO: 7917835 - DNA, 22 bp, Homo sapiens
ggtggctggaggagctgatgga

SEQ ID NO: 7917836 - DNA, 22 bp, Homo sapiens
ggtggctgcttcctcaagagga

SEQ ID NO: 7917837 - DNA, 22 bp, Homo sapiens
ggtggctgcttcctcaagagga

SEQ ID NO: 7917838 - DNA, 22 bp, Homo sapiens
ggtggcagttacaggggcaaat

SEQ ID NO: 7917839 - DNA, 22 bp, Homo sapiens
ggtggcagttacaggggcaaat

SEQ ID NO: 7917840 - DNA, 22 bp, Homo sapiens
ggtggctgcttcctcaagagga

SEQ ID NO: 7917841 - DNA, 22 bp, Homo sapiens
ggtggctgcttcctcaagagga

SEQ ID NO: 7917842 - DNA, 22 bp, Homo sapiens
ggtggctggttttataagaggt

SEQ ID NO: 7917843 - DNA, 18 bp, Homo sapiens
ggtgggaagccagggcct

SEQ ID NO: 7917844 - DNA, 22 bp, Homo sapiens
ggtggctgtgagcattatgtga

SEQ ID NO: 7917845 - DNA, 18 bp, Homo sapiens
ggtggctggggacggaca

SEQ ID NO: 7917846 - DNA, 18 bp, Homo sapiens
ggtggctggggacggaca

SEQ ID NO: 7917847 - DNA, 18 bp, Homo sapiens
ggtggctggggacggaca

SEQ ID NO: 7917848 - DNA, 18 bp, Homo sapiens
ggtggctggggacggaca

SEQ ID NO: 7917849 - DNA, 22 bp, Homo sapiens
ggtggctgggattagtagccca

SEQ ID NO: 7917850 - DNA, 22 bp, Homo sapiens
ggtggctgggattagtagccca

SEQ ID NO: 7917851 - DNA, 22 bp, Homo sapiens
ggtggctgggattagtagccca

SEQ ID NO: 7917852 - DNA, 22 bp, Homo sapiens
ggtggctggaggagctgatgga

SEQ ID NO: 7917853 - DNA, 22 bp, Homo sapiens
ggtggctggaggagctgatgga

SEQ ID NO: 7917854 - DNA, 22 bp, Homo sapiens
ggtggctggaggagctgatgga

SEQ ID NO: 7917855 - DNA, 22 bp, Homo sapiens
ggtggctggaggagctgatgga

SEQ ID NO: 7917856 - DNA, 22 bp, Homo sapiens
cagatggcaacagctctgtgac

SEQ ID NO: 7917857 - DNA, 22 bp, Homo sapiens
ggtgctggttcagggtggctgt

SEQ ID NO: 7917858 - DNA, 22 bp, Homo sapiens
ggtgctggttcagggtggctgt

SEQ ID NO: 7917859 - DNA, 22 bp, Homo sapiens
cagatggcaacagctctgtgac

SEQ ID NO: 7917860 - DNA, 22 bp, Homo sapiens
ggtgctggttcagggtggctgt

SEQ ID NO: 7917861 - DNA, 22 bp, Homo sapiens
ggtgctggttcagggtggctgt

SEQ ID NO: 7917862 - DNA, 22 bp, Homo sapiens
ggtgctggttcagggtggctgt

SEQ ID NO: 7917863 - DNA, 22 bp, Homo sapiens
ggtgctggttcagggtggctgt

SEQ ID NO: 7917864 - DNA, 22 bp, Homo sapiens
ggtggcagggagtgtccctggg

SEQ ID NO: 7917865 - DNA, 22 bp, Homo sapiens
ggtggcagggagtgtccctggg

SEQ ID NO: 7917866 - DNA, 22 bp, Homo sapiens
ggtggcagggagtgtccctggg

SEQ ID NO: 7917867 - DNA, 22 bp, Homo sapiens
cagatggagtcccgtggagttc

SEQ ID NO: 7917868 - DNA, 22 bp, Homo sapiens
cagatggaggataaaacatgca

SEQ ID NO: 7917869 - DNA, 22 bp, Homo sapiens
cagatggaaggcatagaggttt

SEQ ID NO: 7917870 - DNA, 22 bp, Homo sapiens
cagatggaacacagaaaggaga

SEQ ID NO: 7917871 - DNA, 22 bp, Homo sapiens
cagatgcttgttggctggtctc

SEQ ID NO: 7917872 - DNA, 22 bp, Homo sapiens
cagatgcttgttggctggtctc

SEQ ID NO: 7917873 - DNA, 22 bp, Homo sapiens
cagatgcttggaggacacttgg

SEQ ID NO: 7917874 - DNA, 22 bp, Homo sapiens
cagatgcttttgattctggggt

SEQ ID NO: 7917875 - DNA, 22 bp, Homo sapiens
cagatggaacacagaaaggaga

SEQ ID NO: 7917876 - DNA, 22 bp, Homo sapiens
cagatgcttttgattctggggt

SEQ ID NO: 7917877 - DNA, 22 bp, Homo sapiens
ggtggcagtagcactgggcctg

SEQ ID NO: 7917878 - DNA, 22 bp, Homo sapiens
ggtggcagtcttaagagatctt

SEQ ID NO: 7917879 - DNA, 22 bp, Homo sapiens
ggtggcagtcttaagagatctt

SEQ ID NO: 7917880 - DNA, 22 bp, Homo sapiens
ggtggcagtcttaagagatctt

SEQ ID NO: 7917881 - DNA, 22 bp, Homo sapiens
ggtggcagtcttaagagatctt

SEQ ID NO: 7917882 - DNA, 22 bp, Homo sapiens
ggtggcagtagcactgggcctg

SEQ ID NO: 7917883 - DNA, 22 bp, Homo sapiens
ggtggcagtagcactgggcctg

SEQ ID NO: 7917884 - DNA, 22 bp, Homo sapiens
ggtggcagtcttaagagatctt

SEQ ID NO: 7917885 - DNA, 22 bp, Homo sapiens
ggtggcagtcttaagagatctt

SEQ ID NO: 7917886 - DNA, 22 bp, Homo sapiens
ggtggcagtcttaagagatctt

SEQ ID NO: 7917887 - DNA, 22 bp, Homo sapiens
ggtggcagtgcttgcgggtcta

SEQ ID NO: 7917888 - DNA, 22 bp, Homo sapiens
ggtggcagtgcttgcgggtcta

SEQ ID NO: 7917889 - DNA, 22 bp, Homo sapiens
ggtggcagtgcttgcgggtcta

SEQ ID NO: 7917890 - DNA, 22 bp, Homo sapiens
ggtggcagtgcttgcgggtcta

SEQ ID NO: 7917891 - DNA, 22 bp, Homo sapiens
ggtggcagtcttaagagatctt

SEQ ID NO: 7917892 - DNA, 22 bp, Homo sapiens
ggtggcagtgcttgcgggtcta

SEQ ID NO: 7917893 - DNA, 22 bp, Homo sapiens
ggtggcagggagtgtccctggg

SEQ ID NO: 7917894 - DNA, 18 bp, Homo sapiens
ggtggcaggtcagatgcc

SEQ ID NO: 7917895 - DNA, 22 bp, Homo sapiens
ggtggcagggagtgtccctggg

SEQ ID NO: 7917896 - DNA, 18 bp, Homo sapiens
ggtggcaggtcagatgcc

SEQ ID NO: 7917897 - DNA, 18 bp, Homo sapiens
ggtggcaggtcagatgcc

SEQ ID NO: 7917898 - DNA, 18 bp, Homo sapiens
ggtggcaggtcagatgcc

SEQ ID NO: 7917899 - DNA, 18 bp, Homo sapiens
ggtggcaggtcagatgcc

SEQ ID NO: 7917900 - DNA, 18 bp, Homo sapiens
ggtggcaggtcagatgcc

SEQ ID NO: 7917901 - DNA, 22 bp, Homo sapiens
ggtggcagtagcactgggcctg

SEQ ID NO: 7917902 - DNA, 22 bp, Homo sapiens
ggtggcagtagcactgggcctg

SEQ ID NO: 7917903 - DNA, 18 bp, Homo sapiens
ggtggcaggtcagatgcc

SEQ ID NO: 7917904 - DNA, 22 bp, Homo sapiens
ggtggcagtagcactgggcctg

SEQ ID NO: 7917905 - DNA, 22 bp, Homo sapiens
ggtggcagtagcactgggcctg

SEQ ID NO: 7917906 - DNA, 22 bp, Homo sapiens
ggtggcagtagcactgggcctg

SEQ ID NO: 7917907 - DNA, 18 bp, Homo sapiens
ggtggcaggtcagatgcc

SEQ ID NO: 7917908 - DNA, 18 bp, Homo sapiens
ggtggcaggtcagatgcc

SEQ ID NO: 7917909 - DNA, 18 bp, Homo sapiens
ggtggcaggtcagatgcc

SEQ ID NO: 7917910 - DNA, 22 bp, Homo sapiens
ggtgtctatgattcagtttatg

SEQ ID NO: 7917911 - DNA, 22 bp, Homo sapiens
ggtgtctatgattcagtttatg

SEQ ID NO: 7917912 - DNA, 22 bp, Homo sapiens
ggtgtctgatggtggcttctca

SEQ ID NO: 7917913 - DNA, 22 bp, Homo sapiens
ggtgtctgatggtggcttctca

SEQ ID NO: 7917914 - DNA, 22 bp, Homo sapiens
ggtgtctgattccaaggccaca

SEQ ID NO: 7917915 - DNA, 22 bp, Homo sapiens
ggtgtctgatggtggcttctca

SEQ ID NO: 7917916 - DNA, 22 bp, Homo sapiens
ggtgtctgatggtggcttctca

SEQ ID NO: 7917917 - DNA, 22 bp, Homo sapiens
ggtgtctcagctgctggcaggg

SEQ ID NO: 7917918 - DNA, 20 bp, Homo sapiens
cagcagagacccatggggag

SEQ ID NO: 7917919 - DNA, 20 bp, Homo sapiens
cagcagagacccatggggag

SEQ ID NO: 7917920 - DNA, 20 bp, Homo sapiens
cagcagagacccatggggag

SEQ ID NO: 7917921 - DNA, 20 bp, Homo sapiens
cagcagagacccatggggag

SEQ ID NO: 7917922 - DNA, 20 bp, Homo sapiens
cagcagagacccatggggag

SEQ ID NO: 7917923 - DNA, 22 bp, Homo sapiens
ggtgtctgcttccctccagctg

SEQ ID NO: 7917924 - DNA, 22 bp, Homo sapiens
ggtgtctgcttccctccagctg

SEQ ID NO: 7917925 - DNA, 22 bp, Homo sapiens
ggtgtctggacagtgagccagg

SEQ ID NO: 7917926 - DNA, 15 bp, Homo sapiens
ggtgtctgcagtgtg

SEQ ID NO: 7917927 - DNA, 22 bp, Homo sapiens
ggtgtctgcttccctccagctg

SEQ ID NO: 7917928 - DNA, 22 bp, Homo sapiens
ggtgtctgcttccctccagctg

SEQ ID NO: 7917929 - DNA, 22 bp, Homo sapiens
ggtgtctgcttccctccagctg

SEQ ID NO: 7917930 - DNA, 19 bp, Homo sapiens
ggtgtgaagtgaggagtta

SEQ ID NO: 7917931 - DNA, 22 bp, Homo sapiens
ggtgtctgttgcctcctggtta

SEQ ID NO: 7917932 - DNA, 22 bp, Homo sapiens
ggtgtctgttgcctcctggtta

SEQ ID NO: 7917933 - DNA, 22 bp, Homo sapiens
ggtgtctgtgatggcatataac

SEQ ID NO: 7917934 - DNA, 22 bp, Homo sapiens
ggtgtctggacagtgagccagg

SEQ ID NO: 7917935 - DNA, 22 bp, Homo sapiens
ggtgtctgtgatggcatataac

SEQ ID NO: 7917936 - DNA, 22 bp, Homo sapiens
ggtgtctgttgcctcctggtta

SEQ ID NO: 7917937 - DNA, 22 bp, Homo sapiens
ggtgtctgtgatggcatataac

SEQ ID NO: 7917938 - DNA, 22 bp, Homo sapiens
ggtgtctggacagtgagccagg

SEQ ID NO: 7917939 - DNA, 20 bp, Homo sapiens
cagcagagacccatggggag

SEQ ID NO: 7917940 - DNA, 20 bp, Homo sapiens
cagcagagacccatggggag

SEQ ID NO: 7917941 - DNA, 22 bp, Homo sapiens
cagcagagaccaagtgatttga

SEQ ID NO: 7917942 - DNA, 22 bp, Homo sapiens
cagcagagaccaagtgatttga

SEQ ID NO: 7917943 - DNA, 22 bp, Homo sapiens
cagcagagaccaagtgatttga

SEQ ID NO: 7917944 - DNA, 22 bp, Homo sapiens
cagcagagaaattacatatttg

SEQ ID NO: 7917945 - DNA, 18 bp, Homo sapiens
cagcagagacattcaaaa

SEQ ID NO: 7917946 - DNA, 22 bp, Homo sapiens
cagcagagaaattacatatttg

SEQ ID NO: 7917947 - DNA, 22 bp, Homo sapiens
cagcagagaaattacatatttg

SEQ ID NO: 7917948 - DNA, 22 bp, Homo sapiens
cagcagagaaattacatatttg

SEQ ID NO: 7917949 - DNA, 22 bp, Homo sapiens
cagcagaagtccgactccagtc

SEQ ID NO: 7917950 - DNA, 22 bp, Homo sapiens
cagcagaagtccgactccagtc

SEQ ID NO: 7917951 - DNA, 21 bp, Homo sapiens
cagcagaagcatctatggaag

SEQ ID NO: 7917952 - DNA, 22 bp, Homo sapiens
cagcagaagtccgactccagtc

SEQ ID NO: 7917953 - DNA, 22 bp, Homo sapiens
cagcagaagtccgactccagtc

SEQ ID NO: 7917954 - DNA, 22 bp, Homo sapiens
cagcagaagtccgactccagtc

SEQ ID NO: 7917955 - DNA, 22 bp, Homo sapiens
cagcagaagtgcatttgtgatt

SEQ ID NO: 7917956 - DNA, 22 bp, Homo sapiens
cagcagactggagtaggcagtg

SEQ ID NO: 7917957 - DNA, 22 bp, Homo sapiens
cagcagaagtgcatttgtgatt

SEQ ID NO: 7917958 - DNA, 22 bp, Homo sapiens
cagcagaagtgcatttgtgatt

SEQ ID NO: 7917959 - DNA, 22 bp, Homo sapiens
cagcagaagtgcatttgtgatt

SEQ ID NO: 7917960 - DNA, 22 bp, Homo sapiens
cagcagaagtgcatttgtgatt

SEQ ID NO: 7917961 - DNA, 22 bp, Homo sapiens
cagcagactggagtaggcagtg

SEQ ID NO: 7917962 - DNA, 22 bp, Homo sapiens
cagcagactggagtaggcagtg

SEQ ID NO: 7917963 - DNA, 22 bp, Homo sapiens
cagcagactgaccttcaacccc

SEQ ID NO: 7917964 - DNA, 22 bp, Homo sapiens
cagcagactgaccttcaacccc

SEQ ID NO: 7917965 - DNA, 22 bp, Homo sapiens
cagcagacttactagaatgtaa

SEQ ID NO: 7917966 - DNA, 22 bp, Homo sapiens
cagcagagaaattaaacttctg

SEQ ID NO: 7917967 - DNA, 22 bp, Homo sapiens
gtaaacatcagccactctattt

SEQ ID NO: 7917968 - DNA, 22 bp, Homo sapiens
gtaaacatcagccactctattt

SEQ ID NO: 7917969 - DNA, 22 bp, Homo sapiens
gtaaacatcagccactctattt

SEQ ID NO: 7917970 - DNA, 22 bp, Homo sapiens
gtaacattattcatgagataca

SEQ ID NO: 7917971 - DNA, 22 bp, Homo sapiens
gtaaacatcagccactctattt

SEQ ID NO: 7917972 - DNA, 22 bp, Homo sapiens
gtaaacatcgacccaacagggg

SEQ ID NO: 7917973 - DNA, 22 bp, Homo sapiens
gtaaacatgctgtgtactcagc

SEQ ID NO: 7917974 - DNA, 22 bp, Homo sapiens
ggtgtgcagtagcaggaggcct

SEQ ID NO: 7917975 - DNA, 22 bp, Homo sapiens
ggtgtgcagtagcaggaggcct

SEQ ID NO: 7917976 - DNA, 22 bp, Homo sapiens
ggtgtgactcgccctcagggac

SEQ ID NO: 7917977 - DNA, 22 bp, Homo sapiens
ggtgtgaaatgttcagtgttac

SEQ ID NO: 7917978 - DNA, 22 bp, Homo sapiens
ggtgtgaaatgttcagtgttac

SEQ ID NO: 7917979 - DNA, 22 bp, Homo sapiens
ggtgtgacctcagtctgggtaa

SEQ ID NO: 7917980 - DNA, 22 bp, Homo sapiens
ggtgtgaattggcatggtgctt

SEQ ID NO: 7917981 - DNA, 22 bp, Homo sapiens
gtaactctttggaaaacatttt

SEQ ID NO: 7917982 - DNA, 22 bp, Homo sapiens
gtaactctgggtagaactcatg

SEQ ID NO: 7917983 - DNA, 20 bp, Homo sapiens
gtaactctggctaagtaaat

SEQ ID NO: 7917984 - DNA, 22 bp, Homo sapiens
gtaacgaataaacaagtgataa

SEQ ID NO: 7917985 - DNA, 22 bp, Homo sapiens
gtaactaggggcatggacacat

SEQ ID NO: 7917986 - DNA, 22 bp, Homo sapiens
gtaactggttttcttccctctc

SEQ ID NO: 7917987 - DNA, 23 bp, Homo sapiens
gtaactggggaatttgagctatg

SEQ ID NO: 7917988 - DNA, 20 bp, Homo sapiens
gtaactctggctaagtaaat

SEQ ID NO: 7917989 - DNA, 22 bp, Homo sapiens
gtaactctgggtagaactcatg

SEQ ID NO: 7917990 - DNA, 22 bp, Homo sapiens
gtaacatttacagttcctagag

SEQ ID NO: 7917991 - DNA, 22 bp, Homo sapiens
gtaagcctctgctctatctggt

SEQ ID NO: 7917992 - DNA, 22 bp, Homo sapiens
gtaagcctgagaaacaccacct

SEQ ID NO: 7917993 - DNA, 22 bp, Homo sapiens
gtaagcattcattgtctgtata

SEQ ID NO: 7917994 - DNA, 22 bp, Homo sapiens
gtaagcctggaatttttgactt

SEQ ID NO: 7917995 - DNA, 22 bp, Homo sapiens
gtaaggcaatagtaaggagtcc

SEQ ID NO: 7917996 - DNA, 20 bp, Homo sapiens
cagcagagacccatggggag

SEQ ID NO: 7917997 - DNA, 20 bp, Homo sapiens
cagcagagacccatggggag

SEQ ID NO: 7917998 - DNA, 20 bp, Homo sapiens
cagcagagacccatggggag

SEQ ID NO: 7917999 - DNA, 20 bp, Homo sapiens
cagcagagacccatggggag

SEQ ID NO: 7918000 - DNA, 22 bp, Homo sapiens
cagcagagacggtaagcagaac

SEQ ID NO: 7918001 - DNA, 22 bp, Homo sapiens
gtaagatttaaaatagcaattg

SEQ ID NO: 7918002 - DNA, 22 bp, Homo sapiens
gtaagcaaacagcaaatgattt

SEQ ID NO: 7918003 - DNA, 22 bp, Homo sapiens
gtaagcaaacagcaaatgattt

SEQ ID NO: 7918004 - DNA, 18 bp, Homo sapiens
gtaagcaaagactttata

SEQ ID NO: 7918005 - DNA, 22 bp, Homo sapiens
gtaagaggagtgggaagcctca

SEQ ID NO: 7918006 - DNA, 22 bp, Homo sapiens
gtaagattagtgagtcacagtg

SEQ ID NO: 7918007 - DNA, 22 bp, Homo sapiens
gtaactctttggaaaacatttt

SEQ ID NO: 7918008 - DNA, 22 bp, Homo sapiens
gtaacttaccattgtagcatca

SEQ ID NO: 7918009 - DNA, 22 bp, Homo sapiens
gtaacttatcatttcaatatag

SEQ ID NO: 7918010 - DNA, 22 bp, Homo sapiens
gtaagaaaaccttctttctaat

SEQ ID NO: 7918011 - DNA, 22 bp, Homo sapiens
atcttcccaggctggggagagg

SEQ ID NO: 7918012 - DNA, 22 bp, Homo sapiens
atcttcccaggctggggagagg

SEQ ID NO: 7918013 - DNA, 22 bp, Homo sapiens
atcttcccaggctggggagagg

SEQ ID NO: 7918014 - DNA, 22 bp, Homo sapiens
atcttcccaggctggggagagg

SEQ ID NO: 7918015 - DNA, 22 bp, Homo sapiens
atcttcccaggctggggagagg

SEQ ID NO: 7918016 - DNA, 22 bp, Homo sapiens
atcttcccaggctggggagagg

SEQ ID NO: 7918017 - DNA, 22 bp, Homo sapiens
atcttcccaggctggggagagg

SEQ ID NO: 7918018 - DNA, 22 bp, Homo sapiens
atcttcccaggctggggagagg

SEQ ID NO: 7918019 - DNA, 22 bp, Homo sapiens
cttgagaaaggaacaggaagct

SEQ ID NO: 7918020 - DNA, 22 bp, Homo sapiens
cttgagaaaggaacaggaagct

SEQ ID NO: 7918021 - DNA, 22 bp, Homo sapiens
cttgagaaaggaacaggaagct

SEQ ID NO: 7918022 - DNA, 22 bp, Homo sapiens
cttgagaaaggaacaggaagct

SEQ ID NO: 7918023 - DNA, 22 bp, Homo sapiens
cttgagaaaggaacaggaagct

SEQ ID NO: 7918024 - DNA, 22 bp, Homo sapiens
atcttcccaggctggggagagg

SEQ ID NO: 7918025 - DNA, 22 bp, Homo sapiens
cttgagaaaggaacaggaagct

SEQ ID NO: 7918026 - DNA, 22 bp, Homo sapiens
cttgagaaggaggaagggcttt

SEQ ID NO: 7918027 - DNA, 22 bp, Homo sapiens
cttgagaacagggttaggtaac

SEQ ID NO: 7918028 - DNA, 22 bp, Homo sapiens
cttgagaacagggttaggtaac

SEQ ID NO: 7918029 - DNA, 22 bp, Homo sapiens
cttgagaacatctccagctcac

SEQ ID NO: 7918030 - DNA, 22 bp, Homo sapiens
cttgagaagcattaagaggtag

SEQ ID NO: 7918031 - DNA, 22 bp, Homo sapiens
cttgagaagagatttatatttg

SEQ ID NO: 7918032 - DNA, 22 bp, Homo sapiens
cttgagaatgtgagccacagat

SEQ ID NO: 7918033 - DNA, 22 bp, Homo sapiens
cttgagaatcttgatgtctacc

SEQ ID NO: 7918034 - DNA, 22 bp, Homo sapiens
cttgagaatcttctctgaagag

SEQ ID NO: 7918035 - DNA, 22 bp, Homo sapiens
cttgagaatcttgatgtctacc

SEQ ID NO: 7918036 - DNA, 22 bp, Homo sapiens
cttgagaatcttgatgtctacc

SEQ ID NO: 7918037 - DNA, 21 bp, Homo sapiens
cttgagaattaactgttcatt

SEQ ID NO: 7918038 - DNA, 22 bp, Homo sapiens
cttgagaatgtgagccacagat

SEQ ID NO: 7918039 - DNA, 22 bp, Homo sapiens
cttgagaatgtgagccacagat

SEQ ID NO: 7918040 - DNA, 22 bp, Homo sapiens
atcttcaaggaaaaaatacagt

SEQ ID NO: 7918041 - DNA, 22 bp, Homo sapiens
atcttcaactttggggctgcct

SEQ ID NO: 7918042 - DNA, 22 bp, Homo sapiens
atcttcaaggaaaaaatacagt

SEQ ID NO: 7918043 - DNA, 22 bp, Homo sapiens
atcttcaacttgatcatttgaa

SEQ ID NO: 7918044 - DNA, 19 bp, Homo sapiens
atcttcaaagccagcagca

SEQ ID NO: 7918045 - DNA, 22 bp, Homo sapiens
atcttcaaagcacatcgtttgt

SEQ ID NO: 7918046 - DNA, 22 bp, Homo sapiens
atcttcaaagcacatcgtttgt

SEQ ID NO: 7918047 - DNA, 22 bp, Homo sapiens
atcttcaactcagagagtgctg

SEQ ID NO: 7918048 - DNA, 22 bp, Homo sapiens
atcttcaacaacaaattgcctc

SEQ ID NO: 7918049 - DNA, 22 bp, Homo sapiens
atcttcaactcagagagtgctg

SEQ ID NO: 7918050 - DNA, 22 bp, Homo sapiens
atcttcaaagggatgtccatgg

SEQ ID NO: 7918051 - DNA, 22 bp, Homo sapiens
atcttcatcaagttcacagtgg

SEQ ID NO: 7918052 - DNA, 22 bp, Homo sapiens
atcttcagcgaggtttcctttc

SEQ ID NO: 7918053 - DNA, 22 bp, Homo sapiens
atcttccaagctccctggtgta

SEQ ID NO: 7918054 - DNA, 16 bp, Homo sapiens
atcttccaaagttatt

SEQ ID NO: 7918055 - DNA, 22 bp, Homo sapiens
atcttccaagctccctggtgta

SEQ ID NO: 7918056 - DNA, 22 bp, Homo sapiens
atcttccaggtgccgggggtca

SEQ ID NO: 7918057 - DNA, 22 bp, Homo sapiens
atcttcccaggctggggagagg

SEQ ID NO: 7918058 - DNA, 22 bp, Homo sapiens
atcttcaattgaaaactagcct

SEQ ID NO: 7918059 - DNA, 22 bp, Homo sapiens
atcttcaattgaaaactagcct

SEQ ID NO: 7918060 - DNA, 22 bp, Homo sapiens
atcttcaaggaaaaaatacagt

SEQ ID NO: 7918061 - DNA, 22 bp, Homo sapiens
atcttcaatatttttgtgtaga

SEQ ID NO: 7918062 - DNA, 22 bp, Homo sapiens
atcttcaatatttttgtgtaga

SEQ ID NO: 7918063 - DNA, 22 bp, Homo sapiens
atcttcaagggaagaaagagta

SEQ ID NO: 7918064 - DNA, 22 bp, Homo sapiens
cttgaggttttgactcagcttt

SEQ ID NO: 7918065 - DNA, 22 bp, Homo sapiens
cttgaggtatgaaacctgcatt

SEQ ID NO: 7918066 - DNA, 22 bp, Homo sapiens
cttgagctgaagccagttgaaa

SEQ ID NO: 7918067 - DNA, 22 bp, Homo sapiens
cttgagcttaggttcaggattg

SEQ ID NO: 7918068 - DNA, 22 bp, Homo sapiens
cttgaggagtttaatagggatc

SEQ ID NO: 7918069 - DNA, 22 bp, Homo sapiens
cttgaggctgcactccagggcc

SEQ ID NO: 7918070 - DNA, 22 bp, Homo sapiens
cttgagctgaagccagttgaaa

SEQ ID NO: 7918071 - DNA, 22 bp, Homo sapiens
cttgagctctcagccactagct

SEQ ID NO: 7918072 - DNA, 22 bp, Homo sapiens
cttgagcacagcggcttcagga

SEQ ID NO: 7918073 - DNA, 22 bp, Homo sapiens
cttgagagccactcctggggcc

SEQ ID NO: 7918074 - DNA, 22 bp, Homo sapiens
cttgagatgtcatctgctttgg

SEQ ID NO: 7918075 - DNA, 18 bp, Homo sapiens
cttgagctaagggacccc

SEQ ID NO: 7918076 - DNA, 18 bp, Homo sapiens
cttgagctaagggacccc

SEQ ID NO: 7918077 - DNA, 23 bp, Homo sapiens
cttgagctcaggaagagctgagt

SEQ ID NO: 7918078 - DNA, 22 bp, Homo sapiens
cttgagctaggaaggctgaggc

SEQ ID NO: 7918079 - DNA, 22 bp, Homo sapiens
atgaagcaggcacagcttcagg

SEQ ID NO: 7918080 - DNA, 22 bp, Homo sapiens
atgaagcagttaaggtgcatga

SEQ ID NO: 7918081 - DNA, 22 bp, Homo sapiens
cttgaggttttgactcagcttt

SEQ ID NO: 7918082 - DNA, 22 bp, Homo sapiens
cttgaggttttgactcagcttt

SEQ ID NO: 7918083 - DNA, 22 bp, Homo sapiens
atgaataaaacattttaatcag

SEQ ID NO: 7918084 - DNA, 22 bp, Homo sapiens
atgaataaaacattttaatcag

SEQ ID NO: 7918085 - DNA, 22 bp, Homo sapiens
atgaataaaacattttaatcag

SEQ ID NO: 7918086 - DNA, 22 bp, Homo sapiens
atgaagttctcaataatcatgt

SEQ ID NO: 7918087 - DNA, 22 bp, Homo sapiens
atgaagttctcaataatcatgt

SEQ ID NO: 7918088 - DNA, 22 bp, Homo sapiens
atgaataaaacattttaatcag

SEQ ID NO: 7918089 - DNA, 22 bp, Homo sapiens
atgaataaaacattttaatcag

SEQ ID NO: 7918090 - DNA, 22 bp, Homo sapiens
atgaatgaagaacatctgtgcc

SEQ ID NO: 7918091 - DNA, 22 bp, Homo sapiens
atgaatcagaatctgcatttta

SEQ ID NO: 7918092 - DNA, 22 bp, Homo sapiens
atgaatccaaagtttactatta

SEQ ID NO: 7918093 - DNA, 22 bp, Homo sapiens
atgaatctgttttttgtcaata

SEQ ID NO: 7918094 - DNA, 22 bp, Homo sapiens
atgaatatgagactgagagcct

SEQ ID NO: 7918095 - DNA, 22 bp, Homo sapiens
atgaatatgagactgagagcct

SEQ ID NO: 7918096 - DNA, 22 bp, Homo sapiens
atgaatatgtacacatctgtca

SEQ ID NO: 7918097 - DNA, 22 bp, Homo sapiens
atgaatacgcggtcatacacat

SEQ ID NO: 7918098 - DNA, 22 bp, Homo sapiens
atgaatattgaatgtcttatga

SEQ ID NO: 7918099 - DNA, 22 bp, Homo sapiens
atgaatattgaatgtcttatga

SEQ ID NO: 7918100 - DNA, 22 bp, Homo sapiens
atgaatcaaactgtacactgag

SEQ ID NO: 7918101 - DNA, 22 bp, Homo sapiens
atgaatcaaagttcatttgatc

SEQ ID NO: 7918102 - DNA, 22 bp, Homo sapiens
atgaatcaaagttcatttgatc

SEQ ID NO: 7918103 - DNA, 22 bp, Homo sapiens
atgaatcaaactgtacactgag

SEQ ID NO: 7918104 - DNA, 22 bp, Homo sapiens
atgaatcaaactgtacactgag

SEQ ID NO: 7918105 - DNA, 22 bp, Homo sapiens
atgaatcaaactgtacactgag

SEQ ID NO: 7918106 - DNA, 22 bp, Homo sapiens
atgaatcaaactgtacactgag

SEQ ID NO: 7918107 - DNA, 22 bp, Homo sapiens
gaaaactaacggaaaagttagg

SEQ ID NO: 7918108 - DNA, 22 bp, Homo sapiens
gaaaactaacggaaaagttagg

SEQ ID NO: 7918109 - DNA, 22 bp, Homo sapiens
gaaaactattggcctagaacaa

SEQ ID NO: 7918110 - DNA, 22 bp, Homo sapiens
gaaaactaacggaaaagttagg

SEQ ID NO: 7918111 - DNA, 22 bp, Homo sapiens
gaaaactaacggaaaagttagg

SEQ ID NO: 7918112 - DNA, 22 bp, Homo sapiens
gaaaactgtgattagaatgcct

SEQ ID NO: 7918113 - DNA, 22 bp, Homo sapiens
gaaaactgtgattagaatgcct

SEQ ID NO: 7918114 - DNA, 22 bp, Homo sapiens
gaaaactgtgattagaatgcct

SEQ ID NO: 7918115 - DNA, 22 bp, Homo sapiens
gaaaactattggcctagaacaa

SEQ ID NO: 7918116 - DNA, 22 bp, Homo sapiens
gaaaactattggcctagaacaa

SEQ ID NO: 7918117 - DNA, 22 bp, Homo sapiens
gaaaacttggatctctagaatg

SEQ ID NO: 7918118 - DNA, 22 bp, Homo sapiens
gaaaacttggatctctagaatg

SEQ ID NO: 7918119 - DNA, 22 bp, Homo sapiens
gaaaagaactgcatgggattaa

SEQ ID NO: 7918120 - DNA, 22 bp, Homo sapiens
gaaaagaactgcatgggattaa

SEQ ID NO: 7918121 - DNA, 22 bp, Homo sapiens
gaaaagagaacatctgaggatc

SEQ ID NO: 7918122 - DNA, 22 bp, Homo sapiens
gaaaagagaacatctgaggatc

SEQ ID NO: 7918123 - DNA, 22 bp, Homo sapiens
gaaaagagaacatctgaggatc

SEQ ID NO: 7918124 - DNA, 22 bp, Homo sapiens
gaaaagagaacatctgaggatc

SEQ ID NO: 7918125 - DNA, 22 bp, Homo sapiens
gaaaagaactgcatgggattaa

SEQ ID NO: 7918126 - DNA, 22 bp, Homo sapiens
gaaaagaactgcatgggattaa

SEQ ID NO: 7918127 - DNA, 22 bp, Homo sapiens
gaaaagaactgcatgggattaa

SEQ ID NO: 7918128 - DNA, 22 bp, Homo sapiens
gaaaatagttcatcacaatgat

SEQ ID NO: 7918129 - DNA, 22 bp, Homo sapiens
gaaaatctgcttatattatttt

SEQ ID NO: 7918130 - DNA, 22 bp, Homo sapiens
gaaaatgagcctcagctacatt

SEQ ID NO: 7918131 - DNA, 22 bp, Homo sapiens
gaaaatgagcctcagctacatt

SEQ ID NO: 7918132 - DNA, 22 bp, Homo sapiens
gaaaatgagcctcagctacatt

SEQ ID NO: 7918133 - DNA, 22 bp, Homo sapiens
gaaaatagttcatcacaatgat

SEQ ID NO: 7918134 - DNA, 22 bp, Homo sapiens
gaaaatagttcatcacaatgat

SEQ ID NO: 7918135 - DNA, 22 bp, Homo sapiens
gaaaatagttcatcacaatgat

SEQ ID NO: 7918136 - DNA, 22 bp, Homo sapiens
gaaaataggctgcatctccttc

SEQ ID NO: 7918137 - DNA, 22 bp, Homo sapiens
gaaaataggctgcatctccttc

SEQ ID NO: 7918138 - DNA, 22 bp, Homo sapiens
gaaaataggctgcatctccttc

SEQ ID NO: 7918139 - DNA, 20 bp, Homo sapiens
gaaaataggccagccaggta

SEQ ID NO: 7918140 - DNA, 20 bp, Homo sapiens
gaaaataggccagccaggta

SEQ ID NO: 7918141 - DNA, 20 bp, Homo sapiens
gaaaataggccagccaggta

SEQ ID NO: 7918142 - DNA, 20 bp, Homo sapiens
gaaaataggccagccaggta

SEQ ID NO: 7918143 - DNA, 20 bp, Homo sapiens
gaaaataggccagccaggta

SEQ ID NO: 7918144 - DNA, 20 bp, Homo sapiens
gaaaataggccagccaggta

SEQ ID NO: 7918145 - DNA, 22 bp, Homo sapiens
gaaaataggcagatgcattgta

SEQ ID NO: 7918146 - DNA, 22 bp, Homo sapiens
gaaaataggcagatgcattgta

SEQ ID NO: 7918147 - DNA, 22 bp, Homo sapiens
gaaaataggcagatgcattgta

SEQ ID NO: 7918148 - DNA, 22 bp, Homo sapiens
gaaaataggcagatgcattgta

SEQ ID NO: 7918149 - DNA, 22 bp, Homo sapiens
gaaaatagcagatagaccaatg

SEQ ID NO: 7918150 - DNA, 22 bp, Homo sapiens
gaaaatagcagatagaccaatg

SEQ ID NO: 7918151 - DNA, 22 bp, Homo sapiens
gaaaatagcagatagaccaatg

SEQ ID NO: 7918152 - DNA, 22 bp, Homo sapiens
gaaaatagcagatagaccaatg

SEQ ID NO: 7918153 - DNA, 22 bp, Homo sapiens
gaaaatagcagatagaccaatg

SEQ ID NO: 7918154 - DNA, 22 bp, Homo sapiens
atgaattaaggataactggtct

SEQ ID NO: 7918155 - DNA, 22 bp, Homo sapiens
atgaattgaggaaaacagtcgt

SEQ ID NO: 7918156 - DNA, 22 bp, Homo sapiens
atgaattgaggaaaacagtcgt

SEQ ID NO: 7918157 - DNA, 22 bp, Homo sapiens
ctttttccagcttcagggtggg

SEQ ID NO: 7918158 - DNA, 22 bp, Homo sapiens
atgaattgaggaaaacagtcgt

SEQ ID NO: 7918159 - DNA, 19 bp, Homo sapiens
atgaatgtgttcttacctc

SEQ ID NO: 7918160 - DNA, 22 bp, Homo sapiens
atgaatgtttggtgatcagata

SEQ ID NO: 7918161 - DNA, 22 bp, Homo sapiens
atgaatgtttggtgatcagata

SEQ ID NO: 7918162 - DNA, 19 bp, Homo sapiens
gaaaacatgggtgagggtc

SEQ ID NO: 7918163 - DNA, 22 bp, Homo sapiens
gaaaacatccagagatagacct

SEQ ID NO: 7918164 - DNA, 22 bp, Homo sapiens
gaaaacatccagagatagacct

SEQ ID NO: 7918165 - DNA, 22 bp, Homo sapiens
ctttttccagcttcagggtggg

SEQ ID NO: 7918166 - DNA, 22 bp, Homo sapiens
ctttttcccaggtggagagagg

SEQ ID NO: 7918167 - DNA, 22 bp, Homo sapiens
gaaaaccacctcccatcaagca

SEQ ID NO: 7918168 - DNA, 22 bp, Homo sapiens
gaaaaccacctcccatcaagca

SEQ ID NO: 7918169 - DNA, 19 bp, Homo sapiens
gaaaacatgggtgagggtc

SEQ ID NO: 7918170 - DNA, 19 bp, Homo sapiens
gaaaacatgggtgagggtc

SEQ ID NO: 7918171 - DNA, 21 bp, Homo sapiens
gaaaaccatttgcatcatgag

SEQ ID NO: 7918172 - DNA, 22 bp, Homo sapiens
atgaatgctgggacaaatatat

SEQ ID NO: 7918173 - DNA, 22 bp, Homo sapiens
atgaatgctgggacaaatatat

SEQ ID NO: 7918174 - DNA, 22 bp, Homo sapiens
atgaatgctgaattatgaactg

SEQ ID NO: 7918175 - DNA, 22 bp, Homo sapiens
atgaatgcttattaaattgaaa

SEQ ID NO: 7918176 - DNA, 22 bp, Homo sapiens
atgaatgcttattaaattgaaa

SEQ ID NO: 7918177 - DNA, 22 bp, Homo sapiens
atgaatgcttattaaattgaaa

SEQ ID NO: 7918178 - DNA, 22 bp, Homo sapiens
atgaatgctgggacaaatatat

SEQ ID NO: 7918179 - DNA, 22 bp, Homo sapiens
atgaatgctgggacaaatatat

SEQ ID NO: 7918180 - DNA, 22 bp, Homo sapiens
atgaatgcatacatttgtcaag

SEQ ID NO: 7918181 - DNA, 22 bp, Homo sapiens
atgaatgcaatattttatgaca

SEQ ID NO: 7918182 - DNA, 22 bp, Homo sapiens
atgaatgcaatattttatgaca

SEQ ID NO: 7918183 - DNA, 22 bp, Homo sapiens
atgaatgatttgtcagtcacag

SEQ ID NO: 7918184 - DNA, 22 bp, Homo sapiens
atgaatgatttgtcagtcacag

SEQ ID NO: 7918185 - DNA, 22 bp, Homo sapiens
atgaatgattttatgtaaatga

SEQ ID NO: 7918186 - DNA, 22 bp, Homo sapiens
atgaatgattttatgtaaatga

SEQ ID NO: 7918187 - DNA, 22 bp, Homo sapiens
atgaatgagaaagctgaaatct

SEQ ID NO: 7918188 - DNA, 22 bp, Homo sapiens
atgaatgagaaagctgaaatct

SEQ ID NO: 7918189 - DNA, 19 bp, Homo sapiens
atgaatgatccggtttctc

SEQ ID NO: 7918190 - DNA, 22 bp, Homo sapiens
atgcaagacccagaaatcatta

SEQ ID NO: 7918191 - DNA, 22 bp, Homo sapiens
atgcaagacccagaaatcatta

SEQ ID NO: 7918192 - DNA, 22 bp, Homo sapiens
atgcaaatgctagagaatgttg

SEQ ID NO: 7918193 - DNA, 22 bp, Homo sapiens
atgcaagagatggacttgtgtt

SEQ ID NO: 7918194 - DNA, 22 bp, Homo sapiens
atgcaaatgcagccattgcaga

SEQ ID NO: 7918195 - DNA, 23 bp, Homo sapiens
atgcaagagtttctcaaactgga

SEQ ID NO: 7918196 - DNA, 22 bp, Homo sapiens
atgcaagagggaaaaggaaata

SEQ ID NO: 7918197 - DNA, 22 bp, Homo sapiens
atgcaagatcacaccaaacacg

SEQ ID NO: 7918198 - DNA, 22 bp, Homo sapiens
atgcaagatcacaccaaacacg

SEQ ID NO: 7918199 - DNA, 22 bp, Homo sapiens
atgcaagatgtatagaagactt

SEQ ID NO: 7918200 - DNA, 22 bp, Homo sapiens
atgcaagatgtatagaagactt

SEQ ID NO: 7918201 - DNA, 22 bp, Homo sapiens
atgcaagattcagcaggaagat

SEQ ID NO: 7918202 - DNA, 22 bp, Homo sapiens
gaagaaagattggcatgcttca

SEQ ID NO: 7918203 - DNA, 22 bp, Homo sapiens
gaagaaagattggcatgcttca

SEQ ID NO: 7918204 - DNA, 22 bp, Homo sapiens
gaagaaagattggcatgcttca

SEQ ID NO: 7918205 - DNA, 22 bp, Homo sapiens
gaagaaagggaattaacttgag

SEQ ID NO: 7918206 - DNA, 22 bp, Homo sapiens
gaagaaagattggcatgcttca

SEQ ID NO: 7918207 - DNA, 22 bp, Homo sapiens
gaagaaagattggcatgcttca

SEQ ID NO: 7918208 - DNA, 22 bp, Homo sapiens
gaagaaagatcaaatagtttcc

SEQ ID NO: 7918209 - DNA, 22 bp, Homo sapiens
gaagaaagatcaaatagtttcc

SEQ ID NO: 7918210 - DNA, 22 bp, Homo sapiens
gaagaaagatcaaatagtttcc

SEQ ID NO: 7918211 - DNA, 22 bp, Homo sapiens
gaagaaagatcaaatagtttcc

SEQ ID NO: 7918212 - DNA, 22 bp, Homo sapiens
gaagaaagatcaaatagtttcc

SEQ ID NO: 7918213 - DNA, 22 bp, Homo sapiens
atgcaatgttacagaatgtact

SEQ ID NO: 7918214 - DNA, 22 bp, Homo sapiens
atgcaatttactgtacataaat

SEQ ID NO: 7918215 - DNA, 22 bp, Homo sapiens
atgcaatatgtgtttctgttta

SEQ ID NO: 7918216 - DNA, 22 bp, Homo sapiens
atgcacaagaggctagaaaaga

SEQ ID NO: 7918217 - DNA, 22 bp, Homo sapiens
atgcacaacagacgaatggaag

SEQ ID NO: 7918218 - DNA, 22 bp, Homo sapiens
atgcacaacagtggctgccttg

SEQ ID NO: 7918219 - DNA, 22 bp, Homo sapiens
atgcacaaacccacaattagtc

SEQ ID NO: 7918220 - DNA, 21 bp, Homo sapiens
atgcacaaaaagactctttct

SEQ ID NO: 7918221 - DNA, 22 bp, Homo sapiens
atgcaatttactgtacataaat

SEQ ID NO: 7918222 - DNA, 21 bp, Homo sapiens
atgcacaaaaagactctttct

SEQ ID NO: 7918223 - DNA, 22 bp, Homo sapiens
atgcaatatagggaagatagat

SEQ ID NO: 7918224 - DNA, 22 bp, Homo sapiens
atgcaatatagggaagatagat

SEQ ID NO: 7918225 - DNA, 22 bp, Homo sapiens
atgcaatatagggaagatagat

SEQ ID NO: 7918226 - DNA, 22 bp, Homo sapiens
atgcaatatagggaagatagat

SEQ ID NO: 7918227 - DNA, 22 bp, Homo sapiens
atgcaataccttctgaaaataa

SEQ ID NO: 7918228 - DNA, 22 bp, Homo sapiens
atgcaataccttctgaaaataa

SEQ ID NO: 7918229 - DNA, 22 bp, Homo sapiens
atgcaagggttgcctttccagc

SEQ ID NO: 7918230 - DNA, 22 bp, Homo sapiens
atgcaataaatactttccagct

SEQ ID NO: 7918231 - DNA, 22 bp, Homo sapiens
atgcaataccttctgaaaataa

SEQ ID NO: 7918232 - DNA, 22 bp, Homo sapiens
atgcaataccttctgaaaataa

SEQ ID NO: 7918233 - DNA, 22 bp, Homo sapiens
gaacatttatgatgcaatacct

SEQ ID NO: 7918234 - DNA, 22 bp, Homo sapiens
gaacatttatgatgcaatacct

SEQ ID NO: 7918235 - DNA, 22 bp, Homo sapiens
gaacatttatgatgcaatacct

SEQ ID NO: 7918236 - DNA, 22 bp, Homo sapiens
gaacatttccagaaaggaacta

SEQ ID NO: 7918237 - DNA, 22 bp, Homo sapiens
gaacatttccagaaaggaacta

SEQ ID NO: 7918238 - DNA, 22 bp, Homo sapiens
gaacatttccagaaaggaacta

SEQ ID NO: 7918239 - DNA, 22 bp, Homo sapiens
gaacatttatattagatagcta

SEQ ID NO: 7918240 - DNA, 22 bp, Homo sapiens
gaacattcttggaggaaataac

SEQ ID NO: 7918241 - DNA, 22 bp, Homo sapiens
gaacatttatattagatagcta

SEQ ID NO: 7918242 - DNA, 22 bp, Homo sapiens
gaacattgctttatttcttcta

SEQ ID NO: 7918243 - DNA, 22 bp, Homo sapiens
gaacatttatgatgcaatacct

SEQ ID NO: 7918244 - DNA, 22 bp, Homo sapiens
gaacatcatgaagaaaacatat

SEQ ID NO: 7918245 - DNA, 22 bp, Homo sapiens
gaacatctgttaaataaaggta

SEQ ID NO: 7918246 - DNA, 22 bp, Homo sapiens
gaacattattgtacaaatgtct

SEQ ID NO: 7918247 - DNA, 22 bp, Homo sapiens
gaacattattgtacaaatgtct

SEQ ID NO: 7918248 - DNA, 22 bp, Homo sapiens
gaacattcacagactcaccatt

SEQ ID NO: 7918249 - DNA, 23 bp, Homo sapiens
gaacattcattggttgctttaga

SEQ ID NO: 7918250 - DNA, 20 bp, Homo sapiens
gaacatggcaggtggagggg

SEQ ID NO: 7918251 - DNA, 22 bp, Homo sapiens
gaacattattgtacaaatgtct

SEQ ID NO: 7918252 - DNA, 22 bp, Homo sapiens
gaactttgtggggctgagagga

SEQ ID NO: 7918253 - DNA, 22 bp, Homo sapiens
gaactttgtggggctgagagga

SEQ ID NO: 7918254 - DNA, 22 bp, Homo sapiens
gaactttgtggggctgagagga

SEQ ID NO: 7918255 - DNA, 17 bp, Homo sapiens
gaacttttattaaattc

SEQ ID NO: 7918256 - DNA, 22 bp, Homo sapiens
gaactttcctagacctgagatg

SEQ ID NO: 7918257 - DNA, 22 bp, Homo sapiens
gaactttattccagaagaaagc

SEQ ID NO: 7918258 - DNA, 22 bp, Homo sapiens
gaactttcctagacctgagatg

SEQ ID NO: 7918259 - DNA, 22 bp, Homo sapiens
gaactttgcaaatgtcagaagc

SEQ ID NO: 7918260 - DNA, 22 bp, Homo sapiens
gaactttgcgcagttcccgggg

SEQ ID NO: 7918261 - DNA, 22 bp, Homo sapiens
gaactttgcgcagttcccgggg

SEQ ID NO: 7918262 - DNA, 22 bp, Homo sapiens
gaactttggatcatgttcttgg

SEQ ID NO: 7918263 - DNA, 22 bp, Homo sapiens
gaactttattccagaagaaagc

SEQ ID NO: 7918264 - DNA, 22 bp, Homo sapiens
gaacatttgatgatgacattgg

SEQ ID NO: 7918265 - DNA, 22 bp, Homo sapiens
gaacatttgatgatgacattgg

SEQ ID NO: 7918266 - DNA, 22 bp, Homo sapiens
gaactttaaaacaaagtacagt

SEQ ID NO: 7918267 - DNA, 22 bp, Homo sapiens
gaactttaaaacaaagtacagt

SEQ ID NO: 7918268 - DNA, 22 bp, Homo sapiens
gaactttaattagcttttgtct

SEQ ID NO: 7918269 - DNA, 22 bp, Homo sapiens
gaactttaccatttaggtaact

SEQ ID NO: 7918270 - DNA, 22 bp, Homo sapiens
gaactttataactgtaaatgtc

SEQ ID NO: 7918271 - DNA, 22 bp, Homo sapiens
atgaggcagtctggcctgaggg

SEQ ID NO: 7918272 - DNA, 22 bp, Homo sapiens
atgaggcagtctggcctgaggg

SEQ ID NO: 7918273 - DNA, 22 bp, Homo sapiens
gaaatgattttagtttatcatg

SEQ ID NO: 7918274 - DNA, 22 bp, Homo sapiens
gaaatgatgtctgtgctgccac

SEQ ID NO: 7918275 - DNA, 22 bp, Homo sapiens
gaaatgatgtctgtgctgccac

SEQ ID NO: 7918276 - DNA, 22 bp, Homo sapiens
gaaatgattttagtttatcatg

SEQ ID NO: 7918277 - DNA, 22 bp, Homo sapiens
atgaggcatagcagggatcgga

SEQ ID NO: 7918278 - DNA, 16 bp, Homo sapiens
atgaggcataggctgc

SEQ ID NO: 7918279 - DNA, 16 bp, Homo sapiens
atgaggcataggctgc

SEQ ID NO: 7918280 - DNA, 22 bp, Homo sapiens
atgaggcatagcagggatcgga

SEQ ID NO: 7918281 - DNA, 22 bp, Homo sapiens
atgaggcatagcagggatcgga

SEQ ID NO: 7918282 - DNA, 22 bp, Homo sapiens
atgaggcagtctggcctgaggg

SEQ ID NO: 7918283 - DNA, 22 bp, Homo sapiens
atgaggcatctaacattgcaaa

SEQ ID NO: 7918284 - DNA, 22 bp, Homo sapiens
atgaggcatatcctcctatggt

SEQ ID NO: 7918285 - DNA, 22 bp, Homo sapiens
atgaggcatatcctcctatggt

SEQ ID NO: 7918286 - DNA, 22 bp, Homo sapiens
atgaggcatctaacattgcaaa

SEQ ID NO: 7918287 - DNA, 22 bp, Homo sapiens
atgaggcatctgcagtcactag

SEQ ID NO: 7918288 - DNA, 22 bp, Homo sapiens
atgaggcatctgcagtcactag

SEQ ID NO: 7918289 - DNA, 22 bp, Homo sapiens
atgaggcatgtgaggagaaggg

SEQ ID NO: 7918290 - DNA, 22 bp, Homo sapiens
atgaggcatgtgaggagaaggg

SEQ ID NO: 7918291 - DNA, 22 bp, Homo sapiens
atgaggcatgggatcaaaatga

SEQ ID NO: 7918292 - DNA, 21 bp, Homo sapiens
atgaggcatgagagggtttct

SEQ ID NO: 7918293 - DNA, 22 bp, Homo sapiens
gaacataactattgtgaatagt

SEQ ID NO: 7918294 - DNA, 19 bp, Homo sapiens
gaacaatttgttagctctc

SEQ ID NO: 7918295 - DNA, 22 bp, Homo sapiens
gaacataactattgtgaatagt

SEQ ID NO: 7918296 - DNA, 19 bp, Homo sapiens
gaacaatttgttagctctc

SEQ ID NO: 7918297 - DNA, 19 bp, Homo sapiens
gaacaatttgttagctctc

SEQ ID NO: 7918298 - DNA, 22 bp, Homo sapiens
gaacaatgagtcattcaggtga

SEQ ID NO: 7918299 - DNA, 22 bp, Homo sapiens
gaacatcagtcataatttaacg

SEQ ID NO: 7918300 - DNA, 22 bp, Homo sapiens
gaacatcatgaagaaaacatat

SEQ ID NO: 7918301 - DNA, 22 bp, Homo sapiens
gaacatatgcatgtttgttttg

SEQ ID NO: 7918302 - DNA, 22 bp, Homo sapiens
gaacataattaaatgtcctggg

SEQ ID NO: 7918303 - DNA, 22 bp, Homo sapiens
gaacaatgaaagacataaactc

SEQ ID NO: 7918304 - DNA, 15 bp, Homo sapiens
atgaggcatttgggg

SEQ ID NO: 7918305 - DNA, 22 bp, Homo sapiens
atgaggcattccactcaaactc

SEQ ID NO: 7918306 - DNA, 22 bp, Homo sapiens
atgaggcattccactcaaactc

SEQ ID NO: 7918307 - DNA, 22 bp, Homo sapiens
atgaggcattcacagaaggcac

SEQ ID NO: 7918308 - DNA, 22 bp, Homo sapiens
atgaggcattcacagaaggcac

SEQ ID NO: 7918309 - DNA, 23 bp, Homo sapiens
atgaggcattaaacaggcttttt

SEQ ID NO: 7918310 - DNA, 22 bp, Homo sapiens
atgaggcattcacagaaggcac

SEQ ID NO: 7918311 - DNA, 22 bp, Homo sapiens
atgaggcattcacagaaggcac

SEQ ID NO: 7918312 - DNA, 23 bp, Homo sapiens
atgaggcattaaacaggcttttt

SEQ ID NO: 7918313 - DNA, 22 bp, Homo sapiens
gaaatgaaacaggcttttaagg

SEQ ID NO: 7918314 - DNA, 22 bp, Homo sapiens
gaaatgaaacaggcttttaagg

SEQ ID NO: 7918315 - DNA, 22 bp, Homo sapiens
gaaatgaaacaggcttttaagg

SEQ ID NO: 7918316 - DNA, 22 bp, Homo sapiens
gaaatgaaacaggcttttaagg

SEQ ID NO: 7918317 - DNA, 22 bp, Homo sapiens
gaaatgaaatagcaccaaggtt

SEQ ID NO: 7918318 - DNA, 22 bp, Homo sapiens
gaaatgaaatagcaccaaggtt

SEQ ID NO: 7918319 - DNA, 22 bp, Homo sapiens
gaaatgaaatagcaccaaggtt

SEQ ID NO: 7918320 - DNA, 22 bp, Homo sapiens
gaaatgaaatagcaccaaggtt

SEQ ID NO: 7918321 - DNA, 22 bp, Homo sapiens
gaaatgaactgattatcattgc

SEQ ID NO: 7918322 - DNA, 22 bp, Homo sapiens
gaaatgaactgattatcattgc

SEQ ID NO: 7918323 - DNA, 22 bp, Homo sapiens
gaaatgaactgattatcattgc

SEQ ID NO: 7918324 - DNA, 22 bp, Homo sapiens
gaaatgaactgattatcattgc

SEQ ID NO: 7918325 - DNA, 22 bp, Homo sapiens
gaaatgaactgattatcattgc

SEQ ID NO: 7918326 - DNA, 22 bp, Homo sapiens
gaaatgaaatagcaccaaggtt

SEQ ID NO: 7918327 - DNA, 22 bp, Homo sapiens
gaaatgaaatagcaccaaggtt

SEQ ID NO: 7918328 - DNA, 22 bp, Homo sapiens
gaaatgaactgattatcattgc

SEQ ID NO: 7918329 - DNA, 22 bp, Homo sapiens
gaaatcttttaaccattcattt

SEQ ID NO: 7918330 - DNA, 22 bp, Homo sapiens
gaaatctttgccttagctgtgt

SEQ ID NO: 7918331 - DNA, 22 bp, Homo sapiens
gaaatctttgccttagctgtgt

SEQ ID NO: 7918332 - DNA, 22 bp, Homo sapiens
gaaatctttatggaaataacaa

SEQ ID NO: 7918333 - DNA, 22 bp, Homo sapiens
gaaatcttttaaccattcattt

SEQ ID NO: 7918334 - DNA, 22 bp, Homo sapiens
gaaatcttttccaattgtttag

SEQ ID NO: 7918335 - DNA, 22 bp, Homo sapiens
gaaatcttccaatggtcacatc

SEQ ID NO: 7918336 - DNA, 22 bp, Homo sapiens
gaaatcttccttcagtgaagaa

SEQ ID NO: 7918337 - DNA, 22 bp, Homo sapiens
gaaaatgtgcctttgggtattg

SEQ ID NO: 7918338 - DNA, 22 bp, Homo sapiens
gaaaatgtgtcatccctactgt

SEQ ID NO: 7918339 - DNA, 22 bp, Homo sapiens
gaaaatgtgtcatccctactgt

SEQ ID NO: 7918340 - DNA, 22 bp, Homo sapiens
gaaatatacatgaagtcggctg

SEQ ID NO: 7918341 - DNA, 22 bp, Homo sapiens
gaaatatacatgaagtcggctg

SEQ ID NO: 7918342 - DNA, 22 bp, Homo sapiens
gaaaatgcctctggcattaaac

SEQ ID NO: 7918343 - DNA, 22 bp, Homo sapiens
gaaaatgcctctggcattaaac

SEQ ID NO: 7918344 - DNA, 22 bp, Homo sapiens
gaaaatgagcctcagctacatt

SEQ ID NO: 7918345 - DNA, 22 bp, Homo sapiens
gaaaatgagcctcagctacatt

SEQ ID NO: 7918346 - DNA, 22 bp, Homo sapiens
gaaaatgagcctcagctacatt

SEQ ID NO: 7918347 - DNA, 18 bp, Homo sapiens
gaaatctcaagagacaga

SEQ ID NO: 7918348 - DNA, 23 bp, Homo sapiens
gaaatctagtcatttttagtctg

SEQ ID NO: 7918349 - DNA, 23 bp, Homo sapiens
gaaatctagtcatttttagtctg

SEQ ID NO: 7918350 - DNA, 18 bp, Homo sapiens
gaaatctcaagagacaga

SEQ ID NO: 7918351 - DNA, 22 bp, Homo sapiens
gaaatctacgattagtgaaaat

SEQ ID NO: 7918352 - DNA, 22 bp, Homo sapiens
gaaatatacattgcaggaagag

SEQ ID NO: 7918353 - DNA, 22 bp, Homo sapiens
gaaatctacttagtgtctggat

SEQ ID NO: 7918354 - DNA, 22 bp, Homo sapiens
gaaatatacatgaagtcggctg

SEQ ID NO: 7918355 - DNA, 22 bp, Homo sapiens
gaaatatacatgaagtcggctg

SEQ ID NO: 7918356 - DNA, 22 bp, Homo sapiens
gacagggaggaaagagactgct

SEQ ID NO: 7918357 - DNA, 22 bp, Homo sapiens
gacagggaggaaagagactgct

SEQ ID NO: 7918358 - DNA, 22 bp, Homo sapiens
gacagggaggaaagagactgct

SEQ ID NO: 7918359 - DNA, 22 bp, Homo sapiens
gacagggaggagcagagcttct

SEQ ID NO: 7918360 - DNA, 22 bp, Homo sapiens
gacagggaggaaagagactgct

SEQ ID NO: 7918361 - DNA, 22 bp, Homo sapiens
gacagggaggagcagagcttct

SEQ ID NO: 7918362 - DNA, 22 bp, Homo sapiens
gacagggaggagcagagcttct

SEQ ID NO: 7918363 - DNA, 22 bp, Homo sapiens
gacagggcatggtgcagagttc

SEQ ID NO: 7918364 - DNA, 22 bp, Homo sapiens
gacagggcaagactctgtctaa

SEQ ID NO: 7918365 - DNA, 22 bp, Homo sapiens
gacagggcaagactctgtctaa

SEQ ID NO: 7918366 - DNA, 22 bp, Homo sapiens
gacagggccgcagatggagact

SEQ ID NO: 7918367 - DNA, 22 bp, Homo sapiens
gacagggcatggtgcagagttc

SEQ ID NO: 7918368 - DNA, 22 bp, Homo sapiens
gacagggccaaaccggctgatc

SEQ ID NO: 7918369 - DNA, 23 bp, Homo sapiens
gacagggctgacttggcagctgc

SEQ ID NO: 7918370 - DNA, 22 bp, Homo sapiens
gacagggcgagactcagtctca

SEQ ID NO: 7918371 - DNA, 22 bp, Homo sapiens
gacagggcatggtgcagagttc

SEQ ID NO: 7918372 - DNA, 22 bp, Homo sapiens
gacagtttaggttcaaatctca

SEQ ID NO: 7918373 - DNA, 22 bp, Homo sapiens
gacagttttgctaaaaggttga

SEQ ID NO: 7918374 - DNA, 22 bp, Homo sapiens
gacagtttggatgggggtttgc

SEQ ID NO: 7918375 - DNA, 22 bp, Homo sapiens
gacagtttaagcacctaatatt

SEQ ID NO: 7918376 - DNA, 22 bp, Homo sapiens
gacagtgtttgtataattcctg

SEQ ID NO: 7918377 - DNA, 22 bp, Homo sapiens
gacagtgtccctctggggtgga

SEQ ID NO: 7918378 - DNA, 22 bp, Homo sapiens
gacagtggttccaaggcagctt

SEQ ID NO: 7918379 - DNA, 22 bp, Homo sapiens
gacagtggttccaaggcagctt

SEQ ID NO: 7918380 - DNA, 22 bp, Homo sapiens
gacagtgtgaacatctaatagt

SEQ ID NO: 7918381 - DNA, 22 bp, Homo sapiens
gacagtgtgaacatctaatagt

SEQ ID NO: 7918382 - DNA, 22 bp, Homo sapiens
gacagtggttccaaggcagctt

SEQ ID NO: 7918383 - DNA, 22 bp, Homo sapiens
gacagtggttccaaggcagctt

SEQ ID NO: 7918384 - DNA, 22 bp, Homo sapiens
gacagtggttccaaggcagctt

SEQ ID NO: 7918385 - DNA, 22 bp, Homo sapiens
gacagtggtgttttccattgca

SEQ ID NO: 7918386 - DNA, 23 bp, Homo sapiens
gacagggctgacttggcagctgc

SEQ ID NO: 7918387 - DNA, 23 bp, Homo sapiens
gacagggctgacttggcagctgc

SEQ ID NO: 7918388 - DNA, 23 bp, Homo sapiens
gacagggctgacttggcagctgc

SEQ ID NO: 7918389 - DNA, 22 bp, Homo sapiens
gacagtgctatggtaggacatt

SEQ ID NO: 7918390 - DNA, 22 bp, Homo sapiens
gacagtggaatgaccctttgag

SEQ ID NO: 7918391 - DNA, 22 bp, Homo sapiens
gacagtggattcatctagtcaa

SEQ ID NO: 7918392 - DNA, 22 bp, Homo sapiens
gacagtggtgttttccattgca

SEQ ID NO: 7918393 - DNA, 22 bp, Homo sapiens
gacagtggagccacgttgggag

SEQ ID NO: 7918394 - DNA, 22 bp, Homo sapiens
atgcttaacttcctagtctata

SEQ ID NO: 7918395 - DNA, 22 bp, Homo sapiens
atgcttaagctcagttatatat

SEQ ID NO: 7918396 - DNA, 22 bp, Homo sapiens
gacataaagttcttgcttgaat

SEQ ID NO: 7918397 - DNA, 22 bp, Homo sapiens
gacataaagttcttgcttgaat

SEQ ID NO: 7918398 - DNA, 20 bp, Homo sapiens
atgcttaagtgttcattatt

SEQ ID NO: 7918399 - DNA, 20 bp, Homo sapiens
atgcttaagtgttcattatt

SEQ ID NO: 7918400 - DNA, 22 bp, Homo sapiens
atgcttgtactaaaaaaatatt

SEQ ID NO: 7918401 - DNA, 22 bp, Homo sapiens
atgcttgtactaaaaaaatatt

SEQ ID NO: 7918402 - DNA, 22 bp, Homo sapiens
atgcttgtactaaaaaaatatt

SEQ ID NO: 7918403 - DNA, 22 bp, Homo sapiens
atgcttgtactaaaaaaatatt

SEQ ID NO: 7918404 - DNA, 22 bp, Homo sapiens
atgcttgtagtgtaatcactgt

SEQ ID NO: 7918405 - DNA, 22 bp, Homo sapiens
atgcttgtagtgtaatcactgt

SEQ ID NO: 7918406 - DNA, 22 bp, Homo sapiens
gacataaagttcttgcttgaat

SEQ ID NO: 7918407 - DNA, 22 bp, Homo sapiens
gacagttttgctgaaattgagc

SEQ ID NO: 7918408 - DNA, 22 bp, Homo sapiens
gacataaaatggaattctgttg

SEQ ID NO: 7918409 - DNA, 22 bp, Homo sapiens
gacataaaatggaattctgttg

SEQ ID NO: 7918410 - DNA, 22 bp, Homo sapiens
gacataaaattcaataatttgt

SEQ ID NO: 7918411 - DNA, 22 bp, Homo sapiens
gacataaaattcaataatttgt

SEQ ID NO: 7918412 - DNA, 22 bp, Homo sapiens
gacataaaattcaataatttgt

SEQ ID NO: 7918413 - DNA, 22 bp, Homo sapiens
gacataaaccttgagatattaa

SEQ ID NO: 7918414 - DNA, 22 bp, Homo sapiens
gacataaaccttgagatattaa

SEQ ID NO: 7918415 - DNA, 19 bp, Homo sapiens
atgctttatgttatttctt

SEQ ID NO: 7918416 - DNA, 19 bp, Homo sapiens
atgctttatgttatttctt

SEQ ID NO: 7918417 - DNA, 19 bp, Homo sapiens
atgctttatgttatttctt

SEQ ID NO: 7918418 - DNA, 22 bp, Homo sapiens
atgctttatacaaaacacttaa

SEQ ID NO: 7918419 - DNA, 22 bp, Homo sapiens
atgctttatacaaaacacttaa

SEQ ID NO: 7918420 - DNA, 22 bp, Homo sapiens
atgctttatacaaaacacttaa

SEQ ID NO: 7918421 - DNA, 22 bp, Homo sapiens
atgctttatacaaaacacttaa

SEQ ID NO: 7918422 - DNA, 22 bp, Homo sapiens
atgctttatacaaaacacttaa

SEQ ID NO: 7918423 - DNA, 22 bp, Homo sapiens
atgctttacgacaaaaaactca

SEQ ID NO: 7918424 - DNA, 22 bp, Homo sapiens
atgctttagtgtcaagtttggg

SEQ ID NO: 7918425 - DNA, 22 bp, Homo sapiens
atgctttagttcaaaggactta

SEQ ID NO: 7918426 - DNA, 22 bp, Homo sapiens
atgctttaaaacgtatgtgtaa

SEQ ID NO: 7918427 - DNA, 22 bp, Homo sapiens
atgctttaaaacgtatgtgtaa

SEQ ID NO: 7918428 - DNA, 22 bp, Homo sapiens
atgctttaaaacgtatgtgtaa

SEQ ID NO: 7918429 - DNA, 22 bp, Homo sapiens
atgctttaaactataaatccac

SEQ ID NO: 7918430 - DNA, 22 bp, Homo sapiens
atgctttaaactataaatccac

SEQ ID NO: 7918431 - DNA, 22 bp, Homo sapiens
atgctttaaactataaatccac

SEQ ID NO: 7918432 - DNA, 22 bp, Homo sapiens
atgctttaaatgtcttttgctt

SEQ ID NO: 7918433 - DNA, 22 bp, Homo sapiens
atgctttacagttttccaaaca

SEQ ID NO: 7918434 - DNA, 22 bp, Homo sapiens
atgctttacagttttccaaaca

SEQ ID NO: 7918435 - DNA, 22 bp, Homo sapiens
atgctttacgacaaaaaactca

SEQ ID NO: 7918436 - DNA, 22 bp, Homo sapiens
atgctttacgacaaaaaactca

SEQ ID NO: 7918437 - DNA, 22 bp, Homo sapiens
atgctttacccacaccaggatg

SEQ ID NO: 7918438 - DNA, 22 bp, Homo sapiens
atgctttacccacaccaggatg

SEQ ID NO: 7918439 - DNA, 22 bp, Homo sapiens
atgctttacagttttccaaaca

SEQ ID NO: 7918440 - DNA, 22 bp, Homo sapiens
atgctttcttctttcctgtaag

SEQ ID NO: 7918441 - DNA, 20 bp, Homo sapiens
atgctttcttgtgtgctgct

SEQ ID NO: 7918442 - DNA, 22 bp, Homo sapiens
atgctttcttctttcctgtaag

SEQ ID NO: 7918443 - DNA, 22 bp, Homo sapiens
atgctttctaggtgatctgagg

SEQ ID NO: 7918444 - DNA, 22 bp, Homo sapiens
atgctttattgttaggtcatgt

SEQ ID NO: 7918445 - DNA, 22 bp, Homo sapiens
atgctttattgttaggtcatgt

SEQ ID NO: 7918446 - DNA, 20 bp, Homo sapiens
atgctttcttgtgtgctgct

SEQ ID NO: 7918447 - DNA, 22 bp, Homo sapiens
atgctttgaagtttttcctcat

SEQ ID NO: 7918448 - DNA, 22 bp, Homo sapiens
atgctttgaagtttttcctcat

SEQ ID NO: 7918449 - DNA, 22 bp, Homo sapiens
atgctttgatagtttattacat

SEQ ID NO: 7918450 - DNA, 22 bp, Homo sapiens
atgctttgatagtttattacat

SEQ ID NO: 7918451 - DNA, 22 bp, Homo sapiens
atgctttgatttggtttctcta

SEQ ID NO: 7918452 - DNA, 22 bp, Homo sapiens
atgctttgatttggtttctcta

SEQ ID NO: 7918453 - DNA, 22 bp, Homo sapiens
atgcttttccaggagaaatata

SEQ ID NO: 7918454 - DNA, 22 bp, Homo sapiens
atgcttttccaggagaaatata

SEQ ID NO: 7918455 - DNA, 22 bp, Homo sapiens
atgcttttccaggagaaatata

SEQ ID NO: 7918456 - DNA, 22 bp, Homo sapiens
atgcttttccaggagaaatata

SEQ ID NO: 7918457 - DNA, 22 bp, Homo sapiens
atgcttttccaggagaaatata

SEQ ID NO: 7918458 - DNA, 22 bp, Homo sapiens
atgcttttcctaaaatgatgcc

SEQ ID NO: 7918459 - DNA, 22 bp, Homo sapiens
atgctttgtggagtattactgt

SEQ ID NO: 7918460 - DNA, 22 bp, Homo sapiens
atgctttgtttaaagattttca

SEQ ID NO: 7918461 - DNA, 22 bp, Homo sapiens
atgctttgtttaaagattttca

SEQ ID NO: 7918462 - DNA, 22 bp, Homo sapiens
atgcttttaactcctttatccc

SEQ ID NO: 7918463 - DNA, 22 bp, Homo sapiens
atgcttttaactcctttatccc

SEQ ID NO: 7918464 - DNA, 22 bp, Homo sapiens
gactttggcttttattctaggt

SEQ ID NO: 7918465 - DNA, 22 bp, Homo sapiens
gactttggtataccttgcttta

SEQ ID NO: 7918466 - DNA, 17 bp, Homo sapiens
gactttggagtttcata

SEQ ID NO: 7918467 - DNA, 22 bp, Homo sapiens
gactttggagtggttctgctgc

SEQ ID NO: 7918468 - DNA, 22 bp, Homo sapiens
gactttggagcagctacttcct

SEQ ID NO: 7918469 - DNA, 22 bp, Homo sapiens
gactttggagcagaaagaaatt

SEQ ID NO: 7918470 - DNA, 22 bp, Homo sapiens
gactttgaacagtgtatcagta

SEQ ID NO: 7918471 - DNA, 22 bp, Homo sapiens
gactttgattaaatcaagcaaa

SEQ ID NO: 7918472 - DNA, 22 bp, Homo sapiens
gactttcttgcagaaatattcc

SEQ ID NO: 7918473 - DNA, 22 bp, Homo sapiens
gactttcttaggccccctaata

SEQ ID NO: 7918474 - DNA, 22 bp, Homo sapiens
gactttcttaggccccctaata

SEQ ID NO: 7918475 - DNA, 22 bp, Homo sapiens
gactttcttaggccccctaata

SEQ ID NO: 7918476 - DNA, 21 bp, Homo sapiens
gactttcttaccagatttttg

SEQ ID NO: 7918477 - DNA, 22 bp, Homo sapiens
gactttcttgtagtgtctgatg

SEQ ID NO: 7918478 - DNA, 22 bp, Homo sapiens
gactttcttgtagtgtctgatg

SEQ ID NO: 7918479 - DNA, 22 bp, Homo sapiens
gactttcttttacctcaaggat

SEQ ID NO: 7918480 - DNA, 22 bp, Homo sapiens
gactttcttgtagtgtctgatg

SEQ ID NO: 7918481 - DNA, 22 bp, Homo sapiens
gactttcttgcagaaatattcc

SEQ ID NO: 7918482 - DNA, 22 bp, Homo sapiens
gactttcttgcagaaatattcc

SEQ ID NO: 7918483 - DNA, 21 bp, Homo sapiens
gactttcttaccagatttttg

SEQ ID NO: 7918484 - DNA, 21 bp, Homo sapiens
gactttcttaccagatttttg

SEQ ID NO: 7918485 - DNA, 22 bp, Homo sapiens
gactttctgtccagtgatttct

SEQ ID NO: 7918486 - DNA, 21 bp, Homo sapiens
gactttcttaccagatttttg

SEQ ID NO: 7918487 - DNA, 22 bp, Homo sapiens
gactttctgtccagtgatttct

SEQ ID NO: 7918488 - DNA, 22 bp, Homo sapiens
gactttctgctatactttctgt

SEQ ID NO: 7918489 - DNA, 22 bp, Homo sapiens
gactttctgctatactttctgt

SEQ ID NO: 7918490 - DNA, 22 bp, Homo sapiens
gactttctgatgtaaacattta

SEQ ID NO: 7918491 - DNA, 22 bp, Homo sapiens
gactttctgctatactttctgt

SEQ ID NO: 7918492 - DNA, 22 bp, Homo sapiens
gactttctgagtcaaagaaagg

SEQ ID NO: 7918493 - DNA, 22 bp, Homo sapiens
gacccctagagataggaggaac

SEQ ID NO: 7918494 - DNA, 18 bp, Homo sapiens
gaccccgggatctgtcga

SEQ ID NO: 7918495 - DNA, 22 bp, Homo sapiens
gacccgtggcaggctgcctgct

SEQ ID NO: 7918496 - DNA, 22 bp, Homo sapiens
gacccggctccaggcccagcag

SEQ ID NO: 7918497 - DNA, 18 bp, Homo sapiens
gaccccgggatctgtcga

SEQ ID NO: 7918498 - DNA, 22 bp, Homo sapiens
gaccccaggcagatcagggggt

SEQ ID NO: 7918499 - DNA, 22 bp, Homo sapiens
gaccctccactcactgctgtgt

SEQ ID NO: 7918500 - DNA, 22 bp, Homo sapiens
gaccctcattgtcaccgtgagc

SEQ ID NO: 7918501 - DNA, 22 bp, Homo sapiens
gaccctcctactaccctggaaa

SEQ ID NO: 7918502 - DNA, 22 bp, Homo sapiens
gaccctccactcactgctgtgt

SEQ ID NO: 7918503 - DNA, 22 bp, Homo sapiens
gaccctcctactaccctggaaa

SEQ ID NO: 7918504 - DNA, 22 bp, Homo sapiens
atgctttattattttgcaggga

SEQ ID NO: 7918505 - DNA, 22 bp, Homo sapiens
atgctttattgcttctgggcac

SEQ ID NO: 7918506 - DNA, 22 bp, Homo sapiens
atgctttatgttctggcatttt

SEQ ID NO: 7918507 - DNA, 22 bp, Homo sapiens
atgctttatgttctggcatttt

SEQ ID NO: 7918508 - DNA, 22 bp, Homo sapiens
gaccccagaggaaggggcgccg

SEQ ID NO: 7918509 - DNA, 22 bp, Homo sapiens
gaccccagaggaaggggcgccg

SEQ ID NO: 7918510 - DNA, 21 bp, Homo sapiens
gaccccagaccagcagacaca

SEQ ID NO: 7918511 - DNA, 21 bp, Homo sapiens
gaccccagaccagcagacaca

SEQ ID NO: 7918512 - DNA, 22 bp, Homo sapiens
atgctttattggagacagtcat

SEQ ID NO: 7918513 - DNA, 22 bp, Homo sapiens
gactggggtaaggtgaggaggt

SEQ ID NO: 7918514 - DNA, 22 bp, Homo sapiens
gactgggggcagccgcaccagt

SEQ ID NO: 7918515 - DNA, 22 bp, Homo sapiens
gactggggctctagccaggcct

SEQ ID NO: 7918516 - DNA, 22 bp, Homo sapiens
gactttctaatgctctgtagat

SEQ ID NO: 7918517 - DNA, 22 bp, Homo sapiens
gactttccaggtcctgggctat

SEQ ID NO: 7918518 - DNA, 22 bp, Homo sapiens
gactggggtaaggtgaggaggt

SEQ ID NO: 7918519 - DNA, 22 bp, Homo sapiens
gactggggtaaggtgaggaggt

SEQ ID NO: 7918520 - DNA, 22 bp, Homo sapiens
gactttctgatgtaaacattta

SEQ ID NO: 7918521 - DNA, 22 bp, Homo sapiens
gactttctgagtcaaagaaagg

SEQ ID NO: 7918522 - DNA, 22 bp, Homo sapiens
gactttctgagtcaaagaaagg

SEQ ID NO: 7918523 - DNA, 22 bp, Homo sapiens
gactttctaatgctctgtagat

SEQ ID NO: 7918524 - DNA, 22 bp, Homo sapiens
gactttctgaaggtctcgcagt

SEQ ID NO: 7918525 - DNA, 22 bp, Homo sapiens
gactttctctcctcccaggtgt

SEQ ID NO: 7918526 - DNA, 22 bp, Homo sapiens
gactttctaatgctctgtagat

SEQ ID NO: 7918527 - DNA, 22 bp, Homo sapiens
gaccctggaactttcagcagag

SEQ ID NO: 7918528 - DNA, 22 bp, Homo sapiens
gaccctggagccgtctgaggca

SEQ ID NO: 7918529 - DNA, 22 bp, Homo sapiens
gaccctggaactttcagcagag

SEQ ID NO: 7918530 - DNA, 22 bp, Homo sapiens
gaccctggaactttcagcagag

SEQ ID NO: 7918531 - DNA, 22 bp, Homo sapiens
gaccctggaactttcagcagag

SEQ ID NO: 7918532 - DNA, 22 bp, Homo sapiens
gaccctggaactttcagcagag

SEQ ID NO: 7918533 - DNA, 22 bp, Homo sapiens
gaccctgccatgagtgacaggg

SEQ ID NO: 7918534 - DNA, 22 bp, Homo sapiens
gaccctctagatggaagcactg

SEQ ID NO: 7918535 - DNA, 22 bp, Homo sapiens
gaccctctagatggaagcactg

SEQ ID NO: 7918536 - DNA, 22 bp, Homo sapiens
gaatcaggattcaagatcagct

SEQ ID NO: 7918537 - DNA, 22 bp, Homo sapiens
gaatgtaatagtcagtagaaca

SEQ ID NO: 7918538 - DNA, 22 bp, Homo sapiens
gaatgtaataggaaacgtgtgg

SEQ ID NO: 7918539 - DNA, 23 bp, Homo sapiens
gaagcagatgtctgagtaggcag

SEQ ID NO: 7918540 - DNA, 23 bp, Homo sapiens
gaagcagatgtctgagtaggcag

SEQ ID NO: 7918541 - DNA, 16 bp, Homo sapiens
gaagcagagggtgttg

SEQ ID NO: 7918542 - DNA, 22 bp, Homo sapiens
gaatcaggattcaagatcagct

SEQ ID NO: 7918543 - DNA, 23 bp, Homo sapiens
gaagcagatgtctgagtaggcag

SEQ ID NO: 7918544 - DNA, 22 bp, Homo sapiens
gaagcagagcctaaggcagaca

SEQ ID NO: 7918545 - DNA, 22 bp, Homo sapiens
gaagcagagcctaaggcagaca

SEQ ID NO: 7918546 - DNA, 22 bp, Homo sapiens
gaagcagagcctaaggcagaca

SEQ ID NO: 7918547 - DNA, 22 bp, Homo sapiens
gaagcagagcctaaggcagaca

SEQ ID NO: 7918548 - DNA, 22 bp, Homo sapiens
gaagcagaaggtttggacgtgc

SEQ ID NO: 7918549 - DNA, 22 bp, Homo sapiens
gaagcagaaggtttggacgtgc

SEQ ID NO: 7918550 - DNA, 22 bp, Homo sapiens
gaagcagaagtacgatttacta

SEQ ID NO: 7918551 - DNA, 22 bp, Homo sapiens
gaagcagaagtacgatttacta

SEQ ID NO: 7918552 - DNA, 22 bp, Homo sapiens
gaagcagacttttgcttatttg

SEQ ID NO: 7918553 - DNA, 22 bp, Homo sapiens
gaagcagacttttgcttatttg

SEQ ID NO: 7918554 - DNA, 22 bp, Homo sapiens
gaagcacattagatgtgtcttc

SEQ ID NO: 7918555 - DNA, 22 bp, Homo sapiens
gaagcactgcatttcaagatca

SEQ ID NO: 7918556 - DNA, 22 bp, Homo sapiens
gaagcactgcatttcaagatca

SEQ ID NO: 7918557 - DNA, 22 bp, Homo sapiens
gaagcactgcatttcaagatca

SEQ ID NO: 7918558 - DNA, 22 bp, Homo sapiens
gaagcactgccataattcagac

SEQ ID NO: 7918559 - DNA, 22 bp, Homo sapiens
gaagcactgtgctgctaagttg

SEQ ID NO: 7918560 - DNA, 22 bp, Homo sapiens
gaagcactgtgctgctaagttg

SEQ ID NO: 7918561 - DNA, 22 bp, Homo sapiens
gaagcactgccataattcagac

SEQ ID NO: 7918562 - DNA, 22 bp, Homo sapiens
gaagcagaacccactccccaac

SEQ ID NO: 7918563 - DNA, 22 bp, Homo sapiens
atgcacaacagacgaatggaag

SEQ ID NO: 7918564 - DNA, 22 bp, Homo sapiens
atgcacaagaggctagaaaaga

SEQ ID NO: 7918565 - DNA, 22 bp, Homo sapiens
atgcacaagaggctagaaaaga

SEQ ID NO: 7918566 - DNA, 22 bp, Homo sapiens
atgcacaagcaagagataatgg

SEQ ID NO: 7918567 - DNA, 22 bp, Homo sapiens
atgcacaagcaagagataatgg

SEQ ID NO: 7918568 - DNA, 22 bp, Homo sapiens
atgcacaagcaagagataatgg

SEQ ID NO: 7918569 - DNA, 22 bp, Homo sapiens
atgcacaagcaagagataatgg

SEQ ID NO: 7918570 - DNA, 22 bp, Homo sapiens
atgcacaagcaagagataatgg

SEQ ID NO: 7918571 - DNA, 22 bp, Homo sapiens
atgcacaaggtagattattatt

SEQ ID NO: 7918572 - DNA, 22 bp, Homo sapiens
gaagcaattaagtttgtgatct

SEQ ID NO: 7918573 - DNA, 22 bp, Homo sapiens
gaagcaatgtgttttcaacatt

SEQ ID NO: 7918574 - DNA, 22 bp, Homo sapiens
gaagcaatgtgttttcaacatt

SEQ ID NO: 7918575 - DNA, 22 bp, Homo sapiens
gaagcaatctggctcccagcca

SEQ ID NO: 7918576 - DNA, 22 bp, Homo sapiens
gaagcacatggctgtgagcaac

SEQ ID NO: 7918577 - DNA, 22 bp, Homo sapiens
gaagcacatggctgtgagcaac

SEQ ID NO: 7918578 - DNA, 22 bp, Homo sapiens
gaagcacatggctgtgagcaac

SEQ ID NO: 7918579 - DNA, 22 bp, Homo sapiens
gaagcacatggctgtgagcaac

SEQ ID NO: 7918580 - DNA, 22 bp, Homo sapiens
gaagcacatggctatagctatt

SEQ ID NO: 7918581 - DNA, 22 bp, Homo sapiens
gaagcacactgattttatttct

SEQ ID NO: 7918582 - DNA, 22 bp, Homo sapiens
gaagcacagaatggttaacatg

SEQ ID NO: 7918583 - DNA, 22 bp, Homo sapiens
gaagcacactgattttatttct

SEQ ID NO: 7918584 - DNA, 22 bp, Homo sapiens
gaagcacagataattcaagtat

SEQ ID NO: 7918585 - DNA, 22 bp, Homo sapiens
gaagcacagataattcaagtat

SEQ ID NO: 7918586 - DNA, 22 bp, Homo sapiens
gaagcacagataattcaagtat

SEQ ID NO: 7918587 - DNA, 22 bp, Homo sapiens
gaagcaatttagaatcagaagc

SEQ ID NO: 7918588 - DNA, 22 bp, Homo sapiens
gaagcacaaagtgtagttccga

SEQ ID NO: 7918589 - DNA, 22 bp, Homo sapiens
atgcatataaggcacatgtatt

SEQ ID NO: 7918590 - DNA, 22 bp, Homo sapiens
atgcatataaggcacatgtatt

SEQ ID NO: 7918591 - DNA, 22 bp, Homo sapiens
atgcatactgtatgtgtattta

SEQ ID NO: 7918592 - DNA, 22 bp, Homo sapiens
atgcatacagatttaaaatttt

SEQ ID NO: 7918593 - DNA, 22 bp, Homo sapiens
atgcatataaggcacatgtatt

SEQ ID NO: 7918594 - DNA, 22 bp, Homo sapiens
atgcatatatacatacacagtc

SEQ ID NO: 7918595 - DNA, 22 bp, Homo sapiens
atgcatatatacatacacagtc

SEQ ID NO: 7918596 - DNA, 22 bp, Homo sapiens
atgcatatagaacatttgacat

SEQ ID NO: 7918597 - DNA, 22 bp, Homo sapiens
atgcatataatggccagaacaa

SEQ ID NO: 7918598 - DNA, 22 bp, Homo sapiens
atgcatatagaacatttgacat

SEQ ID NO: 7918599 - DNA, 22 bp, Homo sapiens
atgcatatagaacatttgacat

SEQ ID NO: 7918600 - DNA, 22 bp, Homo sapiens
gaatgtttaaaaggtgcagttt

SEQ ID NO: 7918601 - DNA, 22 bp, Homo sapiens
atgcataatgtatgtattgact

SEQ ID NO: 7918602 - DNA, 22 bp, Homo sapiens
atgcataatgtatgtattgact

SEQ ID NO: 7918603 - DNA, 22 bp, Homo sapiens
atgcataagtgcagcagatttg

SEQ ID NO: 7918604 - DNA, 22 bp, Homo sapiens
atgcataagtgcagcagatttg

SEQ ID NO: 7918605 - DNA, 22 bp, Homo sapiens
gaatgtttgactaaaggtagct

SEQ ID NO: 7918606 - DNA, 21 bp, Homo sapiens
gaatgtctgccttcacaatga

SEQ ID NO: 7918607 - DNA, 19 bp, Homo sapiens
gaatgtctcctacttctga

SEQ ID NO: 7918608 - DNA, 22 bp, Homo sapiens
gaatgtctccaacttggggaaa

SEQ ID NO: 7918609 - DNA, 22 bp, Homo sapiens
gaatgtctgtttcaacaagcac

SEQ ID NO: 7918610 - DNA, 22 bp, Homo sapiens
gaatgtcttattgctcgttgta

SEQ ID NO: 7918611 - DNA, 22 bp, Homo sapiens
gaatgtcttcaaaactagactg

SEQ ID NO: 7918612 - DNA, 22 bp, Homo sapiens
gaatgtgaggttgtatgtgaaa

SEQ ID NO: 7918613 - DNA, 22 bp, Homo sapiens
gaatgtctttttggtacttata

SEQ ID NO: 7918614 - DNA, 22 bp, Homo sapiens
gaatgtctttttggtacttata

SEQ ID NO: 7918615 - DNA, 22 bp, Homo sapiens
gaatgtcttctgttcccagctg

SEQ ID NO: 7918616 - DNA, 22 bp, Homo sapiens
gaatgtcttctgttcccagctg

SEQ ID NO: 7918617 - DNA, 22 bp, Homo sapiens
gaatgtcagggccagaagaggc

SEQ ID NO: 7918618 - DNA, 22 bp, Homo sapiens
gaatgtccctgcagttgctgcc

SEQ ID NO: 7918619 - DNA, 22 bp, Homo sapiens
gaatgtcagttgcgggcatttc

SEQ ID NO: 7918620 - DNA, 22 bp, Homo sapiens
gaatgtctatgtaaccgagggg

SEQ ID NO: 7918621 - DNA, 22 bp, Homo sapiens
gaatgtctccaacttggggaaa

SEQ ID NO: 7918622 - DNA, 22 bp, Homo sapiens
gaatgtctaaacatagctttta

SEQ ID NO: 7918623 - DNA, 22 bp, Homo sapiens
gaatgtcctcctggatcactcc

SEQ ID NO: 7918624 - DNA, 22 bp, Homo sapiens
gaatgttattggacagcagtgg

SEQ ID NO: 7918625 - DNA, 22 bp, Homo sapiens
gaatgttattggacagcagtgg

SEQ ID NO: 7918626 - DNA, 22 bp, Homo sapiens
gaatgttatgtatccagtcaca

SEQ ID NO: 7918627 - DNA, 22 bp, Homo sapiens
gaatgttattgaactacgagct

SEQ ID NO: 7918628 - DNA, 22 bp, Homo sapiens
gaatgttattgaactacgagct

SEQ ID NO: 7918629 - DNA, 22 bp, Homo sapiens
gaatgttattgaactacgagct

SEQ ID NO: 7918630 - DNA, 22 bp, Homo sapiens
gaatgttactttgattttgtcc

SEQ ID NO: 7918631 - DNA, 22 bp, Homo sapiens
gaatgttagagattcttaggtt

SEQ ID NO: 7918632 - DNA, 22 bp, Homo sapiens
gaatgttagagattcttaggtt

SEQ ID NO: 7918633 - DNA, 22 bp, Homo sapiens
gaatgttatgtatccagtcaca

SEQ ID NO: 7918634 - DNA, 22 bp, Homo sapiens
gaatgttatgtatccagtcaca

SEQ ID NO: 7918635 - DNA, 22 bp, Homo sapiens
gaatgtgggctgtgaagaggag

SEQ ID NO: 7918636 - DNA, 22 bp, Homo sapiens
gaatgtgggctgtgaagaggag

SEQ ID NO: 7918637 - DNA, 22 bp, Homo sapiens
gaatgttaatgcacttctagct

SEQ ID NO: 7918638 - DNA, 22 bp, Homo sapiens
gaatgttactttgattttgtcc

SEQ ID NO: 7918639 - DNA, 22 bp, Homo sapiens
gaatgttactttgattttgtcc

SEQ ID NO: 7918640 - DNA, 22 bp, Homo sapiens
gaatgttaatgcacttctagct

SEQ ID NO: 7918641 - DNA, 22 bp, Homo sapiens
gaatgttaatgcacttctagct

SEQ ID NO: 7918642 - DNA, 22 bp, Homo sapiens
atgcccaatgtaggccccagga

SEQ ID NO: 7918643 - DNA, 22 bp, Homo sapiens
atgcccaatgtcacaatttttg

SEQ ID NO: 7918644 - DNA, 22 bp, Homo sapiens
atgcccacaacactgcactttt

SEQ ID NO: 7918645 - DNA, 22 bp, Homo sapiens
atgccatttgctggaaggaagt

SEQ ID NO: 7918646 - DNA, 22 bp, Homo sapiens
atgccacttcattccagcctcg

SEQ ID NO: 7918647 - DNA, 20 bp, Homo sapiens
atgcatatatgtggtgtctg

SEQ ID NO: 7918648 - DNA, 22 bp, Homo sapiens
atgcatatcagtgattgtttgc

SEQ ID NO: 7918649 - DNA, 22 bp, Homo sapiens
atgcatatcacagtctccatgt

SEQ ID NO: 7918650 - DNA, 22 bp, Homo sapiens
atgcatatctcctatctcctca

SEQ ID NO: 7918651 - DNA, 22 bp, Homo sapiens
atgcatatgcaatgcacaattt

SEQ ID NO: 7918652 - DNA, 22 bp, Homo sapiens
atgcatatgcatctgtgtacat

SEQ ID NO: 7918653 - DNA, 22 bp, Homo sapiens
atgccctggactagctatactt

SEQ ID NO: 7918654 - DNA, 22 bp, Homo sapiens
atgccctgctctcgggaaggga

SEQ ID NO: 7918655 - DNA, 22 bp, Homo sapiens
atgccctgcatcaagtgacact

SEQ ID NO: 7918656 - DNA, 22 bp, Homo sapiens
atgccctgcatcaagtgacact

SEQ ID NO: 7918657 - DNA, 22 bp, Homo sapiens
atgccctgccaagcaggctaaa

SEQ ID NO: 7918658 - DNA, 22 bp, Homo sapiens
atgccctgccaagcaggctaaa

SEQ ID NO: 7918659 - DNA, 22 bp, Homo sapiens
atgccccaggaggtgccatcca

SEQ ID NO: 7918660 - DNA, 22 bp, Homo sapiens
atgcccagaaccccctggatgg

SEQ ID NO: 7918661 - DNA, 22 bp, Homo sapiens
atgcccagaaccccctggatgg

SEQ ID NO: 7918662 - DNA, 22 bp, Homo sapiens
atgcccagaaccccctggatgg

SEQ ID NO: 7918663 - DNA, 22 bp, Homo sapiens
atgcccaggcccatacctagat

SEQ ID NO: 7918664 - DNA, 22 bp, Homo sapiens
atgcccaggcccatacctagat

SEQ ID NO: 7918665 - DNA, 22 bp, Homo sapiens
atgcccccatctctgttggctc

SEQ ID NO: 7918666 - DNA, 22 bp, Homo sapiens
atgcccctccttgtggtcgccc

SEQ ID NO: 7918667 - DNA, 22 bp, Homo sapiens
atgccctctgtttcccaaggcc

SEQ ID NO: 7918668 - DNA, 22 bp, Homo sapiens
atgcccctggcctggggaacat

SEQ ID NO: 7918669 - DNA, 22 bp, Homo sapiens
atgcccctggccactcatattg

SEQ ID NO: 7918670 - DNA, 22 bp, Homo sapiens
atgccctgagcaggccttcaag

SEQ ID NO: 7918671 - DNA, 22 bp, Homo sapiens
gacagggacgaggcttcaggca

SEQ ID NO: 7918672 - DNA, 22 bp, Homo sapiens
gacagggacgaggcttcaggca

SEQ ID NO: 7918673 - DNA, 22 bp, Homo sapiens
gacagggactccctggttagaa

SEQ ID NO: 7918674 - DNA, 22 bp, Homo sapiens
gacaggaaaggggtctgttttc

SEQ ID NO: 7918675 - DNA, 22 bp, Homo sapiens
atgcctggactgacatgcactg

SEQ ID NO: 7918676 - DNA, 22 bp, Homo sapiens
atgcctggactgacatgcactg

SEQ ID NO: 7918677 - DNA, 22 bp, Homo sapiens
gacaggaaatatgggggttgtt

SEQ ID NO: 7918678 - DNA, 22 bp, Homo sapiens
gacaggaaatatgggggttgtt

SEQ ID NO: 7918679 - DNA, 22 bp, Homo sapiens
gacaggaacataaatgtaggag

SEQ ID NO: 7918680 - DNA, 20 bp, Homo sapiens
atgcctctaattttgcaaac

SEQ ID NO: 7918681 - DNA, 20 bp, Homo sapiens
atgcctctaattttgcaaac

SEQ ID NO: 7918682 - DNA, 22 bp, Homo sapiens
atgcctccttctgaaacagggc

SEQ ID NO: 7918683 - DNA, 22 bp, Homo sapiens
atgcctccttctgaaacagggc

SEQ ID NO: 7918684 - DNA, 22 bp, Homo sapiens
atgcctcctgtgccactgtgat

SEQ ID NO: 7918685 - DNA, 22 bp, Homo sapiens
atgcctcctgtgccactgtgat

SEQ ID NO: 7918686 - DNA, 22 bp, Homo sapiens
atgcctcctgtgccactgtgat

SEQ ID NO: 7918687 - DNA, 22 bp, Homo sapiens
atgcctcctcaaatctgccaca

SEQ ID NO: 7918688 - DNA, 22 bp, Homo sapiens
atgcctggactgacatgcactg

SEQ ID NO: 7918689 - DNA, 22 bp, Homo sapiens
atgcctctgctcttggtcctca

SEQ ID NO: 7918690 - DNA, 22 bp, Homo sapiens
atgcctctgctcttggtcctca

SEQ ID NO: 7918691 - DNA, 22 bp, Homo sapiens
atgcccttatgccagaggcaat

SEQ ID NO: 7918692 - DNA, 22 bp, Homo sapiens
atgccctgtggttcatgtgaga

SEQ ID NO: 7918693 - DNA, 21 bp, Homo sapiens
atgcccttcactcaaggccag

SEQ ID NO: 7918694 - DNA, 22 bp, Homo sapiens
atgcccttcaacgtgaggattt

SEQ ID NO: 7918695 - DNA, 22 bp, Homo sapiens
atgcccttatgccagaggcaat

SEQ ID NO: 7918696 - DNA, 22 bp, Homo sapiens
atgccctttaatttcactgtta

SEQ ID NO: 7918697 - DNA, 22 bp, Homo sapiens
atgccctttaatttcactgtta

SEQ ID NO: 7918698 - DNA, 22 bp, Homo sapiens
atgcccttcatttatcatgaaa

SEQ ID NO: 7918699 - DNA, 22 bp, Homo sapiens
atgcctccctgtccttcagttc

SEQ ID NO: 7918700 - DNA, 22 bp, Homo sapiens
atgcctcccctgtgtcttttat

SEQ ID NO: 7918701 - DNA, 22 bp, Homo sapiens
atgcctcccctgtgtcttttat

SEQ ID NO: 7918702 - DNA, 22 bp, Homo sapiens
atgcctccaagattcttacgtt

SEQ ID NO: 7918703 - DNA, 22 bp, Homo sapiens
atgcctccaagattcttacgtt

SEQ ID NO: 7918704 - DNA, 22 bp, Homo sapiens
atgcctccctgtccttcagttc

SEQ ID NO: 7918705 - DNA, 22 bp, Homo sapiens
atgcctccgcatgtgcctttga

SEQ ID NO: 7918706 - DNA, 22 bp, Homo sapiens
atgcctccgcatgtgcctttga

SEQ ID NO: 7918707 - DNA, 22 bp, Homo sapiens
atgcctcctcaaatctgccaca

SEQ ID NO: 7918708 - DNA, 22 bp, Homo sapiens
gagaggtgtgtttcagataaga

SEQ ID NO: 7918709 - DNA, 22 bp, Homo sapiens
gagaggtggaggttgcagtgag

SEQ ID NO: 7918710 - DNA, 22 bp, Homo sapiens
gagaggtggaggttgcagtgag

SEQ ID NO: 7918711 - DNA, 22 bp, Homo sapiens
gagaggtggaggttgcagtgag

SEQ ID NO: 7918712 - DNA, 22 bp, Homo sapiens
gagaggtggaggttgcagtgag

SEQ ID NO: 7918713 - DNA, 22 bp, Homo sapiens
gagaggtggaggttgcagtgag

SEQ ID NO: 7918714 - DNA, 22 bp, Homo sapiens
gagaggtgaaaggatagtttga

SEQ ID NO: 7918715 - DNA, 22 bp, Homo sapiens
gagaggtgaaatagttgtccgg

SEQ ID NO: 7918716 - DNA, 22 bp, Homo sapiens
gagaggtgaaatagttgtccgg

SEQ ID NO: 7918717 - DNA, 22 bp, Homo sapiens
gagaggtgaaggctgccctggg

SEQ ID NO: 7918718 - DNA, 22 bp, Homo sapiens
gagaggtgaaggctgccctggg

SEQ ID NO: 7918719 - DNA, 22 bp, Homo sapiens
gagaggtgaaggctgccctggg

SEQ ID NO: 7918720 - DNA, 22 bp, Homo sapiens
gagaggtgaaggctgccctggg

SEQ ID NO: 7918721 - DNA, 22 bp, Homo sapiens
gagaggtgaaggctgccctggg

SEQ ID NO: 7918722 - DNA, 22 bp, Homo sapiens
gagaggtgaatgtggatgccac

SEQ ID NO: 7918723 - DNA, 22 bp, Homo sapiens
gagaggtgaatgtggatgccac

SEQ ID NO: 7918724 - DNA, 22 bp, Homo sapiens
gagaggtgaatgtggatgccac

SEQ ID NO: 7918725 - DNA, 22 bp, Homo sapiens
gagcacagtaaagcagtgtcac

SEQ ID NO: 7918726 - DNA, 22 bp, Homo sapiens
gagcacagtaaagcagtgtcac

SEQ ID NO: 7918727 - DNA, 22 bp, Homo sapiens
gagcacagtaaagcagtgtcac

SEQ ID NO: 7918728 - DNA, 22 bp, Homo sapiens
gagcacagtaaagcagtgtcac

SEQ ID NO: 7918729 - DNA, 22 bp, Homo sapiens
gagcacagtaaagcagtgtcac

SEQ ID NO: 7918730 - DNA, 16 bp, Homo sapiens
gagcagcctgggcctt

SEQ ID NO: 7918731 - DNA, 16 bp, Homo sapiens
gagcagcctgggcctt

SEQ ID NO: 7918732 - DNA, 22 bp, Homo sapiens
gagcagctagataaagcccttc

SEQ ID NO: 7918733 - DNA, 22 bp, Homo sapiens
gagcagctaaaattctcatgca

SEQ ID NO: 7918734 - DNA, 22 bp, Homo sapiens
gagcagctagataaagcccttc

SEQ ID NO: 7918735 - DNA, 22 bp, Homo sapiens
gagcagctagataaagcccttc

SEQ ID NO: 7918736 - DNA, 22 bp, Homo sapiens
gagcagctaaaattctcatgca

SEQ ID NO: 7918737 - DNA, 22 bp, Homo sapiens
gagcagctaaaattctcatgca

SEQ ID NO: 7918738 - DNA, 22 bp, Homo sapiens
gagcagctaaaattctcatgca

SEQ ID NO: 7918739 - DNA, 22 bp, Homo sapiens
gagcagctaaaattctcatgca

SEQ ID NO: 7918740 - DNA, 22 bp, Homo sapiens
gagcagctaaaattctcatgca

SEQ ID NO: 7918741 - DNA, 22 bp, Homo sapiens
gagcagctccagccgcatgact

SEQ ID NO: 7918742 - DNA, 22 bp, Homo sapiens
gagcagctccagccgcatgact

SEQ ID NO: 7918743 - DNA, 22 bp, Homo sapiens
gagcagctcaggcacttagcca

SEQ ID NO: 7918744 - DNA, 22 bp, Homo sapiens
gagcagctccagccgcatgact

SEQ ID NO: 7918745 - DNA, 22 bp, Homo sapiens
gagcagctcagaggactagtgt

SEQ ID NO: 7918746 - DNA, 22 bp, Homo sapiens
gagcagctcagaggactagtgt

SEQ ID NO: 7918747 - DNA, 22 bp, Homo sapiens
gagcagctcagaggactagtgt

SEQ ID NO: 7918748 - DNA, 22 bp, Homo sapiens
gagcagctcgagaaggaagcag

SEQ ID NO: 7918749 - DNA, 22 bp, Homo sapiens
gagcagctcgagaaggaagcag

SEQ ID NO: 7918750 - DNA, 22 bp, Homo sapiens
gagcagctcgagaaggaagcag

SEQ ID NO: 7918751 - DNA, 22 bp, Homo sapiens
gagcagctcgagaaggaagcag

SEQ ID NO: 7918752 - DNA, 22 bp, Homo sapiens
gagcagctcgagaaggaagcag

SEQ ID NO: 7918753 - DNA, 22 bp, Homo sapiens
gagcagctcgagaaggaagcag

SEQ ID NO: 7918754 - DNA, 22 bp, Homo sapiens
gagcagctccagccgcatgact

SEQ ID NO: 7918755 - DNA, 22 bp, Homo sapiens
gagcagctcgagaaggaagcag

SEQ ID NO: 7918756 - DNA, 22 bp, Homo sapiens
gagcagctcgagaaggaagcag

SEQ ID NO: 7918757 - DNA, 22 bp, Homo sapiens
gagcagctcgagaaggaagcag

SEQ ID NO: 7918758 - DNA, 22 bp, Homo sapiens
gagaggtagcagtaagaacagg

SEQ ID NO: 7918759 - DNA, 22 bp, Homo sapiens
gagaggtccattcccctgtcag

SEQ ID NO: 7918760 - DNA, 22 bp, Homo sapiens
gagaggtcggggacactgcaaa

SEQ ID NO: 7918761 - DNA, 22 bp, Homo sapiens
gagaggtcatctcccatcagca

SEQ ID NO: 7918762 - DNA, 22 bp, Homo sapiens
gagaggtcatctcccatcagca

SEQ ID NO: 7918763 - DNA, 22 bp, Homo sapiens
gagaggctggcagtgccaggtt

SEQ ID NO: 7918764 - DNA, 22 bp, Homo sapiens
gagaggctggcagtgccaggtt

SEQ ID NO: 7918765 - DNA, 22 bp, Homo sapiens
gagaggctggcagtgccaggtt

SEQ ID NO: 7918766 - DNA, 22 bp, Homo sapiens
gagaggctggcagtgccaggtt

SEQ ID NO: 7918767 - DNA, 22 bp, Homo sapiens
gagaggctgaaatcacaggagc

SEQ ID NO: 7918768 - DNA, 22 bp, Homo sapiens
gagaggctgaaatcacaggagc

SEQ ID NO: 7918769 - DNA, 22 bp, Homo sapiens
gagaggctgaaatcacaggagc

SEQ ID NO: 7918770 - DNA, 22 bp, Homo sapiens
gagaggctgactggctgtcctg

SEQ ID NO: 7918771 - DNA, 22 bp, Homo sapiens
gagaggctgactggctgtcctg

SEQ ID NO: 7918772 - DNA, 22 bp, Homo sapiens
gagaggctgactggctgtcctg

SEQ ID NO: 7918773 - DNA, 22 bp, Homo sapiens
gagaggctgatcctgcagagaa

SEQ ID NO: 7918774 - DNA, 22 bp, Homo sapiens
gagaggctgatcctgcagagaa

SEQ ID NO: 7918775 - DNA, 22 bp, Homo sapiens
gagaggctgatcctgcagagaa

SEQ ID NO: 7918776 - DNA, 22 bp, Homo sapiens
gagaggctgatcctgcagagaa

SEQ ID NO: 7918777 - DNA, 22 bp, Homo sapiens
gagaggctgatcctgcagagaa

SEQ ID NO: 7918778 - DNA, 22 bp, Homo sapiens
gagaggctgatcctgcagagaa

SEQ ID NO: 7918779 - DNA, 22 bp, Homo sapiens
gagaggctctgaggactggggt

SEQ ID NO: 7918780 - DNA, 22 bp, Homo sapiens
gagaggctctgaggactggggt

SEQ ID NO: 7918781 - DNA, 22 bp, Homo sapiens
gagaggctctgaggactggggt

SEQ ID NO: 7918782 - DNA, 22 bp, Homo sapiens
gagaggctctgaggactggggt

SEQ ID NO: 7918783 - DNA, 22 bp, Homo sapiens
gagaggctctgaggactggggt

SEQ ID NO: 7918784 - DNA, 22 bp, Homo sapiens
gagaggctccgccactgctcag

SEQ ID NO: 7918785 - DNA, 22 bp, Homo sapiens
gagaggaatgaggttaaggact

SEQ ID NO: 7918786 - DNA, 22 bp, Homo sapiens
gagaggctccgccactgctcag

SEQ ID NO: 7918787 - DNA, 22 bp, Homo sapiens
gagaggaatgaggttaaggact

SEQ ID NO: 7918788 - DNA, 22 bp, Homo sapiens
gagaggaatgaggttaaggact

SEQ ID NO: 7918789 - DNA, 22 bp, Homo sapiens
gagaggaatatcattatattag

SEQ ID NO: 7918790 - DNA, 22 bp, Homo sapiens
gagaggaatatcattatattag

SEQ ID NO: 7918791 - DNA, 22 bp, Homo sapiens
gagaggaagccttctgtacttg

SEQ ID NO: 7918792 - DNA, 21 bp, Homo sapiens
atggaaaaacaggtagagcat

SEQ ID NO: 7918793 - DNA, 21 bp, Homo sapiens
atggaaaaacaggtagagcat

SEQ ID NO: 7918794 - DNA, 22 bp, Homo sapiens
atgcttttcctaaaatgatgcc

SEQ ID NO: 7918795 - DNA, 22 bp, Homo sapiens
atgcttttcctaaaatgatgcc

SEQ ID NO: 7918796 - DNA, 22 bp, Homo sapiens
atgctttttaaacttaattgga

SEQ ID NO: 7918797 - DNA, 22 bp, Homo sapiens
atgcttttggtctttggtccgg

SEQ ID NO: 7918798 - DNA, 22 bp, Homo sapiens
atgcttttggtctttggtccgg

SEQ ID NO: 7918799 - DNA, 18 bp, Homo sapiens
gagctctgcctcccagtc

SEQ ID NO: 7918800 - DNA, 22 bp, Homo sapiens
gagctctgccatggctcccacc

SEQ ID NO: 7918801 - DNA, 22 bp, Homo sapiens
gagctctgccatggctcccacc

SEQ ID NO: 7918802 - DNA, 22 bp, Homo sapiens
gagctctgcagattgttttagg

SEQ ID NO: 7918803 - DNA, 22 bp, Homo sapiens
gagctctgcagattgttttagg

SEQ ID NO: 7918804 - DNA, 23 bp, Homo sapiens
gagctctgcactaggccctggga

SEQ ID NO: 7918805 - DNA, 23 bp, Homo sapiens
gagctctgcactaggccctggga

SEQ ID NO: 7918806 - DNA, 23 bp, Homo sapiens
gagctctgcactaggccctggga

SEQ ID NO: 7918807 - DNA, 23 bp, Homo sapiens
gagctctgcactaggccctggga

SEQ ID NO: 7918808 - DNA, 22 bp, Homo sapiens
gagccttcatcgcagccttgtt

SEQ ID NO: 7918809 - DNA, 22 bp, Homo sapiens
gagcctgggtccttccctggga

SEQ ID NO: 7918810 - DNA, 21 bp, Homo sapiens
gagccttccctctgccctttc

SEQ ID NO: 7918811 - DNA, 22 bp, Homo sapiens
gagcgcggtccccacggaggat

SEQ ID NO: 7918812 - DNA, 22 bp, Homo sapiens
gagcgcggtccccacggaggat

SEQ ID NO: 7918813 - DNA, 22 bp, Homo sapiens
gagcgcgggtcgagggaacggc

SEQ ID NO: 7918814 - DNA, 22 bp, Homo sapiens
gagcgcgccacaaggagcggcg

SEQ ID NO: 7918815 - DNA, 22 bp, Homo sapiens
gagcgattgcgggggtcagagg

SEQ ID NO: 7918816 - DNA, 22 bp, Homo sapiens
gagcctttgaagccctcagaga

SEQ ID NO: 7918817 - DNA, 22 bp, Homo sapiens
gagcctgggactgggggtcatg

SEQ ID NO: 7918818 - DNA, 22 bp, Homo sapiens
gagcctgggactgggggtcatg

SEQ ID NO: 7918819 - DNA, 22 bp, Homo sapiens
gagcctgggactgggggtcatg

SEQ ID NO: 7918820 - DNA, 22 bp, Homo sapiens
gagcctgggactgggggtcatg

SEQ ID NO: 7918821 - DNA, 22 bp, Homo sapiens
gagcctgggactgggggtcatg

SEQ ID NO: 7918822 - DNA, 22 bp, Homo sapiens
gagcctggggaccctcctgagt

SEQ ID NO: 7918823 - DNA, 22 bp, Homo sapiens
gagcctggggaccctcctgagt

SEQ ID NO: 7918824 - DNA, 22 bp, Homo sapiens
gagcctggggaccctcctgagt

SEQ ID NO: 7918825 - DNA, 22 bp, Homo sapiens
gagcctggggaccctcctgagt

SEQ ID NO: 7918826 - DNA, 22 bp, Homo sapiens
gagcctgggtccttccctggga

SEQ ID NO: 7918827 - DNA, 22 bp, Homo sapiens
gagcctgggtccttccctggga

SEQ ID NO: 7918828 - DNA, 22 bp, Homo sapiens
gagcctgggtccttccctggga

SEQ ID NO: 7918829 - DNA, 22 bp, Homo sapiens
gagcctgggtccttccctggga

SEQ ID NO: 7918830 - DNA, 22 bp, Homo sapiens
gagcctgggtccttccctggga

SEQ ID NO: 7918831 - DNA, 22 bp, Homo sapiens
gagcctgggtccttccctggga

SEQ ID NO: 7918832 - DNA, 22 bp, Homo sapiens
gagcctgggactgggggtcatg

SEQ ID NO: 7918833 - DNA, 22 bp, Homo sapiens
gagcctgggactgggggtcatg

SEQ ID NO: 7918834 - DNA, 22 bp, Homo sapiens
gagcctgggactgggggtcatg

SEQ ID NO: 7918835 - DNA, 20 bp, Homo sapiens
gagcctgggaagtctaaggt

SEQ ID NO: 7918836 - DNA, 20 bp, Homo sapiens
gagcctgggaagtctaaggt

SEQ ID NO: 7918837 - DNA, 20 bp, Homo sapiens
gagcctgggaagtctaaggt

SEQ ID NO: 7918838 - DNA, 20 bp, Homo sapiens
gagcctgggaagtctaaggt

SEQ ID NO: 7918839 - DNA, 20 bp, Homo sapiens
gagcctgggaagtctaaggt

SEQ ID NO: 7918840 - DNA, 22 bp, Homo sapiens
gagcctggcctcctgcctcagc

SEQ ID NO: 7918841 - DNA, 22 bp, Homo sapiens
gagcctggcctcctgcctcagc

SEQ ID NO: 7918842 - DNA, 22 bp, Homo sapiens
gagcctggcctcctgcctcagc

SEQ ID NO: 7918843 - DNA, 22 bp, Homo sapiens
gagcctggcctcctgcctcagc

SEQ ID NO: 7918844 - DNA, 22 bp, Homo sapiens
gagcctggcctcctgcctcagc

SEQ ID NO: 7918845 - DNA, 22 bp, Homo sapiens
gagcctggcctcctgcctcagc

SEQ ID NO: 7918846 - DNA, 22 bp, Homo sapiens
gagcctggcctcctgcctcagc

SEQ ID NO: 7918847 - DNA, 22 bp, Homo sapiens
gagcctggcctcctgcctcagc

SEQ ID NO: 7918848 - DNA, 22 bp, Homo sapiens
gagcctggcctcctgcctcagc

SEQ ID NO: 7918849 - DNA, 22 bp, Homo sapiens
gagcctggcctcctgcctcagc

SEQ ID NO: 7918850 - DNA, 19 bp, Homo sapiens
gagcagctgcacccattga

SEQ ID NO: 7918851 - DNA, 22 bp, Homo sapiens
gagcagctgagctggaatgaga

SEQ ID NO: 7918852 - DNA, 19 bp, Homo sapiens
gagcagctgcacccattga

SEQ ID NO: 7918853 - DNA, 19 bp, Homo sapiens
gagcagctgcacccattga

SEQ ID NO: 7918854 - DNA, 22 bp, Homo sapiens
gagcagggagacaactctggtg

SEQ ID NO: 7918855 - DNA, 22 bp, Homo sapiens
gagcagggagacaactctggtg

SEQ ID NO: 7918856 - DNA, 17 bp, Homo sapiens
gagcagggatgcggttc

SEQ ID NO: 7918857 - DNA, 17 bp, Homo sapiens
gagcagggatgcggttc

SEQ ID NO: 7918858 - DNA, 17 bp, Homo sapiens
gagcagggatgcggttc

SEQ ID NO: 7918859 - DNA, 17 bp, Homo sapiens
gagcagggatgcggttc

SEQ ID NO: 7918860 - DNA, 17 bp, Homo sapiens
gagcagggatgcggttc

SEQ ID NO: 7918861 - DNA, 22 bp, Homo sapiens
gagcagggagacaactctggtg

SEQ ID NO: 7918862 - DNA, 22 bp, Homo sapiens
gagcagggagacaactctggtg

SEQ ID NO: 7918863 - DNA, 22 bp, Homo sapiens
gagcagctctgggtgacccagt

SEQ ID NO: 7918864 - DNA, 22 bp, Homo sapiens
gagcagctctgggtgacccagt

SEQ ID NO: 7918865 - DNA, 22 bp, Homo sapiens
gagcagctctgtgcctggagac

SEQ ID NO: 7918866 - DNA, 22 bp, Homo sapiens
gagcagctctgggtgacccagt

SEQ ID NO: 7918867 - DNA, 22 bp, Homo sapiens
gagcagctctgtgcctggagac

SEQ ID NO: 7918868 - DNA, 22 bp, Homo sapiens
gagcagctctgtgcctggagac

SEQ ID NO: 7918869 - DNA, 22 bp, Homo sapiens
gagcagctgagctggaatgaga

SEQ ID NO: 7918870 - DNA, 22 bp, Homo sapiens
gagcagctctgtgcctggagac

SEQ ID NO: 7918871 - DNA, 22 bp, Homo sapiens
gagcagctctgtgcctggagac

SEQ ID NO: 7918872 - DNA, 22 bp, Homo sapiens
gagcagctgagctggaatgaga

SEQ ID NO: 7918873 - DNA, 22 bp, Homo sapiens
gagcagctgagctggaatgaga

SEQ ID NO: 7918874 - DNA, 22 bp, Homo sapiens
gagcagctgagctggaatgaga

SEQ ID NO: 7918875 - DNA, 22 bp, Homo sapiens
gagcagctgagctggaatgaga

SEQ ID NO: 7918876 - DNA, 22 bp, Homo sapiens
gagcagctgagctggaatgaga

SEQ ID NO: 7918877 - DNA, 22 bp, Homo sapiens
gagcagggcttgtcctcctcat

SEQ ID NO: 7918878 - DNA, 22 bp, Homo sapiens
gagcagggcttgtcctcctcat

SEQ ID NO: 7918879 - DNA, 22 bp, Homo sapiens
gagcagggcttgtcctcctcat

SEQ ID NO: 7918880 - DNA, 22 bp, Homo sapiens
gagcaggtctttcatggtgcat

SEQ ID NO: 7918881 - DNA, 22 bp, Homo sapiens
gagcaggtctttcatggtgcat

SEQ ID NO: 7918882 - DNA, 22 bp, Homo sapiens
gagcaggtctttcatggtgcat

SEQ ID NO: 7918883 - DNA, 17 bp, Homo sapiens
gagcagggatgcggttc

SEQ ID NO: 7918884 - DNA, 22 bp, Homo sapiens
gagcagggccacttctgtacct

SEQ ID NO: 7918885 - DNA, 22 bp, Homo sapiens
gagcagggccacttctgtacct

SEQ ID NO: 7918886 - DNA, 22 bp, Homo sapiens
gagcagtaggagaaccctgagc

SEQ ID NO: 7918887 - DNA, 22 bp, Homo sapiens
gagcagtagagtacatggctcc

SEQ ID NO: 7918888 - DNA, 22 bp, Homo sapiens
gagcaggtttcaatgctgatgc

SEQ ID NO: 7918889 - DNA, 22 bp, Homo sapiens
gagcagtaggagaaccctgagc

SEQ ID NO: 7918890 - DNA, 22 bp, Homo sapiens
gagcagtaggagaaccctgagc

SEQ ID NO: 7918891 - DNA, 22 bp, Homo sapiens
gagcctggattgtcaccgactt

SEQ ID NO: 7918892 - DNA, 22 bp, Homo sapiens
gagcctggattgtcaccgactt

SEQ ID NO: 7918893 - DNA, 22 bp, Homo sapiens
gagcctggattgtcaccgactt

SEQ ID NO: 7918894 - DNA, 22 bp, Homo sapiens
gagccctcttgtctatatggta

SEQ ID NO: 7918895 - DNA, 22 bp, Homo sapiens
gagccctgaacaacagcaggaa

SEQ ID NO: 7918896 - DNA, 20 bp, Homo sapiens
gagccctctgcactagcgcc

SEQ ID NO: 7918897 - DNA, 22 bp, Homo sapiens
gagcagtgactggagcatgaga

SEQ ID NO: 7918898 - DNA, 22 bp, Homo sapiens
gagccctcttccctagtgatcg

SEQ ID NO: 7918899 - DNA, 22 bp, Homo sapiens
atgtacaaaatgttttgaaatg

SEQ ID NO: 7918900 - DNA, 22 bp, Homo sapiens
atgtacaaaatgttttgaaatg

SEQ ID NO: 7918901 - DNA, 22 bp, Homo sapiens
atgtacaaaatgttttgaaatg

SEQ ID NO: 7918902 - DNA, 22 bp, Homo sapiens
atgtacaacctgcatgacagtc

SEQ ID NO: 7918903 - DNA, 22 bp, Homo sapiens
atgtacaacctgcatgacagtc

SEQ ID NO: 7918904 - DNA, 22 bp, Homo sapiens
atgtacaacctgcatgacagtc

SEQ ID NO: 7918905 - DNA, 22 bp, Homo sapiens
atgtacaacctgcatgacagtc

SEQ ID NO: 7918906 - DNA, 22 bp, Homo sapiens
atgtacaacctgcatgacagtc

SEQ ID NO: 7918907 - DNA, 22 bp, Homo sapiens
atgtacaaaatgccactgaatt

SEQ ID NO: 7918908 - DNA, 22 bp, Homo sapiens
atgtacaaaatgccactgaatt

SEQ ID NO: 7918909 - DNA, 22 bp, Homo sapiens
atgtacaaaatgccactgaatt

SEQ ID NO: 7918910 - DNA, 22 bp, Homo sapiens
atgtacaaaatgccactgaatt

SEQ ID NO: 7918911 - DNA, 22 bp, Homo sapiens
atgtacaaaatgttttgaaatg

SEQ ID NO: 7918912 - DNA, 22 bp, Homo sapiens
atgtacaaaatgttttgaaatg

SEQ ID NO: 7918913 - DNA, 22 bp, Homo sapiens
atgtacaaaatgttttgaaatg

SEQ ID NO: 7918914 - DNA, 22 bp, Homo sapiens
atgtacaaaatgttttgaaatg

SEQ ID NO: 7918915 - DNA, 22 bp, Homo sapiens
atgtacaaaatgttttgaaatg

SEQ ID NO: 7918916 - DNA, 22 bp, Homo sapiens
atgtacaagctgttttactgca

SEQ ID NO: 7918917 - DNA, 22 bp, Homo sapiens
atgtacaagctgttttactgca

SEQ ID NO: 7918918 - DNA, 22 bp, Homo sapiens
atgtacaagctgttttactgca

SEQ ID NO: 7918919 - DNA, 22 bp, Homo sapiens
atgtacaacctgcatgacagtc

SEQ ID NO: 7918920 - DNA, 22 bp, Homo sapiens
atgtacaacctgcatgacagtc

SEQ ID NO: 7918921 - DNA, 22 bp, Homo sapiens
atgtacaatctagggtttgcat

SEQ ID NO: 7918922 - DNA, 22 bp, Homo sapiens
atgtacaatctagggtttgcat

SEQ ID NO: 7918923 - DNA, 22 bp, Homo sapiens
atgtacaagctgttttactgca

SEQ ID NO: 7918924 - DNA, 22 bp, Homo sapiens
atgtacaagctgttttactgca

SEQ ID NO: 7918925 - DNA, 22 bp, Homo sapiens
atgtacaatctatcacaagaag

SEQ ID NO: 7918926 - DNA, 22 bp, Homo sapiens
atgtacaatctagggtttgcat

SEQ ID NO: 7918927 - DNA, 22 bp, Homo sapiens
atgtacaatctatcacaagaag

SEQ ID NO: 7918928 - DNA, 22 bp, Homo sapiens
atgtacaatctatcacaagaag

SEQ ID NO: 7918929 - DNA, 22 bp, Homo sapiens
atgtacaatctatcacaagaag

SEQ ID NO: 7918930 - DNA, 22 bp, Homo sapiens
atgtacaatctatcacaagaag

SEQ ID NO: 7918931 - DNA, 22 bp, Homo sapiens
atgtatttctatgtagtgaaga

SEQ ID NO: 7918932 - DNA, 22 bp, Homo sapiens
atgtatttgaaatttgagacat

SEQ ID NO: 7918933 - DNA, 22 bp, Homo sapiens
atgtatttctatgtagtgaaga

SEQ ID NO: 7918934 - DNA, 22 bp, Homo sapiens
atgtatttctatgtagtgaaga

SEQ ID NO: 7918935 - DNA, 22 bp, Homo sapiens
atgtatttctatgtagtgaaga

SEQ ID NO: 7918936 - DNA, 21 bp, Homo sapiens
atgtcaaatgctttattttat

SEQ ID NO: 7918937 - DNA, 21 bp, Homo sapiens
atgtcaaatgctttattttat

SEQ ID NO: 7918938 - DNA, 22 bp, Homo sapiens
atgtcaatttgttctctcgaag

SEQ ID NO: 7918939 - DNA, 22 bp, Homo sapiens
atgtcacagcaggagtattctt

SEQ ID NO: 7918940 - DNA, 22 bp, Homo sapiens
atgtcacagttgcaacatgaat

SEQ ID NO: 7918941 - DNA, 22 bp, Homo sapiens
atgtcacagtctgactcagtga

SEQ ID NO: 7918942 - DNA, 22 bp, Homo sapiens
atgtcacagtctgactcagtga

SEQ ID NO: 7918943 - DNA, 22 bp, Homo sapiens
atgtcacagcaggagtattctt

SEQ ID NO: 7918944 - DNA, 22 bp, Homo sapiens
atgtcacagcaggagtattctt

SEQ ID NO: 7918945 - DNA, 22 bp, Homo sapiens
atgtaacattgaattatatagt

SEQ ID NO: 7918946 - DNA, 22 bp, Homo sapiens
atgtaacattgaattatatagt

SEQ ID NO: 7918947 - DNA, 22 bp, Homo sapiens
atgtaactgaaggaaatgcatg

SEQ ID NO: 7918948 - DNA, 22 bp, Homo sapiens
atgtaactgaaggaaatgcatg

SEQ ID NO: 7918949 - DNA, 22 bp, Homo sapiens
atgtaacaggtgaagctctgag

SEQ ID NO: 7918950 - DNA, 22 bp, Homo sapiens
atgtaacaggtgaagctctgag

SEQ ID NO: 7918951 - DNA, 22 bp, Homo sapiens
atgtaacacccacttttatagc

SEQ ID NO: 7918952 - DNA, 22 bp, Homo sapiens
atgtaaagttcagtacagtttt

SEQ ID NO: 7918953 - DNA, 22 bp, Homo sapiens
atggtttaagggagaatattga

SEQ ID NO: 7918954 - DNA, 22 bp, Homo sapiens
atgtaaagtatctgaaatgctg

SEQ ID NO: 7918955 - DNA, 22 bp, Homo sapiens
atgtaaagtaatctgtcgatca

SEQ ID NO: 7918956 - DNA, 22 bp, Homo sapiens
atgtaacaaatggtatacatgt

SEQ ID NO: 7918957 - DNA, 22 bp, Homo sapiens
atgtaacaaatggtatacatgt

SEQ ID NO: 7918958 - DNA, 22 bp, Homo sapiens
atgtaacaaatggtatacatgt

SEQ ID NO: 7918959 - DNA, 22 bp, Homo sapiens
atgtaaattgtactgacacacg

SEQ ID NO: 7918960 - DNA, 22 bp, Homo sapiens
atgtaatttatgttatccataa

SEQ ID NO: 7918961 - DNA, 22 bp, Homo sapiens
atgtaatttgccctcaagttaa

SEQ ID NO: 7918962 - DNA, 22 bp, Homo sapiens
atgtaatttgccctcaagttaa

SEQ ID NO: 7918963 - DNA, 22 bp, Homo sapiens
atgtacaaaatgccactgaatt

SEQ ID NO: 7918964 - DNA, 22 bp, Homo sapiens
atgtaatttatgttatccataa

SEQ ID NO: 7918965 - DNA, 22 bp, Homo sapiens
atgtaatttagaaatgaacaca

SEQ ID NO: 7918966 - DNA, 22 bp, Homo sapiens
atgtaattgtagcaaaatgatg

SEQ ID NO: 7918967 - DNA, 22 bp, Homo sapiens
atgtaattattaacacctgtgc

SEQ ID NO: 7918968 - DNA, 22 bp, Homo sapiens
atgtaatgtagctgtgttagga

SEQ ID NO: 7918969 - DNA, 22 bp, Homo sapiens
atgtaatagggtaacataacat

SEQ ID NO: 7918970 - DNA, 22 bp, Homo sapiens
atgtaatagggtaacataacat

SEQ ID NO: 7918971 - DNA, 22 bp, Homo sapiens
atgtaatagggtaacataacat

SEQ ID NO: 7918972 - DNA, 22 bp, Homo sapiens
atgtaattgtagcaaaatgatg

SEQ ID NO: 7918973 - DNA, 22 bp, Homo sapiens
atgtaattgtagcaaaatgatg

SEQ ID NO: 7918974 - DNA, 22 bp, Homo sapiens
atgtaattctaagactgaagaa

SEQ ID NO: 7918975 - DNA, 22 bp, Homo sapiens
atgtaatgattgcaatgctgct

SEQ ID NO: 7918976 - DNA, 22 bp, Homo sapiens
atgtaattgtggtttttgccat

SEQ ID NO: 7918977 - DNA, 22 bp, Homo sapiens
atgtaatttagaaatgaacaca

SEQ ID NO: 7918978 - DNA, 22 bp, Homo sapiens
atgtaatttagaaatgaacaca

SEQ ID NO: 7918979 - DNA, 17 bp, Homo sapiens
atgtaagaagaaagcag

SEQ ID NO: 7918980 - DNA, 22 bp, Homo sapiens
atgtaagagctttgcagggaaa

SEQ ID NO: 7918981 - DNA, 22 bp, Homo sapiens
atgtaagactttaagaacctaa

SEQ ID NO: 7918982 - DNA, 23 bp, Homo sapiens
atgtaagagttccagttactttg

SEQ ID NO: 7918983 - DNA, 22 bp, Homo sapiens
atgtaagtattcaaaatatttc

SEQ ID NO: 7918984 - DNA, 22 bp, Homo sapiens
atgtaaggtttcttcctgttcc

SEQ ID NO: 7918985 - DNA, 22 bp, Homo sapiens
gagcttggtgttatttctgtgg

SEQ ID NO: 7918986 - DNA, 22 bp, Homo sapiens
gagcttggtgctgcctgttgtc

SEQ ID NO: 7918987 - DNA, 22 bp, Homo sapiens
gagcttggtgctgcctgttgtc

SEQ ID NO: 7918988 - DNA, 22 bp, Homo sapiens
gagcttggtgctgcctgttgtc

SEQ ID NO: 7918989 - DNA, 22 bp, Homo sapiens
gagctttaccttaggttctgtt

SEQ ID NO: 7918990 - DNA, 22 bp, Homo sapiens
gagctttcacagggtctcattg

SEQ ID NO: 7918991 - DNA, 22 bp, Homo sapiens
gagctttgagattcttatggta

SEQ ID NO: 7918992 - DNA, 22 bp, Homo sapiens
gagctttctgtgttccagttgc

SEQ ID NO: 7918993 - DNA, 22 bp, Homo sapiens
gagctttgatcgctaagcctca

SEQ ID NO: 7918994 - DNA, 22 bp, Homo sapiens
gagctttgatcgctaagcctca

SEQ ID NO: 7918995 - DNA, 22 bp, Homo sapiens
gagcttgggtgccatgctgagc

SEQ ID NO: 7918996 - DNA, 22 bp, Homo sapiens
gagcttggtgatgcctcctggt

SEQ ID NO: 7918997 - DNA, 22 bp, Homo sapiens
gagcttggtgcacagtggttaa

SEQ ID NO: 7918998 - DNA, 22 bp, Homo sapiens
gagcttgggtgccatgctgagc

SEQ ID NO: 7918999 - DNA, 22 bp, Homo sapiens
gagcttgggtgccatgctgagc

SEQ ID NO: 7919000 - DNA, 22 bp, Homo sapiens
gagcttggtgatgcctcctggt

SEQ ID NO: 7919001 - DNA, 22 bp, Homo sapiens
gagcttggggcatatggtgcta

SEQ ID NO: 7919002 - DNA, 22 bp, Homo sapiens
gagcttggggcatatggtgcta

SEQ ID NO: 7919003 - DNA, 22 bp, Homo sapiens
gagcttggctggacctcacgga

SEQ ID NO: 7919004 - DNA, 22 bp, Homo sapiens
gagcttggggcatatggtgcta

SEQ ID NO: 7919005 - DNA, 22 bp, Homo sapiens
gagctggggcggatactcagct

SEQ ID NO: 7919006 - DNA, 22 bp, Homo sapiens
gagctggggcggatactcagct

SEQ ID NO: 7919007 - DNA, 22 bp, Homo sapiens
gagctctgcttgggttcttagg

SEQ ID NO: 7919008 - DNA, 22 bp, Homo sapiens
gagctctgcttgggttcttagg

SEQ ID NO: 7919009 - DNA, 22 bp, Homo sapiens
gagctctgcttgggttcttagg

SEQ ID NO: 7919010 - DNA, 22 bp, Homo sapiens
gagctctggacgaggggagtgg

SEQ ID NO: 7919011 - DNA, 22 bp, Homo sapiens
gagctctgctactcaaagtatg

SEQ ID NO: 7919012 - DNA, 22 bp, Homo sapiens
gagctctgggaaacaaagtgta

SEQ ID NO: 7919013 - DNA, 22 bp, Homo sapiens
gagctctggcagggcaggtctg

SEQ ID NO: 7919014 - DNA, 22 bp, Homo sapiens
gagctctggcagggcaggtctg

SEQ ID NO: 7919015 - DNA, 22 bp, Homo sapiens
gagctctggcagggcaggtctg

SEQ ID NO: 7919016 - DNA, 22 bp, Homo sapiens
gagctctggacgaggggagtgg

SEQ ID NO: 7919017 - DNA, 22 bp, Homo sapiens
gagctctggcagggcaggtctg

SEQ ID NO: 7919018 - DNA, 22 bp, Homo sapiens
gagctctggcagggcaggtctg

SEQ ID NO: 7919019 - DNA, 22 bp, Homo sapiens
gagctctgtacacagagggtgt

SEQ ID NO: 7919020 - DNA, 22 bp, Homo sapiens
gagctctgtccacacttggaga

SEQ ID NO: 7919021 - DNA, 22 bp, Homo sapiens
gagctggggcggatactcagct

SEQ ID NO: 7919022 - DNA, 22 bp, Homo sapiens
gagctctgtgaatgtggggagg

SEQ ID NO: 7919023 - DNA, 22 bp, Homo sapiens
gagctctgtgaatgtggggagg

SEQ ID NO: 7919024 - DNA, 22 bp, Homo sapiens
gagctctgggtggcaggtgtct

SEQ ID NO: 7919025 - DNA, 22 bp, Homo sapiens
gagctctgggtgtgttgtcagt

SEQ ID NO: 7919026 - DNA, 22 bp, Homo sapiens
gagctctggttcatgatctatt

SEQ ID NO: 7919027 - DNA, 22 bp, Homo sapiens
gagctttgtcccttgggggctc

SEQ ID NO: 7919028 - DNA, 22 bp, Homo sapiens
gagctttgtagcaggaaggaag

SEQ ID NO: 7919029 - DNA, 22 bp, Homo sapiens
gagctttgtcccttgggggctc

SEQ ID NO: 7919030 - DNA, 22 bp, Homo sapiens
gagctttggtgccaagtatttg

SEQ ID NO: 7919031 - DNA, 22 bp, Homo sapiens
gagctttgtaaaaaacttgcac

SEQ ID NO: 7919032 - DNA, 22 bp, Homo sapiens
gagctttgttccgtggtggcac

SEQ ID NO: 7919033 - DNA, 22 bp, Homo sapiens
gagctttgtgctggtaggtggt

SEQ ID NO: 7919034 - DNA, 22 bp, Homo sapiens
gagctttgttccgtggtggcac

SEQ ID NO: 7919035 - DNA, 22 bp, Homo sapiens
gagctttgtctcctggagaccc

SEQ ID NO: 7919036 - DNA, 22 bp, Homo sapiens
gagctttgtctcctggagaccc

SEQ ID NO: 7919037 - DNA, 22 bp, Homo sapiens
gagctttgtgctggtaggtggt

SEQ ID NO: 7919038 - DNA, 22 bp, Homo sapiens
gagctttgctggaagcctgggg

SEQ ID NO: 7919039 - DNA, 22 bp, Homo sapiens
gagctttgctggaagcctgggg

SEQ ID NO: 7919040 - DNA, 22 bp, Homo sapiens
gagctttggggaagaatacaga

SEQ ID NO: 7919041 - DNA, 22 bp, Homo sapiens
gagctttggggaagaatacaga

SEQ ID NO: 7919042 - DNA, 22 bp, Homo sapiens
gagctttggggaagaatacaga

SEQ ID NO: 7919043 - DNA, 22 bp, Homo sapiens
gagctttgcctaaaactagaat

SEQ ID NO: 7919044 - DNA, 22 bp, Homo sapiens
gagctttgcattattcagaagc

SEQ ID NO: 7919045 - DNA, 22 bp, Homo sapiens
gagctttgcctaaaactagaat

SEQ ID NO: 7919046 - DNA, 22 bp, Homo sapiens
gaggaagcagggcttggctgag

SEQ ID NO: 7919047 - DNA, 22 bp, Homo sapiens
gaggaagcagggcttggctgag

SEQ ID NO: 7919048 - DNA, 22 bp, Homo sapiens
gaggaagcagggcttggctgag

SEQ ID NO: 7919049 - DNA, 22 bp, Homo sapiens
gaggaagctgcgtggcatttca

SEQ ID NO: 7919050 - DNA, 22 bp, Homo sapiens
gaggaagctgcgtggcatttca

SEQ ID NO: 7919051 - DNA, 22 bp, Homo sapiens
gaggaagccccattgaagccag

SEQ ID NO: 7919052 - DNA, 22 bp, Homo sapiens
gaggaagctgcgtggcatttca

SEQ ID NO: 7919053 - DNA, 22 bp, Homo sapiens
gaggaagccccattgaagccag

SEQ ID NO: 7919054 - DNA, 22 bp, Homo sapiens
gaggaagccccattgaagccag

SEQ ID NO: 7919055 - DNA, 22 bp, Homo sapiens
gaggaagcattgacataatctc

SEQ ID NO: 7919056 - DNA, 22 bp, Homo sapiens
gaggaaggagggaaagcgcgcg

SEQ ID NO: 7919057 - DNA, 22 bp, Homo sapiens
gaggaaggaatgcagtgtatgc

SEQ ID NO: 7919058 - DNA, 22 bp, Homo sapiens
gaggaaggagggaaagcgcgcg

SEQ ID NO: 7919059 - DNA, 22 bp, Homo sapiens
gaggaaggaatgcagtgtatgc

SEQ ID NO: 7919060 - DNA, 22 bp, Homo sapiens
gaggaagcttttgatcgcccag

SEQ ID NO: 7919061 - DNA, 22 bp, Homo sapiens
gaggaaggaatgcagtgtatgc

SEQ ID NO: 7919062 - DNA, 22 bp, Homo sapiens
gaggaaggaatgcagtgtatgc

SEQ ID NO: 7919063 - DNA, 22 bp, Homo sapiens
gaggaaggaatgcagtgtatgc

SEQ ID NO: 7919064 - DNA, 22 bp, Homo sapiens
gaggaaggaatgcagtgtatgc

SEQ ID NO: 7919065 - DNA, 22 bp, Homo sapiens
gaggaaggaatgcagtgtatgc

SEQ ID NO: 7919066 - DNA, 22 bp, Homo sapiens
atggttctggagactggtaatc

SEQ ID NO: 7919067 - DNA, 22 bp, Homo sapiens
atggttgaatcaaggtagacaa

SEQ ID NO: 7919068 - DNA, 22 bp, Homo sapiens
atggtttaaagagtatgacttt

SEQ ID NO: 7919069 - DNA, 22 bp, Homo sapiens
gaggaaggctaaggggcttaga

SEQ ID NO: 7919070 - DNA, 22 bp, Homo sapiens
gaggaaggctaaggggcttaga

SEQ ID NO: 7919071 - DNA, 22 bp, Homo sapiens
gaggaaggatttagtttgaggg

SEQ ID NO: 7919072 - DNA, 22 bp, Homo sapiens
gaggaaggatttagtttgaggg

SEQ ID NO: 7919073 - DNA, 22 bp, Homo sapiens
gaggaaggatttagtttgaggg

SEQ ID NO: 7919074 - DNA, 22 bp, Homo sapiens
gaggaaggatttagtttgaggg

SEQ ID NO: 7919075 - DNA, 22 bp, Homo sapiens
gaggaaggctaaggggcttaga

SEQ ID NO: 7919076 - DNA, 22 bp, Homo sapiens
gaggaaggatttagtttgaggg

SEQ ID NO: 7919077 - DNA, 22 bp, Homo sapiens
atgtttcaagagaaaaagagac

SEQ ID NO: 7919078 - DNA, 22 bp, Homo sapiens
atgtttcaatgcactttagcct

SEQ ID NO: 7919079 - DNA, 22 bp, Homo sapiens
atgtttcaaatatatagagttg

SEQ ID NO: 7919080 - DNA, 22 bp, Homo sapiens
atgtttcaccagttttataaga

SEQ ID NO: 7919081 - DNA, 22 bp, Homo sapiens
atgtttcaccagttttataaga

SEQ ID NO: 7919082 - DNA, 22 bp, Homo sapiens
atgtttcaccagttttataaga

SEQ ID NO: 7919083 - DNA, 22 bp, Homo sapiens
atgtttcaccagcaaattacct

SEQ ID NO: 7919084 - DNA, 22 bp, Homo sapiens
atgtttatgttgggctatattt

SEQ ID NO: 7919085 - DNA, 22 bp, Homo sapiens
atgtttacaaaaaggaggcttg

SEQ ID NO: 7919086 - DNA, 22 bp, Homo sapiens
atgtttattgttttaagctgct

SEQ ID NO: 7919087 - DNA, 22 bp, Homo sapiens
atgtttattgttttaagctgct

SEQ ID NO: 7919088 - DNA, 22 bp, Homo sapiens
atgtttattttgcagagtaggg

SEQ ID NO: 7919089 - DNA, 22 bp, Homo sapiens
atgtttattttgcagagtaggg

SEQ ID NO: 7919090 - DNA, 22 bp, Homo sapiens
atgtttaatcggctgcctttcc

SEQ ID NO: 7919091 - DNA, 20 bp, Homo sapiens
atgtttaatgttgtccaccc

SEQ ID NO: 7919092 - DNA, 22 bp, Homo sapiens
atgtttaattatctgggttttg

SEQ ID NO: 7919093 - DNA, 21 bp, Homo sapiens
gagtgcaggtctgatgccatc

SEQ ID NO: 7919094 - DNA, 21 bp, Homo sapiens
gagtgcaggtctgatgccatc

SEQ ID NO: 7919095 - DNA, 21 bp, Homo sapiens
gagtgcaggtctgatgccatc

SEQ ID NO: 7919096 - DNA, 22 bp, Homo sapiens
atgtttcagatacagatcaaat

SEQ ID NO: 7919097 - DNA, 22 bp, Homo sapiens
atgtttcaccagttttataaga

SEQ ID NO: 7919098 - DNA, 22 bp, Homo sapiens
atgtttcagggtgatagaaggt

SEQ ID NO: 7919099 - DNA, 22 bp, Homo sapiens
atgtttcaggcgaactaacatg

SEQ ID NO: 7919100 - DNA, 22 bp, Homo sapiens
atgtttcaggcgaactaacatg

SEQ ID NO: 7919101 - DNA, 22 bp, Homo sapiens
atgtttcatgactgagcaaaat

SEQ ID NO: 7919102 - DNA, 22 bp, Homo sapiens
atgtttcatgactgagcaaaat

SEQ ID NO: 7919103 - DNA, 22 bp, Homo sapiens
atgtttcatccactggcctttc

SEQ ID NO: 7919104 - DNA, 22 bp, Homo sapiens
atgtttcatttagatatcaggc

SEQ ID NO: 7919105 - DNA, 22 bp, Homo sapiens
atgtttcatgactgagcaaaat

SEQ ID NO: 7919106 - DNA, 22 bp, Homo sapiens
gagttaaagtacctttgtatgt

SEQ ID NO: 7919107 - DNA, 22 bp, Homo sapiens
gagttaaatagcttaggattca

SEQ ID NO: 7919108 - DNA, 22 bp, Homo sapiens
gagttaaatattttctgaagtt

SEQ ID NO: 7919109 - DNA, 22 bp, Homo sapiens
gagttaaatgacttggttaagg

SEQ ID NO: 7919110 - DNA, 22 bp, Homo sapiens
gagttaaatgacttggttaagg

SEQ ID NO: 7919111 - DNA, 22 bp, Homo sapiens
gagtccagttagtgaggctggg

SEQ ID NO: 7919112 - DNA, 22 bp, Homo sapiens
gagtccagttagtgaggctggg

SEQ ID NO: 7919113 - DNA, 22 bp, Homo sapiens
gagtccagtgtttaccaggggt

SEQ ID NO: 7919114 - DNA, 22 bp, Homo sapiens
gagtccagttagtgaggctggg

SEQ ID NO: 7919115 - DNA, 22 bp, Homo sapiens
gagtccagtgatgttcctggtc

SEQ ID NO: 7919116 - DNA, 23 bp, Homo sapiens
gagtgcagaatagacatgcagtg

SEQ ID NO: 7919117 - DNA, 23 bp, Homo sapiens
gagtgcagaatagacatgcagtg

SEQ ID NO: 7919118 - DNA, 23 bp, Homo sapiens
gagtgcagaatagacatgcagtg

SEQ ID NO: 7919119 - DNA, 22 bp, Homo sapiens
gagtccagttagtgaggctggg

SEQ ID NO: 7919120 - DNA, 22 bp, Homo sapiens
gagtccagttagtgaggctggg

SEQ ID NO: 7919121 - DNA, 22 bp, Homo sapiens
gagtccagttctttccagcagt

SEQ ID NO: 7919122 - DNA, 22 bp, Homo sapiens
gagtccagttagtgaggctggg

SEQ ID NO: 7919123 - DNA, 22 bp, Homo sapiens
gagtccaggctggtcaaatagc

SEQ ID NO: 7919124 - DNA, 22 bp, Homo sapiens
gagtccaggctgttgctcatct

SEQ ID NO: 7919125 - DNA, 22 bp, Homo sapiens
gagtccaggctgttgctcatct

SEQ ID NO: 7919126 - DNA, 22 bp, Homo sapiens
gagtccaggctgttgctcatct

SEQ ID NO: 7919127 - DNA, 20 bp, Homo sapiens
gagtccaggggcctgtagca

SEQ ID NO: 7919128 - DNA, 22 bp, Homo sapiens
gagtccaggctgttgctcatct

SEQ ID NO: 7919129 - DNA, 20 bp, Homo sapiens
gagtccaggggcctgtagca

SEQ ID NO: 7919130 - DNA, 20 bp, Homo sapiens
gagtccaggggcctgtagca

SEQ ID NO: 7919131 - DNA, 22 bp, Homo sapiens
gagtccagtagttaggacagag

SEQ ID NO: 7919132 - DNA, 22 bp, Homo sapiens
gagtccagtagttaggacagag

SEQ ID NO: 7919133 - DNA, 22 bp, Homo sapiens
gagtccagtgatgttcctggtc

SEQ ID NO: 7919134 - DNA, 22 bp, Homo sapiens
gagtgcaggcctgagcaccatc

SEQ ID NO: 7919135 - DNA, 22 bp, Homo sapiens
gagtgcaggcctgagcaccatc

SEQ ID NO: 7919136 - DNA, 22 bp, Homo sapiens
gagtgcaggcctgagcaccatc

SEQ ID NO: 7919137 - DNA, 22 bp, Homo sapiens
gagtgcaggcctgagcaccatc

SEQ ID NO: 7919138 - DNA, 22 bp, Homo sapiens
gagtgcaggcctgagcaccatc

SEQ ID NO: 7919139 - DNA, 21 bp, Homo sapiens
gagtgcaggtctgatgccatc

SEQ ID NO: 7919140 - DNA, 21 bp, Homo sapiens
gagtgcagcaaggtagagtct

SEQ ID NO: 7919141 - DNA, 21 bp, Homo sapiens
gagtgcagcaaggtagagtct

SEQ ID NO: 7919142 - DNA, 21 bp, Homo sapiens
gagtgcagcaaggtagagtct

SEQ ID NO: 7919143 - DNA, 21 bp, Homo sapiens
gagtgcagcaaggtagagtct

SEQ ID NO: 7919144 - DNA, 22 bp, Homo sapiens
gagtgcagatgccagccccagt

SEQ ID NO: 7919145 - DNA, 22 bp, Homo sapiens
gagtgcagatgccagccccagt

SEQ ID NO: 7919146 - DNA, 22 bp, Homo sapiens
gagtgcagatgccagccccagt

SEQ ID NO: 7919147 - DNA, 22 bp, Homo sapiens
gagtgcagatgccagccccagt

SEQ ID NO: 7919148 - DNA, 22 bp, Homo sapiens
gagtgcagatgccagccccagt

SEQ ID NO: 7919149 - DNA, 22 bp, Homo sapiens
gagtgcagatgaacagaagatt

SEQ ID NO: 7919150 - DNA, 17 bp, Homo sapiens
gagtgcagacacaagca

SEQ ID NO: 7919151 - DNA, 22 bp, Homo sapiens
gagtgcagatgaacagaagatt

SEQ ID NO: 7919152 - DNA, 23 bp, Homo sapiens
gagtgcagaatagacatgcagtg

SEQ ID NO: 7919153 - DNA, 17 bp, Homo sapiens
gagtgcagacacaagca

SEQ ID NO: 7919154 - DNA, 22 bp, Homo sapiens
atgtttcatttagatatcaggc

SEQ ID NO: 7919155 - DNA, 22 bp, Homo sapiens
atgtttccagatatgtcaccct

SEQ ID NO: 7919156 - DNA, 22 bp, Homo sapiens
atgtttccagatatgtcaccct

SEQ ID NO: 7919157 - DNA, 22 bp, Homo sapiens
atgtttccagatatgtcaccct

SEQ ID NO: 7919158 - DNA, 22 bp, Homo sapiens
gatctgggagcctcatggagac

SEQ ID NO: 7919159 - DNA, 22 bp, Homo sapiens
gatctgggagcctcatggagac

SEQ ID NO: 7919160 - DNA, 22 bp, Homo sapiens
gatctggaatctgaaggctgag

SEQ ID NO: 7919161 - DNA, 22 bp, Homo sapiens
atgtttccatcaaatttgatga

SEQ ID NO: 7919162 - DNA, 22 bp, Homo sapiens
atgtttccatagaagtcacagt

SEQ ID NO: 7919163 - DNA, 22 bp, Homo sapiens
atgtttccatagaagtcacagt

SEQ ID NO: 7919164 - DNA, 22 bp, Homo sapiens
atgtttccaggttcttcctatg

SEQ ID NO: 7919165 - DNA, 22 bp, Homo sapiens
atgtttccaggttcttcctatg

SEQ ID NO: 7919166 - DNA, 22 bp, Homo sapiens
atgtttccaggttcttcctatg

SEQ ID NO: 7919167 - DNA, 22 bp, Homo sapiens
atgtttccaggttcttcctatg

SEQ ID NO: 7919168 - DNA, 22 bp, Homo sapiens
atgtttccagctcagctgcagg

SEQ ID NO: 7919169 - DNA, 22 bp, Homo sapiens
atgtttcccttctgatttggga

SEQ ID NO: 7919170 - DNA, 22 bp, Homo sapiens
atgtttcccataagattttctg

SEQ ID NO: 7919171 - DNA, 22 bp, Homo sapiens
atgtttccgtgagcatccttga

SEQ ID NO: 7919172 - DNA, 22 bp, Homo sapiens
atgtttccgtgagcatccttga

SEQ ID NO: 7919173 - DNA, 22 bp, Homo sapiens
atgtttccgtgagcatccttga

SEQ ID NO: 7919174 - DNA, 22 bp, Homo sapiens
atgtttcctgttggattggccc

SEQ ID NO: 7919175 - DNA, 22 bp, Homo sapiens
atgtttccgtgagcatccttga

SEQ ID NO: 7919176 - DNA, 22 bp, Homo sapiens
atgtttccttatagataaaagc

SEQ ID NO: 7919177 - DNA, 22 bp, Homo sapiens
atgtttctaaaacttgcatggc

SEQ ID NO: 7919178 - DNA, 22 bp, Homo sapiens
atgtttccattttcttgtatca

SEQ ID NO: 7919179 - DNA, 22 bp, Homo sapiens
atgtttccattttcttgtatca

SEQ ID NO: 7919180 - DNA, 22 bp, Homo sapiens
atgtttccattttcttgtatca

SEQ ID NO: 7919181 - DNA, 22 bp, Homo sapiens
atgtttccatgttcaatttact

SEQ ID NO: 7919182 - DNA, 22 bp, Homo sapiens
atgtttcccataagattttctg

SEQ ID NO: 7919183 - DNA, 22 bp, Homo sapiens
atgtttcccagagcaaatctgg

SEQ ID NO: 7919184 - DNA, 22 bp, Homo sapiens
atgtttccattttcttgtatca

SEQ ID NO: 7919185 - DNA, 22 bp, Homo sapiens
atgtttccattttcttgtatca

SEQ ID NO: 7919186 - DNA, 22 bp, Homo sapiens
gatctgcactctgagaggcttg

SEQ ID NO: 7919187 - DNA, 22 bp, Homo sapiens
gatctgagatctaaaccagagg

SEQ ID NO: 7919188 - DNA, 22 bp, Homo sapiens
gatctgaatcaatagaataact

SEQ ID NO: 7919189 - DNA, 22 bp, Homo sapiens
gatctgagaaatccttggccag

SEQ ID NO: 7919190 - DNA, 22 bp, Homo sapiens
gatctgagatctaaaccagagg

SEQ ID NO: 7919191 - DNA, 22 bp, Homo sapiens
gatctgaatcaatagaataact

SEQ ID NO: 7919192 - DNA, 22 bp, Homo sapiens
gatctgaagatatgaaatattt

SEQ ID NO: 7919193 - DNA, 22 bp, Homo sapiens
gatctgaagatatgaaatattt

SEQ ID NO: 7919194 - DNA, 22 bp, Homo sapiens
gatctgaaatagctactgcaga

SEQ ID NO: 7919195 - DNA, 22 bp, Homo sapiens
gatctgaaatagctactgcaga

SEQ ID NO: 7919196 - DNA, 22 bp, Homo sapiens
gatctgaagagcaatgaaatat

SEQ ID NO: 7919197 - DNA, 22 bp, Homo sapiens
gatctcagagtaactgaggggc

SEQ ID NO: 7919198 - DNA, 22 bp, Homo sapiens
gatctcagacaggtggacaggg

SEQ ID NO: 7919199 - DNA, 22 bp, Homo sapiens
gatctcaaagcagtgtgggttg

SEQ ID NO: 7919200 - DNA, 22 bp, Homo sapiens
gatctcagacaggtggacaggg

SEQ ID NO: 7919201 - DNA, 22 bp, Homo sapiens
gatctagaccagaagctgttgt

SEQ ID NO: 7919202 - DNA, 22 bp, Homo sapiens
gatctagaccagaagctgttgt

SEQ ID NO: 7919203 - DNA, 21 bp, Homo sapiens
gatctagacttgggcccagta

SEQ ID NO: 7919204 - DNA, 21 bp, Homo sapiens
gatctagacttgggcccagta

SEQ ID NO: 7919205 - DNA, 21 bp, Homo sapiens
gatctagacttgggcccagta

SEQ ID NO: 7919206 - DNA, 22 bp, Homo sapiens
gatctatttactcttttcctag

SEQ ID NO: 7919207 - DNA, 22 bp, Homo sapiens
gatctagaccagaagctgttgt

SEQ ID NO: 7919208 - DNA, 22 bp, Homo sapiens
gatctctgggtcctgttggcct

SEQ ID NO: 7919209 - DNA, 21 bp, Homo sapiens
gatctctggaaggagaaagct

SEQ ID NO: 7919210 - DNA, 21 bp, Homo sapiens
gatctctggaatgactctggc

SEQ ID NO: 7919211 - DNA, 22 bp, Homo sapiens
gatcctggagctccatcactat

SEQ ID NO: 7919212 - DNA, 22 bp, Homo sapiens
gatcctgggactgaatgggtgc

SEQ ID NO: 7919213 - DNA, 22 bp, Homo sapiens
gatatttaactctcacaggtcc

SEQ ID NO: 7919214 - DNA, 22 bp, Homo sapiens
gagttatttgtagggattatat

SEQ ID NO: 7919215 - DNA, 22 bp, Homo sapiens
gatatttacaaatttgccaata

SEQ ID NO: 7919216 - DNA, 22 bp, Homo sapiens
gatatttacaaatttgccaata

SEQ ID NO: 7919217 - DNA, 22 bp, Homo sapiens
gagttattgggtggaaaggtag

SEQ ID NO: 7919218 - DNA, 22 bp, Homo sapiens
gagttatttcagaaggaaagat

SEQ ID NO: 7919219 - DNA, 22 bp, Homo sapiens
gagttatttgtagggattatat

SEQ ID NO: 7919220 - DNA, 22 bp, Homo sapiens
gatcctgttagatcccattaga

SEQ ID NO: 7919221 - DNA, 22 bp, Homo sapiens
gatcctgttataatttggatgt

SEQ ID NO: 7919222 - DNA, 22 bp, Homo sapiens
gatccttacagttagacgttgg

SEQ ID NO: 7919223 - DNA, 22 bp, Homo sapiens
gatcctgtggttttcctgtgca

SEQ ID NO: 7919224 - DNA, 22 bp, Homo sapiens
gatcctgttagaaatgtagact

SEQ ID NO: 7919225 - DNA, 22 bp, Homo sapiens
gatccttctcctttttcatgct

SEQ ID NO: 7919226 - DNA, 22 bp, Homo sapiens
gatccttatttggtcaagcttc

SEQ ID NO: 7919227 - DNA, 22 bp, Homo sapiens
gatccttatccttaaagatgct

SEQ ID NO: 7919228 - DNA, 22 bp, Homo sapiens
gatccttacagttttgactcat

SEQ ID NO: 7919229 - DNA, 22 bp, Homo sapiens
gatccttatccttaaagatgct

SEQ ID NO: 7919230 - DNA, 22 bp, Homo sapiens
gatcctgtctccgcaccgtgtt

SEQ ID NO: 7919231 - DNA, 22 bp, Homo sapiens
gatcctgtctgtggagtcagca

SEQ ID NO: 7919232 - DNA, 22 bp, Homo sapiens
gatcctgtgcatggggtgatgg

SEQ ID NO: 7919233 - DNA, 22 bp, Homo sapiens
gatcctgggactgaatgggtgc

SEQ ID NO: 7919234 - DNA, 22 bp, Homo sapiens
gatcctgtcccaagagtgacag

SEQ ID NO: 7919235 - DNA, 22 bp, Homo sapiens
gatctagaaggcaaatatagtg

SEQ ID NO: 7919236 - DNA, 22 bp, Homo sapiens
gatctagaaggcaaatatagtg

SEQ ID NO: 7919237 - DNA, 22 bp, Homo sapiens
gatctagaaggcaaatatagtg

SEQ ID NO: 7919238 - DNA, 18 bp, Homo sapiens
gatcgggggcgccccaag

SEQ ID NO: 7919239 - DNA, 22 bp, Homo sapiens
gatcctttggtttctgatttag

SEQ ID NO: 7919240 - DNA, 18 bp, Homo sapiens
gatcgggggcgccccaag

SEQ ID NO: 7919241 - DNA, 22 bp, Homo sapiens
gatcctttggtttctgatttag

SEQ ID NO: 7919242 - DNA, 22 bp, Homo sapiens
gatccttattattgcccattta

SEQ ID NO: 7919243 - DNA, 22 bp, Homo sapiens
gatccttatttggtcaagcttc

SEQ ID NO: 7919244 - DNA, 22 bp, Homo sapiens
gagttagaagacagaatgtaaa

SEQ ID NO: 7919245 - DNA, 22 bp, Homo sapiens
gagttagagccatagagcacgg

SEQ ID NO: 7919246 - DNA, 22 bp, Homo sapiens
gagttactgggtggaaggcact

SEQ ID NO: 7919247 - DNA, 22 bp, Homo sapiens
gagttacatggacattctctcc

SEQ ID NO: 7919248 - DNA, 22 bp, Homo sapiens
gagttacagagaggattatggt

SEQ ID NO: 7919249 - DNA, 22 bp, Homo sapiens
gagttacatggacattctctcc

SEQ ID NO: 7919250 - DNA, 22 bp, Homo sapiens
gagttacatttggtgacacttc

SEQ ID NO: 7919251 - DNA, 22 bp, Homo sapiens
gagttaattcgaatattctagc

SEQ ID NO: 7919252 - DNA, 22 bp, Homo sapiens
gagttaatactgagtttattaa

SEQ ID NO: 7919253 - DNA, 22 bp, Homo sapiens
gagttacacaaaatttctattt

SEQ ID NO: 7919254 - DNA, 22 bp, Homo sapiens
gagttatagatggactattatt

SEQ ID NO: 7919255 - DNA, 22 bp, Homo sapiens
gagttatagatggactattatt

SEQ ID NO: 7919256 - DNA, 22 bp, Homo sapiens
gagttatatcctgagtcatatt

SEQ ID NO: 7919257 - DNA, 22 bp, Homo sapiens
gagttatagatggactattatt

SEQ ID NO: 7919258 - DNA, 22 bp, Homo sapiens
gagttatatcctgagtcatatt

SEQ ID NO: 7919259 - DNA, 22 bp, Homo sapiens
gagttataacctagtttaactg

SEQ ID NO: 7919260 - DNA, 22 bp, Homo sapiens
gagttagcgtgacaccctcgct

SEQ ID NO: 7919261 - DNA, 22 bp, Homo sapiens
gagttagctgtgagtctcatat

SEQ ID NO: 7919262 - DNA, 22 bp, Homo sapiens
gagttagcaaagggtggcaggg

SEQ ID NO: 7919263 - DNA, 22 bp, Homo sapiens
gagttattctaggtcctttgta

SEQ ID NO: 7919264 - DNA, 22 bp, Homo sapiens
gagttattctaggtcctttgta

SEQ ID NO: 7919265 - DNA, 19 bp, Homo sapiens
gagttattgccagggcatg

SEQ ID NO: 7919266 - DNA, 22 bp, Homo sapiens
gagttattgagtatagaatgta

SEQ ID NO: 7919267 - DNA, 22 bp, Homo sapiens
gagttatatttgcgatattgga

SEQ ID NO: 7919268 - DNA, 22 bp, Homo sapiens
gagttatatcctgagtcatatt

SEQ ID NO: 7919269 - DNA, 22 bp, Homo sapiens
gagttatatttgcgatattgga

SEQ ID NO: 7919270 - DNA, 22 bp, Homo sapiens
gagttattaatggctgagtttg

SEQ ID NO: 7919271 - DNA, 22 bp, Homo sapiens
gagttattaatggctgagtttg

SEQ ID NO: 7919272 - DNA, 23 bp, Homo sapiens
gaggtacagcaccagtgaatagg

SEQ ID NO: 7919273 - DNA, 22 bp, Homo sapiens
gaggtacagagtgttccaatgt

SEQ ID NO: 7919274 - DNA, 22 bp, Homo sapiens
gaggtaagggcaggagagtgaa

SEQ ID NO: 7919275 - DNA, 22 bp, Homo sapiens
gaggggtcacatgggctggctt

SEQ ID NO: 7919276 - DNA, 22 bp, Homo sapiens
gaggtaagggcaggagagtgaa

SEQ ID NO: 7919277 - DNA, 22 bp, Homo sapiens
gaggtaagggcaggagagtgaa

SEQ ID NO: 7919278 - DNA, 22 bp, Homo sapiens
gaggggtcacatgggctggctt

SEQ ID NO: 7919279 - DNA, 22 bp, Homo sapiens
gaggtacatgaggatacacagg

SEQ ID NO: 7919280 - DNA, 18 bp, Homo sapiens
gaggtagataagattttc

SEQ ID NO: 7919281 - DNA, 18 bp, Homo sapiens
gaggtagataagattttc

SEQ ID NO: 7919282 - DNA, 22 bp, Homo sapiens
gaggtagacttcttggaagtag

SEQ ID NO: 7919283 - DNA, 22 bp, Homo sapiens
gaggtagacttcttggaagtag

SEQ ID NO: 7919284 - DNA, 17 bp, Homo sapiens
gaggtaggaagtgagtc

SEQ ID NO: 7919285 - DNA, 17 bp, Homo sapiens
gaggtaggaagtgagtc

SEQ ID NO: 7919286 - DNA, 22 bp, Homo sapiens
gaggtagcgagtggacagtgca

SEQ ID NO: 7919287 - DNA, 22 bp, Homo sapiens
gaggtagcgagtggacagtgca

SEQ ID NO: 7919288 - DNA, 22 bp, Homo sapiens
gaggtagccacagatagagact

SEQ ID NO: 7919289 - DNA, 22 bp, Homo sapiens
gaggtagcatgctggaagggac

SEQ ID NO: 7919290 - DNA, 22 bp, Homo sapiens
gaggtagcgagtggacagtgca

SEQ ID NO: 7919291 - DNA, 22 bp, Homo sapiens
gaggtaggaggtaggtattgtg

SEQ ID NO: 7919292 - DNA, 22 bp, Homo sapiens
gaggtaggaggtaggtattgtg

SEQ ID NO: 7919293 - DNA, 22 bp, Homo sapiens
gaggtaggctgtgaaagggggt

SEQ ID NO: 7919294 - DNA, 17 bp, Homo sapiens
gaggtaggaagtgagtc

SEQ ID NO: 7919295 - DNA, 22 bp, Homo sapiens
gagtccaggatttgagctctgt

SEQ ID NO: 7919296 - DNA, 22 bp, Homo sapiens
gagtccaggatttgagctctgt

SEQ ID NO: 7919297 - DNA, 22 bp, Homo sapiens
gagtccagctctgcctcttact

SEQ ID NO: 7919298 - DNA, 22 bp, Homo sapiens
gagtccaggatttgagctctgt

SEQ ID NO: 7919299 - DNA, 22 bp, Homo sapiens
gagtccaggatttgagctctgt

SEQ ID NO: 7919300 - DNA, 22 bp, Homo sapiens
gagtccaggatttgagctctgt

SEQ ID NO: 7919301 - DNA, 22 bp, Homo sapiens
gagtccaggatttgagctctgt

SEQ ID NO: 7919302 - DNA, 22 bp, Homo sapiens
gagtccaggatttgagctctgt

SEQ ID NO: 7919303 - DNA, 22 bp, Homo sapiens
gagtccaggctgttgctcatct

SEQ ID NO: 7919304 - DNA, 22 bp, Homo sapiens
gagtccaggctggtcaaatagc

SEQ ID NO: 7919305 - DNA, 22 bp, Homo sapiens
gagtccaggctggtcaaatagc

SEQ ID NO: 7919306 - DNA, 18 bp, Homo sapiens
gagtccaggctcttcacc

SEQ ID NO: 7919307 - DNA, 22 bp, Homo sapiens
gagtccaggctcagaaacccgt

SEQ ID NO: 7919308 - DNA, 22 bp, Homo sapiens
gagtccaggcatccctcccata

SEQ ID NO: 7919309 - DNA, 22 bp, Homo sapiens
gagtccaggctcagaaacccgt

SEQ ID NO: 7919310 - DNA, 22 bp, Homo sapiens
gagtccaggctcagaaacccgt

SEQ ID NO: 7919311 - DNA, 22 bp, Homo sapiens
gagtccaggcatccctcccata

SEQ ID NO: 7919312 - DNA, 22 bp, Homo sapiens
gaggtagggcagaggctgaatg

SEQ ID NO: 7919313 - DNA, 22 bp, Homo sapiens
gaggttggggctgcagtgagct

SEQ ID NO: 7919314 - DNA, 22 bp, Homo sapiens
gagtccagcagaatgagccaag

SEQ ID NO: 7919315 - DNA, 22 bp, Homo sapiens
gaggttggggctgcagtgagct

SEQ ID NO: 7919316 - DNA, 22 bp, Homo sapiens
gaggttggtgaggggacacggt

SEQ ID NO: 7919317 - DNA, 22 bp, Homo sapiens
gagtccagctcattgtctggga

SEQ ID NO: 7919318 - DNA, 22 bp, Homo sapiens
gagtccagccctgttctagtaa

SEQ ID NO: 7919319 - DNA, 22 bp, Homo sapiens
gagtccagccctgttctagtaa

SEQ ID NO: 7919320 - DNA, 22 bp, Homo sapiens
gagtccagcagaatgagccaag

SEQ ID NO: 7919321 - DNA, 22 bp, Homo sapiens
gagtccagctcattgtctggga

SEQ ID NO: 7919322 - DNA, 22 bp, Homo sapiens
gagtccagctcattgtctggga

SEQ ID NO: 7919323 - DNA, 22 bp, Homo sapiens
gagggggctctgccaacctgtc

SEQ ID NO: 7919324 - DNA, 22 bp, Homo sapiens
gagggggctctgccaacctgtc

SEQ ID NO: 7919325 - DNA, 22 bp, Homo sapiens
gagggggctctgccaacctgtc

SEQ ID NO: 7919326 - DNA, 22 bp, Homo sapiens
gaggggggcgccctgcagtgca

SEQ ID NO: 7919327 - DNA, 22 bp, Homo sapiens
gaggggggcgccctgcagtgca

SEQ ID NO: 7919328 - DNA, 22 bp, Homo sapiens
gagggggctctgccaacctgtc

SEQ ID NO: 7919329 - DNA, 22 bp, Homo sapiens
gaggggggcgccctgcagtgca

SEQ ID NO: 7919330 - DNA, 22 bp, Homo sapiens
gaggggggcgccctgcagtgca

SEQ ID NO: 7919331 - DNA, 22 bp, Homo sapiens
gaggggggcgccctgcagtgca

SEQ ID NO: 7919332 - DNA, 22 bp, Homo sapiens
gagggggtctatgaggtagagc

SEQ ID NO: 7919333 - DNA, 22 bp, Homo sapiens
gagggggtctatgaggtagagc

SEQ ID NO: 7919334 - DNA, 22 bp, Homo sapiens
gagggggtctatgaggtagagc

SEQ ID NO: 7919335 - DNA, 22 bp, Homo sapiens
gagggggtctatgaggtagagc

SEQ ID NO: 7919336 - DNA, 22 bp, Homo sapiens
gagggggtctatgaggtagagc

SEQ ID NO: 7919337 - DNA, 22 bp, Homo sapiens
gagggggtctatgaggtagagc

SEQ ID NO: 7919338 - DNA, 22 bp, Homo sapiens
gagggggctagcgcagtgccca

SEQ ID NO: 7919339 - DNA, 22 bp, Homo sapiens
gagggggctagcgcagtgccca

SEQ ID NO: 7919340 - DNA, 22 bp, Homo sapiens
gagggggctagcgcagtgccca

SEQ ID NO: 7919341 - DNA, 22 bp, Homo sapiens
gagggggcgtgcaaggctccgc

SEQ ID NO: 7919342 - DNA, 22 bp, Homo sapiens
gagggggctagcgcagtgccca

SEQ ID NO: 7919343 - DNA, 22 bp, Homo sapiens
gagggggctagcgcagtgccca

SEQ ID NO: 7919344 - DNA, 22 bp, Homo sapiens
gagggggctccctgaagccagt

SEQ ID NO: 7919345 - DNA, 22 bp, Homo sapiens
gagggggctccctgaagccagt

SEQ ID NO: 7919346 - DNA, 22 bp, Homo sapiens
gagggggctccctgaagccagt

SEQ ID NO: 7919347 - DNA, 22 bp, Homo sapiens
gagggggctccctgaagccagt

SEQ ID NO: 7919348 - DNA, 22 bp, Homo sapiens
gagggggctccctgaagccagt

SEQ ID NO: 7919349 - DNA, 22 bp, Homo sapiens
gagggggctccctgaagccagt

SEQ ID NO: 7919350 - DNA, 22 bp, Homo sapiens
gagggggctccctgaagccagt

SEQ ID NO: 7919351 - DNA, 22 bp, Homo sapiens
gagggggcgtgcaaggctccgc

SEQ ID NO: 7919352 - DNA, 22 bp, Homo sapiens
gagggggcgtgcaaggctccgc

SEQ ID NO: 7919353 - DNA, 22 bp, Homo sapiens
gagggggcgtgcaaggctccgc

SEQ ID NO: 7919354 - DNA, 22 bp, Homo sapiens
gagggggcgtgcaaggctccgc

SEQ ID NO: 7919355 - DNA, 22 bp, Homo sapiens
gagggggcgtgcaaggctccgc

SEQ ID NO: 7919356 - DNA, 22 bp, Homo sapiens
gagggggcgtgcaaggctccgc

SEQ ID NO: 7919357 - DNA, 19 bp, Homo sapiens
gaggggaggaattgacaag

SEQ ID NO: 7919358 - DNA, 22 bp, Homo sapiens
gagggggcgaacagaagcaagg

SEQ ID NO: 7919359 - DNA, 19 bp, Homo sapiens
gaggggaggaattgacaag

SEQ ID NO: 7919360 - DNA, 19 bp, Homo sapiens
gaggggaggaattgacaag

SEQ ID NO: 7919361 - DNA, 19 bp, Homo sapiens
gaggggaggaattgacaag

SEQ ID NO: 7919362 - DNA, 22 bp, Homo sapiens
gagggcagaaaattatgcggtg

SEQ ID NO: 7919363 - DNA, 22 bp, Homo sapiens
gagggcagaaaattatgcggtg

SEQ ID NO: 7919364 - DNA, 22 bp, Homo sapiens
gagggcagaaaattatgcggtg

SEQ ID NO: 7919365 - DNA, 22 bp, Homo sapiens
gagggcagaaaattatgcggtg

SEQ ID NO: 7919366 - DNA, 22 bp, Homo sapiens
gagggcactgggtttcaatgtc

SEQ ID NO: 7919367 - DNA, 22 bp, Homo sapiens
gagggcactcgagactacggca

SEQ ID NO: 7919368 - DNA, 22 bp, Homo sapiens
gagggcactcgagactacggca

SEQ ID NO: 7919369 - DNA, 22 bp, Homo sapiens
gagggcactcgagactacggca

SEQ ID NO: 7919370 - DNA, 22 bp, Homo sapiens
gagggcagaaaattatgcggtg

SEQ ID NO: 7919371 - DNA, 22 bp, Homo sapiens
gagggcaccagaagagccagat

SEQ ID NO: 7919372 - DNA, 22 bp, Homo sapiens
gagggcaccagaagagccagat

SEQ ID NO: 7919373 - DNA, 22 bp, Homo sapiens
gagggcaccagaagagccagat

SEQ ID NO: 7919374 - DNA, 22 bp, Homo sapiens
gagggcaccagaagagccagat

SEQ ID NO: 7919375 - DNA, 20 bp, Homo sapiens
gagggcacattgttccgtgc

SEQ ID NO: 7919376 - DNA, 20 bp, Homo sapiens
gagggcacattgttccgtgc

SEQ ID NO: 7919377 - DNA, 22 bp, Homo sapiens
gagggcaccttcagtaatagct

SEQ ID NO: 7919378 - DNA, 22 bp, Homo sapiens
gagggcaccttcagtaatagct

SEQ ID NO: 7919379 - DNA, 22 bp, Homo sapiens
gagggcaccagaagagccagat

SEQ ID NO: 7919380 - DNA, 22 bp, Homo sapiens
gagggcacgaaacaaccacttc

SEQ ID NO: 7919381 - DNA, 22 bp, Homo sapiens
gagggatggtgtgagaggctca

SEQ ID NO: 7919382 - DNA, 22 bp, Homo sapiens
gagggatgtcaggggaccttgg

SEQ ID NO: 7919383 - DNA, 22 bp, Homo sapiens
gagggatgtcaggggaccttgg

SEQ ID NO: 7919384 - DNA, 22 bp, Homo sapiens
gagggatgtcaggggaccttgg

SEQ ID NO: 7919385 - DNA, 22 bp, Homo sapiens
gagggatgtgcctgaaggcagg

SEQ ID NO: 7919386 - DNA, 22 bp, Homo sapiens
gagggatgtgcctgaaggcagg

SEQ ID NO: 7919387 - DNA, 22 bp, Homo sapiens
gagggatgtgcctgaaggcagg

SEQ ID NO: 7919388 - DNA, 22 bp, Homo sapiens
gagggatgtgcctgaaggcagg

SEQ ID NO: 7919389 - DNA, 22 bp, Homo sapiens
gagggatgtgcctgaaggcagg

SEQ ID NO: 7919390 - DNA, 22 bp, Homo sapiens
gagggcaaaacagagaagatgt

SEQ ID NO: 7919391 - DNA, 22 bp, Homo sapiens
gagggaagaaagaattgatgcg

SEQ ID NO: 7919392 - DNA, 22 bp, Homo sapiens
gagggatggtgtgagaggctca

SEQ ID NO: 7919393 - DNA, 22 bp, Homo sapiens
gagggaagaaagaattgatgcg

SEQ ID NO: 7919394 - DNA, 22 bp, Homo sapiens
gagggatggtgtgagaggctca

SEQ ID NO: 7919395 - DNA, 22 bp, Homo sapiens
gagggatggtgtgagaggctca

SEQ ID NO: 7919396 - DNA, 22 bp, Homo sapiens
gagggatggtgtgagaggctca

SEQ ID NO: 7919397 - DNA, 22 bp, Homo sapiens
gagggatggtagttgacactga

SEQ ID NO: 7919398 - DNA, 22 bp, Homo sapiens
gagggatggtgtgagaggctca

SEQ ID NO: 7919399 - DNA, 22 bp, Homo sapiens
gagggatggtgtgagaggctca

SEQ ID NO: 7919400 - DNA, 22 bp, Homo sapiens
gagggaagaaagaattgatgcg

SEQ ID NO: 7919401 - DNA, 22 bp, Homo sapiens
gagggaagaaagaattgatgcg

SEQ ID NO: 7919402 - DNA, 22 bp, Homo sapiens
gagggaagaaagaattgatgcg

SEQ ID NO: 7919403 - DNA, 22 bp, Homo sapiens
gagggaagaaagaattgatgcg

SEQ ID NO: 7919404 - DNA, 22 bp, Homo sapiens
gagggaaaggttaatacatgat

SEQ ID NO: 7919405 - DNA, 22 bp, Homo sapiens
gagggaaaggttaatacatgat

SEQ ID NO: 7919406 - DNA, 22 bp, Homo sapiens
gagggaaacagatgggttgtgg

SEQ ID NO: 7919407 - DNA, 22 bp, Homo sapiens
gagggaaaataaaattgcagta

SEQ ID NO: 7919408 - DNA, 22 bp, Homo sapiens
gagggaaaataaaattgcagta

SEQ ID NO: 7919409 - DNA, 22 bp, Homo sapiens
gagggaaacagatgggttgtgg

SEQ ID NO: 7919410 - DNA, 22 bp, Homo sapiens
gaggcttttcttcaggtatcaa

SEQ ID NO: 7919411 - DNA, 22 bp, Homo sapiens
gaggcttttctctaaatagtgg

SEQ ID NO: 7919412 - DNA, 22 bp, Homo sapiens
gaggcttttcttcaggtatcaa

SEQ ID NO: 7919413 - DNA, 22 bp, Homo sapiens
gaggcttttctctaaatagtgg

SEQ ID NO: 7919414 - DNA, 22 bp, Homo sapiens
gaggcttttagtatggggactg

SEQ ID NO: 7919415 - DNA, 22 bp, Homo sapiens
gaggcttttggctaataactgt

SEQ ID NO: 7919416 - DNA, 22 bp, Homo sapiens
gagggaaaataaaattgcagta

SEQ ID NO: 7919417 - DNA, 22 bp, Homo sapiens
gaggcttttggctaataactgt

SEQ ID NO: 7919418 - DNA, 22 bp, Homo sapiens
gaggctttgaatgcacggttca

SEQ ID NO: 7919419 - DNA, 22 bp, Homo sapiens
gaggctttcacaaggttagttc

SEQ ID NO: 7919420 - DNA, 22 bp, Homo sapiens
gaggctttgaatgcacggttca

SEQ ID NO: 7919421 - DNA, 22 bp, Homo sapiens
gaggctttggttataaaagatc

SEQ ID NO: 7919422 - DNA, 22 bp, Homo sapiens
gaggctttggttataaaagatc

SEQ ID NO: 7919423 - DNA, 22 bp, Homo sapiens
gaggcttttagtatggggactg

SEQ ID NO: 7919424 - DNA, 22 bp, Homo sapiens
gaggctttataactatttgttc

SEQ ID NO: 7919425 - DNA, 22 bp, Homo sapiens
gaggctttacctagtaaagtgg

SEQ ID NO: 7919426 - DNA, 22 bp, Homo sapiens
gaggctttcacaaggttagttc

SEQ ID NO: 7919427 - DNA, 22 bp, Homo sapiens
gaggctttacctagtaaagtgg

SEQ ID NO: 7919428 - DNA, 22 bp, Homo sapiens
gaggctttataactatttgttc

SEQ ID NO: 7919429 - DNA, 22 bp, Homo sapiens
gaggctttataactatttgttc

SEQ ID NO: 7919430 - DNA, 22 bp, Homo sapiens
gaggctgttagggcctgaggta

SEQ ID NO: 7919431 - DNA, 22 bp, Homo sapiens
gaggctgttcagtgtccagctt

SEQ ID NO: 7919432 - DNA, 22 bp, Homo sapiens
gaggctgttggctgatctgagt

SEQ ID NO: 7919433 - DNA, 22 bp, Homo sapiens
gaggctgtttgtggcagtgatg

SEQ ID NO: 7919434 - DNA, 22 bp, Homo sapiens
gaggctgtttgtggcagtgatg

SEQ ID NO: 7919435 - DNA, 22 bp, Homo sapiens
gaggctgtttgtggcagtgatg

SEQ ID NO: 7919436 - DNA, 22 bp, Homo sapiens
gaggcttcccgcccatgctgga

SEQ ID NO: 7919437 - DNA, 22 bp, Homo sapiens
gaggcttcccgcccatgctgga

SEQ ID NO: 7919438 - DNA, 22 bp, Homo sapiens
gaggcttctgtaaccctgtcct

SEQ ID NO: 7919439 - DNA, 22 bp, Homo sapiens
gaggcttctggaaagcctggca

SEQ ID NO: 7919440 - DNA, 22 bp, Homo sapiens
gaggcttcccgcccatgctgga

SEQ ID NO: 7919441 - DNA, 22 bp, Homo sapiens
gaggcttctgtaaccctgtcct

SEQ ID NO: 7919442 - DNA, 22 bp, Homo sapiens
gaggcttgcaccatgagcacca

SEQ ID NO: 7919443 - DNA, 22 bp, Homo sapiens
gaggcttgcaccatgagcacca

SEQ ID NO: 7919444 - DNA, 23 bp, Homo sapiens
gaggccacattcccctgcttgag

SEQ ID NO: 7919445 - DNA, 23 bp, Homo sapiens
gaggccacattcccctgcttgag

SEQ ID NO: 7919446 - DNA, 22 bp, Homo sapiens
gaggctgttaggagggactctg

SEQ ID NO: 7919447 - DNA, 22 bp, Homo sapiens
gaggctgttaggagggactctg

SEQ ID NO: 7919448 - DNA, 22 bp, Homo sapiens
gaggctgtgtcttggggtggaa

SEQ ID NO: 7919449 - DNA, 22 bp, Homo sapiens
gaggccacagtcctgaggcatc

SEQ ID NO: 7919450 - DNA, 22 bp, Homo sapiens
gaggccacagtcctgaggcatc

SEQ ID NO: 7919451 - DNA, 22 bp, Homo sapiens
gaggccacagtcagtgttcatc

SEQ ID NO: 7919452 - DNA, 22 bp, Homo sapiens
gaggccacagtgtctgggggcc

SEQ ID NO: 7919453 - DNA, 22 bp, Homo sapiens
gaggccacagtcctgaggcatc

SEQ ID NO: 7919454 - DNA, 22 bp, Homo sapiens
gaggccacagtcctgaggcatc

SEQ ID NO: 7919455 - DNA, 22 bp, Homo sapiens
gaggccacattacttggtgggt

SEQ ID NO: 7919456 - DNA, 23 bp, Homo sapiens
gaggccacattcccctgcttgag

SEQ ID NO: 7919457 - DNA, 22 bp, Homo sapiens
atgtcacatctgggatggccct

SEQ ID NO: 7919458 - DNA, 22 bp, Homo sapiens
atgtcacatggtcacctctagc

SEQ ID NO: 7919459 - DNA, 22 bp, Homo sapiens
atgtcacattggagctgctgga

SEQ ID NO: 7919460 - DNA, 22 bp, Homo sapiens
atgtcacattggagctgctgga

SEQ ID NO: 7919461 - DNA, 22 bp, Homo sapiens
gaggcattaaagggaatcttct

SEQ ID NO: 7919462 - DNA, 22 bp, Homo sapiens
atgtcacattggagctgctgga

SEQ ID NO: 7919463 - DNA, 22 bp, Homo sapiens
gaggccacagctatcagggaca

SEQ ID NO: 7919464 - DNA, 22 bp, Homo sapiens
gaggccaatgaagtgagtttaa

SEQ ID NO: 7919465 - DNA, 22 bp, Homo sapiens
gaggccaatcaatagggcaata

SEQ ID NO: 7919466 - DNA, 22 bp, Homo sapiens
gaggccaatcaatagggcaata

SEQ ID NO: 7919467 - DNA, 22 bp, Homo sapiens
gaggccaaggtgggcagatcac

SEQ ID NO: 7919468 - DNA, 22 bp, Homo sapiens
gaggccaagttggagaccaggt

SEQ ID NO: 7919469 - DNA, 22 bp, Homo sapiens
gaggccaagttggagaccaggt

SEQ ID NO: 7919470 - DNA, 22 bp, Homo sapiens
gaggccaactttggagaacagg

SEQ ID NO: 7919471 - DNA, 17 bp, Homo sapiens
gaggccaaggcaggcgg

SEQ ID NO: 7919472 - DNA, 22 bp, Homo sapiens
gaggccaaggtgggcagatcac

SEQ ID NO: 7919473 - DNA, 17 bp, Homo sapiens
gaggccaaggcaggcgg

SEQ ID NO: 7919474 - DNA, 22 bp, Homo sapiens
gaggccaaggtgggcagatcac

SEQ ID NO: 7919475 - DNA, 17 bp, Homo sapiens
gaggccaaggcaggcgg

SEQ ID NO: 7919476 - DNA, 22 bp, Homo sapiens
gaggccaagggagaagatctct

SEQ ID NO: 7919477 - DNA, 22 bp, Homo sapiens
gcctggctcctaaggactggct

SEQ ID NO: 7919478 - DNA, 22 bp, Homo sapiens
gcctggctcctaaggactggct

SEQ ID NO: 7919479 - DNA, 22 bp, Homo sapiens
gcctggctcctaaggactggct

SEQ ID NO: 7919480 - DNA, 22 bp, Homo sapiens
gcctggctcctaaggactggct

SEQ ID NO: 7919481 - DNA, 22 bp, Homo sapiens
gcctggctcctaagagcacaac

SEQ ID NO: 7919482 - DNA, 22 bp, Homo sapiens
gcctggctcctaagagcacaac

SEQ ID NO: 7919483 - DNA, 22 bp, Homo sapiens
gcctggctcctaaggactggct

SEQ ID NO: 7919484 - DNA, 22 bp, Homo sapiens
gcctggctcgggcactcgccag

SEQ ID NO: 7919485 - DNA, 21 bp, Homo sapiens
gcctggctctcactggcctgg

SEQ ID NO: 7919486 - DNA, 21 bp, Homo sapiens
gcctggctctcactggcctgg

SEQ ID NO: 7919487 - DNA, 21 bp, Homo sapiens
gcctggctctcactggcctgg

SEQ ID NO: 7919488 - DNA, 22 bp, Homo sapiens
gcctggctcgggcactcgccag

SEQ ID NO: 7919489 - DNA, 22 bp, Homo sapiens
gcctggctcctaaggactggct

SEQ ID NO: 7919490 - DNA, 22 bp, Homo sapiens
gcgccccatctacagtactttt

SEQ ID NO: 7919491 - DNA, 22 bp, Homo sapiens
gcctggctctgagtttctctcc

SEQ ID NO: 7919492 - DNA, 22 bp, Homo sapiens
gcgcaggagccgcggagggccg

SEQ ID NO: 7919493 - DNA, 22 bp, Homo sapiens
gcctggctctgagtttctctcc

SEQ ID NO: 7919494 - DNA, 22 bp, Homo sapiens
gcctggctctgagtttctctcc

SEQ ID NO: 7919495 - DNA, 22 bp, Homo sapiens
gcctggctctgagggagctcct

SEQ ID NO: 7919496 - DNA, 22 bp, Homo sapiens
gcctggctctgagggagctcct

SEQ ID NO: 7919497 - DNA, 22 bp, Homo sapiens
gcctggctctgagggagctcct

SEQ ID NO: 7919498 - DNA, 22 bp, Homo sapiens
gcctggctctgagggagctcct

SEQ ID NO: 7919499 - DNA, 22 bp, Homo sapiens
gcctggctctgagggagctcct

SEQ ID NO: 7919500 - DNA, 21 bp, Homo sapiens
gcctggctctcactggcctgg

SEQ ID NO: 7919501 - DNA, 21 bp, Homo sapiens
gcctggctctcactggcctgg

SEQ ID NO: 7919502 - DNA, 22 bp, Homo sapiens
gctaacattgattcagtgcctg

SEQ ID NO: 7919503 - DNA, 22 bp, Homo sapiens
gctaacagcaggttccgggctc

SEQ ID NO: 7919504 - DNA, 22 bp, Homo sapiens
gctaacattgattcagtgcctg

SEQ ID NO: 7919505 - DNA, 22 bp, Homo sapiens
gctaaatctcctacaatgcaca

SEQ ID NO: 7919506 - DNA, 22 bp, Homo sapiens
gctaaataatcttcttctgaca

SEQ ID NO: 7919507 - DNA, 22 bp, Homo sapiens
gctaagggaggcatgccgtggt

SEQ ID NO: 7919508 - DNA, 22 bp, Homo sapiens
gctaagggaccctttctaatgt

SEQ ID NO: 7919509 - DNA, 22 bp, Homo sapiens
gctaaggccttaactcatggag

SEQ ID NO: 7919510 - DNA, 22 bp, Homo sapiens
gctaaggccttaactcatggag

SEQ ID NO: 7919511 - DNA, 22 bp, Homo sapiens
gctaaggagggtcttgcaaatt

SEQ ID NO: 7919512 - DNA, 22 bp, Homo sapiens
gctaagaggagcctccttctga

SEQ ID NO: 7919513 - DNA, 22 bp, Homo sapiens
gctaagaggctatatctttctc

SEQ ID NO: 7919514 - DNA, 22 bp, Homo sapiens
gctaagaattctgagcagctga

SEQ ID NO: 7919515 - DNA, 22 bp, Homo sapiens
gcgttggggaccccgaagctgg

SEQ ID NO: 7919516 - DNA, 22 bp, Homo sapiens
gcgttggggaccccgaagctgg

SEQ ID NO: 7919517 - DNA, 22 bp, Homo sapiens
gcgtgtaaattagacattcagc

SEQ ID NO: 7919518 - DNA, 22 bp, Homo sapiens
gcgtgtttgcccagtgagtggc

SEQ ID NO: 7919519 - DNA, 22 bp, Homo sapiens
gcgtgtgtgatatgcctctgca

SEQ ID NO: 7919520 - DNA, 22 bp, Homo sapiens
gcgtggggtaggtagacatgga

SEQ ID NO: 7919521 - DNA, 22 bp, Homo sapiens
gcgtggggtaggtagacatgga

SEQ ID NO: 7919522 - DNA, 22 bp, Homo sapiens
gcgtgtatgcaggtctgtgcag

SEQ ID NO: 7919523 - DNA, 22 bp, Homo sapiens
gcgtggtgctgccctgcacaca

SEQ ID NO: 7919524 - DNA, 22 bp, Homo sapiens
gcgtggtgctgccctgcacaca

SEQ ID NO: 7919525 - DNA, 22 bp, Homo sapiens
gctcaaagaatattcagaatga

SEQ ID NO: 7919526 - DNA, 22 bp, Homo sapiens
gctcaaagaccagacagaggag

SEQ ID NO: 7919527 - DNA, 22 bp, Homo sapiens
gctatttttgagccatttataa

SEQ ID NO: 7919528 - DNA, 22 bp, Homo sapiens
gctatttttgagccatttataa

SEQ ID NO: 7919529 - DNA, 22 bp, Homo sapiens
gctatttttgagccatttataa

SEQ ID NO: 7919530 - DNA, 22 bp, Homo sapiens
gctatttctttaaattgatctc

SEQ ID NO: 7919531 - DNA, 22 bp, Homo sapiens
gctatttattaaaatggtgaag

SEQ ID NO: 7919532 - DNA, 22 bp, Homo sapiens
gctatttattaaaatggtgaag

SEQ ID NO: 7919533 - DNA, 21 bp, Homo sapiens
gctcaaagggcttgccatgct

SEQ ID NO: 7919534 - DNA, 22 bp, Homo sapiens
gctcaaagcataagacatctaa

SEQ ID NO: 7919535 - DNA, 22 bp, Homo sapiens
gctcaaaggccaggtagcagca

SEQ ID NO: 7919536 - DNA, 22 bp, Homo sapiens
gctcagggctaaggctgagggg

SEQ ID NO: 7919537 - DNA, 22 bp, Homo sapiens
gctcagggctaaggctgagggg

SEQ ID NO: 7919538 - DNA, 22 bp, Homo sapiens
gctcagggctaaggctgagggg

SEQ ID NO: 7919539 - DNA, 22 bp, Homo sapiens
gctcagggctaaggctgagggg

SEQ ID NO: 7919540 - DNA, 22 bp, Homo sapiens
gctcagggctaaggctgagggg

SEQ ID NO: 7919541 - DNA, 23 bp, Homo sapiens
gctcaggcatcattcttcctggc

SEQ ID NO: 7919542 - DNA, 23 bp, Homo sapiens
gctcaggcatcattcttcctggc

SEQ ID NO: 7919543 - DNA, 23 bp, Homo sapiens
gctcaggcatcattcttcctggc

SEQ ID NO: 7919544 - DNA, 22 bp, Homo sapiens
gctatgggatgtgctgtggatg

SEQ ID NO: 7919545 - DNA, 22 bp, Homo sapiens
gctatgcaggagcctaatgaca

SEQ ID NO: 7919546 - DNA, 22 bp, Homo sapiens
gctacagactgagcatggctct

SEQ ID NO: 7919547 - DNA, 22 bp, Homo sapiens
gctattgtgacagcttttcgcc

SEQ ID NO: 7919548 - DNA, 22 bp, Homo sapiens
gctaatgatagcaagataaaca

SEQ ID NO: 7919549 - DNA, 22 bp, Homo sapiens
gctaatgaggtaatgaatacgt

SEQ ID NO: 7919550 - DNA, 22 bp, Homo sapiens
gctaatgactgagtttttagca

SEQ ID NO: 7919551 - DNA, 22 bp, Homo sapiens
gctaatgaaaaatagattatag

SEQ ID NO: 7919552 - DNA, 22 bp, Homo sapiens
gctaatgaaaaatagattatag

SEQ ID NO: 7919553 - DNA, 22 bp, Homo sapiens
gctaatcaatgttaaggctgtg

SEQ ID NO: 7919554 - DNA, 22 bp, Homo sapiens
gctaatcaatgttaaggctgtg

SEQ ID NO: 7919555 - DNA, 22 bp, Homo sapiens
gctacaagtcttgtcattcatt

SEQ ID NO: 7919556 - DNA, 22 bp, Homo sapiens
gctacagactgagcatggctct

SEQ ID NO: 7919557 - DNA, 22 bp, Homo sapiens
gctacagactgagcatggctct

SEQ ID NO: 7919558 - DNA, 22 bp, Homo sapiens
gctacacaatagcgttcactta

SEQ ID NO: 7919559 - DNA, 22 bp, Homo sapiens
gctacacaatagcgttcactta

SEQ ID NO: 7919560 - DNA, 22 bp, Homo sapiens
gctccaggcagcatagtggatg

SEQ ID NO: 7919561 - DNA, 22 bp, Homo sapiens
gctccaggccacggcttcttgg

SEQ ID NO: 7919562 - DNA, 22 bp, Homo sapiens
gctccaggccccagcgttccgc

SEQ ID NO: 7919563 - DNA, 22 bp, Homo sapiens
gctccaggccacggcttcttgg

SEQ ID NO: 7919564 - DNA, 22 bp, Homo sapiens
gctccaggccacggcttcttgg

SEQ ID NO: 7919565 - DNA, 22 bp, Homo sapiens
gctcagtgaaacatcaaatagt

SEQ ID NO: 7919566 - DNA, 22 bp, Homo sapiens
gctccaggcagcatagtggatg

SEQ ID NO: 7919567 - DNA, 22 bp, Homo sapiens
gctcagtgaaacatcaaatagt

SEQ ID NO: 7919568 - DNA, 22 bp, Homo sapiens
gctcagtctttgtggggtacgg

SEQ ID NO: 7919569 - DNA, 19 bp, Homo sapiens
gctcagtctcctgattgct

SEQ ID NO: 7919570 - DNA, 22 bp, Homo sapiens
gctcagtctaaagacatgctcc

SEQ ID NO: 7919571 - DNA, 22 bp, Homo sapiens
gctccaggcagcatagtggatg

SEQ ID NO: 7919572 - DNA, 22 bp, Homo sapiens
gctccaggcagcatagtggatg

SEQ ID NO: 7919573 - DNA, 22 bp, Homo sapiens
gctccaggcagcatagtggatg

SEQ ID NO: 7919574 - DNA, 22 bp, Homo sapiens
gctccaggcagcatagtggatg

SEQ ID NO: 7919575 - DNA, 22 bp, Homo sapiens
gctccaggcgagctggaccaga

SEQ ID NO: 7919576 - DNA, 22 bp, Homo sapiens
gctccaggcgagctggaccaga

SEQ ID NO: 7919577 - DNA, 22 bp, Homo sapiens
gctccaggcgagctggaccaga

SEQ ID NO: 7919578 - DNA, 22 bp, Homo sapiens
gctccaggcgagctggaccaga

SEQ ID NO: 7919579 - DNA, 22 bp, Homo sapiens
gctccaggcgagctggaccaga

SEQ ID NO: 7919580 - DNA, 22 bp, Homo sapiens
gctccaggcgagctggaccaga

SEQ ID NO: 7919581 - DNA, 22 bp, Homo sapiens
gctccaggccccagcgttccgc

SEQ ID NO: 7919582 - DNA, 17 bp, Homo sapiens
gctccaggcgtgagtga

SEQ ID NO: 7919583 - DNA, 17 bp, Homo sapiens
gctccaggcgtgagtga

SEQ ID NO: 7919584 - DNA, 17 bp, Homo sapiens
gctccaggcgtgagtga

SEQ ID NO: 7919585 - DNA, 22 bp, Homo sapiens
gctcaggggaatgggctgccgt

SEQ ID NO: 7919586 - DNA, 22 bp, Homo sapiens
gctcaggggaatgggctgccgt

SEQ ID NO: 7919587 - DNA, 22 bp, Homo sapiens
gctcaggggaatgggctgccgt

SEQ ID NO: 7919588 - DNA, 22 bp, Homo sapiens
gctcagggctaaggctgagggg

SEQ ID NO: 7919589 - DNA, 22 bp, Homo sapiens
gctcagggctaaggctgagggg

SEQ ID NO: 7919590 - DNA, 22 bp, Homo sapiens
gctcagggtcccttggtgctgg

SEQ ID NO: 7919591 - DNA, 22 bp, Homo sapiens
gctcagggtcccttggtgctgg

SEQ ID NO: 7919592 - DNA, 22 bp, Homo sapiens
gctcagggtcccttggtgctgg

SEQ ID NO: 7919593 - DNA, 22 bp, Homo sapiens
gctcagggtcccttggtgctgg

SEQ ID NO: 7919594 - DNA, 22 bp, Homo sapiens
gctcagggtcccttggtgctgg

SEQ ID NO: 7919595 - DNA, 22 bp, Homo sapiens
gctcagggtcccttggtgctgg

SEQ ID NO: 7919596 - DNA, 23 bp, Homo sapiens
gctcaggtggctcagggactgat

SEQ ID NO: 7919597 - DNA, 23 bp, Homo sapiens
gctcaggtggctcagggactgat

SEQ ID NO: 7919598 - DNA, 20 bp, Homo sapiens
gctcaggtgacagtcaggag

SEQ ID NO: 7919599 - DNA, 22 bp, Homo sapiens
gctcaggtgttacctcctctag

SEQ ID NO: 7919600 - DNA, 22 bp, Homo sapiens
gctcagggtgcagtgtccatga

SEQ ID NO: 7919601 - DNA, 22 bp, Homo sapiens
gctcagggtgcagtgtccatga

SEQ ID NO: 7919602 - DNA, 22 bp, Homo sapiens
gctcctggatgttcaagtcggc

SEQ ID NO: 7919603 - DNA, 22 bp, Homo sapiens
gctcctggatgttcaagtcggc

SEQ ID NO: 7919604 - DNA, 19 bp, Homo sapiens
gctcctggatgacctgtgg

SEQ ID NO: 7919605 - DNA, 22 bp, Homo sapiens
gctcctggatgttcaagtcggc

SEQ ID NO: 7919606 - DNA, 22 bp, Homo sapiens
gctccagggaacagaatgtact

SEQ ID NO: 7919607 - DNA, 22 bp, Homo sapiens
gctccagggaacagaatgtact

SEQ ID NO: 7919608 - DNA, 22 bp, Homo sapiens
gctccaggctgctctgtcccat

SEQ ID NO: 7919609 - DNA, 22 bp, Homo sapiens
gctccaggctgctctgtcccat

SEQ ID NO: 7919610 - DNA, 22 bp, Homo sapiens
gctccaggctgctctgtcccat

SEQ ID NO: 7919611 - DNA, 22 bp, Homo sapiens
gctccaggctgctctgtcccat

SEQ ID NO: 7919612 - DNA, 22 bp, Homo sapiens
gctcggagtcccacctgggaaa

SEQ ID NO: 7919613 - DNA, 22 bp, Homo sapiens
gctcggagtcccacctgggaaa

SEQ ID NO: 7919614 - DNA, 22 bp, Homo sapiens
gctcggccccgacggccggcgg

SEQ ID NO: 7919615 - DNA, 22 bp, Homo sapiens
gctcggccccttccctttcttg

SEQ ID NO: 7919616 - DNA, 22 bp, Homo sapiens
gctcggagaactgggggctccg

SEQ ID NO: 7919617 - DNA, 22 bp, Homo sapiens
gctcggtggccagcctgaggcc

SEQ ID NO: 7919618 - DNA, 22 bp, Homo sapiens
gctcggtggccagcctgaggcc

SEQ ID NO: 7919619 - DNA, 22 bp, Homo sapiens
gctcggtggccagcctgaggcc

SEQ ID NO: 7919620 - DNA, 22 bp, Homo sapiens
gctcggtggccagcctgaggcc

SEQ ID NO: 7919621 - DNA, 22 bp, Homo sapiens
gctcctggatgttcaagtcggc

SEQ ID NO: 7919622 - DNA, 17 bp, Homo sapiens
gctccttctaacttcca

SEQ ID NO: 7919623 - DNA, 22 bp, Homo sapiens
gctccttctggctcccttttgg

SEQ ID NO: 7919624 - DNA, 22 bp, Homo sapiens
gctcgaccgccagaaacttcct

SEQ ID NO: 7919625 - DNA, 22 bp, Homo sapiens
gctcgcatcacctttgttctcc

SEQ ID NO: 7919626 - DNA, 22 bp, Homo sapiens
gctcgcctggctggatctgggt

SEQ ID NO: 7919627 - DNA, 22 bp, Homo sapiens
gctctaggttcctagccaagtc

SEQ ID NO: 7919628 - DNA, 22 bp, Homo sapiens
gctctaggaggtgtgcttagaa

SEQ ID NO: 7919629 - DNA, 22 bp, Homo sapiens
gctctaggttcctagccaagtc

SEQ ID NO: 7919630 - DNA, 21 bp, Homo sapiens
gctctatcaggccaaaatgtc

SEQ ID NO: 7919631 - DNA, 23 bp, Homo sapiens
gctctatcaggaacaagccaggt

SEQ ID NO: 7919632 - DNA, 22 bp, Homo sapiens
gctctagtaggaatgtccctct

SEQ ID NO: 7919633 - DNA, 20 bp, Homo sapiens
gctctgaaccaagagctgtc

SEQ ID NO: 7919634 - DNA, 22 bp, Homo sapiens
gctctaggaggtgtgcttagaa

SEQ ID NO: 7919635 - DNA, 22 bp, Homo sapiens
gctctaggagaggggcagtcca

SEQ ID NO: 7919636 - DNA, 22 bp, Homo sapiens
gctctaggagaggggcagtcca

SEQ ID NO: 7919637 - DNA, 22 bp, Homo sapiens
gctctaggagaggggcagtcca

SEQ ID NO: 7919638 - DNA, 22 bp, Homo sapiens
gctctagcccatttcctgcttg

SEQ ID NO: 7919639 - DNA, 22 bp, Homo sapiens
gctctagctggcgctgacctgg

SEQ ID NO: 7919640 - DNA, 22 bp, Homo sapiens
gctctagcaaggctggcctggg

SEQ ID NO: 7919641 - DNA, 22 bp, Homo sapiens
gctctagatcataggtcattat

SEQ ID NO: 7919642 - DNA, 20 bp, Homo sapiens
gctctaaagccacagattga

SEQ ID NO: 7919643 - DNA, 22 bp, Homo sapiens
gctctagaaagaaggatgtggg

SEQ ID NO: 7919644 - DNA, 19 bp, Homo sapiens
gctctaaaagattttgaag

SEQ ID NO: 7919645 - DNA, 19 bp, Homo sapiens
gctctaaaagattttgaag

SEQ ID NO: 7919646 - DNA, 20 bp, Homo sapiens
gctctaaaccacaaagccca

SEQ ID NO: 7919647 - DNA, 22 bp, Homo sapiens
gctctaaagaacccagaggagt

SEQ ID NO: 7919648 - DNA, 20 bp, Homo sapiens
gctctaaagccacagattga

SEQ ID NO: 7919649 - DNA, 22 bp, Homo sapiens
gctctaaagaacccagaggagt

SEQ ID NO: 7919650 - DNA, 22 bp, Homo sapiens
gctctaaagagaatctatgcgg

SEQ ID NO: 7919651 - DNA, 22 bp, Homo sapiens
gctgaggaagtcaggtggccca

SEQ ID NO: 7919652 - DNA, 22 bp, Homo sapiens
gctgaggacatacacattgtgc

SEQ ID NO: 7919653 - DNA, 22 bp, Homo sapiens
gctgaggaagtcaggtggccca

SEQ ID NO: 7919654 - DNA, 22 bp, Homo sapiens
gctgaggacatacacattgtgc

SEQ ID NO: 7919655 - DNA, 22 bp, Homo sapiens
gctgaggacatcatggaaggaa

SEQ ID NO: 7919656 - DNA, 22 bp, Homo sapiens
gctgaggacatcatggaaggaa

SEQ ID NO: 7919657 - DNA, 22 bp, Homo sapiens
gctgaggagcgagaactctgct

SEQ ID NO: 7919658 - DNA, 20 bp, Homo sapiens
gctgaggagcagtgtggttg

SEQ ID NO: 7919659 - DNA, 22 bp, Homo sapiens
gctgaggaagtcaggtggccca

SEQ ID NO: 7919660 - DNA, 22 bp, Homo sapiens
gctgaggaaaggctggaaggga

SEQ ID NO: 7919661 - DNA, 22 bp, Homo sapiens
gctgaggaaaggctggaaggga

SEQ ID NO: 7919662 - DNA, 22 bp, Homo sapiens
gctgagctgggacagtcctggg

SEQ ID NO: 7919663 - DNA, 22 bp, Homo sapiens
gctgagctgggacagtcctggg

SEQ ID NO: 7919664 - DNA, 22 bp, Homo sapiens
gctgaggaaaccaatgctcaga

SEQ ID NO: 7919665 - DNA, 22 bp, Homo sapiens
gctgaggaaaccaatgctcaga

SEQ ID NO: 7919666 - DNA, 22 bp, Homo sapiens
gctgaggaaaccaatgctcaga

SEQ ID NO: 7919667 - DNA, 22 bp, Homo sapiens
gctgaggaaaccaatgctcaga

SEQ ID NO: 7919668 - DNA, 22 bp, Homo sapiens
gctgagaaatgcagacatgctg

SEQ ID NO: 7919669 - DNA, 22 bp, Homo sapiens
gctgagaaatgcagacatgctg

SEQ ID NO: 7919670 - DNA, 22 bp, Homo sapiens
gctgagaacagagctctgagct

SEQ ID NO: 7919671 - DNA, 22 bp, Homo sapiens
gctgagaacagagctctgagct

SEQ ID NO: 7919672 - DNA, 22 bp, Homo sapiens
gctgagctgaggcagggctggg

SEQ ID NO: 7919673 - DNA, 22 bp, Homo sapiens
gctgagctgggacagtcctggg

SEQ ID NO: 7919674 - DNA, 22 bp, Homo sapiens
gctgagctgggacagtcctggg

SEQ ID NO: 7919675 - DNA, 22 bp, Homo sapiens
gctgagctgggacagtcctggg

SEQ ID NO: 7919676 - DNA, 22 bp, Homo sapiens
gctgagctgggacagtcctggg

SEQ ID NO: 7919677 - DNA, 22 bp, Homo sapiens
gctgagaaatgcagacatgctg

SEQ ID NO: 7919678 - DNA, 22 bp, Homo sapiens
gctgagctgctgttcatcctgc

SEQ ID NO: 7919679 - DNA, 22 bp, Homo sapiens
gctgagctgaggcagggctggg

SEQ ID NO: 7919680 - DNA, 22 bp, Homo sapiens
gctctgggttctgatttatgag

SEQ ID NO: 7919681 - DNA, 22 bp, Homo sapiens
gctctgggttctgatttatgag

SEQ ID NO: 7919682 - DNA, 22 bp, Homo sapiens
gctctggtaccagctactccta

SEQ ID NO: 7919683 - DNA, 22 bp, Homo sapiens
gctctggtagatcctcaggctc

SEQ ID NO: 7919684 - DNA, 22 bp, Homo sapiens
gctctggtctgcttatatctat

SEQ ID NO: 7919685 - DNA, 22 bp, Homo sapiens
gctctggtgagtgtagttcagg

SEQ ID NO: 7919686 - DNA, 22 bp, Homo sapiens
gctctggtagatcctcaggctc

SEQ ID NO: 7919687 - DNA, 22 bp, Homo sapiens
gctctggtagatcctcaggctc

SEQ ID NO: 7919688 - DNA, 22 bp, Homo sapiens
gctctggtagatcctcaggctc

SEQ ID NO: 7919689 - DNA, 22 bp, Homo sapiens
gctctggtagatcctcaggctc

SEQ ID NO: 7919690 - DNA, 22 bp, Homo sapiens
gctctggttaaaaagaattaaa

SEQ ID NO: 7919691 - DNA, 22 bp, Homo sapiens
gctctggtggtgatcagacgct

SEQ ID NO: 7919692 - DNA, 22 bp, Homo sapiens
gctctggtggtgatcagacgct

SEQ ID NO: 7919693 - DNA, 20 bp, Homo sapiens
gctgactgtttgggtggcgg

SEQ ID NO: 7919694 - DNA, 22 bp, Homo sapiens
gctctggttccagcgcgcccga

SEQ ID NO: 7919695 - DNA, 22 bp, Homo sapiens
gctgagaaatgcagacatgctg

SEQ ID NO: 7919696 - DNA, 22 bp, Homo sapiens
gctgactttgcctgtctttagc

SEQ ID NO: 7919697 - DNA, 22 bp, Homo sapiens
gctgactttgcctgtctttagc

SEQ ID NO: 7919698 - DNA, 22 bp, Homo sapiens
caaatgaagggagctgaagtct

SEQ ID NO: 7919699 - DNA, 22 bp, Homo sapiens
caaatgaagggagctgaagtct

SEQ ID NO: 7919700 - DNA, 22 bp, Homo sapiens
caaatgaagggagctgaagtct

SEQ ID NO: 7919701 - DNA, 20 bp, Homo sapiens
caaatgaagctgttggcctc

SEQ ID NO: 7919702 - DNA, 20 bp, Homo sapiens
caaatgaagctgttggcctc

SEQ ID NO: 7919703 - DNA, 20 bp, Homo sapiens
caaatgaagctgttggcctc

SEQ ID NO: 7919704 - DNA, 22 bp, Homo sapiens
caaatgaagagggcaacttctg

SEQ ID NO: 7919705 - DNA, 22 bp, Homo sapiens
caaatgaagaaccttctcacct

SEQ ID NO: 7919706 - DNA, 22 bp, Homo sapiens
caaatgaagagggcaacttctg

SEQ ID NO: 7919707 - DNA, 22 bp, Homo sapiens
caaatgaagagggcaacttctg

SEQ ID NO: 7919708 - DNA, 22 bp, Homo sapiens
caaatgaagagggcaacttctg

SEQ ID NO: 7919709 - DNA, 22 bp, Homo sapiens
caaatgaagaaccttctcacct

SEQ ID NO: 7919710 - DNA, 22 bp, Homo sapiens
gctgaggagcgagaactctgct

SEQ ID NO: 7919711 - DNA, 22 bp, Homo sapiens
gctgaggagcgagaactctgct

SEQ ID NO: 7919712 - DNA, 22 bp, Homo sapiens
caaatgaaggtggtgggtcatt

SEQ ID NO: 7919713 - DNA, 22 bp, Homo sapiens
caaatgaaggtggtgggtcatt

SEQ ID NO: 7919714 - DNA, 22 bp, Homo sapiens
caaatgaaggtggtgggtcatt

SEQ ID NO: 7919715 - DNA, 22 bp, Homo sapiens
caaatgaaggtggtgggtcatt

SEQ ID NO: 7919716 - DNA, 22 bp, Homo sapiens
caaatgaagggagctgaagtct

SEQ ID NO: 7919717 - DNA, 22 bp, Homo sapiens
caaatgaagggagctgaagtct

SEQ ID NO: 7919718 - DNA, 22 bp, Homo sapiens
caaatgaatagggagtgtgatg

SEQ ID NO: 7919719 - DNA, 22 bp, Homo sapiens
caaatgaatagggagtgtgatg

SEQ ID NO: 7919720 - DNA, 22 bp, Homo sapiens
caaatgaatagggagtgtgatg

SEQ ID NO: 7919721 - DNA, 22 bp, Homo sapiens
caaatgaagtccaaagggctta

SEQ ID NO: 7919722 - DNA, 22 bp, Homo sapiens
caaatgaagtccaaagggctta

SEQ ID NO: 7919723 - DNA, 22 bp, Homo sapiens
caaatgaagtccaaagggctta

SEQ ID NO: 7919724 - DNA, 22 bp, Homo sapiens
caaatgaagtccaaagggctta

SEQ ID NO: 7919725 - DNA, 22 bp, Homo sapiens
caaatgaatatttccatgggtt

SEQ ID NO: 7919726 - DNA, 22 bp, Homo sapiens
caaatgaatatttccatgggtt

SEQ ID NO: 7919727 - DNA, 22 bp, Homo sapiens
caaatgaatagggagtgtgatg

SEQ ID NO: 7919728 - DNA, 22 bp, Homo sapiens
caaatgaatagggagtgtgatg

SEQ ID NO: 7919729 - DNA, 22 bp, Homo sapiens
caaatgaatatttccatgggtt

SEQ ID NO: 7919730 - DNA, 22 bp, Homo sapiens
caaatgaatatttccatgggtt

SEQ ID NO: 7919731 - DNA, 22 bp, Homo sapiens
caaatgaatatttccatgggtt

SEQ ID NO: 7919732 - DNA, 22 bp, Homo sapiens
caaatgaatatttccatgggtt

SEQ ID NO: 7919733 - DNA, 22 bp, Homo sapiens
caaatgaatttccctgcaaatg

SEQ ID NO: 7919734 - DNA, 22 bp, Homo sapiens
caaatgaatttccctgcaaatg

SEQ ID NO: 7919735 - DNA, 22 bp, Homo sapiens
caaatgaatttccctgcaaatg

SEQ ID NO: 7919736 - DNA, 22 bp, Homo sapiens
caaatgaatttccctgcaaatg

SEQ ID NO: 7919737 - DNA, 22 bp, Homo sapiens
caaatgaatttccctgcaaatg

SEQ ID NO: 7919738 - DNA, 22 bp, Homo sapiens
caaatgtgttttttcttctaca

SEQ ID NO: 7919739 - DNA, 22 bp, Homo sapiens
caaattaccctcaacatctaga

SEQ ID NO: 7919740 - DNA, 22 bp, Homo sapiens
caaattaccctcaacatctaga

SEQ ID NO: 7919741 - DNA, 22 bp, Homo sapiens
caaattaccctcaacatctaga

SEQ ID NO: 7919742 - DNA, 22 bp, Homo sapiens
caaattcaaatttcatcagtgt

SEQ ID NO: 7919743 - DNA, 22 bp, Homo sapiens
caaattcagaaaattggtagag

SEQ ID NO: 7919744 - DNA, 22 bp, Homo sapiens
caaattcacatgattgcttctg

SEQ ID NO: 7919745 - DNA, 22 bp, Homo sapiens
caaattcaaatttcatcagtgt

SEQ ID NO: 7919746 - DNA, 22 bp, Homo sapiens
caaattcaaatttcatcagtgt

SEQ ID NO: 7919747 - DNA, 22 bp, Homo sapiens
gctctgaacttccaccttttca

SEQ ID NO: 7919748 - DNA, 20 bp, Homo sapiens
gctctgaaccaagagctgtc

SEQ ID NO: 7919749 - DNA, 20 bp, Homo sapiens
gctctgaaccaagagctgtc

SEQ ID NO: 7919750 - DNA, 22 bp, Homo sapiens
gctctgaagggtgagctgttcg

SEQ ID NO: 7919751 - DNA, 22 bp, Homo sapiens
gctctgaagggtgagctgttcg

SEQ ID NO: 7919752 - DNA, 22 bp, Homo sapiens
gctctgaagggtgagctgttcg

SEQ ID NO: 7919753 - DNA, 22 bp, Homo sapiens
gctctgaagggtgagctgttcg

SEQ ID NO: 7919754 - DNA, 20 bp, Homo sapiens
gctctgaccatatcaagaca

SEQ ID NO: 7919755 - DNA, 22 bp, Homo sapiens
gctctgacaaaggccacttaca

SEQ ID NO: 7919756 - DNA, 22 bp, Homo sapiens
gctctgaatcaatcagataagg

SEQ ID NO: 7919757 - DNA, 22 bp, Homo sapiens
gctctgacctggccgccctgct

SEQ ID NO: 7919758 - DNA, 22 bp, Homo sapiens
gctctgactgagcttcctgcct

SEQ ID NO: 7919759 - DNA, 22 bp, Homo sapiens
gctctgactggtgggccacagt

SEQ ID NO: 7919760 - DNA, 22 bp, Homo sapiens
gctctgagaaccaggaacacag

SEQ ID NO: 7919761 - DNA, 22 bp, Homo sapiens
gctctgagaggatgctgagcag

SEQ ID NO: 7919762 - DNA, 22 bp, Homo sapiens
gctctgagagctacacagggta

SEQ ID NO: 7919763 - DNA, 22 bp, Homo sapiens
gctctgagaggatgctgagcag

SEQ ID NO: 7919764 - DNA, 22 bp, Homo sapiens
gctctgagagctacacagggta

SEQ ID NO: 7919765 - DNA, 22 bp, Homo sapiens
gctctgagagctacacagggta

SEQ ID NO: 7919766 - DNA, 22 bp, Homo sapiens
gctctgagacagtagagatggc

SEQ ID NO: 7919767 - DNA, 22 bp, Homo sapiens
gctctgagacagtagagatggc

SEQ ID NO: 7919768 - DNA, 22 bp, Homo sapiens
gctctgagacagtagagatggc

SEQ ID NO: 7919769 - DNA, 22 bp, Homo sapiens
caaatagacttcaatctcttga

SEQ ID NO: 7919770 - DNA, 22 bp, Homo sapiens
caaatagacttcaatctcttga

SEQ ID NO: 7919771 - DNA, 22 bp, Homo sapiens
caaatagacttcaatctcttga

SEQ ID NO: 7919772 - DNA, 22 bp, Homo sapiens
caaatattccaggtacatccct

SEQ ID NO: 7919773 - DNA, 22 bp, Homo sapiens
caaatagacttaagcatctgta

SEQ ID NO: 7919774 - DNA, 22 bp, Homo sapiens
caaatagacttcaatctcttga

SEQ ID NO: 7919775 - DNA, 22 bp, Homo sapiens
caaatagacttaagcatctgta

SEQ ID NO: 7919776 - DNA, 22 bp, Homo sapiens
caaatattccaggtacatccct

SEQ ID NO: 7919777 - DNA, 22 bp, Homo sapiens
caaatattccaggtacatccct

SEQ ID NO: 7919778 - DNA, 22 bp, Homo sapiens
caaatattccaggtacatccct

SEQ ID NO: 7919779 - DNA, 22 bp, Homo sapiens
caaatattccaggtacatccct

SEQ ID NO: 7919780 - DNA, 20 bp, Homo sapiens
caaatcacaggtaattgcaa

SEQ ID NO: 7919781 - DNA, 22 bp, Homo sapiens
caaatcaccacttaatgggtta

SEQ ID NO: 7919782 - DNA, 22 bp, Homo sapiens
gctctgagaggtgcagcagtaa

SEQ ID NO: 7919783 - DNA, 19 bp, Homo sapiens
gctctgagaggggcatggg

SEQ ID NO: 7919784 - DNA, 19 bp, Homo sapiens
gctctgagaggggcatggg

SEQ ID NO: 7919785 - DNA, 19 bp, Homo sapiens
gctctgagaggggcatggg

SEQ ID NO: 7919786 - DNA, 22 bp, Homo sapiens
caaatcatggctctagcttaca

SEQ ID NO: 7919787 - DNA, 22 bp, Homo sapiens
caaatcatggaataactagaga

SEQ ID NO: 7919788 - DNA, 22 bp, Homo sapiens
caaatcatggaataactagaga

SEQ ID NO: 7919789 - DNA, 22 bp, Homo sapiens
caaatcatggaataactagaga

SEQ ID NO: 7919790 - DNA, 22 bp, Homo sapiens
caaatcatggaataactagaga

SEQ ID NO: 7919791 - DNA, 22 bp, Homo sapiens
caaatccagatcccagtcgtag

SEQ ID NO: 7919792 - DNA, 22 bp, Homo sapiens
caaatctaggatgcatgtagtg

SEQ ID NO: 7919793 - DNA, 22 bp, Homo sapiens
caaatcctggagccatggtaac

SEQ ID NO: 7919794 - DNA, 22 bp, Homo sapiens
caaatcctggagccatggtaac

SEQ ID NO: 7919795 - DNA, 17 bp, Homo sapiens
caaatcctaggatgtct

SEQ ID NO: 7919796 - DNA, 20 bp, Homo sapiens
caaatccctgctctgtgctg

SEQ ID NO: 7919797 - DNA, 22 bp, Homo sapiens
caaatcctcacctcatcatgaa

SEQ ID NO: 7919798 - DNA, 20 bp, Homo sapiens
caaatccctgctctgtgctg

SEQ ID NO: 7919799 - DNA, 22 bp, Homo sapiens
caaatctccttaaaggtaaaat

SEQ ID NO: 7919800 - DNA, 22 bp, Homo sapiens
caaatctccttaaaggtaaaat

SEQ ID NO: 7919801 - DNA, 22 bp, Homo sapiens
caaatctatatgttgatattct

SEQ ID NO: 7919802 - DNA, 22 bp, Homo sapiens
caaatctctgctactagctatg

SEQ ID NO: 7919803 - DNA, 22 bp, Homo sapiens
caaatctgagtctacaatttta

SEQ ID NO: 7919804 - DNA, 22 bp, Homo sapiens
caaatctttaattgaggaatca

SEQ ID NO: 7919805 - DNA, 22 bp, Homo sapiens
caaatctaggatgcatgtagtg

SEQ ID NO: 7919806 - DNA, 22 bp, Homo sapiens
gctctgggtgaacttggagcaa

SEQ ID NO: 7919807 - DNA, 22 bp, Homo sapiens
gctctgggtgaacttggagcaa

SEQ ID NO: 7919808 - DNA, 22 bp, Homo sapiens
gctctgggtgaacttggagcaa

SEQ ID NO: 7919809 - DNA, 15 bp, Homo sapiens
gctctgggtatttga

SEQ ID NO: 7919810 - DNA, 22 bp, Homo sapiens
gctctgggtgaacttggagcaa

SEQ ID NO: 7919811 - DNA, 22 bp, Homo sapiens
gctctgggtgaacttggagcaa

SEQ ID NO: 7919812 - DNA, 15 bp, Homo sapiens
gctctgggtatttga

SEQ ID NO: 7919813 - DNA, 22 bp, Homo sapiens
caaatgaagaaccttctcacct

SEQ ID NO: 7919814 - DNA, 22 bp, Homo sapiens
caaatgaagaaccttctcacct

SEQ ID NO: 7919815 - DNA, 22 bp, Homo sapiens
caaatgaagaaccttctcacct

SEQ ID NO: 7919816 - DNA, 22 bp, Homo sapiens
caaatgaaaatggcgtcttgga

SEQ ID NO: 7919817 - DNA, 22 bp, Homo sapiens
caaatgaaaatggcgtcttgga

SEQ ID NO: 7919818 - DNA, 22 bp, Homo sapiens
caaatgaaaatggcgtcttgga

SEQ ID NO: 7919819 - DNA, 22 bp, Homo sapiens
caaatgaaaatggcgtcttgga

SEQ ID NO: 7919820 - DNA, 22 bp, Homo sapiens
caaatctttaattgaggaatca

SEQ ID NO: 7919821 - DNA, 22 bp, Homo sapiens
gctctgggtgaatggcagattg

SEQ ID NO: 7919822 - DNA, 22 bp, Homo sapiens
gctctgggtgaatggcagattg

SEQ ID NO: 7919823 - DNA, 22 bp, Homo sapiens
gctctgggtgaatggcagattg

SEQ ID NO: 7919824 - DNA, 22 bp, Homo sapiens
gctctgggtgaatggcagattg

SEQ ID NO: 7919825 - DNA, 22 bp, Homo sapiens
gctctgggtgaatggcagattg

SEQ ID NO: 7919826 - DNA, 22 bp, Homo sapiens
gctctgggtgaagggtaccatt

SEQ ID NO: 7919827 - DNA, 22 bp, Homo sapiens
gctctgggtgaagggtaccatt

SEQ ID NO: 7919828 - DNA, 22 bp, Homo sapiens
gctctgggtgaagggtaccatt

SEQ ID NO: 7919829 - DNA, 22 bp, Homo sapiens
gctctgggtgaagggtaccatt

SEQ ID NO: 7919830 - DNA, 20 bp, Homo sapiens
gctctgggtggtaaatgact

SEQ ID NO: 7919831 - DNA, 20 bp, Homo sapiens
gctctgggtggtaaatgact

SEQ ID NO: 7919832 - DNA, 22 bp, Homo sapiens
gctctgggttctgatttatgag

SEQ ID NO: 7919833 - DNA, 22 bp, Homo sapiens
gctctgggttctgatttatgag

SEQ ID NO: 7919834 - DNA, 22 bp, Homo sapiens
gctctgggtgaatggcagattg

SEQ ID NO: 7919835 - DNA, 22 bp, Homo sapiens
gctctgggtgaatggcagattg

SEQ ID NO: 7919836 - DNA, 22 bp, Homo sapiens
gctctgggtgaatggcagattg

SEQ ID NO: 7919837 - DNA, 22 bp, Homo sapiens
gctctgggtgaatggcagattg

SEQ ID NO: 7919838 - DNA, 22 bp, Homo sapiens
gcctggctccctctgcagctcc

SEQ ID NO: 7919839 - DNA, 22 bp, Homo sapiens
gcctggctccctctgcagctcc

SEQ ID NO: 7919840 - DNA, 22 bp, Homo sapiens
gcctggctcacagagcagcctt

SEQ ID NO: 7919841 - DNA, 22 bp, Homo sapiens
gcctggctcacagagcagcctt

SEQ ID NO: 7919842 - DNA, 22 bp, Homo sapiens
gcctggctcacagagcagcctt

SEQ ID NO: 7919843 - DNA, 22 bp, Homo sapiens
gcctggctcctaagagcacaac

SEQ ID NO: 7919844 - DNA, 22 bp, Homo sapiens
gcctggctcctaagagcacaac

SEQ ID NO: 7919845 - DNA, 22 bp, Homo sapiens
gcctggctcctaagagcacaac

SEQ ID NO: 7919846 - DNA, 22 bp, Homo sapiens
gcctggctcctaagagcacaac

SEQ ID NO: 7919847 - DNA, 22 bp, Homo sapiens
gcctggctccctctgcagctcc

SEQ ID NO: 7919848 - DNA, 22 bp, Homo sapiens
attttgaaatacttgaaggaaa

SEQ ID NO: 7919849 - DNA, 18 bp, Homo sapiens
attttgaacaatgctgta

SEQ ID NO: 7919850 - DNA, 18 bp, Homo sapiens
attttgaacaatgctgta

SEQ ID NO: 7919851 - DNA, 18 bp, Homo sapiens
attttgaacaatgctgta

SEQ ID NO: 7919852 - DNA, 18 bp, Homo sapiens
attttgaacaatgctgta

SEQ ID NO: 7919853 - DNA, 22 bp, Homo sapiens
attttgaagggaattgaagttc

SEQ ID NO: 7919854 - DNA, 18 bp, Homo sapiens
attttgaactgggaatat

SEQ ID NO: 7919855 - DNA, 22 bp, Homo sapiens
attttgaaaccaagttatttcc

SEQ ID NO: 7919856 - DNA, 22 bp, Homo sapiens
attttgaaatacttgaaggaaa

SEQ ID NO: 7919857 - DNA, 22 bp, Homo sapiens
attttgaaatacttgaaggaaa

SEQ ID NO: 7919858 - DNA, 22 bp, Homo sapiens
attttgaaaccaagttatttcc

SEQ ID NO: 7919859 - DNA, 22 bp, Homo sapiens
attttgaaaccaagttatttcc

SEQ ID NO: 7919860 - DNA, 22 bp, Homo sapiens
attttgaaaagcatttgagtaa

SEQ ID NO: 7919861 - DNA, 22 bp, Homo sapiens
attttgaaaagcatttgagtaa

SEQ ID NO: 7919862 - DNA, 22 bp, Homo sapiens
attttgaaaagcatttgagtaa

SEQ ID NO: 7919863 - DNA, 22 bp, Homo sapiens
attttcttctctccctggctgc

SEQ ID NO: 7919864 - DNA, 22 bp, Homo sapiens
attttcttctctccctggctgc

SEQ ID NO: 7919865 - DNA, 22 bp, Homo sapiens
attttcttctctccctggctgc

SEQ ID NO: 7919866 - DNA, 22 bp, Homo sapiens
attttcttctctccctggctgc

SEQ ID NO: 7919867 - DNA, 22 bp, Homo sapiens
attttctgtgtgcagataaata

SEQ ID NO: 7919868 - DNA, 22 bp, Homo sapiens
attttcttctctccctggctgc

SEQ ID NO: 7919869 - DNA, 22 bp, Homo sapiens
attttctagatagatgatgcat

SEQ ID NO: 7919870 - DNA, 22 bp, Homo sapiens
attttctagatagatgatgcat

SEQ ID NO: 7919871 - DNA, 21 bp, Homo sapiens
gcctgccctctgtgatggcca

SEQ ID NO: 7919872 - DNA, 21 bp, Homo sapiens
gcctgccctctgtgatggcca

SEQ ID NO: 7919873 - DNA, 21 bp, Homo sapiens
gcctgccctctgtgatggcca

SEQ ID NO: 7919874 - DNA, 21 bp, Homo sapiens
gcctgccctctgtgatggcca

SEQ ID NO: 7919875 - DNA, 21 bp, Homo sapiens
gcctgccctctgtgatggcca

SEQ ID NO: 7919876 - DNA, 21 bp, Homo sapiens
gcctgccctctgtgatggcca

SEQ ID NO: 7919877 - DNA, 22 bp, Homo sapiens
gcctgccctgaaagaggtgaag

SEQ ID NO: 7919878 - DNA, 22 bp, Homo sapiens
gcctgccctgaaagaggtgaag

SEQ ID NO: 7919879 - DNA, 22 bp, Homo sapiens
gcctgccccttcctgggcaggg

SEQ ID NO: 7919880 - DNA, 22 bp, Homo sapiens
gcctgccccttcctgggcaggg

SEQ ID NO: 7919881 - DNA, 22 bp, Homo sapiens
gcctgccccttcctgggcaggg

SEQ ID NO: 7919882 - DNA, 21 bp, Homo sapiens
gcctgccccatgtttctgttg

SEQ ID NO: 7919883 - DNA, 22 bp, Homo sapiens
gcctgccccttcctgggcaggg

SEQ ID NO: 7919884 - DNA, 22 bp, Homo sapiens
gcctgccccttcctgggcaggg

SEQ ID NO: 7919885 - DNA, 22 bp, Homo sapiens
gcctgccccttcctgggcaggg

SEQ ID NO: 7919886 - DNA, 22 bp, Homo sapiens
gcctgcctagaattgcagcttt

SEQ ID NO: 7919887 - DNA, 22 bp, Homo sapiens
gcctgcctagaattgcagcttt

SEQ ID NO: 7919888 - DNA, 22 bp, Homo sapiens
gcctgcctagaattgcagcttt

SEQ ID NO: 7919889 - DNA, 23 bp, Homo sapiens
gcctgccgcctggctgagaactg

SEQ ID NO: 7919890 - DNA, 22 bp, Homo sapiens
gcctgccctgaaagaggtgaag

SEQ ID NO: 7919891 - DNA, 22 bp, Homo sapiens
gcctgcctagaattgcagcttt

SEQ ID NO: 7919892 - DNA, 18 bp, Homo sapiens
gcctgcctagagcttgcc

SEQ ID NO: 7919893 - DNA, 22 bp, Homo sapiens
attttctagatagatgatgcat

SEQ ID NO: 7919894 - DNA, 22 bp, Homo sapiens
attttctagatagatgatgcat

SEQ ID NO: 7919895 - DNA, 22 bp, Homo sapiens
gcctgcctagaattgcagcttt

SEQ ID NO: 7919896 - DNA, 22 bp, Homo sapiens
gcctgcctagaattgcagcttt

SEQ ID NO: 7919897 - DNA, 23 bp, Homo sapiens
attttacaggtcagttccttgaa

SEQ ID NO: 7919898 - DNA, 23 bp, Homo sapiens
attttacaggtcagttccttgaa

SEQ ID NO: 7919899 - DNA, 23 bp, Homo sapiens
attttacaggtcagttccttgaa

SEQ ID NO: 7919900 - DNA, 23 bp, Homo sapiens
attttacaggtcagttccttgaa

SEQ ID NO: 7919901 - DNA, 22 bp, Homo sapiens
attttacataaggaaggtttaa

SEQ ID NO: 7919902 - DNA, 22 bp, Homo sapiens
attttacataaggaaggtttaa

SEQ ID NO: 7919903 - DNA, 22 bp, Homo sapiens
attttacataaggaaggtttaa

SEQ ID NO: 7919904 - DNA, 22 bp, Homo sapiens
attttacataaggaaggtttaa

SEQ ID NO: 7919905 - DNA, 22 bp, Homo sapiens
attttacataaggaaggtttaa

SEQ ID NO: 7919906 - DNA, 22 bp, Homo sapiens
attttacataaggaaggtttaa

SEQ ID NO: 7919907 - DNA, 22 bp, Homo sapiens
attttaccttaaagtctatatt

SEQ ID NO: 7919908 - DNA, 22 bp, Homo sapiens
attttaccttaaagtctatatt

SEQ ID NO: 7919909 - DNA, 22 bp, Homo sapiens
attttaccttaaagtctatatt

SEQ ID NO: 7919910 - DNA, 22 bp, Homo sapiens
attttactaagtggatatctgt

SEQ ID NO: 7919911 - DNA, 22 bp, Homo sapiens
attttactaagtggatatctgt

SEQ ID NO: 7919912 - DNA, 22 bp, Homo sapiens
attttactactccaattaatga

SEQ ID NO: 7919913 - DNA, 22 bp, Homo sapiens
attttactactccaattaatga

SEQ ID NO: 7919914 - DNA, 22 bp, Homo sapiens
gcctgcccacggggctggcata

SEQ ID NO: 7919915 - DNA, 22 bp, Homo sapiens
gcctgcccacggggctggcata

SEQ ID NO: 7919916 - DNA, 22 bp, Homo sapiens
gcctgcccacggggctggcata

SEQ ID NO: 7919917 - DNA, 22 bp, Homo sapiens
gcctgcccacggggctggcata

SEQ ID NO: 7919918 - DNA, 22 bp, Homo sapiens
gcctgcccacggggctggcata

SEQ ID NO: 7919919 - DNA, 22 bp, Homo sapiens
gcctgcccacggggctggcata

SEQ ID NO: 7919920 - DNA, 21 bp, Homo sapiens
gcctgccccatgtttctgttg

SEQ ID NO: 7919921 - DNA, 22 bp, Homo sapiens
atttgcatttacatagcataga

SEQ ID NO: 7919922 - DNA, 22 bp, Homo sapiens
atttgcatttacatagcataga

SEQ ID NO: 7919923 - DNA, 21 bp, Homo sapiens
atttgcattaaaatattacgc

SEQ ID NO: 7919924 - DNA, 21 bp, Homo sapiens
atttgcattaaaatattacgc

SEQ ID NO: 7919925 - DNA, 22 bp, Homo sapiens
atttgcatgcttctattgtgaa

SEQ ID NO: 7919926 - DNA, 22 bp, Homo sapiens
atttgcatgacctttgcaagtg

SEQ ID NO: 7919927 - DNA, 23 bp, Homo sapiens
atttgcatggccggattatggat

SEQ ID NO: 7919928 - DNA, 23 bp, Homo sapiens
atttgcatggccggattatggat

SEQ ID NO: 7919929 - DNA, 22 bp, Homo sapiens
atttgcatgacctttgcaagtg

SEQ ID NO: 7919930 - DNA, 20 bp, Homo sapiens
atttgcatctgaataactta

SEQ ID NO: 7919931 - DNA, 20 bp, Homo sapiens
atttgcatctgaataactta

SEQ ID NO: 7919932 - DNA, 22 bp, Homo sapiens
atttgcatatctgatagactaa

SEQ ID NO: 7919933 - DNA, 22 bp, Homo sapiens
atttgccttgtgatttgtaagt

SEQ ID NO: 7919934 - DNA, 22 bp, Homo sapiens
atttgcctttcgaatcaacagg

SEQ ID NO: 7919935 - DNA, 22 bp, Homo sapiens
atttgccttgtgatttgtaagt

SEQ ID NO: 7919936 - DNA, 22 bp, Homo sapiens
atttgccttggtgatttgtaaa

SEQ ID NO: 7919937 - DNA, 22 bp, Homo sapiens
atttgcatttagaaagatcact

SEQ ID NO: 7919938 - DNA, 22 bp, Homo sapiens
atttgcatttagaaagatcact

SEQ ID NO: 7919939 - DNA, 22 bp, Homo sapiens
atttgcatttagaaagatcact

SEQ ID NO: 7919940 - DNA, 22 bp, Homo sapiens
atttgccatgaagagtgtttga

SEQ ID NO: 7919941 - DNA, 22 bp, Homo sapiens
atttgccttactgaagaaggag

SEQ ID NO: 7919942 - DNA, 22 bp, Homo sapiens
attttaaggcttatttaaaggc

SEQ ID NO: 7919943 - DNA, 22 bp, Homo sapiens
attttaaggcttatttaaaggc

SEQ ID NO: 7919944 - DNA, 22 bp, Homo sapiens
attttaataagatccatttggt

SEQ ID NO: 7919945 - DNA, 22 bp, Homo sapiens
attttaataagatccatttggt

SEQ ID NO: 7919946 - DNA, 22 bp, Homo sapiens
attttaataagatccatttggt

SEQ ID NO: 7919947 - DNA, 22 bp, Homo sapiens
attttaataagattcccaagta

SEQ ID NO: 7919948 - DNA, 22 bp, Homo sapiens
attttaataagattcccaagta

SEQ ID NO: 7919949 - DNA, 23 bp, Homo sapiens
attttacaggtcagttccttgaa

SEQ ID NO: 7919950 - DNA, 22 bp, Homo sapiens
attttaataagatccatttggt

SEQ ID NO: 7919951 - DNA, 23 bp, Homo sapiens
attttaaccttgactaacatgca

SEQ ID NO: 7919952 - DNA, 23 bp, Homo sapiens
attttaaccttgactaacatgca

SEQ ID NO: 7919953 - DNA, 22 bp, Homo sapiens
atttgtctttggacctgtgaga

SEQ ID NO: 7919954 - DNA, 22 bp, Homo sapiens
attttaaggcttatttaaaggc

SEQ ID NO: 7919955 - DNA, 22 bp, Homo sapiens
attttaaggcttatttaaaggc

SEQ ID NO: 7919956 - DNA, 22 bp, Homo sapiens
attttaaggcttatttaaaggc

SEQ ID NO: 7919957 - DNA, 22 bp, Homo sapiens
atttgtctctgcactttactca

SEQ ID NO: 7919958 - DNA, 22 bp, Homo sapiens
atttgtctgcttgctgccttcc

SEQ ID NO: 7919959 - DNA, 22 bp, Homo sapiens
atttgattgtgtctgagacgat

SEQ ID NO: 7919960 - DNA, 22 bp, Homo sapiens
atttgattagctgtgtaatttt

SEQ ID NO: 7919961 - DNA, 22 bp, Homo sapiens
atttgattagctgtgtaatttt

SEQ ID NO: 7919962 - DNA, 22 bp, Homo sapiens
atttgattagctgtgtaatttt

SEQ ID NO: 7919963 - DNA, 22 bp, Homo sapiens
atttgattagctgtgtaatttt

SEQ ID NO: 7919964 - DNA, 22 bp, Homo sapiens
atttgatagtatgacagggcag

SEQ ID NO: 7919965 - DNA, 22 bp, Homo sapiens
atttgagcatataagtggccca

SEQ ID NO: 7919966 - DNA, 22 bp, Homo sapiens
atttgagcatataagtggccca

SEQ ID NO: 7919967 - DNA, 22 bp, Homo sapiens
atttgagcacctagataccctg

SEQ ID NO: 7919968 - DNA, 22 bp, Homo sapiens
atttgagcacctagataccctg

SEQ ID NO: 7919969 - DNA, 22 bp, Homo sapiens
atttgagcttggtagaggagag

SEQ ID NO: 7919970 - DNA, 22 bp, Homo sapiens
atttgagcttggtagaggagag

SEQ ID NO: 7919971 - DNA, 23 bp, Homo sapiens
atttgagaaagtatttttaagac

SEQ ID NO: 7919972 - DNA, 23 bp, Homo sapiens
atttgagaaagtatttttaagac

SEQ ID NO: 7919973 - DNA, 22 bp, Homo sapiens
atttgagatggtaaataacttt

SEQ ID NO: 7919974 - DNA, 22 bp, Homo sapiens
atttgagaaaggagggaacttt

SEQ ID NO: 7919975 - DNA, 22 bp, Homo sapiens
atttgagatggtaaataacttt

SEQ ID NO: 7919976 - DNA, 20 bp, Homo sapiens
atttgacttggagagagaaa

SEQ ID NO: 7919977 - DNA, 22 bp, Homo sapiens
atttgaccaggaaaggaggatg

SEQ ID NO: 7919978 - DNA, 22 bp, Homo sapiens
atttgacccgcctcagacccca

SEQ ID NO: 7919979 - DNA, 22 bp, Homo sapiens
atttgacattgacacacctatg

SEQ ID NO: 7919980 - DNA, 23 bp, Homo sapiens
atttgacagagcatagcatttct

SEQ ID NO: 7919981 - DNA, 22 bp, Homo sapiens
atttcttgattccaccagtgaa

SEQ ID NO: 7919982 - DNA, 22 bp, Homo sapiens
atttcttccttctcctagaaga

SEQ ID NO: 7919983 - DNA, 22 bp, Homo sapiens
atttcttccttctcctagaaga

SEQ ID NO: 7919984 - DNA, 22 bp, Homo sapiens
atttcttccttctcctagaaga

SEQ ID NO: 7919985 - DNA, 22 bp, Homo sapiens
atttgcaattactcatgtcatt

SEQ ID NO: 7919986 - DNA, 22 bp, Homo sapiens
atttgcaattactcatgtcatt

SEQ ID NO: 7919987 - DNA, 22 bp, Homo sapiens
atttgcaagcatgcacaaaagc

SEQ ID NO: 7919988 - DNA, 22 bp, Homo sapiens
atttgcaagcatgcacaaaagc

SEQ ID NO: 7919989 - DNA, 22 bp, Homo sapiens
atttgcaagcatgcacaaaagc

SEQ ID NO: 7919990 - DNA, 22 bp, Homo sapiens
atttgcaagcatgcacaaaagc

SEQ ID NO: 7919991 - DNA, 22 bp, Homo sapiens
atttgatttgtagatagtgtag

SEQ ID NO: 7919992 - DNA, 22 bp, Homo sapiens
atttgatttgtagatagtgtag

SEQ ID NO: 7919993 - DNA, 22 bp, Homo sapiens
atttgatttgtagatagtgtag

SEQ ID NO: 7919994 - DNA, 22 bp, Homo sapiens
atttgcaaaggttaacagcagt

SEQ ID NO: 7919995 - DNA, 22 bp, Homo sapiens
atttgcaaaggttaacagcagt

SEQ ID NO: 7919996 - DNA, 22 bp, Homo sapiens
atttgcataatagtgatttgta

SEQ ID NO: 7919997 - DNA, 22 bp, Homo sapiens
atttgcataaggatgctactgt

SEQ ID NO: 7919998 - DNA, 22 bp, Homo sapiens
atttgcagttattgttcatgaa

SEQ ID NO: 7919999 - DNA, 18 bp, Homo sapiens
atttgcaggcatgcaggc

SEQ ID NO: 7920000 - DNA, 22 bp, Homo sapiens
atttgcagagctctgaattttg

SEQ ID NO: 7920001 - DNA, 22 bp, Homo sapiens
atttgcagagctctgaattttg

SEQ ID NO: 7920002 - DNA, 22 bp, Homo sapiens
atttgcagaagggagggggacc

SEQ ID NO: 7920003 - DNA, 22 bp, Homo sapiens
atttgcagattctgtcaggttt

SEQ ID NO: 7920004 - DNA, 22 bp, Homo sapiens
atttgcagctaggatccaaagt

SEQ ID NO: 7920005 - DNA, 22 bp, Homo sapiens
atttgcagggaagggcagaagg

SEQ ID NO: 7920006 - DNA, 22 bp, Homo sapiens
gcccaggaggtggaggtgcagt

SEQ ID NO: 7920007 - DNA, 22 bp, Homo sapiens
gcccaggaggtggaggtgcagt

SEQ ID NO: 7920008 - DNA, 22 bp, Homo sapiens
gcccaggaggtggaggtgcagt

SEQ ID NO: 7920009 - DNA, 22 bp, Homo sapiens
gcccaggaggtggaggtgcagt

SEQ ID NO: 7920010 - DNA, 22 bp, Homo sapiens
gcccaggaggtggaggtgcagt

SEQ ID NO: 7920011 - DNA, 22 bp, Homo sapiens
gcccaggaggtggaggtgcagt

SEQ ID NO: 7920012 - DNA, 22 bp, Homo sapiens
gcccagcccctgggtggacgtg

SEQ ID NO: 7920013 - DNA, 22 bp, Homo sapiens
gcccagcccctgggtggacgtg

SEQ ID NO: 7920014 - DNA, 22 bp, Homo sapiens
gcccagcccctgggtggacgtg

SEQ ID NO: 7920015 - DNA, 22 bp, Homo sapiens
gcccagcccctgggtggacgtg

SEQ ID NO: 7920016 - DNA, 22 bp, Homo sapiens
gcccaggaggtcaagtagctat

SEQ ID NO: 7920017 - DNA, 22 bp, Homo sapiens
gcccaggaggtcaagtagctat

SEQ ID NO: 7920018 - DNA, 22 bp, Homo sapiens
gcccaggaggttgggctgtgca

SEQ ID NO: 7920019 - DNA, 22 bp, Homo sapiens
gcccaggaggttgggctgtgca

SEQ ID NO: 7920020 - DNA, 22 bp, Homo sapiens
gcccaggaggttgggctgtgca

SEQ ID NO: 7920021 - DNA, 22 bp, Homo sapiens
gcccaggaggttgggctgtgca

SEQ ID NO: 7920022 - DNA, 22 bp, Homo sapiens
gcccaggaggttgggctgtgca

SEQ ID NO: 7920023 - DNA, 22 bp, Homo sapiens
gcccaggagttcaaggctgcag

SEQ ID NO: 7920024 - DNA, 22 bp, Homo sapiens
gcccaggagttcaaggctgcag

SEQ ID NO: 7920025 - DNA, 22 bp, Homo sapiens
gcccaggagttcaagtctagtg

SEQ ID NO: 7920026 - DNA, 22 bp, Homo sapiens
gcccaggagttcaaggctgcag

SEQ ID NO: 7920027 - DNA, 22 bp, Homo sapiens
gcccaggagttcaaggctgcag

SEQ ID NO: 7920028 - DNA, 22 bp, Homo sapiens
gcccaggagttcaaggctgcag

SEQ ID NO: 7920029 - DNA, 22 bp, Homo sapiens
gcccaggagttcaaggctgcag

SEQ ID NO: 7920030 - DNA, 22 bp, Homo sapiens
gcccaggagttcaaggctgcag

SEQ ID NO: 7920031 - DNA, 21 bp, Homo sapiens
gccccctggactcctcatcca

SEQ ID NO: 7920032 - DNA, 21 bp, Homo sapiens
gccccctggactcctcatcca

SEQ ID NO: 7920033 - DNA, 21 bp, Homo sapiens
gccccctggactcctcatcca

SEQ ID NO: 7920034 - DNA, 22 bp, Homo sapiens
gcccccttgacctaatcacctt

SEQ ID NO: 7920035 - DNA, 22 bp, Homo sapiens
gcccaggagttgaagggctgac

SEQ ID NO: 7920036 - DNA, 22 bp, Homo sapiens
gcccaggagttgaagggctgac

SEQ ID NO: 7920037 - DNA, 22 bp, Homo sapiens
gcccaggagttcaagtctagtg

SEQ ID NO: 7920038 - DNA, 22 bp, Homo sapiens
gcccaggagttcaagtctagtg

SEQ ID NO: 7920039 - DNA, 22 bp, Homo sapiens
gcccaggagttcaagtctagtg

SEQ ID NO: 7920040 - DNA, 22 bp, Homo sapiens
gcccaggagttcaagtctagtg

SEQ ID NO: 7920041 - DNA, 22 bp, Homo sapiens
gcccaggagttcaagtctagtg

SEQ ID NO: 7920042 - DNA, 22 bp, Homo sapiens
gcccaggagttcaagtctagtg

SEQ ID NO: 7920043 - DNA, 22 bp, Homo sapiens
gcccaggagttgaagggctgac

SEQ ID NO: 7920044 - DNA, 22 bp, Homo sapiens
gcccaggagttgaagggctgac

SEQ ID NO: 7920045 - DNA, 22 bp, Homo sapiens
gccctccagctgttgcgcgtcg

SEQ ID NO: 7920046 - DNA, 22 bp, Homo sapiens
gccctccatgagacacagtgta

SEQ ID NO: 7920047 - DNA, 22 bp, Homo sapiens
gccctccatgagacacagtgta

SEQ ID NO: 7920048 - DNA, 22 bp, Homo sapiens
gccctccatgagacacagtgta

SEQ ID NO: 7920049 - DNA, 22 bp, Homo sapiens
gccctccatgagacacagtgta

SEQ ID NO: 7920050 - DNA, 22 bp, Homo sapiens
gccctccatgagacacagtgta

SEQ ID NO: 7920051 - DNA, 22 bp, Homo sapiens
gccctccaccagagcccttctc

SEQ ID NO: 7920052 - DNA, 22 bp, Homo sapiens
gcccctccatccatcaccgggg

SEQ ID NO: 7920053 - DNA, 22 bp, Homo sapiens
gccctccacctggtctctctgg

SEQ ID NO: 7920054 - DNA, 22 bp, Homo sapiens
gccctccacctggtctctctgg

SEQ ID NO: 7920055 - DNA, 22 bp, Homo sapiens
gccctccaccagagcccttctc

SEQ ID NO: 7920056 - DNA, 22 bp, Homo sapiens
gccctgccctctcggcactcgc

SEQ ID NO: 7920057 - DNA, 22 bp, Homo sapiens
gccctgccctctcggcactcgc

SEQ ID NO: 7920058 - DNA, 22 bp, Homo sapiens
gccctgccctctcggcactcgc

SEQ ID NO: 7920059 - DNA, 22 bp, Homo sapiens
gccctgccctctcggcactcgc

SEQ ID NO: 7920060 - DNA, 22 bp, Homo sapiens
gccctgccctctcggcactcgc

SEQ ID NO: 7920061 - DNA, 22 bp, Homo sapiens
gccctgccctgagccgtagacc

SEQ ID NO: 7920062 - DNA, 22 bp, Homo sapiens
gccctgccctgagccgtagacc

SEQ ID NO: 7920063 - DNA, 22 bp, Homo sapiens
gccctgcagtgcggaggtggca

SEQ ID NO: 7920064 - DNA, 19 bp, Homo sapiens
gccctgcaggaggtggggc

SEQ ID NO: 7920065 - DNA, 22 bp, Homo sapiens
gccctgcaccccaatggcatga

SEQ ID NO: 7920066 - DNA, 22 bp, Homo sapiens
gccctgcaccccaatggcatga

SEQ ID NO: 7920067 - DNA, 22 bp, Homo sapiens
gccctgccctgagccgtagacc

SEQ ID NO: 7920068 - DNA, 22 bp, Homo sapiens
gccctgccctgttgaaactaga

SEQ ID NO: 7920069 - DNA, 22 bp, Homo sapiens
gccctgccctgagccgtagacc

SEQ ID NO: 7920070 - DNA, 23 bp, Homo sapiens
gccctgcccttagcacactcaca

SEQ ID NO: 7920071 - DNA, 23 bp, Homo sapiens
gccctgcccttagcacactcaca

SEQ ID NO: 7920072 - DNA, 22 bp, Homo sapiens
gccctgccgggtattttgtgct

SEQ ID NO: 7920073 - DNA, 23 bp, Homo sapiens
gccctgcccttagcacactcaca

SEQ ID NO: 7920074 - DNA, 23 bp, Homo sapiens
gccctgcccttagcacactcaca

SEQ ID NO: 7920075 - DNA, 22 bp, Homo sapiens
gccctgcctgccggtgtgggtc

SEQ ID NO: 7920076 - DNA, 22 bp, Homo sapiens
atttcttccttctcctagaaga

SEQ ID NO: 7920077 - DNA, 22 bp, Homo sapiens
atttcttccttctcctagaaga

SEQ ID NO: 7920078 - DNA, 22 bp, Homo sapiens
gccctcccctctgggtggtgag

SEQ ID NO: 7920079 - DNA, 22 bp, Homo sapiens
gccctccatggtgatccaggcc

SEQ ID NO: 7920080 - DNA, 22 bp, Homo sapiens
gccctcccctctgggtggtgag

SEQ ID NO: 7920081 - DNA, 22 bp, Homo sapiens
gccctcccctctgggtggtgag

SEQ ID NO: 7920082 - DNA, 22 bp, Homo sapiens
gccctcccctctgggtggtgag

SEQ ID NO: 7920083 - DNA, 23 bp, Homo sapiens
gccctccctcccaggtgggtgtt

SEQ ID NO: 7920084 - DNA, 23 bp, Homo sapiens
gccctccctcccaggtgggtgtt

SEQ ID NO: 7920085 - DNA, 23 bp, Homo sapiens
gccctccctcccaggtgggtgtt

SEQ ID NO: 7920086 - DNA, 22 bp, Homo sapiens
gccctccctacagcctatttct

SEQ ID NO: 7920087 - DNA, 22 bp, Homo sapiens
gccctccctacagcctatttct

SEQ ID NO: 7920088 - DNA, 22 bp, Homo sapiens
gccctccctacagcctatttct

SEQ ID NO: 7920089 - DNA, 19 bp, Homo sapiens
gccctcctcactgagctct

SEQ ID NO: 7920090 - DNA, 19 bp, Homo sapiens
gccctcctcactgagctct

SEQ ID NO: 7920091 - DNA, 19 bp, Homo sapiens
gccctcctcactgagctct

SEQ ID NO: 7920092 - DNA, 19 bp, Homo sapiens
gccctcctcactgagctct

SEQ ID NO: 7920093 - DNA, 23 bp, Homo sapiens
gccctccctcccaggtgggtgtt

SEQ ID NO: 7920094 - DNA, 22 bp, Homo sapiens
gccctcctgcaggggcttctgg

SEQ ID NO: 7920095 - DNA, 22 bp, Homo sapiens
gccctcctgcaggggcttctgg

SEQ ID NO: 7920096 - DNA, 22 bp, Homo sapiens
gccctgagttgagccttccaaa

SEQ ID NO: 7920097 - DNA, 22 bp, Homo sapiens
gccctgagttgagccttccaaa

SEQ ID NO: 7920098 - DNA, 22 bp, Homo sapiens
atttaccagctgtgcactgata

SEQ ID NO: 7920099 - DNA, 22 bp, Homo sapiens
atttaccagctgtgcactgata

SEQ ID NO: 7920100 - DNA, 22 bp, Homo sapiens
atttaccagctgtgcactgata

SEQ ID NO: 7920101 - DNA, 22 bp, Homo sapiens
atttaccatatgtactgagtat

SEQ ID NO: 7920102 - DNA, 22 bp, Homo sapiens
atttaccatcctgtgaatggcc

SEQ ID NO: 7920103 - DNA, 22 bp, Homo sapiens
atttaccagtgctgacatttga

SEQ ID NO: 7920104 - DNA, 22 bp, Homo sapiens
atttaccagtgctgacatttga

SEQ ID NO: 7920105 - DNA, 22 bp, Homo sapiens
atttacatttatttgagaaggt

SEQ ID NO: 7920106 - DNA, 22 bp, Homo sapiens
atttacatttatttgagaaggt

SEQ ID NO: 7920107 - DNA, 22 bp, Homo sapiens
atttacatttatttgagaaggt

SEQ ID NO: 7920108 - DNA, 22 bp, Homo sapiens
atttacatttatttgagaaggt

SEQ ID NO: 7920109 - DNA, 17 bp, Homo sapiens
atttacattgtcaccga

SEQ ID NO: 7920110 - DNA, 22 bp, Homo sapiens
atttacatttatttgagaaggt

SEQ ID NO: 7920111 - DNA, 22 bp, Homo sapiens
atttacatttatttgagaaggt

SEQ ID NO: 7920112 - DNA, 17 bp, Homo sapiens
atttacattgtcaccga

SEQ ID NO: 7920113 - DNA, 17 bp, Homo sapiens
atttacattgtcaccga

SEQ ID NO: 7920114 - DNA, 22 bp, Homo sapiens
atttacatttatttgagaaggt

SEQ ID NO: 7920115 - DNA, 22 bp, Homo sapiens
atttactaatgtcatatcgcgt

SEQ ID NO: 7920116 - DNA, 18 bp, Homo sapiens
atttacccagcaacgtgg

SEQ ID NO: 7920117 - DNA, 22 bp, Homo sapiens
atttactaatgtcatatcgcgt

SEQ ID NO: 7920118 - DNA, 22 bp, Homo sapiens
atttactaatgtcatatcgcgt

SEQ ID NO: 7920119 - DNA, 18 bp, Homo sapiens
gccagagggaagcaggtg

SEQ ID NO: 7920120 - DNA, 18 bp, Homo sapiens
gccagagggaagcaggtg

SEQ ID NO: 7920121 - DNA, 18 bp, Homo sapiens
gccagagggaagcaggtg

SEQ ID NO: 7920122 - DNA, 18 bp, Homo sapiens
gccagagggaagcaggtg

SEQ ID NO: 7920123 - DNA, 18 bp, Homo sapiens
gccagagggaagcaggtg

SEQ ID NO: 7920124 - DNA, 18 bp, Homo sapiens
gccagagggaagcaggtg

SEQ ID NO: 7920125 - DNA, 18 bp, Homo sapiens
gccagagggaagcaggtg

SEQ ID NO: 7920126 - DNA, 18 bp, Homo sapiens
gccagagggaagcaggtg

SEQ ID NO: 7920127 - DNA, 18 bp, Homo sapiens
gccagagggaagcaggtg

SEQ ID NO: 7920128 - DNA, 18 bp, Homo sapiens
gccagagggaagcaggtg

SEQ ID NO: 7920129 - DNA, 22 bp, Homo sapiens
gccagagggattcctggtgtgt

SEQ ID NO: 7920130 - DNA, 22 bp, Homo sapiens
gccagagggattcctggtgtgt

SEQ ID NO: 7920131 - DNA, 22 bp, Homo sapiens
atttacataatagactttaggt

SEQ ID NO: 7920132 - DNA, 22 bp, Homo sapiens
atttacattccatggtggttac

SEQ ID NO: 7920133 - DNA, 17 bp, Homo sapiens
atttacattgtcaccga

SEQ ID NO: 7920134 - DNA, 22 bp, Homo sapiens
atttacataatagactttaggt

SEQ ID NO: 7920135 - DNA, 22 bp, Homo sapiens
atttacattccatggtggttac

SEQ ID NO: 7920136 - DNA, 22 bp, Homo sapiens
atttacattccatggtggttac

SEQ ID NO: 7920137 - DNA, 22 bp, Homo sapiens
atttacattccatggtggttac

SEQ ID NO: 7920138 - DNA, 22 bp, Homo sapiens
atttacataatagactttaggt

SEQ ID NO: 7920139 - DNA, 22 bp, Homo sapiens
atttacagtttagcatttcaag

SEQ ID NO: 7920140 - DNA, 22 bp, Homo sapiens
atttacataatagactttaggt

SEQ ID NO: 7920141 - DNA, 22 bp, Homo sapiens
atttacataatagactttaggt

SEQ ID NO: 7920142 - DNA, 22 bp, Homo sapiens
atttacataatagactttaggt

SEQ ID NO: 7920143 - DNA, 22 bp, Homo sapiens
atttacataatagactttaggt

SEQ ID NO: 7920144 - DNA, 23 bp, Homo sapiens
atttacaggttaaatgaaatcag

SEQ ID NO: 7920145 - DNA, 23 bp, Homo sapiens
atttacaggttaaatgaaatcag

SEQ ID NO: 7920146 - DNA, 23 bp, Homo sapiens
atttacaggttaaatgaaatcag

SEQ ID NO: 7920147 - DNA, 22 bp, Homo sapiens
atttacagtgtgcctactatat

SEQ ID NO: 7920148 - DNA, 22 bp, Homo sapiens
atttacagtgtgcctactatat

SEQ ID NO: 7920149 - DNA, 22 bp, Homo sapiens
atttacagtgtgcctactatat

SEQ ID NO: 7920150 - DNA, 22 bp, Homo sapiens
atttacagacgtggattagtgc

SEQ ID NO: 7920151 - DNA, 22 bp, Homo sapiens
atttacagacgtggattagtgc

SEQ ID NO: 7920152 - DNA, 22 bp, Homo sapiens
atttacagacgtggattagtgc

SEQ ID NO: 7920153 - DNA, 22 bp, Homo sapiens
atttacagacgtggattagtgc

SEQ ID NO: 7920154 - DNA, 22 bp, Homo sapiens
atttacagtttagcatttcaag

SEQ ID NO: 7920155 - DNA, 22 bp, Homo sapiens
atttacagtttagcatttcaag

SEQ ID NO: 7920156 - DNA, 22 bp, Homo sapiens
atttacagtttagcatttcaag

SEQ ID NO: 7920157 - DNA, 22 bp, Homo sapiens
atttacagtttagcatttcaag

SEQ ID NO: 7920158 - DNA, 22 bp, Homo sapiens
atttacagtttagcatttcaag

SEQ ID NO: 7920159 - DNA, 22 bp, Homo sapiens
atttacagtttagcatttcaag

SEQ ID NO: 7920160 - DNA, 22 bp, Homo sapiens
atttacagtgtgcctactatat

SEQ ID NO: 7920161 - DNA, 22 bp, Homo sapiens
atttacagaccctcccactaag

SEQ ID NO: 7920162 - DNA, 22 bp, Homo sapiens
gcccagcaggggatggcagctc

SEQ ID NO: 7920163 - DNA, 22 bp, Homo sapiens
gcccagcaggggatggcagctc

SEQ ID NO: 7920164 - DNA, 22 bp, Homo sapiens
gcccagcaggggatggcagctc

SEQ ID NO: 7920165 - DNA, 22 bp, Homo sapiens
gcccagccacagtcactttcat

SEQ ID NO: 7920166 - DNA, 22 bp, Homo sapiens
gcccagccacagtcactttcat

SEQ ID NO: 7920167 - DNA, 22 bp, Homo sapiens
gcccagccacagtcactttcat

SEQ ID NO: 7920168 - DNA, 22 bp, Homo sapiens
gcccagcaggacagagtggttt

SEQ ID NO: 7920169 - DNA, 22 bp, Homo sapiens
gcccagcaggacagagtggttt

SEQ ID NO: 7920170 - DNA, 22 bp, Homo sapiens
gcccagcaggacagagtggttt

SEQ ID NO: 7920171 - DNA, 22 bp, Homo sapiens
gcccagcaggacagagtggttt

SEQ ID NO: 7920172 - DNA, 22 bp, Homo sapiens
gcccagcaggggatggcagctc

SEQ ID NO: 7920173 - DNA, 22 bp, Homo sapiens
gcccagcaggggatggcagctc

SEQ ID NO: 7920174 - DNA, 22 bp, Homo sapiens
gcccagcaggggatggcagctc

SEQ ID NO: 7920175 - DNA, 22 bp, Homo sapiens
gcccagcaggggatggcagctc

SEQ ID NO: 7920176 - DNA, 22 bp, Homo sapiens
gcccagcccagaaaggttcgga

SEQ ID NO: 7920177 - DNA, 22 bp, Homo sapiens
gcccagccagagctgtgtgatg

SEQ ID NO: 7920178 - DNA, 22 bp, Homo sapiens
gcccagccagagctgtgtgatg

SEQ ID NO: 7920179 - DNA, 22 bp, Homo sapiens
gcccagcccagaaaggttcgga

SEQ ID NO: 7920180 - DNA, 22 bp, Homo sapiens
gcccagcccagaaaggttcgga

SEQ ID NO: 7920181 - DNA, 22 bp, Homo sapiens
gcccagcccctgggtggacgtg

SEQ ID NO: 7920182 - DNA, 22 bp, Homo sapiens
gcccagcccctgggtggacgtg

SEQ ID NO: 7920183 - DNA, 22 bp, Homo sapiens
gcccagccagagctgtgtgatg

SEQ ID NO: 7920184 - DNA, 22 bp, Homo sapiens
gcccagccagagctgtgtgatg

SEQ ID NO: 7920185 - DNA, 22 bp, Homo sapiens
gcccagccacagtcactttcat

SEQ ID NO: 7920186 - DNA, 22 bp, Homo sapiens
gcccagccacagtcactttcat

SEQ ID NO: 7920187 - DNA, 22 bp, Homo sapiens
gcccagccagagctgtgtgatg

SEQ ID NO: 7920188 - DNA, 18 bp, Homo sapiens
gccagagggcccaaggtc

SEQ ID NO: 7920189 - DNA, 18 bp, Homo sapiens
gccagagggcccaaggtc

SEQ ID NO: 7920190 - DNA, 22 bp, Homo sapiens
gccagagggattcctggtgtgt

SEQ ID NO: 7920191 - DNA, 18 bp, Homo sapiens
gccagagggcccaaggtc

SEQ ID NO: 7920192 - DNA, 18 bp, Homo sapiens
gccagagggcccaaggtc

SEQ ID NO: 7920193 - DNA, 18 bp, Homo sapiens
gccagagggcccaaggtc

SEQ ID NO: 7920194 - DNA, 18 bp, Homo sapiens
gccagaggtactactgat

SEQ ID NO: 7920195 - DNA, 22 bp, Homo sapiens
gccagaggggctcgaaggcgcg

SEQ ID NO: 7920196 - DNA, 22 bp, Homo sapiens
gccagaggggctcgaaggcgcg

SEQ ID NO: 7920197 - DNA, 22 bp, Homo sapiens
gccagaggggctcgaaggcgcg

SEQ ID NO: 7920198 - DNA, 22 bp, Homo sapiens
gccagaggggctcgaaggcgcg

SEQ ID NO: 7920199 - DNA, 20 bp, Homo sapiens
gcccactctaatccactgtc

SEQ ID NO: 7920200 - DNA, 22 bp, Homo sapiens
gcccactccagcttctcccaca

SEQ ID NO: 7920201 - DNA, 22 bp, Homo sapiens
gccagaggttcaacaactgtct

SEQ ID NO: 7920202 - DNA, 22 bp, Homo sapiens
gcccactccagcttctcccaca

SEQ ID NO: 7920203 - DNA, 22 bp, Homo sapiens
gccagaggtatcaaagatagta

SEQ ID NO: 7920204 - DNA, 22 bp, Homo sapiens
gccagaggtatcaaagatagta

SEQ ID NO: 7920205 - DNA, 22 bp, Homo sapiens
gccagaggtatcaaagatagta

SEQ ID NO: 7920206 - DNA, 18 bp, Homo sapiens
gccagaggtactactgat

SEQ ID NO: 7920207 - DNA, 18 bp, Homo sapiens
gccagaggtactactgat

SEQ ID NO: 7920208 - DNA, 18 bp, Homo sapiens
gccagaggtactactgat

SEQ ID NO: 7920209 - DNA, 22 bp, Homo sapiens
gccactggcgctgtgcagagtg

SEQ ID NO: 7920210 - DNA, 22 bp, Homo sapiens
gccactggcgctgtgcagagtg

SEQ ID NO: 7920211 - DNA, 22 bp, Homo sapiens
gccactggcgctgtgcagagtg

SEQ ID NO: 7920212 - DNA, 20 bp, Homo sapiens
gccactgggcaccagcaggg

SEQ ID NO: 7920213 - DNA, 20 bp, Homo sapiens
gccactgggcaccagcaggg

SEQ ID NO: 7920214 - DNA, 22 bp, Homo sapiens
gccactggcgctgtgcagagtg

SEQ ID NO: 7920215 - DNA, 22 bp, Homo sapiens
gccactggcgctgtgcagagtg

SEQ ID NO: 7920216 - DNA, 22 bp, Homo sapiens
gccactggcgctgtgcagagtg

SEQ ID NO: 7920217 - DNA, 20 bp, Homo sapiens
gccactgggcaccagcaggg

SEQ ID NO: 7920218 - DNA, 22 bp, Homo sapiens
gccactgtcataccctggcaat

SEQ ID NO: 7920219 - DNA, 22 bp, Homo sapiens
gccactgtagagtatggacaag

SEQ ID NO: 7920220 - DNA, 22 bp, Homo sapiens
gccactgtcatcttgtgaagca

SEQ ID NO: 7920221 - DNA, 22 bp, Homo sapiens
gccactgtcatcttgtgaagca

SEQ ID NO: 7920222 - DNA, 20 bp, Homo sapiens
attgtttcatttaatgtaca

SEQ ID NO: 7920223 - DNA, 22 bp, Homo sapiens
attgtttccccggaattattca

SEQ ID NO: 7920224 - DNA, 22 bp, Homo sapiens
attgtttccccggaattattca

SEQ ID NO: 7920225 - DNA, 22 bp, Homo sapiens
attgtttccccggaattattca

SEQ ID NO: 7920226 - DNA, 22 bp, Homo sapiens
gccactgtcctgtgcctgtgct

SEQ ID NO: 7920227 - DNA, 22 bp, Homo sapiens
gccactgtcctgtgcctgtgct

SEQ ID NO: 7920228 - DNA, 21 bp, Homo sapiens
gccactgtgcacactaaccca

SEQ ID NO: 7920229 - DNA, 20 bp, Homo sapiens
attgtttcatttaatgtaca

SEQ ID NO: 7920230 - DNA, 22 bp, Homo sapiens
attgttttaattccattgtgaa

SEQ ID NO: 7920231 - DNA, 22 bp, Homo sapiens
attgttttaattccattgtgaa

SEQ ID NO: 7920232 - DNA, 22 bp, Homo sapiens
attgttttaattccattgtgaa

SEQ ID NO: 7920233 - DNA, 22 bp, Homo sapiens
attgttttaattccattgtgaa

SEQ ID NO: 7920234 - DNA, 22 bp, Homo sapiens
attgttttaattccattgtgaa

SEQ ID NO: 7920235 - DNA, 22 bp, Homo sapiens
attgtttctgctttatttaggg

SEQ ID NO: 7920236 - DNA, 22 bp, Homo sapiens
attgttttattaaatgagccct

SEQ ID NO: 7920237 - DNA, 22 bp, Homo sapiens
attgttttattaaatgagccct

SEQ ID NO: 7920238 - DNA, 22 bp, Homo sapiens
atttaaatgcttaagagggttt

SEQ ID NO: 7920239 - DNA, 22 bp, Homo sapiens
atttaaatgcttaagagggttt

SEQ ID NO: 7920240 - DNA, 22 bp, Homo sapiens
atttacagaagcatgtaatagc

SEQ ID NO: 7920241 - DNA, 22 bp, Homo sapiens
atttaaattttctgatggagag

SEQ ID NO: 7920242 - DNA, 22 bp, Homo sapiens
atttaaattttctgatggagag

SEQ ID NO: 7920243 - DNA, 22 bp, Homo sapiens
atttaaattttctgatggagag

SEQ ID NO: 7920244 - DNA, 22 bp, Homo sapiens
atttaaatgcttaagagggttt

SEQ ID NO: 7920245 - DNA, 22 bp, Homo sapiens
atttaaatgcttaagagggttt

SEQ ID NO: 7920246 - DNA, 22 bp, Homo sapiens
atttaaatgcttaagagggttt

SEQ ID NO: 7920247 - DNA, 22 bp, Homo sapiens
atttaaatgcttaagagggttt

SEQ ID NO: 7920248 - DNA, 22 bp, Homo sapiens
atttaaatgcttaagagggttt

SEQ ID NO: 7920249 - DNA, 22 bp, Homo sapiens
atttaaatgcttaagagggttt

SEQ ID NO: 7920250 - DNA, 22 bp, Homo sapiens
atttaaatgcttaagagggttt

SEQ ID NO: 7920251 - DNA, 22 bp, Homo sapiens
attgttttgtttcccagtgact

SEQ ID NO: 7920252 - DNA, 22 bp, Homo sapiens
attgttttgtttcccagtgact

SEQ ID NO: 7920253 - DNA, 22 bp, Homo sapiens
attgttttgtttcccagtgact

SEQ ID NO: 7920254 - DNA, 23 bp, Homo sapiens
attgtttttggctctcagggaat

SEQ ID NO: 7920255 - DNA, 23 bp, Homo sapiens
attgtttttggctctcagggaat

SEQ ID NO: 7920256 - DNA, 23 bp, Homo sapiens
attgtttttggctctcagggaat

SEQ ID NO: 7920257 - DNA, 22 bp, Homo sapiens
attgttttccaaagatgctgct

SEQ ID NO: 7920258 - DNA, 22 bp, Homo sapiens
attgttttccaaagatgctgct

SEQ ID NO: 7920259 - DNA, 22 bp, Homo sapiens
attgttttgtagaatgaccctt

SEQ ID NO: 7920260 - DNA, 22 bp, Homo sapiens
attgttttgtagaatgaccctt

SEQ ID NO: 7920261 - DNA, 16 bp, Homo sapiens
attgttttcaattaga

SEQ ID NO: 7920262 - DNA, 16 bp, Homo sapiens
attgttttcaattaga

SEQ ID NO: 7920263 - DNA, 16 bp, Homo sapiens
attgttttcaattaga

SEQ ID NO: 7920264 - DNA, 22 bp, Homo sapiens
gcattcaggaaccggaagggta

SEQ ID NO: 7920265 - DNA, 22 bp, Homo sapiens
gcattcagggttcacggtcaac

SEQ ID NO: 7920266 - DNA, 22 bp, Homo sapiens
gcattcatatggaaggaaacta

SEQ ID NO: 7920267 - DNA, 22 bp, Homo sapiens
gcattcaggaaccggaagggta

SEQ ID NO: 7920268 - DNA, 22 bp, Homo sapiens
gcattcaggaaccggaagggta

SEQ ID NO: 7920269 - DNA, 22 bp, Homo sapiens
gcattcaggaaccggaagggta

SEQ ID NO: 7920270 - DNA, 22 bp, Homo sapiens
gcattcagcctaaagagaaaag

SEQ ID NO: 7920271 - DNA, 22 bp, Homo sapiens
gcattcatcaaaaatgttcctc

SEQ ID NO: 7920272 - DNA, 22 bp, Homo sapiens
gcattcatcttcatgaaagcac

SEQ ID NO: 7920273 - DNA, 22 bp, Homo sapiens
gcattcatcttcatgaaagcac

SEQ ID NO: 7920274 - DNA, 22 bp, Homo sapiens
gcattcatctagtatcactctg

SEQ ID NO: 7920275 - DNA, 22 bp, Homo sapiens
gcattcatatggaaggaaacta

SEQ ID NO: 7920276 - DNA, 22 bp, Homo sapiens
gcattccttgagttccctgtgc

SEQ ID NO: 7920277 - DNA, 22 bp, Homo sapiens
gcattccttggtttaaaacaag

SEQ ID NO: 7920278 - DNA, 22 bp, Homo sapiens
gcattccttggtttaaaacaag

SEQ ID NO: 7920279 - DNA, 22 bp, Homo sapiens
gccacagtcactgctgcagggg

SEQ ID NO: 7920280 - DNA, 22 bp, Homo sapiens
gcattccttgttagcatttgat

SEQ ID NO: 7920281 - DNA, 22 bp, Homo sapiens
gcattccttgttagcatttgat

SEQ ID NO: 7920282 - DNA, 22 bp, Homo sapiens
gcattcctgagaatgcagagtg

SEQ ID NO: 7920283 - DNA, 22 bp, Homo sapiens
gcattcctgtacctctctgcta

SEQ ID NO: 7920284 - DNA, 22 bp, Homo sapiens
gcattcctgtacctctctgcta

SEQ ID NO: 7920285 - DNA, 22 bp, Homo sapiens
gcattccttgagttccctgtgc

SEQ ID NO: 7920286 - DNA, 22 bp, Homo sapiens
gcattccttgagttccctgtgc

SEQ ID NO: 7920287 - DNA, 21 bp, Homo sapiens
gcattcctaggaggtaagcat

SEQ ID NO: 7920288 - DNA, 22 bp, Homo sapiens
gcattcctacaggctgctatga

SEQ ID NO: 7920289 - DNA, 22 bp, Homo sapiens
gcattcctacaggctgctatga

SEQ ID NO: 7920290 - DNA, 15 bp, Homo sapiens
gcattcctcatttcc

SEQ ID NO: 7920291 - DNA, 22 bp, Homo sapiens
gcattcctgagaatgcagagtg

SEQ ID NO: 7920292 - DNA, 21 bp, Homo sapiens
gcattcctaggaggtaagcat

SEQ ID NO: 7920293 - DNA, 15 bp, Homo sapiens
gcattcctcatttcc

SEQ ID NO: 7920294 - DNA, 22 bp, Homo sapiens
gcattcatgcctgtgtgagctc

SEQ ID NO: 7920295 - DNA, 22 bp, Homo sapiens
gcattcattcattcattaggta

SEQ ID NO: 7920296 - DNA, 22 bp, Homo sapiens
gcattcattcaggctcccaggg

SEQ ID NO: 7920297 - DNA, 22 bp, Homo sapiens
gccacagtcaggacggggagag

SEQ ID NO: 7920298 - DNA, 22 bp, Homo sapiens
gccacagtcaggacggggagag

SEQ ID NO: 7920299 - DNA, 22 bp, Homo sapiens
gccacagtgggctggggccaga

SEQ ID NO: 7920300 - DNA, 20 bp, Homo sapiens
gccacagttttctcactgca

SEQ ID NO: 7920301 - DNA, 22 bp, Homo sapiens
gccacagtgggctggggccaga

SEQ ID NO: 7920302 - DNA, 22 bp, Homo sapiens
gccacagtgggctggggccaga

SEQ ID NO: 7920303 - DNA, 20 bp, Homo sapiens
gccacagttttctcactgca

SEQ ID NO: 7920304 - DNA, 22 bp, Homo sapiens
gccactgagcccggccattgtt

SEQ ID NO: 7920305 - DNA, 22 bp, Homo sapiens
gccactcacatgtaccagatgc

SEQ ID NO: 7920306 - DNA, 22 bp, Homo sapiens
gccactcatgggaggtgtgcaa

SEQ ID NO: 7920307 - DNA, 22 bp, Homo sapiens
gccactgcactccagcccaggc

SEQ ID NO: 7920308 - DNA, 21 bp, Homo sapiens
gccactgcactccagcctggg

SEQ ID NO: 7920309 - DNA, 21 bp, Homo sapiens
gccactgcactccagcctggg

SEQ ID NO: 7920310 - DNA, 21 bp, Homo sapiens
gccactgcactccagcctggg

SEQ ID NO: 7920311 - DNA, 22 bp, Homo sapiens
gccactggacccagggttatca

SEQ ID NO: 7920312 - DNA, 22 bp, Homo sapiens
gccactggagacagtggggaag

SEQ ID NO: 7920313 - DNA, 22 bp, Homo sapiens
gccactggcatctagttggtag

SEQ ID NO: 7920314 - DNA, 22 bp, Homo sapiens
gccactggagacagtggggaag

SEQ ID NO: 7920315 - DNA, 22 bp, Homo sapiens
gccactggagacagtggggaag

SEQ ID NO: 7920316 - DNA, 22 bp, Homo sapiens
gccactggacccagaaagggaa

SEQ ID NO: 7920317 - DNA, 21 bp, Homo sapiens
gccactgcactccagcctggg

SEQ ID NO: 7920318 - DNA, 21 bp, Homo sapiens
gccactgcactccagcctggg

SEQ ID NO: 7920319 - DNA, 22 bp, Homo sapiens
gcattcacattgtggttgcacg

SEQ ID NO: 7920320 - DNA, 22 bp, Homo sapiens
gcattagatttgcctttgaagc

SEQ ID NO: 7920321 - DNA, 22 bp, Homo sapiens
gcattagatatccttgaagtta

SEQ ID NO: 7920322 - DNA, 20 bp, Homo sapiens
gcattagagtactatatgct

SEQ ID NO: 7920323 - DNA, 22 bp, Homo sapiens
gcattagagcccatcacctgta

SEQ ID NO: 7920324 - DNA, 22 bp, Homo sapiens
attgttgggtagtttgttcagc

SEQ ID NO: 7920325 - DNA, 22 bp, Homo sapiens
attgttgatcttctggtaagcc

SEQ ID NO: 7920326 - DNA, 22 bp, Homo sapiens
attgttgggtctcactcctaga

SEQ ID NO: 7920327 - DNA, 22 bp, Homo sapiens
attgtttacactaacttcataa

SEQ ID NO: 7920328 - DNA, 22 bp, Homo sapiens
attgttgagtgcttcagctgta

SEQ ID NO: 7920329 - DNA, 22 bp, Homo sapiens
attgttgaggcagttcatcttg

SEQ ID NO: 7920330 - DNA, 22 bp, Homo sapiens
attgttgaggagactcttcaat

SEQ ID NO: 7920331 - DNA, 22 bp, Homo sapiens
attgttctgtagtgacatgtag

SEQ ID NO: 7920332 - DNA, 22 bp, Homo sapiens
attgttctgtagtgacatgtag

SEQ ID NO: 7920333 - DNA, 22 bp, Homo sapiens
attgttctgtagtgacatgtag

SEQ ID NO: 7920334 - DNA, 22 bp, Homo sapiens
attgttctgtagtgacatgtag

SEQ ID NO: 7920335 - DNA, 22 bp, Homo sapiens
attgttctggatatttacattg

SEQ ID NO: 7920336 - DNA, 22 bp, Homo sapiens
attgttccacttccttgtttgc

SEQ ID NO: 7920337 - DNA, 22 bp, Homo sapiens
attgttccctactgttcaactg

SEQ ID NO: 7920338 - DNA, 22 bp, Homo sapiens
attgttcctggaaaagaacagg

SEQ ID NO: 7920339 - DNA, 22 bp, Homo sapiens
attgttccttagaaccatgcct

SEQ ID NO: 7920340 - DNA, 22 bp, Homo sapiens
attgttctaagggtttaattaa

SEQ ID NO: 7920341 - DNA, 22 bp, Homo sapiens
attgttctaagggtttaattaa

SEQ ID NO: 7920342 - DNA, 21 bp, Homo sapiens
attgttctggaggaaaggatt

SEQ ID NO: 7920343 - DNA, 22 bp, Homo sapiens
attgttctggatatttacattg

SEQ ID NO: 7920344 - DNA, 22 bp, Homo sapiens
attgttctggatatttacattg

SEQ ID NO: 7920345 - DNA, 22 bp, Homo sapiens
attgttctggatatttacattg

SEQ ID NO: 7920346 - DNA, 22 bp, Homo sapiens
attgttcaatgtaataattttg

SEQ ID NO: 7920347 - DNA, 22 bp, Homo sapiens
attgttcaatgtaataattttg

SEQ ID NO: 7920348 - DNA, 22 bp, Homo sapiens
attgttcaaagtgctttgcatg

SEQ ID NO: 7920349 - DNA, 22 bp, Homo sapiens
attgttcaaagtgctttgcatg

SEQ ID NO: 7920350 - DNA, 22 bp, Homo sapiens
attgttcaatgtaataattttg

SEQ ID NO: 7920351 - DNA, 22 bp, Homo sapiens
attgttcaaagtgctttgcatg

SEQ ID NO: 7920352 - DNA, 22 bp, Homo sapiens
attgttagttagtgtggggaga

SEQ ID NO: 7920353 - DNA, 21 bp, Homo sapiens
attgttatcattgtgctgtgt

SEQ ID NO: 7920354 - DNA, 22 bp, Homo sapiens
attgttatgaaaataagatgtt

SEQ ID NO: 7920355 - DNA, 22 bp, Homo sapiens
attgttatgaaaataagatgtt

SEQ ID NO: 7920356 - DNA, 22 bp, Homo sapiens
attgttatgaaaataagatgtt

SEQ ID NO: 7920357 - DNA, 22 bp, Homo sapiens
attgttatgaaaataagatgtt

SEQ ID NO: 7920358 - DNA, 22 bp, Homo sapiens
attgttcattgtacacctagta

SEQ ID NO: 7920359 - DNA, 22 bp, Homo sapiens
attgttccacttccttgtttgc

SEQ ID NO: 7920360 - DNA, 22 bp, Homo sapiens
attgttcattgtacacctagta

SEQ ID NO: 7920361 - DNA, 22 bp, Homo sapiens
attgttcattgtacacctagta

SEQ ID NO: 7920362 - DNA, 22 bp, Homo sapiens
attgttcatgtatgaataaata

SEQ ID NO: 7920363 - DNA, 22 bp, Homo sapiens
attgttcagagtagggctctgt

SEQ ID NO: 7920364 - DNA, 22 bp, Homo sapiens
attgttcagagtagggctctgt

SEQ ID NO: 7920365 - DNA, 22 bp, Homo sapiens
attgttcactgtgaatcttgat

SEQ ID NO: 7920366 - DNA, 22 bp, Homo sapiens
attgttcactgtgaatcttgat

SEQ ID NO: 7920367 - DNA, 22 bp, Homo sapiens
attgttcactgtgaatcttgat

SEQ ID NO: 7920368 - DNA, 22 bp, Homo sapiens
attgttcaatgtaataattttg

SEQ ID NO: 7920369 - DNA, 22 bp, Homo sapiens
attgttcactgtgaatcttgat

SEQ ID NO: 7920370 - DNA, 22 bp, Homo sapiens
attgtgcagctctgctcttatt

SEQ ID NO: 7920371 - DNA, 22 bp, Homo sapiens
attgtgcagcacagatcatgac

SEQ ID NO: 7920372 - DNA, 20 bp, Homo sapiens
gcagtgctggtgcctctgct

SEQ ID NO: 7920373 - DNA, 22 bp, Homo sapiens
attgttaatgttgcactaaggt

SEQ ID NO: 7920374 - DNA, 22 bp, Homo sapiens
attgttaatgttgcactaaggt

SEQ ID NO: 7920375 - DNA, 21 bp, Homo sapiens
attgttatcattgtgctgtgt

SEQ ID NO: 7920376 - DNA, 22 bp, Homo sapiens
gcagtgctgagaggtgatcgga

SEQ ID NO: 7920377 - DNA, 22 bp, Homo sapiens
gcagtgctagcctcacagggtc

SEQ ID NO: 7920378 - DNA, 22 bp, Homo sapiens
gcagtgctctgcctataatgga

SEQ ID NO: 7920379 - DNA, 22 bp, Homo sapiens
gcagtgccttgcttctctgtct

SEQ ID NO: 7920380 - DNA, 18 bp, Homo sapiens
gcagtgccagcctctcct

SEQ ID NO: 7920381 - DNA, 18 bp, Homo sapiens
gcagtgccagcctctcct

SEQ ID NO: 7920382 - DNA, 22 bp, Homo sapiens
gcagtgccgaaggtagtggttg

SEQ ID NO: 7920383 - DNA, 22 bp, Homo sapiens
gcagtgccgaaggtagtggttg

SEQ ID NO: 7920384 - DNA, 22 bp, Homo sapiens
gcagtgcaggacaaatcagtgc

SEQ ID NO: 7920385 - DNA, 22 bp, Homo sapiens
gcagtgcagtgggacagggcgc

SEQ ID NO: 7920386 - DNA, 22 bp, Homo sapiens
gcagtgcagtgggacagggcgc

SEQ ID NO: 7920387 - DNA, 18 bp, Homo sapiens
gcagtgcaggaagaagag

SEQ ID NO: 7920388 - DNA, 22 bp, Homo sapiens
gcagtgcaggaacatagcttct

SEQ ID NO: 7920389 - DNA, 18 bp, Homo sapiens
gcagtgcaggaagaagag

SEQ ID NO: 7920390 - DNA, 22 bp, Homo sapiens
gcagtgcattactcacatgttt

SEQ ID NO: 7920391 - DNA, 22 bp, Homo sapiens
gcagtgcagtgggacagggcgc

SEQ ID NO: 7920392 - DNA, 22 bp, Homo sapiens
gcagtgcatgtcggaactcatt

SEQ ID NO: 7920393 - DNA, 22 bp, Homo sapiens
gcagtgcattactcacatgttt

SEQ ID NO: 7920394 - DNA, 22 bp, Homo sapiens
gcagtgcattactcacatgttt

SEQ ID NO: 7920395 - DNA, 22 bp, Homo sapiens
gcagtgccacaagatgggagga

SEQ ID NO: 7920396 - DNA, 22 bp, Homo sapiens
gcagtgccacaagatgggagga

SEQ ID NO: 7920397 - DNA, 22 bp, Homo sapiens
gcagtgccacaagatgggagga

SEQ ID NO: 7920398 - DNA, 22 bp, Homo sapiens
attgtacaatgctgaggtttgg

SEQ ID NO: 7920399 - DNA, 22 bp, Homo sapiens
attgtacaatgctgaggtttgg

SEQ ID NO: 7920400 - DNA, 22 bp, Homo sapiens
attgtacactagtggcagcagt

SEQ ID NO: 7920401 - DNA, 22 bp, Homo sapiens
attgtacactagtggcagcagt

SEQ ID NO: 7920402 - DNA, 22 bp, Homo sapiens
attgtacaatgcctggaacatt

SEQ ID NO: 7920403 - DNA, 22 bp, Homo sapiens
attgtacaatgcctggaacatt

SEQ ID NO: 7920404 - DNA, 22 bp, Homo sapiens
attgtacaatgcctggaacatt

SEQ ID NO: 7920405 - DNA, 22 bp, Homo sapiens
attgtacaatgctgaggtttgg

SEQ ID NO: 7920406 - DNA, 22 bp, Homo sapiens
attgtacactagtggcagcagt

SEQ ID NO: 7920407 - DNA, 21 bp, Homo sapiens
gcagtgcagcttggagggtag

SEQ ID NO: 7920408 - DNA, 21 bp, Homo sapiens
gcagtgcagcttggagggtag

SEQ ID NO: 7920409 - DNA, 21 bp, Homo sapiens
gcagtgcagcttggagggtag

SEQ ID NO: 7920410 - DNA, 21 bp, Homo sapiens
gcagtgcagcttggagggtag

SEQ ID NO: 7920411 - DNA, 22 bp, Homo sapiens
attgtaacatgttcagatcact

SEQ ID NO: 7920412 - DNA, 22 bp, Homo sapiens
attgtaagtagaaatgttatgg

SEQ ID NO: 7920413 - DNA, 22 bp, Homo sapiens
attgtaagaggtttggctgtgt

SEQ ID NO: 7920414 - DNA, 22 bp, Homo sapiens
attgtaagtagaaatgttatgg

SEQ ID NO: 7920415 - DNA, 22 bp, Homo sapiens
attgtacaaaaaagtagacctt

SEQ ID NO: 7920416 - DNA, 22 bp, Homo sapiens
attgtacaaaaaagtagacctt

SEQ ID NO: 7920417 - DNA, 22 bp, Homo sapiens
attgtacaactgagggtggaat

SEQ ID NO: 7920418 - DNA, 22 bp, Homo sapiens
attgtacaaaaaagtagacctt

SEQ ID NO: 7920419 - DNA, 22 bp, Homo sapiens
attgtacaactgagggtggaat

SEQ ID NO: 7920420 - DNA, 22 bp, Homo sapiens
attgtacaagtttggttattta

SEQ ID NO: 7920421 - DNA, 22 bp, Homo sapiens
attgtacaatgcctggaacatt

SEQ ID NO: 7920422 - DNA, 22 bp, Homo sapiens
attgtacaatgcctggaacatt

SEQ ID NO: 7920423 - DNA, 22 bp, Homo sapiens
attgtacaagtttggttattta

SEQ ID NO: 7920424 - DNA, 22 bp, Homo sapiens
attgtacaatgcctggaacatt

SEQ ID NO: 7920425 - DNA, 22 bp, Homo sapiens
attgtaaaagtattctaagatt

SEQ ID NO: 7920426 - DNA, 22 bp, Homo sapiens
attgtaaaagtattctaagatt

SEQ ID NO: 7920427 - DNA, 22 bp, Homo sapiens
attgtaaaagtattctaagatt

SEQ ID NO: 7920428 - DNA, 22 bp, Homo sapiens
attgtaaaagtattctaagatt

SEQ ID NO: 7920429 - DNA, 22 bp, Homo sapiens
attgtaaaagtattctaagatt

SEQ ID NO: 7920430 - DNA, 22 bp, Homo sapiens
attgtaaaagtattctaagatt

SEQ ID NO: 7920431 - DNA, 22 bp, Homo sapiens
attgtaaatagtgccacaataa

SEQ ID NO: 7920432 - DNA, 22 bp, Homo sapiens
attgtaaatagtgccacaataa

SEQ ID NO: 7920433 - DNA, 22 bp, Homo sapiens
attgtaaatagtgccacaataa

SEQ ID NO: 7920434 - DNA, 22 bp, Homo sapiens
attgtaaatagtgccacaataa

SEQ ID NO: 7920435 - DNA, 22 bp, Homo sapiens
attgtaaagtactgtgtacaat

SEQ ID NO: 7920436 - DNA, 22 bp, Homo sapiens
attgtaaagtactgtgtacaat

SEQ ID NO: 7920437 - DNA, 22 bp, Homo sapiens
attgtaaatagtgccacaataa

SEQ ID NO: 7920438 - DNA, 22 bp, Homo sapiens
attggttaactctgtgtgtcaa

SEQ ID NO: 7920439 - DNA, 22 bp, Homo sapiens
attggtgtgccacaactagttt

SEQ ID NO: 7920440 - DNA, 22 bp, Homo sapiens
attggtgtgccacaactagttt

SEQ ID NO: 7920441 - DNA, 22 bp, Homo sapiens
attggttactcaatttgactga

SEQ ID NO: 7920442 - DNA, 22 bp, Homo sapiens
attggtgtgccacaactagttt

SEQ ID NO: 7920443 - DNA, 14 bp, Homo sapiens
gcaggtggatcact

SEQ ID NO: 7920444 - DNA, 15 bp, Homo sapiens
gcaggtggatcactt

SEQ ID NO: 7920445 - DNA, 22 bp, Homo sapiens
attggcaggaaccgaggagggg

SEQ ID NO: 7920446 - DNA, 22 bp, Homo sapiens
attggcagggccagcatctccc

SEQ ID NO: 7920447 - DNA, 22 bp, Homo sapiens
attggcagggccagcatctccc

SEQ ID NO: 7920448 - DNA, 22 bp, Homo sapiens
attggcagggccagcatctccc

SEQ ID NO: 7920449 - DNA, 22 bp, Homo sapiens
attggcagttagtgacgaggct

SEQ ID NO: 7920450 - DNA, 22 bp, Homo sapiens
gcaggtggatcacctgaggtca

SEQ ID NO: 7920451 - DNA, 22 bp, Homo sapiens
gcaggtggatcacctgaggtca

SEQ ID NO: 7920452 - DNA, 22 bp, Homo sapiens
gcaggtggatcacctgaggtca

SEQ ID NO: 7920453 - DNA, 22 bp, Homo sapiens
gcaggtggatcacctgaggtca

SEQ ID NO: 7920454 - DNA, 16 bp, Homo sapiens
gcaggtggatcacctg

SEQ ID NO: 7920455 - DNA, 22 bp, Homo sapiens
gcaggtggatcacctgaggtca

SEQ ID NO: 7920456 - DNA, 22 bp, Homo sapiens
gcaggtggatcacctgaggtca

SEQ ID NO: 7920457 - DNA, 22 bp, Homo sapiens
gcaggtggatcacctgaggtca

SEQ ID NO: 7920458 - DNA, 22 bp, Homo sapiens
gcaggtggagcagtagtctggt

SEQ ID NO: 7920459 - DNA, 22 bp, Homo sapiens
gcagggtgaaggtcacatagaa

SEQ ID NO: 7920460 - DNA, 22 bp, Homo sapiens
gcaggtggatattgctacttga

SEQ ID NO: 7920461 - DNA, 22 bp, Homo sapiens
gcaggtggatattgctacttga

SEQ ID NO: 7920462 - DNA, 22 bp, Homo sapiens
gcaggtggatcaccacgtcagg

SEQ ID NO: 7920463 - DNA, 22 bp, Homo sapiens
gcaggtggatcaccacgtcagg

SEQ ID NO: 7920464 - DNA, 22 bp, Homo sapiens
gcaggtggatcaccacgtcagg

SEQ ID NO: 7920465 - DNA, 22 bp, Homo sapiens
gcaggtggatcaccacgtcagg

SEQ ID NO: 7920466 - DNA, 14 bp, Homo sapiens
gcaggtggatcacc

SEQ ID NO: 7920467 - DNA, 22 bp, Homo sapiens
gcaggtggatcaccacgtcagg

SEQ ID NO: 7920468 - DNA, 22 bp, Homo sapiens
gcaggtggatattgctacttga

SEQ ID NO: 7920469 - DNA, 22 bp, Homo sapiens
gcagggattgtcaatgctgctc

SEQ ID NO: 7920470 - DNA, 22 bp, Homo sapiens
gcagggatgctgaggctcagtg

SEQ ID NO: 7920471 - DNA, 22 bp, Homo sapiens
gcagggatgctgaggctcagtg

SEQ ID NO: 7920472 - DNA, 22 bp, Homo sapiens
gcagggattgtgcagggggcta

SEQ ID NO: 7920473 - DNA, 22 bp, Homo sapiens
gcagggattgtgcagggggcta

SEQ ID NO: 7920474 - DNA, 22 bp, Homo sapiens
gcagggatgctgaggctcagtg

SEQ ID NO: 7920475 - DNA, 22 bp, Homo sapiens
gcagggatgctgaggctcagtg

SEQ ID NO: 7920476 - DNA, 22 bp, Homo sapiens
gcagggaggtttgctgacctgg

SEQ ID NO: 7920477 - DNA, 22 bp, Homo sapiens
gcagggaggtttgctgacctgg

SEQ ID NO: 7920478 - DNA, 22 bp, Homo sapiens
gcagggaggtttgctgacctgg

SEQ ID NO: 7920479 - DNA, 22 bp, Homo sapiens
gcagggaggtttgctgacctgg

SEQ ID NO: 7920480 - DNA, 22 bp, Homo sapiens
gcagggctgggatttgagccca

SEQ ID NO: 7920481 - DNA, 22 bp, Homo sapiens
gcagggctgggatttgagccca

SEQ ID NO: 7920482 - DNA, 22 bp, Homo sapiens
gcagggctggggctgctcctga

SEQ ID NO: 7920483 - DNA, 22 bp, Homo sapiens
gcaggggtagagattgctggtg

SEQ ID NO: 7920484 - DNA, 22 bp, Homo sapiens
gcaggggtagagattgctggtg

SEQ ID NO: 7920485 - DNA, 16 bp, Homo sapiens
gcaggggtgggtggag

SEQ ID NO: 7920486 - DNA, 16 bp, Homo sapiens
gcaggggtgggtggag

SEQ ID NO: 7920487 - DNA, 22 bp, Homo sapiens
gcaggggtggaggctgtcctgt

SEQ ID NO: 7920488 - DNA, 22 bp, Homo sapiens
gcaggggtagtgtcttcctgag

SEQ ID NO: 7920489 - DNA, 22 bp, Homo sapiens
gcaggggtagtgtcttcctgag

SEQ ID NO: 7920490 - DNA, 22 bp, Homo sapiens
gcaggggtagtgtcttcctgag

SEQ ID NO: 7920491 - DNA, 22 bp, Homo sapiens
gcaggggtggaggctgtcctgt

SEQ ID NO: 7920492 - DNA, 22 bp, Homo sapiens
gcagggtctgaggccacagagg

SEQ ID NO: 7920493 - DNA, 21 bp, Homo sapiens
gcagggtcctttccattccta

SEQ ID NO: 7920494 - DNA, 22 bp, Homo sapiens
gcagggtcgctctaggagatca

SEQ ID NO: 7920495 - DNA, 22 bp, Homo sapiens
gcagggtcttgagaggcagcca

SEQ ID NO: 7920496 - DNA, 22 bp, Homo sapiens
gcagggtctgaggccacagagg

SEQ ID NO: 7920497 - DNA, 22 bp, Homo sapiens
gcagggtgaaggtcacatagaa

SEQ ID NO: 7920498 - DNA, 22 bp, Homo sapiens
gcagggtacattgggatgggat

SEQ ID NO: 7920499 - DNA, 22 bp, Homo sapiens
gcagggtacattgggatgggat

SEQ ID NO: 7920500 - DNA, 22 bp, Homo sapiens
gcagggtacattgggatgggat

SEQ ID NO: 7920501 - DNA, 22 bp, Homo sapiens
gcagggtaggtgacaggtagtc

SEQ ID NO: 7920502 - DNA, 22 bp, Homo sapiens
gcagggtaggtgacaggtagtc

SEQ ID NO: 7920503 - DNA, 21 bp, Homo sapiens
gcagggtcctttccattccta

SEQ ID NO: 7920504 - DNA, 22 bp, Homo sapiens
gcagggtccatggaggcagccc

SEQ ID NO: 7920505 - DNA, 22 bp, Homo sapiens
gcagggaggaagagatgcttcc

SEQ ID NO: 7920506 - DNA, 22 bp, Homo sapiens
gcagggaggaagagatgcttcc

SEQ ID NO: 7920507 - DNA, 22 bp, Homo sapiens
gcagggaggaagagatgcttcc

SEQ ID NO: 7920508 - DNA, 22 bp, Homo sapiens
gcagggactttggcaacaggtg

SEQ ID NO: 7920509 - DNA, 22 bp, Homo sapiens
gcagggaggaagagatgcttcc

SEQ ID NO: 7920510 - DNA, 22 bp, Homo sapiens
gcagggaggaagagatgcttcc

SEQ ID NO: 7920511 - DNA, 22 bp, Homo sapiens
gcagggagggcctttcatgaca

SEQ ID NO: 7920512 - DNA, 22 bp, Homo sapiens
gcagggagggcctttcatgaca

SEQ ID NO: 7920513 - DNA, 22 bp, Homo sapiens
gcagggaggaagagatgcttcc

SEQ ID NO: 7920514 - DNA, 22 bp, Homo sapiens
gcagggaggaagagatgcttcc

SEQ ID NO: 7920515 - DNA, 22 bp, Homo sapiens
gcagggagggcctttcatgaca

SEQ ID NO: 7920516 - DNA, 22 bp, Homo sapiens
gcagggagggcctttcatgaca

SEQ ID NO: 7920517 - DNA, 22 bp, Homo sapiens
gcagggactttggcaacaggtg

SEQ ID NO: 7920518 - DNA, 22 bp, Homo sapiens
gcagggactgtgatctcacaga

SEQ ID NO: 7920519 - DNA, 22 bp, Homo sapiens
gcagggactgtgatctcacaga

SEQ ID NO: 7920520 - DNA, 22 bp, Homo sapiens
gcagggacgccagggacagcaa

SEQ ID NO: 7920521 - DNA, 22 bp, Homo sapiens
gcagggacgccagggacagcaa

SEQ ID NO: 7920522 - DNA, 22 bp, Homo sapiens
gcaggctgtggtatgttgggca

SEQ ID NO: 7920523 - DNA, 22 bp, Homo sapiens
gcaggctgtggtatgttgggca

SEQ ID NO: 7920524 - DNA, 22 bp, Homo sapiens
gcaggctgtggtatgttgggca

SEQ ID NO: 7920525 - DNA, 22 bp, Homo sapiens
gcaggctgtggtatgttgggca

SEQ ID NO: 7920526 - DNA, 22 bp, Homo sapiens
gcaggctgtggtatgttgggca

SEQ ID NO: 7920527 - DNA, 22 bp, Homo sapiens
gcaggctgtggtatgttgggca

SEQ ID NO: 7920528 - DNA, 22 bp, Homo sapiens
gcaggctgtgaggctcagatgg

SEQ ID NO: 7920529 - DNA, 22 bp, Homo sapiens
gcaggctgtgaggctcagatgg

SEQ ID NO: 7920530 - DNA, 22 bp, Homo sapiens
gcaggctgtgaggctcagatgg

SEQ ID NO: 7920531 - DNA, 22 bp, Homo sapiens
gcaggctgtctaaagttagagt

SEQ ID NO: 7920532 - DNA, 22 bp, Homo sapiens
gcaggctgtctaaagttagagt

SEQ ID NO: 7920533 - DNA, 22 bp, Homo sapiens
gcaggctgtgaggctcagatgg

SEQ ID NO: 7920534 - DNA, 22 bp, Homo sapiens
gcaggctgtgaggctcagatgg

SEQ ID NO: 7920535 - DNA, 22 bp, Homo sapiens
gcaggctgtgaggctcagatgg

SEQ ID NO: 7920536 - DNA, 22 bp, Homo sapiens
gcaggctgtgaggctcagatgg

SEQ ID NO: 7920537 - DNA, 22 bp, Homo sapiens
gcaggctgtggtatgttgggca

SEQ ID NO: 7920538 - DNA, 22 bp, Homo sapiens
gcaggctgtggtatgttgggca

SEQ ID NO: 7920539 - DNA, 22 bp, Homo sapiens
gcaggctgtctaaagttagagt

SEQ ID NO: 7920540 - DNA, 22 bp, Homo sapiens
gcaggctgtctaaagttagagt

SEQ ID NO: 7920541 - DNA, 22 bp, Homo sapiens
gcaggctgtctaaagttagagt

SEQ ID NO: 7920542 - DNA, 22 bp, Homo sapiens
gcaggctgtctaaagttagagt

SEQ ID NO: 7920543 - DNA, 22 bp, Homo sapiens
gcaggctgtagacaccaaacta

SEQ ID NO: 7920544 - DNA, 22 bp, Homo sapiens
gcaggctgtagacaccaaacta

SEQ ID NO: 7920545 - DNA, 22 bp, Homo sapiens
gcaggctgtagacaccaaacta

SEQ ID NO: 7920546 - DNA, 22 bp, Homo sapiens
gcaggctggtctgaccatccct

SEQ ID NO: 7920547 - DNA, 14 bp, Homo sapiens
gcaggcggatcact

SEQ ID NO: 7920548 - DNA, 14 bp, Homo sapiens
gcaggcggatcact

SEQ ID NO: 7920549 - DNA, 22 bp, Homo sapiens
gcaggcggaggttgcagtgagc

SEQ ID NO: 7920550 - DNA, 22 bp, Homo sapiens
gcaggatggtggaaggcctgct

SEQ ID NO: 7920551 - DNA, 22 bp, Homo sapiens
gcaggatggtggaaggcctgct

SEQ ID NO: 7920552 - DNA, 14 bp, Homo sapiens
gcaggcggatcact

SEQ ID NO: 7920553 - DNA, 22 bp, Homo sapiens
gcaggatgggtgtagcccagca

SEQ ID NO: 7920554 - DNA, 22 bp, Homo sapiens
gcaggatgggtgtagcccagca

SEQ ID NO: 7920555 - DNA, 22 bp, Homo sapiens
gcaggatggtggaaggcctgct

SEQ ID NO: 7920556 - DNA, 22 bp, Homo sapiens
gcaggatggtggaaggcctgct

SEQ ID NO: 7920557 - DNA, 22 bp, Homo sapiens
gcaggatggtgccctttctgcc

SEQ ID NO: 7920558 - DNA, 22 bp, Homo sapiens
gcaggatgagtgagtacattta

SEQ ID NO: 7920559 - DNA, 22 bp, Homo sapiens
gcaggatgaactaacacctgca

SEQ ID NO: 7920560 - DNA, 22 bp, Homo sapiens
gcaggatgaaggcagaggctga

SEQ ID NO: 7920561 - DNA, 22 bp, Homo sapiens
gcaggatgaaggcagaggctga

SEQ ID NO: 7920562 - DNA, 22 bp, Homo sapiens
gcaggatgaaggcagaggctga

SEQ ID NO: 7920563 - DNA, 22 bp, Homo sapiens
gcaggatgccagggcagcagcg

SEQ ID NO: 7920564 - DNA, 22 bp, Homo sapiens
gcaggatgccagggcagcagcg

SEQ ID NO: 7920565 - DNA, 22 bp, Homo sapiens
gcaggatgccagggcagcagcg

SEQ ID NO: 7920566 - DNA, 22 bp, Homo sapiens
gcaggatgggagcttcactctg

SEQ ID NO: 7920567 - DNA, 22 bp, Homo sapiens
gcaggatgggtgtagcccagca

SEQ ID NO: 7920568 - DNA, 22 bp, Homo sapiens
gcaggagcagtcaggggcagct

SEQ ID NO: 7920569 - DNA, 22 bp, Homo sapiens
gcaggagcagtcaggggcagct

SEQ ID NO: 7920570 - DNA, 22 bp, Homo sapiens
gcaggagcagtcaggggcagct

SEQ ID NO: 7920571 - DNA, 22 bp, Homo sapiens
gcaggagcagtcaggggcagct

SEQ ID NO: 7920572 - DNA, 22 bp, Homo sapiens
gcaggagcaatggcctatcaga

SEQ ID NO: 7920573 - DNA, 22 bp, Homo sapiens
gcaggagcaatggcctatcaga

SEQ ID NO: 7920574 - DNA, 22 bp, Homo sapiens
gcaggagcaatggcctatcaga

SEQ ID NO: 7920575 - DNA, 22 bp, Homo sapiens
gcaggagcaaactgcagtgtgg

SEQ ID NO: 7920576 - DNA, 22 bp, Homo sapiens
gcaggagcaaactgcagtgtgg

SEQ ID NO: 7920577 - DNA, 22 bp, Homo sapiens
gcaggagcaaactgcagtgtgg

SEQ ID NO: 7920578 - DNA, 22 bp, Homo sapiens
gcaggagcaaactgcagtgtgg

SEQ ID NO: 7920579 - DNA, 18 bp, Homo sapiens
gcaggagatgggtggggt

SEQ ID NO: 7920580 - DNA, 18 bp, Homo sapiens
gcaggagatgggtggggt

SEQ ID NO: 7920581 - DNA, 22 bp, Homo sapiens
gcaggagccacttcagggatgc

SEQ ID NO: 7920582 - DNA, 22 bp, Homo sapiens
gcaggagccacttcagggatgc

SEQ ID NO: 7920583 - DNA, 22 bp, Homo sapiens
gcaggagcagtcaggggcagct

SEQ ID NO: 7920584 - DNA, 22 bp, Homo sapiens
gcaggagccacttcagggatgc

SEQ ID NO: 7920585 - DNA, 22 bp, Homo sapiens
gcaggagcagtcaggggcagct

SEQ ID NO: 7920586 - DNA, 22 bp, Homo sapiens
gcaggagcagtcaggggcagct

SEQ ID NO: 7920587 - DNA, 22 bp, Homo sapiens
gcaggagcagtcaggggcagct

SEQ ID NO: 7920588 - DNA, 22 bp, Homo sapiens
gcaggatgaactaacacctgca

SEQ ID NO: 7920589 - DNA, 22 bp, Homo sapiens
gcaggatgaactaacacctgca

SEQ ID NO: 7920590 - DNA, 19 bp, Homo sapiens
gcaggataggctgagacta

SEQ ID NO: 7920591 - DNA, 19 bp, Homo sapiens
gcagccaggtgctctacct

SEQ ID NO: 7920592 - DNA, 22 bp, Homo sapiens
gcagccaggtttgaggaccact

SEQ ID NO: 7920593 - DNA, 22 bp, Homo sapiens
gcagccaggtttgaggaccact

SEQ ID NO: 7920594 - DNA, 22 bp, Homo sapiens
gcagccaggtttgaggaccact

SEQ ID NO: 7920595 - DNA, 19 bp, Homo sapiens
gcagccaggtgctctacct

SEQ ID NO: 7920596 - DNA, 19 bp, Homo sapiens
gcagccaggtgctctacct

SEQ ID NO: 7920597 - DNA, 19 bp, Homo sapiens
gcagccaggtgctctacct

SEQ ID NO: 7920598 - DNA, 22 bp, Homo sapiens
gcagccaggggctgtgacctgt

SEQ ID NO: 7920599 - DNA, 19 bp, Homo sapiens
gcagccaggtgctctacct

SEQ ID NO: 7920600 - DNA, 19 bp, Homo sapiens
gcagccaggtgctctacct

SEQ ID NO: 7920601 - DNA, 19 bp, Homo sapiens
gcagccaggtgctctacct

SEQ ID NO: 7920602 - DNA, 22 bp, Homo sapiens
gcagccaggggctgtgacctgt

SEQ ID NO: 7920603 - DNA, 22 bp, Homo sapiens
gcagccagggttaattatattt

SEQ ID NO: 7920604 - DNA, 22 bp, Homo sapiens
gcagccagggctaagctgggga

SEQ ID NO: 7920605 - DNA, 22 bp, Homo sapiens
gcagccagggctaagctgggga

SEQ ID NO: 7920606 - DNA, 22 bp, Homo sapiens
gcagccagggagagaaccaggg

SEQ ID NO: 7920607 - DNA, 22 bp, Homo sapiens
gcagccagggagagaaccaggg

SEQ ID NO: 7920608 - DNA, 22 bp, Homo sapiens
gcagccagggagagaaccaggg

SEQ ID NO: 7920609 - DNA, 22 bp, Homo sapiens
gcagccagggctaagctgggga

SEQ ID NO: 7920610 - DNA, 22 bp, Homo sapiens
gcagccagggctaagctgggga

SEQ ID NO: 7920611 - DNA, 22 bp, Homo sapiens
gcagccagggctaagctgggga

SEQ ID NO: 7920612 - DNA, 22 bp, Homo sapiens
gcagccaggctacagcgggctt

SEQ ID NO: 7920613 - DNA, 22 bp, Homo sapiens
gcagccaggctacagcgggctt

SEQ ID NO: 7920614 - DNA, 22 bp, Homo sapiens
gcagccaggctacagcgggctt

SEQ ID NO: 7920615 - DNA, 22 bp, Homo sapiens
gcagccagggagagaaccaggg

SEQ ID NO: 7920616 - DNA, 22 bp, Homo sapiens
gcagccaggctacagcgggctt

SEQ ID NO: 7920617 - DNA, 22 bp, Homo sapiens
gcagccagggagagaaccaggg

SEQ ID NO: 7920618 - DNA, 22 bp, Homo sapiens
gcagccagggagagaaccaggg

SEQ ID NO: 7920619 - DNA, 22 bp, Homo sapiens
gcagatgccactaggtgaagtg

SEQ ID NO: 7920620 - DNA, 22 bp, Homo sapiens
gcagatgccagatcatgcaggg

SEQ ID NO: 7920621 - DNA, 22 bp, Homo sapiens
gcagatgcagaactcagtgggt

SEQ ID NO: 7920622 - DNA, 22 bp, Homo sapiens
gcagatgcagagatggctgggg

SEQ ID NO: 7920623 - DNA, 22 bp, Homo sapiens
gcagatgcagagatggctgggg

SEQ ID NO: 7920624 - DNA, 22 bp, Homo sapiens
gcagatgcagagatggctgggg

SEQ ID NO: 7920625 - DNA, 22 bp, Homo sapiens
gcagatgatgtagacagacagt

SEQ ID NO: 7920626 - DNA, 22 bp, Homo sapiens
gcagatgcaagggtactggggc

SEQ ID NO: 7920627 - DNA, 19 bp, Homo sapiens
gcagatgatgaggctggtc

SEQ ID NO: 7920628 - DNA, 19 bp, Homo sapiens
gcagatgatgaggctggtc

SEQ ID NO: 7920629 - DNA, 19 bp, Homo sapiens
gcagatgatgaggctggtc

SEQ ID NO: 7920630 - DNA, 22 bp, Homo sapiens
gcagatgatgtagacagacagt

SEQ ID NO: 7920631 - DNA, 21 bp, Homo sapiens
gcagccaggactttgggctgg

SEQ ID NO: 7920632 - DNA, 21 bp, Homo sapiens
gcagccaggactttgggctgg

SEQ ID NO: 7920633 - DNA, 21 bp, Homo sapiens
gcagccaggactttgggctgg

SEQ ID NO: 7920634 - DNA, 21 bp, Homo sapiens
gcagccaggactttgggctgg

SEQ ID NO: 7920635 - DNA, 22 bp, Homo sapiens
gcagccaggaagcctttccctc

SEQ ID NO: 7920636 - DNA, 21 bp, Homo sapiens
gcagccaggactttgggctgg

SEQ ID NO: 7920637 - DNA, 22 bp, Homo sapiens
gcagccaggaagcctttccctc

SEQ ID NO: 7920638 - DNA, 22 bp, Homo sapiens
gcagcaggtctgtcaatgtcat

SEQ ID NO: 7920639 - DNA, 22 bp, Homo sapiens
gcagccaggaagcctttccctc

SEQ ID NO: 7920640 - DNA, 22 bp, Homo sapiens
gcagatgccagatcatgcaggg

SEQ ID NO: 7920641 - DNA, 22 bp, Homo sapiens
gcagatgcctgaaggagctggg

SEQ ID NO: 7920642 - DNA, 22 bp, Homo sapiens
gcagatgctgagatttatttct

SEQ ID NO: 7920643 - DNA, 22 bp, Homo sapiens
gcagatgctgagatttatttct

SEQ ID NO: 7920644 - DNA, 22 bp, Homo sapiens
gcagcaggtccgcatcatcatc

SEQ ID NO: 7920645 - DNA, 22 bp, Homo sapiens
gcagcaggtccgcatcatcatc

SEQ ID NO: 7920646 - DNA, 22 bp, Homo sapiens
gcagatgctgctcctctctaga

SEQ ID NO: 7920647 - DNA, 22 bp, Homo sapiens
gcagatgctgctcctctctaga

SEQ ID NO: 7920648 - DNA, 22 bp, Homo sapiens
gcagctttctaagctttattgc

SEQ ID NO: 7920649 - DNA, 22 bp, Homo sapiens
gcagctttaaacattggaaata

SEQ ID NO: 7920650 - DNA, 22 bp, Homo sapiens
gcagccttggttgtgagatgaa

SEQ ID NO: 7920651 - DNA, 22 bp, Homo sapiens
gcagccttccgtggacctggac

SEQ ID NO: 7920652 - DNA, 22 bp, Homo sapiens
gcagccttcagtttggcaggag

SEQ ID NO: 7920653 - DNA, 22 bp, Homo sapiens
gcagccttcagtttggcaggag

SEQ ID NO: 7920654 - DNA, 22 bp, Homo sapiens
gcagcctgttgtaccagcctgt

SEQ ID NO: 7920655 - DNA, 22 bp, Homo sapiens
gcagcctgttgtaccagcctgt

SEQ ID NO: 7920656 - DNA, 22 bp, Homo sapiens
gcagccttccgtggacctggac

SEQ ID NO: 7920657 - DNA, 22 bp, Homo sapiens
gcagccttcctgacctctaccc

SEQ ID NO: 7920658 - DNA, 22 bp, Homo sapiens
gcagccttggtgactgagtctg

SEQ ID NO: 7920659 - DNA, 22 bp, Homo sapiens
gcaggagagtctgtgccaggtt

SEQ ID NO: 7920660 - DNA, 22 bp, Homo sapiens
gcaggagagtctgtgccaggtt

SEQ ID NO: 7920661 - DNA, 22 bp, Homo sapiens
gcaggagagtctgtgccaggtt

SEQ ID NO: 7920662 - DNA, 22 bp, Homo sapiens
gcaggagagtctgtgccaggtt

SEQ ID NO: 7920663 - DNA, 22 bp, Homo sapiens
gcaggagagtctgtgccaggtt

SEQ ID NO: 7920664 - DNA, 22 bp, Homo sapiens
gcaggagagtctgtgccaggtt

SEQ ID NO: 7920665 - DNA, 22 bp, Homo sapiens
gcaggagagtctgtgccaggtt

SEQ ID NO: 7920666 - DNA, 22 bp, Homo sapiens
gcaggagagtctgtgccaggtt

SEQ ID NO: 7920667 - DNA, 18 bp, Homo sapiens
gcaggagatgggtggggt

SEQ ID NO: 7920668 - DNA, 18 bp, Homo sapiens
gcaggagatgggtggggt

SEQ ID NO: 7920669 - DNA, 18 bp, Homo sapiens
gcaggagatgggtggggt

SEQ ID NO: 7920670 - DNA, 18 bp, Homo sapiens
gcaggagatgggtggggt

SEQ ID NO: 7920671 - DNA, 22 bp, Homo sapiens
gcagcctgttgtaccagcctgt

SEQ ID NO: 7920672 - DNA, 22 bp, Homo sapiens
gcagcctgttgtaccagcctgt

SEQ ID NO: 7920673 - DNA, 22 bp, Homo sapiens
gcagcctgttgtaccagcctgt

SEQ ID NO: 7920674 - DNA, 22 bp, Homo sapiens
gcagcctgttgtaccagcctgt

SEQ ID NO: 7920675 - DNA, 22 bp, Homo sapiens
gcagcctgttgtaccagcctgt

SEQ ID NO: 7920676 - DNA, 22 bp, Homo sapiens
gcagcctgttgtaccagcctgt

SEQ ID NO: 7920677 - DNA, 22 bp, Homo sapiens
gcagcctgggcaacagagtgag

SEQ ID NO: 7920678 - DNA, 22 bp, Homo sapiens
gcagcctgggcaacagagtgag

SEQ ID NO: 7920679 - DNA, 22 bp, Homo sapiens
gcagcctgggcaacagagtgag

SEQ ID NO: 7920680 - DNA, 22 bp, Homo sapiens
gcagcctgggcaacagagtgag

SEQ ID NO: 7920681 - DNA, 22 bp, Homo sapiens
gcagcctgggcaacagagtgag

SEQ ID NO: 7920682 - DNA, 22 bp, Homo sapiens
gcagcctgggcaacagagtgag

SEQ ID NO: 7920683 - DNA, 22 bp, Homo sapiens
gcagcctgggcaacagagtgag

SEQ ID NO: 7920684 - DNA, 22 bp, Homo sapiens
gcagcctgggcaacagagtgag

SEQ ID NO: 7920685 - DNA, 22 bp, Homo sapiens
gcagcctgggcaacagagtgag

SEQ ID NO: 7920686 - DNA, 17 bp, Homo sapiens
gcagcctcttggtagtg

SEQ ID NO: 7920687 - DNA, 17 bp, Homo sapiens
gcagcctcttggtagtg

SEQ ID NO: 7920688 - DNA, 22 bp, Homo sapiens
gcagccaggtttgaggaccact

SEQ ID NO: 7920689 - DNA, 22 bp, Homo sapiens
gcagccaggtttgaggaccact

SEQ ID NO: 7920690 - DNA, 22 bp, Homo sapiens
gcagccaggtttgaggaccact

SEQ ID NO: 7920691 - DNA, 22 bp, Homo sapiens
gcagcctgatgatctgggttgt

SEQ ID NO: 7920692 - DNA, 22 bp, Homo sapiens
gcagcctgggcaacagagtgag

SEQ ID NO: 7920693 - DNA, 22 bp, Homo sapiens
gcagcctgatgatctgggttgt

SEQ ID NO: 7920694 - DNA, 22 bp, Homo sapiens
gcagcctgatgatctgggttgt

SEQ ID NO: 7920695 - DNA, 22 bp, Homo sapiens
gcagcctgaggccctttctggc

SEQ ID NO: 7920696 - DNA, 22 bp, Homo sapiens
gcagcctgaggccctttctggc

SEQ ID NO: 7920697 - DNA, 22 bp, Homo sapiens
gcagcctgaggccctttctggc

SEQ ID NO: 7920698 - DNA, 22 bp, Homo sapiens
gcactgtgacccagagcaggtg

SEQ ID NO: 7920699 - DNA, 22 bp, Homo sapiens
gcactgtgacccagagcaggtg

SEQ ID NO: 7920700 - DNA, 22 bp, Homo sapiens
gcactgtgatcaaggctaagca

SEQ ID NO: 7920701 - DNA, 22 bp, Homo sapiens
gcactgtgatcaaggctaagca

SEQ ID NO: 7920702 - DNA, 22 bp, Homo sapiens
gcactgtgacccagagcaggtg

SEQ ID NO: 7920703 - DNA, 22 bp, Homo sapiens
gcactgtgacccagagcaggtg

SEQ ID NO: 7920704 - DNA, 22 bp, Homo sapiens
gcactgtgatcaaggctaagca

SEQ ID NO: 7920705 - DNA, 22 bp, Homo sapiens
gcagaaggtcaaagcaagatgt

SEQ ID NO: 7920706 - DNA, 22 bp, Homo sapiens
gcagaagggaataaggagcttt

SEQ ID NO: 7920707 - DNA, 22 bp, Homo sapiens
gcagaagggaataaggagcttt

SEQ ID NO: 7920708 - DNA, 22 bp, Homo sapiens
gcagaagtcagaccatctgaat

SEQ ID NO: 7920709 - DNA, 22 bp, Homo sapiens
gcagaagtggattctacaattt

SEQ ID NO: 7920710 - DNA, 22 bp, Homo sapiens
gcagaagtggattctacaattt

SEQ ID NO: 7920711 - DNA, 22 bp, Homo sapiens
gcagaagtggattctacaattt

SEQ ID NO: 7920712 - DNA, 22 bp, Homo sapiens
gcagaagtacctcgttctagtt

SEQ ID NO: 7920713 - DNA, 22 bp, Homo sapiens
gcagaagtacctcgttctagtt

SEQ ID NO: 7920714 - DNA, 22 bp, Homo sapiens
gcagaagtaggctctgtgtagg

SEQ ID NO: 7920715 - DNA, 22 bp, Homo sapiens
gcagaagtcagaccatctgaat

SEQ ID NO: 7920716 - DNA, 22 bp, Homo sapiens
gcagaaggttgtttgggaaagg

SEQ ID NO: 7920717 - DNA, 22 bp, Homo sapiens
gcagaaggttgtttgggaaagg

SEQ ID NO: 7920718 - DNA, 22 bp, Homo sapiens
gcagaaggtctggcacttcagg

SEQ ID NO: 7920719 - DNA, 22 bp, Homo sapiens
gcagaaggtcaaagcaagatgt

SEQ ID NO: 7920720 - DNA, 22 bp, Homo sapiens
gcagaaggtctggcacttcagg

SEQ ID NO: 7920721 - DNA, 22 bp, Homo sapiens
gcagaggcctaggtggaaggcc

SEQ ID NO: 7920722 - DNA, 22 bp, Homo sapiens
gcagaggcctaggtggaaggcc

SEQ ID NO: 7920723 - DNA, 22 bp, Homo sapiens
gcagaggcctaggtggaaggcc

SEQ ID NO: 7920724 - DNA, 22 bp, Homo sapiens
gcagaggcctaggtggaaggcc

SEQ ID NO: 7920725 - DNA, 22 bp, Homo sapiens
gcagaggcctaggtggaaggcc

SEQ ID NO: 7920726 - DNA, 22 bp, Homo sapiens
gcagaggcctaggtggaaggcc

SEQ ID NO: 7920727 - DNA, 22 bp, Homo sapiens
gcagaggccatcaactttgcca

SEQ ID NO: 7920728 - DNA, 22 bp, Homo sapiens
gcagaggccatcaactttgcca

SEQ ID NO: 7920729 - DNA, 21 bp, Homo sapiens
gcagaggaatggtatacataa

SEQ ID NO: 7920730 - DNA, 16 bp, Homo sapiens
gcagaggaaaggggag

SEQ ID NO: 7920731 - DNA, 22 bp, Homo sapiens
gcagaattgaaatgtgtcactt

SEQ ID NO: 7920732 - DNA, 22 bp, Homo sapiens
gcagaattgaaatgtgtcactt

SEQ ID NO: 7920733 - DNA, 22 bp, Homo sapiens
gcagaatttaggaattaggaaa

SEQ ID NO: 7920734 - DNA, 22 bp, Homo sapiens
gcagaattgatggagaacttaa

SEQ ID NO: 7920735 - DNA, 22 bp, Homo sapiens
gcagaagttaatcgaaggccat

SEQ ID NO: 7920736 - DNA, 22 bp, Homo sapiens
gcagaatactgagagctgattg

SEQ ID NO: 7920737 - DNA, 22 bp, Homo sapiens
gcagaatactgagagctgattg

SEQ ID NO: 7920738 - DNA, 22 bp, Homo sapiens
gcagaatagggcataactttgc

SEQ ID NO: 7920739 - DNA, 22 bp, Homo sapiens
gcagaatgtccaagctgggccc

SEQ ID NO: 7920740 - DNA, 22 bp, Homo sapiens
gcagaattctacagatgataaa

SEQ ID NO: 7920741 - DNA, 22 bp, Homo sapiens
gcagaatgtaggccttcagtgt

SEQ ID NO: 7920742 - DNA, 22 bp, Homo sapiens
gcagaatattatggaaaaagta

SEQ ID NO: 7920743 - DNA, 22 bp, Homo sapiens
gcagaggctctttaatgcttag

SEQ ID NO: 7920744 - DNA, 22 bp, Homo sapiens
gcagaggctctttaatgcttag

SEQ ID NO: 7920745 - DNA, 22 bp, Homo sapiens
gcagaggctgggtgtcccagtc

SEQ ID NO: 7920746 - DNA, 22 bp, Homo sapiens
gcagaggctgggtgtcccagtc

SEQ ID NO: 7920747 - DNA, 22 bp, Homo sapiens
gcagaggctgggtgtcccagtc

SEQ ID NO: 7920748 - DNA, 22 bp, Homo sapiens
gcagaggctgggtgtcccagtc

SEQ ID NO: 7920749 - DNA, 22 bp, Homo sapiens
gcagaggctgggtgtcccagtc

SEQ ID NO: 7920750 - DNA, 22 bp, Homo sapiens
gcagaggctgggtgtcccagtc

SEQ ID NO: 7920751 - DNA, 22 bp, Homo sapiens
gcagaggctgtagggaaggttg

SEQ ID NO: 7920752 - DNA, 22 bp, Homo sapiens
gcagaggctgtagggaaggttg

SEQ ID NO: 7920753 - DNA, 22 bp, Homo sapiens
gcagaggctgtagggaaggttg

SEQ ID NO: 7920754 - DNA, 22 bp, Homo sapiens
gcagaggctgtagggaaggttg

SEQ ID NO: 7920755 - DNA, 22 bp, Homo sapiens
gcagaggctgtagggaaggttg

SEQ ID NO: 7920756 - DNA, 22 bp, Homo sapiens
gcagaggctgtagggaaggttg

SEQ ID NO: 7920757 - DNA, 22 bp, Homo sapiens
gcagaggctgtagggaaggttg

SEQ ID NO: 7920758 - DNA, 22 bp, Homo sapiens
gcagaggctctttaatgcttag

SEQ ID NO: 7920759 - DNA, 22 bp, Homo sapiens
gcagaggctccattttacagat

SEQ ID NO: 7920760 - DNA, 22 bp, Homo sapiens
gcagaggctccattttacagat

SEQ ID NO: 7920761 - DNA, 22 bp, Homo sapiens
gcagaggctccattttacagat

SEQ ID NO: 7920762 - DNA, 22 bp, Homo sapiens
gcagaggcctgaaggtggcggg

SEQ ID NO: 7920763 - DNA, 22 bp, Homo sapiens
gcagaggcctgaaggtggcggg

SEQ ID NO: 7920764 - DNA, 22 bp, Homo sapiens
gcagaggcctgaaggtggcggg

SEQ ID NO: 7920765 - DNA, 22 bp, Homo sapiens
gcagaggcctgaaggtggcggg

SEQ ID NO: 7920766 - DNA, 22 bp, Homo sapiens
gcagaggcctgaaggtggcggg

SEQ ID NO: 7920767 - DNA, 22 bp, Homo sapiens
gcagaggcctgaaggtggcggg

SEQ ID NO: 7920768 - DNA, 22 bp, Homo sapiens
gcagaggcctgaaggtggcggg

SEQ ID NO: 7920769 - DNA, 22 bp, Homo sapiens
gcagaggcctaggtggaaggcc

SEQ ID NO: 7920770 - DNA, 22 bp, Homo sapiens
gcagaggcctgaaggtggcggg

SEQ ID NO: 7920771 - DNA, 22 bp, Homo sapiens
gcagagggcaggggtgtttgtt

SEQ ID NO: 7920772 - DNA, 22 bp, Homo sapiens
gcagaggggaagctgaggaatt

SEQ ID NO: 7920773 - DNA, 22 bp, Homo sapiens
gcagaggggaagctgaggaatt

SEQ ID NO: 7920774 - DNA, 22 bp, Homo sapiens
gcagaggggaagctgaggaatt

SEQ ID NO: 7920775 - DNA, 22 bp, Homo sapiens
gcagagggcaggggtgtttgtt

SEQ ID NO: 7920776 - DNA, 22 bp, Homo sapiens
gcagaggggaagctgaggaatt

SEQ ID NO: 7920777 - DNA, 22 bp, Homo sapiens
gcagagggcaggggtgtttgtt

SEQ ID NO: 7920778 - DNA, 22 bp, Homo sapiens
gcagaggggaagctgaggaatt

SEQ ID NO: 7920779 - DNA, 22 bp, Homo sapiens
gcagaggggaagctgaggaatt

SEQ ID NO: 7920780 - DNA, 22 bp, Homo sapiens
gcagagtttctggcacattgga

SEQ ID NO: 7920781 - DNA, 22 bp, Homo sapiens
gcagagttggagccagcccagg

SEQ ID NO: 7920782 - DNA, 22 bp, Homo sapiens
gcagagttgatgcaagtactga

SEQ ID NO: 7920783 - DNA, 22 bp, Homo sapiens
gcagagttctcttccagctaac

SEQ ID NO: 7920784 - DNA, 22 bp, Homo sapiens
gcagagttggagccagcccagg

SEQ ID NO: 7920785 - DNA, 22 bp, Homo sapiens
gcagagttgatgcaagtactga

SEQ ID NO: 7920786 - DNA, 19 bp, Homo sapiens
gcagatgatgaggctggtc

SEQ ID NO: 7920787 - DNA, 19 bp, Homo sapiens
gcagatgatgaggctggtc

SEQ ID NO: 7920788 - DNA, 19 bp, Homo sapiens
gcagatgatgaggctggtc

SEQ ID NO: 7920789 - DNA, 18 bp, Homo sapiens
gcagatgagtagtgtacc

SEQ ID NO: 7920790 - DNA, 20 bp, Homo sapiens
gcagatgagactcacagagg

SEQ ID NO: 7920791 - DNA, 20 bp, Homo sapiens
gcagatgagactcacagagg

SEQ ID NO: 7920792 - DNA, 20 bp, Homo sapiens
gcagatgagactcacagagg

SEQ ID NO: 7920793 - DNA, 18 bp, Homo sapiens
gcagatgagtagtgtacc

SEQ ID NO: 7920794 - DNA, 22 bp, Homo sapiens
gcagatagggtattaggagtaa

SEQ ID NO: 7920795 - DNA, 22 bp, Homo sapiens
gcagatcaacactctctttcaa

SEQ ID NO: 7920796 - DNA, 22 bp, Homo sapiens
gcagagtttgaagtcaagatgt

SEQ ID NO: 7920797 - DNA, 22 bp, Homo sapiens
gcagagtttgaagtcaagatgt

SEQ ID NO: 7920798 - DNA, 22 bp, Homo sapiens
gcagatgaagtttacaggaaac

SEQ ID NO: 7920799 - DNA, 22 bp, Homo sapiens
gcagatgaagtttacaggaaac

SEQ ID NO: 7920800 - DNA, 22 bp, Homo sapiens
gcagatcaattgattgttcact

SEQ ID NO: 7920801 - DNA, 22 bp, Homo sapiens
gcagatctttaacagggtcact

SEQ ID NO: 7920802 - DNA, 22 bp, Homo sapiens
gcacagggagacagccgtggcc

SEQ ID NO: 7920803 - DNA, 22 bp, Homo sapiens
gcacagggagacagccgtggcc

SEQ ID NO: 7920804 - DNA, 22 bp, Homo sapiens
gcacagggagacagccgtggcc

SEQ ID NO: 7920805 - DNA, 22 bp, Homo sapiens
gcacagggagcaggtctctggt

SEQ ID NO: 7920806 - DNA, 22 bp, Homo sapiens
gcacagggagcaggtctctggt

SEQ ID NO: 7920807 - DNA, 22 bp, Homo sapiens
gcacagggagcaggtctctggt

SEQ ID NO: 7920808 - DNA, 22 bp, Homo sapiens
gcacagggagcaggtctctggt

SEQ ID NO: 7920809 - DNA, 22 bp, Homo sapiens
gcacagggagcaggtctctggt

SEQ ID NO: 7920810 - DNA, 22 bp, Homo sapiens
gcacagggagacagccgtggcc

SEQ ID NO: 7920811 - DNA, 22 bp, Homo sapiens
gcacagggagacagccgtggcc

SEQ ID NO: 7920812 - DNA, 22 bp, Homo sapiens
gcacagggagacagccgtggcc

SEQ ID NO: 7920813 - DNA, 22 bp, Homo sapiens
gcacagggagacagccgtggcc

SEQ ID NO: 7920814 - DNA, 21 bp, Homo sapiens
gcacagggacagatcatcaca

SEQ ID NO: 7920815 - DNA, 21 bp, Homo sapiens
gcacagggacagatcatcaca

SEQ ID NO: 7920816 - DNA, 22 bp, Homo sapiens
gcacagaggatgaggcagctct

SEQ ID NO: 7920817 - DNA, 22 bp, Homo sapiens
gcacaggctctcttggggacac

SEQ ID NO: 7920818 - DNA, 22 bp, Homo sapiens
gcacaggctctcttggggacac

SEQ ID NO: 7920819 - DNA, 22 bp, Homo sapiens
gcacaggctctcttggggacac

SEQ ID NO: 7920820 - DNA, 22 bp, Homo sapiens
gcacaggctctcttggggacac

SEQ ID NO: 7920821 - DNA, 17 bp, Homo sapiens
gcacagaggccaaagga

SEQ ID NO: 7920822 - DNA, 22 bp, Homo sapiens
gcacaggctctcttggggacac

SEQ ID NO: 7920823 - DNA, 22 bp, Homo sapiens
gcacaggctgttggccttcaga

SEQ ID NO: 7920824 - DNA, 22 bp, Homo sapiens
gcacaggctgttggccttcaga

SEQ ID NO: 7920825 - DNA, 22 bp, Homo sapiens
gcacaggctgttggccttcaga

SEQ ID NO: 7920826 - DNA, 23 bp, Homo sapiens
gcacagagcagttaggggaagat

SEQ ID NO: 7920827 - DNA, 23 bp, Homo sapiens
gcacagagcagttaggggaagat

SEQ ID NO: 7920828 - DNA, 18 bp, Homo sapiens
gcacagagcaagtttcat

SEQ ID NO: 7920829 - DNA, 23 bp, Homo sapiens
gcacagagcagttaggggaagat

SEQ ID NO: 7920830 - DNA, 20 bp, Homo sapiens
gcacagagatgagcaaagta

SEQ ID NO: 7920831 - DNA, 23 bp, Homo sapiens
gcacagagcagttaggggaagat

SEQ ID NO: 7920832 - DNA, 18 bp, Homo sapiens
gcacagagcccaggctct

SEQ ID NO: 7920833 - DNA, 18 bp, Homo sapiens
gcacagagcccaggctct

SEQ ID NO: 7920834 - DNA, 18 bp, Homo sapiens
gcacagagcccaggctct

SEQ ID NO: 7920835 - DNA, 18 bp, Homo sapiens
gcacagagcccaggctct

SEQ ID NO: 7920836 - DNA, 22 bp, Homo sapiens
gcacagaggaagcacagactct

SEQ ID NO: 7920837 - DNA, 22 bp, Homo sapiens
gcacagaggaagcacagactct

SEQ ID NO: 7920838 - DNA, 22 bp, Homo sapiens
gcacagaggaagcacagactct

SEQ ID NO: 7920839 - DNA, 22 bp, Homo sapiens
gcacagagcctggtaccgagaa

SEQ ID NO: 7920840 - DNA, 22 bp, Homo sapiens
gcacagagcctggtaccgagaa

SEQ ID NO: 7920841 - DNA, 22 bp, Homo sapiens
gcacagagcctggtaccgagaa

SEQ ID NO: 7920842 - DNA, 22 bp, Homo sapiens
gcacagagctggccctccaggc

SEQ ID NO: 7920843 - DNA, 22 bp, Homo sapiens
gcacagagctggccctccaggc

SEQ ID NO: 7920844 - DNA, 22 bp, Homo sapiens
gcacagagctggccctccaggc

SEQ ID NO: 7920845 - DNA, 22 bp, Homo sapiens
gcacagggccctgtgcgtaggt

SEQ ID NO: 7920846 - DNA, 22 bp, Homo sapiens
gcacagggccctgtgcgtaggt

SEQ ID NO: 7920847 - DNA, 22 bp, Homo sapiens
gcacagggccctgtgcgtaggt

SEQ ID NO: 7920848 - DNA, 22 bp, Homo sapiens
gcacagggccctgtgcgtaggt

SEQ ID NO: 7920849 - DNA, 22 bp, Homo sapiens
gcactcaggactctcatcagta

SEQ ID NO: 7920850 - DNA, 22 bp, Homo sapiens
gcactcaggactctcatcagta

SEQ ID NO: 7920851 - DNA, 22 bp, Homo sapiens
gcacagggccctgtgcgtaggt

SEQ ID NO: 7920852 - DNA, 22 bp, Homo sapiens
gcactgggggcagcagtgaggg

SEQ ID NO: 7920853 - DNA, 22 bp, Homo sapiens
gcactgggggcagcagtgaggg

SEQ ID NO: 7920854 - DNA, 22 bp, Homo sapiens
gcactgggggcagcagtgaggg

SEQ ID NO: 7920855 - DNA, 23 bp, Homo sapiens
gcactgggctctcagcaaggtgt

SEQ ID NO: 7920856 - DNA, 23 bp, Homo sapiens
gcactgggctctcagcaaggtgt

SEQ ID NO: 7920857 - DNA, 22 bp, Homo sapiens
gcactcagtaccaggtcactgc

SEQ ID NO: 7920858 - DNA, 22 bp, Homo sapiens
gcactcagtaccaggtcactgc

SEQ ID NO: 7920859 - DNA, 22 bp, Homo sapiens
gcacagggaggctggcctggcc

SEQ ID NO: 7920860 - DNA, 22 bp, Homo sapiens
gcacagggaggctggcctggcc

SEQ ID NO: 7920861 - DNA, 22 bp, Homo sapiens
gcacagggaggctggcctggcc

SEQ ID NO: 7920862 - DNA, 22 bp, Homo sapiens
gcacagggaggctggcctggcc

SEQ ID NO: 7920863 - DNA, 22 bp, Homo sapiens
gcacagggagcaggtctctggt

SEQ ID NO: 7920864 - DNA, 22 bp, Homo sapiens
gcacagggcaacaggtctgtta

SEQ ID NO: 7920865 - DNA, 22 bp, Homo sapiens
gcacagggcaacaggtctgtta

SEQ ID NO: 7920866 - DNA, 22 bp, Homo sapiens
gcacagggcaacaggtctgtta

SEQ ID NO: 7920867 - DNA, 22 bp, Homo sapiens
gcacagggcaacaggtctgtta

SEQ ID NO: 7920868 - DNA, 22 bp, Homo sapiens
gcacagggaggctggcctggcc

SEQ ID NO: 7920869 - DNA, 22 bp, Homo sapiens
gcacagggcaacaggtctgtta

SEQ ID NO: 7920870 - DNA, 22 bp, Homo sapiens
gcacagggaggctggcctggcc

SEQ ID NO: 7920871 - DNA, 22 bp, Homo sapiens
gcacagggcaacaggtctgtta

SEQ ID NO: 7920872 - DNA, 22 bp, Homo sapiens
gcacagggcaacaggtctgtta

SEQ ID NO: 7920873 - DNA, 22 bp, Homo sapiens
gcactgggtgtgaggcagcgtc

SEQ ID NO: 7920874 - DNA, 22 bp, Homo sapiens
gcactgggtgggagatctgaat

SEQ ID NO: 7920875 - DNA, 22 bp, Homo sapiens
gcactgggtgggagatctgaat

SEQ ID NO: 7920876 - DNA, 22 bp, Homo sapiens
gcactgggtgggagatctgaat

SEQ ID NO: 7920877 - DNA, 22 bp, Homo sapiens
gcactgggtgtgaggcagcgtc

SEQ ID NO: 7920878 - DNA, 22 bp, Homo sapiens
gcactgggtgtgaggcagcgtc

SEQ ID NO: 7920879 - DNA, 22 bp, Homo sapiens
gcactgggtgtgaggcagcgtc

SEQ ID NO: 7920880 - DNA, 22 bp, Homo sapiens
gcactgggtgtgaggcagcgtc

SEQ ID NO: 7920881 - DNA, 22 bp, Homo sapiens
gcactgggtgtgaggcagcgtc

SEQ ID NO: 7920882 - DNA, 22 bp, Homo sapiens
gcactgggtgtgaggcagcgtc

SEQ ID NO: 7920883 - DNA, 22 bp, Homo sapiens
gcactgggggcagcagtgaggg

SEQ ID NO: 7920884 - DNA, 22 bp, Homo sapiens
gcactgggggcagcagtgaggg

SEQ ID NO: 7920885 - DNA, 22 bp, Homo sapiens
gcactgggggcagcagtgaggg

SEQ ID NO: 7920886 - DNA, 22 bp, Homo sapiens
gcactgggggcagcagtgaggg

SEQ ID NO: 7920887 - DNA, 22 bp, Homo sapiens
gcactgggggcagcagtgaggg

SEQ ID NO: 7920888 - DNA, 22 bp, Homo sapiens
gcactgggggcagcagtgaggg

SEQ ID NO: 7920889 - DNA, 22 bp, Homo sapiens
gcactggggtcatagcctccag

SEQ ID NO: 7920890 - DNA, 22 bp, Homo sapiens
gcactggggtcatagcctccag

SEQ ID NO: 7920891 - DNA, 22 bp, Homo sapiens
gcactggggtcatagcctccag

SEQ ID NO: 7920892 - DNA, 22 bp, Homo sapiens
gcactggggtcatagcctccag

SEQ ID NO: 7920893 - DNA, 22 bp, Homo sapiens
gcactggggtcatagcctccag

SEQ ID NO: 7920894 - DNA, 22 bp, Homo sapiens
gcactggtatcacctgagagct

SEQ ID NO: 7920895 - DNA, 22 bp, Homo sapiens
gcactggtatcacctgagagct

SEQ ID NO: 7920896 - DNA, 22 bp, Homo sapiens
gcactggtatcacctgagagct

SEQ ID NO: 7920897 - DNA, 22 bp, Homo sapiens
gcactggtcttcccagcgaact

SEQ ID NO: 7920898 - DNA, 20 bp, Homo sapiens
gcactggtctggatctcctg

SEQ ID NO: 7920899 - DNA, 22 bp, Homo sapiens
gcactggtcagcatgtttcgca

SEQ ID NO: 7920900 - DNA, 22 bp, Homo sapiens
gcactggttaccctgagtggct

SEQ ID NO: 7920901 - DNA, 22 bp, Homo sapiens
gcactggttaccctgagtggct

SEQ ID NO: 7920902 - DNA, 22 bp, Homo sapiens
gcactggttaccctgagtggct

SEQ ID NO: 7920903 - DNA, 22 bp, Homo sapiens
gcactggtgtgaaacagtagat

SEQ ID NO: 7920904 - DNA, 22 bp, Homo sapiens
gcactggtgtgttagtaaggga

SEQ ID NO: 7920905 - DNA, 22 bp, Homo sapiens
gcactggtgtgttagtaaggga

SEQ ID NO: 7920906 - DNA, 22 bp, Homo sapiens
gcactgtgaatatactagcaaa

SEQ ID NO: 7920907 - DNA, 22 bp, Homo sapiens
gcactgtgacagcaagagtgag

SEQ ID NO: 7920908 - DNA, 22 bp, Homo sapiens
gcactgtgacccagagcaggtg

SEQ ID NO: 7920909 - DNA, 22 bp, Homo sapiens
gcactgtgacagcaagagtgag

SEQ ID NO: 7920910 - DNA, 22 bp, Homo sapiens
gcactgtgaatatactagcaaa

SEQ ID NO: 7920911 - DNA, 22 bp, Homo sapiens
gcactgtgaatatactagcaaa

SEQ ID NO: 7920912 - DNA, 22 bp, Homo sapiens
gcactgtagtgggggagaaatg

SEQ ID NO: 7920913 - DNA, 22 bp, Homo sapiens
gcactggtttatttaagaacaa

SEQ ID NO: 7920914 - DNA, 22 bp, Homo sapiens
gcaaacaagctgcctgaagatt

SEQ ID NO: 7920915 - DNA, 22 bp, Homo sapiens
gcaaatgctctccagcctgggt

SEQ ID NO: 7920916 - DNA, 22 bp, Homo sapiens
gcaaacaaggacatacatcctg

SEQ ID NO: 7920917 - DNA, 22 bp, Homo sapiens
gcaaacaaggacatacatcctg

SEQ ID NO: 7920918 - DNA, 21 bp, Homo sapiens
gcaaatgttcaggaaaaaaga

SEQ ID NO: 7920919 - DNA, 22 bp, Homo sapiens
gcaaatgtggcttcctttctag

SEQ ID NO: 7920920 - DNA, 22 bp, Homo sapiens
gcaaatgtggcttcctttctag

SEQ ID NO: 7920921 - DNA, 22 bp, Homo sapiens
gcaaatgtggcttcctttctag

SEQ ID NO: 7920922 - DNA, 22 bp, Homo sapiens
gcaaatgttcacggggagcata

SEQ ID NO: 7920923 - DNA, 22 bp, Homo sapiens
gcaaatgtggcttcctttctag

SEQ ID NO: 7920924 - DNA, 22 bp, Homo sapiens
gcaaatgtttttgagtgtttac

SEQ ID NO: 7920925 - DNA, 21 bp, Homo sapiens
gcaaatgttcaggaaaaaaga

SEQ ID NO: 7920926 - DNA, 22 bp, Homo sapiens
gcaaatgttctatatttgctgt

SEQ ID NO: 7920927 - DNA, 22 bp, Homo sapiens
gcaaatgttctatatttgctgt

SEQ ID NO: 7920928 - DNA, 22 bp, Homo sapiens
gcaaattcttaactggactgtg

SEQ ID NO: 7920929 - DNA, 22 bp, Homo sapiens
gcaaattgctagctttctctgc

SEQ ID NO: 7920930 - DNA, 22 bp, Homo sapiens
gcaaattgggaaatttctctag

SEQ ID NO: 7920931 - DNA, 22 bp, Homo sapiens
gcaacacagatcttctttgttg

SEQ ID NO: 7920932 - DNA, 22 bp, Homo sapiens
gcaacaatggaggtttggaggg

SEQ ID NO: 7920933 - DNA, 22 bp, Homo sapiens
gcaacagcattctcattgacat

SEQ ID NO: 7920934 - DNA, 22 bp, Homo sapiens
gcaacagcccaggttctgtgtg

SEQ ID NO: 7920935 - DNA, 22 bp, Homo sapiens
gcaacagcccaggttctgtgtg

SEQ ID NO: 7920936 - DNA, 22 bp, Homo sapiens
gcaacagcccaggttctgtgtg

SEQ ID NO: 7920937 - DNA, 22 bp, Homo sapiens
gcaacagcccaggttctgtgtg

SEQ ID NO: 7920938 - DNA, 22 bp, Homo sapiens
gcaacagcattctcattgacat

SEQ ID NO: 7920939 - DNA, 18 bp, Homo sapiens
gcaacagatcaacagaaa

SEQ ID NO: 7920940 - DNA, 23 bp, Homo sapiens
gcaacagagaagtaggagatggc

SEQ ID NO: 7920941 - DNA, 23 bp, Homo sapiens
gcaacagagaagtaggagatggc

SEQ ID NO: 7920942 - DNA, 22 bp, Homo sapiens
gcaacattgcttctgaacatag

SEQ ID NO: 7920943 - DNA, 22 bp, Homo sapiens
gcaacattgagtctaagtacca

SEQ ID NO: 7920944 - DNA, 22 bp, Homo sapiens
gcaacattcatgttctgtaacc

SEQ ID NO: 7920945 - DNA, 21 bp, Homo sapiens
gcaaccagaccacagggcagt

SEQ ID NO: 7920946 - DNA, 19 bp, Homo sapiens
gcaaccttcccttggctcc

SEQ ID NO: 7920947 - DNA, 22 bp, Homo sapiens
gcaactgaacatgtgtgtggcc

SEQ ID NO: 7920948 - DNA, 22 bp, Homo sapiens
gcacacagggatttttgaatgg

SEQ ID NO: 7920949 - DNA, 22 bp, Homo sapiens
gcaactgttttgagcacccagt

SEQ ID NO: 7920950 - DNA, 22 bp, Homo sapiens
gcacacaggggagttctcagaa

SEQ ID NO: 7920951 - DNA, 22 bp, Homo sapiens
gcacacaggggagttctcagaa

SEQ ID NO: 7920952 - DNA, 20 bp, Homo sapiens
gcaaaataggctctgttggt

SEQ ID NO: 7920953 - DNA, 20 bp, Homo sapiens
gcaaaataggctctgttggt

SEQ ID NO: 7920954 - DNA, 20 bp, Homo sapiens
gcaaaataggctctgttggt

SEQ ID NO: 7920955 - DNA, 22 bp, Homo sapiens
gcaaaattaaacttagcatcat

SEQ ID NO: 7920956 - DNA, 22 bp, Homo sapiens
gcaaaattaaacttagcatcat

SEQ ID NO: 7920957 - DNA, 22 bp, Homo sapiens
gcaaaatgatcttcttcaggct

SEQ ID NO: 7920958 - DNA, 22 bp, Homo sapiens
gcaaacaagctgcctgaagatt

SEQ ID NO: 7920959 - DNA, 22 bp, Homo sapiens
gcaaacaagctgcctgaagatt

SEQ ID NO: 7920960 - DNA, 22 bp, Homo sapiens
gcaaacaagctgcctgaagatt

SEQ ID NO: 7920961 - DNA, 22 bp, Homo sapiens
gcaaacaagctgcctgaagatt

SEQ ID NO: 7920962 - DNA, 22 bp, Homo sapiens
gcaaaagtacagccggatttct

SEQ ID NO: 7920963 - DNA, 22 bp, Homo sapiens
gcaaaagtacagccggatttct

SEQ ID NO: 7920964 - DNA, 22 bp, Homo sapiens
gcaaaagtacagccggatttct

SEQ ID NO: 7920965 - DNA, 22 bp, Homo sapiens
gcaaaagtacagccggatttct

SEQ ID NO: 7920966 - DNA, 22 bp, Homo sapiens
gcaaaaattccagggacgactc

SEQ ID NO: 7920967 - DNA, 22 bp, Homo sapiens
gcaaaactcggacatctaatct

SEQ ID NO: 7920968 - DNA, 22 bp, Homo sapiens
gcaaaactcggacatctaatct

SEQ ID NO: 7920969 - DNA, 22 bp, Homo sapiens
gcaaaactcggacatctaatct

SEQ ID NO: 7920970 - DNA, 22 bp, Homo sapiens
gcaaaacagtcgatgcctccca

SEQ ID NO: 7920971 - DNA, 22 bp, Homo sapiens
gcaaaacagtcgatgcctccca

SEQ ID NO: 7920972 - DNA, 22 bp, Homo sapiens
gcaaaaagtagtgctggttagg

SEQ ID NO: 7920973 - DNA, 22 bp, Homo sapiens
gcaaaaattccagggacgactc

SEQ ID NO: 7920974 - DNA, 22 bp, Homo sapiens
gcaaaacagtcgatgcctccca

SEQ ID NO: 7920975 - DNA, 22 bp, Homo sapiens
gcaaaaattccagggacgactc

SEQ ID NO: 7920976 - DNA, 22 bp, Homo sapiens
gatttctgggctttatttcaga

SEQ ID NO: 7920977 - DNA, 22 bp, Homo sapiens
gatttctgggctttatttcaga

SEQ ID NO: 7920978 - DNA, 22 bp, Homo sapiens
gcaaaaaatgcttgttgcttag

SEQ ID NO: 7920979 - DNA, 22 bp, Homo sapiens
gcaaaaaatgcttgttgcttag

SEQ ID NO: 7920980 - DNA, 22 bp, Homo sapiens
gcaaaaaatgcttgttgcttag

SEQ ID NO: 7920981 - DNA, 22 bp, Homo sapiens
gcaaaaaatgcttgttgcttag

SEQ ID NO: 7920982 - DNA, 22 bp, Homo sapiens
atgtttctcactgtttctctat

SEQ ID NO: 7920983 - DNA, 22 bp, Homo sapiens
atgtttctcactgtttctctat

SEQ ID NO: 7920984 - DNA, 22 bp, Homo sapiens
atgtttctcactgtttctctat

SEQ ID NO: 7920985 - DNA, 22 bp, Homo sapiens
atgtttctagttgtatgtcact

SEQ ID NO: 7920986 - DNA, 22 bp, Homo sapiens
atgtttctagttgtatgtcact

SEQ ID NO: 7920987 - DNA, 22 bp, Homo sapiens
atgtttctagttgtatgtcact

SEQ ID NO: 7920988 - DNA, 22 bp, Homo sapiens
atgtttctacagcgtccactga

SEQ ID NO: 7920989 - DNA, 22 bp, Homo sapiens
cccatcggcaaggtaggtgatt

SEQ ID NO: 7920990 - DNA, 22 bp, Homo sapiens
cccatctcagtcgtgctaaggg

SEQ ID NO: 7920991 - DNA, 22 bp, Homo sapiens
cccatccctgattttcactcgt

SEQ ID NO: 7920992 - DNA, 22 bp, Homo sapiens
cccatccctgattttcactcgt

SEQ ID NO: 7920993 - DNA, 22 bp, Homo sapiens
cccatccctgattttcactcgt

SEQ ID NO: 7920994 - DNA, 22 bp, Homo sapiens
cccatcatattctattattggg

SEQ ID NO: 7920995 - DNA, 22 bp, Homo sapiens
cccatcaggaacccaggagccc

SEQ ID NO: 7920996 - DNA, 22 bp, Homo sapiens
cccagtcatcctgcaggtgaaa

SEQ ID NO: 7920997 - DNA, 22 bp, Homo sapiens
cccagtcatcctgcaggtgaaa

SEQ ID NO: 7920998 - DNA, 22 bp, Homo sapiens
cccagtttcaactttccagtgg

SEQ ID NO: 7920999 - DNA, 22 bp, Homo sapiens
cccatcaggaacccaggagccc

SEQ ID NO: 7921000 - DNA, 22 bp, Homo sapiens
cccatcacagacactgggttat

SEQ ID NO: 7921001 - DNA, 22 bp, Homo sapiens
cccatcacagacactgggttat

SEQ ID NO: 7921002 - DNA, 22 bp, Homo sapiens
cccagttttctgattgaagagc

SEQ ID NO: 7921003 - DNA, 22 bp, Homo sapiens
cccaggcttttctcttgcccca

SEQ ID NO: 7921004 - DNA, 22 bp, Homo sapiens
cccagtacctctgttccctgct

SEQ ID NO: 7921005 - DNA, 22 bp, Homo sapiens
cccagtattgagctacaggcct

SEQ ID NO: 7921006 - DNA, 22 bp, Homo sapiens
cccagtattgagctacaggcct

SEQ ID NO: 7921007 - DNA, 22 bp, Homo sapiens
cccaggcttttctcttgcccca

SEQ ID NO: 7921008 - DNA, 22 bp, Homo sapiens
cccaggcttttctcttgcccca

SEQ ID NO: 7921009 - DNA, 22 bp, Homo sapiens
cccaggcttttctcttgcccca

SEQ ID NO: 7921010 - DNA, 22 bp, Homo sapiens
cccaggcttttaagttagacag

SEQ ID NO: 7921011 - DNA, 22 bp, Homo sapiens
cccaggcttttaagttagacag

SEQ ID NO: 7921012 - DNA, 22 bp, Homo sapiens
cccaggcttttctcttgcccca

SEQ ID NO: 7921013 - DNA, 22 bp, Homo sapiens
cccaggctgtctgtcctttgct

SEQ ID NO: 7921014 - DNA, 22 bp, Homo sapiens
cccaggctgtctgtcctttgct

SEQ ID NO: 7921015 - DNA, 22 bp, Homo sapiens
cccaggctgtctgtcctttgct

SEQ ID NO: 7921016 - DNA, 22 bp, Homo sapiens
cccaggctgtgcaaacttcaaa

SEQ ID NO: 7921017 - DNA, 22 bp, Homo sapiens
cccaggctggaattccaggcct

SEQ ID NO: 7921018 - DNA, 22 bp, Homo sapiens
cccaggctggaattccaggcct

SEQ ID NO: 7921019 - DNA, 22 bp, Homo sapiens
cccaggctggaattccaggcct

SEQ ID NO: 7921020 - DNA, 22 bp, Homo sapiens
cccaggctggaattccaggcct

SEQ ID NO: 7921021 - DNA, 22 bp, Homo sapiens
cccaggctgcgtatccacaata

SEQ ID NO: 7921022 - DNA, 22 bp, Homo sapiens
cccaggctggaattccaggcct

SEQ ID NO: 7921023 - DNA, 18 bp, Homo sapiens
cccaggctttgtgggtct

SEQ ID NO: 7921024 - DNA, 18 bp, Homo sapiens
cccaggctttgtgggtct

SEQ ID NO: 7921025 - DNA, 18 bp, Homo sapiens
cccaggctttgtgggtct

SEQ ID NO: 7921026 - DNA, 18 bp, Homo sapiens
cccaggctttgtgggtct

SEQ ID NO: 7921027 - DNA, 22 bp, Homo sapiens
cccaggcttcccaatcagaagg

SEQ ID NO: 7921028 - DNA, 22 bp, Homo sapiens
cccaggcttttaagttagacag

SEQ ID NO: 7921029 - DNA, 22 bp, Homo sapiens
cccaggctgtgcaaacttcaaa

SEQ ID NO: 7921030 - DNA, 22 bp, Homo sapiens
cccaggctgtgcaaacttcaaa

SEQ ID NO: 7921031 - DNA, 22 bp, Homo sapiens
cccaggctgtgcaaacttcaaa

SEQ ID NO: 7921032 - DNA, 18 bp, Homo sapiens
cccaggctttgtgggtct

SEQ ID NO: 7921033 - DNA, 22 bp, Homo sapiens
cccaggcttcccaatcagaagg

SEQ ID NO: 7921034 - DNA, 22 bp, Homo sapiens
cccaggcttcccaatcagaagg

SEQ ID NO: 7921035 - DNA, 22 bp, Homo sapiens
cccaggctgcgtatccacaata

SEQ ID NO: 7921036 - DNA, 22 bp, Homo sapiens
cccaggctgccacgattactgc

SEQ ID NO: 7921037 - DNA, 22 bp, Homo sapiens
cccaggctgcgtatccacaata

SEQ ID NO: 7921038 - DNA, 22 bp, Homo sapiens
cccaggctgccacgattactgc

SEQ ID NO: 7921039 - DNA, 22 bp, Homo sapiens
cccaggctgccacgattactgc

SEQ ID NO: 7921040 - DNA, 22 bp, Homo sapiens
cccaggctgcatgagtccatgg

SEQ ID NO: 7921041 - DNA, 22 bp, Homo sapiens
cccaggctgcatgagtccatgg

SEQ ID NO: 7921042 - DNA, 22 bp, Homo sapiens
cccaggctgcatgagtccatgg

SEQ ID NO: 7921043 - DNA, 22 bp, Homo sapiens
cccaggctgatgttcagcgggt

SEQ ID NO: 7921044 - DNA, 22 bp, Homo sapiens
cccaggctgcatgagtccatgg

SEQ ID NO: 7921045 - DNA, 22 bp, Homo sapiens
cccaggctgatgttcagcgggt

SEQ ID NO: 7921046 - DNA, 22 bp, Homo sapiens
cccaggctgatgttcagcgggt

SEQ ID NO: 7921047 - DNA, 22 bp, Homo sapiens
cccaggctgatgttcagcgggt

SEQ ID NO: 7921048 - DNA, 22 bp, Homo sapiens
cccaggctgatgttcagcgggt

SEQ ID NO: 7921049 - DNA, 22 bp, Homo sapiens
cccaggctgatgttcagcgggt

SEQ ID NO: 7921050 - DNA, 22 bp, Homo sapiens
cccaggctgatgttcagcgggt

SEQ ID NO: 7921051 - DNA, 22 bp, Homo sapiens
cccaggctgatgggatgggcca

SEQ ID NO: 7921052 - DNA, 22 bp, Homo sapiens
cccaggctgatgggatgggcca

SEQ ID NO: 7921053 - DNA, 22 bp, Homo sapiens
cccaggctgatgggatgggcca

SEQ ID NO: 7921054 - DNA, 22 bp, Homo sapiens
cccaggctgatgggatgggcca

SEQ ID NO: 7921055 - DNA, 22 bp, Homo sapiens
cccaggctgatgggatgggcca

SEQ ID NO: 7921056 - DNA, 22 bp, Homo sapiens
cccaggctgatgggatgggcca

SEQ ID NO: 7921057 - DNA, 22 bp, Homo sapiens
cccaggaggtcaaggctgcagt

SEQ ID NO: 7921058 - DNA, 22 bp, Homo sapiens
cccaggaggtcaaggctgcagt

SEQ ID NO: 7921059 - DNA, 22 bp, Homo sapiens
cccaggaggtcaaggctgcagt

SEQ ID NO: 7921060 - DNA, 22 bp, Homo sapiens
cccaggaggtcaaggctgcagt

SEQ ID NO: 7921061 - DNA, 22 bp, Homo sapiens
cccaggaggtcaaggctgcagt

SEQ ID NO: 7921062 - DNA, 22 bp, Homo sapiens
cccaggaggtcaaggctgcagt

SEQ ID NO: 7921063 - DNA, 22 bp, Homo sapiens
cccaggaggtcaaggctgcagt

SEQ ID NO: 7921064 - DNA, 22 bp, Homo sapiens
cccaggaggtcaaggctgcagt

SEQ ID NO: 7921065 - DNA, 22 bp, Homo sapiens
cccaggaggtcgaagctgcagt

SEQ ID NO: 7921066 - DNA, 22 bp, Homo sapiens
cccaggaggtcgaagctgcagt

SEQ ID NO: 7921067 - DNA, 22 bp, Homo sapiens
cccaggaggtcgaagctgcagt

SEQ ID NO: 7921068 - DNA, 22 bp, Homo sapiens
cccaggaggtcgaagctgcagt

SEQ ID NO: 7921069 - DNA, 22 bp, Homo sapiens
cccaggaggtcgaagctgcagt

SEQ ID NO: 7921070 - DNA, 22 bp, Homo sapiens
cccaggaggtcgaagctgcagt

SEQ ID NO: 7921071 - DNA, 22 bp, Homo sapiens
cccaggaggtcgaagctgcagt

SEQ ID NO: 7921072 - DNA, 22 bp, Homo sapiens
cccaggaggtcgaagctgcagt

SEQ ID NO: 7921073 - DNA, 22 bp, Homo sapiens
cccaggaggtcgaagctgcagt

SEQ ID NO: 7921074 - DNA, 22 bp, Homo sapiens
cccaggaggtcgaagctgcagt

SEQ ID NO: 7921075 - DNA, 22 bp, Homo sapiens
cccaggaggtggagcttgcagt

SEQ ID NO: 7921076 - DNA, 22 bp, Homo sapiens
cccaggaggtggagcttgcagt

SEQ ID NO: 7921077 - DNA, 22 bp, Homo sapiens
cccaggaggtggagcttgcagt

SEQ ID NO: 7921078 - DNA, 22 bp, Homo sapiens
cccaggaggtggagcttgcagt

SEQ ID NO: 7921079 - DNA, 22 bp, Homo sapiens
cccaggcctggtctgggccagt

SEQ ID NO: 7921080 - DNA, 23 bp, Homo sapiens
cccaggctacaaattatgctctg

SEQ ID NO: 7921081 - DNA, 23 bp, Homo sapiens
cccaggctacaaattatgctctg

SEQ ID NO: 7921082 - DNA, 23 bp, Homo sapiens
cccaggctacaaattatgctctg

SEQ ID NO: 7921083 - DNA, 23 bp, Homo sapiens
cccaggctacaaattatgctctg

SEQ ID NO: 7921084 - DNA, 22 bp, Homo sapiens
aggctgtccaaggtggcgaagt

SEQ ID NO: 7921085 - DNA, 22 bp, Homo sapiens
aggctgtcctctcttgctcagt

SEQ ID NO: 7921086 - DNA, 22 bp, Homo sapiens
aggctgtcatggctataggccc

SEQ ID NO: 7921087 - DNA, 20 bp, Homo sapiens
aggctgtcatttctggcagg

SEQ ID NO: 7921088 - DNA, 21 bp, Homo sapiens
aggctgtcctttgccagccct

SEQ ID NO: 7921089 - DNA, 21 bp, Homo sapiens
aggctgtcctttgccagccct

SEQ ID NO: 7921090 - DNA, 22 bp, Homo sapiens
aggctgtcttcctccctcttgg

SEQ ID NO: 7921091 - DNA, 22 bp, Homo sapiens
aggctgtctcagcctgcttgca

SEQ ID NO: 7921092 - DNA, 22 bp, Homo sapiens
aggctgtctgaccccagagccc

SEQ ID NO: 7921093 - DNA, 22 bp, Homo sapiens
aggctgtctcagcctgcttgca

SEQ ID NO: 7921094 - DNA, 22 bp, Homo sapiens
aggctgtctcagcctgcttgca

SEQ ID NO: 7921095 - DNA, 22 bp, Homo sapiens
aggctgtctcagcctgcttgca

SEQ ID NO: 7921096 - DNA, 22 bp, Homo sapiens
aggctgtgaactctatgctgaa

SEQ ID NO: 7921097 - DNA, 22 bp, Homo sapiens
aggctgtgaactctatgctgaa

SEQ ID NO: 7921098 - DNA, 22 bp, Homo sapiens
aggctgtgaaatgtggcaagga

SEQ ID NO: 7921099 - DNA, 22 bp, Homo sapiens
aggctgtgaactctatgctgaa

SEQ ID NO: 7921100 - DNA, 22 bp, Homo sapiens
aggctgtgaaatgtggcaagga

SEQ ID NO: 7921101 - DNA, 22 bp, Homo sapiens
aggctgtcttcctccctcttgg

SEQ ID NO: 7921102 - DNA, 22 bp, Homo sapiens
aggctgtgacagggtcatggag

SEQ ID NO: 7921103 - DNA, 22 bp, Homo sapiens
aggctgtgacagggtcatggag

SEQ ID NO: 7921104 - DNA, 22 bp, Homo sapiens
aggctgtgacagggtcatggag

SEQ ID NO: 7921105 - DNA, 22 bp, Homo sapiens
cccaggaatgaggggcggaggc

SEQ ID NO: 7921106 - DNA, 22 bp, Homo sapiens
cccaggaatgaggggcggaggc

SEQ ID NO: 7921107 - DNA, 22 bp, Homo sapiens
cccaggaatgagcaggcagggg

SEQ ID NO: 7921108 - DNA, 22 bp, Homo sapiens
cccaggaatgagcaggcagggg

SEQ ID NO: 7921109 - DNA, 22 bp, Homo sapiens
aggctggtgcttcctagggcag

SEQ ID NO: 7921110 - DNA, 22 bp, Homo sapiens
aggctggtgcttcctagggcag

SEQ ID NO: 7921111 - DNA, 22 bp, Homo sapiens
aggctggtgtctctgtcctgtc

SEQ ID NO: 7921112 - DNA, 22 bp, Homo sapiens
aggctggtgtctctgtcctgtc

SEQ ID NO: 7921113 - DNA, 22 bp, Homo sapiens
aggctggtgcctgcagtgaatc

SEQ ID NO: 7921114 - DNA, 22 bp, Homo sapiens
aggctggtgcctgcagtgaatc

SEQ ID NO: 7921115 - DNA, 22 bp, Homo sapiens
aggctggtgcttcctagggcag

SEQ ID NO: 7921116 - DNA, 22 bp, Homo sapiens
aggctgtcatctttgcaggcag

SEQ ID NO: 7921117 - DNA, 22 bp, Homo sapiens
aggctgtagtgcatgtgctatg

SEQ ID NO: 7921118 - DNA, 22 bp, Homo sapiens
aggctggtgtgtcctgaagcct

SEQ ID NO: 7921119 - DNA, 22 bp, Homo sapiens
aggctggtgtgtcctgaagcct

SEQ ID NO: 7921120 - DNA, 22 bp, Homo sapiens
aggctggtgtctctgtcctgtc

SEQ ID NO: 7921121 - DNA, 22 bp, Homo sapiens
aggctggtgattagaagcagcc

SEQ ID NO: 7921122 - DNA, 22 bp, Homo sapiens
aggctggtgattagaagcagcc

SEQ ID NO: 7921123 - DNA, 22 bp, Homo sapiens
aggctggtgattagaagcagcc

SEQ ID NO: 7921124 - DNA, 22 bp, Homo sapiens
aggctggtctgttggcattttt

SEQ ID NO: 7921125 - DNA, 22 bp, Homo sapiens
aggctggtctgttggcattttt

SEQ ID NO: 7921126 - DNA, 22 bp, Homo sapiens
aggctggtgattagaagcagcc

SEQ ID NO: 7921127 - DNA, 22 bp, Homo sapiens
aggctggtgattagaagcagcc

SEQ ID NO: 7921128 - DNA, 22 bp, Homo sapiens
aggctggtgattagaagcagcc

SEQ ID NO: 7921129 - DNA, 22 bp, Homo sapiens
aggctggtgattagaagcagcc

SEQ ID NO: 7921130 - DNA, 22 bp, Homo sapiens
aggctggtgcctgcagtgaatc

SEQ ID NO: 7921131 - DNA, 22 bp, Homo sapiens
aggctggtgcctgcagtgaatc

SEQ ID NO: 7921132 - DNA, 22 bp, Homo sapiens
aggctggtctatacggagacga

SEQ ID NO: 7921133 - DNA, 22 bp, Homo sapiens
aggctggtcccagggagggaat

SEQ ID NO: 7921134 - DNA, 22 bp, Homo sapiens
aggctggtcccagggagggaat

SEQ ID NO: 7921135 - DNA, 22 bp, Homo sapiens
aggctggtctatacggagacga

SEQ ID NO: 7921136 - DNA, 22 bp, Homo sapiens
aggctggtagtatttagtcaca

SEQ ID NO: 7921137 - DNA, 22 bp, Homo sapiens
aggctgggtacctgtcatatgc

SEQ ID NO: 7921138 - DNA, 22 bp, Homo sapiens
aggctgggtacctgtcatatgc

SEQ ID NO: 7921139 - DNA, 22 bp, Homo sapiens
aggctggtagtatttagtcaca

SEQ ID NO: 7921140 - DNA, 22 bp, Homo sapiens
aggctggtagtatttagtcaca

SEQ ID NO: 7921141 - DNA, 22 bp, Homo sapiens
aggctggtcccagggagggaat

SEQ ID NO: 7921142 - DNA, 22 bp, Homo sapiens
cccaggagggtggcctctgccc

SEQ ID NO: 7921143 - DNA, 22 bp, Homo sapiens
cccaggaggtagaggttgcagt

SEQ ID NO: 7921144 - DNA, 22 bp, Homo sapiens
cccaggagcttctctctgcctc

SEQ ID NO: 7921145 - DNA, 22 bp, Homo sapiens
cccaggaggtagaggttgcagt

SEQ ID NO: 7921146 - DNA, 22 bp, Homo sapiens
cccaggaggtagaggttgcagt

SEQ ID NO: 7921147 - DNA, 22 bp, Homo sapiens
cccaggaggtagaggttgcagt

SEQ ID NO: 7921148 - DNA, 22 bp, Homo sapiens
cccaggaggtcaaggctgcagt

SEQ ID NO: 7921149 - DNA, 22 bp, Homo sapiens
cccaggaggtcaaggctgcagt

SEQ ID NO: 7921150 - DNA, 22 bp, Homo sapiens
cccaggaggtcaaggctgcagt

SEQ ID NO: 7921151 - DNA, 22 bp, Homo sapiens
cccaggaggtcaaggctgcagt

SEQ ID NO: 7921152 - DNA, 22 bp, Homo sapiens
cccaggaggtcaaggctgcagt

SEQ ID NO: 7921153 - DNA, 23 bp, Homo sapiens
cccaggagcctgagtcctctctg

SEQ ID NO: 7921154 - DNA, 23 bp, Homo sapiens
cccaggagcctgagtcctctctg

SEQ ID NO: 7921155 - DNA, 20 bp, Homo sapiens
cccaggagctgtgccccatc

SEQ ID NO: 7921156 - DNA, 20 bp, Homo sapiens
cccaggagctgtgccccatc

SEQ ID NO: 7921157 - DNA, 20 bp, Homo sapiens
cccaggagctgtgccccatc

SEQ ID NO: 7921158 - DNA, 22 bp, Homo sapiens
cccaggagcttctctctgcctc

SEQ ID NO: 7921159 - DNA, 22 bp, Homo sapiens
cccaggagcttctctctgcctc

SEQ ID NO: 7921160 - DNA, 22 bp, Homo sapiens
cccaggagatggtgcgtggtct

SEQ ID NO: 7921161 - DNA, 22 bp, Homo sapiens
cccaggagatggtgcgtggtct

SEQ ID NO: 7921162 - DNA, 19 bp, Homo sapiens
cccaggagcagtattgatg

SEQ ID NO: 7921163 - DNA, 19 bp, Homo sapiens
cccaggagcagtattgatg

SEQ ID NO: 7921164 - DNA, 22 bp, Homo sapiens
cccaggagatggaggttgcagt

SEQ ID NO: 7921165 - DNA, 22 bp, Homo sapiens
cccaggagatggtgcgtggtct

SEQ ID NO: 7921166 - DNA, 22 bp, Homo sapiens
cccaggagatggtgcgtggtct

SEQ ID NO: 7921167 - DNA, 23 bp, Homo sapiens
cccaggagcctgagtcctctctg

SEQ ID NO: 7921168 - DNA, 23 bp, Homo sapiens
cccaggagcctgagtcctctctg

SEQ ID NO: 7921169 - DNA, 23 bp, Homo sapiens
cccaggagcctgagtcctctctg

SEQ ID NO: 7921170 - DNA, 19 bp, Homo sapiens
cccaggagcagtattgatg

SEQ ID NO: 7921171 - DNA, 22 bp, Homo sapiens
cccaggagccatctgtcttggc

SEQ ID NO: 7921172 - DNA, 22 bp, Homo sapiens
cccaggagatctggatctcgtc

SEQ ID NO: 7921173 - DNA, 22 bp, Homo sapiens
cccaggaattcagggctcaagg

SEQ ID NO: 7921174 - DNA, 22 bp, Homo sapiens
cccaggaatgggaaggaggaat

SEQ ID NO: 7921175 - DNA, 22 bp, Homo sapiens
cccaggaatgggaaggaggaat

SEQ ID NO: 7921176 - DNA, 22 bp, Homo sapiens
cccaggaattcagggctcaagg

SEQ ID NO: 7921177 - DNA, 22 bp, Homo sapiens
cccaggagatgcactccattgg

SEQ ID NO: 7921178 - DNA, 22 bp, Homo sapiens
cccaggagatgcactccattgg

SEQ ID NO: 7921179 - DNA, 22 bp, Homo sapiens
cccaggagatggaggttgcagt

SEQ ID NO: 7921180 - DNA, 22 bp, Homo sapiens
cccaggagatggaggttgcagt

SEQ ID NO: 7921181 - DNA, 22 bp, Homo sapiens
cccaggagatggaggttgcagt

SEQ ID NO: 7921182 - DNA, 21 bp, Homo sapiens
ccccagcaccttgccagcctg

SEQ ID NO: 7921183 - DNA, 22 bp, Homo sapiens
ccccagcactaccagaagccag

SEQ ID NO: 7921184 - DNA, 22 bp, Homo sapiens
ccccagcactaccagaagccag

SEQ ID NO: 7921185 - DNA, 22 bp, Homo sapiens
ccccagcactaccagaagccag

SEQ ID NO: 7921186 - DNA, 22 bp, Homo sapiens
ccccagcactaccagaagccag

SEQ ID NO: 7921187 - DNA, 22 bp, Homo sapiens
ccccagcacaggctcctcagat

SEQ ID NO: 7921188 - DNA, 22 bp, Homo sapiens
ccccagcacaggctcctcagat

SEQ ID NO: 7921189 - DNA, 22 bp, Homo sapiens
ccccagcacaggctcctcagat

SEQ ID NO: 7921190 - DNA, 22 bp, Homo sapiens
ccccagcacaggctcctcagat

SEQ ID NO: 7921191 - DNA, 21 bp, Homo sapiens
ccccagcaccttgccagcctg

SEQ ID NO: 7921192 - DNA, 21 bp, Homo sapiens
ccccagcaccttgccagcctg

SEQ ID NO: 7921193 - DNA, 21 bp, Homo sapiens
ccccagcaccttgccagcctg

SEQ ID NO: 7921194 - DNA, 22 bp, Homo sapiens
ccccagcacaggctcctcagat

SEQ ID NO: 7921195 - DNA, 22 bp, Homo sapiens
ccccagcacttggagtggggag

SEQ ID NO: 7921196 - DNA, 22 bp, Homo sapiens
ccccagcacttggagtggggag

SEQ ID NO: 7921197 - DNA, 20 bp, Homo sapiens
ccccttcatctacagcctga

SEQ ID NO: 7921198 - DNA, 22 bp, Homo sapiens
ccccttccacagtgcttcctaa

SEQ ID NO: 7921199 - DNA, 22 bp, Homo sapiens
ccccttccacagtgcttcctaa

SEQ ID NO: 7921200 - DNA, 22 bp, Homo sapiens
ccccttccacagtgcttcctaa

SEQ ID NO: 7921201 - DNA, 22 bp, Homo sapiens
ccctagggctaagcaggactgc

SEQ ID NO: 7921202 - DNA, 22 bp, Homo sapiens
ccctaggctgaggccagggtgc

SEQ ID NO: 7921203 - DNA, 22 bp, Homo sapiens
ccctaggctgggctcttggctt

SEQ ID NO: 7921204 - DNA, 22 bp, Homo sapiens
ccctaggctgaggccagggtgc

SEQ ID NO: 7921205 - DNA, 22 bp, Homo sapiens
ccctaggctgaggccagggtgc

SEQ ID NO: 7921206 - DNA, 22 bp, Homo sapiens
ccccttccaggaagcagaatcg

SEQ ID NO: 7921207 - DNA, 22 bp, Homo sapiens
ccctagggctaagcaggactgc

SEQ ID NO: 7921208 - DNA, 22 bp, Homo sapiens
ccctagggctaagcaggactgc

SEQ ID NO: 7921209 - DNA, 19 bp, Homo sapiens
ccctaggggctcctgaggg

SEQ ID NO: 7921210 - DNA, 22 bp, Homo sapiens
ccctagggtttggccagagccc

SEQ ID NO: 7921211 - DNA, 22 bp, Homo sapiens
ccctagggtttggccagagccc

SEQ ID NO: 7921212 - DNA, 22 bp, Homo sapiens
ccctagggtttggccagagccc

SEQ ID NO: 7921213 - DNA, 22 bp, Homo sapiens
ccctagggtttggccagagccc

SEQ ID NO: 7921214 - DNA, 22 bp, Homo sapiens
ccctagtccacaggttcctgga

SEQ ID NO: 7921215 - DNA, 22 bp, Homo sapiens
ccctagggtttggccagagccc

SEQ ID NO: 7921216 - DNA, 22 bp, Homo sapiens
ccctatcagaagctgagagaag

SEQ ID NO: 7921217 - DNA, 22 bp, Homo sapiens
ccctatcctgcaggcctgggct

SEQ ID NO: 7921218 - DNA, 22 bp, Homo sapiens
ccctattagtgaccacatcata

SEQ ID NO: 7921219 - DNA, 22 bp, Homo sapiens
ccctcacttcacgctctgcaga

SEQ ID NO: 7921220 - DNA, 22 bp, Homo sapiens
ccctcacttcacgctctgcaga

SEQ ID NO: 7921221 - DNA, 22 bp, Homo sapiens
ccctcacttcacgctctgcaga

SEQ ID NO: 7921222 - DNA, 17 bp, Homo sapiens
ccctcactcctgccggg

SEQ ID NO: 7921223 - DNA, 22 bp, Homo sapiens
ccctcactctgcctcctggggt

SEQ ID NO: 7921224 - DNA, 22 bp, Homo sapiens
ccctcaccaggctccaggcatg

SEQ ID NO: 7921225 - DNA, 22 bp, Homo sapiens
ccctcaccaggctccaggcatg

SEQ ID NO: 7921226 - DNA, 22 bp, Homo sapiens
ccctcaccaggctccaggcatg

SEQ ID NO: 7921227 - DNA, 22 bp, Homo sapiens
ccctcaccaggctccaggcatg

SEQ ID NO: 7921228 - DNA, 22 bp, Homo sapiens
ccctcaccaggctccaggcatg

SEQ ID NO: 7921229 - DNA, 22 bp, Homo sapiens
ccctcaccaggctccaggcatg

SEQ ID NO: 7921230 - DNA, 22 bp, Homo sapiens
cccatgctgagtggcctgagat

SEQ ID NO: 7921231 - DNA, 22 bp, Homo sapiens
cccatgctgagtggcctgagat

SEQ ID NO: 7921232 - DNA, 22 bp, Homo sapiens
cccatgccttctgactcacagg

SEQ ID NO: 7921233 - DNA, 22 bp, Homo sapiens
cccatggagtgcctgagggcca

SEQ ID NO: 7921234 - DNA, 22 bp, Homo sapiens
cccatggagtgcctgagggcca

SEQ ID NO: 7921235 - DNA, 22 bp, Homo sapiens
cccatgctgtgcctagagagca

SEQ ID NO: 7921236 - DNA, 22 bp, Homo sapiens
cccatgggttttcctccctgcc

SEQ ID NO: 7921237 - DNA, 22 bp, Homo sapiens
cccatgggttttcctccctgcc

SEQ ID NO: 7921238 - DNA, 22 bp, Homo sapiens
cccatggcaataaggtcacagg

SEQ ID NO: 7921239 - DNA, 22 bp, Homo sapiens
cccatggcaataaggtcacagg

SEQ ID NO: 7921240 - DNA, 22 bp, Homo sapiens
cccatggcagtcagagataaga

SEQ ID NO: 7921241 - DNA, 22 bp, Homo sapiens
cccatgcaccctctaagaagga

SEQ ID NO: 7921242 - DNA, 22 bp, Homo sapiens
cccatgcatccctctcctgggc

SEQ ID NO: 7921243 - DNA, 20 bp, Homo sapiens
cccatgcatcttcacaacct

SEQ ID NO: 7921244 - DNA, 20 bp, Homo sapiens
cccatgcatcttcacaacct

SEQ ID NO: 7921245 - DNA, 22 bp, Homo sapiens
cccatgcaccctctaagaagga

SEQ ID NO: 7921246 - DNA, 22 bp, Homo sapiens
cccatgcaccctctaagaagga

SEQ ID NO: 7921247 - DNA, 22 bp, Homo sapiens
cccatgcaccctctaagaagga

SEQ ID NO: 7921248 - DNA, 22 bp, Homo sapiens
cccatgcaccctctaagaagga

SEQ ID NO: 7921249 - DNA, 22 bp, Homo sapiens
cccatgagattctgaatttggc

SEQ ID NO: 7921250 - DNA, 22 bp, Homo sapiens
cccatgagtgctgctcagaggc

SEQ ID NO: 7921251 - DNA, 22 bp, Homo sapiens
ccccagagaaagtcagcagcat

SEQ ID NO: 7921252 - DNA, 22 bp, Homo sapiens
ccccagaagtttgcacaagaga

SEQ ID NO: 7921253 - DNA, 22 bp, Homo sapiens
ccccagagaaagtcagcagcat

SEQ ID NO: 7921254 - DNA, 22 bp, Homo sapiens
ccccagagagcaccatgaagcc

SEQ ID NO: 7921255 - DNA, 22 bp, Homo sapiens
ccccagagagcaccatgaagcc

SEQ ID NO: 7921256 - DNA, 22 bp, Homo sapiens
ccccagagagcaccatgaagcc

SEQ ID NO: 7921257 - DNA, 22 bp, Homo sapiens
ccccagagagcaccatgaagcc

SEQ ID NO: 7921258 - DNA, 22 bp, Homo sapiens
ccccagagaaagtcagcagcat

SEQ ID NO: 7921259 - DNA, 22 bp, Homo sapiens
ccccagagtgagggattgagtg

SEQ ID NO: 7921260 - DNA, 22 bp, Homo sapiens
ccccagagtgagggattgagtg

SEQ ID NO: 7921261 - DNA, 22 bp, Homo sapiens
ccccagagagcaccatgaagcc

SEQ ID NO: 7921262 - DNA, 22 bp, Homo sapiens
ccccagagagcaccatgaagcc

SEQ ID NO: 7921263 - DNA, 22 bp, Homo sapiens
ccccagaaagcctggcactagg

SEQ ID NO: 7921264 - DNA, 22 bp, Homo sapiens
ccccagaaagcctggcactagg

SEQ ID NO: 7921265 - DNA, 22 bp, Homo sapiens
ccccagaaagcctggcactagg

SEQ ID NO: 7921266 - DNA, 22 bp, Homo sapiens
ccccagaaagcctggcactagg

SEQ ID NO: 7921267 - DNA, 22 bp, Homo sapiens
ccccacttgctcagcatgtcca

SEQ ID NO: 7921268 - DNA, 22 bp, Homo sapiens
ccccactttgagtagcacttga

SEQ ID NO: 7921269 - DNA, 22 bp, Homo sapiens
ccccagaaggggacagagggta

SEQ ID NO: 7921270 - DNA, 22 bp, Homo sapiens
ccccagaaggggacagagggta

SEQ ID NO: 7921271 - DNA, 22 bp, Homo sapiens
ccccagaaggggacagagggta

SEQ ID NO: 7921272 - DNA, 22 bp, Homo sapiens
ccccagaaggggacagagggta

SEQ ID NO: 7921273 - DNA, 22 bp, Homo sapiens
ccccagaagtttgcacaagaga

SEQ ID NO: 7921274 - DNA, 22 bp, Homo sapiens
ccccacttgctcagcatgtcca

SEQ ID NO: 7921275 - DNA, 22 bp, Homo sapiens
cccattcatcctcgcttccttc

SEQ ID NO: 7921276 - DNA, 22 bp, Homo sapiens
ccccactttgagtagcacttga

SEQ ID NO: 7921277 - DNA, 19 bp, Homo sapiens
ccccacttccatgggctcc

SEQ ID NO: 7921278 - DNA, 22 bp, Homo sapiens
cccattcatcctcgcttccttc

SEQ ID NO: 7921279 - DNA, 22 bp, Homo sapiens
ccctgcccaccacatgctggga

SEQ ID NO: 7921280 - DNA, 22 bp, Homo sapiens
ccctgcccatcggggcggcctg

SEQ ID NO: 7921281 - DNA, 22 bp, Homo sapiens
ccctgccagggtcctgacagac

SEQ ID NO: 7921282 - DNA, 18 bp, Homo sapiens
ccctgccagctcccagca

SEQ ID NO: 7921283 - DNA, 18 bp, Homo sapiens
ccctgccagctcccagca

SEQ ID NO: 7921284 - DNA, 22 bp, Homo sapiens
ccctgcccaccacatgctggga

SEQ ID NO: 7921285 - DNA, 22 bp, Homo sapiens
ccctgccagggtcctgacagac

SEQ ID NO: 7921286 - DNA, 22 bp, Homo sapiens
ccctgccctggagacacttaaa

SEQ ID NO: 7921287 - DNA, 22 bp, Homo sapiens
ccctgccctggagacacttaaa

SEQ ID NO: 7921288 - DNA, 21 bp, Homo sapiens
ccctgccctcaaggacagtgc

SEQ ID NO: 7921289 - DNA, 22 bp, Homo sapiens
ccctgccccaggcggcttcact

SEQ ID NO: 7921290 - DNA, 23 bp, Homo sapiens
ccctgcccattgagcaggacgtc

SEQ ID NO: 7921291 - DNA, 23 bp, Homo sapiens
ccctgcccattgagcaggacgtc

SEQ ID NO: 7921292 - DNA, 22 bp, Homo sapiens
ccctgccccaggcggcttcact

SEQ ID NO: 7921293 - DNA, 22 bp, Homo sapiens
ccctgccccaggcggcttcact

SEQ ID NO: 7921294 - DNA, 22 bp, Homo sapiens
ccctgccccaggcggcttcact

SEQ ID NO: 7921295 - DNA, 22 bp, Homo sapiens
ccctgctgtcaggtgctgggag

SEQ ID NO: 7921296 - DNA, 22 bp, Homo sapiens
ccctgctgtcaggtgctgggag

SEQ ID NO: 7921297 - DNA, 22 bp, Homo sapiens
ccctgctgtcaggtgctgggag

SEQ ID NO: 7921298 - DNA, 22 bp, Homo sapiens
ccctgctgtcaggtgctgggag

SEQ ID NO: 7921299 - DNA, 22 bp, Homo sapiens
ccctgctgcatggcctccacga

SEQ ID NO: 7921300 - DNA, 22 bp, Homo sapiens
ccctgctgccttcacccaggac

SEQ ID NO: 7921301 - DNA, 22 bp, Homo sapiens
ccctgctgccttcacccaggac

SEQ ID NO: 7921302 - DNA, 22 bp, Homo sapiens
ccctgctgcaggcttcaggagg

SEQ ID NO: 7921303 - DNA, 22 bp, Homo sapiens
ccctgctgcaggcttcaggagg

SEQ ID NO: 7921304 - DNA, 19 bp, Homo sapiens
ccctgccctggtgactggg

SEQ ID NO: 7921305 - DNA, 19 bp, Homo sapiens
ccctgccctggtgactggg

SEQ ID NO: 7921306 - DNA, 22 bp, Homo sapiens
ccctgccctgggcagaagtggg

SEQ ID NO: 7921307 - DNA, 22 bp, Homo sapiens
ccctgccctggagacacttaaa

SEQ ID NO: 7921308 - DNA, 22 bp, Homo sapiens
ccctgccctgggcagaagtggg

SEQ ID NO: 7921309 - DNA, 22 bp, Homo sapiens
ccctgctgtgtagcggaggaac

SEQ ID NO: 7921310 - DNA, 22 bp, Homo sapiens
ccctgctgtgcctgactgccat

SEQ ID NO: 7921311 - DNA, 22 bp, Homo sapiens
ccctgctgtgcctgactgccat

SEQ ID NO: 7921312 - DNA, 22 bp, Homo sapiens
ccctgctgtgcctgactgccat

SEQ ID NO: 7921313 - DNA, 22 bp, Homo sapiens
ccctgctgtgtcccacctggaa

SEQ ID NO: 7921314 - DNA, 22 bp, Homo sapiens
ccctgctgtgtcccacctggaa

SEQ ID NO: 7921315 - DNA, 22 bp, Homo sapiens
ccctgctgtgtcccacctggaa

SEQ ID NO: 7921316 - DNA, 22 bp, Homo sapiens
ccctgctgtccctcagtcctgc

SEQ ID NO: 7921317 - DNA, 22 bp, Homo sapiens
ccctgctgtccctcagtcctgc

SEQ ID NO: 7921318 - DNA, 22 bp, Homo sapiens
ccctgctgtccctcagtcctgc

SEQ ID NO: 7921319 - DNA, 22 bp, Homo sapiens
ccctgctgtccctcagtcctgc

SEQ ID NO: 7921320 - DNA, 22 bp, Homo sapiens
ccctgccaatcccgtctctctg

SEQ ID NO: 7921321 - DNA, 22 bp, Homo sapiens
ccctgccaatcccgtctctctg

SEQ ID NO: 7921322 - DNA, 22 bp, Homo sapiens
ccctgccaatcccgtctctctg

SEQ ID NO: 7921323 - DNA, 23 bp, Homo sapiens
ccctgcatctgtccctcaccagt

SEQ ID NO: 7921324 - DNA, 18 bp, Homo sapiens
ccctgccagctcccagca

SEQ ID NO: 7921325 - DNA, 18 bp, Homo sapiens
ccctgccagctcccagca

SEQ ID NO: 7921326 - DNA, 22 bp, Homo sapiens
ccctgccagatgtgcttcagtt

SEQ ID NO: 7921327 - DNA, 18 bp, Homo sapiens
ccctgccagctcccagca

SEQ ID NO: 7921328 - DNA, 22 bp, Homo sapiens
ccctgccagatgtgcttcagtt

SEQ ID NO: 7921329 - DNA, 22 bp, Homo sapiens
ccctgccagatgtgcttcagtt

SEQ ID NO: 7921330 - DNA, 22 bp, Homo sapiens
ccctgcacagcctggctctctt

SEQ ID NO: 7921331 - DNA, 22 bp, Homo sapiens
ccctgcacactcgtgtcttgac

SEQ ID NO: 7921332 - DNA, 22 bp, Homo sapiens
ccctcccaggagtggccagaga

SEQ ID NO: 7921333 - DNA, 22 bp, Homo sapiens
ccctcccaggagtggccagaga

SEQ ID NO: 7921334 - DNA, 22 bp, Homo sapiens
ccctcccaggagtggccagaga

SEQ ID NO: 7921335 - DNA, 22 bp, Homo sapiens
ccctcccaggagtggccagaga

SEQ ID NO: 7921336 - DNA, 22 bp, Homo sapiens
ccctcccagatgggcttgaggt

SEQ ID NO: 7921337 - DNA, 22 bp, Homo sapiens
ccctcccagatgggcttgaggt

SEQ ID NO: 7921338 - DNA, 20 bp, Homo sapiens
ccctcccagatgcttcccaa

SEQ ID NO: 7921339 - DNA, 20 bp, Homo sapiens
ccctcccagatgcttcccaa

SEQ ID NO: 7921340 - DNA, 22 bp, Homo sapiens
ccctcccaagcactctgacata

SEQ ID NO: 7921341 - DNA, 22 bp, Homo sapiens
ccctcccaagcactctgacata

SEQ ID NO: 7921342 - DNA, 22 bp, Homo sapiens
ccctcccaagcactctgacata

SEQ ID NO: 7921343 - DNA, 22 bp, Homo sapiens
ccctcccaagcactctgacata

SEQ ID NO: 7921344 - DNA, 22 bp, Homo sapiens
ccctccattaaaacagacctat

SEQ ID NO: 7921345 - DNA, 22 bp, Homo sapiens
ccctccattaaaacagacctat

SEQ ID NO: 7921346 - DNA, 22 bp, Homo sapiens
ccctccatgagtgtgctgctgg

SEQ ID NO: 7921347 - DNA, 22 bp, Homo sapiens
ccctcagctccaccctcagcag

SEQ ID NO: 7921348 - DNA, 22 bp, Homo sapiens
ccctcagctccaccctcagcag

SEQ ID NO: 7921349 - DNA, 22 bp, Homo sapiens
ccctcagctccaccctcagcag

SEQ ID NO: 7921350 - DNA, 23 bp, Homo sapiens
aggggcagcaagttttggtgtta

SEQ ID NO: 7921351 - DNA, 23 bp, Homo sapiens
aggggcagcaagttttggtgtta

SEQ ID NO: 7921352 - DNA, 23 bp, Homo sapiens
aggggcagcaagttttggtgtta

SEQ ID NO: 7921353 - DNA, 23 bp, Homo sapiens
aggggcagcaagttttggtgtta

SEQ ID NO: 7921354 - DNA, 22 bp, Homo sapiens
aggggcagcctcacaatcctct

SEQ ID NO: 7921355 - DNA, 22 bp, Homo sapiens
aggggcagcctcacaatcctct

SEQ ID NO: 7921356 - DNA, 23 bp, Homo sapiens
aggggcagcaagttttggtgtta

SEQ ID NO: 7921357 - DNA, 23 bp, Homo sapiens
aggggcagcaagttttggtgtta

SEQ ID NO: 7921358 - DNA, 23 bp, Homo sapiens
aggggcagcaagttttggtgtta

SEQ ID NO: 7921359 - DNA, 22 bp, Homo sapiens
aggggcacttctcaggctgtgg

SEQ ID NO: 7921360 - DNA, 19 bp, Homo sapiens
aggggcactgtctctagag

SEQ ID NO: 7921361 - DNA, 19 bp, Homo sapiens
aggggcactgtctctagag

SEQ ID NO: 7921362 - DNA, 22 bp, Homo sapiens
aggggcacttctcaggctgtgg

SEQ ID NO: 7921363 - DNA, 22 bp, Homo sapiens
aggggcacttctcaggctgtgg

SEQ ID NO: 7921364 - DNA, 22 bp, Homo sapiens
aggggcacttctcaggctgtgg

SEQ ID NO: 7921365 - DNA, 22 bp, Homo sapiens
cctcttccactgggccccatcc

SEQ ID NO: 7921366 - DNA, 22 bp, Homo sapiens
cctcttcatcctggaagctgct

SEQ ID NO: 7921367 - DNA, 22 bp, Homo sapiens
cctcttccactgggccccatcc

SEQ ID NO: 7921368 - DNA, 22 bp, Homo sapiens
cctcttccactgggccccatcc

SEQ ID NO: 7921369 - DNA, 22 bp, Homo sapiens
cctgaaacagtccttgccctca

SEQ ID NO: 7921370 - DNA, 22 bp, Homo sapiens
cctcttcatcctggaagctgct

SEQ ID NO: 7921371 - DNA, 22 bp, Homo sapiens
cctcttcaggcactcgaaggcc

SEQ ID NO: 7921372 - DNA, 18 bp, Homo sapiens
aggggcagcttgtgtgga

SEQ ID NO: 7921373 - DNA, 18 bp, Homo sapiens
aggggcagcttgtgtgga

SEQ ID NO: 7921374 - DNA, 18 bp, Homo sapiens
aggggcagcttgtgtgga

SEQ ID NO: 7921375 - DNA, 22 bp, Homo sapiens
aggggcagcctcacaatcctct

SEQ ID NO: 7921376 - DNA, 22 bp, Homo sapiens
aggggcacgagtagagctctag

SEQ ID NO: 7921377 - DNA, 22 bp, Homo sapiens
aggggcacgagtagagctctag

SEQ ID NO: 7921378 - DNA, 22 bp, Homo sapiens
aggggcacgagtagagctctag

SEQ ID NO: 7921379 - DNA, 22 bp, Homo sapiens
aggggcactagaatgggagact

SEQ ID NO: 7921380 - DNA, 19 bp, Homo sapiens
aggggcactgtctctagag

SEQ ID NO: 7921381 - DNA, 19 bp, Homo sapiens
aggggcactgtctctagag

SEQ ID NO: 7921382 - DNA, 19 bp, Homo sapiens
aggggcactgtctctagag

SEQ ID NO: 7921383 - DNA, 22 bp, Homo sapiens
aggggcactagaatgggagact

SEQ ID NO: 7921384 - DNA, 22 bp, Homo sapiens
aggggcactagaatgggagact

SEQ ID NO: 7921385 - DNA, 22 bp, Homo sapiens
aggggcactagaatgggagact

SEQ ID NO: 7921386 - DNA, 22 bp, Homo sapiens
aggggatggagctggaaggcag

SEQ ID NO: 7921387 - DNA, 22 bp, Homo sapiens
aggggatggagctggaaggcag

SEQ ID NO: 7921388 - DNA, 22 bp, Homo sapiens
aggggatggagctggaaggcag

SEQ ID NO: 7921389 - DNA, 22 bp, Homo sapiens
aggggatggagctggaaggcag

SEQ ID NO: 7921390 - DNA, 20 bp, Homo sapiens
aggggcacctgcgacggggc

SEQ ID NO: 7921391 - DNA, 20 bp, Homo sapiens
aggggcacctgcgacggggc

SEQ ID NO: 7921392 - DNA, 22 bp, Homo sapiens
aggggcaaatgtgagcctggaa

SEQ ID NO: 7921393 - DNA, 22 bp, Homo sapiens
aggggcaaatgtgagcctggaa

SEQ ID NO: 7921394 - DNA, 22 bp, Homo sapiens
aggggatggagctggaaggcag

SEQ ID NO: 7921395 - DNA, 22 bp, Homo sapiens
aggggatggagctggaaggcag

SEQ ID NO: 7921396 - DNA, 22 bp, Homo sapiens
aggggatggagctggaaggcag

SEQ ID NO: 7921397 - DNA, 22 bp, Homo sapiens
aggggatggagctggaaggcag

SEQ ID NO: 7921398 - DNA, 22 bp, Homo sapiens
aggggatgcctgaggatctgta

SEQ ID NO: 7921399 - DNA, 22 bp, Homo sapiens
aggggatgcctgaggatctgta

SEQ ID NO: 7921400 - DNA, 22 bp, Homo sapiens
aggggatgcctgaggatctgta

SEQ ID NO: 7921401 - DNA, 22 bp, Homo sapiens
aggggatggagctggaaggcag

SEQ ID NO: 7921402 - DNA, 22 bp, Homo sapiens
aggggatgcctgaggatctgta

SEQ ID NO: 7921403 - DNA, 22 bp, Homo sapiens
aggggatgcctagtggagtctc

SEQ ID NO: 7921404 - DNA, 22 bp, Homo sapiens
agggctggccacatgatttggt

SEQ ID NO: 7921405 - DNA, 22 bp, Homo sapiens
agggctggccacatgatttggt

SEQ ID NO: 7921406 - DNA, 22 bp, Homo sapiens
agggctggctaggtgcgttccc

SEQ ID NO: 7921407 - DNA, 22 bp, Homo sapiens
agggctggctaggtgcgttccc

SEQ ID NO: 7921408 - DNA, 22 bp, Homo sapiens
agggctggctaggtgcgttccc

SEQ ID NO: 7921409 - DNA, 22 bp, Homo sapiens
agggctggctaggtgcgttccc

SEQ ID NO: 7921410 - DNA, 22 bp, Homo sapiens
agggctggctaggtgcgttccc

SEQ ID NO: 7921411 - DNA, 22 bp, Homo sapiens
agggctggctaggtgcgttccc

SEQ ID NO: 7921412 - DNA, 22 bp, Homo sapiens
agggctggcatctctaatgctg

SEQ ID NO: 7921413 - DNA, 22 bp, Homo sapiens
agggctggcatctctaatgctg

SEQ ID NO: 7921414 - DNA, 22 bp, Homo sapiens
agggctggccacatgatttggt

SEQ ID NO: 7921415 - DNA, 22 bp, Homo sapiens
agggctggccacatgatttggt

SEQ ID NO: 7921416 - DNA, 22 bp, Homo sapiens
agggctggcatctctaatgctg

SEQ ID NO: 7921417 - DNA, 22 bp, Homo sapiens
agggctggctaggtgcgttccc

SEQ ID NO: 7921418 - DNA, 22 bp, Homo sapiens
agggctggctccgttaccttga

SEQ ID NO: 7921419 - DNA, 22 bp, Homo sapiens
agggctggctccgttaccttga

SEQ ID NO: 7921420 - DNA, 22 bp, Homo sapiens
agggctggctccgttaccttga

SEQ ID NO: 7921421 - DNA, 22 bp, Homo sapiens
agggctggctaggtgcgttccc

SEQ ID NO: 7921422 - DNA, 22 bp, Homo sapiens
agggctggctccgttaccttga

SEQ ID NO: 7921423 - DNA, 22 bp, Homo sapiens
aggggagcaacatagtcactct

SEQ ID NO: 7921424 - DNA, 22 bp, Homo sapiens
aggggagcaacatagtcactct

SEQ ID NO: 7921425 - DNA, 22 bp, Homo sapiens
aggggagagttaatgtgaatgt

SEQ ID NO: 7921426 - DNA, 22 bp, Homo sapiens
agggctggctccgttaccttga

SEQ ID NO: 7921427 - DNA, 22 bp, Homo sapiens
agggctggctccgttaccttga

SEQ ID NO: 7921428 - DNA, 22 bp, Homo sapiens
agggctggctccgttaccttga

SEQ ID NO: 7921429 - DNA, 22 bp, Homo sapiens
aggggagagttaatgtgaatgt

SEQ ID NO: 7921430 - DNA, 22 bp, Homo sapiens
aggggaggtgtccccaaatctc

SEQ ID NO: 7921431 - DNA, 22 bp, Homo sapiens
aggggaggtgtccccaaatctc

SEQ ID NO: 7921432 - DNA, 22 bp, Homo sapiens
aggggaggtgtccccaaatctc

SEQ ID NO: 7921433 - DNA, 22 bp, Homo sapiens
aggggaggtgtccccaaatctc

SEQ ID NO: 7921434 - DNA, 22 bp, Homo sapiens
aggggaggtgtccccaaatctc

SEQ ID NO: 7921435 - DNA, 22 bp, Homo sapiens
aggggaggtgtccccaaatctc

SEQ ID NO: 7921436 - DNA, 22 bp, Homo sapiens
aggggatgatcctcccgcagcg

SEQ ID NO: 7921437 - DNA, 22 bp, Homo sapiens
aggggatgatcctcccgcagcg

SEQ ID NO: 7921438 - DNA, 22 bp, Homo sapiens
aggggatgcctagtggagtctc

SEQ ID NO: 7921439 - DNA, 22 bp, Homo sapiens
aggggatgcctagtggagtctc

SEQ ID NO: 7921440 - DNA, 22 bp, Homo sapiens
aggggaggcagcgataaacctg

SEQ ID NO: 7921441 - DNA, 22 bp, Homo sapiens
aggggaggcagcgataaacctg

SEQ ID NO: 7921442 - DNA, 22 bp, Homo sapiens
aggggaggcagcgataaacctg

SEQ ID NO: 7921443 - DNA, 22 bp, Homo sapiens
aggggaggcagcgataaacctg

SEQ ID NO: 7921444 - DNA, 22 bp, Homo sapiens
aggggaggcagcgataaacctg

SEQ ID NO: 7921445 - DNA, 22 bp, Homo sapiens
aggggaggcagcgataaacctg

SEQ ID NO: 7921446 - DNA, 22 bp, Homo sapiens
aggggaggcagcgataaacctg

SEQ ID NO: 7921447 - DNA, 22 bp, Homo sapiens
aggggaggagcttttcttgcct

SEQ ID NO: 7921448 - DNA, 22 bp, Homo sapiens
aggggaggagcttttcttgcct

SEQ ID NO: 7921449 - DNA, 22 bp, Homo sapiens
aggggaggagcttttcttgcct

SEQ ID NO: 7921450 - DNA, 22 bp, Homo sapiens
cctgagagcattccacactgaa

SEQ ID NO: 7921451 - DNA, 22 bp, Homo sapiens
cctgagagcattccacactgaa

SEQ ID NO: 7921452 - DNA, 22 bp, Homo sapiens
cctgagagccagtgcctgccca

SEQ ID NO: 7921453 - DNA, 22 bp, Homo sapiens
cctgagagccagtgcctgccca

SEQ ID NO: 7921454 - DNA, 22 bp, Homo sapiens
cctgagagccagtgcctgccca

SEQ ID NO: 7921455 - DNA, 22 bp, Homo sapiens
cctgagagccctagccaggcgc

SEQ ID NO: 7921456 - DNA, 22 bp, Homo sapiens
cctgagagccctagccaggcgc

SEQ ID NO: 7921457 - DNA, 22 bp, Homo sapiens
cctgaagcaagggtaggcaggt

SEQ ID NO: 7921458 - DNA, 22 bp, Homo sapiens
cctgagagagtgagccctgaca

SEQ ID NO: 7921459 - DNA, 22 bp, Homo sapiens
cctgagagcagcttcctgctta

SEQ ID NO: 7921460 - DNA, 22 bp, Homo sapiens
cctgagagcagcttcctgctta

SEQ ID NO: 7921461 - DNA, 22 bp, Homo sapiens
cctgagagcagcttcctgctta

SEQ ID NO: 7921462 - DNA, 22 bp, Homo sapiens
cctgagaggccctctcactgtc

SEQ ID NO: 7921463 - DNA, 22 bp, Homo sapiens
cctgagagggggccctagaaat

SEQ ID NO: 7921464 - DNA, 22 bp, Homo sapiens
cctgagagtaggtgtctcttta

SEQ ID NO: 7921465 - DNA, 22 bp, Homo sapiens
cctgagaggttggcctgtccag

SEQ ID NO: 7921466 - DNA, 22 bp, Homo sapiens
cctgagaggttggcctgtccag

SEQ ID NO: 7921467 - DNA, 22 bp, Homo sapiens
cctgagaggttggcctgtccag

SEQ ID NO: 7921468 - DNA, 22 bp, Homo sapiens
cctgagagcgagtggcctcatg

SEQ ID NO: 7921469 - DNA, 22 bp, Homo sapiens
cctgagagcgagtggcctcatg

SEQ ID NO: 7921470 - DNA, 22 bp, Homo sapiens
cctgagagcgagtggcctcatg

SEQ ID NO: 7921471 - DNA, 22 bp, Homo sapiens
cctgagaggccctctcactgtc

SEQ ID NO: 7921472 - DNA, 22 bp, Homo sapiens
cctgagaggccctctcactgtc

SEQ ID NO: 7921473 - DNA, 22 bp, Homo sapiens
cctgaagaagttgttatggtct

SEQ ID NO: 7921474 - DNA, 22 bp, Homo sapiens
cctgaaatttgaagacctgaat

SEQ ID NO: 7921475 - DNA, 21 bp, Homo sapiens
cctgaaattctcactagctta

SEQ ID NO: 7921476 - DNA, 22 bp, Homo sapiens
cctgaacaaatggcatagccaa

SEQ ID NO: 7921477 - DNA, 21 bp, Homo sapiens
cctgaaattctcactagctta

SEQ ID NO: 7921478 - DNA, 22 bp, Homo sapiens
cctgaaatgagttctgctcact

SEQ ID NO: 7921479 - DNA, 22 bp, Homo sapiens
cctgaaatgactccagctgagt

SEQ ID NO: 7921480 - DNA, 21 bp, Homo sapiens
cctgaaattctcactagctta

SEQ ID NO: 7921481 - DNA, 22 bp, Homo sapiens
cctgaaatgagttctgctcact

SEQ ID NO: 7921482 - DNA, 22 bp, Homo sapiens
cctgaaatccatagtttacact

SEQ ID NO: 7921483 - DNA, 22 bp, Homo sapiens
cctgaaatgactccagctgagt

SEQ ID NO: 7921484 - DNA, 22 bp, Homo sapiens
cctgaaatccatagtttacact

SEQ ID NO: 7921485 - DNA, 22 bp, Homo sapiens
cctgaaatgactccagctgagt

SEQ ID NO: 7921486 - DNA, 20 bp, Homo sapiens
cctgaagagtttctctttct

SEQ ID NO: 7921487 - DNA, 20 bp, Homo sapiens
cctgaagagtttctctttct

SEQ ID NO: 7921488 - DNA, 22 bp, Homo sapiens
cctgaagatccattatagacac

SEQ ID NO: 7921489 - DNA, 22 bp, Homo sapiens
cctgaagatccattatagacac

SEQ ID NO: 7921490 - DNA, 22 bp, Homo sapiens
cctgaagatgagggacagctaa

SEQ ID NO: 7921491 - DNA, 22 bp, Homo sapiens
cctgaagacaacttttatcacc

SEQ ID NO: 7921492 - DNA, 22 bp, Homo sapiens
cctgaagaattcaaatccagat

SEQ ID NO: 7921493 - DNA, 22 bp, Homo sapiens
cctgaagagcactctagagttg

SEQ ID NO: 7921494 - DNA, 22 bp, Homo sapiens
cctgaagagtgaatgtggcagt

SEQ ID NO: 7921495 - DNA, 22 bp, Homo sapiens
cctgaagagcactctagagttg

SEQ ID NO: 7921496 - DNA, 22 bp, Homo sapiens
agggtatgttttaggctgagtt

SEQ ID NO: 7921497 - DNA, 22 bp, Homo sapiens
agggtaggtgtaagatagccct

SEQ ID NO: 7921498 - DNA, 22 bp, Homo sapiens
agggtaggtgtaagatagccct

SEQ ID NO: 7921499 - DNA, 22 bp, Homo sapiens
agggtagggtaaatgatgcatc

SEQ ID NO: 7921500 - DNA, 22 bp, Homo sapiens
agggtagggtaaatgatgcatc

SEQ ID NO: 7921501 - DNA, 22 bp, Homo sapiens
agggtagggtaaatgatgcatc

SEQ ID NO: 7921502 - DNA, 22 bp, Homo sapiens
agggtagggtaaatgatgcatc

SEQ ID NO: 7921503 - DNA, 22 bp, Homo sapiens
agggtagggtaaatgatgcatc

SEQ ID NO: 7921504 - DNA, 22 bp, Homo sapiens
agggtagggccgtagggccatg

SEQ ID NO: 7921505 - DNA, 22 bp, Homo sapiens
agggtagggccgtagggccatg

SEQ ID NO: 7921506 - DNA, 22 bp, Homo sapiens
agggtagggccgtagggccatg

SEQ ID NO: 7921507 - DNA, 22 bp, Homo sapiens
cctgaggtctagagtcagggtg

SEQ ID NO: 7921508 - DNA, 22 bp, Homo sapiens
cctgaggtggctgcagcactgc

SEQ ID NO: 7921509 - DNA, 22 bp, Homo sapiens
agggtcacctgcttgccagggc

SEQ ID NO: 7921510 - DNA, 22 bp, Homo sapiens
agggtcaccagttcataggcac

SEQ ID NO: 7921511 - DNA, 22 bp, Homo sapiens
agggtcaacatttcattgattc

SEQ ID NO: 7921512 - DNA, 22 bp, Homo sapiens
agggtatgttttaggctgagtt

SEQ ID NO: 7921513 - DNA, 22 bp, Homo sapiens
cctgagagtgagtgccacctta

SEQ ID NO: 7921514 - DNA, 22 bp, Homo sapiens
cctgagagtgagtgccacctta

SEQ ID NO: 7921515 - DNA, 22 bp, Homo sapiens
cctgagagtaggtgtctcttta

SEQ ID NO: 7921516 - DNA, 22 bp, Homo sapiens
cctgagagtaggtgtctcttta

SEQ ID NO: 7921517 - DNA, 22 bp, Homo sapiens
cctgagagtgagggcctcctta

SEQ ID NO: 7921518 - DNA, 22 bp, Homo sapiens
cctgagagtgagggcctcctta

SEQ ID NO: 7921519 - DNA, 22 bp, Homo sapiens
aggggtgacacatatcagtgca

SEQ ID NO: 7921520 - DNA, 22 bp, Homo sapiens
agggtaggaactgagtggaagg

SEQ ID NO: 7921521 - DNA, 22 bp, Homo sapiens
agggtaggaactgagtggaagg

SEQ ID NO: 7921522 - DNA, 22 bp, Homo sapiens
cctgagagtgagtgcctcctta

SEQ ID NO: 7921523 - DNA, 22 bp, Homo sapiens
cctgagagtgagtgcctcctta

SEQ ID NO: 7921524 - DNA, 22 bp, Homo sapiens
aggggtgaaggcccgataggag

SEQ ID NO: 7921525 - DNA, 22 bp, Homo sapiens
agggtagggcccggagacagac

SEQ ID NO: 7921526 - DNA, 22 bp, Homo sapiens
agggtagggcccggagacagac

SEQ ID NO: 7921527 - DNA, 22 bp, Homo sapiens
agggtagggcccggagacagac

SEQ ID NO: 7921528 - DNA, 22 bp, Homo sapiens
agggtagggccgtagggccatg

SEQ ID NO: 7921529 - DNA, 22 bp, Homo sapiens
agggtagggcccggagacagac

SEQ ID NO: 7921530 - DNA, 22 bp, Homo sapiens
agggtagggcccggagacagac

SEQ ID NO: 7921531 - DNA, 22 bp, Homo sapiens
agggtagggcccggagacagac

SEQ ID NO: 7921532 - DNA, 22 bp, Homo sapiens
agggtaggaactgagtggaagg

SEQ ID NO: 7921533 - DNA, 22 bp, Homo sapiens
agggtaggaactgagtggaagg

SEQ ID NO: 7921534 - DNA, 22 bp, Homo sapiens
agggtaggaactgagtggaagg

SEQ ID NO: 7921535 - DNA, 22 bp, Homo sapiens
agggtaggaactgagtggaagg

SEQ ID NO: 7921536 - DNA, 19 bp, Homo sapiens
agggcctgcagctcaagct

SEQ ID NO: 7921537 - DNA, 19 bp, Homo sapiens
agggcctgcagctcaagct

SEQ ID NO: 7921538 - DNA, 19 bp, Homo sapiens
agggcctgcagctcaagct

SEQ ID NO: 7921539 - DNA, 19 bp, Homo sapiens
agggcctgcagctcaagct

SEQ ID NO: 7921540 - DNA, 22 bp, Homo sapiens
agggcctgcatcaggagcttgg

SEQ ID NO: 7921541 - DNA, 22 bp, Homo sapiens
agggcctgcatcaggagcttgg

SEQ ID NO: 7921542 - DNA, 22 bp, Homo sapiens
agggcctgcatcaggagcttgg

SEQ ID NO: 7921543 - DNA, 22 bp, Homo sapiens
agggcctgcatcaggagcttgg

SEQ ID NO: 7921544 - DNA, 22 bp, Homo sapiens
agggcctgcatcaggagcttgg

SEQ ID NO: 7921545 - DNA, 22 bp, Homo sapiens
agggcctgcatcaggagcttgg

SEQ ID NO: 7921546 - DNA, 23 bp, Homo sapiens
agggcctgatggctcccgctggc

SEQ ID NO: 7921547 - DNA, 23 bp, Homo sapiens
agggcctgatggctcccgctggc

SEQ ID NO: 7921548 - DNA, 19 bp, Homo sapiens
agggcctgcagctcaagct

SEQ ID NO: 7921549 - DNA, 22 bp, Homo sapiens
agggcctgaggctgacggggag

SEQ ID NO: 7921550 - DNA, 22 bp, Homo sapiens
agggcctgaggctgacggggag

SEQ ID NO: 7921551 - DNA, 22 bp, Homo sapiens
agggcctgaggctgacggggag

SEQ ID NO: 7921552 - DNA, 22 bp, Homo sapiens
agggcctgaggctgacggggag

SEQ ID NO: 7921553 - DNA, 22 bp, Homo sapiens
agggcctgagctggctgacctc

SEQ ID NO: 7921554 - DNA, 22 bp, Homo sapiens
agggcctgagctggctgacctc

SEQ ID NO: 7921555 - DNA, 22 bp, Homo sapiens
agggcctgagctggctgacctc

SEQ ID NO: 7921556 - DNA, 22 bp, Homo sapiens
agggcctccagggcagcagtgg

SEQ ID NO: 7921557 - DNA, 22 bp, Homo sapiens
agggcctccagggcagcagtgg

SEQ ID NO: 7921558 - DNA, 22 bp, Homo sapiens
agggcctccagggcagcagtgg

SEQ ID NO: 7921559 - DNA, 22 bp, Homo sapiens
agggcctcagtgttctcatctg

SEQ ID NO: 7921560 - DNA, 22 bp, Homo sapiens
agggcctgagctggctgacctc

SEQ ID NO: 7921561 - DNA, 22 bp, Homo sapiens
agggcctgagctctcctccagt

SEQ ID NO: 7921562 - DNA, 22 bp, Homo sapiens
ccctggaagagcctgggcatgg

SEQ ID NO: 7921563 - DNA, 22 bp, Homo sapiens
ccctggaaggagatgggacatg

SEQ ID NO: 7921564 - DNA, 22 bp, Homo sapiens
agggcctcagtgttctcatctg

SEQ ID NO: 7921565 - DNA, 22 bp, Homo sapiens
ccctggaactcctaggcaagca

SEQ ID NO: 7921566 - DNA, 22 bp, Homo sapiens
ccctggaactgccaagcctcag

SEQ ID NO: 7921567 - DNA, 22 bp, Homo sapiens
ccctggaactgccaagcctcag

SEQ ID NO: 7921568 - DNA, 22 bp, Homo sapiens
ccctggaactcctaggcaagca

SEQ ID NO: 7921569 - DNA, 22 bp, Homo sapiens
ccctggaactcctaggcaagca

SEQ ID NO: 7921570 - DNA, 22 bp, Homo sapiens
ccctggaaatgaggcatgtgcg

SEQ ID NO: 7921571 - DNA, 22 bp, Homo sapiens
ccctggaacccatggccagtgt

SEQ ID NO: 7921572 - DNA, 22 bp, Homo sapiens
ccctgctttgcacccaggctgg

SEQ ID NO: 7921573 - DNA, 22 bp, Homo sapiens
ccctggaaatgaggcatgtgcg

SEQ ID NO: 7921574 - DNA, 22 bp, Homo sapiens
ccctgcttagcacccttgcacc

SEQ ID NO: 7921575 - DNA, 22 bp, Homo sapiens
ccctgcttccctgggagaggcg

SEQ ID NO: 7921576 - DNA, 22 bp, Homo sapiens
ccctgcttgtcacccctgggtc

SEQ ID NO: 7921577 - DNA, 22 bp, Homo sapiens
ccctgcttccgctgttttctca

SEQ ID NO: 7921578 - DNA, 22 bp, Homo sapiens
ccctgctttcaaccttctagct

SEQ ID NO: 7921579 - DNA, 22 bp, Homo sapiens
ccctgctttcaaccttctagct

SEQ ID NO: 7921580 - DNA, 22 bp, Homo sapiens
ccctgctttgcacccaggctgg

SEQ ID NO: 7921581 - DNA, 22 bp, Homo sapiens
agggcctggaactggagaccac

SEQ ID NO: 7921582 - DNA, 22 bp, Homo sapiens
agggcctggaactggagaccac

SEQ ID NO: 7921583 - DNA, 20 bp, Homo sapiens
agggcctgctctgtggtgtc

SEQ ID NO: 7921584 - DNA, 20 bp, Homo sapiens
agggcctgctctgtggtgtc

SEQ ID NO: 7921585 - DNA, 22 bp, Homo sapiens
agggcctggaactggagaccac

SEQ ID NO: 7921586 - DNA, 20 bp, Homo sapiens
agggcctgctctgtggtgtc

SEQ ID NO: 7921587 - DNA, 20 bp, Homo sapiens
agggcctgctctgtggtgtc

SEQ ID NO: 7921588 - DNA, 20 bp, Homo sapiens
agggcctgctctgtggtgtc

SEQ ID NO: 7921589 - DNA, 22 bp, Homo sapiens
agggcctgctctatcactctca

SEQ ID NO: 7921590 - DNA, 22 bp, Homo sapiens
agggcctgctctatcactctca

SEQ ID NO: 7921591 - DNA, 22 bp, Homo sapiens
agggcctgctctatcactctca

SEQ ID NO: 7921592 - DNA, 20 bp, Homo sapiens
agggcctgctctgtggtgtc

SEQ ID NO: 7921593 - DNA, 20 bp, Homo sapiens
agggcctgctctgtggtgtc

SEQ ID NO: 7921594 - DNA, 22 bp, Homo sapiens
agggcctggaactgtgggcagg

SEQ ID NO: 7921595 - DNA, 22 bp, Homo sapiens
agggcctggaactgtgggcagg

SEQ ID NO: 7921596 - DNA, 22 bp, Homo sapiens
agggcctggaactgtgggcagg

SEQ ID NO: 7921597 - DNA, 22 bp, Homo sapiens
agggcctggaactgtgggcagg

SEQ ID NO: 7921598 - DNA, 22 bp, Homo sapiens
agggcctggaactgtgggcagg

SEQ ID NO: 7921599 - DNA, 22 bp, Homo sapiens
agggcctggaactgtgggcagg

SEQ ID NO: 7921600 - DNA, 22 bp, Homo sapiens
agggcctggaactggagaccac

SEQ ID NO: 7921601 - DNA, 22 bp, Homo sapiens
agggcctggaactgtgggcagg

SEQ ID NO: 7921602 - DNA, 22 bp, Homo sapiens
agggcctggaactgtgggcagg

SEQ ID NO: 7921603 - DNA, 22 bp, Homo sapiens
agggcctggaactggagaccac

SEQ ID NO: 7921604 - DNA, 22 bp, Homo sapiens
cctcagcttgatttctgcagag

SEQ ID NO: 7921605 - DNA, 22 bp, Homo sapiens
cctcagcttgatttctgcagag

SEQ ID NO: 7921606 - DNA, 18 bp, Homo sapiens
cctcagaggcaaattgtt

SEQ ID NO: 7921607 - DNA, 22 bp, Homo sapiens
cctcaggaaccacattgctgct

SEQ ID NO: 7921608 - DNA, 22 bp, Homo sapiens
cctcaggaaatgaataaatggc

SEQ ID NO: 7921609 - DNA, 22 bp, Homo sapiens
cctcaggaaccacattgctgct

SEQ ID NO: 7921610 - DNA, 22 bp, Homo sapiens
cctcagcttgatttctgcagag

SEQ ID NO: 7921611 - DNA, 22 bp, Homo sapiens
cctcaggaaatgaataaatggc

SEQ ID NO: 7921612 - DNA, 19 bp, Homo sapiens
cctcagagctagtgaacat

SEQ ID NO: 7921613 - DNA, 19 bp, Homo sapiens
cctcagagctagtgaacat

SEQ ID NO: 7921614 - DNA, 23 bp, Homo sapiens
agggcctggcgtggagtgtgtgc

SEQ ID NO: 7921615 - DNA, 23 bp, Homo sapiens
agggcctggcgtggagtgtgtgc

SEQ ID NO: 7921616 - DNA, 22 bp, Homo sapiens
cctcagagcgcgtggcattatt

SEQ ID NO: 7921617 - DNA, 22 bp, Homo sapiens
agggcctggcgcgtggccgccg

SEQ ID NO: 7921618 - DNA, 20 bp, Homo sapiens
agggcctggagtacagcagg

SEQ ID NO: 7921619 - DNA, 20 bp, Homo sapiens
agggcctggagtacagcagg

SEQ ID NO: 7921620 - DNA, 22 bp, Homo sapiens
agggcctggcgcgtggccgccg

SEQ ID NO: 7921621 - DNA, 22 bp, Homo sapiens
agggcctggcgcgtggccgccg

SEQ ID NO: 7921622 - DNA, 23 bp, Homo sapiens
agggcctggcgtggagtgtgtgc

SEQ ID NO: 7921623 - DNA, 23 bp, Homo sapiens
agggcctggcgtggagtgtgtgc

SEQ ID NO: 7921624 - DNA, 23 bp, Homo sapiens
agggcctggcgtggagtgtgtgc

SEQ ID NO: 7921625 - DNA, 22 bp, Homo sapiens
agggctggagccacagctggga

SEQ ID NO: 7921626 - DNA, 22 bp, Homo sapiens
agggctggagccacagctggga

SEQ ID NO: 7921627 - DNA, 22 bp, Homo sapiens
agggctggagccacagctggga

SEQ ID NO: 7921628 - DNA, 22 bp, Homo sapiens
agggctggagccacagctggga

SEQ ID NO: 7921629 - DNA, 22 bp, Homo sapiens
agggctggagccacagctggga

SEQ ID NO: 7921630 - DNA, 22 bp, Homo sapiens
agggctggagccacagctggga

SEQ ID NO: 7921631 - DNA, 22 bp, Homo sapiens
agggctggagccacagctggga

SEQ ID NO: 7921632 - DNA, 22 bp, Homo sapiens
agggctggagccacagctggga

SEQ ID NO: 7921633 - DNA, 22 bp, Homo sapiens
agggctggagccacagctggga

SEQ ID NO: 7921634 - DNA, 22 bp, Homo sapiens
agggctggagccacagctggga

SEQ ID NO: 7921635 - DNA, 22 bp, Homo sapiens
agggctgctttgctaaatatgg

SEQ ID NO: 7921636 - DNA, 22 bp, Homo sapiens
agggctggagccacagctggga

SEQ ID NO: 7921637 - DNA, 22 bp, Homo sapiens
agggctggagccacagctggga

SEQ ID NO: 7921638 - DNA, 22 bp, Homo sapiens
agggctggagccacagctggga

SEQ ID NO: 7921639 - DNA, 22 bp, Homo sapiens
agggctgctttgctaaatatgg

SEQ ID NO: 7921640 - DNA, 22 bp, Homo sapiens
agggcgtggtggtgctggagca

SEQ ID NO: 7921641 - DNA, 22 bp, Homo sapiens
agggcgtggtggtgctggagca

SEQ ID NO: 7921642 - DNA, 22 bp, Homo sapiens
agggctaggaatggaactggag

SEQ ID NO: 7921643 - DNA, 22 bp, Homo sapiens
agggctgcatctgcctggtgaa

SEQ ID NO: 7921644 - DNA, 22 bp, Homo sapiens
agggctgctgaggaagccttgc

SEQ ID NO: 7921645 - DNA, 22 bp, Homo sapiens
agggctggagccacagctggga

SEQ ID NO: 7921646 - DNA, 22 bp, Homo sapiens
agggctggagccacagctggga

SEQ ID NO: 7921647 - DNA, 22 bp, Homo sapiens
agggctggagccacagctggga

SEQ ID NO: 7921648 - DNA, 22 bp, Homo sapiens
agggctggagggtactagttta

SEQ ID NO: 7921649 - DNA, 22 bp, Homo sapiens
agggctggagggtactagttta

SEQ ID NO: 7921650 - DNA, 22 bp, Homo sapiens
agggctggagggtactagttta

SEQ ID NO: 7921651 - DNA, 22 bp, Homo sapiens
agggctggagccacagctggga

SEQ ID NO: 7921652 - DNA, 22 bp, Homo sapiens
agggctggagccacagctggga

SEQ ID NO: 7921653 - DNA, 22 bp, Homo sapiens
agggctggagccacagctggga

SEQ ID NO: 7921654 - DNA, 22 bp, Homo sapiens
agggctggcaagggattgaaat

SEQ ID NO: 7921655 - DNA, 22 bp, Homo sapiens
agggctggcatctctaatgctg

SEQ ID NO: 7921656 - DNA, 22 bp, Homo sapiens
agggctggcatctctaatgctg

SEQ ID NO: 7921657 - DNA, 22 bp, Homo sapiens
agggctggcatctctaatgctg

SEQ ID NO: 7921658 - DNA, 22 bp, Homo sapiens
agggctggcatctctaatgctg

SEQ ID NO: 7921659 - DNA, 22 bp, Homo sapiens
agggctggcaagggattgaaat

SEQ ID NO: 7921660 - DNA, 22 bp, Homo sapiens
agggctggcaagggattgaaat

SEQ ID NO: 7921661 - DNA, 22 bp, Homo sapiens
agggctggcaagggattgaaat

SEQ ID NO: 7921662 - DNA, 22 bp, Homo sapiens
agggctggcaagggattgaaat

SEQ ID NO: 7921663 - DNA, 22 bp, Homo sapiens
agggctggagggtactagttta

SEQ ID NO: 7921664 - DNA, 22 bp, Homo sapiens
agggctggagggtactagttta

SEQ ID NO: 7921665 - DNA, 22 bp, Homo sapiens
agggctggagggtactagttta

SEQ ID NO: 7921666 - DNA, 22 bp, Homo sapiens
agggctggcaagggattgaaat

SEQ ID NO: 7921667 - DNA, 22 bp, Homo sapiens
agggctggcaagggattgaaat

SEQ ID NO: 7921668 - DNA, 22 bp, Homo sapiens
agggcgacaatggagagcgttt

SEQ ID NO: 7921669 - DNA, 22 bp, Homo sapiens
agggcgacaatggagagcgttt

SEQ ID NO: 7921670 - DNA, 22 bp, Homo sapiens
agggccttgctgtctgaagctg

SEQ ID NO: 7921671 - DNA, 22 bp, Homo sapiens
agggcgaggagacggaggcaca

SEQ ID NO: 7921672 - DNA, 22 bp, Homo sapiens
agggcgacaatggagagcgttt

SEQ ID NO: 7921673 - DNA, 22 bp, Homo sapiens
agggcgacaatggagagcgttt

SEQ ID NO: 7921674 - DNA, 22 bp, Homo sapiens
agggcgaggagacggaggcaca

SEQ ID NO: 7921675 - DNA, 22 bp, Homo sapiens
agggcgaggagacggaggcaca

SEQ ID NO: 7921676 - DNA, 22 bp, Homo sapiens
agggcgaggagacggaggcaca

SEQ ID NO: 7921677 - DNA, 22 bp, Homo sapiens
agggcgaggagacggaggcaca

SEQ ID NO: 7921678 - DNA, 22 bp, Homo sapiens
agggcgctgaaatactaacatg

SEQ ID NO: 7921679 - DNA, 22 bp, Homo sapiens
agggcgcctgctgtggccaccg

SEQ ID NO: 7921680 - DNA, 22 bp, Homo sapiens
agggcgaggagacggaggcaca

SEQ ID NO: 7921681 - DNA, 22 bp, Homo sapiens
agggcgtggtggtgctggagca

SEQ ID NO: 7921682 - DNA, 22 bp, Homo sapiens
agggcgtggtggtgctggagca

SEQ ID NO: 7921683 - DNA, 22 bp, Homo sapiens
agggcgtggtggtgctggagca

SEQ ID NO: 7921684 - DNA, 22 bp, Homo sapiens
agggcgtggtggtgctggagca

SEQ ID NO: 7921685 - DNA, 22 bp, Homo sapiens
agggcgtggtggtgctggagca

SEQ ID NO: 7921686 - DNA, 19 bp, Homo sapiens
agggcgtggtggcacatgt

SEQ ID NO: 7921687 - DNA, 19 bp, Homo sapiens
agggcgtggtggcacatgt

SEQ ID NO: 7921688 - DNA, 22 bp, Homo sapiens
agggcgtggtggtgctggagca

SEQ ID NO: 7921689 - DNA, 22 bp, Homo sapiens
agggcgctgaaatactaacatg

SEQ ID NO: 7921690 - DNA, 22 bp, Homo sapiens
agggcgggctcatcacatgctc

SEQ ID NO: 7921691 - DNA, 19 bp, Homo sapiens
agggcggggcccaggcaca

SEQ ID NO: 7921692 - DNA, 19 bp, Homo sapiens
agggcggggcccaggcaca

SEQ ID NO: 7921693 - DNA, 22 bp, Homo sapiens
cctcaggatccgcaggtgcagt

SEQ ID NO: 7921694 - DNA, 22 bp, Homo sapiens
cctcaggatccgcaggtgcagt

SEQ ID NO: 7921695 - DNA, 20 bp, Homo sapiens
cctcaggatgagggtgagca

SEQ ID NO: 7921696 - DNA, 22 bp, Homo sapiens
cctcaggatacaggagccacag

SEQ ID NO: 7921697 - DNA, 22 bp, Homo sapiens
cctcaggatacaggagccacag

SEQ ID NO: 7921698 - DNA, 22 bp, Homo sapiens
cctcaggatacaggagccacag

SEQ ID NO: 7921699 - DNA, 22 bp, Homo sapiens
cctcaggatacaggagccacag

SEQ ID NO: 7921700 - DNA, 22 bp, Homo sapiens
cctcaggatacaggagccacag

SEQ ID NO: 7921701 - DNA, 22 bp, Homo sapiens
cctcaggatacaggagccacag

SEQ ID NO: 7921702 - DNA, 20 bp, Homo sapiens
cctcaggatgagggtgagca

SEQ ID NO: 7921703 - DNA, 20 bp, Homo sapiens
cctcaggatgagggtgagca

SEQ ID NO: 7921704 - DNA, 22 bp, Homo sapiens
cctcaggcaagtcacttaacat

SEQ ID NO: 7921705 - DNA, 22 bp, Homo sapiens
cctcaggcaagtcacttaacat

SEQ ID NO: 7921706 - DNA, 22 bp, Homo sapiens
cctcaggcaggaaactgtcccg

SEQ ID NO: 7921707 - DNA, 22 bp, Homo sapiens
cctcaggcaggaaactgtcccg

SEQ ID NO: 7921708 - DNA, 22 bp, Homo sapiens
cctcaggccagggggcggccag

SEQ ID NO: 7921709 - DNA, 22 bp, Homo sapiens
cctcaggccagggggcggccag

SEQ ID NO: 7921710 - DNA, 22 bp, Homo sapiens
cctcaggccagggggcggccag

SEQ ID NO: 7921711 - DNA, 20 bp, Homo sapiens
cctcaggccagttttaaagt

SEQ ID NO: 7921712 - DNA, 22 bp, Homo sapiens
cctcaggcaggaaactgtcccg

SEQ ID NO: 7921713 - DNA, 22 bp, Homo sapiens
cctcaggcagtggtatggatgg

SEQ ID NO: 7921714 - DNA, 22 bp, Homo sapiens
cctcaggccagggggcggccag

SEQ ID NO: 7921715 - DNA, 22 bp, Homo sapiens
cctcaggccagggggcggccag

SEQ ID NO: 7921716 - DNA, 22 bp, Homo sapiens
cctcaggcctctgcctcattgg

SEQ ID NO: 7921717 - DNA, 22 bp, Homo sapiens
cctcaggccctgtccctgcgcc

SEQ ID NO: 7921718 - DNA, 22 bp, Homo sapiens
cctcaggccctgtccctgcgcc

SEQ ID NO: 7921719 - DNA, 22 bp, Homo sapiens
cctcaggccctgtccctgcgcc

SEQ ID NO: 7921720 - DNA, 22 bp, Homo sapiens
ccaggctctgcgctggacatgg

SEQ ID NO: 7921721 - DNA, 22 bp, Homo sapiens
ccaggctgctgttggtgtccgc

SEQ ID NO: 7921722 - DNA, 22 bp, Homo sapiens
ccaggctctgcgctggacatgg

SEQ ID NO: 7921723 - DNA, 22 bp, Homo sapiens
aggctagaggcttctggcttca

SEQ ID NO: 7921724 - DNA, 22 bp, Homo sapiens
ccaggctgcttagccttatctt

SEQ ID NO: 7921725 - DNA, 22 bp, Homo sapiens
ccaggctgctgttggtgtccgc

SEQ ID NO: 7921726 - DNA, 22 bp, Homo sapiens
aggctacatgttggggtggaag

SEQ ID NO: 7921727 - DNA, 22 bp, Homo sapiens
aggctacaggagacgccaggag

SEQ ID NO: 7921728 - DNA, 22 bp, Homo sapiens
aggctacatgttggggtggaag

SEQ ID NO: 7921729 - DNA, 22 bp, Homo sapiens
aggctacttctagagggacaat

SEQ ID NO: 7921730 - DNA, 22 bp, Homo sapiens
aggctagaggcttctggcttca

SEQ ID NO: 7921731 - DNA, 22 bp, Homo sapiens
aggctacttctagagggacaat

SEQ ID NO: 7921732 - DNA, 22 bp, Homo sapiens
aggctacttctagagggacaat

SEQ ID NO: 7921733 - DNA, 22 bp, Homo sapiens
aggctagactttggcgaagcac

SEQ ID NO: 7921734 - DNA, 22 bp, Homo sapiens
aggctacagatacagaggctac

SEQ ID NO: 7921735 - DNA, 22 bp, Homo sapiens
aggctacactgttttgatgtct

SEQ ID NO: 7921736 - DNA, 22 bp, Homo sapiens
aggctacagatacagaggctac

SEQ ID NO: 7921737 - DNA, 22 bp, Homo sapiens
aggctacagatacagaggctac

SEQ ID NO: 7921738 - DNA, 22 bp, Homo sapiens
aggctacagatacagaggctac

SEQ ID NO: 7921739 - DNA, 22 bp, Homo sapiens
aggctacagcctcaagagtgca

SEQ ID NO: 7921740 - DNA, 22 bp, Homo sapiens
aggctacagcctcaagagtgca

SEQ ID NO: 7921741 - DNA, 22 bp, Homo sapiens
aggcgtggttgaggcgagcata

SEQ ID NO: 7921742 - DNA, 22 bp, Homo sapiens
aggcgtggttgaggcgagcata

SEQ ID NO: 7921743 - DNA, 22 bp, Homo sapiens
aggcgtggttgaggcgagcata

SEQ ID NO: 7921744 - DNA, 22 bp, Homo sapiens
aggcgtggttgaggcgagcata

SEQ ID NO: 7921745 - DNA, 19 bp, Homo sapiens
aggctaaagagtcttgcgt

SEQ ID NO: 7921746 - DNA, 19 bp, Homo sapiens
aggctaaagagtcttgcgt

SEQ ID NO: 7921747 - DNA, 19 bp, Homo sapiens
aggctaaagagtcttgcgt

SEQ ID NO: 7921748 - DNA, 22 bp, Homo sapiens
aggctaagaccctcctggggcc

SEQ ID NO: 7921749 - DNA, 22 bp, Homo sapiens
aggctaagatgtggtctgagca

SEQ ID NO: 7921750 - DNA, 22 bp, Homo sapiens
aggctaatatggcacatgaaca

SEQ ID NO: 7921751 - DNA, 22 bp, Homo sapiens
aggctaatatggcacatgaaca

SEQ ID NO: 7921752 - DNA, 22 bp, Homo sapiens
aggctaagtgggtgtcagggcc

SEQ ID NO: 7921753 - DNA, 22 bp, Homo sapiens
aggctaagttgattaaattgtt

SEQ ID NO: 7921754 - DNA, 22 bp, Homo sapiens
aggctaagtgggtgtcagggcc

SEQ ID NO: 7921755 - DNA, 22 bp, Homo sapiens
aggctaagtgggtgtcagggcc

SEQ ID NO: 7921756 - DNA, 22 bp, Homo sapiens
aggctaagatgtggtctgagca

SEQ ID NO: 7921757 - DNA, 22 bp, Homo sapiens
aggctaaggaccaggagggcca

SEQ ID NO: 7921758 - DNA, 22 bp, Homo sapiens
aggctaaggagtgtgatgctca

SEQ ID NO: 7921759 - DNA, 22 bp, Homo sapiens
aggctaagggatgactggagtg

SEQ ID NO: 7921760 - DNA, 22 bp, Homo sapiens
aggctaagggatgactggagtg

SEQ ID NO: 7921761 - DNA, 22 bp, Homo sapiens
aggctaaggtgggaggatcgct

SEQ ID NO: 7921762 - DNA, 22 bp, Homo sapiens
aggctaaggtgggaggatcgct

SEQ ID NO: 7921763 - DNA, 22 bp, Homo sapiens
aggctaaggtgggaggatcgct

SEQ ID NO: 7921764 - DNA, 22 bp, Homo sapiens
aggctaagtgattagtgacata

SEQ ID NO: 7921765 - DNA, 22 bp, Homo sapiens
ccaggctgggctacaagttgag

SEQ ID NO: 7921766 - DNA, 22 bp, Homo sapiens
ccaggctgggcggggaacctgg

SEQ ID NO: 7921767 - DNA, 22 bp, Homo sapiens
ccaggctgggctacaagttgag

SEQ ID NO: 7921768 - DNA, 22 bp, Homo sapiens
ccaggctgggcggggaacctgg

SEQ ID NO: 7921769 - DNA, 22 bp, Homo sapiens
ccaggctgggcggggaacctgg

SEQ ID NO: 7921770 - DNA, 22 bp, Homo sapiens
ccaggctgggcggggaacctgg

SEQ ID NO: 7921771 - DNA, 22 bp, Homo sapiens
ccaggctgggcggggaacctgg

SEQ ID NO: 7921772 - DNA, 22 bp, Homo sapiens
ccaggctgggcggggaacctgg

SEQ ID NO: 7921773 - DNA, 22 bp, Homo sapiens
ccaggctgggcggggaacctgg

SEQ ID NO: 7921774 - DNA, 21 bp, Homo sapiens
ccaggctgggagggcagttcc

SEQ ID NO: 7921775 - DNA, 22 bp, Homo sapiens
ccaggctggtctgaatttctag

SEQ ID NO: 7921776 - DNA, 22 bp, Homo sapiens
ccaggctggtctgaatttctag

SEQ ID NO: 7921777 - DNA, 22 bp, Homo sapiens
ccaggctggtctgaatttctag

SEQ ID NO: 7921778 - DNA, 15 bp, Homo sapiens
ccaggctgggtgagc

SEQ ID NO: 7921779 - DNA, 15 bp, Homo sapiens
ccaggctgggtgagc

SEQ ID NO: 7921780 - DNA, 22 bp, Homo sapiens
ccaggctgggctacaagttgag

SEQ ID NO: 7921781 - DNA, 22 bp, Homo sapiens
ccaggctgggctacaagttgag

SEQ ID NO: 7921782 - DNA, 22 bp, Homo sapiens
ccaggctgggctacaagttgag

SEQ ID NO: 7921783 - DNA, 22 bp, Homo sapiens
ccaggctgggctacaagttgag

SEQ ID NO: 7921784 - DNA, 22 bp, Homo sapiens
ccaggctgggctacaagttgag

SEQ ID NO: 7921785 - DNA, 22 bp, Homo sapiens
ccaggctggaatcaatattctg

SEQ ID NO: 7921786 - DNA, 22 bp, Homo sapiens
ccaggctggaatcaatattctg

SEQ ID NO: 7921787 - DNA, 22 bp, Homo sapiens
ccaggctggaatcaatattctg

SEQ ID NO: 7921788 - DNA, 22 bp, Homo sapiens
ccaggctgctttattactctgt

SEQ ID NO: 7921789 - DNA, 22 bp, Homo sapiens
ccaggctgctttattactctgt

SEQ ID NO: 7921790 - DNA, 22 bp, Homo sapiens
ccaggctgctttattactctgt

SEQ ID NO: 7921791 - DNA, 22 bp, Homo sapiens
ccaggctgctttattactctgt

SEQ ID NO: 7921792 - DNA, 22 bp, Homo sapiens
ccaggctgcttagccttatctt

SEQ ID NO: 7921793 - DNA, 22 bp, Homo sapiens
ccaggctgcttagccttatctt

SEQ ID NO: 7921794 - DNA, 22 bp, Homo sapiens
ccaggctgcttagccttatctt

SEQ ID NO: 7921795 - DNA, 22 bp, Homo sapiens
ccaggctggagtatagtggcgc

SEQ ID NO: 7921796 - DNA, 22 bp, Homo sapiens
ccaggctggagtatagtggcgc

SEQ ID NO: 7921797 - DNA, 22 bp, Homo sapiens
ccaggctggagtatagtggcgc

SEQ ID NO: 7921798 - DNA, 22 bp, Homo sapiens
ccaggctggagtatagtggcgc

SEQ ID NO: 7921799 - DNA, 22 bp, Homo sapiens
ccaggctggagtgcaatggcat

SEQ ID NO: 7921800 - DNA, 22 bp, Homo sapiens
ccaggctggagtgcaatggcat

SEQ ID NO: 7921801 - DNA, 22 bp, Homo sapiens
ccaggctggagtgcaatggcat

SEQ ID NO: 7921802 - DNA, 22 bp, Homo sapiens
ccaggctggagtgcaatggcat

SEQ ID NO: 7921803 - DNA, 22 bp, Homo sapiens
ccaggctggagtatagtggcgc

SEQ ID NO: 7921804 - DNA, 22 bp, Homo sapiens
ccaggctggagtatagtggcgc

SEQ ID NO: 7921805 - DNA, 22 bp, Homo sapiens
ccaggctggagtatagtggcgc

SEQ ID NO: 7921806 - DNA, 22 bp, Homo sapiens
ccaggctggagtatagtggcgc

SEQ ID NO: 7921807 - DNA, 22 bp, Homo sapiens
ccaggctggagtatagtggcgc

SEQ ID NO: 7921808 - DNA, 22 bp, Homo sapiens
ccaggctggagtatagtggcgc

SEQ ID NO: 7921809 - DNA, 22 bp, Homo sapiens
ccaggctggaatcaatattctg

SEQ ID NO: 7921810 - DNA, 22 bp, Homo sapiens
ccaggctggagtatagtggcgc

SEQ ID NO: 7921811 - DNA, 22 bp, Homo sapiens
aggctgaggatcgtactttcca

SEQ ID NO: 7921812 - DNA, 22 bp, Homo sapiens
aggctgaggatcgtactttcca

SEQ ID NO: 7921813 - DNA, 22 bp, Homo sapiens
aggctgaggcaagaggatcact

SEQ ID NO: 7921814 - DNA, 22 bp, Homo sapiens
aggctgaggatcgtactttcca

SEQ ID NO: 7921815 - DNA, 22 bp, Homo sapiens
aggctgaggcaagaggatcact

SEQ ID NO: 7921816 - DNA, 22 bp, Homo sapiens
aggctgaggcaagaggatcact

SEQ ID NO: 7921817 - DNA, 22 bp, Homo sapiens
aggctgaggcaagaggatcact

SEQ ID NO: 7921818 - DNA, 22 bp, Homo sapiens
aggctgaggcaagaggatcact

SEQ ID NO: 7921819 - DNA, 22 bp, Homo sapiens
aggctgaggcaagaggatcact

SEQ ID NO: 7921820 - DNA, 22 bp, Homo sapiens
aggctgaggcaggtggatcacc

SEQ ID NO: 7921821 - DNA, 22 bp, Homo sapiens
aggctgaggcaagaggatcact

SEQ ID NO: 7921822 - DNA, 22 bp, Homo sapiens
aggctgaggcaagaggatcact

SEQ ID NO: 7921823 - DNA, 22 bp, Homo sapiens
ccaggtctgcgggcggcaggca

SEQ ID NO: 7921824 - DNA, 22 bp, Homo sapiens
ccaggtctggaaccaccagggc

SEQ ID NO: 7921825 - DNA, 22 bp, Homo sapiens
ccaggtctggaaccaccagggc

SEQ ID NO: 7921826 - DNA, 22 bp, Homo sapiens
ccaggtctcgggtctgctcgtg

SEQ ID NO: 7921827 - DNA, 22 bp, Homo sapiens
ccaggtctgcgggcggcaggca

SEQ ID NO: 7921828 - DNA, 22 bp, Homo sapiens
ccaggtctcgggtctgctcgtg

SEQ ID NO: 7921829 - DNA, 22 bp, Homo sapiens
ccaggtctcgggtctgctcgtg

SEQ ID NO: 7921830 - DNA, 22 bp, Homo sapiens
aggctgaggcaggtggatcacc

SEQ ID NO: 7921831 - DNA, 22 bp, Homo sapiens
aggctgaggcaggtggatcacc

SEQ ID NO: 7921832 - DNA, 22 bp, Homo sapiens
aggctgaggcaggtggatcacc

SEQ ID NO: 7921833 - DNA, 22 bp, Homo sapiens
aggctgaggcaggtggatcacc

SEQ ID NO: 7921834 - DNA, 22 bp, Homo sapiens
aggctgaggcaggtggatcacc

SEQ ID NO: 7921835 - DNA, 22 bp, Homo sapiens
ccagggctggtgggagatgctg

SEQ ID NO: 7921836 - DNA, 22 bp, Homo sapiens
ccagggctggtgggagatgctg

SEQ ID NO: 7921837 - DNA, 22 bp, Homo sapiens
ccagggctggtgggagatgctg

SEQ ID NO: 7921838 - DNA, 22 bp, Homo sapiens
aggctgagctgacctggtttgg

SEQ ID NO: 7921839 - DNA, 22 bp, Homo sapiens
aggctgagctgacctggtttgg

SEQ ID NO: 7921840 - DNA, 22 bp, Homo sapiens
aggctgagctgacctggtttgg

SEQ ID NO: 7921841 - DNA, 22 bp, Homo sapiens
ccagggctggtgggagatgctg

SEQ ID NO: 7921842 - DNA, 22 bp, Homo sapiens
aggctgaggatccctgtgttct

SEQ ID NO: 7921843 - DNA, 22 bp, Homo sapiens
aggctgaggatccctgtgttct

SEQ ID NO: 7921844 - DNA, 22 bp, Homo sapiens
aggctgaggatcgtactttcca

SEQ ID NO: 7921845 - DNA, 22 bp, Homo sapiens
aggctgaggatcgtactttcca

SEQ ID NO: 7921846 - DNA, 22 bp, Homo sapiens
aggctgaggatcgtactttcca

SEQ ID NO: 7921847 - DNA, 22 bp, Homo sapiens
aggctgaggatccctgtgttct

SEQ ID NO: 7921848 - DNA, 22 bp, Homo sapiens
ccagggctggtggctgcagagg

SEQ ID NO: 7921849 - DNA, 22 bp, Homo sapiens
ccagggctggtggctgcagagg

SEQ ID NO: 7921850 - DNA, 22 bp, Homo sapiens
ccagggctggtggctgcagagg

SEQ ID NO: 7921851 - DNA, 22 bp, Homo sapiens
ccagggctggtgggagatgctg

SEQ ID NO: 7921852 - DNA, 22 bp, Homo sapiens
ccagggctggtgggagatgctg

SEQ ID NO: 7921853 - DNA, 22 bp, Homo sapiens
ccagggctggtgggagatgctg

SEQ ID NO: 7921854 - DNA, 22 bp, Homo sapiens
ccagggctggtgggagatgctg

SEQ ID NO: 7921855 - DNA, 22 bp, Homo sapiens
ccagggctggtggctgcagagg

SEQ ID NO: 7921856 - DNA, 22 bp, Homo sapiens
ccagggctggtggctgcagagg

SEQ ID NO: 7921857 - DNA, 22 bp, Homo sapiens
ccagggctggtggctgcagagg

SEQ ID NO: 7921858 - DNA, 22 bp, Homo sapiens
ccagggctggtggctgcagagg

SEQ ID NO: 7921859 - DNA, 22 bp, Homo sapiens
ccagggctgggtttgtcggtgt

SEQ ID NO: 7921860 - DNA, 22 bp, Homo sapiens
ccagggctgggtttgtcggtgt

SEQ ID NO: 7921861 - DNA, 22 bp, Homo sapiens
ccagggctgggtttgtcggtgt

SEQ ID NO: 7921862 - DNA, 22 bp, Homo sapiens
ccagggctgggtttgtcggtgt

SEQ ID NO: 7921863 - DNA, 22 bp, Homo sapiens
ccagggctgggtttgtcggtgt

SEQ ID NO: 7921864 - DNA, 22 bp, Homo sapiens
ccagggcctgagggcgacgccc

SEQ ID NO: 7921865 - DNA, 22 bp, Homo sapiens
ccagggcctgagggcgacgccc

SEQ ID NO: 7921866 - DNA, 22 bp, Homo sapiens
ccagggcctgagggcgacgccc

SEQ ID NO: 7921867 - DNA, 22 bp, Homo sapiens
ccagggcctgagggcgacgccc

SEQ ID NO: 7921868 - DNA, 22 bp, Homo sapiens
ccagggcctgccacttagcaag

SEQ ID NO: 7921869 - DNA, 22 bp, Homo sapiens
ccagggcctgccacttagcaag

SEQ ID NO: 7921870 - DNA, 22 bp, Homo sapiens
ccagggcctgccacttagcaag

SEQ ID NO: 7921871 - DNA, 22 bp, Homo sapiens
ccagggcctgccacttagcaag

SEQ ID NO: 7921872 - DNA, 23 bp, Homo sapiens
ccagggctacgggcaccgtcctg

SEQ ID NO: 7921873 - DNA, 23 bp, Homo sapiens
ccagggctacgggcaccgtcctg

SEQ ID NO: 7921874 - DNA, 22 bp, Homo sapiens
ccagggcctgccacttagcaag

SEQ ID NO: 7921875 - DNA, 22 bp, Homo sapiens
ccagggcctcgtgttctgagtg

SEQ ID NO: 7921876 - DNA, 22 bp, Homo sapiens
ccagggcctgagggcgacgccc

SEQ ID NO: 7921877 - DNA, 22 bp, Homo sapiens
ccagggcctcgtgttctgagtg

SEQ ID NO: 7921878 - DNA, 22 bp, Homo sapiens
ccagggcctcgtgttctgagtg

SEQ ID NO: 7921879 - DNA, 22 bp, Homo sapiens
ccaggctgtaaacaccttcaaa

SEQ ID NO: 7921880 - DNA, 22 bp, Homo sapiens
ccaggctgtaaacaccttcaaa

SEQ ID NO: 7921881 - DNA, 22 bp, Homo sapiens
ccaggctgtaaacaccttcaaa

SEQ ID NO: 7921882 - DNA, 22 bp, Homo sapiens
ccaggctgtaaacaccttcaaa

SEQ ID NO: 7921883 - DNA, 22 bp, Homo sapiens
ccaggctgtaaacaccttcaaa

SEQ ID NO: 7921884 - DNA, 22 bp, Homo sapiens
ccagggcaggagaaagactcac

SEQ ID NO: 7921885 - DNA, 22 bp, Homo sapiens
ccaggctgtaaacaccttcaaa

SEQ ID NO: 7921886 - DNA, 20 bp, Homo sapiens
ccagggctggctcctgggat

SEQ ID NO: 7921887 - DNA, 20 bp, Homo sapiens
ccagggctggctcctgggat

SEQ ID NO: 7921888 - DNA, 20 bp, Homo sapiens
ccagggctggctcctgggat

SEQ ID NO: 7921889 - DNA, 20 bp, Homo sapiens
ccagggctggctcctgggat

SEQ ID NO: 7921890 - DNA, 20 bp, Homo sapiens
ccagggctggctcctgggat

SEQ ID NO: 7921891 - DNA, 20 bp, Homo sapiens
ccagggctggctcctgggat

SEQ ID NO: 7921892 - DNA, 20 bp, Homo sapiens
ccagggctggctcctgggat

SEQ ID NO: 7921893 - DNA, 20 bp, Homo sapiens
ccagggctggctcctgggat

SEQ ID NO: 7921894 - DNA, 22 bp, Homo sapiens
ccagggctccattgctcatcct

SEQ ID NO: 7921895 - DNA, 22 bp, Homo sapiens
ccagggctggaccagtgcttgg

SEQ ID NO: 7921896 - DNA, 22 bp, Homo sapiens
ccagggctccattgctcatcct

SEQ ID NO: 7921897 - DNA, 22 bp, Homo sapiens
ccagggctggaccagtgcttgg

SEQ ID NO: 7921898 - DNA, 22 bp, Homo sapiens
ccagggctggaccagtgcttgg

SEQ ID NO: 7921899 - DNA, 22 bp, Homo sapiens
ccagggctggaccagtgcttgg

SEQ ID NO: 7921900 - DNA, 20 bp, Homo sapiens
ccagggctggctcctgggat

SEQ ID NO: 7921901 - DNA, 20 bp, Homo sapiens
ccagggctggctcctgggat

SEQ ID NO: 7921902 - DNA, 22 bp, Homo sapiens
ccagggctcaggctcccagtgg

SEQ ID NO: 7921903 - DNA, 22 bp, Homo sapiens
ccagggctcaggctcccagtgg

SEQ ID NO: 7921904 - DNA, 22 bp, Homo sapiens
ccagggctcaggctcccagtgg

SEQ ID NO: 7921905 - DNA, 22 bp, Homo sapiens
ccagggctcaggctcccagtgg

SEQ ID NO: 7921906 - DNA, 22 bp, Homo sapiens
ccagggctcaggctcccagtgg

SEQ ID NO: 7921907 - DNA, 22 bp, Homo sapiens
ccagggctcaggctcccagtgg

SEQ ID NO: 7921908 - DNA, 23 bp, Homo sapiens
ccagggctacgggcaccgtcctg

SEQ ID NO: 7921909 - DNA, 19 bp, Homo sapiens
ccagggctccaagctgagt

SEQ ID NO: 7921910 - DNA, 19 bp, Homo sapiens
ccagggctccaagctgagt

SEQ ID NO: 7921911 - DNA, 19 bp, Homo sapiens
ccagggctccaagctgagt

SEQ ID NO: 7921912 - DNA, 19 bp, Homo sapiens
ccagggctccaagctgagt

SEQ ID NO: 7921913 - DNA, 22 bp, Homo sapiens
ccagggctccattgctcatcct

SEQ ID NO: 7921914 - DNA, 22 bp, Homo sapiens
ccagggctccattgctcatcct

SEQ ID NO: 7921915 - DNA, 22 bp, Homo sapiens
ccagggctccattgctcatcct

SEQ ID NO: 7921916 - DNA, 22 bp, Homo sapiens
ccatttaacacagagttttcca

SEQ ID NO: 7921917 - DNA, 22 bp, Homo sapiens
ccatttacattgtactctgtga

SEQ ID NO: 7921918 - DNA, 22 bp, Homo sapiens
ccatttagtaaggaagaacagc

SEQ ID NO: 7921919 - DNA, 22 bp, Homo sapiens
ccatttagtaaggaagaacagc

SEQ ID NO: 7921920 - DNA, 22 bp, Homo sapiens
ccatttcacccactgctttagg

SEQ ID NO: 7921921 - DNA, 22 bp, Homo sapiens
aggctggcgtcaggggctgtac

SEQ ID NO: 7921922 - DNA, 22 bp, Homo sapiens
aggctggcgtcaggggctgtac

SEQ ID NO: 7921923 - DNA, 22 bp, Homo sapiens
aggctggcgtcaggggctgtac

SEQ ID NO: 7921924 - DNA, 22 bp, Homo sapiens
ccatttaacacagagttttcca

SEQ ID NO: 7921925 - DNA, 22 bp, Homo sapiens
aggctggcggtgactgctctga

SEQ ID NO: 7921926 - DNA, 22 bp, Homo sapiens
ccatttggcaagaaagagtcat

SEQ ID NO: 7921927 - DNA, 22 bp, Homo sapiens
ccatttggcaagaaagagtcat

SEQ ID NO: 7921928 - DNA, 22 bp, Homo sapiens
ccatttggctcttaaactgagc

SEQ ID NO: 7921929 - DNA, 22 bp, Homo sapiens
ccatttggctcttaaactgagc

SEQ ID NO: 7921930 - DNA, 22 bp, Homo sapiens
ccatttggtatagtgaaaagga

SEQ ID NO: 7921931 - DNA, 22 bp, Homo sapiens
ccatttgggaatcttccatgga

SEQ ID NO: 7921932 - DNA, 22 bp, Homo sapiens
ccatttggtatagtgaaaagga

SEQ ID NO: 7921933 - DNA, 22 bp, Homo sapiens
ccatttggcaaacattttacag

SEQ ID NO: 7921934 - DNA, 22 bp, Homo sapiens
ccatttggcaagaaagagtcat

SEQ ID NO: 7921935 - DNA, 18 bp, Homo sapiens
ccatttggatagtgaagc

SEQ ID NO: 7921936 - DNA, 22 bp, Homo sapiens
ccatttggatacttttggttac

SEQ ID NO: 7921937 - DNA, 22 bp, Homo sapiens
ccatttggaggtcattaggaca

SEQ ID NO: 7921938 - DNA, 22 bp, Homo sapiens
ccatttggaggtcattaggaca

SEQ ID NO: 7921939 - DNA, 22 bp, Homo sapiens
ccatttcattgcctgtaaagtg

SEQ ID NO: 7921940 - DNA, 22 bp, Homo sapiens
ccatttcactcttcctgaagga

SEQ ID NO: 7921941 - DNA, 22 bp, Homo sapiens
aggctggccctactggctgcct

SEQ ID NO: 7921942 - DNA, 22 bp, Homo sapiens
aggctggccctactggctgcct

SEQ ID NO: 7921943 - DNA, 22 bp, Homo sapiens
aggctggccctactggctgcct

SEQ ID NO: 7921944 - DNA, 22 bp, Homo sapiens
aggctggccctactggctgcct

SEQ ID NO: 7921945 - DNA, 22 bp, Homo sapiens
aggctggccctactggctgcct

SEQ ID NO: 7921946 - DNA, 22 bp, Homo sapiens
aggctggccctactggctgcct

SEQ ID NO: 7921947 - DNA, 22 bp, Homo sapiens
aggctggccctactggctgcct

SEQ ID NO: 7921948 - DNA, 22 bp, Homo sapiens
aggctggccctactggctgcct

SEQ ID NO: 7921949 - DNA, 22 bp, Homo sapiens
aggctggcctatttctttatcg

SEQ ID NO: 7921950 - DNA, 22 bp, Homo sapiens
aggctggccctactggctgcct

SEQ ID NO: 7921951 - DNA, 17 bp, Homo sapiens
aggctggccttcacagt

SEQ ID NO: 7921952 - DNA, 17 bp, Homo sapiens
aggctggccttcacagt

SEQ ID NO: 7921953 - DNA, 17 bp, Homo sapiens
aggctggccttcacagt

SEQ ID NO: 7921954 - DNA, 17 bp, Homo sapiens
aggctggccttcacagt

SEQ ID NO: 7921955 - DNA, 22 bp, Homo sapiens
aggctggcgacatctggcgggc

SEQ ID NO: 7921956 - DNA, 22 bp, Homo sapiens
aggctggcgacatctggcgggc

SEQ ID NO: 7921957 - DNA, 22 bp, Homo sapiens
aggctggcgacatctggcgggc

SEQ ID NO: 7921958 - DNA, 22 bp, Homo sapiens
aggctggcgacatctggcgggc

SEQ ID NO: 7921959 - DNA, 22 bp, Homo sapiens
aggctggcgacatctggcgggc

SEQ ID NO: 7921960 - DNA, 22 bp, Homo sapiens
aggctggcgacatctggcgggc

SEQ ID NO: 7921961 - DNA, 22 bp, Homo sapiens
aggctggcggtgactgctctga

SEQ ID NO: 7921962 - DNA, 22 bp, Homo sapiens
aggctggcggtgactgctctga

SEQ ID NO: 7921963 - DNA, 22 bp, Homo sapiens
aggctggcggtgactgctctga

SEQ ID NO: 7921964 - DNA, 22 bp, Homo sapiens
aggctggcggtgactgctctga

SEQ ID NO: 7921965 - DNA, 22 bp, Homo sapiens
aggctggcgacatctggcgggc

SEQ ID NO: 7921966 - DNA, 22 bp, Homo sapiens
ccatttgtgcttcttcaaagca

SEQ ID NO: 7921967 - DNA, 22 bp, Homo sapiens
ccatttgtgatgtggcagcatc

SEQ ID NO: 7921968 - DNA, 22 bp, Homo sapiens
ccatttgtcacctctgcactcc

SEQ ID NO: 7921969 - DNA, 22 bp, Homo sapiens
ccatttgtggtttatttgctct

SEQ ID NO: 7921970 - DNA, 22 bp, Homo sapiens
ccatttgtggtttatttgctct

SEQ ID NO: 7921971 - DNA, 22 bp, Homo sapiens
ccatttgtgcttcttcaaagca

SEQ ID NO: 7921972 - DNA, 22 bp, Homo sapiens
ccatttgtggtttatttgctct

SEQ ID NO: 7921973 - DNA, 22 bp, Homo sapiens
ccatttgttgtgtattaatatt

SEQ ID NO: 7921974 - DNA, 22 bp, Homo sapiens
ccatttgtggtttatttgctct

SEQ ID NO: 7921975 - DNA, 22 bp, Homo sapiens
ccatttgttcgcccagctccaa

SEQ ID NO: 7921976 - DNA, 22 bp, Homo sapiens
ccatttgttgagaacgtgcctt

SEQ ID NO: 7921977 - DNA, 22 bp, Homo sapiens
ccatttgttgagaacgtgcctt

SEQ ID NO: 7921978 - DNA, 22 bp, Homo sapiens
ccatttgtggtttatttgctct

SEQ ID NO: 7921979 - DNA, 22 bp, Homo sapiens
ccatttgtggtttatttgctct

SEQ ID NO: 7921980 - DNA, 22 bp, Homo sapiens
ccatttgttcgcccagctccaa

SEQ ID NO: 7921981 - DNA, 22 bp, Homo sapiens
ccatttgtaaccttagagcaat

SEQ ID NO: 7921982 - DNA, 22 bp, Homo sapiens
ccatttgtaaccttagagcaat

SEQ ID NO: 7921983 - DNA, 22 bp, Homo sapiens
ccatttggttatgtatcgaaac

SEQ ID NO: 7921984 - DNA, 22 bp, Homo sapiens
ccatttgtaccatttctttgta

SEQ ID NO: 7921985 - DNA, 22 bp, Homo sapiens
ccatttgtaaccttagagcaat

SEQ ID NO: 7921986 - DNA, 22 bp, Homo sapiens
ccatttgtaccatttctttgta

SEQ ID NO: 7921987 - DNA, 22 bp, Homo sapiens
ccatttgtaccatttctttgta

SEQ ID NO: 7921988 - DNA, 21 bp, Homo sapiens
ccatttgtaggtttccctctg

SEQ ID NO: 7921989 - DNA, 21 bp, Homo sapiens
ccatttgtaggtttccctctg

SEQ ID NO: 7921990 - DNA, 22 bp, Homo sapiens
ccatttgtaaccttagagcaat

SEQ ID NO: 7921991 - DNA, 22 bp, Homo sapiens
ccatttgtaccatttctttgta

SEQ ID NO: 7921992 - DNA, 22 bp, Homo sapiens
ccatttgtgatgtggcagcatc

SEQ ID NO: 7921993 - DNA, 22 bp, Homo sapiens
ccatttgtgatgtggcagcatc

SEQ ID NO: 7921994 - DNA, 22 bp, Homo sapiens
ccatttgtgatgtggcagcatc

SEQ ID NO: 7921995 - DNA, 22 bp, Homo sapiens
ccatttgtcacctctgcactcc

SEQ ID NO: 7921996 - DNA, 22 bp, Homo sapiens
ccatttgtcacctctgcactcc

SEQ ID NO: 7921997 - DNA, 22 bp, Homo sapiens
ccatttgtattactgccccagg

SEQ ID NO: 7921998 - DNA, 22 bp, Homo sapiens
ccatttgtattactgccccagg

SEQ ID NO: 7921999 - DNA, 22 bp, Homo sapiens
ccatttgtcacctctgcactcc

SEQ ID NO: 7922000 - DNA, 22 bp, Homo sapiens
ccatttgtattactgccccagg

SEQ ID NO: 7922001 - DNA, 22 bp, Homo sapiens
ccatttgttgtgtattaatatt

SEQ ID NO: 7922002 - DNA, 22 bp, Homo sapiens
ccatttgtttcccttgggaaac

SEQ ID NO: 7922003 - DNA, 22 bp, Homo sapiens
ccatttgttgtgtattaatatt

SEQ ID NO: 7922004 - DNA, 22 bp, Homo sapiens
ccatttgttgtgtattaatatt

SEQ ID NO: 7922005 - DNA, 22 bp, Homo sapiens
ccatttgttttcgctaccatgg

SEQ ID NO: 7922006 - DNA, 22 bp, Homo sapiens
ccatttgttgtgtattaatatt

SEQ ID NO: 7922007 - DNA, 22 bp, Homo sapiens
ccatttgttttcgctaccatgg

SEQ ID NO: 7922008 - DNA, 22 bp, Homo sapiens
ccatttgtttcccttgggaaac

SEQ ID NO: 7922009 - DNA, 22 bp, Homo sapiens
ccatttgttttcgctaccatgg

SEQ ID NO: 7922010 - DNA, 22 bp, Homo sapiens
aggctggctggcaggggacaca

SEQ ID NO: 7922011 - DNA, 22 bp, Homo sapiens
ccattttattagtgacatttag

SEQ ID NO: 7922012 - DNA, 22 bp, Homo sapiens
aggctggctggggatgcgtctt

SEQ ID NO: 7922013 - DNA, 22 bp, Homo sapiens
aggctgggaaggtaaagttgta

SEQ ID NO: 7922014 - DNA, 22 bp, Homo sapiens
aggctggggaattgaatttgct

SEQ ID NO: 7922015 - DNA, 22 bp, Homo sapiens
aggctgggctccgcccaactcc

SEQ ID NO: 7922016 - DNA, 22 bp, Homo sapiens
aggctggggaattgaatttgct

SEQ ID NO: 7922017 - DNA, 22 bp, Homo sapiens
aggctgggctccgcccaactcc

SEQ ID NO: 7922018 - DNA, 22 bp, Homo sapiens
aggctgggctccgcccaactcc

SEQ ID NO: 7922019 - DNA, 22 bp, Homo sapiens
aggctgggctccgcccaactcc

SEQ ID NO: 7922020 - DNA, 22 bp, Homo sapiens
aggctgggcaccgttttgatcc

SEQ ID NO: 7922021 - DNA, 22 bp, Homo sapiens
aggctgggctccgcccaactcc

SEQ ID NO: 7922022 - DNA, 22 bp, Homo sapiens
aggctgggaaggtaaagttgta

SEQ ID NO: 7922023 - DNA, 22 bp, Homo sapiens
aggctgggcaccgttttgatcc

SEQ ID NO: 7922024 - DNA, 22 bp, Homo sapiens
aggctgggcaccgttttgatcc

SEQ ID NO: 7922025 - DNA, 22 bp, Homo sapiens
aggctgggtacctgtcatatgc

SEQ ID NO: 7922026 - DNA, 20 bp, Homo sapiens
aggctggggtgttttgccca

SEQ ID NO: 7922027 - DNA, 22 bp, Homo sapiens
aggctgggtacctgtcatatgc

SEQ ID NO: 7922028 - DNA, 20 bp, Homo sapiens
aggctggggtgttttgccca

SEQ ID NO: 7922029 - DNA, 22 bp, Homo sapiens
aggctggggaattgaatttgct

SEQ ID NO: 7922030 - DNA, 22 bp, Homo sapiens
aggctggggaattgaatttgct

SEQ ID NO: 7922031 - DNA, 20 bp, Homo sapiens
aggctggggtgttttgccca

SEQ ID NO: 7922032 - DNA, 22 bp, Homo sapiens
aggctggggaattgaatttgct

SEQ ID NO: 7922033 - DNA, 21 bp, Homo sapiens
ccaggtcttggtccttggact

SEQ ID NO: 7922034 - DNA, 22 bp, Homo sapiens
ccaggtcttggcccccggacct

SEQ ID NO: 7922035 - DNA, 21 bp, Homo sapiens
ccaggtcttggtccttggact

SEQ ID NO: 7922036 - DNA, 22 bp, Homo sapiens
ccaggtctttgactaatatgct

SEQ ID NO: 7922037 - DNA, 22 bp, Homo sapiens
ccaggtcttgtttgacatcaat

SEQ ID NO: 7922038 - DNA, 22 bp, Homo sapiens
ccaggtctttggccttggcact

SEQ ID NO: 7922039 - DNA, 22 bp, Homo sapiens
ccaggtctttggccttggcact

SEQ ID NO: 7922040 - DNA, 22 bp, Homo sapiens
ccaggtctttggccttggcact

SEQ ID NO: 7922041 - DNA, 22 bp, Homo sapiens
ccaggtgactgtcagaggtttt

SEQ ID NO: 7922042 - DNA, 22 bp, Homo sapiens
ccaggtgaaatcttcatggttc

SEQ ID NO: 7922043 - DNA, 22 bp, Homo sapiens
aggctgctcagtagatggagct

SEQ ID NO: 7922044 - DNA, 22 bp, Homo sapiens
aggctgctcagtagatggagct

SEQ ID NO: 7922045 - DNA, 22 bp, Homo sapiens
ccaggtgcaaactcccagcagg

SEQ ID NO: 7922046 - DNA, 22 bp, Homo sapiens
ccaggtgcaaactcccagcagg

SEQ ID NO: 7922047 - DNA, 22 bp, Homo sapiens
ccaggtgaggtaggtatggtag

SEQ ID NO: 7922048 - DNA, 22 bp, Homo sapiens
ccaggtcttcactttactgaag

SEQ ID NO: 7922049 - DNA, 22 bp, Homo sapiens
ccaggtcttcactttactgaag

SEQ ID NO: 7922050 - DNA, 22 bp, Homo sapiens
ccaggtctgtcttcttagctca

SEQ ID NO: 7922051 - DNA, 22 bp, Homo sapiens
ccaggtctgtcttcttagctca

SEQ ID NO: 7922052 - DNA, 22 bp, Homo sapiens
ccaggtctggcactggccagtc

SEQ ID NO: 7922053 - DNA, 22 bp, Homo sapiens
ccaggtctggcactggccagtc

SEQ ID NO: 7922054 - DNA, 19 bp, Homo sapiens
ccaggtctggggccagatt

SEQ ID NO: 7922055 - DNA, 19 bp, Homo sapiens
ccaggtctggggccagatt

SEQ ID NO: 7922056 - DNA, 22 bp, Homo sapiens
ccaggtctggcactggccagtc

SEQ ID NO: 7922057 - DNA, 22 bp, Homo sapiens
aggctgctctgcgaagtcagct

SEQ ID NO: 7922058 - DNA, 22 bp, Homo sapiens
aggctgctcagtagatggagct

SEQ ID NO: 7922059 - DNA, 22 bp, Homo sapiens
aggctgcttcagctgcagggag

SEQ ID NO: 7922060 - DNA, 22 bp, Homo sapiens
aggctgctcagtagatggagct

SEQ ID NO: 7922061 - DNA, 22 bp, Homo sapiens
aggctgcttccttacgtggctg

SEQ ID NO: 7922062 - DNA, 22 bp, Homo sapiens
aggctgctttttatttacaggt

SEQ ID NO: 7922063 - DNA, 22 bp, Homo sapiens
aggctgctttcatggccgcccc

SEQ ID NO: 7922064 - DNA, 22 bp, Homo sapiens
aggctgcttcttgtccttggca

SEQ ID NO: 7922065 - DNA, 22 bp, Homo sapiens
aggctgcttcttgtccttggca

SEQ ID NO: 7922066 - DNA, 22 bp, Homo sapiens
aggctggaaagggaccagagtg

SEQ ID NO: 7922067 - DNA, 22 bp, Homo sapiens
aggctggaaagggaccagagtg

SEQ ID NO: 7922068 - DNA, 22 bp, Homo sapiens
aggctggaaagggaccagagtg

SEQ ID NO: 7922069 - DNA, 22 bp, Homo sapiens
aggctggaaagggaccagagtg

SEQ ID NO: 7922070 - DNA, 22 bp, Homo sapiens
aggctgctttttatttacaggt

SEQ ID NO: 7922071 - DNA, 22 bp, Homo sapiens
aggctggaaatcactagattcc

SEQ ID NO: 7922072 - DNA, 22 bp, Homo sapiens
aggctggaaagggaccagagtg

SEQ ID NO: 7922073 - DNA, 22 bp, Homo sapiens
aggctggaaagggaccagagtg

SEQ ID NO: 7922074 - DNA, 19 bp, Homo sapiens
aggctggagacaccaggcc

SEQ ID NO: 7922075 - DNA, 19 bp, Homo sapiens
aggctggagacaccaggcc

SEQ ID NO: 7922076 - DNA, 19 bp, Homo sapiens
aggctggagacaccaggcc

SEQ ID NO: 7922077 - DNA, 19 bp, Homo sapiens
aggctggagacaccaggcc

SEQ ID NO: 7922078 - DNA, 19 bp, Homo sapiens
aggctggagacaccaggcc

SEQ ID NO: 7922079 - DNA, 22 bp, Homo sapiens
aggctggacccgacacctgccc

SEQ ID NO: 7922080 - DNA, 22 bp, Homo sapiens
aggctggacccgacacctgccc

SEQ ID NO: 7922081 - DNA, 22 bp, Homo sapiens
aggctggacccgacacctgccc

SEQ ID NO: 7922082 - DNA, 22 bp, Homo sapiens
aggctggacccgacacctgccc

SEQ ID NO: 7922083 - DNA, 22 bp, Homo sapiens
aggctggagagtgcagtggcgt

SEQ ID NO: 7922084 - DNA, 22 bp, Homo sapiens
aggctggagagtgcagtggcgt

SEQ ID NO: 7922085 - DNA, 22 bp, Homo sapiens
aggctggagagtgcagtggcgt

SEQ ID NO: 7922086 - DNA, 22 bp, Homo sapiens
aggctggagagtgcagtggcgt

SEQ ID NO: 7922087 - DNA, 22 bp, Homo sapiens
aggctggagagtgcagtggcgt

SEQ ID NO: 7922088 - DNA, 22 bp, Homo sapiens
aggctggagagtgcagtggcgt

SEQ ID NO: 7922089 - DNA, 22 bp, Homo sapiens
aggctggagagtgcagtggcgt

SEQ ID NO: 7922090 - DNA, 22 bp, Homo sapiens
aggctggagagtgcagtggcgt

SEQ ID NO: 7922091 - DNA, 22 bp, Homo sapiens
aggctggagagtgcagtggcgt

SEQ ID NO: 7922092 - DNA, 22 bp, Homo sapiens
aggctggagacccgccaagaaa

SEQ ID NO: 7922093 - DNA, 22 bp, Homo sapiens
aggctggagacccgccaagaaa

SEQ ID NO: 7922094 - DNA, 22 bp, Homo sapiens
aggctggagacccgccaagaaa

SEQ ID NO: 7922095 - DNA, 22 bp, Homo sapiens
aggctggagacccgccaagaaa

SEQ ID NO: 7922096 - DNA, 22 bp, Homo sapiens
aggctggaggtttgttgcggct

SEQ ID NO: 7922097 - DNA, 22 bp, Homo sapiens
aggctggagggcaatggcaaga

SEQ ID NO: 7922098 - DNA, 22 bp, Homo sapiens
aggctggagggcaatggcaaga

SEQ ID NO: 7922099 - DNA, 22 bp, Homo sapiens
aggctggagggcaatggcaaga

SEQ ID NO: 7922100 - DNA, 22 bp, Homo sapiens
aggctggagtacagtggctatt

SEQ ID NO: 7922101 - DNA, 22 bp, Homo sapiens
aggctggagtacagtggctatt

SEQ ID NO: 7922102 - DNA, 22 bp, Homo sapiens
aggctggagtacagtggctatt

SEQ ID NO: 7922103 - DNA, 22 bp, Homo sapiens
aggctggagtacagtggctatt

SEQ ID NO: 7922104 - DNA, 22 bp, Homo sapiens
aggctggagcaagggggcatat

SEQ ID NO: 7922105 - DNA, 22 bp, Homo sapiens
aggctggagcaagggggcatat

SEQ ID NO: 7922106 - DNA, 22 bp, Homo sapiens
aggctggagagtgcagtggcgt

SEQ ID NO: 7922107 - DNA, 22 bp, Homo sapiens
aggctggagcaagggggcatat

SEQ ID NO: 7922108 - DNA, 22 bp, Homo sapiens
aggctggagcaagggggcatat

SEQ ID NO: 7922109 - DNA, 22 bp, Homo sapiens
aggctggagcaagggggcatat

SEQ ID NO: 7922110 - DNA, 22 bp, Homo sapiens
aggctggccagtgctgcagtgg

SEQ ID NO: 7922111 - DNA, 22 bp, Homo sapiens
aggctggccagtgctgcagtgg

SEQ ID NO: 7922112 - DNA, 22 bp, Homo sapiens
aggctggcccacctcttgtctt

SEQ ID NO: 7922113 - DNA, 22 bp, Homo sapiens
aggctggcccacctcttgtctt

SEQ ID NO: 7922114 - DNA, 22 bp, Homo sapiens
aggctggcccacctcttgtctt

SEQ ID NO: 7922115 - DNA, 22 bp, Homo sapiens
aggctggcccacctcttgtctt

SEQ ID NO: 7922116 - DNA, 22 bp, Homo sapiens
aggctggagtgtagcagtgcag

SEQ ID NO: 7922117 - DNA, 22 bp, Homo sapiens
aggctggagtgtagcagtgcag

SEQ ID NO: 7922118 - DNA, 22 bp, Homo sapiens
aggctggagtgtagcagtgcag

SEQ ID NO: 7922119 - DNA, 22 bp, Homo sapiens
aggctggagtgtagcagtgcag

SEQ ID NO: 7922120 - DNA, 22 bp, Homo sapiens
aggctggagtgtagcagtgcag

SEQ ID NO: 7922121 - DNA, 22 bp, Homo sapiens
aggctggagtgtagcagtgcag

SEQ ID NO: 7922122 - DNA, 22 bp, Homo sapiens
aggctggagtgcagtggcgtga

SEQ ID NO: 7922123 - DNA, 22 bp, Homo sapiens
aggctggagtgcagtggcgtga

SEQ ID NO: 7922124 - DNA, 22 bp, Homo sapiens
aggctggagtgcagtggtgtga

SEQ ID NO: 7922125 - DNA, 22 bp, Homo sapiens
aggctggagtacagtggctatt

SEQ ID NO: 7922126 - DNA, 22 bp, Homo sapiens
aggctggagtgcaatggcgtga

SEQ ID NO: 7922127 - DNA, 22 bp, Homo sapiens
aggctggagtgcaatggcgtga

SEQ ID NO: 7922128 - DNA, 22 bp, Homo sapiens
aggctggagtgcaatggcgtga

SEQ ID NO: 7922129 - DNA, 22 bp, Homo sapiens
aggctggagtgctggagtgctg

SEQ ID NO: 7922130 - DNA, 22 bp, Homo sapiens
aggctggagtgctggagtgctg

SEQ ID NO: 7922131 - DNA, 22 bp, Homo sapiens
aggctggagtgctggagtgctg

SEQ ID NO: 7922132 - DNA, 22 bp, Homo sapiens
aggctggagtgctggagtgctg

SEQ ID NO: 7922133 - DNA, 22 bp, Homo sapiens
aggctggagtgctggagtgctg

SEQ ID NO: 7922134 - DNA, 22 bp, Homo sapiens
aggctggagtgcagttgcatga

SEQ ID NO: 7922135 - DNA, 22 bp, Homo sapiens
aggctggagtgcagttgcatga

SEQ ID NO: 7922136 - DNA, 22 bp, Homo sapiens
ccagctggaacggcagcccagc

SEQ ID NO: 7922137 - DNA, 22 bp, Homo sapiens
ccagctggaacggcagcccagc

SEQ ID NO: 7922138 - DNA, 22 bp, Homo sapiens
ccagctggaacggcagcccagc

SEQ ID NO: 7922139 - DNA, 22 bp, Homo sapiens
ccagctggaacggcagcccagc

SEQ ID NO: 7922140 - DNA, 22 bp, Homo sapiens
ccagctggaaacaaatagagtg

SEQ ID NO: 7922141 - DNA, 22 bp, Homo sapiens
ccagctggaaacaaatagagtg

SEQ ID NO: 7922142 - DNA, 22 bp, Homo sapiens
ccagctgacgatgcctggtctc

SEQ ID NO: 7922143 - DNA, 22 bp, Homo sapiens
ccagctcttttggctgagtgag

SEQ ID NO: 7922144 - DNA, 22 bp, Homo sapiens
ccagctcttttggctgagtgag

SEQ ID NO: 7922145 - DNA, 22 bp, Homo sapiens
ccagctcttttggctgagtgag

SEQ ID NO: 7922146 - DNA, 22 bp, Homo sapiens
ccagctggaagagtgcagaact

SEQ ID NO: 7922147 - DNA, 22 bp, Homo sapiens
ccagctggaagagtgcagaact

SEQ ID NO: 7922148 - DNA, 22 bp, Homo sapiens
ccagctggaagagtgcagaact

SEQ ID NO: 7922149 - DNA, 22 bp, Homo sapiens
ccagctggagccaaggtggact

SEQ ID NO: 7922150 - DNA, 22 bp, Homo sapiens
ccagctggagccaaggtggact

SEQ ID NO: 7922151 - DNA, 22 bp, Homo sapiens
ccagctggagccaaggtggact

SEQ ID NO: 7922152 - DNA, 22 bp, Homo sapiens
ccagctggaagagtgcagaact

SEQ ID NO: 7922153 - DNA, 22 bp, Homo sapiens
ccagctggaagagtgcagaact

SEQ ID NO: 7922154 - DNA, 22 bp, Homo sapiens
ccagctggagccaaggtggact

SEQ ID NO: 7922155 - DNA, 22 bp, Homo sapiens
ccagctggagccaaggtggact

SEQ ID NO: 7922156 - DNA, 22 bp, Homo sapiens
ccagctggagccaaggtggact

SEQ ID NO: 7922157 - DNA, 22 bp, Homo sapiens
ccagctggagctcgcagatagg

SEQ ID NO: 7922158 - DNA, 22 bp, Homo sapiens
aggcctctgggcctgcgggttt

SEQ ID NO: 7922159 - DNA, 22 bp, Homo sapiens
aggcctctgggcctgcgggttt

SEQ ID NO: 7922160 - DNA, 22 bp, Homo sapiens
aggcctgccttgagcaaccagc

SEQ ID NO: 7922161 - DNA, 22 bp, Homo sapiens
aggcctctgggtctcctctgac

SEQ ID NO: 7922162 - DNA, 22 bp, Homo sapiens
aggcctgctgtcttgaggccaa

SEQ ID NO: 7922163 - DNA, 22 bp, Homo sapiens
aggcctgccttgagcaaccagc

SEQ ID NO: 7922164 - DNA, 22 bp, Homo sapiens
aggcctgctgtcttgaggccaa

SEQ ID NO: 7922165 - DNA, 22 bp, Homo sapiens
aggcctgctgtcttgaggccaa

SEQ ID NO: 7922166 - DNA, 22 bp, Homo sapiens
ccagctggcccagctgtgctcc

SEQ ID NO: 7922167 - DNA, 22 bp, Homo sapiens
ccagctggcccagctgtgctcc

SEQ ID NO: 7922168 - DNA, 22 bp, Homo sapiens
ccagctggcccagctgtgctcc

SEQ ID NO: 7922169 - DNA, 22 bp, Homo sapiens
aggcctctggaggtggcagtgt

SEQ ID NO: 7922170 - DNA, 22 bp, Homo sapiens
aggcctctggaggtggcagtgt

SEQ ID NO: 7922171 - DNA, 22 bp, Homo sapiens
aggcctctgctggaaagagttg

SEQ ID NO: 7922172 - DNA, 22 bp, Homo sapiens
aggcctctggaggtggcagtgt

SEQ ID NO: 7922173 - DNA, 17 bp, Homo sapiens
aggcctctgccggtgcc

SEQ ID NO: 7922174 - DNA, 17 bp, Homo sapiens
aggcctctgccggtgcc

SEQ ID NO: 7922175 - DNA, 22 bp, Homo sapiens
aggcctctgctggaaagagttg

SEQ ID NO: 7922176 - DNA, 22 bp, Homo sapiens
ccagctggcaggagagtcaggg

SEQ ID NO: 7922177 - DNA, 22 bp, Homo sapiens
ccagctggcaggagagtcaggg

SEQ ID NO: 7922178 - DNA, 22 bp, Homo sapiens
ccagctggcaggagagtcaggg

SEQ ID NO: 7922179 - DNA, 22 bp, Homo sapiens
ccagctggcaggagagtcaggg

SEQ ID NO: 7922180 - DNA, 22 bp, Homo sapiens
ccagctggcaggagagtcaggg

SEQ ID NO: 7922181 - DNA, 22 bp, Homo sapiens
ccagctggcaggagagtcaggg

SEQ ID NO: 7922182 - DNA, 22 bp, Homo sapiens
ccagctggcaggagagtcaggg

SEQ ID NO: 7922183 - DNA, 22 bp, Homo sapiens
ccagctggcaggagagtcaggg

SEQ ID NO: 7922184 - DNA, 22 bp, Homo sapiens
ccagctggcactgtggctgccc

SEQ ID NO: 7922185 - DNA, 22 bp, Homo sapiens
ccagctggcactgtggctgccc

SEQ ID NO: 7922186 - DNA, 22 bp, Homo sapiens
ccagctggcactgtggctgccc

SEQ ID NO: 7922187 - DNA, 22 bp, Homo sapiens
ccagctggcactgtggctgccc

SEQ ID NO: 7922188 - DNA, 22 bp, Homo sapiens
ccagctggcactgtggctgccc

SEQ ID NO: 7922189 - DNA, 22 bp, Homo sapiens
ccagctggcactgtggctgccc

SEQ ID NO: 7922190 - DNA, 22 bp, Homo sapiens
ccagctggcactgtggctgccc

SEQ ID NO: 7922191 - DNA, 22 bp, Homo sapiens
ccagctggcactgtggctgccc

SEQ ID NO: 7922192 - DNA, 20 bp, Homo sapiens
ccagctctgtggttagatac

SEQ ID NO: 7922193 - DNA, 20 bp, Homo sapiens
ccagctctgtggttagatac

SEQ ID NO: 7922194 - DNA, 22 bp, Homo sapiens
ccagctctgtaagctgtgaaat

SEQ ID NO: 7922195 - DNA, 22 bp, Homo sapiens
ccagctctgtaagctgtgaaat

SEQ ID NO: 7922196 - DNA, 22 bp, Homo sapiens
ccagctctggcttcttgctggg

SEQ ID NO: 7922197 - DNA, 22 bp, Homo sapiens
ccagctctggcttcttgctggg

SEQ ID NO: 7922198 - DNA, 22 bp, Homo sapiens
ccagctcttggtgcacttacat

SEQ ID NO: 7922199 - DNA, 22 bp, Homo sapiens
ccagctcttggtgcacttacat

SEQ ID NO: 7922200 - DNA, 22 bp, Homo sapiens
ccagctcttttggctgagtgag

SEQ ID NO: 7922201 - DNA, 22 bp, Homo sapiens
ccagctcttttggctgagtgag

SEQ ID NO: 7922202 - DNA, 22 bp, Homo sapiens
ccagctcttttggctgagtgag

SEQ ID NO: 7922203 - DNA, 22 bp, Homo sapiens
ccagctcttttggctgagtgag

SEQ ID NO: 7922204 - DNA, 22 bp, Homo sapiens
ccagctctgcttgcccagtcag

SEQ ID NO: 7922205 - DNA, 22 bp, Homo sapiens
ccagctctgcttgcccagtcag

SEQ ID NO: 7922206 - DNA, 22 bp, Homo sapiens
ccagctctgcttgcccagtcag

SEQ ID NO: 7922207 - DNA, 22 bp, Homo sapiens
ccagctctgcttgcccagtcag

SEQ ID NO: 7922208 - DNA, 22 bp, Homo sapiens
ccagctctgcttgcccagtcag

SEQ ID NO: 7922209 - DNA, 21 bp, Homo sapiens
ccagctctgcctccagttggt

SEQ ID NO: 7922210 - DNA, 21 bp, Homo sapiens
ccagctctgcctccagttggt

SEQ ID NO: 7922211 - DNA, 22 bp, Homo sapiens
ccagctctggcttcttgctggg

SEQ ID NO: 7922212 - DNA, 22 bp, Homo sapiens
ccagctctgcttgcccagtcag

SEQ ID NO: 7922213 - DNA, 22 bp, Homo sapiens
ccagctctgcttgcccagtcag

SEQ ID NO: 7922214 - DNA, 22 bp, Homo sapiens
ccagctctggcttcttgctggg

SEQ ID NO: 7922215 - DNA, 22 bp, Homo sapiens
ccagcaggcagtcatatccttt

SEQ ID NO: 7922216 - DNA, 22 bp, Homo sapiens
ccagcaggcagtcatatccttt

SEQ ID NO: 7922217 - DNA, 22 bp, Homo sapiens
ccagcaggagatgcctgtgtct

SEQ ID NO: 7922218 - DNA, 22 bp, Homo sapiens
ccagctccggtgtgcttatttc

SEQ ID NO: 7922219 - DNA, 22 bp, Homo sapiens
ccagcaggcagtcatatccttt

SEQ ID NO: 7922220 - DNA, 21 bp, Homo sapiens
ccagctctgcctccagttggt

SEQ ID NO: 7922221 - DNA, 21 bp, Homo sapiens
ccagctctgcctccagttggt

SEQ ID NO: 7922222 - DNA, 21 bp, Homo sapiens
ccagctctgcctccagttggt

SEQ ID NO: 7922223 - DNA, 23 bp, Homo sapiens
ccagctccgtgagcctcgggctc

SEQ ID NO: 7922224 - DNA, 23 bp, Homo sapiens
ccagctccgtgagcctcgggctc

SEQ ID NO: 7922225 - DNA, 23 bp, Homo sapiens
ccagctccgtgagcctcgggctc

SEQ ID NO: 7922226 - DNA, 22 bp, Homo sapiens
ccagcaggagatgcctgtgtct

SEQ ID NO: 7922227 - DNA, 22 bp, Homo sapiens
ccagcaggagagaacatttccc

SEQ ID NO: 7922228 - DNA, 22 bp, Homo sapiens
ccagcaggagagaacatttccc

SEQ ID NO: 7922229 - DNA, 22 bp, Homo sapiens
ccagcaggagagaacatttccc

SEQ ID NO: 7922230 - DNA, 22 bp, Homo sapiens
ccagcaggagatgcctgtgtct

SEQ ID NO: 7922231 - DNA, 22 bp, Homo sapiens
ccagcaggagagaacatttccc

SEQ ID NO: 7922232 - DNA, 22 bp, Homo sapiens
ccagcaggagactagcaacata

SEQ ID NO: 7922233 - DNA, 22 bp, Homo sapiens
ccagcaggagactagcaacata

SEQ ID NO: 7922234 - DNA, 22 bp, Homo sapiens
ccagcaggagactagcaacata

SEQ ID NO: 7922235 - DNA, 22 bp, Homo sapiens
ccagcaggagactagcaacata

SEQ ID NO: 7922236 - DNA, 22 bp, Homo sapiens
ccagcaggagactagcaacata

SEQ ID NO: 7922237 - DNA, 22 bp, Homo sapiens
ccaggacaagccagagggacag

SEQ ID NO: 7922238 - DNA, 22 bp, Homo sapiens
ccaggaatgcacactctgagaa

SEQ ID NO: 7922239 - DNA, 22 bp, Homo sapiens
ccaggaatgcacactctgagaa

SEQ ID NO: 7922240 - DNA, 22 bp, Homo sapiens
ccaggaagtatgacccaacaga

SEQ ID NO: 7922241 - DNA, 22 bp, Homo sapiens
ccaggaaggtgtttaactagag

SEQ ID NO: 7922242 - DNA, 22 bp, Homo sapiens
ccaggaaggtgtttaactagag

SEQ ID NO: 7922243 - DNA, 22 bp, Homo sapiens
ccaggaaggtgtttaactagag

SEQ ID NO: 7922244 - DNA, 22 bp, Homo sapiens
ccaggaaggtgtttaactagag

SEQ ID NO: 7922245 - DNA, 22 bp, Homo sapiens
ccaggaaggtgtttaactagag

SEQ ID NO: 7922246 - DNA, 22 bp, Homo sapiens
ccaggaaggtatgggaagaaaa

SEQ ID NO: 7922247 - DNA, 22 bp, Homo sapiens
ccaggaaggtatgggaagaaaa

SEQ ID NO: 7922248 - DNA, 22 bp, Homo sapiens
ccaggaaggtatgggaagaaaa

SEQ ID NO: 7922249 - DNA, 22 bp, Homo sapiens
ccaggacaagccagagggacag

SEQ ID NO: 7922250 - DNA, 22 bp, Homo sapiens
ccaggacaagtgtggccatggc

SEQ ID NO: 7922251 - DNA, 22 bp, Homo sapiens
aggcctgtaatcccagcacttt

SEQ ID NO: 7922252 - DNA, 22 bp, Homo sapiens
aggcctgtaattttcctctttt

SEQ ID NO: 7922253 - DNA, 22 bp, Homo sapiens
aggcctggtgtgccggatgcag

SEQ ID NO: 7922254 - DNA, 22 bp, Homo sapiens
ccaggacaagccagagggacag

SEQ ID NO: 7922255 - DNA, 22 bp, Homo sapiens
ccaggacaagccagagggacag

SEQ ID NO: 7922256 - DNA, 22 bp, Homo sapiens
ccaggacaagccagagggacag

SEQ ID NO: 7922257 - DNA, 22 bp, Homo sapiens
aggcctgtagttcctctttcca

SEQ ID NO: 7922258 - DNA, 22 bp, Homo sapiens
aggcctgtcccagctgaggacg

SEQ ID NO: 7922259 - DNA, 22 bp, Homo sapiens
aggcctgtcccagctgaggacg

SEQ ID NO: 7922260 - DNA, 22 bp, Homo sapiens
aggcctgtcccagctgaggacg

SEQ ID NO: 7922261 - DNA, 22 bp, Homo sapiens
aggcctgtcccagctgaggacg

SEQ ID NO: 7922262 - DNA, 22 bp, Homo sapiens
aggcctgtctgaggtccccact

SEQ ID NO: 7922263 - DNA, 22 bp, Homo sapiens
aggcgctgcatgtgaaggagtt

SEQ ID NO: 7922264 - DNA, 22 bp, Homo sapiens
aggcgctgcatgtgaaggagtt

SEQ ID NO: 7922265 - DNA, 22 bp, Homo sapiens
aggcgctgcgctggggccagaa

SEQ ID NO: 7922266 - DNA, 22 bp, Homo sapiens
aggcgctgcgctggggccagaa

SEQ ID NO: 7922267 - DNA, 22 bp, Homo sapiens
aggcgctgcatgtgaaggagtt

SEQ ID NO: 7922268 - DNA, 22 bp, Homo sapiens
aggcgctgtgcttggggctgga

SEQ ID NO: 7922269 - DNA, 22 bp, Homo sapiens
aggcgctgcgctggggccagaa

SEQ ID NO: 7922270 - DNA, 22 bp, Homo sapiens
aggcgctgtgcttggggctgga

SEQ ID NO: 7922271 - DNA, 22 bp, Homo sapiens
aggcggagctcagtgtgtccaa

SEQ ID NO: 7922272 - DNA, 22 bp, Homo sapiens
aggcggaagatggccccataga

SEQ ID NO: 7922273 - DNA, 22 bp, Homo sapiens
aggcgctgtgcttggggctgga

SEQ ID NO: 7922274 - DNA, 22 bp, Homo sapiens
aggcgctgtgcttggggctgga

SEQ ID NO: 7922275 - DNA, 22 bp, Homo sapiens
aggcgctgtgcttggggctgga

SEQ ID NO: 7922276 - DNA, 22 bp, Homo sapiens
aggcggctccgggagtgtgggc

SEQ ID NO: 7922277 - DNA, 22 bp, Homo sapiens
aggcgtgggaggatctgaggcc

SEQ ID NO: 7922278 - DNA, 22 bp, Homo sapiens
aggcgtgggaggatctgaggcc

SEQ ID NO: 7922279 - DNA, 22 bp, Homo sapiens
aggcggtgtgctttgcagagca

SEQ ID NO: 7922280 - DNA, 22 bp, Homo sapiens
aggcggtgtgctttgcagagca

SEQ ID NO: 7922281 - DNA, 22 bp, Homo sapiens
aggcggtgtgctttgcagagca

SEQ ID NO: 7922282 - DNA, 22 bp, Homo sapiens
aggcggtggccaaggagcggga

SEQ ID NO: 7922283 - DNA, 22 bp, Homo sapiens
aggcggtggccaaggagcggga

SEQ ID NO: 7922284 - DNA, 22 bp, Homo sapiens
aggcggtggccaaggagcggga

SEQ ID NO: 7922285 - DNA, 22 bp, Homo sapiens
aggcggcttctgaggaggctgc

SEQ ID NO: 7922286 - DNA, 22 bp, Homo sapiens
aggcggcttctgaggaggctgc

SEQ ID NO: 7922287 - DNA, 22 bp, Homo sapiens
aggcgggtaccctggctcgaaa

SEQ ID NO: 7922288 - DNA, 22 bp, Homo sapiens
aggcggggaggcgctgctgtag

SEQ ID NO: 7922289 - DNA, 22 bp, Homo sapiens
aggcgggttcagggctgccatg

SEQ ID NO: 7922290 - DNA, 22 bp, Homo sapiens
aggcggggaggcgctgctgtag

SEQ ID NO: 7922291 - DNA, 22 bp, Homo sapiens
aggcggtgctgtggacagtgac

SEQ ID NO: 7922292 - DNA, 22 bp, Homo sapiens
ccaggaaggatcgtttgggagt

SEQ ID NO: 7922293 - DNA, 22 bp, Homo sapiens
ccaggaaggcaggcctccccgc

SEQ ID NO: 7922294 - DNA, 22 bp, Homo sapiens
ccaggaaggcaggcctccccgc

SEQ ID NO: 7922295 - DNA, 22 bp, Homo sapiens
ccaggaaggatcgtttgggagt

SEQ ID NO: 7922296 - DNA, 18 bp, Homo sapiens
aggcctgggaagctgagg

SEQ ID NO: 7922297 - DNA, 18 bp, Homo sapiens
aggcctgggaagctgagg

SEQ ID NO: 7922298 - DNA, 18 bp, Homo sapiens
aggcctgggaagctgagg

SEQ ID NO: 7922299 - DNA, 18 bp, Homo sapiens
aggcctgggaagctgagg

SEQ ID NO: 7922300 - DNA, 22 bp, Homo sapiens
aggcctggctttggtttgctga

SEQ ID NO: 7922301 - DNA, 18 bp, Homo sapiens
aggcctgggaagctgagg

SEQ ID NO: 7922302 - DNA, 18 bp, Homo sapiens
aggcctgggaagctgagg

SEQ ID NO: 7922303 - DNA, 18 bp, Homo sapiens
aggcctgggaagctgagg

SEQ ID NO: 7922304 - DNA, 22 bp, Homo sapiens
aggcctgggacgggagccgtga

SEQ ID NO: 7922305 - DNA, 22 bp, Homo sapiens
aggcctgggacgggagccgtga

SEQ ID NO: 7922306 - DNA, 22 bp, Homo sapiens
ccaggaaggcgttgttcctctc

SEQ ID NO: 7922307 - DNA, 22 bp, Homo sapiens
ccaggaaggcgttgttcctctc

SEQ ID NO: 7922308 - DNA, 22 bp, Homo sapiens
ccaggaagggctctttaaagac

SEQ ID NO: 7922309 - DNA, 22 bp, Homo sapiens
ccaggaaggtatgggaagaaaa

SEQ ID NO: 7922310 - DNA, 22 bp, Homo sapiens
ccaggaagggctctttaaagac

SEQ ID NO: 7922311 - DNA, 22 bp, Homo sapiens
ccaggaaggcctggatgccccc

SEQ ID NO: 7922312 - DNA, 22 bp, Homo sapiens
ccaggaaggcaggcctccccgc

SEQ ID NO: 7922313 - DNA, 22 bp, Homo sapiens
ccaggaaggcctggatgccccc

SEQ ID NO: 7922314 - DNA, 22 bp, Homo sapiens
ccaggaaggcctggatgccccc

SEQ ID NO: 7922315 - DNA, 22 bp, Homo sapiens
aggcctggcatgagacctgaga

SEQ ID NO: 7922316 - DNA, 22 bp, Homo sapiens
aggcctggcatgagacctgaga

SEQ ID NO: 7922317 - DNA, 22 bp, Homo sapiens
aggcctgcttacaatgttatcc

SEQ ID NO: 7922318 - DNA, 22 bp, Homo sapiens
aggcctgctgtgtagcctgttg

SEQ ID NO: 7922319 - DNA, 22 bp, Homo sapiens
aggcctgctgtgtagcctgttg

SEQ ID NO: 7922320 - DNA, 22 bp, Homo sapiens
aggcctgctgtgtagcctgttg

SEQ ID NO: 7922321 - DNA, 22 bp, Homo sapiens
aggcctggccccagttgctagg

SEQ ID NO: 7922322 - DNA, 22 bp, Homo sapiens
aggcctggcatgagacctgaga

SEQ ID NO: 7922323 - DNA, 22 bp, Homo sapiens
aggcctggcatgagacctgaga

SEQ ID NO: 7922324 - DNA, 22 bp, Homo sapiens
aggcctggctttggtttgctga

SEQ ID NO: 7922325 - DNA, 22 bp, Homo sapiens
aggcctggcctttatgttcaag

SEQ ID NO: 7922326 - DNA, 22 bp, Homo sapiens
aggcctggcctttatgttcaag

SEQ ID NO: 7922327 - DNA, 22 bp, Homo sapiens
aggcctggcctttatgttcaag

SEQ ID NO: 7922328 - DNA, 22 bp, Homo sapiens
aggcctggcctttatgttcaag

SEQ ID NO: 7922329 - DNA, 22 bp, Homo sapiens
aggcctggcctgggcggcattg

SEQ ID NO: 7922330 - DNA, 22 bp, Homo sapiens
aggcctggcctgggcggcattg

SEQ ID NO: 7922331 - DNA, 22 bp, Homo sapiens
aggcctggcctgggcggcattg

SEQ ID NO: 7922332 - DNA, 22 bp, Homo sapiens
aggcctggcctgggcggcattg

SEQ ID NO: 7922333 - DNA, 22 bp, Homo sapiens
aggcctggccccagttgctagg

SEQ ID NO: 7922334 - DNA, 22 bp, Homo sapiens
aggcctggcctttatgttcaag

SEQ ID NO: 7922335 - DNA, 22 bp, Homo sapiens
aggcctggcctgggcggcattg

SEQ ID NO: 7922336 - DNA, 22 bp, Homo sapiens
aggcctggcctgggcggcattg

SEQ ID NO: 7922337 - DNA, 18 bp, Homo sapiens
aggcaggctggagtgact

SEQ ID NO: 7922338 - DNA, 22 bp, Homo sapiens
aggcaggctgctatggagtaga

SEQ ID NO: 7922339 - DNA, 18 bp, Homo sapiens
aggcaggctggagtgact

SEQ ID NO: 7922340 - DNA, 18 bp, Homo sapiens
aggcaggctggagtgact

SEQ ID NO: 7922341 - DNA, 22 bp, Homo sapiens
ccactgggggctgcaggcactc

SEQ ID NO: 7922342 - DNA, 18 bp, Homo sapiens
aggcaggctggagtgact

SEQ ID NO: 7922343 - DNA, 22 bp, Homo sapiens
ccactgggggctgcaggcactc

SEQ ID NO: 7922344 - DNA, 22 bp, Homo sapiens
ccactgggggctgcaggcactc

SEQ ID NO: 7922345 - DNA, 22 bp, Homo sapiens
ccactgggggctgcaggcactc

SEQ ID NO: 7922346 - DNA, 22 bp, Homo sapiens
ccagaaaaggagctgcaggatg

SEQ ID NO: 7922347 - DNA, 22 bp, Homo sapiens
ccagaaaatatggctaaggtga

SEQ ID NO: 7922348 - DNA, 22 bp, Homo sapiens
ccagaaaatatggctaaggtga

SEQ ID NO: 7922349 - DNA, 22 bp, Homo sapiens
ccagaaaatatggctaaggtga

SEQ ID NO: 7922350 - DNA, 22 bp, Homo sapiens
ccagaaaatatggctaaggtga

SEQ ID NO: 7922351 - DNA, 22 bp, Homo sapiens
ccagaaaatgcagaacatagaa

SEQ ID NO: 7922352 - DNA, 22 bp, Homo sapiens
ccagaaaatgcagaacatagaa

SEQ ID NO: 7922353 - DNA, 22 bp, Homo sapiens
ccagaaagaatgaactgaaccc

SEQ ID NO: 7922354 - DNA, 22 bp, Homo sapiens
ccagaaagaatgaactgaaccc

SEQ ID NO: 7922355 - DNA, 22 bp, Homo sapiens
ccagaaagaatgaactgaaccc

SEQ ID NO: 7922356 - DNA, 22 bp, Homo sapiens
ccagaaagaatgaactgaaccc

SEQ ID NO: 7922357 - DNA, 22 bp, Homo sapiens
ccagaaagaatgaactgaaccc

SEQ ID NO: 7922358 - DNA, 22 bp, Homo sapiens
ccagaaagataggaaatcaagt

SEQ ID NO: 7922359 - DNA, 22 bp, Homo sapiens
ccagaaagataggaaatcaagt

SEQ ID NO: 7922360 - DNA, 22 bp, Homo sapiens
ccagaaagataggaaatcaagt

SEQ ID NO: 7922361 - DNA, 22 bp, Homo sapiens
ccagaaagactttttaggtacg

SEQ ID NO: 7922362 - DNA, 22 bp, Homo sapiens
ccagaaagataggaaatcaagt

SEQ ID NO: 7922363 - DNA, 22 bp, Homo sapiens
ccagaaagttcagctgtgaatg

SEQ ID NO: 7922364 - DNA, 22 bp, Homo sapiens
ccagaaaggtaaacactggatt

SEQ ID NO: 7922365 - DNA, 22 bp, Homo sapiens
ccagaaaggtaaacactggatt

SEQ ID NO: 7922366 - DNA, 22 bp, Homo sapiens
ccagaaaggtaaacactggatt

SEQ ID NO: 7922367 - DNA, 22 bp, Homo sapiens
ccagaaaggtaaacactggatt

SEQ ID NO: 7922368 - DNA, 22 bp, Homo sapiens
ccagaaagttcagctgtgaatg

SEQ ID NO: 7922369 - DNA, 22 bp, Homo sapiens
ccagaaatcctctctttcttgc

SEQ ID NO: 7922370 - DNA, 22 bp, Homo sapiens
ccagaaatgagtagaggatgct

SEQ ID NO: 7922371 - DNA, 22 bp, Homo sapiens
ccagaaatgagtagaggatgct

SEQ ID NO: 7922372 - DNA, 22 bp, Homo sapiens
ccagaacacagtggaagaatat

SEQ ID NO: 7922373 - DNA, 22 bp, Homo sapiens
ccagaacacagtggaagaatat

SEQ ID NO: 7922374 - DNA, 22 bp, Homo sapiens
ccagaacagacctgcctgacct

SEQ ID NO: 7922375 - DNA, 22 bp, Homo sapiens
ccagaacagacctgcctgacct

SEQ ID NO: 7922376 - DNA, 22 bp, Homo sapiens
ccagaaatggccctagtcagag

SEQ ID NO: 7922377 - DNA, 22 bp, Homo sapiens
ccagaacacagtggaagaatat

SEQ ID NO: 7922378 - DNA, 22 bp, Homo sapiens
ccagaaatggccctcaggtgac

SEQ ID NO: 7922379 - DNA, 22 bp, Homo sapiens
ccagaagacaagaatgttctta

SEQ ID NO: 7922380 - DNA, 22 bp, Homo sapiens
ccagaagacaagaatgttctta

SEQ ID NO: 7922381 - DNA, 22 bp, Homo sapiens
ccagaagaacttaattcaaaac

SEQ ID NO: 7922382 - DNA, 22 bp, Homo sapiens
ccagaagaacttaattcaaaac

SEQ ID NO: 7922383 - DNA, 22 bp, Homo sapiens
ccagaagaacttaattcaaaac

SEQ ID NO: 7922384 - DNA, 22 bp, Homo sapiens
ccagaagaacttaattcaaaac

SEQ ID NO: 7922385 - DNA, 22 bp, Homo sapiens
ccagaagaacttaattcaaaac

SEQ ID NO: 7922386 - DNA, 22 bp, Homo sapiens
ccagaagaccggggagtcaggg

SEQ ID NO: 7922387 - DNA, 22 bp, Homo sapiens
ccagaagaccccgtccacctcc

SEQ ID NO: 7922388 - DNA, 22 bp, Homo sapiens
ccagaagaccccgtccacctcc

SEQ ID NO: 7922389 - DNA, 22 bp, Homo sapiens
ccagaagacaagaatgttctta

SEQ ID NO: 7922390 - DNA, 22 bp, Homo sapiens
ccagaagacaagaatgttctta

SEQ ID NO: 7922391 - DNA, 22 bp, Homo sapiens
ccagaagaaaaagctggtatta

SEQ ID NO: 7922392 - DNA, 22 bp, Homo sapiens
ccagaagaaaaagctggtatta

SEQ ID NO: 7922393 - DNA, 22 bp, Homo sapiens
ccagaactgagaaaataaattt

SEQ ID NO: 7922394 - DNA, 22 bp, Homo sapiens
ccagaactgagaaaataaattt

SEQ ID NO: 7922395 - DNA, 22 bp, Homo sapiens
ccagaactgggcaacagaaagt

SEQ ID NO: 7922396 - DNA, 22 bp, Homo sapiens
ccagaacagacctgcctgacct

SEQ ID NO: 7922397 - DNA, 22 bp, Homo sapiens
ccagaaccaaaagcatggagta

SEQ ID NO: 7922398 - DNA, 22 bp, Homo sapiens
ccagaaccaaaagcatggagta

SEQ ID NO: 7922399 - DNA, 22 bp, Homo sapiens
ccagaaccaaaagcatggagta

SEQ ID NO: 7922400 - DNA, 22 bp, Homo sapiens
ccagaactgagaaaataaattt

SEQ ID NO: 7922401 - DNA, 22 bp, Homo sapiens
ccagaacgtttgtgcgaggcag

SEQ ID NO: 7922402 - DNA, 22 bp, Homo sapiens
ccagagaaagctcacaggcagt

SEQ ID NO: 7922403 - DNA, 22 bp, Homo sapiens
ccagagaaagctcacaggcagt

SEQ ID NO: 7922404 - DNA, 22 bp, Homo sapiens
ccagagaaaagaggccaaggat

SEQ ID NO: 7922405 - DNA, 22 bp, Homo sapiens
ccagagaaaagaggccaaggat

SEQ ID NO: 7922406 - DNA, 22 bp, Homo sapiens
ccagagaaaagaggccaaggat

SEQ ID NO: 7922407 - DNA, 22 bp, Homo sapiens
ccagagaaaagaggccaaggat

SEQ ID NO: 7922408 - DNA, 22 bp, Homo sapiens
ccagagaaaaatgtgtccctgt

SEQ ID NO: 7922409 - DNA, 22 bp, Homo sapiens
ccagagaaaaatgtgtccctgt

SEQ ID NO: 7922410 - DNA, 22 bp, Homo sapiens
ccagagaaaaatgtgtccctgt

SEQ ID NO: 7922411 - DNA, 22 bp, Homo sapiens
ccagagaaaaatgtgtccctgt

SEQ ID NO: 7922412 - DNA, 22 bp, Homo sapiens
ccagagaaaaatgtgtccctgt

SEQ ID NO: 7922413 - DNA, 22 bp, Homo sapiens
aggccacagtcagtgggtgctg

SEQ ID NO: 7922414 - DNA, 22 bp, Homo sapiens
aggccacaagaactaccccatc

SEQ ID NO: 7922415 - DNA, 22 bp, Homo sapiens
aggccacaagaactaccccatc

SEQ ID NO: 7922416 - DNA, 22 bp, Homo sapiens
aggccacagtactttgcagacc

SEQ ID NO: 7922417 - DNA, 22 bp, Homo sapiens
aggccacagttgaggccagcaa

SEQ ID NO: 7922418 - DNA, 22 bp, Homo sapiens
aggccacagttgaggccagcaa

SEQ ID NO: 7922419 - DNA, 22 bp, Homo sapiens
aggccacagtcagtgggtgctg

SEQ ID NO: 7922420 - DNA, 22 bp, Homo sapiens
aggccacagtcagtgggtgctg

SEQ ID NO: 7922421 - DNA, 22 bp, Homo sapiens
aggccacagttgaggccagcaa

SEQ ID NO: 7922422 - DNA, 22 bp, Homo sapiens
ccagaccagactgacttgagcc

SEQ ID NO: 7922423 - DNA, 22 bp, Homo sapiens
ccagaccaccctggccatgcac

SEQ ID NO: 7922424 - DNA, 22 bp, Homo sapiens
ccagaccaccctggccatgcac

SEQ ID NO: 7922425 - DNA, 22 bp, Homo sapiens
ccagaccaccctggccatgcac

SEQ ID NO: 7922426 - DNA, 22 bp, Homo sapiens
ccagaccctgctctggggctct

SEQ ID NO: 7922427 - DNA, 22 bp, Homo sapiens
ccagaccagactgacttgagcc

SEQ ID NO: 7922428 - DNA, 22 bp, Homo sapiens
ccagaagaccggggagtcaggg

SEQ ID NO: 7922429 - DNA, 22 bp, Homo sapiens
ccagaagaccggggagtcaggg

SEQ ID NO: 7922430 - DNA, 22 bp, Homo sapiens
ccagacagttccttgaggttca

SEQ ID NO: 7922431 - DNA, 22 bp, Homo sapiens
ccagaagaccggggagtcaggg

SEQ ID NO: 7922432 - DNA, 22 bp, Homo sapiens
ccagacagttccttgaggttca

SEQ ID NO: 7922433 - DNA, 22 bp, Homo sapiens
ccagacatgtgcccttgaggaa

SEQ ID NO: 7922434 - DNA, 22 bp, Homo sapiens
ccagaccaccctggccatgcac

SEQ ID NO: 7922435 - DNA, 22 bp, Homo sapiens
ccagacctaaccagcttttgta

SEQ ID NO: 7922436 - DNA, 22 bp, Homo sapiens
ccagaccctttcttggcatgtg

SEQ ID NO: 7922437 - DNA, 22 bp, Homo sapiens
ccagacctgcaaggctgagagg

SEQ ID NO: 7922438 - DNA, 22 bp, Homo sapiens
ccagacctgcaaggctgagagg

SEQ ID NO: 7922439 - DNA, 22 bp, Homo sapiens
ccagaccctttcttggcatgtg

SEQ ID NO: 7922440 - DNA, 22 bp, Homo sapiens
ccagaccctttcttggcatgtg

SEQ ID NO: 7922441 - DNA, 22 bp, Homo sapiens
ccagactgagggtccctgagct

SEQ ID NO: 7922442 - DNA, 22 bp, Homo sapiens
ccagactgagggtccctgagct

SEQ ID NO: 7922443 - DNA, 22 bp, Homo sapiens
ccagactgcttgcttcccagcc

SEQ ID NO: 7922444 - DNA, 22 bp, Homo sapiens
ccagactggggctccttgaggg

SEQ ID NO: 7922445 - DNA, 22 bp, Homo sapiens
aggccaggtggtcatgcttgct

SEQ ID NO: 7922446 - DNA, 22 bp, Homo sapiens
aggccaggcaacattctgaagt

SEQ ID NO: 7922447 - DNA, 22 bp, Homo sapiens
aggccaggatagcatggatcag

SEQ ID NO: 7922448 - DNA, 22 bp, Homo sapiens
aggccaggcaacattctgaagt

SEQ ID NO: 7922449 - DNA, 22 bp, Homo sapiens
aggccaggcaacattctgaagt

SEQ ID NO: 7922450 - DNA, 22 bp, Homo sapiens
aggccaggatagcatggatcag

SEQ ID NO: 7922451 - DNA, 20 bp, Homo sapiens
ccagagctgatggctgcccg

SEQ ID NO: 7922452 - DNA, 22 bp, Homo sapiens
aggccaggttcctcaatcttga

SEQ ID NO: 7922453 - DNA, 22 bp, Homo sapiens
aggccaggttcctcaatcttga

SEQ ID NO: 7922454 - DNA, 22 bp, Homo sapiens
aggccaggttcctcaatcttga

SEQ ID NO: 7922455 - DNA, 22 bp, Homo sapiens
aggccaggcaacattctgaagt

SEQ ID NO: 7922456 - DNA, 22 bp, Homo sapiens
aggccaggtggtcatgcttgct

SEQ ID NO: 7922457 - DNA, 22 bp, Homo sapiens
aggccaggtggtcatgcttgct

SEQ ID NO: 7922458 - DNA, 22 bp, Homo sapiens
aggccaggtggtcatgcttgct

SEQ ID NO: 7922459 - DNA, 22 bp, Homo sapiens
aggccaggttcctcaatcttga

SEQ ID NO: 7922460 - DNA, 22 bp, Homo sapiens
aggccaggttcctcaatcttga

SEQ ID NO: 7922461 - DNA, 22 bp, Homo sapiens
aggccagtgcagctggaacaga

SEQ ID NO: 7922462 - DNA, 22 bp, Homo sapiens
aggccagtgcagctggaacaga

SEQ ID NO: 7922463 - DNA, 22 bp, Homo sapiens
aggccagtgcagctggaacaga

SEQ ID NO: 7922464 - DNA, 22 bp, Homo sapiens
aggccagtgccatcagggtttt

SEQ ID NO: 7922465 - DNA, 22 bp, Homo sapiens
aggccagtgccatcagggtttt

SEQ ID NO: 7922466 - DNA, 22 bp, Homo sapiens
aggccagtgcctttccagggct

SEQ ID NO: 7922467 - DNA, 22 bp, Homo sapiens
aggccagtgcctttccagggct

SEQ ID NO: 7922468 - DNA, 22 bp, Homo sapiens
aggccagtgcctttccagggct

SEQ ID NO: 7922469 - DNA, 22 bp, Homo sapiens
aggccagtggttctctgtgtcc

SEQ ID NO: 7922470 - DNA, 22 bp, Homo sapiens
aggccagtgtggctggagcaca

SEQ ID NO: 7922471 - DNA, 22 bp, Homo sapiens
aggccagtgtggctggagcaca

SEQ ID NO: 7922472 - DNA, 22 bp, Homo sapiens
aggccagtgcagctggaacaga

SEQ ID NO: 7922473 - DNA, 22 bp, Homo sapiens
aggccatcaaatcatgtagtgc

SEQ ID NO: 7922474 - DNA, 22 bp, Homo sapiens
aggccagtgtggctggagcaca

SEQ ID NO: 7922475 - DNA, 22 bp, Homo sapiens
aggccagttgttcagtgggccg

SEQ ID NO: 7922476 - DNA, 22 bp, Homo sapiens
ccagcaggagactagcaacata

SEQ ID NO: 7922477 - DNA, 22 bp, Homo sapiens
ccagcaggactttggaaatatg

SEQ ID NO: 7922478 - DNA, 22 bp, Homo sapiens
ccagcaggactttggaaatatg

SEQ ID NO: 7922479 - DNA, 22 bp, Homo sapiens
ccagcaggactttggaaatatg

SEQ ID NO: 7922480 - DNA, 22 bp, Homo sapiens
ccagcaggaaagtgacgtttga

SEQ ID NO: 7922481 - DNA, 22 bp, Homo sapiens
ccagcaggaaagtgacgtttga

SEQ ID NO: 7922482 - DNA, 22 bp, Homo sapiens
ccagcaggaaagtgacgtttga

SEQ ID NO: 7922483 - DNA, 22 bp, Homo sapiens
ccagcagctttgcatacactaa

SEQ ID NO: 7922484 - DNA, 19 bp, Homo sapiens
ccagcagctttgattctct

SEQ ID NO: 7922485 - DNA, 22 bp, Homo sapiens
ccagcagctttgcatacactaa

SEQ ID NO: 7922486 - DNA, 22 bp, Homo sapiens
ccagcagctttgcatacactaa

SEQ ID NO: 7922487 - DNA, 19 bp, Homo sapiens
ccagcagctttgattctct

SEQ ID NO: 7922488 - DNA, 19 bp, Homo sapiens
ccagcagctttgattctct

SEQ ID NO: 7922489 - DNA, 22 bp, Homo sapiens
ccagcagctttgcatacactaa

SEQ ID NO: 7922490 - DNA, 19 bp, Homo sapiens
ccagcagctttgattctct

SEQ ID NO: 7922491 - DNA, 22 bp, Homo sapiens
aggcccagactcagcggggcgg

SEQ ID NO: 7922492 - DNA, 22 bp, Homo sapiens
aggcccagactcagcggggcgg

SEQ ID NO: 7922493 - DNA, 22 bp, Homo sapiens
aggcccagactcagcggggcgg

SEQ ID NO: 7922494 - DNA, 23 bp, Homo sapiens
aggcccaactctgtgagggctgc

SEQ ID NO: 7922495 - DNA, 22 bp, Homo sapiens
aggcccagactcagcggggcgg

SEQ ID NO: 7922496 - DNA, 22 bp, Homo sapiens
aggcccagactcagcggggcgg

SEQ ID NO: 7922497 - DNA, 22 bp, Homo sapiens
aggcccagactcagcggggcgg

SEQ ID NO: 7922498 - DNA, 19 bp, Homo sapiens
ccagcagctttgattctct

SEQ ID NO: 7922499 - DNA, 22 bp, Homo sapiens
aggcccagagagccagttagtg

SEQ ID NO: 7922500 - DNA, 22 bp, Homo sapiens
aggccatgtggccccagagtct

SEQ ID NO: 7922501 - DNA, 22 bp, Homo sapiens
aggccatgtggccccagagtct

SEQ ID NO: 7922502 - DNA, 22 bp, Homo sapiens
aggccatgccaggcccaggaag

SEQ ID NO: 7922503 - DNA, 22 bp, Homo sapiens
aggccatgaggtcatgggagat

SEQ ID NO: 7922504 - DNA, 22 bp, Homo sapiens
aggccatgaggtcatgggagat

SEQ ID NO: 7922505 - DNA, 22 bp, Homo sapiens
aggcccaaaagaaaccactggg

SEQ ID NO: 7922506 - DNA, 23 bp, Homo sapiens
aggcccaactctgtgagggctgc

SEQ ID NO: 7922507 - DNA, 23 bp, Homo sapiens
aggcccaactctgtgagggctgc

SEQ ID NO: 7922508 - DNA, 22 bp, Homo sapiens
aggccagaaaaagacagctcca

SEQ ID NO: 7922509 - DNA, 22 bp, Homo sapiens
aggccagaaaaagacagctcca

SEQ ID NO: 7922510 - DNA, 22 bp, Homo sapiens
aggccagaaatgtcagggagtg

SEQ ID NO: 7922511 - DNA, 22 bp, Homo sapiens
aggccagaaatgtcagggagtg

SEQ ID NO: 7922512 - DNA, 22 bp, Homo sapiens
aggccagaaatgtcagggagtg

SEQ ID NO: 7922513 - DNA, 22 bp, Homo sapiens
aggccagaaatgtcagggagtg

SEQ ID NO: 7922514 - DNA, 22 bp, Homo sapiens
aggccagaaatgtcagggagtg

SEQ ID NO: 7922515 - DNA, 22 bp, Homo sapiens
aggccagaaatgtcagggagtg

SEQ ID NO: 7922516 - DNA, 22 bp, Homo sapiens
ccagagcctggcatctgcataa

SEQ ID NO: 7922517 - DNA, 22 bp, Homo sapiens
ccagagcctggcatctgcataa

SEQ ID NO: 7922518 - DNA, 22 bp, Homo sapiens
ccagagcctggcatctgcataa

SEQ ID NO: 7922519 - DNA, 21 bp, Homo sapiens
ccagagcctgctgagccccct

SEQ ID NO: 7922520 - DNA, 21 bp, Homo sapiens
ccagagcctgctgagccccct

SEQ ID NO: 7922521 - DNA, 21 bp, Homo sapiens
ccagagcctgctgagccccct

SEQ ID NO: 7922522 - DNA, 22 bp, Homo sapiens
aggccacatagcttgcatgtag

SEQ ID NO: 7922523 - DNA, 22 bp, Homo sapiens
aggccacattgtgattcccgca

SEQ ID NO: 7922524 - DNA, 22 bp, Homo sapiens
aggccagaaaaagacagctcca

SEQ ID NO: 7922525 - DNA, 22 bp, Homo sapiens
aggccagaaaaagacagctcca

SEQ ID NO: 7922526 - DNA, 22 bp, Homo sapiens
aggccagaaaaagacagctcca

SEQ ID NO: 7922527 - DNA, 22 bp, Homo sapiens
aggccagaaaaagacagctcca

SEQ ID NO: 7922528 - DNA, 22 bp, Homo sapiens
aggccacagttgaggccagcaa

SEQ ID NO: 7922529 - DNA, 22 bp, Homo sapiens
aggccacagttgaggccagcaa

SEQ ID NO: 7922530 - DNA, 22 bp, Homo sapiens
aggccacatagcttgcatgtag

SEQ ID NO: 7922531 - DNA, 22 bp, Homo sapiens
aggccacatagcttgcatgtag

SEQ ID NO: 7922532 - DNA, 22 bp, Homo sapiens
aggccacatagcttgcatgtag

SEQ ID NO: 7922533 - DNA, 22 bp, Homo sapiens
aggccacatagcttgcatgtag

SEQ ID NO: 7922534 - DNA, 22 bp, Homo sapiens
ccagagctccagggctacagaa

SEQ ID NO: 7922535 - DNA, 22 bp, Homo sapiens
ccagagctccagggctacagaa

SEQ ID NO: 7922536 - DNA, 22 bp, Homo sapiens
ccagagctccagggctacagaa

SEQ ID NO: 7922537 - DNA, 17 bp, Homo sapiens
ccagagctactgagact

SEQ ID NO: 7922538 - DNA, 22 bp, Homo sapiens
ccagagctccagggctacagaa

SEQ ID NO: 7922539 - DNA, 17 bp, Homo sapiens
ccagagctactgagact

SEQ ID NO: 7922540 - DNA, 22 bp, Homo sapiens
ccagagctccagggctacagaa

SEQ ID NO: 7922541 - DNA, 22 bp, Homo sapiens
ccagagctaaacacacaggctg

SEQ ID NO: 7922542 - DNA, 22 bp, Homo sapiens
ccagagctaaacacacaggctg

SEQ ID NO: 7922543 - DNA, 22 bp, Homo sapiens
ccagagctaaacacacaggctg

SEQ ID NO: 7922544 - DNA, 22 bp, Homo sapiens
ccagagctaaacacacaggctg

SEQ ID NO: 7922545 - DNA, 17 bp, Homo sapiens
ccagagctactgagact

SEQ ID NO: 7922546 - DNA, 22 bp, Homo sapiens
ccagagctgaggagatgggctt

SEQ ID NO: 7922547 - DNA, 22 bp, Homo sapiens
ccagagctgaggagatgggctt

SEQ ID NO: 7922548 - DNA, 23 bp, Homo sapiens
ccagagctctttcatgcttccat

SEQ ID NO: 7922549 - DNA, 22 bp, Homo sapiens
ccagagctccagggctacagaa

SEQ ID NO: 7922550 - DNA, 22 bp, Homo sapiens
ccagagctccagggctacagaa

SEQ ID NO: 7922551 - DNA, 22 bp, Homo sapiens
ccagagctccagggctacagaa

SEQ ID NO: 7922552 - DNA, 22 bp, Homo sapiens
ccagagctgagggagcctgagc

SEQ ID NO: 7922553 - DNA, 22 bp, Homo sapiens
ccagagctgagggagcctgagc

SEQ ID NO: 7922554 - DNA, 20 bp, Homo sapiens
ccagagctgatggctgcccg

SEQ ID NO: 7922555 - DNA, 22 bp, Homo sapiens
ccagagctgagggagcctgagc

SEQ ID NO: 7922556 - DNA, 22 bp, Homo sapiens
ccagagctgagggagcctgagc

SEQ ID NO: 7922557 - DNA, 22 bp, Homo sapiens
ccagagctgaggagatgggctt

SEQ ID NO: 7922558 - DNA, 22 bp, Homo sapiens
ccagagctgaggagatgggctt

SEQ ID NO: 7922559 - DNA, 22 bp, Homo sapiens
ccagagctgagggagcctgagc

SEQ ID NO: 7922560 - DNA, 22 bp, Homo sapiens
aggaagggttctttgtgaaaga

SEQ ID NO: 7922561 - DNA, 22 bp, Homo sapiens
aggaagggttctttgtgaaaga

SEQ ID NO: 7922562 - DNA, 22 bp, Homo sapiens
aggaagggttctttgtgaaaga

SEQ ID NO: 7922563 - DNA, 22 bp, Homo sapiens
aggaagggttctttgtgaaaga

SEQ ID NO: 7922564 - DNA, 22 bp, Homo sapiens
aggaaggtaatgaactgaggag

SEQ ID NO: 7922565 - DNA, 20 bp, Homo sapiens
aggaagtattgtcatgaagg

SEQ ID NO: 7922566 - DNA, 20 bp, Homo sapiens
aggaagtattgtcatgaagg

SEQ ID NO: 7922567 - DNA, 20 bp, Homo sapiens
aggaagtattgtcatgaagg

SEQ ID NO: 7922568 - DNA, 22 bp, Homo sapiens
aggaagtgaaagggaaggagtt

SEQ ID NO: 7922569 - DNA, 22 bp, Homo sapiens
aggaagtcagctgccatgctgt

SEQ ID NO: 7922570 - DNA, 22 bp, Homo sapiens
aggaagtcagctgccatgctgt

SEQ ID NO: 7922571 - DNA, 20 bp, Homo sapiens
caggtccagcacgtgcacgg

SEQ ID NO: 7922572 - DNA, 20 bp, Homo sapiens
caggtccagcacgtgcacgg

SEQ ID NO: 7922573 - DNA, 22 bp, Homo sapiens
caggtccagtaaaaagagtcct

SEQ ID NO: 7922574 - DNA, 17 bp, Homo sapiens
caggtcccagggtctct

SEQ ID NO: 7922575 - DNA, 22 bp, Homo sapiens
caggtccagtcactggtctgca

SEQ ID NO: 7922576 - DNA, 17 bp, Homo sapiens
caggtcccagggtctct

SEQ ID NO: 7922577 - DNA, 22 bp, Homo sapiens
caggtccagtcactggtctgca

SEQ ID NO: 7922578 - DNA, 22 bp, Homo sapiens
caggtcccctcccctaccaggc

SEQ ID NO: 7922579 - DNA, 22 bp, Homo sapiens
caggtccccagggtacctacct

SEQ ID NO: 7922580 - DNA, 17 bp, Homo sapiens
caggtcccagggtctct

SEQ ID NO: 7922581 - DNA, 22 bp, Homo sapiens
caggtcccgccccgggctgacc

SEQ ID NO: 7922582 - DNA, 22 bp, Homo sapiens
aggaaggggagaagttaaagct

SEQ ID NO: 7922583 - DNA, 22 bp, Homo sapiens
aggaaggggagaagttaaagct

SEQ ID NO: 7922584 - DNA, 22 bp, Homo sapiens
aggaagggtggatagtaacgtg

SEQ ID NO: 7922585 - DNA, 22 bp, Homo sapiens
aggaagggtggatagtaacgtg

SEQ ID NO: 7922586 - DNA, 22 bp, Homo sapiens
aggaagggtggatagtaacgtg

SEQ ID NO: 7922587 - DNA, 22 bp, Homo sapiens
aggaagggtggatagtaacgtg

SEQ ID NO: 7922588 - DNA, 22 bp, Homo sapiens
aggaaggggagaagttaaagct

SEQ ID NO: 7922589 - DNA, 22 bp, Homo sapiens
aggaaggggagaagttaaagct

SEQ ID NO: 7922590 - DNA, 22 bp, Homo sapiens
aggaaggggagaagttaaagct

SEQ ID NO: 7922591 - DNA, 22 bp, Homo sapiens
aggaaggggagaagttaaagct

SEQ ID NO: 7922592 - DNA, 20 bp, Homo sapiens
aggaaggagaatctgagcaa

SEQ ID NO: 7922593 - DNA, 20 bp, Homo sapiens
aggaaggagaatctgagcaa

SEQ ID NO: 7922594 - DNA, 22 bp, Homo sapiens
aggaagggctgtttctccaaga

SEQ ID NO: 7922595 - DNA, 22 bp, Homo sapiens
aggaagggtgtcatgagccctt

SEQ ID NO: 7922596 - DNA, 22 bp, Homo sapiens
aggaagggtgtcatgagccctt

SEQ ID NO: 7922597 - DNA, 22 bp, Homo sapiens
aggaagggtgtcatgagccctt

SEQ ID NO: 7922598 - DNA, 22 bp, Homo sapiens
aggaagggtgtcatgagccctt

SEQ ID NO: 7922599 - DNA, 22 bp, Homo sapiens
aggaagggtggatagtaacgtg

SEQ ID NO: 7922600 - DNA, 22 bp, Homo sapiens
aggaagggtgtcatgagccctt

SEQ ID NO: 7922601 - DNA, 22 bp, Homo sapiens
aggaagggtgtcatgagccctt

SEQ ID NO: 7922602 - DNA, 22 bp, Homo sapiens
aggaagggtgtcatgagccctt

SEQ ID NO: 7922603 - DNA, 22 bp, Homo sapiens
aggaagggtggatagtaacgtg

SEQ ID NO: 7922604 - DNA, 22 bp, Homo sapiens
aggaagggttctttctgtttat

SEQ ID NO: 7922605 - DNA, 22 bp, Homo sapiens
aggaagggttctttctgtttat

SEQ ID NO: 7922606 - DNA, 22 bp, Homo sapiens
aggaagggttctttctgtttat

SEQ ID NO: 7922607 - DNA, 22 bp, Homo sapiens
aggaagggttctttgtgaaaga

SEQ ID NO: 7922608 - DNA, 22 bp, Homo sapiens
aggaagggttctttgtgaaaga

SEQ ID NO: 7922609 - DNA, 22 bp, Homo sapiens
aggaagggttctttgtgaaaga

SEQ ID NO: 7922610 - DNA, 22 bp, Homo sapiens
aggaagggttctttctgtttat

SEQ ID NO: 7922611 - DNA, 22 bp, Homo sapiens
caggtccctgcgccccggcctc

SEQ ID NO: 7922612 - DNA, 22 bp, Homo sapiens
caggtcctcgggggaggccggc

SEQ ID NO: 7922613 - DNA, 22 bp, Homo sapiens
caggtcctcgggggaggccggc

SEQ ID NO: 7922614 - DNA, 22 bp, Homo sapiens
caggtcctctgagatgggaggt

SEQ ID NO: 7922615 - DNA, 22 bp, Homo sapiens
caggtcctgcagggagagtaaa

SEQ ID NO: 7922616 - DNA, 22 bp, Homo sapiens
caggtcctgccttggttaccct

SEQ ID NO: 7922617 - DNA, 22 bp, Homo sapiens
caggtcctggcagctgactcag

SEQ ID NO: 7922618 - DNA, 22 bp, Homo sapiens
caggtcctggcatcaggcaggt

SEQ ID NO: 7922619 - DNA, 22 bp, Homo sapiens
aggaatgaactcgagtgatctg

SEQ ID NO: 7922620 - DNA, 22 bp, Homo sapiens
aggaatgacagatgtccgcacc

SEQ ID NO: 7922621 - DNA, 14 bp, Homo sapiens
aggaatgtcctagg

SEQ ID NO: 7922622 - DNA, 22 bp, Homo sapiens
aggaatgtcgtcataaacatga

SEQ ID NO: 7922623 - DNA, 22 bp, Homo sapiens
aggaatgtcgtcataaacatga

SEQ ID NO: 7922624 - DNA, 22 bp, Homo sapiens
caggtcctggcatcaggcaggt

SEQ ID NO: 7922625 - DNA, 22 bp, Homo sapiens
caggtcctggcatcaggcaggt

SEQ ID NO: 7922626 - DNA, 22 bp, Homo sapiens
caggtcctggcatcaggcaggt

SEQ ID NO: 7922627 - DNA, 22 bp, Homo sapiens
caggtcctggcatcaggcaggt

SEQ ID NO: 7922628 - DNA, 23 bp, Homo sapiens
aggaatgtgcccacccatctcct

SEQ ID NO: 7922629 - DNA, 22 bp, Homo sapiens
aggaatgtgcctagcctccctg

SEQ ID NO: 7922630 - DNA, 22 bp, Homo sapiens
aggaatgtgcctagcctccctg

SEQ ID NO: 7922631 - DNA, 22 bp, Homo sapiens
aggaatgtggaaggtggcggcg

SEQ ID NO: 7922632 - DNA, 22 bp, Homo sapiens
aggaatgtggaaggtggcggcg

SEQ ID NO: 7922633 - DNA, 22 bp, Homo sapiens
aggaatgtggcctagggaggag

SEQ ID NO: 7922634 - DNA, 16 bp, Homo sapiens
aggaatgtggcggaac

SEQ ID NO: 7922635 - DNA, 22 bp, Homo sapiens
aggaatgtggcctagggaggag

SEQ ID NO: 7922636 - DNA, 22 bp, Homo sapiens
aggaatgtggcaatcttcaagt

SEQ ID NO: 7922637 - DNA, 22 bp, Homo sapiens
aggaatgtggcaatcttcaagt

SEQ ID NO: 7922638 - DNA, 22 bp, Homo sapiens
aggaatgtgactattttttcag

SEQ ID NO: 7922639 - DNA, 22 bp, Homo sapiens
aggaatgtgaccactagactct

SEQ ID NO: 7922640 - DNA, 22 bp, Homo sapiens
aggaatgtgactattttttcag

SEQ ID NO: 7922641 - DNA, 22 bp, Homo sapiens
aggaatgtgaggcaagttgtga

SEQ ID NO: 7922642 - DNA, 23 bp, Homo sapiens
aggaatgtgcccacccatctcct

SEQ ID NO: 7922643 - DNA, 22 bp, Homo sapiens
aggaatgtgaggcaagttgtga

SEQ ID NO: 7922644 - DNA, 22 bp, Homo sapiens
aggaatgtgaggcaagttgtga

SEQ ID NO: 7922645 - DNA, 22 bp, Homo sapiens
aggaatgtgaccactagactct

SEQ ID NO: 7922646 - DNA, 22 bp, Homo sapiens
aggaatgtgaaacaggtggctg

SEQ ID NO: 7922647 - DNA, 22 bp, Homo sapiens
aggaatgtgaaacaggtggctg

SEQ ID NO: 7922648 - DNA, 22 bp, Homo sapiens
aggaatgtctgagaaagaggca

SEQ ID NO: 7922649 - DNA, 22 bp, Homo sapiens
aggaatgtctgagaaagaggca

SEQ ID NO: 7922650 - DNA, 22 bp, Homo sapiens
aggaatgtctgagaaagaggca

SEQ ID NO: 7922651 - DNA, 22 bp, Homo sapiens
aggaatgtgtgtccaccgggga

SEQ ID NO: 7922652 - DNA, 22 bp, Homo sapiens
aggaatgtgtgtccaccgggga

SEQ ID NO: 7922653 - DNA, 21 bp, Homo sapiens
aggaatgtgtatatatacaat

SEQ ID NO: 7922654 - DNA, 16 bp, Homo sapiens
aggaatgtggcggaac

SEQ ID NO: 7922655 - DNA, 21 bp, Homo sapiens
aggaatgtgtatatatacaat

SEQ ID NO: 7922656 - DNA, 22 bp, Homo sapiens
aggaatgttaaagattaagagc

SEQ ID NO: 7922657 - DNA, 22 bp, Homo sapiens
aggaatgtgtttctaggctgtt

SEQ ID NO: 7922658 - DNA, 22 bp, Homo sapiens
aggaatgtgtttctaggctgtt

SEQ ID NO: 7922659 - DNA, 22 bp, Homo sapiens
aggaatgttaaagattaagagc

SEQ ID NO: 7922660 - DNA, 22 bp, Homo sapiens
aggaatgttaagaaggtctacc

SEQ ID NO: 7922661 - DNA, 22 bp, Homo sapiens
aggaatgttagttctgtataca

SEQ ID NO: 7922662 - DNA, 22 bp, Homo sapiens
aggaatgtttacacgacagaaa

SEQ ID NO: 7922663 - DNA, 22 bp, Homo sapiens
aggaatgttaggagatgagtct

SEQ ID NO: 7922664 - DNA, 22 bp, Homo sapiens
aggaatgttagttctgtataca

SEQ ID NO: 7922665 - DNA, 22 bp, Homo sapiens
aggaatgttaagaaggtctacc

SEQ ID NO: 7922666 - DNA, 22 bp, Homo sapiens
aggaatgttaggagatgagtct

SEQ ID NO: 7922667 - DNA, 22 bp, Homo sapiens
aggaatgtttacacgacagaaa

SEQ ID NO: 7922668 - DNA, 22 bp, Homo sapiens
aggaatgtttagaatgtcagaa

SEQ ID NO: 7922669 - DNA, 22 bp, Homo sapiens
aggaatgtttagaatgtcagaa

SEQ ID NO: 7922670 - DNA, 22 bp, Homo sapiens
aggaagagggtggcagataatc

SEQ ID NO: 7922671 - DNA, 22 bp, Homo sapiens
aggaagagggtggcagataatc

SEQ ID NO: 7922672 - DNA, 22 bp, Homo sapiens
aggaagagggtggcagataatc

SEQ ID NO: 7922673 - DNA, 22 bp, Homo sapiens
aggaagaggtagctgtcaaggg

SEQ ID NO: 7922674 - DNA, 22 bp, Homo sapiens
aggaagaggtagctgtcaaggg

SEQ ID NO: 7922675 - DNA, 22 bp, Homo sapiens
aggaagagggtggcagataatc

SEQ ID NO: 7922676 - DNA, 22 bp, Homo sapiens
aggaagaggtagctgtcaaggg

SEQ ID NO: 7922677 - DNA, 22 bp, Homo sapiens
aggaagaggtagctgtcaaggg

SEQ ID NO: 7922678 - DNA, 22 bp, Homo sapiens
aggaagaggtagctgtcaaggg

SEQ ID NO: 7922679 - DNA, 22 bp, Homo sapiens
aggaagaggtagctgtcaaggg

SEQ ID NO: 7922680 - DNA, 22 bp, Homo sapiens
aggaagaggtagctgtcaaggg

SEQ ID NO: 7922681 - DNA, 22 bp, Homo sapiens
aggaagaggtagctgtcaaggg

SEQ ID NO: 7922682 - DNA, 22 bp, Homo sapiens
cagggtttcaccatgttagcag

SEQ ID NO: 7922683 - DNA, 22 bp, Homo sapiens
cagggtttcaccatgttagcag

SEQ ID NO: 7922684 - DNA, 22 bp, Homo sapiens
cagggtttcaccatgttagcag

SEQ ID NO: 7922685 - DNA, 22 bp, Homo sapiens
cagggtttcaccatgttagcag

SEQ ID NO: 7922686 - DNA, 22 bp, Homo sapiens
cagggtttcaccatgttagcag

SEQ ID NO: 7922687 - DNA, 22 bp, Homo sapiens
cagggtttcaccatgttagcag

SEQ ID NO: 7922688 - DNA, 22 bp, Homo sapiens
cagggtttcaccatgttagcag

SEQ ID NO: 7922689 - DNA, 22 bp, Homo sapiens
cagggtttcaccatgttagcag

SEQ ID NO: 7922690 - DNA, 22 bp, Homo sapiens
cagggtttcaccatgttagcag

SEQ ID NO: 7922691 - DNA, 22 bp, Homo sapiens
cagggttggtttctcctcaggc

SEQ ID NO: 7922692 - DNA, 22 bp, Homo sapiens
cagggttgattccttctgaggg

SEQ ID NO: 7922693 - DNA, 22 bp, Homo sapiens
cagggttgcatgcatctgtggg

SEQ ID NO: 7922694 - DNA, 22 bp, Homo sapiens
aggaagagtgttacctatgggt

SEQ ID NO: 7922695 - DNA, 22 bp, Homo sapiens
aggaagagtgttacctatgggt

SEQ ID NO: 7922696 - DNA, 22 bp, Homo sapiens
aggaagagtgttacctatgggt

SEQ ID NO: 7922697 - DNA, 22 bp, Homo sapiens
aggaagaggtgtgcaatggtgt

SEQ ID NO: 7922698 - DNA, 22 bp, Homo sapiens
aggaagagtgttacctatgggt

SEQ ID NO: 7922699 - DNA, 22 bp, Homo sapiens
aggaagaggtgtgcaatggtgt

SEQ ID NO: 7922700 - DNA, 22 bp, Homo sapiens
aggaagaggtgtgcaatggtgt

SEQ ID NO: 7922701 - DNA, 22 bp, Homo sapiens
aggaagcactggaaggggttgg

SEQ ID NO: 7922702 - DNA, 22 bp, Homo sapiens
aggaagcaccggaatgatgact

SEQ ID NO: 7922703 - DNA, 22 bp, Homo sapiens
aggaaggactgcagcatttggt

SEQ ID NO: 7922704 - DNA, 20 bp, Homo sapiens
aggaaggagaatctgagcaa

SEQ ID NO: 7922705 - DNA, 22 bp, Homo sapiens
aggaagcactggaaggggttgg

SEQ ID NO: 7922706 - DNA, 22 bp, Homo sapiens
aggaagcactggaaggggttgg

SEQ ID NO: 7922707 - DNA, 22 bp, Homo sapiens
aggaagcaccggaatgatgact

SEQ ID NO: 7922708 - DNA, 22 bp, Homo sapiens
aggaagcaccggaatgatgact

SEQ ID NO: 7922709 - DNA, 22 bp, Homo sapiens
aggaagcaaaaggcagggtcta

SEQ ID NO: 7922710 - DNA, 22 bp, Homo sapiens
aggaagcaaaaggcagggtcta

SEQ ID NO: 7922711 - DNA, 22 bp, Homo sapiens
aggaagcaaaaggcagggtcta

SEQ ID NO: 7922712 - DNA, 22 bp, Homo sapiens
aggaagcaaaaggcagggtcta

SEQ ID NO: 7922713 - DNA, 22 bp, Homo sapiens
aggaagatgtgcaaagttggaa

SEQ ID NO: 7922714 - DNA, 22 bp, Homo sapiens
aggaagatgtgtttagcaggtt

SEQ ID NO: 7922715 - DNA, 22 bp, Homo sapiens
aggaagatgtgcaaagttggaa

SEQ ID NO: 7922716 - DNA, 22 bp, Homo sapiens
aggaagatgggagagctctgga

SEQ ID NO: 7922717 - DNA, 22 bp, Homo sapiens
cagggtggtaccagcatctagt

SEQ ID NO: 7922718 - DNA, 22 bp, Homo sapiens
cagggtggtaccagcatctagt

SEQ ID NO: 7922719 - DNA, 22 bp, Homo sapiens
cagggtggtaccagcatctagt

SEQ ID NO: 7922720 - DNA, 22 bp, Homo sapiens
cagggtggtaccagcatctagt

SEQ ID NO: 7922721 - DNA, 22 bp, Homo sapiens
cagggtggtgaatagctatagt

SEQ ID NO: 7922722 - DNA, 22 bp, Homo sapiens
cagggtggtgaatagctatagt

SEQ ID NO: 7922723 - DNA, 22 bp, Homo sapiens
cagggtggtgaatagctatagt

SEQ ID NO: 7922724 - DNA, 22 bp, Homo sapiens
cagggtggtgaatagctatagt

SEQ ID NO: 7922725 - DNA, 22 bp, Homo sapiens
cagggtgtatagtgtagaagtt

SEQ ID NO: 7922726 - DNA, 22 bp, Homo sapiens
cagggttctggaatataatgtg

SEQ ID NO: 7922727 - DNA, 22 bp, Homo sapiens
cagggtggggctggctatcaaa

SEQ ID NO: 7922728 - DNA, 22 bp, Homo sapiens
cagggtggtaccagcatctagt

SEQ ID NO: 7922729 - DNA, 22 bp, Homo sapiens
cagggtggtaccagcatctagt

SEQ ID NO: 7922730 - DNA, 22 bp, Homo sapiens
cagggtggtaccagcatctagt

SEQ ID NO: 7922731 - DNA, 22 bp, Homo sapiens
cagggtggtaccagcatctagt

SEQ ID NO: 7922732 - DNA, 22 bp, Homo sapiens
cagggtggtaccagcatctagt

SEQ ID NO: 7922733 - DNA, 22 bp, Homo sapiens
cagggtgcttagaaatggacct

SEQ ID NO: 7922734 - DNA, 22 bp, Homo sapiens
cagggtgctgcaccatccctca

SEQ ID NO: 7922735 - DNA, 22 bp, Homo sapiens
cagggtggggctggctatcaaa

SEQ ID NO: 7922736 - DNA, 22 bp, Homo sapiens
aggaaacatgaatctgccttga

SEQ ID NO: 7922737 - DNA, 22 bp, Homo sapiens
aggaaacatgaatctgccttga

SEQ ID NO: 7922738 - DNA, 22 bp, Homo sapiens
aggaaacatgaatctgccttga

SEQ ID NO: 7922739 - DNA, 17 bp, Homo sapiens
aggaaacattttctttc

SEQ ID NO: 7922740 - DNA, 22 bp, Homo sapiens
aggaaacattgatattgggaaa

SEQ ID NO: 7922741 - DNA, 22 bp, Homo sapiens
aggaaacatgaatctgccttga

SEQ ID NO: 7922742 - DNA, 22 bp, Homo sapiens
aggaaacagagtgaagcttggg

SEQ ID NO: 7922743 - DNA, 22 bp, Homo sapiens
aggaaacagagtgaagcttggg

SEQ ID NO: 7922744 - DNA, 22 bp, Homo sapiens
aggaaacagagtgaagcttggg

SEQ ID NO: 7922745 - DNA, 22 bp, Homo sapiens
aggaaacagagtgaagcttggg

SEQ ID NO: 7922746 - DNA, 22 bp, Homo sapiens
aggaaacagtgaacttggcagg

SEQ ID NO: 7922747 - DNA, 22 bp, Homo sapiens
aggaaacagtgaacttggcagg

SEQ ID NO: 7922748 - DNA, 22 bp, Homo sapiens
aggaaacagttggtaatgcata

SEQ ID NO: 7922749 - DNA, 22 bp, Homo sapiens
aggaaacagttggtaatgcata

SEQ ID NO: 7922750 - DNA, 22 bp, Homo sapiens
aggaaacagttggtaatgcata

SEQ ID NO: 7922751 - DNA, 22 bp, Homo sapiens
aggaaacagttggtaatgcata

SEQ ID NO: 7922752 - DNA, 22 bp, Homo sapiens
aggaaacatccttatctattct

SEQ ID NO: 7922753 - DNA, 22 bp, Homo sapiens
aggaaacatccttatctattct

SEQ ID NO: 7922754 - DNA, 22 bp, Homo sapiens
cagggacatgactggtctctgt

SEQ ID NO: 7922755 - DNA, 22 bp, Homo sapiens
cagggacattggtggccaggtt

SEQ ID NO: 7922756 - DNA, 22 bp, Homo sapiens
cagggacattggtggccaggtt

SEQ ID NO: 7922757 - DNA, 22 bp, Homo sapiens
cagggacattggtggccaggtt

SEQ ID NO: 7922758 - DNA, 22 bp, Homo sapiens
cagggacattggtggccaggtt

SEQ ID NO: 7922759 - DNA, 22 bp, Homo sapiens
cagggacattggtggccaggtt

SEQ ID NO: 7922760 - DNA, 22 bp, Homo sapiens
cagggacattggtggccaggtt

SEQ ID NO: 7922761 - DNA, 22 bp, Homo sapiens
cagggacattggtggccaggtt

SEQ ID NO: 7922762 - DNA, 22 bp, Homo sapiens
cagggacattggtggccaggtt

SEQ ID NO: 7922763 - DNA, 22 bp, Homo sapiens
cagggacccgcacaggtagcat

SEQ ID NO: 7922764 - DNA, 22 bp, Homo sapiens
cagggacccgcacaggtagcat

SEQ ID NO: 7922765 - DNA, 22 bp, Homo sapiens
cagggacatttccaagagaatt

SEQ ID NO: 7922766 - DNA, 22 bp, Homo sapiens
cagggacattggtggccaggtt

SEQ ID NO: 7922767 - DNA, 22 bp, Homo sapiens
cagggacatttccaagagaatt

SEQ ID NO: 7922768 - DNA, 22 bp, Homo sapiens
cagggaccctactagctcacac

SEQ ID NO: 7922769 - DNA, 22 bp, Homo sapiens
cagggactacagccagccctcc

SEQ ID NO: 7922770 - DNA, 22 bp, Homo sapiens
cagggactcccagggtagctcc

SEQ ID NO: 7922771 - DNA, 22 bp, Homo sapiens
cagggactcgctggacataccg

SEQ ID NO: 7922772 - DNA, 22 bp, Homo sapiens
cagggactcccagggtagctcc

SEQ ID NO: 7922773 - DNA, 22 bp, Homo sapiens
cagggactcccagggtagctcc

SEQ ID NO: 7922774 - DNA, 22 bp, Homo sapiens
cagggactacagccagccctcc

SEQ ID NO: 7922775 - DNA, 22 bp, Homo sapiens
cagggagaaatctccaggaggt

SEQ ID NO: 7922776 - DNA, 22 bp, Homo sapiens
agctttgggccactggctggat

SEQ ID NO: 7922777 - DNA, 22 bp, Homo sapiens
agctttgggccactggctggat

SEQ ID NO: 7922778 - DNA, 22 bp, Homo sapiens
agctttgggggtaggtatagag

SEQ ID NO: 7922779 - DNA, 22 bp, Homo sapiens
agctttgggggaggtagtctgt

SEQ ID NO: 7922780 - DNA, 22 bp, Homo sapiens
agctttgggggaggtagtctgt

SEQ ID NO: 7922781 - DNA, 22 bp, Homo sapiens
agctttgggggaggtagtctgt

SEQ ID NO: 7922782 - DNA, 22 bp, Homo sapiens
agctttggggacagccaaggtt

SEQ ID NO: 7922783 - DNA, 22 bp, Homo sapiens
agctttctcttctttagaaagt

SEQ ID NO: 7922784 - DNA, 22 bp, Homo sapiens
agctttctcttctttagaaagt

SEQ ID NO: 7922785 - DNA, 22 bp, Homo sapiens
agctttctctcagccaggctgc

SEQ ID NO: 7922786 - DNA, 20 bp, Homo sapiens
agctttctccttggagctcc

SEQ ID NO: 7922787 - DNA, 22 bp, Homo sapiens
agctttctctcagccaggctgc

SEQ ID NO: 7922788 - DNA, 22 bp, Homo sapiens
agctttctatatatgagttgct

SEQ ID NO: 7922789 - DNA, 20 bp, Homo sapiens
agctttctccttggagctcc

SEQ ID NO: 7922790 - DNA, 20 bp, Homo sapiens
agctttctccttggagctcc

SEQ ID NO: 7922791 - DNA, 22 bp, Homo sapiens
agctttctccctgacgctttgg

SEQ ID NO: 7922792 - DNA, 22 bp, Homo sapiens
agctttctatatatgagttgct

SEQ ID NO: 7922793 - DNA, 22 bp, Homo sapiens
agctttctccctgacgctttgg

SEQ ID NO: 7922794 - DNA, 22 bp, Homo sapiens
agctttctagtttagccatctt

SEQ ID NO: 7922795 - DNA, 22 bp, Homo sapiens
agctttctagatttggaattgt

SEQ ID NO: 7922796 - DNA, 22 bp, Homo sapiens
agctttctagatttggaattgt

SEQ ID NO: 7922797 - DNA, 22 bp, Homo sapiens
agctttctagtttagccatctt

SEQ ID NO: 7922798 - DNA, 22 bp, Homo sapiens
agctttctagtttagccatctt

SEQ ID NO: 7922799 - DNA, 22 bp, Homo sapiens
agctttctatatatgagttgct

SEQ ID NO: 7922800 - DNA, 22 bp, Homo sapiens
cagggacaggggagaaaagatg

SEQ ID NO: 7922801 - DNA, 22 bp, Homo sapiens
cagggacaggggagaaaagatg

SEQ ID NO: 7922802 - DNA, 22 bp, Homo sapiens
cagggacagcgggactctgaca

SEQ ID NO: 7922803 - DNA, 22 bp, Homo sapiens
cagggacagcgggactctgaca

SEQ ID NO: 7922804 - DNA, 22 bp, Homo sapiens
cagggacagggatcatttgctt

SEQ ID NO: 7922805 - DNA, 22 bp, Homo sapiens
cagggacataagaggaacatgg

SEQ ID NO: 7922806 - DNA, 22 bp, Homo sapiens
cagggacataagaggaacatgg

SEQ ID NO: 7922807 - DNA, 22 bp, Homo sapiens
cagggacatgactggtctctgt

SEQ ID NO: 7922808 - DNA, 22 bp, Homo sapiens
aggaaaagtgtgaagtatggag

SEQ ID NO: 7922809 - DNA, 22 bp, Homo sapiens
aggaaaatcaatgtctttttaa

SEQ ID NO: 7922810 - DNA, 22 bp, Homo sapiens
aggaaaagtgtgaagtatggag

SEQ ID NO: 7922811 - DNA, 22 bp, Homo sapiens
aggaaaagtgtgaagtatggag

SEQ ID NO: 7922812 - DNA, 22 bp, Homo sapiens
aggaaaatcaatgtctttttaa

SEQ ID NO: 7922813 - DNA, 22 bp, Homo sapiens
aggaaaagtgtgaagtatggag

SEQ ID NO: 7922814 - DNA, 22 bp, Homo sapiens
aggaaaatgaaacagcaactgt

SEQ ID NO: 7922815 - DNA, 22 bp, Homo sapiens
aggaaaatgaaacagcaactgt

SEQ ID NO: 7922816 - DNA, 22 bp, Homo sapiens
aggaaaatgaaacagcaactgt

SEQ ID NO: 7922817 - DNA, 22 bp, Homo sapiens
aggaaaatgaaacagcaactgt

SEQ ID NO: 7922818 - DNA, 22 bp, Homo sapiens
aggaaaatgaaacagcaactgt

SEQ ID NO: 7922819 - DNA, 22 bp, Homo sapiens
aggaaaatcgagtctggaggca

SEQ ID NO: 7922820 - DNA, 22 bp, Homo sapiens
aggaaaatgatattctgctgtt

SEQ ID NO: 7922821 - DNA, 22 bp, Homo sapiens
aggaaacaacttggcatgagcc

SEQ ID NO: 7922822 - DNA, 22 bp, Homo sapiens
aggaaacagaggtgccacaata

SEQ ID NO: 7922823 - DNA, 22 bp, Homo sapiens
aggaaacagaggtgccacaata

SEQ ID NO: 7922824 - DNA, 22 bp, Homo sapiens
aggaaaatggaccagagttgtt

SEQ ID NO: 7922825 - DNA, 22 bp, Homo sapiens
aggaaaatggaccagagttgtt

SEQ ID NO: 7922826 - DNA, 22 bp, Homo sapiens
aggaaaattatcatgagagcca

SEQ ID NO: 7922827 - DNA, 22 bp, Homo sapiens
aggaaaattatcatgagagcca

SEQ ID NO: 7922828 - DNA, 22 bp, Homo sapiens
aggaaacaacttggcatgagcc

SEQ ID NO: 7922829 - DNA, 20 bp, Homo sapiens
aggaaaaatggaaactggag

SEQ ID NO: 7922830 - DNA, 20 bp, Homo sapiens
aggaaaaatggaaactggag

SEQ ID NO: 7922831 - DNA, 20 bp, Homo sapiens
aggaaaaatggaaactggag

SEQ ID NO: 7922832 - DNA, 20 bp, Homo sapiens
aggaaaaatggaaactggag

SEQ ID NO: 7922833 - DNA, 22 bp, Homo sapiens
aggaaaaataaggcagcagggc

SEQ ID NO: 7922834 - DNA, 22 bp, Homo sapiens
aggaaaaataaggcagcagggc

SEQ ID NO: 7922835 - DNA, 20 bp, Homo sapiens
aggaaaaatggaaactggag

SEQ ID NO: 7922836 - DNA, 20 bp, Homo sapiens
aggaaaaatggaaactggag

SEQ ID NO: 7922837 - DNA, 22 bp, Homo sapiens
aggaaaaataaggcagcagggc

SEQ ID NO: 7922838 - DNA, 22 bp, Homo sapiens
aggaaaaataaggcagcagggc

SEQ ID NO: 7922839 - DNA, 22 bp, Homo sapiens
aggaaaaataaggcagcagggc

SEQ ID NO: 7922840 - DNA, 22 bp, Homo sapiens
aggaaaaataaggcagcagggc

SEQ ID NO: 7922841 - DNA, 22 bp, Homo sapiens
aggaaaacacagtattgatgga

SEQ ID NO: 7922842 - DNA, 22 bp, Homo sapiens
aggaaaacagaccaaggagctc

SEQ ID NO: 7922843 - DNA, 22 bp, Homo sapiens
aggaaaacagaccaaggagctc

SEQ ID NO: 7922844 - DNA, 20 bp, Homo sapiens
aggaaaagggtggtggtaga

SEQ ID NO: 7922845 - DNA, 22 bp, Homo sapiens
aggaaaagtgtgaagtatggag

SEQ ID NO: 7922846 - DNA, 20 bp, Homo sapiens
aggaaaagggtggtggtaga

SEQ ID NO: 7922847 - DNA, 20 bp, Homo sapiens
aggaaaagggtggtggtaga

SEQ ID NO: 7922848 - DNA, 20 bp, Homo sapiens
aggaaaagggtggtggtaga

SEQ ID NO: 7922849 - DNA, 22 bp, Homo sapiens
agcttctccatctgcccagaga

SEQ ID NO: 7922850 - DNA, 22 bp, Homo sapiens
agcttctccatctgcccagaga

SEQ ID NO: 7922851 - DNA, 22 bp, Homo sapiens
agcttctcaggagtctgaggca

SEQ ID NO: 7922852 - DNA, 22 bp, Homo sapiens
caggcttgctgctagagcactt

SEQ ID NO: 7922853 - DNA, 22 bp, Homo sapiens
caggcttgctgctagagcactt

SEQ ID NO: 7922854 - DNA, 22 bp, Homo sapiens
caggcttgctgctagagcactt

SEQ ID NO: 7922855 - DNA, 22 bp, Homo sapiens
agcttctcaggagtctgaggca

SEQ ID NO: 7922856 - DNA, 22 bp, Homo sapiens
caggcttgattattcagacaat

SEQ ID NO: 7922857 - DNA, 22 bp, Homo sapiens
caggcttgctagaggagccaaa

SEQ ID NO: 7922858 - DNA, 22 bp, Homo sapiens
caggcttgctagaggagccaaa

SEQ ID NO: 7922859 - DNA, 22 bp, Homo sapiens
caggcttgatgtgtctatactt

SEQ ID NO: 7922860 - DNA, 22 bp, Homo sapiens
caggcttgagggcaggcccagt

SEQ ID NO: 7922861 - DNA, 22 bp, Homo sapiens
caggcttcgctctgtgggcagg

SEQ ID NO: 7922862 - DNA, 22 bp, Homo sapiens
caggcttcatgaattatgcacc

SEQ ID NO: 7922863 - DNA, 21 bp, Homo sapiens
caggcttgaggaatgtgcctg

SEQ ID NO: 7922864 - DNA, 21 bp, Homo sapiens
caggcttgaggaatgtgcctg

SEQ ID NO: 7922865 - DNA, 22 bp, Homo sapiens
caggcttgagggcaggcccagt

SEQ ID NO: 7922866 - DNA, 22 bp, Homo sapiens
caggcttgagggcaggcccagt

SEQ ID NO: 7922867 - DNA, 21 bp, Homo sapiens
caggcttgaccctagtgggaa

SEQ ID NO: 7922868 - DNA, 21 bp, Homo sapiens
caggcttgaccctagtgggaa

SEQ ID NO: 7922869 - DNA, 22 bp, Homo sapiens
caggcttgacagttttcatctt

SEQ ID NO: 7922870 - DNA, 22 bp, Homo sapiens
caggcttgacagttttcatctt

SEQ ID NO: 7922871 - DNA, 22 bp, Homo sapiens
caggcttgaagcttcagagtat

SEQ ID NO: 7922872 - DNA, 22 bp, Homo sapiens
caggctgtggatcaggagcctt

SEQ ID NO: 7922873 - DNA, 22 bp, Homo sapiens
caggctgtgggagtcaggaccc

SEQ ID NO: 7922874 - DNA, 22 bp, Homo sapiens
caggctgtgggagtcaggaccc

SEQ ID NO: 7922875 - DNA, 22 bp, Homo sapiens
caggctgtgggagtcaggaccc

SEQ ID NO: 7922876 - DNA, 22 bp, Homo sapiens
caggctgtgttcctggaacccc

SEQ ID NO: 7922877 - DNA, 22 bp, Homo sapiens
caggctgtgttcctggaacccc

SEQ ID NO: 7922878 - DNA, 22 bp, Homo sapiens
caggctgtgttcctggaacccc

SEQ ID NO: 7922879 - DNA, 22 bp, Homo sapiens
caggcttcagcatccacttagt

SEQ ID NO: 7922880 - DNA, 22 bp, Homo sapiens
caggctgtggatcaggagcctt

SEQ ID NO: 7922881 - DNA, 22 bp, Homo sapiens
caggctgtggatcaggagcctt

SEQ ID NO: 7922882 - DNA, 22 bp, Homo sapiens
caggctgtggatcaggagcctt

SEQ ID NO: 7922883 - DNA, 22 bp, Homo sapiens
caggctgtgaaactgagatgcg

SEQ ID NO: 7922884 - DNA, 22 bp, Homo sapiens
caggctgtgaaactgagatgcg

SEQ ID NO: 7922885 - DNA, 22 bp, Homo sapiens
caggctgtgaaactgagatgcg

SEQ ID NO: 7922886 - DNA, 22 bp, Homo sapiens
agctggtgctgaagctcttgag

SEQ ID NO: 7922887 - DNA, 22 bp, Homo sapiens
agctggtgctgaagctcttgag

SEQ ID NO: 7922888 - DNA, 22 bp, Homo sapiens
caggctggagttcagtggtgtg

SEQ ID NO: 7922889 - DNA, 22 bp, Homo sapiens
caggctgtctgaatggaggccc

SEQ ID NO: 7922890 - DNA, 22 bp, Homo sapiens
caggctgtgaaactgagatgcg

SEQ ID NO: 7922891 - DNA, 22 bp, Homo sapiens
agctggtgctcggggagctggc

SEQ ID NO: 7922892 - DNA, 22 bp, Homo sapiens
agctggtgctcggggagctggc

SEQ ID NO: 7922893 - DNA, 22 bp, Homo sapiens
agctggtgctcggggagctggc

SEQ ID NO: 7922894 - DNA, 22 bp, Homo sapiens
agctggtgctcggggagctggc

SEQ ID NO: 7922895 - DNA, 22 bp, Homo sapiens
agctggtgctcggggagctggc

SEQ ID NO: 7922896 - DNA, 22 bp, Homo sapiens
agctggtgctcggggagctggc

SEQ ID NO: 7922897 - DNA, 22 bp, Homo sapiens
agctggtgctcggggagctggc

SEQ ID NO: 7922898 - DNA, 22 bp, Homo sapiens
agctggtgctcggggagctggc

SEQ ID NO: 7922899 - DNA, 22 bp, Homo sapiens
agctggtgctgaagctcttgag

SEQ ID NO: 7922900 - DNA, 22 bp, Homo sapiens
agctggtgctgaagctcttgag

SEQ ID NO: 7922901 - DNA, 22 bp, Homo sapiens
agctggtgctgaagctcttgag

SEQ ID NO: 7922902 - DNA, 22 bp, Homo sapiens
agctggtgctgaagctcttgag

SEQ ID NO: 7922903 - DNA, 22 bp, Homo sapiens
agctttctagactctgtggtca

SEQ ID NO: 7922904 - DNA, 22 bp, Homo sapiens
agctttctaccaggtcctgtct

SEQ ID NO: 7922905 - DNA, 22 bp, Homo sapiens
agctttctagatttggaattgt

SEQ ID NO: 7922906 - DNA, 22 bp, Homo sapiens
agctttctagactctgtggtca

SEQ ID NO: 7922907 - DNA, 22 bp, Homo sapiens
agctttctagactctgtggtca

SEQ ID NO: 7922908 - DNA, 22 bp, Homo sapiens
agctttctagactctgtggtca

SEQ ID NO: 7922909 - DNA, 22 bp, Homo sapiens
agctttcgttccttagacacat

SEQ ID NO: 7922910 - DNA, 22 bp, Homo sapiens
agctttcagttactaatgaagg

SEQ ID NO: 7922911 - DNA, 22 bp, Homo sapiens
agctttatttgtcattcacggc

SEQ ID NO: 7922912 - DNA, 22 bp, Homo sapiens
agctttcacgatttggaacagg

SEQ ID NO: 7922913 - DNA, 22 bp, Homo sapiens
agctttcagtctctgaaggaac

SEQ ID NO: 7922914 - DNA, 22 bp, Homo sapiens
agctttcaggataatgaaaaag

SEQ ID NO: 7922915 - DNA, 22 bp, Homo sapiens
agctttattaactctccaggtg

SEQ ID NO: 7922916 - DNA, 22 bp, Homo sapiens
agctttatatttaatgaattct

SEQ ID NO: 7922917 - DNA, 22 bp, Homo sapiens
agctttatatttaatgaattct

SEQ ID NO: 7922918 - DNA, 22 bp, Homo sapiens
agcttctgttcatcttccaggc

SEQ ID NO: 7922919 - DNA, 22 bp, Homo sapiens
agctttatatttaatgaattct

SEQ ID NO: 7922920 - DNA, 22 bp, Homo sapiens
agctttatatttaatgaattct

SEQ ID NO: 7922921 - DNA, 22 bp, Homo sapiens
agcttctgttcatcttccaggc

SEQ ID NO: 7922922 - DNA, 22 bp, Homo sapiens
agctttattcatgatttcaggg

SEQ ID NO: 7922923 - DNA, 22 bp, Homo sapiens
agctttatttgtcattcacggc

SEQ ID NO: 7922924 - DNA, 22 bp, Homo sapiens
agctttattcatgatttcaggg

SEQ ID NO: 7922925 - DNA, 23 bp, Homo sapiens
agcttctggttcaggtcaagcag

SEQ ID NO: 7922926 - DNA, 22 bp, Homo sapiens
agcttctgttcatcttccaggc

SEQ ID NO: 7922927 - DNA, 22 bp, Homo sapiens
agcttctggaaggcaaggcttg

SEQ ID NO: 7922928 - DNA, 22 bp, Homo sapiens
agcttctggaaggcaaggcttg

SEQ ID NO: 7922929 - DNA, 22 bp, Homo sapiens
agcttctggaagcctggcagca

SEQ ID NO: 7922930 - DNA, 22 bp, Homo sapiens
agcttctggaagcctggcagca

SEQ ID NO: 7922931 - DNA, 22 bp, Homo sapiens
agcttctggaagcctggcagca

SEQ ID NO: 7922932 - DNA, 22 bp, Homo sapiens
agcttctggaaggcaaggcttg

SEQ ID NO: 7922933 - DNA, 22 bp, Homo sapiens
agcttctggaagcctggcagca

SEQ ID NO: 7922934 - DNA, 22 bp, Homo sapiens
agcttctctcagggtatctttc

SEQ ID NO: 7922935 - DNA, 22 bp, Homo sapiens
agcttctctctttgcactcaca

SEQ ID NO: 7922936 - DNA, 22 bp, Homo sapiens
agcttctcggctgggagtattt

SEQ ID NO: 7922937 - DNA, 22 bp, Homo sapiens
agcttctcctggtacagaactg

SEQ ID NO: 7922938 - DNA, 22 bp, Homo sapiens
agcttctctcagggtatctttc

SEQ ID NO: 7922939 - DNA, 22 bp, Homo sapiens
agcttctgagaatagtaaatgc

SEQ ID NO: 7922940 - DNA, 22 bp, Homo sapiens
agcttctgaaagtctgttttcc

SEQ ID NO: 7922941 - DNA, 22 bp, Homo sapiens
agcttctctctttgcactcaca

SEQ ID NO: 7922942 - DNA, 22 bp, Homo sapiens
agcttctctctttgcactcaca

SEQ ID NO: 7922943 - DNA, 22 bp, Homo sapiens
agcttctgcccgtgtttgctct

SEQ ID NO: 7922944 - DNA, 22 bp, Homo sapiens
agcttctgcccgtgtttgctct

SEQ ID NO: 7922945 - DNA, 22 bp, Homo sapiens
agcttctgcatcttttcttccc

SEQ ID NO: 7922946 - DNA, 22 bp, Homo sapiens
agcttctgcatcttttcttccc

SEQ ID NO: 7922947 - DNA, 17 bp, Homo sapiens
agctgggttctcaggaa

SEQ ID NO: 7922948 - DNA, 22 bp, Homo sapiens
agctgggttcagaggcacatgg

SEQ ID NO: 7922949 - DNA, 17 bp, Homo sapiens
agctgggttctcaggaa

SEQ ID NO: 7922950 - DNA, 22 bp, Homo sapiens
agctgggttgacaagatggaaa

SEQ ID NO: 7922951 - DNA, 17 bp, Homo sapiens
agctgggttctcaggaa

SEQ ID NO: 7922952 - DNA, 22 bp, Homo sapiens
agctgggttgacaagatggaaa

SEQ ID NO: 7922953 - DNA, 19 bp, Homo sapiens
agctgggtgttagtggaga

SEQ ID NO: 7922954 - DNA, 19 bp, Homo sapiens
agctgggtgttagtggaga

SEQ ID NO: 7922955 - DNA, 22 bp, Homo sapiens
agctgggtgtgtatcagataaa

SEQ ID NO: 7922956 - DNA, 22 bp, Homo sapiens
agctgggtgttcttgggcctaa

SEQ ID NO: 7922957 - DNA, 22 bp, Homo sapiens
agctgggtgttcttgggcctaa

SEQ ID NO: 7922958 - DNA, 22 bp, Homo sapiens
agctggtaagtggcagagattc

SEQ ID NO: 7922959 - DNA, 22 bp, Homo sapiens
agctggtaagtggcagagattc

SEQ ID NO: 7922960 - DNA, 22 bp, Homo sapiens
agctggtaacattagtcagtat

SEQ ID NO: 7922961 - DNA, 22 bp, Homo sapiens
agctggtaaaggggaaagcaga

SEQ ID NO: 7922962 - DNA, 22 bp, Homo sapiens
agctggtaaaggggaaagcaga

SEQ ID NO: 7922963 - DNA, 22 bp, Homo sapiens
agctgggtttctggcaggctta

SEQ ID NO: 7922964 - DNA, 22 bp, Homo sapiens
agctgggtttctggcaggctta

SEQ ID NO: 7922965 - DNA, 22 bp, Homo sapiens
agctggtatttctgaaggaaag

SEQ ID NO: 7922966 - DNA, 20 bp, Homo sapiens
agctggtccccaagcctctc

SEQ ID NO: 7922967 - DNA, 22 bp, Homo sapiens
agctggtcctaattgagccatt

SEQ ID NO: 7922968 - DNA, 22 bp, Homo sapiens
agctggtcagagtggggataga

SEQ ID NO: 7922969 - DNA, 22 bp, Homo sapiens
agctggtcagagtggggataga

SEQ ID NO: 7922970 - DNA, 20 bp, Homo sapiens
agctggtgaattaaagactg

SEQ ID NO: 7922971 - DNA, 22 bp, Homo sapiens
agctggtgaacctgaggcacag

SEQ ID NO: 7922972 - DNA, 22 bp, Homo sapiens
agctggtgaacctgaggcacag

SEQ ID NO: 7922973 - DNA, 18 bp, Homo sapiens
agctggtgaaatccagta

SEQ ID NO: 7922974 - DNA, 22 bp, Homo sapiens
agctggtgaacctgaggcacag

SEQ ID NO: 7922975 - DNA, 18 bp, Homo sapiens
agctggtgaaatccagta

SEQ ID NO: 7922976 - DNA, 22 bp, Homo sapiens
agctggtgaacctgaggcacag

SEQ ID NO: 7922977 - DNA, 22 bp, Homo sapiens
agctggtgaacctgaggcacag

SEQ ID NO: 7922978 - DNA, 22 bp, Homo sapiens
agctggtgaacctgaggcacag

SEQ ID NO: 7922979 - DNA, 22 bp, Homo sapiens
agctggtgaacctgaggcacag

SEQ ID NO: 7922980 - DNA, 22 bp, Homo sapiens
agctggtccttggcagttctca

SEQ ID NO: 7922981 - DNA, 22 bp, Homo sapiens
agctggtccttcaatctagcat

SEQ ID NO: 7922982 - DNA, 22 bp, Homo sapiens
agctggtccttccctgccctgt

SEQ ID NO: 7922983 - DNA, 22 bp, Homo sapiens
agctggtcctaattgagccatt

SEQ ID NO: 7922984 - DNA, 22 bp, Homo sapiens
agctggtcttaaatgtgtccag

SEQ ID NO: 7922985 - DNA, 18 bp, Homo sapiens
agctggtgaaatccagta

SEQ ID NO: 7922986 - DNA, 22 bp, Homo sapiens
agctggtcttaaatgtgtccag

SEQ ID NO: 7922987 - DNA, 22 bp, Homo sapiens
agctggtctgctgcatggagtg

SEQ ID NO: 7922988 - DNA, 22 bp, Homo sapiens
agctggtctgctgcatggagtg

SEQ ID NO: 7922989 - DNA, 22 bp, Homo sapiens
agctggtgctcaggggcatgga

SEQ ID NO: 7922990 - DNA, 22 bp, Homo sapiens
agctggtgctcaggggcatgga

SEQ ID NO: 7922991 - DNA, 22 bp, Homo sapiens
agctggtgctcaggggcatgga

SEQ ID NO: 7922992 - DNA, 22 bp, Homo sapiens
agctggtgctcaggggcatgga

SEQ ID NO: 7922993 - DNA, 22 bp, Homo sapiens
agctggtgctcaggggcatgga

SEQ ID NO: 7922994 - DNA, 22 bp, Homo sapiens
agctggtgcctgcttttgtgtg

SEQ ID NO: 7922995 - DNA, 22 bp, Homo sapiens
agctggtgatgtggtccctcac

SEQ ID NO: 7922996 - DNA, 22 bp, Homo sapiens
agctggtgatgtggtccctcac

SEQ ID NO: 7922997 - DNA, 22 bp, Homo sapiens
agctggtgcctgcttttgtgtg

SEQ ID NO: 7922998 - DNA, 22 bp, Homo sapiens
agctggtgctcaggggcatgga

SEQ ID NO: 7922999 - DNA, 22 bp, Homo sapiens
agctggtgctcaggggcatgga

SEQ ID NO: 7923000 - DNA, 20 bp, Homo sapiens
agctggtgaattaaagactg

SEQ ID NO: 7923001 - DNA, 22 bp, Homo sapiens
agctggtgagggttgaggggta

SEQ ID NO: 7923002 - DNA, 22 bp, Homo sapiens
agctggtgagggttgaggggta

SEQ ID NO: 7923003 - DNA, 22 bp, Homo sapiens
agctggtgatggcctaagaagg

SEQ ID NO: 7923004 - DNA, 22 bp, Homo sapiens
agctggtgatgtggtccctcac

SEQ ID NO: 7923005 - DNA, 22 bp, Homo sapiens
agctggtgatgtggtccctcac

SEQ ID NO: 7923006 - DNA, 22 bp, Homo sapiens
agctggtgagggttgaggggta

SEQ ID NO: 7923007 - DNA, 19 bp, Homo sapiens
agctggggcggtgtgtgtt

SEQ ID NO: 7923008 - DNA, 19 bp, Homo sapiens
agctggggcggtgtgtgtt

SEQ ID NO: 7923009 - DNA, 22 bp, Homo sapiens
agctgggtgcggtggctcatgc

SEQ ID NO: 7923010 - DNA, 22 bp, Homo sapiens
agctgggtgcggtggctcatgc

SEQ ID NO: 7923011 - DNA, 22 bp, Homo sapiens
agctgggtgcccgaagccacgt

SEQ ID NO: 7923012 - DNA, 22 bp, Homo sapiens
caggcagagtgagaagcccttg

SEQ ID NO: 7923013 - DNA, 22 bp, Homo sapiens
caggcagagtgagaagcccttg

SEQ ID NO: 7923014 - DNA, 22 bp, Homo sapiens
caggcagagtgagaagcccttg

SEQ ID NO: 7923015 - DNA, 22 bp, Homo sapiens
caggcagagtgagaagcccttg

SEQ ID NO: 7923016 - DNA, 19 bp, Homo sapiens
agctggggcggtgtgtgtt

SEQ ID NO: 7923017 - DNA, 19 bp, Homo sapiens
agctggggcggtgtgtgtt

SEQ ID NO: 7923018 - DNA, 19 bp, Homo sapiens
agctggggcggtgtgtgtt

SEQ ID NO: 7923019 - DNA, 22 bp, Homo sapiens
caggcagagtgaggtggtctaa

SEQ ID NO: 7923020 - DNA, 22 bp, Homo sapiens
caggcagagtgaggtggtctaa

SEQ ID NO: 7923021 - DNA, 21 bp, Homo sapiens
agctgggtgggctgagtgaca

SEQ ID NO: 7923022 - DNA, 23 bp, Homo sapiens
agctgggtggcctgcgtgaagct

SEQ ID NO: 7923023 - DNA, 22 bp, Homo sapiens
agctgggtggcctctcctcggg

SEQ ID NO: 7923024 - DNA, 22 bp, Homo sapiens
agctgggtggcctctcctcggg

SEQ ID NO: 7923025 - DNA, 22 bp, Homo sapiens
agctgggtgcggtggctcatgc

SEQ ID NO: 7923026 - DNA, 20 bp, Homo sapiens
caggcagaggatgctgacca

SEQ ID NO: 7923027 - DNA, 20 bp, Homo sapiens
caggcagaggatgctgacca

SEQ ID NO: 7923028 - DNA, 22 bp, Homo sapiens
caggcagaggaggccttctcct

SEQ ID NO: 7923029 - DNA, 22 bp, Homo sapiens
caggcagaggaggccttctcct

SEQ ID NO: 7923030 - DNA, 22 bp, Homo sapiens
caggcagaggaggccttctcct

SEQ ID NO: 7923031 - DNA, 20 bp, Homo sapiens
caggcagaggatgctgacca

SEQ ID NO: 7923032 - DNA, 20 bp, Homo sapiens
caggcagaggatgctgacca

SEQ ID NO: 7923033 - DNA, 20 bp, Homo sapiens
caggcagaggatgctgacca

SEQ ID NO: 7923034 - DNA, 22 bp, Homo sapiens
caggcagaggaagtctgggtct

SEQ ID NO: 7923035 - DNA, 22 bp, Homo sapiens
caggcagaggaagtctgggtct

SEQ ID NO: 7923036 - DNA, 22 bp, Homo sapiens
caggcagaggaagtctgggtct

SEQ ID NO: 7923037 - DNA, 22 bp, Homo sapiens
caggcagaggaagtctgggtct

SEQ ID NO: 7923038 - DNA, 22 bp, Homo sapiens
caggcagaggaagtctgggtct

SEQ ID NO: 7923039 - DNA, 22 bp, Homo sapiens
caggcagaggaagtctgggtct

SEQ ID NO: 7923040 - DNA, 22 bp, Homo sapiens
caggcagaggaggccttctcct

SEQ ID NO: 7923041 - DNA, 22 bp, Homo sapiens
caggcagaggaagtctgggtct

SEQ ID NO: 7923042 - DNA, 22 bp, Homo sapiens
caggcagaggaagtctgggtct

SEQ ID NO: 7923043 - DNA, 22 bp, Homo sapiens
caggcagagtgagaagcccttg

SEQ ID NO: 7923044 - DNA, 22 bp, Homo sapiens
caggcagagtgagaagcccttg

SEQ ID NO: 7923045 - DNA, 22 bp, Homo sapiens
caggcagagtcagattagactt

SEQ ID NO: 7923046 - DNA, 22 bp, Homo sapiens
caggcagagtgagaagcccttg

SEQ ID NO: 7923047 - DNA, 22 bp, Homo sapiens
caggcagagtcagattagactt

SEQ ID NO: 7923048 - DNA, 22 bp, Homo sapiens
caggcagaggtaccaagattga

SEQ ID NO: 7923049 - DNA, 22 bp, Homo sapiens
caggcagagtcagattagactt

SEQ ID NO: 7923050 - DNA, 22 bp, Homo sapiens
caggcagagtcagattagactt

SEQ ID NO: 7923051 - DNA, 22 bp, Homo sapiens
caggcagaggcttttcatggct

SEQ ID NO: 7923052 - DNA, 22 bp, Homo sapiens
caggcagaggcttttcatggct

SEQ ID NO: 7923053 - DNA, 20 bp, Homo sapiens
caggcagaggatgctgacca

SEQ ID NO: 7923054 - DNA, 22 bp, Homo sapiens
caggcagaggtaccaagattga

SEQ ID NO: 7923055 - DNA, 22 bp, Homo sapiens
caggcagaggtaccaagattga

SEQ ID NO: 7923056 - DNA, 22 bp, Homo sapiens
caggcagaggtaccaagattga

SEQ ID NO: 7923057 - DNA, 22 bp, Homo sapiens
caggcagaggcttttcatggct

SEQ ID NO: 7923058 - DNA, 22 bp, Homo sapiens
caggcagaggcttttcatggct

SEQ ID NO: 7923059 - DNA, 22 bp, Homo sapiens
agctggagatcatgctgatact

SEQ ID NO: 7923060 - DNA, 22 bp, Homo sapiens
agctggagagtttccaggaagg

SEQ ID NO: 7923061 - DNA, 22 bp, Homo sapiens
agctggagatcatgctgatact

SEQ ID NO: 7923062 - DNA, 22 bp, Homo sapiens
agctggagatgagtgacgtgcc

SEQ ID NO: 7923063 - DNA, 22 bp, Homo sapiens
agctggagatcatgctgatact

SEQ ID NO: 7923064 - DNA, 22 bp, Homo sapiens
agctggagatgagtgacgtgcc

SEQ ID NO: 7923065 - DNA, 22 bp, Homo sapiens
agctggagatgagtgacgtgcc

SEQ ID NO: 7923066 - DNA, 22 bp, Homo sapiens
agctggagatcatgctgatact

SEQ ID NO: 7923067 - DNA, 22 bp, Homo sapiens
agctggagatgagtgacgtgcc

SEQ ID NO: 7923068 - DNA, 22 bp, Homo sapiens
agctggagatgcccagcaccgg

SEQ ID NO: 7923069 - DNA, 22 bp, Homo sapiens
agctggagatgcccagcaccgg

SEQ ID NO: 7923070 - DNA, 22 bp, Homo sapiens
agctggagatgcccagcaccgg

SEQ ID NO: 7923071 - DNA, 22 bp, Homo sapiens
agctggagatcatgctgatact

SEQ ID NO: 7923072 - DNA, 22 bp, Homo sapiens
agctggagagtttccaggaagg

SEQ ID NO: 7923073 - DNA, 22 bp, Homo sapiens
agctggagagtttccaggaagg

SEQ ID NO: 7923074 - DNA, 22 bp, Homo sapiens
agctggagagtttccaggaagg

SEQ ID NO: 7923075 - DNA, 22 bp, Homo sapiens
agctggagagtttccaggaagg

SEQ ID NO: 7923076 - DNA, 22 bp, Homo sapiens
agctggagaatgtggatgatcc

SEQ ID NO: 7923077 - DNA, 22 bp, Homo sapiens
agctggagaatgtggatgatcc

SEQ ID NO: 7923078 - DNA, 22 bp, Homo sapiens
agctggagaatgtggatgatcc

SEQ ID NO: 7923079 - DNA, 22 bp, Homo sapiens
agctggagaatgtggatgatcc

SEQ ID NO: 7923080 - DNA, 22 bp, Homo sapiens
agctggagaatgtggatgatcc

SEQ ID NO: 7923081 - DNA, 22 bp, Homo sapiens
agctggagaataggaattagtg

SEQ ID NO: 7923082 - DNA, 22 bp, Homo sapiens
agctggagaataggaattagtg

SEQ ID NO: 7923083 - DNA, 20 bp, Homo sapiens
agctggagaagggcccttcc

SEQ ID NO: 7923084 - DNA, 20 bp, Homo sapiens
agctggagaagggcccttcc

SEQ ID NO: 7923085 - DNA, 22 bp, Homo sapiens
agctggagaataggaattagtg

SEQ ID NO: 7923086 - DNA, 20 bp, Homo sapiens
agctggagaagggcccttcc

SEQ ID NO: 7923087 - DNA, 20 bp, Homo sapiens
agctggagaagggcccttcc

SEQ ID NO: 7923088 - DNA, 22 bp, Homo sapiens
agctggagaaacctgggagggt

SEQ ID NO: 7923089 - DNA, 22 bp, Homo sapiens
agctggagaaacctgggagggt

SEQ ID NO: 7923090 - DNA, 22 bp, Homo sapiens
agctggagaaacctgggagggt

SEQ ID NO: 7923091 - DNA, 22 bp, Homo sapiens
agctggagaaacctgggagggt

SEQ ID NO: 7923092 - DNA, 22 bp, Homo sapiens
agctggagaaacctgggagggt

SEQ ID NO: 7923093 - DNA, 22 bp, Homo sapiens
agctggaattacaggcacgcac

SEQ ID NO: 7923094 - DNA, 22 bp, Homo sapiens
agctggagaaacctgggagggt

SEQ ID NO: 7923095 - DNA, 21 bp, Homo sapiens
agctggaatctggctgtgctt

SEQ ID NO: 7923096 - DNA, 21 bp, Homo sapiens
agctggaatctggctgtgctt

SEQ ID NO: 7923097 - DNA, 22 bp, Homo sapiens
agctggaattacaggcacgcac

SEQ ID NO: 7923098 - DNA, 22 bp, Homo sapiens
agctggagaaacctgggagggt

SEQ ID NO: 7923099 - DNA, 22 bp, Homo sapiens
agctggagaaacctgggagggt

SEQ ID NO: 7923100 - DNA, 22 bp, Homo sapiens
agctggagccagtgtgaggctt

SEQ ID NO: 7923101 - DNA, 22 bp, Homo sapiens
agctggagccagtgtgaggctt

SEQ ID NO: 7923102 - DNA, 22 bp, Homo sapiens
agctggagccagtgtgaggctt

SEQ ID NO: 7923103 - DNA, 22 bp, Homo sapiens
agctggagccagtgtgaggctt

SEQ ID NO: 7923104 - DNA, 22 bp, Homo sapiens
agctggagccagtgtgaggctt

SEQ ID NO: 7923105 - DNA, 22 bp, Homo sapiens
agctggagcttcaagcaggtaa

SEQ ID NO: 7923106 - DNA, 22 bp, Homo sapiens
agctggagcttcaagcaggtaa

SEQ ID NO: 7923107 - DNA, 22 bp, Homo sapiens
agctggagcttcaagcaggtaa

SEQ ID NO: 7923108 - DNA, 22 bp, Homo sapiens
agctggagcttcaagcaggtaa

SEQ ID NO: 7923109 - DNA, 22 bp, Homo sapiens
agctggagcttcaagcaggtaa

SEQ ID NO: 7923110 - DNA, 22 bp, Homo sapiens
agctggagcttcaagcaggtaa

SEQ ID NO: 7923111 - DNA, 22 bp, Homo sapiens
agctggagcttcaagcaggtaa

SEQ ID NO: 7923112 - DNA, 22 bp, Homo sapiens
agctggagcttcaagcaggtaa

SEQ ID NO: 7923113 - DNA, 22 bp, Homo sapiens
agctggagccagtgtgaggctt

SEQ ID NO: 7923114 - DNA, 19 bp, Homo sapiens
agctggagattggagggca

SEQ ID NO: 7923115 - DNA, 22 bp, Homo sapiens
agctggagccagtgtgaggctt

SEQ ID NO: 7923116 - DNA, 19 bp, Homo sapiens
agctggagattggagggca

SEQ ID NO: 7923117 - DNA, 22 bp, Homo sapiens
agctggagccagtgtgaggctt

SEQ ID NO: 7923118 - DNA, 19 bp, Homo sapiens
agctggagattggagggca

SEQ ID NO: 7923119 - DNA, 19 bp, Homo sapiens
agctggagattggagggca

SEQ ID NO: 7923120 - DNA, 19 bp, Homo sapiens
agctggagattggagggca

SEQ ID NO: 7923121 - DNA, 22 bp, Homo sapiens
agctggagattctggggacagt

SEQ ID NO: 7923122 - DNA, 22 bp, Homo sapiens
agctggagattctggggacagt

SEQ ID NO: 7923123 - DNA, 22 bp, Homo sapiens
agctggagatgcccagcaccgg

SEQ ID NO: 7923124 - DNA, 22 bp, Homo sapiens
agctggagattctggggacagt

SEQ ID NO: 7923125 - DNA, 19 bp, Homo sapiens
agctggagattggagggca

SEQ ID NO: 7923126 - DNA, 19 bp, Homo sapiens
agctggagattggagggca

SEQ ID NO: 7923127 - DNA, 22 bp, Homo sapiens
agctggagattctggggacagt

SEQ ID NO: 7923128 - DNA, 19 bp, Homo sapiens
agctggagattggagggca

SEQ ID NO: 7923129 - DNA, 22 bp, Homo sapiens
agctggaggagtttctcctagc

SEQ ID NO: 7923130 - DNA, 22 bp, Homo sapiens
agctggaggagtttctcctagc

SEQ ID NO: 7923131 - DNA, 22 bp, Homo sapiens
agctggaggagtttctcctagc

SEQ ID NO: 7923132 - DNA, 22 bp, Homo sapiens
agctggaggagtttctcctagc

SEQ ID NO: 7923133 - DNA, 22 bp, Homo sapiens
agctggagcttcaagcaggtaa

SEQ ID NO: 7923134 - DNA, 22 bp, Homo sapiens
agctggaggataactcacttct

SEQ ID NO: 7923135 - DNA, 22 bp, Homo sapiens
agctggaggagtttctcctagc

SEQ ID NO: 7923136 - DNA, 22 bp, Homo sapiens
agctggaggagtttctcctagc

SEQ ID NO: 7923137 - DNA, 22 bp, Homo sapiens
agctgggactcaactgtctggg

SEQ ID NO: 7923138 - DNA, 22 bp, Homo sapiens
agctgggactcaactgtctggg

SEQ ID NO: 7923139 - DNA, 22 bp, Homo sapiens
agctgggactcaactgtctggg

SEQ ID NO: 7923140 - DNA, 22 bp, Homo sapiens
agctgggcaccccgctgcgtct

SEQ ID NO: 7923141 - DNA, 22 bp, Homo sapiens
agctgggactcaactgtctggg

SEQ ID NO: 7923142 - DNA, 22 bp, Homo sapiens
agctgggcagactgcagtggtt

SEQ ID NO: 7923143 - DNA, 22 bp, Homo sapiens
agctgggcaccccgctgcgtct

SEQ ID NO: 7923144 - DNA, 22 bp, Homo sapiens
agctgggcaccccgctgcgtct

SEQ ID NO: 7923145 - DNA, 22 bp, Homo sapiens
agctgggactcaactgtctggg

SEQ ID NO: 7923146 - DNA, 22 bp, Homo sapiens
agctgggcaccccgctgcgtct

SEQ ID NO: 7923147 - DNA, 21 bp, Homo sapiens
agctgggcctcagcctgcagt

SEQ ID NO: 7923148 - DNA, 21 bp, Homo sapiens
agctgggcctcagcctgcagt

SEQ ID NO: 7923149 - DNA, 21 bp, Homo sapiens
agctgggcctcagcctgcagt

SEQ ID NO: 7923150 - DNA, 21 bp, Homo sapiens
agctgggcctcagcctgcagt

SEQ ID NO: 7923151 - DNA, 21 bp, Homo sapiens
agctgggcctcagcctgcagt

SEQ ID NO: 7923152 - DNA, 21 bp, Homo sapiens
agctgggcctcagcctgcagt

SEQ ID NO: 7923153 - DNA, 23 bp, Homo sapiens
agctgggccaggtggtcagacct

SEQ ID NO: 7923154 - DNA, 23 bp, Homo sapiens
agctgggccaggtggtcagacct

SEQ ID NO: 7923155 - DNA, 23 bp, Homo sapiens
agctgggccaggtggtcagacct

SEQ ID NO: 7923156 - DNA, 23 bp, Homo sapiens
agctgggccaggtggtcagacct

SEQ ID NO: 7923157 - DNA, 22 bp, Homo sapiens
agctgggcagactgcagtggtt

SEQ ID NO: 7923158 - DNA, 22 bp, Homo sapiens
agctgggcagactgcagtggtt

SEQ ID NO: 7923159 - DNA, 22 bp, Homo sapiens
agctgggcagactgcagtggtt

SEQ ID NO: 7923160 - DNA, 22 bp, Homo sapiens
agctgggcagactgcagtggtt

SEQ ID NO: 7923161 - DNA, 22 bp, Homo sapiens
agctgggcagtgcttggattca

SEQ ID NO: 7923162 - DNA, 23 bp, Homo sapiens
agctgggccaggtggtcagacct

SEQ ID NO: 7923163 - DNA, 22 bp, Homo sapiens
agctgggcagtgcttggattca

SEQ ID NO: 7923164 - DNA, 22 bp, Homo sapiens
agctgggcagtgcttggattca

SEQ ID NO: 7923165 - DNA, 22 bp, Homo sapiens
agctgggcagtgcttggattca

SEQ ID NO: 7923166 - DNA, 22 bp, Homo sapiens
agctgggcagtgcttggattca

SEQ ID NO: 7923167 - DNA, 22 bp, Homo sapiens
agctgggcctgagctggaagct

SEQ ID NO: 7923168 - DNA, 22 bp, Homo sapiens
agctgggcctgatttgcagggg

SEQ ID NO: 7923169 - DNA, 22 bp, Homo sapiens
agctgggcctgagctggaagct

SEQ ID NO: 7923170 - DNA, 22 bp, Homo sapiens
agctgggcgcagtggctggtga

SEQ ID NO: 7923171 - DNA, 22 bp, Homo sapiens
agctgggcctgatttgcagggg

SEQ ID NO: 7923172 - DNA, 22 bp, Homo sapiens
agctgggcctgatttgcagggg

SEQ ID NO: 7923173 - DNA, 21 bp, Homo sapiens
agctgggcctcagcctgcagt

SEQ ID NO: 7923174 - DNA, 21 bp, Homo sapiens
agctgggcctcagcctgcagt

SEQ ID NO: 7923175 - DNA, 21 bp, Homo sapiens
agctgggcctcagcctgcagt

SEQ ID NO: 7923176 - DNA, 21 bp, Homo sapiens
agctgggcctcagcctgcagt

SEQ ID NO: 7923177 - DNA, 22 bp, Homo sapiens
agctgggcctgagctggaagct

SEQ ID NO: 7923178 - DNA, 22 bp, Homo sapiens
agctgggcctgagctggaagct

SEQ ID NO: 7923179 - DNA, 22 bp, Homo sapiens
agctgggcctgagctggaagct

SEQ ID NO: 7923180 - DNA, 22 bp, Homo sapiens
agctgggcctgagctggaagct

SEQ ID NO: 7923181 - DNA, 22 bp, Homo sapiens
agctgggcctgagctggaagct

SEQ ID NO: 7923182 - DNA, 22 bp, Homo sapiens
agctgggctgatgactcatgtt

SEQ ID NO: 7923183 - DNA, 22 bp, Homo sapiens
agctgggctgatgactcatgtt

SEQ ID NO: 7923184 - DNA, 22 bp, Homo sapiens
agctgggctgatgactcatgtt

SEQ ID NO: 7923185 - DNA, 22 bp, Homo sapiens
agctgggctgatgactcatgtt

SEQ ID NO: 7923186 - DNA, 22 bp, Homo sapiens
caggcagagctgaagatagatg

SEQ ID NO: 7923187 - DNA, 22 bp, Homo sapiens
agctgggctggagctccaagcg

SEQ ID NO: 7923188 - DNA, 22 bp, Homo sapiens
agctgggctgatgactcatgtt

SEQ ID NO: 7923189 - DNA, 22 bp, Homo sapiens
agctgggcgcagtggctggtga

SEQ ID NO: 7923190 - DNA, 22 bp, Homo sapiens
agctgggcgcagtggctggtga

SEQ ID NO: 7923191 - DNA, 22 bp, Homo sapiens
agctgggcgcagtggctggtga

SEQ ID NO: 7923192 - DNA, 22 bp, Homo sapiens
agctgggcgcagtggctggtga

SEQ ID NO: 7923193 - DNA, 22 bp, Homo sapiens
agctgggcgcagtggctggtga

SEQ ID NO: 7923194 - DNA, 22 bp, Homo sapiens
agctgggctccaagagggatct

SEQ ID NO: 7923195 - DNA, 22 bp, Homo sapiens
agctgggctccaagagggatct

SEQ ID NO: 7923196 - DNA, 22 bp, Homo sapiens
agctgggctccaagagggatct

SEQ ID NO: 7923197 - DNA, 22 bp, Homo sapiens
agctgggcgcagtggctggtga

SEQ ID NO: 7923198 - DNA, 22 bp, Homo sapiens
agctgggcgcagtggctggtga

SEQ ID NO: 7923199 - DNA, 22 bp, Homo sapiens
caggaagaccagggctgtggct

SEQ ID NO: 7923200 - DNA, 22 bp, Homo sapiens
caggaagaccagggctgtggct

SEQ ID NO: 7923201 - DNA, 22 bp, Homo sapiens
caggaagaccagggctgtggct

SEQ ID NO: 7923202 - DNA, 22 bp, Homo sapiens
caggaagaccagggctgtggct

SEQ ID NO: 7923203 - DNA, 22 bp, Homo sapiens
caggaagaccagggctgtggct

SEQ ID NO: 7923204 - DNA, 22 bp, Homo sapiens
caggaagaagggtggtgagtcc

SEQ ID NO: 7923205 - DNA, 22 bp, Homo sapiens
caggaagaagggtggtgagtcc

SEQ ID NO: 7923206 - DNA, 22 bp, Homo sapiens
caggaagaagggtggtgagtcc

SEQ ID NO: 7923207 - DNA, 22 bp, Homo sapiens
caggaagaagggtggtgagtcc

SEQ ID NO: 7923208 - DNA, 22 bp, Homo sapiens
caggaagaaagaggtgaggtgt

SEQ ID NO: 7923209 - DNA, 22 bp, Homo sapiens
caggaagaaagaggtgaggtgt

SEQ ID NO: 7923210 - DNA, 22 bp, Homo sapiens
caggaagaagggtggtgagtcc

SEQ ID NO: 7923211 - DNA, 22 bp, Homo sapiens
caggaagaaagaggtgaggtgt

SEQ ID NO: 7923212 - DNA, 22 bp, Homo sapiens
caggaagaaagaggtgaggtgt

SEQ ID NO: 7923213 - DNA, 22 bp, Homo sapiens
caggaagaaagaggtgaggtgt

SEQ ID NO: 7923214 - DNA, 22 bp, Homo sapiens
caggaactggaaccctggccga

SEQ ID NO: 7923215 - DNA, 22 bp, Homo sapiens
caggaagaaagaggtgaggtgt

SEQ ID NO: 7923216 - DNA, 22 bp, Homo sapiens
caggaactggaaccctggccga

SEQ ID NO: 7923217 - DNA, 22 bp, Homo sapiens
caggaaatgaacaggaatgaac

SEQ ID NO: 7923218 - DNA, 23 bp, Homo sapiens
caggaaatgaatccaggaggatg

SEQ ID NO: 7923219 - DNA, 23 bp, Homo sapiens
caggaaatgaatccaggaggatg

SEQ ID NO: 7923220 - DNA, 23 bp, Homo sapiens
caggaaatgaatccaggaggatg

SEQ ID NO: 7923221 - DNA, 22 bp, Homo sapiens
caggaaatgaacaggaatgaac

SEQ ID NO: 7923222 - DNA, 22 bp, Homo sapiens
caggaaatgaacaggaatgaac

SEQ ID NO: 7923223 - DNA, 22 bp, Homo sapiens
caggaaatgaaagctagctaat

SEQ ID NO: 7923224 - DNA, 22 bp, Homo sapiens
caggaaatgaacaggaatgaac

SEQ ID NO: 7923225 - DNA, 22 bp, Homo sapiens
caggaaatgaaagctagctaat

SEQ ID NO: 7923226 - DNA, 21 bp, Homo sapiens
caggaaatcagtgtgaattag

SEQ ID NO: 7923227 - DNA, 22 bp, Homo sapiens
caggaaatgctatcatagctga

SEQ ID NO: 7923228 - DNA, 22 bp, Homo sapiens
caggaaatgctatcatagctga

SEQ ID NO: 7923229 - DNA, 15 bp, Homo sapiens
caggaaatgaatctg

SEQ ID NO: 7923230 - DNA, 22 bp, Homo sapiens
caggaaatgaggctgaagggtg

SEQ ID NO: 7923231 - DNA, 22 bp, Homo sapiens
caggaaatgcgtagttgaactt

SEQ ID NO: 7923232 - DNA, 22 bp, Homo sapiens
caggaaatgcgtagttgaactt

SEQ ID NO: 7923233 - DNA, 22 bp, Homo sapiens
caggaaatgaggctgaagggtg

SEQ ID NO: 7923234 - DNA, 22 bp, Homo sapiens
caggaaatgaggctgaagggtg

SEQ ID NO: 7923235 - DNA, 22 bp, Homo sapiens
caggaacccaatgggccaggcc

SEQ ID NO: 7923236 - DNA, 22 bp, Homo sapiens
caggaacccccactctcagctc

SEQ ID NO: 7923237 - DNA, 23 bp, Homo sapiens
caggaaatgcttggaggggctgg

SEQ ID NO: 7923238 - DNA, 23 bp, Homo sapiens
caggaaatgcttggaggggctgg

SEQ ID NO: 7923239 - DNA, 23 bp, Homo sapiens
caggaaatgcttggaggggctgg

SEQ ID NO: 7923240 - DNA, 22 bp, Homo sapiens
caggaacatttaaccacagggt

SEQ ID NO: 7923241 - DNA, 22 bp, Homo sapiens
caggaaccaggagagtccctga

SEQ ID NO: 7923242 - DNA, 21 bp, Homo sapiens
agctgaaaagttgtttacaag

SEQ ID NO: 7923243 - DNA, 21 bp, Homo sapiens
agctgaaaagttgtttacaag

SEQ ID NO: 7923244 - DNA, 22 bp, Homo sapiens
agctgaaacccaggcctcagct

SEQ ID NO: 7923245 - DNA, 22 bp, Homo sapiens
agctgaaattcacaaggatcca

SEQ ID NO: 7923246 - DNA, 22 bp, Homo sapiens
agctgaaattctttgtcctcag

SEQ ID NO: 7923247 - DNA, 22 bp, Homo sapiens
agctgaaattctttgtcctcag

SEQ ID NO: 7923248 - DNA, 22 bp, Homo sapiens
agctgaaagggtgttggagtgt

SEQ ID NO: 7923249 - DNA, 22 bp, Homo sapiens
agctgaaagggtgttggagtgt

SEQ ID NO: 7923250 - DNA, 17 bp, Homo sapiens
agctgaaattgctgaag

SEQ ID NO: 7923251 - DNA, 22 bp, Homo sapiens
agctgaaattttactgagtata

SEQ ID NO: 7923252 - DNA, 22 bp, Homo sapiens
agctgaacgtgcttctgcagca

SEQ ID NO: 7923253 - DNA, 22 bp, Homo sapiens
agctgaagaaatgggaagcatt

SEQ ID NO: 7923254 - DNA, 22 bp, Homo sapiens
agctgaaccttagtctggagtg

SEQ ID NO: 7923255 - DNA, 22 bp, Homo sapiens
agctgaagaaatgggaagcatt

SEQ ID NO: 7923256 - DNA, 22 bp, Homo sapiens
caggaaatcagaactcaagtgg

SEQ ID NO: 7923257 - DNA, 22 bp, Homo sapiens
caggaaatcagaactcaagtgg

SEQ ID NO: 7923258 - DNA, 22 bp, Homo sapiens
caggaaatcagaactcaagtgg

SEQ ID NO: 7923259 - DNA, 21 bp, Homo sapiens
caggaaatcagtgtgaattag

SEQ ID NO: 7923260 - DNA, 21 bp, Homo sapiens
caggaaatcagtgtgaattag

SEQ ID NO: 7923261 - DNA, 21 bp, Homo sapiens
caggaaatcagtgtgaattag

SEQ ID NO: 7923262 - DNA, 22 bp, Homo sapiens
caggaaatcagaactcaagtgg

SEQ ID NO: 7923263 - DNA, 22 bp, Homo sapiens
caggaaatcactctgattttgg

SEQ ID NO: 7923264 - DNA, 23 bp, Homo sapiens
caggaaatcaattcttccagcat

SEQ ID NO: 7923265 - DNA, 23 bp, Homo sapiens
caggaaatcaattcttccagcat

SEQ ID NO: 7923266 - DNA, 23 bp, Homo sapiens
caggaaatcaattcttccagcat

SEQ ID NO: 7923267 - DNA, 22 bp, Homo sapiens
caggaaatcactctgattttgg

SEQ ID NO: 7923268 - DNA, 23 bp, Homo sapiens
caggaaatcaattcttccagcat

SEQ ID NO: 7923269 - DNA, 22 bp, Homo sapiens
caggaaatatctcctggcagag

SEQ ID NO: 7923270 - DNA, 22 bp, Homo sapiens
caggaaatatctcctggcagag

SEQ ID NO: 7923271 - DNA, 22 bp, Homo sapiens
caggaaatatctcaacacttta

SEQ ID NO: 7923272 - DNA, 22 bp, Homo sapiens
caggaaatatctcctggcagag

SEQ ID NO: 7923273 - DNA, 22 bp, Homo sapiens
caggaaatataggaaaaggaac

SEQ ID NO: 7923274 - DNA, 22 bp, Homo sapiens
caggaaatataggaaaaggaac

SEQ ID NO: 7923275 - DNA, 22 bp, Homo sapiens
caggaaatataggaaaaggaac

SEQ ID NO: 7923276 - DNA, 22 bp, Homo sapiens
caggaaatataggaaaaggaac

SEQ ID NO: 7923277 - DNA, 22 bp, Homo sapiens
caggaaatagttcagtcaaact

SEQ ID NO: 7923278 - DNA, 22 bp, Homo sapiens
caggaaaatctgcccacacaag

SEQ ID NO: 7923279 - DNA, 22 bp, Homo sapiens
caggaaatatctcaacacttta

SEQ ID NO: 7923280 - DNA, 22 bp, Homo sapiens
caggaaatatctcaacacttta

SEQ ID NO: 7923281 - DNA, 22 bp, Homo sapiens
caggaaatatctcaacacttta

SEQ ID NO: 7923282 - DNA, 17 bp, Homo sapiens
caggaaaatatgagtga

SEQ ID NO: 7923283 - DNA, 17 bp, Homo sapiens
caggaaaatatgagtga

SEQ ID NO: 7923284 - DNA, 17 bp, Homo sapiens
caggaaaatatgagtga

SEQ ID NO: 7923285 - DNA, 17 bp, Homo sapiens
caggaaaatatgagtga

SEQ ID NO: 7923286 - DNA, 22 bp, Homo sapiens
agctgcctgcttatgagctcca

SEQ ID NO: 7923287 - DNA, 22 bp, Homo sapiens
agctgcctgcttatgagctcca

SEQ ID NO: 7923288 - DNA, 22 bp, Homo sapiens
agctgcctggagccagagttga

SEQ ID NO: 7923289 - DNA, 22 bp, Homo sapiens
agctgcctggagccagagttga

SEQ ID NO: 7923290 - DNA, 22 bp, Homo sapiens
agctgctgggaccccagatcca

SEQ ID NO: 7923291 - DNA, 22 bp, Homo sapiens
agctgctgggagaagtgagcca

SEQ ID NO: 7923292 - DNA, 22 bp, Homo sapiens
agctgctgggatacagtagtga

SEQ ID NO: 7923293 - DNA, 22 bp, Homo sapiens
agctgctgggatacagtagtga

SEQ ID NO: 7923294 - DNA, 22 bp, Homo sapiens
agctgctgggatacagtagtga

SEQ ID NO: 7923295 - DNA, 22 bp, Homo sapiens
agctgctgggatacagtagtga

SEQ ID NO: 7923296 - DNA, 22 bp, Homo sapiens
agctgctgggatacagtagtga

SEQ ID NO: 7923297 - DNA, 22 bp, Homo sapiens
agctgctgggagaagtgagcca

SEQ ID NO: 7923298 - DNA, 22 bp, Homo sapiens
agctgctgggagaagtgagcca

SEQ ID NO: 7923299 - DNA, 22 bp, Homo sapiens
agctgctgggagaagtgagcca

SEQ ID NO: 7923300 - DNA, 22 bp, Homo sapiens
agctgctgggagaagtgagcca

SEQ ID NO: 7923301 - DNA, 21 bp, Homo sapiens
agctgctttcagctcctagag

SEQ ID NO: 7923302 - DNA, 22 bp, Homo sapiens
agctgctttgctgggcaggccc

SEQ ID NO: 7923303 - DNA, 22 bp, Homo sapiens
agctgcttttagggccgggctc

SEQ ID NO: 7923304 - DNA, 22 bp, Homo sapiens
agctggaatcctacttctaaca

SEQ ID NO: 7923305 - DNA, 22 bp, Homo sapiens
agctggaagtgcatttctcact

SEQ ID NO: 7923306 - DNA, 22 bp, Homo sapiens
agctggaagctgatgagcacag

SEQ ID NO: 7923307 - DNA, 22 bp, Homo sapiens
agctggaacgtcacaggagcag

SEQ ID NO: 7923308 - DNA, 22 bp, Homo sapiens
agctggaagctgatgagcacag

SEQ ID NO: 7923309 - DNA, 22 bp, Homo sapiens
agctggaagctgatgagcacag

SEQ ID NO: 7923310 - DNA, 22 bp, Homo sapiens
agctggaaaatccaagaccttg

SEQ ID NO: 7923311 - DNA, 23 bp, Homo sapiens
agctggaaatggccgagctctgc

SEQ ID NO: 7923312 - DNA, 22 bp, Homo sapiens
agctggaaagaaggtggcagcc

SEQ ID NO: 7923313 - DNA, 22 bp, Homo sapiens
agctgcctcctggtgccccatc

SEQ ID NO: 7923314 - DNA, 17 bp, Homo sapiens
agctgcctctcccacca

SEQ ID NO: 7923315 - DNA, 17 bp, Homo sapiens
agctgcctctcccacca

SEQ ID NO: 7923316 - DNA, 17 bp, Homo sapiens
agctgcctctcccacca

SEQ ID NO: 7923317 - DNA, 22 bp, Homo sapiens
agctgcctctcttgaggttacg

SEQ ID NO: 7923318 - DNA, 22 bp, Homo sapiens
agctgcctctcttgaggttacg

SEQ ID NO: 7923319 - DNA, 22 bp, Homo sapiens
agctgcctcctggtgccccatc

SEQ ID NO: 7923320 - DNA, 22 bp, Homo sapiens
agctgcctcctggtgccccatc

SEQ ID NO: 7923321 - DNA, 22 bp, Homo sapiens
agctgcctccctgtgcttgtcc

SEQ ID NO: 7923322 - DNA, 22 bp, Homo sapiens
agctgcctccctgtgcttgtcc

SEQ ID NO: 7923323 - DNA, 22 bp, Homo sapiens
agctgcctccctgtgcttgtcc

SEQ ID NO: 7923324 - DNA, 22 bp, Homo sapiens
agctgcctccatggtcaaagat

SEQ ID NO: 7923325 - DNA, 22 bp, Homo sapiens
agctgcctgctgcactcggtgc

SEQ ID NO: 7923326 - DNA, 21 bp, Homo sapiens
agctgcctgctctggacctgg

SEQ ID NO: 7923327 - DNA, 22 bp, Homo sapiens
agctgcctgcttatgagctcca

SEQ ID NO: 7923328 - DNA, 21 bp, Homo sapiens
agctgcctgctctggacctgg

SEQ ID NO: 7923329 - DNA, 21 bp, Homo sapiens
agctgcctgctctggacctgg

SEQ ID NO: 7923330 - DNA, 22 bp, Homo sapiens
agctgcctgccatgccgctggt

SEQ ID NO: 7923331 - DNA, 22 bp, Homo sapiens
agctgcctgccatgccgctggt

SEQ ID NO: 7923332 - DNA, 22 bp, Homo sapiens
agctgcctgccatgccgctggt

SEQ ID NO: 7923333 - DNA, 22 bp, Homo sapiens
agctgcctgccatgccgctggt

SEQ ID NO: 7923334 - DNA, 22 bp, Homo sapiens
agctgcctgccatgccgctggt

SEQ ID NO: 7923335 - DNA, 22 bp, Homo sapiens
agctgcctgccatgccgctggt

SEQ ID NO: 7923336 - DNA, 22 bp, Homo sapiens
agctgcctgcatttatatcctg

SEQ ID NO: 7923337 - DNA, 22 bp, Homo sapiens
agctgcctctgaactttaattc

SEQ ID NO: 7923338 - DNA, 22 bp, Homo sapiens
agctgcctctgaactttaattc

SEQ ID NO: 7923339 - DNA, 22 bp, Homo sapiens
agctgcctctgctggtttagaa

SEQ ID NO: 7923340 - DNA, 22 bp, Homo sapiens
agctgccgatgcccagctgcat

SEQ ID NO: 7923341 - DNA, 22 bp, Homo sapiens
agctgccgatgcccagctgcat

SEQ ID NO: 7923342 - DNA, 22 bp, Homo sapiens
agctgcctagtagattgattgg

SEQ ID NO: 7923343 - DNA, 20 bp, Homo sapiens
agctgcccttttcacatgtt

SEQ ID NO: 7923344 - DNA, 20 bp, Homo sapiens
agctgcccttttcacatgtt

SEQ ID NO: 7923345 - DNA, 22 bp, Homo sapiens
agctgcctcagtcactcatggc

SEQ ID NO: 7923346 - DNA, 22 bp, Homo sapiens
agctgcctcagtcactcatggc

SEQ ID NO: 7923347 - DNA, 22 bp, Homo sapiens
agctgcctcagcaacacagacc

SEQ ID NO: 7923348 - DNA, 21 bp, Homo sapiens
agctgcctccacttctgaggc

SEQ ID NO: 7923349 - DNA, 21 bp, Homo sapiens
agctgcctccacttctgaggc

SEQ ID NO: 7923350 - DNA, 22 bp, Homo sapiens
agctgccctgtggggagggttg

SEQ ID NO: 7923351 - DNA, 22 bp, Homo sapiens
agctgccctgtggggagggttg

SEQ ID NO: 7923352 - DNA, 22 bp, Homo sapiens
agctgcccttaataggcattca

SEQ ID NO: 7923353 - DNA, 22 bp, Homo sapiens
agctgccctggtaagattgatg

SEQ ID NO: 7923354 - DNA, 22 bp, Homo sapiens
agctgccctgggtcttgctgct

SEQ ID NO: 7923355 - DNA, 22 bp, Homo sapiens
agctgccctgggtcttgctgct

SEQ ID NO: 7923356 - DNA, 22 bp, Homo sapiens
agctgccctgggtcttgctgct

SEQ ID NO: 7923357 - DNA, 22 bp, Homo sapiens
agctgcccttaataggcattca

SEQ ID NO: 7923358 - DNA, 22 bp, Homo sapiens
agctgcccttaataggcattca

SEQ ID NO: 7923359 - DNA, 22 bp, Homo sapiens
agctgcccttaataggcattca

SEQ ID NO: 7923360 - DNA, 22 bp, Homo sapiens
agctgcccttctcttgcccttg

SEQ ID NO: 7923361 - DNA, 22 bp, Homo sapiens
agctgccctttatgatgctgaa

SEQ ID NO: 7923362 - DNA, 22 bp, Homo sapiens
agctgccctttatgatgctgaa

SEQ ID NO: 7923363 - DNA, 22 bp, Homo sapiens
agctgccagatgacagtgctat

SEQ ID NO: 7923364 - DNA, 22 bp, Homo sapiens
agctgccagatgacagtgctat

SEQ ID NO: 7923365 - DNA, 22 bp, Homo sapiens
agctgccactgagggtgcacag

SEQ ID NO: 7923366 - DNA, 22 bp, Homo sapiens
agctgccagatgacagtgctat

SEQ ID NO: 7923367 - DNA, 22 bp, Homo sapiens
caggaagaccagggctgtggct

SEQ ID NO: 7923368 - DNA, 22 bp, Homo sapiens
caggaagaccagggctgtggct

SEQ ID NO: 7923369 - DNA, 22 bp, Homo sapiens
caggaagaccagggctgtggct

SEQ ID NO: 7923370 - DNA, 22 bp, Homo sapiens
agctgccccgaggcggcgggaa

SEQ ID NO: 7923371 - DNA, 22 bp, Homo sapiens
agctgcccccagggctgtgctt

SEQ ID NO: 7923372 - DNA, 22 bp, Homo sapiens
agctgcccctcattttcaccac

SEQ ID NO: 7923373 - DNA, 22 bp, Homo sapiens
agctgcccctcattttcaccac

SEQ ID NO: 7923374 - DNA, 22 bp, Homo sapiens
agctgccccgaggcggcgggaa

SEQ ID NO: 7923375 - DNA, 22 bp, Homo sapiens
agctgccccgaggcggcgggaa

SEQ ID NO: 7923376 - DNA, 22 bp, Homo sapiens
agctgccctggcggagctgctc

SEQ ID NO: 7923377 - DNA, 22 bp, Homo sapiens
agctgccctggcggagctgctc

SEQ ID NO: 7923378 - DNA, 22 bp, Homo sapiens
agctgccctcgctggggccaga

SEQ ID NO: 7923379 - DNA, 22 bp, Homo sapiens
agctgccctcgctggggccaga

SEQ ID NO: 7923380 - DNA, 20 bp, Homo sapiens
agctgcccctgggcactgcc

SEQ ID NO: 7923381 - DNA, 20 bp, Homo sapiens
agctgcccctgggcactgcc

SEQ ID NO: 7923382 - DNA, 20 bp, Homo sapiens
agctgcccctgggcactgcc

SEQ ID NO: 7923383 - DNA, 20 bp, Homo sapiens
agctgcccctgggcactgcc

SEQ ID NO: 7923384 - DNA, 22 bp, Homo sapiens
agctgccctggcggagctgctc

SEQ ID NO: 7923385 - DNA, 22 bp, Homo sapiens
agctgccctggcggagctgctc

SEQ ID NO: 7923386 - DNA, 22 bp, Homo sapiens
agctgccctggcggagctgctc

SEQ ID NO: 7923387 - DNA, 18 bp, Homo sapiens
agctgccctgggctggag

SEQ ID NO: 7923388 - DNA, 18 bp, Homo sapiens
agctgccctgggctggag

SEQ ID NO: 7923389 - DNA, 18 bp, Homo sapiens
agctgccctgggctggag

SEQ ID NO: 7923390 - DNA, 22 bp, Homo sapiens
agctgccctgggctggagatgg

SEQ ID NO: 7923391 - DNA, 22 bp, Homo sapiens
agctgccctgggtcttgctgct

SEQ ID NO: 7923392 - DNA, 18 bp, Homo sapiens
agctgccctgggctggag

SEQ ID NO: 7923393 - DNA, 22 bp, Homo sapiens
catgtgtgagtgagcagtcttc

SEQ ID NO: 7923394 - DNA, 22 bp, Homo sapiens
catgtgtggagggcatgcatgg

SEQ ID NO: 7923395 - DNA, 23 bp, Homo sapiens
catgtgtgacagtatcactgttt

SEQ ID NO: 7923396 - DNA, 22 bp, Homo sapiens
catgtgtgacaaactgcctgca

SEQ ID NO: 7923397 - DNA, 22 bp, Homo sapiens
catgtgtgacaaactgcctgca

SEQ ID NO: 7923398 - DNA, 22 bp, Homo sapiens
catgtgtgagtatatcttatcc

SEQ ID NO: 7923399 - DNA, 23 bp, Homo sapiens
catgtgtgacagtatcactgttt

SEQ ID NO: 7923400 - DNA, 23 bp, Homo sapiens
catgtgtgacagtatcactgttt

SEQ ID NO: 7923401 - DNA, 22 bp, Homo sapiens
catgtgtggtctgtggctatct

SEQ ID NO: 7923402 - DNA, 22 bp, Homo sapiens
aggcacaggcctcagcacccag

SEQ ID NO: 7923403 - DNA, 22 bp, Homo sapiens
catgtgtggtctgtggctatct

SEQ ID NO: 7923404 - DNA, 22 bp, Homo sapiens
catgtgtgggacccttaggttg

SEQ ID NO: 7923405 - DNA, 22 bp, Homo sapiens
aggcacagggatgcggagccag

SEQ ID NO: 7923406 - DNA, 22 bp, Homo sapiens
aggcacagggatgcggagccag

SEQ ID NO: 7923407 - DNA, 22 bp, Homo sapiens
aggcacagggatgcggagccag

SEQ ID NO: 7923408 - DNA, 22 bp, Homo sapiens
aggcacagggatgcggagccag

SEQ ID NO: 7923409 - DNA, 22 bp, Homo sapiens
aggcacagggatgcggagccag

SEQ ID NO: 7923410 - DNA, 22 bp, Homo sapiens
aggcacaggtggacttcacagt

SEQ ID NO: 7923411 - DNA, 22 bp, Homo sapiens
aggcacagggatgcggagccag

SEQ ID NO: 7923412 - DNA, 22 bp, Homo sapiens
aggcacagggatgcggagccag

SEQ ID NO: 7923413 - DNA, 22 bp, Homo sapiens
aggcacaggtggacttcacagt

SEQ ID NO: 7923414 - DNA, 22 bp, Homo sapiens
aggcacaggtggacttcacagt

SEQ ID NO: 7923415 - DNA, 22 bp, Homo sapiens
catgtctgagtagagtgtgatt

SEQ ID NO: 7923416 - DNA, 22 bp, Homo sapiens
catgtctgagtagagtgtgatt

SEQ ID NO: 7923417 - DNA, 22 bp, Homo sapiens
catgtccttctcattgcctcat

SEQ ID NO: 7923418 - DNA, 22 bp, Homo sapiens
catgtcgagtgggtctctgttc

SEQ ID NO: 7923419 - DNA, 22 bp, Homo sapiens
aggatgaatatttagtgggata

SEQ ID NO: 7923420 - DNA, 22 bp, Homo sapiens
aggatgactggaacccaagtga

SEQ ID NO: 7923421 - DNA, 22 bp, Homo sapiens
aggatcttgctgtagaggatag

SEQ ID NO: 7923422 - DNA, 22 bp, Homo sapiens
aggatcttgctgtagaggatag

SEQ ID NO: 7923423 - DNA, 22 bp, Homo sapiens
aggatcttcattgtgctgcaaa

SEQ ID NO: 7923424 - DNA, 22 bp, Homo sapiens
aggatcttatgtaataattatg

SEQ ID NO: 7923425 - DNA, 22 bp, Homo sapiens
aggatcttatgtaataattatg

SEQ ID NO: 7923426 - DNA, 22 bp, Homo sapiens
aggatgaatatttagtgggata

SEQ ID NO: 7923427 - DNA, 22 bp, Homo sapiens
aggatgaataactgaaatggtg

SEQ ID NO: 7923428 - DNA, 22 bp, Homo sapiens
catgtgtgaatcttgtgatcat

SEQ ID NO: 7923429 - DNA, 22 bp, Homo sapiens
catgtgtgaatcttgtgatcat

SEQ ID NO: 7923430 - DNA, 22 bp, Homo sapiens
catgtgtgaatcttgtgatcat

SEQ ID NO: 7923431 - DNA, 22 bp, Homo sapiens
catgtgtgaatcttgtgatcat

SEQ ID NO: 7923432 - DNA, 22 bp, Homo sapiens
catgtgtgaagactgcgggcca

SEQ ID NO: 7923433 - DNA, 22 bp, Homo sapiens
catgtgtcctagctattctcct

SEQ ID NO: 7923434 - DNA, 22 bp, Homo sapiens
catgtgtctttatggagccaca

SEQ ID NO: 7923435 - DNA, 21 bp, Homo sapiens
catgtgtcttgtgttactgct

SEQ ID NO: 7923436 - DNA, 23 bp, Homo sapiens
aggataaactaaactcattttgg

SEQ ID NO: 7923437 - DNA, 23 bp, Homo sapiens
aggataaactaaactcattttgg

SEQ ID NO: 7923438 - DNA, 22 bp, Homo sapiens
aggagtttatccgagggcataa

SEQ ID NO: 7923439 - DNA, 22 bp, Homo sapiens
aggagtttcaaagcttccatgt

SEQ ID NO: 7923440 - DNA, 22 bp, Homo sapiens
aggatacaagtctcagaatgct

SEQ ID NO: 7923441 - DNA, 22 bp, Homo sapiens
aggataaatgatctagattttc

SEQ ID NO: 7923442 - DNA, 22 bp, Homo sapiens
aggataaatgatctagattttc

SEQ ID NO: 7923443 - DNA, 22 bp, Homo sapiens
aggataaaggtcattattccca

SEQ ID NO: 7923444 - DNA, 22 bp, Homo sapiens
aggagtgttcagcgtggggatg

SEQ ID NO: 7923445 - DNA, 22 bp, Homo sapiens
aggatcagtgaatactcagggt

SEQ ID NO: 7923446 - DNA, 22 bp, Homo sapiens
aggatcaggccctctagggtag

SEQ ID NO: 7923447 - DNA, 22 bp, Homo sapiens
aggatacacggggatttatgta

SEQ ID NO: 7923448 - DNA, 22 bp, Homo sapiens
aggatacaagtctcagaatgct

SEQ ID NO: 7923449 - DNA, 22 bp, Homo sapiens
aggatacatgttttttatcaat

SEQ ID NO: 7923450 - DNA, 22 bp, Homo sapiens
aggatagaagccccatgttctt

SEQ ID NO: 7923451 - DNA, 22 bp, Homo sapiens
aggatataaaaagactatttgg

SEQ ID NO: 7923452 - DNA, 22 bp, Homo sapiens
aggatataaaaagactatttgg

SEQ ID NO: 7923453 - DNA, 22 bp, Homo sapiens
aggatataaaaagactatttgg

SEQ ID NO: 7923454 - DNA, 23 bp, Homo sapiens
aggatcctggtacaggagcagag

SEQ ID NO: 7923455 - DNA, 22 bp, Homo sapiens
aggatcctccttagaaaagacc

SEQ ID NO: 7923456 - DNA, 22 bp, Homo sapiens
aggatcatataagctccagcta

SEQ ID NO: 7923457 - DNA, 22 bp, Homo sapiens
aggatcatgtggtcattcctga

SEQ ID NO: 7923458 - DNA, 20 bp, Homo sapiens
aggatctgagatagaatgga

SEQ ID NO: 7923459 - DNA, 22 bp, Homo sapiens
aggatcctttttctgctgtttg

SEQ ID NO: 7923460 - DNA, 22 bp, Homo sapiens
aggatctgtgagtgctgcagac

SEQ ID NO: 7923461 - DNA, 22 bp, Homo sapiens
aggatctgtgcctcaacccaga

SEQ ID NO: 7923462 - DNA, 22 bp, Homo sapiens
aggcactgactcaagggagcca

SEQ ID NO: 7923463 - DNA, 22 bp, Homo sapiens
aggcactgactcaagggagcca

SEQ ID NO: 7923464 - DNA, 22 bp, Homo sapiens
aggcactgacagattctgtgtc

SEQ ID NO: 7923465 - DNA, 22 bp, Homo sapiens
aggcactgacctgcttccttga

SEQ ID NO: 7923466 - DNA, 22 bp, Homo sapiens
aggcactgactcaagggagcca

SEQ ID NO: 7923467 - DNA, 22 bp, Homo sapiens
aggcactgacctgcttccttga

SEQ ID NO: 7923468 - DNA, 22 bp, Homo sapiens
aggcactgattctcagagttac

SEQ ID NO: 7923469 - DNA, 22 bp, Homo sapiens
aggcactgagaggctgtgttgc

SEQ ID NO: 7923470 - DNA, 22 bp, Homo sapiens
aggcactgactcaagggagcca

SEQ ID NO: 7923471 - DNA, 22 bp, Homo sapiens
aggcactgactcaagggagcca

SEQ ID NO: 7923472 - DNA, 22 bp, Homo sapiens
aggcactgagaggctgtgttgc

SEQ ID NO: 7923473 - DNA, 22 bp, Homo sapiens
aggcactgagaggctgtgttgc

SEQ ID NO: 7923474 - DNA, 22 bp, Homo sapiens
aggcactgactcaagggagcca

SEQ ID NO: 7923475 - DNA, 22 bp, Homo sapiens
aggcactgactcaagggagcca

SEQ ID NO: 7923476 - DNA, 22 bp, Homo sapiens
aggcactgactcaagggagcca

SEQ ID NO: 7923477 - DNA, 23 bp, Homo sapiens
aggcactgaatgtgtcagtgagt

SEQ ID NO: 7923478 - DNA, 23 bp, Homo sapiens
aggcactgaatgtgtcagtgagt

SEQ ID NO: 7923479 - DNA, 23 bp, Homo sapiens
aggcactgaatgtgtcagtgagt

SEQ ID NO: 7923480 - DNA, 23 bp, Homo sapiens
aggcactgaatgtgtcagtgagt

SEQ ID NO: 7923481 - DNA, 22 bp, Homo sapiens
aggcactgacaattctggactg

SEQ ID NO: 7923482 - DNA, 23 bp, Homo sapiens
aggcactgaatgtgtcagtgagt

SEQ ID NO: 7923483 - DNA, 22 bp, Homo sapiens
aggcactgacaattctggactg

SEQ ID NO: 7923484 - DNA, 22 bp, Homo sapiens
aggcactgacaattctggactg

SEQ ID NO: 7923485 - DNA, 22 bp, Homo sapiens
aggcactgacagattctgtgtc

SEQ ID NO: 7923486 - DNA, 22 bp, Homo sapiens
aggcactgacagattctgtgtc

SEQ ID NO: 7923487 - DNA, 22 bp, Homo sapiens
aggcactgacaattctggactg

SEQ ID NO: 7923488 - DNA, 22 bp, Homo sapiens
aggcactgacaattctggactg

SEQ ID NO: 7923489 - DNA, 22 bp, Homo sapiens
aggcactgacctgcttccttga

SEQ ID NO: 7923490 - DNA, 22 bp, Homo sapiens
aggcactgacagattctgtgtc

SEQ ID NO: 7923491 - DNA, 22 bp, Homo sapiens
aggcactgacagattctgtgtc

SEQ ID NO: 7923492 - DNA, 22 bp, Homo sapiens
aggcactgacagattctgtgtc

SEQ ID NO: 7923493 - DNA, 22 bp, Homo sapiens
aggcactgacagattctgtgtc

SEQ ID NO: 7923494 - DNA, 22 bp, Homo sapiens
aggcactgattctcagagttac

SEQ ID NO: 7923495 - DNA, 22 bp, Homo sapiens
aggcactgattctgttttccat

SEQ ID NO: 7923496 - DNA, 22 bp, Homo sapiens
aggcactgattctcagagttac

SEQ ID NO: 7923497 - DNA, 22 bp, Homo sapiens
aggcactttaggatcaggttga

SEQ ID NO: 7923498 - DNA, 22 bp, Homo sapiens
aggcactgattctgttttccat

SEQ ID NO: 7923499 - DNA, 22 bp, Homo sapiens
aggcactgcagattacaggcgc

SEQ ID NO: 7923500 - DNA, 22 bp, Homo sapiens
aggcactttgaaatttggagct

SEQ ID NO: 7923501 - DNA, 22 bp, Homo sapiens
aggcactttgaaatttggagct

SEQ ID NO: 7923502 - DNA, 22 bp, Homo sapiens
aggcagagagcagtggccgtct

SEQ ID NO: 7923503 - DNA, 22 bp, Homo sapiens
aggcactttccttgaggagttt

SEQ ID NO: 7923504 - DNA, 22 bp, Homo sapiens
aggcactttccttgaggagttt

SEQ ID NO: 7923505 - DNA, 22 bp, Homo sapiens
aggcactttctgtatgctagtt

SEQ ID NO: 7923506 - DNA, 22 bp, Homo sapiens
aggcactttctgtatgctagtt

SEQ ID NO: 7923507 - DNA, 16 bp, Homo sapiens
aggcagagatttaccc

SEQ ID NO: 7923508 - DNA, 16 bp, Homo sapiens
aggcagagatttaccc

SEQ ID NO: 7923509 - DNA, 22 bp, Homo sapiens
aggcagagagcagtggccgtct

SEQ ID NO: 7923510 - DNA, 22 bp, Homo sapiens
aggcagagagcagtggccgtct

SEQ ID NO: 7923511 - DNA, 22 bp, Homo sapiens
aggcagagagcagtggccgtct

SEQ ID NO: 7923512 - DNA, 22 bp, Homo sapiens
aggcagagagcagtggccgtct

SEQ ID NO: 7923513 - DNA, 22 bp, Homo sapiens
aggcagagagcagtggccgtct

SEQ ID NO: 7923514 - DNA, 22 bp, Homo sapiens
aggcagagagcagtggccgtct

SEQ ID NO: 7923515 - DNA, 22 bp, Homo sapiens
aggcactgaaggaagcttgcgc

SEQ ID NO: 7923516 - DNA, 22 bp, Homo sapiens
aggcactgaaggaagcttgcgc

SEQ ID NO: 7923517 - DNA, 22 bp, Homo sapiens
aggcactgaaggaagcttgcgc

SEQ ID NO: 7923518 - DNA, 22 bp, Homo sapiens
aggcactgaaggaagcttgcgc

SEQ ID NO: 7923519 - DNA, 22 bp, Homo sapiens
aggcactgaaaggtggccagag

SEQ ID NO: 7923520 - DNA, 22 bp, Homo sapiens
aggcactgaaggaagcttgcgc

SEQ ID NO: 7923521 - DNA, 22 bp, Homo sapiens
aggcactgaaggaagcttgcgc

SEQ ID NO: 7923522 - DNA, 22 bp, Homo sapiens
aggcactgaagtggtaaatgta

SEQ ID NO: 7923523 - DNA, 22 bp, Homo sapiens
aggcactgaagtggtaaatgta

SEQ ID NO: 7923524 - DNA, 22 bp, Homo sapiens
aggcactgaagtggtaaatgta

SEQ ID NO: 7923525 - DNA, 22 bp, Homo sapiens
aggcactgaagtggtaaatgta

SEQ ID NO: 7923526 - DNA, 22 bp, Homo sapiens
aggcactgaatatccagtaaaa

SEQ ID NO: 7923527 - DNA, 22 bp, Homo sapiens
aggcactgaagtggtaaatgta

SEQ ID NO: 7923528 - DNA, 23 bp, Homo sapiens
aggcactgaatgtgtcagtgagt

SEQ ID NO: 7923529 - DNA, 22 bp, Homo sapiens
aggcactgaatatccagtaaaa

SEQ ID NO: 7923530 - DNA, 22 bp, Homo sapiens
aggcactgaatatccagtaaaa

SEQ ID NO: 7923531 - DNA, 22 bp, Homo sapiens
aggcactgaatatccagtaaaa

SEQ ID NO: 7923532 - DNA, 22 bp, Homo sapiens
aggcactgaagaactctttttg

SEQ ID NO: 7923533 - DNA, 22 bp, Homo sapiens
aggcactgaagaactctttttg

SEQ ID NO: 7923534 - DNA, 22 bp, Homo sapiens
aggcactgaagaactctttttg

SEQ ID NO: 7923535 - DNA, 22 bp, Homo sapiens
aggcactgaaaggtggccagag

SEQ ID NO: 7923536 - DNA, 22 bp, Homo sapiens
aggcactgaagaactctttttg

SEQ ID NO: 7923537 - DNA, 22 bp, Homo sapiens
aggcactgaaaggtggccagag

SEQ ID NO: 7923538 - DNA, 22 bp, Homo sapiens
aggcactgaaaggtggccagag

SEQ ID NO: 7923539 - DNA, 22 bp, Homo sapiens
aggcactgaaaggtggccagag

SEQ ID NO: 7923540 - DNA, 22 bp, Homo sapiens
aggcacataatcatcctagcta

SEQ ID NO: 7923541 - DNA, 20 bp, Homo sapiens
aggcacagttcctagttggg

SEQ ID NO: 7923542 - DNA, 22 bp, Homo sapiens
aggcacagtttcatccccgggc

SEQ ID NO: 7923543 - DNA, 19 bp, Homo sapiens
aggcacaggttgtctggac

SEQ ID NO: 7923544 - DNA, 19 bp, Homo sapiens
aggcacaggttgtctggac

SEQ ID NO: 7923545 - DNA, 22 bp, Homo sapiens
aggcacagtgcctggaatcaaa

SEQ ID NO: 7923546 - DNA, 22 bp, Homo sapiens
aggcacagtgcctggaatcaaa

SEQ ID NO: 7923547 - DNA, 22 bp, Homo sapiens
aggcacagtgcctggaatcaaa

SEQ ID NO: 7923548 - DNA, 22 bp, Homo sapiens
aggcacagtgcctggaatcaaa

SEQ ID NO: 7923549 - DNA, 19 bp, Homo sapiens
aggcacaggttgtctggac

SEQ ID NO: 7923550 - DNA, 19 bp, Homo sapiens
aggcacaggttgtctggac

SEQ ID NO: 7923551 - DNA, 19 bp, Homo sapiens
aggcacaggttgtctggac

SEQ ID NO: 7923552 - DNA, 19 bp, Homo sapiens
aggcacaggttgtctggac

SEQ ID NO: 7923553 - DNA, 19 bp, Homo sapiens
aggcacaggttgtctggac

SEQ ID NO: 7923554 - DNA, 22 bp, Homo sapiens
aggcacaggtggacttcacagt

SEQ ID NO: 7923555 - DNA, 19 bp, Homo sapiens
aggcacaggttgtctggac

SEQ ID NO: 7923556 - DNA, 22 bp, Homo sapiens
aggcacaggtggacttcacagt

SEQ ID NO: 7923557 - DNA, 22 bp, Homo sapiens
aggcacaggtggacttcacagt

SEQ ID NO: 7923558 - DNA, 20 bp, Homo sapiens
aggcacagttcctagttggg

SEQ ID NO: 7923559 - DNA, 20 bp, Homo sapiens
aggcacagttcctagttggg

SEQ ID NO: 7923560 - DNA, 20 bp, Homo sapiens
aggcacagttcctagttggg

SEQ ID NO: 7923561 - DNA, 20 bp, Homo sapiens
aggcacagttcctagttggg

SEQ ID NO: 7923562 - DNA, 20 bp, Homo sapiens
aggcacagttcctagttggg

SEQ ID NO: 7923563 - DNA, 20 bp, Homo sapiens
aggcacagttcctagttggg

SEQ ID NO: 7923564 - DNA, 22 bp, Homo sapiens
aggcacagtggctcacacctgt

SEQ ID NO: 7923565 - DNA, 22 bp, Homo sapiens
aggcacagtggctcacacctgt

SEQ ID NO: 7923566 - DNA, 22 bp, Homo sapiens
aggcacagtgcctggaatcaaa

SEQ ID NO: 7923567 - DNA, 22 bp, Homo sapiens
aggcacagtgcctggaatcaaa

SEQ ID NO: 7923568 - DNA, 22 bp, Homo sapiens
aggcacagtgcctggaatcaaa

SEQ ID NO: 7923569 - DNA, 22 bp, Homo sapiens
aggcacagtggccctgtttggg

SEQ ID NO: 7923570 - DNA, 22 bp, Homo sapiens
aggcacagtggccctgtttggg

SEQ ID NO: 7923571 - DNA, 22 bp, Homo sapiens
aggcacagtggctcacacctgt

SEQ ID NO: 7923572 - DNA, 22 bp, Homo sapiens
aggcacagtggctcacacctgt

SEQ ID NO: 7923573 - DNA, 22 bp, Homo sapiens
aggcacagtggccctgtttggg

SEQ ID NO: 7923574 - DNA, 22 bp, Homo sapiens
aggcacagtggctcacacctgt

SEQ ID NO: 7923575 - DNA, 21 bp, Homo sapiens
aggcaggattcaaacacagag

SEQ ID NO: 7923576 - DNA, 23 bp, Homo sapiens
aggcaggcagttcagctgttgtt

SEQ ID NO: 7923577 - DNA, 22 bp, Homo sapiens
aggcaggcccctgagaatagac

SEQ ID NO: 7923578 - DNA, 22 bp, Homo sapiens
aggcaggcccctgagaatagac

SEQ ID NO: 7923579 - DNA, 22 bp, Homo sapiens
aggcaggcccctgagaatagac

SEQ ID NO: 7923580 - DNA, 22 bp, Homo sapiens
aggcaggcccctgagaatagac

SEQ ID NO: 7923581 - DNA, 22 bp, Homo sapiens
aggcaggccctctggaaaggta

SEQ ID NO: 7923582 - DNA, 22 bp, Homo sapiens
aggcaggcccctgagaatagac

SEQ ID NO: 7923583 - DNA, 22 bp, Homo sapiens
aggcaggcccctgagaatagac

SEQ ID NO: 7923584 - DNA, 22 bp, Homo sapiens
aggcaggcccctgagaatagac

SEQ ID NO: 7923585 - DNA, 21 bp, Homo sapiens
ccaaagaactgccatttgtca

SEQ ID NO: 7923586 - DNA, 21 bp, Homo sapiens
ccaaagaactgccatttgtca

SEQ ID NO: 7923587 - DNA, 21 bp, Homo sapiens
ccaaagaactgccatttgtca

SEQ ID NO: 7923588 - DNA, 22 bp, Homo sapiens
ccaaagagctagaattataggc

SEQ ID NO: 7923589 - DNA, 22 bp, Homo sapiens
ccaaagagctagaattataggc

SEQ ID NO: 7923590 - DNA, 18 bp, Homo sapiens
aggcaggatcctggcctc

SEQ ID NO: 7923591 - DNA, 18 bp, Homo sapiens
aggcaggatcctggcctc

SEQ ID NO: 7923592 - DNA, 21 bp, Homo sapiens
aggcaggattcaaacacagag

SEQ ID NO: 7923593 - DNA, 18 bp, Homo sapiens
aggcaggatcctggcctc

SEQ ID NO: 7923594 - DNA, 21 bp, Homo sapiens
aggcaggattcaaacacagag

SEQ ID NO: 7923595 - DNA, 21 bp, Homo sapiens
aggcaggattcaaacacagag

SEQ ID NO: 7923596 - DNA, 22 bp, Homo sapiens
ccaaacaaatccccattcttag

SEQ ID NO: 7923597 - DNA, 22 bp, Homo sapiens
ccaaacatttcaaatttagaga

SEQ ID NO: 7923598 - DNA, 22 bp, Homo sapiens
ccaaacaaatccccattcttag

SEQ ID NO: 7923599 - DNA, 22 bp, Homo sapiens
ccaaacaaatccccattcttag

SEQ ID NO: 7923600 - DNA, 22 bp, Homo sapiens
ccaaaattattacatttgtagg

SEQ ID NO: 7923601 - DNA, 22 bp, Homo sapiens
ccaaaccatccatctccaggct

SEQ ID NO: 7923602 - DNA, 22 bp, Homo sapiens
ccaaagaaacccaagctcaggg

SEQ ID NO: 7923603 - DNA, 22 bp, Homo sapiens
ccaaagaaacccaagctcaggg

SEQ ID NO: 7923604 - DNA, 22 bp, Homo sapiens
ccaaagaaacccaagctcaggg

SEQ ID NO: 7923605 - DNA, 22 bp, Homo sapiens
ccaaaatattagtgcttaagta

SEQ ID NO: 7923606 - DNA, 22 bp, Homo sapiens
ccaaaatgtttgaatgcatgtg

SEQ ID NO: 7923607 - DNA, 22 bp, Homo sapiens
ccaaaattattacatttgtagg

SEQ ID NO: 7923608 - DNA, 22 bp, Homo sapiens
ccaaaattaagcctcttatgtt

SEQ ID NO: 7923609 - DNA, 22 bp, Homo sapiens
ccaaaatgtttgaatgcatgtg

SEQ ID NO: 7923610 - DNA, 22 bp, Homo sapiens
ccaaaattaagcctcttatgtt

SEQ ID NO: 7923611 - DNA, 22 bp, Homo sapiens
ccaaaataacagcccaattcac

SEQ ID NO: 7923612 - DNA, 22 bp, Homo sapiens
ccaaaatattagtgcttaagta

SEQ ID NO: 7923613 - DNA, 22 bp, Homo sapiens
ccaaaataacagcccaattcac

SEQ ID NO: 7923614 - DNA, 22 bp, Homo sapiens
ccaaaatattagtgcttaagta

SEQ ID NO: 7923615 - DNA, 22 bp, Homo sapiens
ccaaaatattagtgcttaagta

SEQ ID NO: 7923616 - DNA, 22 bp, Homo sapiens
aggcaggctagtcgcttgagcc

SEQ ID NO: 7923617 - DNA, 22 bp, Homo sapiens
aggcaggctagtcgcttgagcc

SEQ ID NO: 7923618 - DNA, 22 bp, Homo sapiens
aggcaggctcaatgcccagtct

SEQ ID NO: 7923619 - DNA, 22 bp, Homo sapiens
aggcaggctagtcgcttgagcc

SEQ ID NO: 7923620 - DNA, 22 bp, Homo sapiens
aggcaggctcaatgcccagtct

SEQ ID NO: 7923621 - DNA, 22 bp, Homo sapiens
aggcaggctcaatgcccagtct

SEQ ID NO: 7923622 - DNA, 22 bp, Homo sapiens
aggcaggctcaatgcccagtct

SEQ ID NO: 7923623 - DNA, 22 bp, Homo sapiens
aggcaggctcaggcccatgctt

SEQ ID NO: 7923624 - DNA, 22 bp, Homo sapiens
aggcaggctgctatggagtaga

SEQ ID NO: 7923625 - DNA, 22 bp, Homo sapiens
aggcaggctgctatggagtaga

SEQ ID NO: 7923626 - DNA, 22 bp, Homo sapiens
aggcaggctgctatggagtaga

SEQ ID NO: 7923627 - DNA, 22 bp, Homo sapiens
aggcaggctgctatggagtaga

SEQ ID NO: 7923628 - DNA, 22 bp, Homo sapiens
aggcaggctctgggtatgtgca

SEQ ID NO: 7923629 - DNA, 22 bp, Homo sapiens
aggcaggctgctatggagtaga

SEQ ID NO: 7923630 - DNA, 22 bp, Homo sapiens
aggcaggctgctatggagtaga

SEQ ID NO: 7923631 - DNA, 22 bp, Homo sapiens
aggcaggctctgggtatgtgca

SEQ ID NO: 7923632 - DNA, 22 bp, Homo sapiens
aggcaggctctgggtatgtgca

SEQ ID NO: 7923633 - DNA, 22 bp, Homo sapiens
aggcaggctctgggtatgtgca

SEQ ID NO: 7923634 - DNA, 22 bp, Homo sapiens
aggcaggctcaggcccatgctt

SEQ ID NO: 7923635 - DNA, 22 bp, Homo sapiens
aggcaggccgtgtccctcctca

SEQ ID NO: 7923636 - DNA, 22 bp, Homo sapiens
aggcaggcctacacaatgggag

SEQ ID NO: 7923637 - DNA, 22 bp, Homo sapiens
aggcaggcctacacaatgggag

SEQ ID NO: 7923638 - DNA, 22 bp, Homo sapiens
aggcaggcctacacaatgggag

SEQ ID NO: 7923639 - DNA, 22 bp, Homo sapiens
aggcaggcctacacaatgggag

SEQ ID NO: 7923640 - DNA, 22 bp, Homo sapiens
aggcaggcctacacaatgggag

SEQ ID NO: 7923641 - DNA, 18 bp, Homo sapiens
aggcaggcggatcacaag

SEQ ID NO: 7923642 - DNA, 22 bp, Homo sapiens
aggcaggcctacacaatgggag

SEQ ID NO: 7923643 - DNA, 18 bp, Homo sapiens
aggcaggcggatcacaag

SEQ ID NO: 7923644 - DNA, 18 bp, Homo sapiens
aggcaggcggatcacaag

SEQ ID NO: 7923645 - DNA, 18 bp, Homo sapiens
aggcaggcggatcacaag

SEQ ID NO: 7923646 - DNA, 18 bp, Homo sapiens
aggcaggcggatcacaag

SEQ ID NO: 7923647 - DNA, 22 bp, Homo sapiens
aggcaggccctgggccatcccg

SEQ ID NO: 7923648 - DNA, 22 bp, Homo sapiens
aggcaggccgtgtccctcctca

SEQ ID NO: 7923649 - DNA, 22 bp, Homo sapiens
aggcaggccctgggccatcccg

SEQ ID NO: 7923650 - DNA, 22 bp, Homo sapiens
aggcaggccctgggccatcccg

SEQ ID NO: 7923651 - DNA, 22 bp, Homo sapiens
aggcaggccctctggaaaggta

SEQ ID NO: 7923652 - DNA, 22 bp, Homo sapiens
aggcaggccctctggaaaggta

SEQ ID NO: 7923653 - DNA, 22 bp, Homo sapiens
aggcaggccctgggccatcccg

SEQ ID NO: 7923654 - DNA, 22 bp, Homo sapiens
aggcaggccctctggaaaggta

SEQ ID NO: 7923655 - DNA, 22 bp, Homo sapiens
aggcaggccctctggaaaggta

SEQ ID NO: 7923656 - DNA, 22 bp, Homo sapiens
aggcaggaaaatcgcttgaacc

SEQ ID NO: 7923657 - DNA, 22 bp, Homo sapiens
aggcagctttgtagtaaagcta

SEQ ID NO: 7923658 - DNA, 22 bp, Homo sapiens
aggcagctttgtagtaaagcta

SEQ ID NO: 7923659 - DNA, 22 bp, Homo sapiens
aggcagctttgtagtaaagcta

SEQ ID NO: 7923660 - DNA, 22 bp, Homo sapiens
aggcagctttgtagtaaagcta

SEQ ID NO: 7923661 - DNA, 22 bp, Homo sapiens
aggcagctttgtagtaaagcta

SEQ ID NO: 7923662 - DNA, 22 bp, Homo sapiens
aggcagctttctgtaggggtgt

SEQ ID NO: 7923663 - DNA, 22 bp, Homo sapiens
aggcagctttctgtaggggtgt

SEQ ID NO: 7923664 - DNA, 22 bp, Homo sapiens
aggcagctttctgtaggggtgt

SEQ ID NO: 7923665 - DNA, 22 bp, Homo sapiens
aggcagctttctggtgcaccat

SEQ ID NO: 7923666 - DNA, 22 bp, Homo sapiens
aggcagctttctggtgcaccat

SEQ ID NO: 7923667 - DNA, 22 bp, Homo sapiens
aggcagctttcagtgtctctca

SEQ ID NO: 7923668 - DNA, 22 bp, Homo sapiens
aggcagctttctggtgcaccat

SEQ ID NO: 7923669 - DNA, 22 bp, Homo sapiens
aggcagctttctggtgcaccat

SEQ ID NO: 7923670 - DNA, 22 bp, Homo sapiens
aggcagctttcagtgtctctca

SEQ ID NO: 7923671 - DNA, 22 bp, Homo sapiens
aggcagctttcagtgtctctca

SEQ ID NO: 7923672 - DNA, 22 bp, Homo sapiens
aggcagcttaagccctggccca

SEQ ID NO: 7923673 - DNA, 22 bp, Homo sapiens
aggcagcttaagccctggccca

SEQ ID NO: 7923674 - DNA, 22 bp, Homo sapiens
aggcagcttaagccctggccca

SEQ ID NO: 7923675 - DNA, 22 bp, Homo sapiens
aggcagcttaagccctggccca

SEQ ID NO: 7923676 - DNA, 22 bp, Homo sapiens
aggcagctgtgaggactggatt

SEQ ID NO: 7923677 - DNA, 22 bp, Homo sapiens
aggcagcttctgattagcagcg

SEQ ID NO: 7923678 - DNA, 22 bp, Homo sapiens
aggcagcttctgattagcagcg

SEQ ID NO: 7923679 - DNA, 22 bp, Homo sapiens
aggcagcttctgattagcagcg

SEQ ID NO: 7923680 - DNA, 22 bp, Homo sapiens
aggcagctttaactggtagtag

SEQ ID NO: 7923681 - DNA, 22 bp, Homo sapiens
aggcagctttaactggtagtag

SEQ ID NO: 7923682 - DNA, 22 bp, Homo sapiens
aggcagctttcagtgtctctca

SEQ ID NO: 7923683 - DNA, 22 bp, Homo sapiens
aggcagctttcagtgtctctca

SEQ ID NO: 7923684 - DNA, 22 bp, Homo sapiens
aggcagctttcagtgtctctca

SEQ ID NO: 7923685 - DNA, 22 bp, Homo sapiens
aggcagcttctgattagcagcg

SEQ ID NO: 7923686 - DNA, 22 bp, Homo sapiens
aggcagcttctgattagcagcg

SEQ ID NO: 7923687 - DNA, 22 bp, Homo sapiens
aggcagcttctgattagcagcg

SEQ ID NO: 7923688 - DNA, 22 bp, Homo sapiens
aggcagctttaactggtagtag

SEQ ID NO: 7923689 - DNA, 22 bp, Homo sapiens
aggcagctttaactggtagtag

SEQ ID NO: 7923690 - DNA, 21 bp, Homo sapiens
aggcagcgtgagggccactca

SEQ ID NO: 7923691 - DNA, 21 bp, Homo sapiens
aggcagcgtgagggccactca

SEQ ID NO: 7923692 - DNA, 22 bp, Homo sapiens
aggcagctggcaaattctagag

SEQ ID NO: 7923693 - DNA, 22 bp, Homo sapiens
aggcagctggcagcacccaggg

SEQ ID NO: 7923694 - DNA, 22 bp, Homo sapiens
aggcagctggcagcacccaggg

SEQ ID NO: 7923695 - DNA, 22 bp, Homo sapiens
aggcagctggcagcacccaggg

SEQ ID NO: 7923696 - DNA, 22 bp, Homo sapiens
aggcagctggcagcacccaggg

SEQ ID NO: 7923697 - DNA, 22 bp, Homo sapiens
aggcagcgtagcaaggctagta

SEQ ID NO: 7923698 - DNA, 22 bp, Homo sapiens
aggcagcgtagcaaggctagta

SEQ ID NO: 7923699 - DNA, 19 bp, Homo sapiens
aggcagaggcttggctagc

SEQ ID NO: 7923700 - DNA, 19 bp, Homo sapiens
aggcagaggcttggctagc

SEQ ID NO: 7923701 - DNA, 21 bp, Homo sapiens
aggcagcgattttcatattgc

SEQ ID NO: 7923702 - DNA, 22 bp, Homo sapiens
aggcagctgtgaggactggatt

SEQ ID NO: 7923703 - DNA, 22 bp, Homo sapiens
aggcagctgtgaggactggatt

SEQ ID NO: 7923704 - DNA, 22 bp, Homo sapiens
aggcagctgtgaggactggatt

SEQ ID NO: 7923705 - DNA, 22 bp, Homo sapiens
aggcagctgtgaggactggatt

SEQ ID NO: 7923706 - DNA, 22 bp, Homo sapiens
aggcagctgtgaggactggatt

SEQ ID NO: 7923707 - DNA, 20 bp, Homo sapiens
aggcagctgggaaatgaggg

SEQ ID NO: 7923708 - DNA, 23 bp, Homo sapiens
aggcagctgggtagcatctttct

SEQ ID NO: 7923709 - DNA, 23 bp, Homo sapiens
aggcagctgggtagcatctttct

SEQ ID NO: 7923710 - DNA, 20 bp, Homo sapiens
aggcagctggccaggcaggt

SEQ ID NO: 7923711 - DNA, 20 bp, Homo sapiens
aggcagctgggaaatgaggg

SEQ ID NO: 7923712 - DNA, 20 bp, Homo sapiens
aggcagctgggaaatgaggg

SEQ ID NO: 7923713 - DNA, 20 bp, Homo sapiens
aggcagctgggaaatgaggg

SEQ ID NO: 7923714 - DNA, 20 bp, Homo sapiens
aggcagctggccaggcaggt

SEQ ID NO: 7923715 - DNA, 20 bp, Homo sapiens
aggcagctggccaggcaggt

SEQ ID NO: 7923716 - DNA, 20 bp, Homo sapiens
aggcagctggccaggcaggt

SEQ ID NO: 7923717 - DNA, 20 bp, Homo sapiens
aggcagctggccaggcaggt

SEQ ID NO: 7923718 - DNA, 20 bp, Homo sapiens
aggcagctggccaggcaggt

SEQ ID NO: 7923719 - DNA, 20 bp, Homo sapiens
aggcagctggccaggcaggt

SEQ ID NO: 7923720 - DNA, 22 bp, Homo sapiens
aggcagagctgggttttgaaat

SEQ ID NO: 7923721 - DNA, 22 bp, Homo sapiens
aggcagagctgggttttgaaat

SEQ ID NO: 7923722 - DNA, 22 bp, Homo sapiens
aggcagagctgggttttgaaat

SEQ ID NO: 7923723 - DNA, 22 bp, Homo sapiens
aggcagaggaagggtggatttg

SEQ ID NO: 7923724 - DNA, 22 bp, Homo sapiens
aggcagagctgggttttgaaat

SEQ ID NO: 7923725 - DNA, 22 bp, Homo sapiens
aggcagaggaagggtggatttg

SEQ ID NO: 7923726 - DNA, 22 bp, Homo sapiens
aggcagaggaagggtggatttg

SEQ ID NO: 7923727 - DNA, 22 bp, Homo sapiens
aggcagaggaagggtggatttg

SEQ ID NO: 7923728 - DNA, 22 bp, Homo sapiens
aggcagaggagaatgatcttcc

SEQ ID NO: 7923729 - DNA, 22 bp, Homo sapiens
aggcagaggagaatgatcttcc

SEQ ID NO: 7923730 - DNA, 22 bp, Homo sapiens
aggcagaggagaatgatcttcc

SEQ ID NO: 7923731 - DNA, 22 bp, Homo sapiens
aggcagaggaagggtggatttg

SEQ ID NO: 7923732 - DNA, 22 bp, Homo sapiens
aggcagaggagaatgatcttcc

SEQ ID NO: 7923733 - DNA, 22 bp, Homo sapiens
aggcagaggagaatgatcttcc

SEQ ID NO: 7923734 - DNA, 22 bp, Homo sapiens
aggcagaggagaatgatcttcc

SEQ ID NO: 7923735 - DNA, 22 bp, Homo sapiens
aggcagaggagaatgatcttcc

SEQ ID NO: 7923736 - DNA, 22 bp, Homo sapiens
aggcagaggagaatgatcttcc

SEQ ID NO: 7923737 - DNA, 19 bp, Homo sapiens
aggcagaggcttggctagc

SEQ ID NO: 7923738 - DNA, 22 bp, Homo sapiens
aggcagaggagaatgatcttcc

SEQ ID NO: 7923739 - DNA, 19 bp, Homo sapiens
aggcagaggcttggctagc

SEQ ID NO: 7923740 - DNA, 20 bp, Homo sapiens
aggcagagcgcacttttaga

SEQ ID NO: 7923741 - DNA, 20 bp, Homo sapiens
aggcagagcgcacttttaga

SEQ ID NO: 7923742 - DNA, 20 bp, Homo sapiens
aggcagagcgcacttttaga

SEQ ID NO: 7923743 - DNA, 23 bp, Homo sapiens
aggcagagccaaggtcaaaaccc

SEQ ID NO: 7923744 - DNA, 22 bp, Homo sapiens
aggcagagctaggaagaattgt

SEQ ID NO: 7923745 - DNA, 20 bp, Homo sapiens
aggcagagcgcacttttaga

SEQ ID NO: 7923746 - DNA, 22 bp, Homo sapiens
aggcagagctaggaagaattgt

SEQ ID NO: 7923747 - DNA, 22 bp, Homo sapiens
aggcagagctaggaagaattgt

SEQ ID NO: 7923748 - DNA, 20 bp, Homo sapiens
aggcagagcgcacttttaga

SEQ ID NO: 7923749 - DNA, 20 bp, Homo sapiens
aggcagagcgcacttttaga

SEQ ID NO: 7923750 - DNA, 22 bp, Homo sapiens
aggcagagctgatgttctgtga

SEQ ID NO: 7923751 - DNA, 22 bp, Homo sapiens
aggcagagctaggaagaattgt

SEQ ID NO: 7923752 - DNA, 22 bp, Homo sapiens
aggcagagctgatgttctgtga

SEQ ID NO: 7923753 - DNA, 22 bp, Homo sapiens
aggcagagctaggaagaattgt

SEQ ID NO: 7923754 - DNA, 22 bp, Homo sapiens
aggcagagctaggaagaattgt

SEQ ID NO: 7923755 - DNA, 22 bp, Homo sapiens
aggcagagctgatgttctgtga

SEQ ID NO: 7923756 - DNA, 22 bp, Homo sapiens
aggcagagctgatgttctgtga

SEQ ID NO: 7923757 - DNA, 22 bp, Homo sapiens
aggcagagctgatgttctgtga

SEQ ID NO: 7923758 - DNA, 22 bp, Homo sapiens
aggcagagctgatgttctgtga

SEQ ID NO: 7923759 - DNA, 22 bp, Homo sapiens
aggcagagctaggaagaattgt

SEQ ID NO: 7923760 - DNA, 22 bp, Homo sapiens
cagtgcaggaagtgagatgcct

SEQ ID NO: 7923761 - DNA, 22 bp, Homo sapiens
cagtgcaggaagtgagatgcct

SEQ ID NO: 7923762 - DNA, 22 bp, Homo sapiens
cagtgcaggaagtgagatgcct

SEQ ID NO: 7923763 - DNA, 22 bp, Homo sapiens
cagtgcaggctgggggccctgc

SEQ ID NO: 7923764 - DNA, 22 bp, Homo sapiens
cagtgcaggctgggggccctgc

SEQ ID NO: 7923765 - DNA, 22 bp, Homo sapiens
cagtgcaggaagtgagatgcct

SEQ ID NO: 7923766 - DNA, 22 bp, Homo sapiens
cagtgcaggaagtgagatgcct

SEQ ID NO: 7923767 - DNA, 22 bp, Homo sapiens
cagtgcaggaagtgagatgcct

SEQ ID NO: 7923768 - DNA, 22 bp, Homo sapiens
cagtgcaggaagtgagatgcct

SEQ ID NO: 7923769 - DNA, 22 bp, Homo sapiens
cagtgcaggaagtgagatgcct

SEQ ID NO: 7923770 - DNA, 22 bp, Homo sapiens
cagtgcaggaagtgagatgcct

SEQ ID NO: 7923771 - DNA, 22 bp, Homo sapiens
cagtgcagctgccccgctggta

SEQ ID NO: 7923772 - DNA, 22 bp, Homo sapiens
cagtgcagctgccccgctggta

SEQ ID NO: 7923773 - DNA, 22 bp, Homo sapiens
cagtgcagccaaggacaggcac

SEQ ID NO: 7923774 - DNA, 22 bp, Homo sapiens
cagtgcagctgccccgctggta

SEQ ID NO: 7923775 - DNA, 22 bp, Homo sapiens
cagtgcagctgccccgctggta

SEQ ID NO: 7923776 - DNA, 22 bp, Homo sapiens
cagtgcagccaaggacaggcac

SEQ ID NO: 7923777 - DNA, 22 bp, Homo sapiens
cagtgcagccaaggacaggcac

SEQ ID NO: 7923778 - DNA, 22 bp, Homo sapiens
cagtgcagccaaggacaggcac

SEQ ID NO: 7923779 - DNA, 17 bp, Homo sapiens
cagtgcagataagtgag

SEQ ID NO: 7923780 - DNA, 22 bp, Homo sapiens
cagtgcagccaaggacaggcac

SEQ ID NO: 7923781 - DNA, 22 bp, Homo sapiens
cagtgcagccaaggacaggcac

SEQ ID NO: 7923782 - DNA, 23 bp, Homo sapiens
cagtgcagggcaactcagactcc

SEQ ID NO: 7923783 - DNA, 23 bp, Homo sapiens
cagtgcagggcaactcagactcc

SEQ ID NO: 7923784 - DNA, 22 bp, Homo sapiens
cagtgcaggcttgtggccgcag

SEQ ID NO: 7923785 - DNA, 23 bp, Homo sapiens
cagtgcagggcaactcagactcc

SEQ ID NO: 7923786 - DNA, 22 bp, Homo sapiens
cagtgcaggctgggggccctgc

SEQ ID NO: 7923787 - DNA, 22 bp, Homo sapiens
cagtgcaggctgggggccctgc

SEQ ID NO: 7923788 - DNA, 22 bp, Homo sapiens
cagtgcaggctgggggccctgc

SEQ ID NO: 7923789 - DNA, 22 bp, Homo sapiens
cagtgcaggcttgtggccgcag

SEQ ID NO: 7923790 - DNA, 22 bp, Homo sapiens
cagtgcaggctgggggccctgc

SEQ ID NO: 7923791 - DNA, 22 bp, Homo sapiens
cagtgcaggcttgtggccgcag

SEQ ID NO: 7923792 - DNA, 20 bp, Homo sapiens
aggagatgatccagagtcag

SEQ ID NO: 7923793 - DNA, 20 bp, Homo sapiens
aggagatgatccagagtcag

SEQ ID NO: 7923794 - DNA, 20 bp, Homo sapiens
aggagatgatccagagtcag

SEQ ID NO: 7923795 - DNA, 20 bp, Homo sapiens
aggagatgatccagagtcag

SEQ ID NO: 7923796 - DNA, 21 bp, Homo sapiens
cagtgcaggggttagcgtgta

SEQ ID NO: 7923797 - DNA, 21 bp, Homo sapiens
cagtgcaggggttagcgtgta

SEQ ID NO: 7923798 - DNA, 23 bp, Homo sapiens
cagtgcagggcaactcagactcc

SEQ ID NO: 7923799 - DNA, 23 bp, Homo sapiens
cagtgcagggcaactcagactcc

SEQ ID NO: 7923800 - DNA, 21 bp, Homo sapiens
cagtgcaggggttagcgtgta

SEQ ID NO: 7923801 - DNA, 22 bp, Homo sapiens
cagtgagggcattcagtgctgg

SEQ ID NO: 7923802 - DNA, 22 bp, Homo sapiens
cagtgagggcattcagtgctgg

SEQ ID NO: 7923803 - DNA, 22 bp, Homo sapiens
cagtgagggcattcagtgctgg

SEQ ID NO: 7923804 - DNA, 22 bp, Homo sapiens
cagtgagggcattcagtgctgg

SEQ ID NO: 7923805 - DNA, 22 bp, Homo sapiens
cagtgagggcattcagtgctgg

SEQ ID NO: 7923806 - DNA, 22 bp, Homo sapiens
cagtgagggaagatctcagcac

SEQ ID NO: 7923807 - DNA, 22 bp, Homo sapiens
cagtgagggcattcagtgctgg

SEQ ID NO: 7923808 - DNA, 22 bp, Homo sapiens
cagtgagggcccccttccaggt

SEQ ID NO: 7923809 - DNA, 22 bp, Homo sapiens
cagtgagggcccccttccaggt

SEQ ID NO: 7923810 - DNA, 22 bp, Homo sapiens
cagtgagggcccccttccaggt

SEQ ID NO: 7923811 - DNA, 17 bp, Homo sapiens
cagtgcagataagtgag

SEQ ID NO: 7923812 - DNA, 22 bp, Homo sapiens
cagtgagggcccccttccaggt

SEQ ID NO: 7923813 - DNA, 17 bp, Homo sapiens
cagtgcagataagtgag

SEQ ID NO: 7923814 - DNA, 22 bp, Homo sapiens
cagtgcagccaaggacaggcac

SEQ ID NO: 7923815 - DNA, 22 bp, Homo sapiens
cagtgcagccaaggacaggcac

SEQ ID NO: 7923816 - DNA, 22 bp, Homo sapiens
cagtgcagccaaggacaggcac

SEQ ID NO: 7923817 - DNA, 17 bp, Homo sapiens
cagtgcagataagtgag

SEQ ID NO: 7923818 - DNA, 22 bp, Homo sapiens
cagtgcagccaaggacaggcac

SEQ ID NO: 7923819 - DNA, 22 bp, Homo sapiens
cagtgaggctctgctgagcggt

SEQ ID NO: 7923820 - DNA, 22 bp, Homo sapiens
cagtgaggctctgctgagcggt

SEQ ID NO: 7923821 - DNA, 22 bp, Homo sapiens
cagtgagggaagatctcagcac

SEQ ID NO: 7923822 - DNA, 22 bp, Homo sapiens
cagtgagggaagatctcagcac

SEQ ID NO: 7923823 - DNA, 22 bp, Homo sapiens
cagtgagggaagatctcagcac

SEQ ID NO: 7923824 - DNA, 17 bp, Homo sapiens
cagtgaggcctttcctc

SEQ ID NO: 7923825 - DNA, 21 bp, Homo sapiens
cagtgaggccctcctgttccc

SEQ ID NO: 7923826 - DNA, 21 bp, Homo sapiens
cagtgaggccctcctgttccc

SEQ ID NO: 7923827 - DNA, 22 bp, Homo sapiens
cagtgaggctctgctgagcggt

SEQ ID NO: 7923828 - DNA, 22 bp, Homo sapiens
cagtgaggctctgctgagcggt

SEQ ID NO: 7923829 - DNA, 22 bp, Homo sapiens
cagtgaggctctgctgagcggt

SEQ ID NO: 7923830 - DNA, 22 bp, Homo sapiens
cagtgaggagtccagggcagag

SEQ ID NO: 7923831 - DNA, 22 bp, Homo sapiens
cagtgaggagtccagggcagag

SEQ ID NO: 7923832 - DNA, 18 bp, Homo sapiens
cagtgaggatgaagggtt

SEQ ID NO: 7923833 - DNA, 22 bp, Homo sapiens
cagtgaggatgataattaaggt

SEQ ID NO: 7923834 - DNA, 18 bp, Homo sapiens
cagtgaggatgaagggtt

SEQ ID NO: 7923835 - DNA, 22 bp, Homo sapiens
cagtgaggagtccagggcagag

SEQ ID NO: 7923836 - DNA, 22 bp, Homo sapiens
cagtgaggagtccagggcagag

SEQ ID NO: 7923837 - DNA, 22 bp, Homo sapiens
cagtgaggagtccagggcagag

SEQ ID NO: 7923838 - DNA, 22 bp, Homo sapiens
cagtgaggagtccagggcagag

SEQ ID NO: 7923839 - DNA, 22 bp, Homo sapiens
cagtgaggagtccagggcagag

SEQ ID NO: 7923840 - DNA, 20 bp, Homo sapiens
cagtgaggaggtgctggggg

SEQ ID NO: 7923841 - DNA, 22 bp, Homo sapiens
cagtgaggagtccagggcagag

SEQ ID NO: 7923842 - DNA, 22 bp, Homo sapiens
aggacaaaggaccagatctgga

SEQ ID NO: 7923843 - DNA, 22 bp, Homo sapiens
aggaatttttctagccggagtt

SEQ ID NO: 7923844 - DNA, 22 bp, Homo sapiens
aggacaaaggaccagatctgga

SEQ ID NO: 7923845 - DNA, 22 bp, Homo sapiens
aggacaaaggaccagatctgga

SEQ ID NO: 7923846 - DNA, 22 bp, Homo sapiens
aggacaagacaaggaccagaga

SEQ ID NO: 7923847 - DNA, 22 bp, Homo sapiens
aggacaagacaaggaccagaga

SEQ ID NO: 7923848 - DNA, 22 bp, Homo sapiens
aggacaagacaaggaccagaga

SEQ ID NO: 7923849 - DNA, 22 bp, Homo sapiens
cagtctcttttcagctccatcc

SEQ ID NO: 7923850 - DNA, 22 bp, Homo sapiens
cagtctgaacactgggctactc

SEQ ID NO: 7923851 - DNA, 22 bp, Homo sapiens
cagtctgaacactgggctactc

SEQ ID NO: 7923852 - DNA, 23 bp, Homo sapiens
cagtctgcagcccacttgggcag

SEQ ID NO: 7923853 - DNA, 23 bp, Homo sapiens
cagtctgcagcccacttgggcag

SEQ ID NO: 7923854 - DNA, 22 bp, Homo sapiens
aggaattcaagaccagctgggc

SEQ ID NO: 7923855 - DNA, 22 bp, Homo sapiens
aggaattcaagaccagctgggc

SEQ ID NO: 7923856 - DNA, 22 bp, Homo sapiens
aggaattcaagaccagctgggc

SEQ ID NO: 7923857 - DNA, 22 bp, Homo sapiens
aggaattgagatcctaggtttt

SEQ ID NO: 7923858 - DNA, 22 bp, Homo sapiens
aggaattctgtctctagacatt

SEQ ID NO: 7923859 - DNA, 22 bp, Homo sapiens
aggaattcctgggaaggcacag

SEQ ID NO: 7923860 - DNA, 22 bp, Homo sapiens
aggaattgagatcctaggtttt

SEQ ID NO: 7923861 - DNA, 22 bp, Homo sapiens
aggaattgcctggggcctggga

SEQ ID NO: 7923862 - DNA, 22 bp, Homo sapiens
aggaattatttgtcttagtctt

SEQ ID NO: 7923863 - DNA, 22 bp, Homo sapiens
aggaattcaagaccagctgggc

SEQ ID NO: 7923864 - DNA, 22 bp, Homo sapiens
aggaatttggggttacatgatg

SEQ ID NO: 7923865 - DNA, 22 bp, Homo sapiens
aggaattttcacagttgggtat

SEQ ID NO: 7923866 - DNA, 22 bp, Homo sapiens
aggaattttacaagctggttgc

SEQ ID NO: 7923867 - DNA, 22 bp, Homo sapiens
aggaattttacatctcagagag

SEQ ID NO: 7923868 - DNA, 22 bp, Homo sapiens
aggaattttaatatgcttgtct

SEQ ID NO: 7923869 - DNA, 22 bp, Homo sapiens
aggaattgtgttgtagtggaga

SEQ ID NO: 7923870 - DNA, 22 bp, Homo sapiens
aggaatttaagggctcagagag

SEQ ID NO: 7923871 - DNA, 19 bp, Homo sapiens
aggaatttctcagggaggc

SEQ ID NO: 7923872 - DNA, 22 bp, Homo sapiens
aggaatttgagtgctgtaggaa

SEQ ID NO: 7923873 - DNA, 22 bp, Homo sapiens
aggagccaaattttagactctg

SEQ ID NO: 7923874 - DNA, 22 bp, Homo sapiens
aggagccaaattttagactctg

SEQ ID NO: 7923875 - DNA, 22 bp, Homo sapiens
aggagccaaattttagactctg

SEQ ID NO: 7923876 - DNA, 22 bp, Homo sapiens
aggagccaagatggggcaagta

SEQ ID NO: 7923877 - DNA, 22 bp, Homo sapiens
aggagccaagatggggcaagta

SEQ ID NO: 7923878 - DNA, 22 bp, Homo sapiens
aggagccaagatggggcaagta

SEQ ID NO: 7923879 - DNA, 22 bp, Homo sapiens
aggagccacctaggagctgttt

SEQ ID NO: 7923880 - DNA, 22 bp, Homo sapiens
aggagccaaggaaaacagtatt

SEQ ID NO: 7923881 - DNA, 22 bp, Homo sapiens
aggagccaaggaaaacagtatt

SEQ ID NO: 7923882 - DNA, 22 bp, Homo sapiens
aggagccaagcagaactaagga

SEQ ID NO: 7923883 - DNA, 22 bp, Homo sapiens
aggagccaagatggggcaagta

SEQ ID NO: 7923884 - DNA, 22 bp, Homo sapiens
cagtgcttttcaaagttctatg

SEQ ID NO: 7923885 - DNA, 22 bp, Homo sapiens
cagtgcttttttaccttccaac

SEQ ID NO: 7923886 - DNA, 22 bp, Homo sapiens
cagtgcttttttaccttccaac

SEQ ID NO: 7923887 - DNA, 22 bp, Homo sapiens
cagtggaaactatgctgctgga

SEQ ID NO: 7923888 - DNA, 22 bp, Homo sapiens
cagtggaaactatgctgctgga

SEQ ID NO: 7923889 - DNA, 22 bp, Homo sapiens
cagtggaaactatgctgctgga

SEQ ID NO: 7923890 - DNA, 22 bp, Homo sapiens
cagtggaaactatgctgctgga

SEQ ID NO: 7923891 - DNA, 22 bp, Homo sapiens
cagtggaaatcagagtgagagt

SEQ ID NO: 7923892 - DNA, 22 bp, Homo sapiens
cagtggaaatattggcagcatc

SEQ ID NO: 7923893 - DNA, 22 bp, Homo sapiens
cagtgcttggggagcggagaga

SEQ ID NO: 7923894 - DNA, 22 bp, Homo sapiens
cagtgctttgggaggctgagga

SEQ ID NO: 7923895 - DNA, 22 bp, Homo sapiens
cagtgctttgggaggctgagga

SEQ ID NO: 7923896 - DNA, 17 bp, Homo sapiens
cagtgcttctgcttctt

SEQ ID NO: 7923897 - DNA, 20 bp, Homo sapiens
cagtgcttcctcctttcttt

SEQ ID NO: 7923898 - DNA, 22 bp, Homo sapiens
aggagccacctaggagctgttt

SEQ ID NO: 7923899 - DNA, 21 bp, Homo sapiens
aggagcattgttgtggtggag

SEQ ID NO: 7923900 - DNA, 22 bp, Homo sapiens
aggagcagcttctgaaccatgt

SEQ ID NO: 7923901 - DNA, 22 bp, Homo sapiens
aggagcagcttctgaaccatgt

SEQ ID NO: 7923902 - DNA, 21 bp, Homo sapiens
aggagcattgttgtggtggag

SEQ ID NO: 7923903 - DNA, 22 bp, Homo sapiens
aggagcagcttctgaaccatgt

SEQ ID NO: 7923904 - DNA, 22 bp, Homo sapiens
aggagcagcttctgaaccatgt

SEQ ID NO: 7923905 - DNA, 22 bp, Homo sapiens
aggagcagcttctgaaccatgt

SEQ ID NO: 7923906 - DNA, 22 bp, Homo sapiens
aggagcagcttctgaaccatgt

SEQ ID NO: 7923907 - DNA, 22 bp, Homo sapiens
aggagccaaattactagctctg

SEQ ID NO: 7923908 - DNA, 22 bp, Homo sapiens
aggagccaaacatattgagaga

SEQ ID NO: 7923909 - DNA, 22 bp, Homo sapiens
aggagccaaaagctgaacaaga

SEQ ID NO: 7923910 - DNA, 22 bp, Homo sapiens
aggagccaaacatattgagaga

SEQ ID NO: 7923911 - DNA, 22 bp, Homo sapiens
aggagccaaattttagactctg

SEQ ID NO: 7923912 - DNA, 22 bp, Homo sapiens
aggagccaaattttagactctg

SEQ ID NO: 7923913 - DNA, 22 bp, Homo sapiens
aggagcagattggtaagatcat

SEQ ID NO: 7923914 - DNA, 22 bp, Homo sapiens
aggagcagattggtaagatcat

SEQ ID NO: 7923915 - DNA, 22 bp, Homo sapiens
aggagcagattggtaagatcat

SEQ ID NO: 7923916 - DNA, 22 bp, Homo sapiens
aggagcagattggtaagatcat

SEQ ID NO: 7923917 - DNA, 22 bp, Homo sapiens
aggagcagattggtaagatcat

SEQ ID NO: 7923918 - DNA, 22 bp, Homo sapiens
aggagatggagctcagtgggca

SEQ ID NO: 7923919 - DNA, 22 bp, Homo sapiens
aggagatggagctcagtgggca

SEQ ID NO: 7923920 - DNA, 22 bp, Homo sapiens
aggagcagcccactcctgtcct

SEQ ID NO: 7923921 - DNA, 22 bp, Homo sapiens
aggagcagcccactcctgtcct

SEQ ID NO: 7923922 - DNA, 22 bp, Homo sapiens
aggagcagcccactcctgtcct

SEQ ID NO: 7923923 - DNA, 22 bp, Homo sapiens
aggagcagcccactcctgtcct

SEQ ID NO: 7923924 - DNA, 22 bp, Homo sapiens
aggagcagcccactcctgtcct

SEQ ID NO: 7923925 - DNA, 21 bp, Homo sapiens
cagtgcaggggttagcgtgta

SEQ ID NO: 7923926 - DNA, 22 bp, Homo sapiens
aggagcagcccactcctgtcct

SEQ ID NO: 7923927 - DNA, 23 bp, Homo sapiens
cagtggagactcatgcttcctta

SEQ ID NO: 7923928 - DNA, 23 bp, Homo sapiens
cagtggagactcatgcttcctta

SEQ ID NO: 7923929 - DNA, 23 bp, Homo sapiens
cagtggagactcatgcttcctta

SEQ ID NO: 7923930 - DNA, 23 bp, Homo sapiens
cagtggagactcatgcttcctta

SEQ ID NO: 7923931 - DNA, 23 bp, Homo sapiens
cagtggagactcatgcttcctta

SEQ ID NO: 7923932 - DNA, 22 bp, Homo sapiens
cagtggaatatataggggattt

SEQ ID NO: 7923933 - DNA, 22 bp, Homo sapiens
aggagctgatagtctatggaga

SEQ ID NO: 7923934 - DNA, 22 bp, Homo sapiens
cagtggagagacttttactctt

SEQ ID NO: 7923935 - DNA, 22 bp, Homo sapiens
aggagctgatagtctatggaga

SEQ ID NO: 7923936 - DNA, 22 bp, Homo sapiens
aggagctgatagtctatggaga

SEQ ID NO: 7923937 - DNA, 22 bp, Homo sapiens
aggagctgatagtctatggaga

SEQ ID NO: 7923938 - DNA, 22 bp, Homo sapiens
aggagctgatagtctatggaga

SEQ ID NO: 7923939 - DNA, 22 bp, Homo sapiens
cagtggaagctggctgtgaaga

SEQ ID NO: 7923940 - DNA, 22 bp, Homo sapiens
cagtggaagctggctgtgaaga

SEQ ID NO: 7923941 - DNA, 22 bp, Homo sapiens
cagtggaatacgagcagatgtc

SEQ ID NO: 7923942 - DNA, 22 bp, Homo sapiens
cagtggaatatataggggattt

SEQ ID NO: 7923943 - DNA, 22 bp, Homo sapiens
cagtggaagactcagctctccc

SEQ ID NO: 7923944 - DNA, 22 bp, Homo sapiens
cagtggaaatcagagtgagagt

SEQ ID NO: 7923945 - DNA, 22 bp, Homo sapiens
cagtggaaatcagagtgagagt

SEQ ID NO: 7923946 - DNA, 22 bp, Homo sapiens
aggagctgatagtctatggaga

SEQ ID NO: 7923947 - DNA, 22 bp, Homo sapiens
cagtggaaatcagagtgagagt

SEQ ID NO: 7923948 - DNA, 22 bp, Homo sapiens
aggagctgatgattctttgatc

SEQ ID NO: 7923949 - DNA, 22 bp, Homo sapiens
aggagctggccactaggatgca

SEQ ID NO: 7923950 - DNA, 22 bp, Homo sapiens
aggagctggccactaggatgca

SEQ ID NO: 7923951 - DNA, 22 bp, Homo sapiens
aggagctggccactaggatgca

SEQ ID NO: 7923952 - DNA, 22 bp, Homo sapiens
aggagctggcctagaaaggaga

SEQ ID NO: 7923953 - DNA, 22 bp, Homo sapiens
aggagctggcctagaaaggaga

SEQ ID NO: 7923954 - DNA, 22 bp, Homo sapiens
aggagctggcctagaaaggaga

SEQ ID NO: 7923955 - DNA, 22 bp, Homo sapiens
aggagctggcctagaaaggaga

SEQ ID NO: 7923956 - DNA, 17 bp, Homo sapiens
aggagctgggggtggtg

SEQ ID NO: 7923957 - DNA, 17 bp, Homo sapiens
aggagctgggggtggtg

SEQ ID NO: 7923958 - DNA, 17 bp, Homo sapiens
aggagctgggggtggtg

SEQ ID NO: 7923959 - DNA, 22 bp, Homo sapiens
aggagctgggctgctgctggga

SEQ ID NO: 7923960 - DNA, 22 bp, Homo sapiens
aggagctgggctgctgctggga

SEQ ID NO: 7923961 - DNA, 22 bp, Homo sapiens
aggagctgggctgctgctggga

SEQ ID NO: 7923962 - DNA, 22 bp, Homo sapiens
aggagctgggctgctgctggga

SEQ ID NO: 7923963 - DNA, 22 bp, Homo sapiens
aggagctgggctgctgctggga

SEQ ID NO: 7923964 - DNA, 22 bp, Homo sapiens
aggagctgggctgctgctggga

SEQ ID NO: 7923965 - DNA, 22 bp, Homo sapiens
aggagctgggctgctgctggga

SEQ ID NO: 7923966 - DNA, 22 bp, Homo sapiens
aggagctgggctgctgctggga

SEQ ID NO: 7923967 - DNA, 22 bp, Homo sapiens
aggagctgggctgctgctggga

SEQ ID NO: 7923968 - DNA, 22 bp, Homo sapiens
aggagctgggcccaaggatgct

SEQ ID NO: 7923969 - DNA, 22 bp, Homo sapiens
aggagctgggcccaaggatgct

SEQ ID NO: 7923970 - DNA, 22 bp, Homo sapiens
aggagctgggcccaaggatgct

SEQ ID NO: 7923971 - DNA, 22 bp, Homo sapiens
aggagctgggagaaggactaaa

SEQ ID NO: 7923972 - DNA, 22 bp, Homo sapiens
aggagctgggagaaggactaaa

SEQ ID NO: 7923973 - DNA, 22 bp, Homo sapiens
aggagctgggagaaggactaaa

SEQ ID NO: 7923974 - DNA, 22 bp, Homo sapiens
aggagctgggagaaggactaaa

SEQ ID NO: 7923975 - DNA, 22 bp, Homo sapiens
catcagaaaccttgaggaaact

SEQ ID NO: 7923976 - DNA, 22 bp, Homo sapiens
catcagaaaccttgaggaaact

SEQ ID NO: 7923977 - DNA, 22 bp, Homo sapiens
catcacttttaaaggtgatcga

SEQ ID NO: 7923978 - DNA, 22 bp, Homo sapiens
catcactgtcctcagcattcca

SEQ ID NO: 7923979 - DNA, 20 bp, Homo sapiens
catcagaaatcctgacccac

SEQ ID NO: 7923980 - DNA, 22 bp, Homo sapiens
catcactgtcaccatctttcct

SEQ ID NO: 7923981 - DNA, 22 bp, Homo sapiens
catcactgtcaccatctttcct

SEQ ID NO: 7923982 - DNA, 22 bp, Homo sapiens
catcactggctgctgacagatg

SEQ ID NO: 7923983 - DNA, 22 bp, Homo sapiens
catcactggctgctgacagatg

SEQ ID NO: 7923984 - DNA, 22 bp, Homo sapiens
catcactggcatcatgggaggg

SEQ ID NO: 7923985 - DNA, 22 bp, Homo sapiens
catcagaagaaagacaaatgat

SEQ ID NO: 7923986 - DNA, 22 bp, Homo sapiens
catcagaagatggctctggaaa

SEQ ID NO: 7923987 - DNA, 22 bp, Homo sapiens
catcagaacgtgagctccttgt

SEQ ID NO: 7923988 - DNA, 22 bp, Homo sapiens
catcagaaccagtggggacatt

SEQ ID NO: 7923989 - DNA, 22 bp, Homo sapiens
catcagaacgtgagctccttgt

SEQ ID NO: 7923990 - DNA, 22 bp, Homo sapiens
catcagaagaaagacaaatgat

SEQ ID NO: 7923991 - DNA, 22 bp, Homo sapiens
catcagaagaaagacaaatgat

SEQ ID NO: 7923992 - DNA, 22 bp, Homo sapiens
catcagaagaaagacaaatgat

SEQ ID NO: 7923993 - DNA, 22 bp, Homo sapiens
catcagaacgtgagctccttgt

SEQ ID NO: 7923994 - DNA, 22 bp, Homo sapiens
catcagaaggaaggacgattat

SEQ ID NO: 7923995 - DNA, 22 bp, Homo sapiens
catcagaaggccagagggtagc

SEQ ID NO: 7923996 - DNA, 22 bp, Homo sapiens
catcagaaggccagagggtagc

SEQ ID NO: 7923997 - DNA, 22 bp, Homo sapiens
catcagaagatggctctggaaa

SEQ ID NO: 7923998 - DNA, 22 bp, Homo sapiens
catcagaagatggctctggaaa

SEQ ID NO: 7923999 - DNA, 22 bp, Homo sapiens
catcagaatagctctgtggata

SEQ ID NO: 7924000 - DNA, 22 bp, Homo sapiens
catcagaatctgagtctctgcc

SEQ ID NO: 7924001 - DNA, 22 bp, Homo sapiens
aggaggctgcaaccctgaggcc

SEQ ID NO: 7924002 - DNA, 22 bp, Homo sapiens
aggaggctgggcacagtggcct

SEQ ID NO: 7924003 - DNA, 22 bp, Homo sapiens
aggaggctgggcacagtggcct

SEQ ID NO: 7924004 - DNA, 22 bp, Homo sapiens
aggaggctgggcacagtggcct

SEQ ID NO: 7924005 - DNA, 22 bp, Homo sapiens
aggaggctgggcacagtggcct

SEQ ID NO: 7924006 - DNA, 22 bp, Homo sapiens
aggaggctgggcacagtggcct

SEQ ID NO: 7924007 - DNA, 22 bp, Homo sapiens
aggaggctgggcacagtggcct

SEQ ID NO: 7924008 - DNA, 22 bp, Homo sapiens
aggaggctggttcaggccatat

SEQ ID NO: 7924009 - DNA, 19 bp, Homo sapiens
catcagagggcataggatg

SEQ ID NO: 7924010 - DNA, 19 bp, Homo sapiens
catcagagggcataggatg

SEQ ID NO: 7924011 - DNA, 22 bp, Homo sapiens
catcagaggtacttaatgaatg

SEQ ID NO: 7924012 - DNA, 23 bp, Homo sapiens
catcagaggttgccactccctgg

SEQ ID NO: 7924013 - DNA, 19 bp, Homo sapiens
catcagagggcataggatg

SEQ ID NO: 7924014 - DNA, 22 bp, Homo sapiens
catcagacctgccagactaggt

SEQ ID NO: 7924015 - DNA, 22 bp, Homo sapiens
catcagacctgccagactaggt

SEQ ID NO: 7924016 - DNA, 22 bp, Homo sapiens
aggaggctgcaaccctgaggcc

SEQ ID NO: 7924017 - DNA, 22 bp, Homo sapiens
catcagagtcagagctctttct

SEQ ID NO: 7924018 - DNA, 22 bp, Homo sapiens
aggaggctgcaaccctgaggcc

SEQ ID NO: 7924019 - DNA, 22 bp, Homo sapiens
aggaggctgcaaccctgaggcc

SEQ ID NO: 7924020 - DNA, 22 bp, Homo sapiens
aggaggctgcaaccctgaggcc

SEQ ID NO: 7924021 - DNA, 22 bp, Homo sapiens
aggaggctgcaaccctgaggcc

SEQ ID NO: 7924022 - DNA, 22 bp, Homo sapiens
aggaggctgcaaccctgaggcc

SEQ ID NO: 7924023 - DNA, 22 bp, Homo sapiens
aggaggctgcaaccctgaggcc

SEQ ID NO: 7924024 - DNA, 22 bp, Homo sapiens
cagttctctgtgcctcgctggg

SEQ ID NO: 7924025 - DNA, 21 bp, Homo sapiens
cagttctcttagatttccagt

SEQ ID NO: 7924026 - DNA, 22 bp, Homo sapiens
cagttctcttgatcgtctcttg

SEQ ID NO: 7924027 - DNA, 22 bp, Homo sapiens
cagttctcttgatcgtctcttg

SEQ ID NO: 7924028 - DNA, 22 bp, Homo sapiens
cagttctacttggatgtctgca

SEQ ID NO: 7924029 - DNA, 22 bp, Homo sapiens
cagttctaattaataggagtaa

SEQ ID NO: 7924030 - DNA, 22 bp, Homo sapiens
cagttccctaatgtgtagaaga

SEQ ID NO: 7924031 - DNA, 23 bp, Homo sapiens
cagttcccactgtctgtcacaag

SEQ ID NO: 7924032 - DNA, 22 bp, Homo sapiens
cagttcccttcttctggcccct

SEQ ID NO: 7924033 - DNA, 22 bp, Homo sapiens
cagttcccttcttctggcccct

SEQ ID NO: 7924034 - DNA, 23 bp, Homo sapiens
cagttcccactgtctgtcacaag

SEQ ID NO: 7924035 - DNA, 22 bp, Homo sapiens
cagttccctccgccagcacttc

SEQ ID NO: 7924036 - DNA, 22 bp, Homo sapiens
cagttccttgagaatggttgct

SEQ ID NO: 7924037 - DNA, 22 bp, Homo sapiens
cagttccttgagaatggttgct

SEQ ID NO: 7924038 - DNA, 19 bp, Homo sapiens
catatttttgggctggcat

SEQ ID NO: 7924039 - DNA, 22 bp, Homo sapiens
catattttagttgctgaacagc

SEQ ID NO: 7924040 - DNA, 22 bp, Homo sapiens
catattttagttgctgaacagc

SEQ ID NO: 7924041 - DNA, 21 bp, Homo sapiens
cagttctcttagatttccagt

SEQ ID NO: 7924042 - DNA, 22 bp, Homo sapiens
cagttctctttccactggaggc

SEQ ID NO: 7924043 - DNA, 22 bp, Homo sapiens
catcacatttaattaaaatgtc

SEQ ID NO: 7924044 - DNA, 22 bp, Homo sapiens
catcacatttaattaaaatgtc

SEQ ID NO: 7924045 - DNA, 19 bp, Homo sapiens
catatttttgggctggcat

SEQ ID NO: 7924046 - DNA, 22 bp, Homo sapiens
catcactacaaatttaagaaat

SEQ ID NO: 7924047 - DNA, 22 bp, Homo sapiens
catcactacaaatttaagaaat

SEQ ID NO: 7924048 - DNA, 22 bp, Homo sapiens
catcacccggaactgtgtctgc

SEQ ID NO: 7924049 - DNA, 22 bp, Homo sapiens
cagttcagctagaagaaacaaa

SEQ ID NO: 7924050 - DNA, 22 bp, Homo sapiens
cagttcacactgtgctatctgc

SEQ ID NO: 7924051 - DNA, 22 bp, Homo sapiens
cagttcaaaattttgaagaagg

SEQ ID NO: 7924052 - DNA, 19 bp, Homo sapiens
cagttccagcttcttgacc

SEQ ID NO: 7924053 - DNA, 22 bp, Homo sapiens
cagttcatccccatgttttcaa

SEQ ID NO: 7924054 - DNA, 22 bp, Homo sapiens
cagttcatagtcttcatgtctc

SEQ ID NO: 7924055 - DNA, 22 bp, Homo sapiens
cagttcaggccggctgactcag

SEQ ID NO: 7924056 - DNA, 22 bp, Homo sapiens
cagttcaggccggctgactcag

SEQ ID NO: 7924057 - DNA, 22 bp, Homo sapiens
cagttcaaaattttgaagaagg

SEQ ID NO: 7924058 - DNA, 21 bp, Homo sapiens
cagttattcttgatgtgtgtg

SEQ ID NO: 7924059 - DNA, 22 bp, Homo sapiens
cagttattatgaggtcattagg

SEQ ID NO: 7924060 - DNA, 22 bp, Homo sapiens
cagttataggagccattgtata

SEQ ID NO: 7924061 - DNA, 22 bp, Homo sapiens
cagttataggagccattgtata

SEQ ID NO: 7924062 - DNA, 22 bp, Homo sapiens
cagttataggagccattgtata

SEQ ID NO: 7924063 - DNA, 17 bp, Homo sapiens
aggagctgggggtggtg

SEQ ID NO: 7924064 - DNA, 22 bp, Homo sapiens
cagttataggagccattgtata

SEQ ID NO: 7924065 - DNA, 22 bp, Homo sapiens
aggaggtgacagcctgcatctg

SEQ ID NO: 7924066 - DNA, 22 bp, Homo sapiens
aggaggtgagcggtcatgtggt

SEQ ID NO: 7924067 - DNA, 22 bp, Homo sapiens
aggaggtgagcggtcatgtggt

SEQ ID NO: 7924068 - DNA, 22 bp, Homo sapiens
aggaggtgagcggtcatgtggt

SEQ ID NO: 7924069 - DNA, 22 bp, Homo sapiens
aggaggtgagcggtcatgtggt

SEQ ID NO: 7924070 - DNA, 23 bp, Homo sapiens
catcatgcaatcttgggatttct

SEQ ID NO: 7924071 - DNA, 22 bp, Homo sapiens
catcatgccccgctacagtgca

SEQ ID NO: 7924072 - DNA, 22 bp, Homo sapiens
aggaggtgacagcctgcatctg

SEQ ID NO: 7924073 - DNA, 22 bp, Homo sapiens
aggaggtctcactatgttgccc

SEQ ID NO: 7924074 - DNA, 22 bp, Homo sapiens
aggaggtgacagcctgcatctg

SEQ ID NO: 7924075 - DNA, 22 bp, Homo sapiens
aggaggtcagagccccatgctg

SEQ ID NO: 7924076 - DNA, 22 bp, Homo sapiens
aggaggtgacagcctgcatctg

SEQ ID NO: 7924077 - DNA, 22 bp, Homo sapiens
aggaggtgacagcctgcatctg

SEQ ID NO: 7924078 - DNA, 22 bp, Homo sapiens
aggaggtgacagcctgcatctg

SEQ ID NO: 7924079 - DNA, 22 bp, Homo sapiens
aggagggtttcaatgggatgag

SEQ ID NO: 7924080 - DNA, 22 bp, Homo sapiens
aggagggtttcaatgggatgag

SEQ ID NO: 7924081 - DNA, 22 bp, Homo sapiens
aggagggtttcaatgggatgag

SEQ ID NO: 7924082 - DNA, 22 bp, Homo sapiens
aggagggtttcaatgggatgag

SEQ ID NO: 7924083 - DNA, 20 bp, Homo sapiens
aggaggtcaaatggaatctg

SEQ ID NO: 7924084 - DNA, 22 bp, Homo sapiens
aggagggttgaggaggatactt

SEQ ID NO: 7924085 - DNA, 22 bp, Homo sapiens
aggagggtttcaatgggatgag

SEQ ID NO: 7924086 - DNA, 22 bp, Homo sapiens
aggagggtttcaatgggatgag

SEQ ID NO: 7924087 - DNA, 22 bp, Homo sapiens
aggagggtttcaatgggatgag

SEQ ID NO: 7924088 - DNA, 22 bp, Homo sapiens
aggagggttctctggacagagg

SEQ ID NO: 7924089 - DNA, 22 bp, Homo sapiens
aggagggttctctggacagagg

SEQ ID NO: 7924090 - DNA, 22 bp, Homo sapiens
aggagggttctctggacagagg

SEQ ID NO: 7924091 - DNA, 22 bp, Homo sapiens
aggagggttctctggacagagg

SEQ ID NO: 7924092 - DNA, 22 bp, Homo sapiens
aggagggtggggtctgcctgtc

SEQ ID NO: 7924093 - DNA, 22 bp, Homo sapiens
aggagggtggggtctgcctgtc

SEQ ID NO: 7924094 - DNA, 22 bp, Homo sapiens
aggagggtgggaagcagtttta

SEQ ID NO: 7924095 - DNA, 22 bp, Homo sapiens
aggagggtggggtctgcctgtc

SEQ ID NO: 7924096 - DNA, 22 bp, Homo sapiens
aggagggtggcctcatgtgagt

SEQ ID NO: 7924097 - DNA, 22 bp, Homo sapiens
aggagggtggcctcatgtgagt

SEQ ID NO: 7924098 - DNA, 22 bp, Homo sapiens
aggagggtggcctcatgtgagt

SEQ ID NO: 7924099 - DNA, 21 bp, Homo sapiens
aggaggctgtctctttcagct

SEQ ID NO: 7924100 - DNA, 22 bp, Homo sapiens
aggaggctggttcaggccatat

SEQ ID NO: 7924101 - DNA, 22 bp, Homo sapiens
aggaggctggttcaggccatat

SEQ ID NO: 7924102 - DNA, 22 bp, Homo sapiens
aggaggggcaatgatagtctgg

SEQ ID NO: 7924103 - DNA, 22 bp, Homo sapiens
aggaggggcatagaaatgtaat

SEQ ID NO: 7924104 - DNA, 22 bp, Homo sapiens
aggaggctggttcaggccatat

SEQ ID NO: 7924105 - DNA, 22 bp, Homo sapiens
aggaggctggttcaggccatat

SEQ ID NO: 7924106 - DNA, 22 bp, Homo sapiens
aggaggctggttcaggccatat

SEQ ID NO: 7924107 - DNA, 22 bp, Homo sapiens
aggaggctggttcaggccatat

SEQ ID NO: 7924108 - DNA, 22 bp, Homo sapiens
aggaggctggttcaggccatat

SEQ ID NO: 7924109 - DNA, 22 bp, Homo sapiens
aggaggctggttcaggccatat

SEQ ID NO: 7924110 - DNA, 22 bp, Homo sapiens
aggaggctggttcaggccatat

SEQ ID NO: 7924111 - DNA, 22 bp, Homo sapiens
catcattttattaaccaagaaa

SEQ ID NO: 7924112 - DNA, 20 bp, Homo sapiens
catcattttaaaatctctcc

SEQ ID NO: 7924113 - DNA, 22 bp, Homo sapiens
catcatttgtttgcatgcagga

SEQ ID NO: 7924114 - DNA, 22 bp, Homo sapiens
catcatttgtttgcatgcagga

SEQ ID NO: 7924115 - DNA, 22 bp, Homo sapiens
catcatttgttcacttgattcc

SEQ ID NO: 7924116 - DNA, 22 bp, Homo sapiens
catcatttgttcacttgattcc

SEQ ID NO: 7924117 - DNA, 22 bp, Homo sapiens
catcatttgttcacttgattcc

SEQ ID NO: 7924118 - DNA, 22 bp, Homo sapiens
catcatttgttcacttgattcc

SEQ ID NO: 7924119 - DNA, 22 bp, Homo sapiens
catcatttcacttagatgaagt

SEQ ID NO: 7924120 - DNA, 23 bp, Homo sapiens
catcattgttatgggtgctacta

SEQ ID NO: 7924121 - DNA, 22 bp, Homo sapiens
catcatttaattataggggctg

SEQ ID NO: 7924122 - DNA, 22 bp, Homo sapiens
catcatttcacttagatgaagt

SEQ ID NO: 7924123 - DNA, 22 bp, Homo sapiens
catcatttcacttagatgaagt

SEQ ID NO: 7924124 - DNA, 22 bp, Homo sapiens
catcatttaattataggggctg

SEQ ID NO: 7924125 - DNA, 21 bp, Homo sapiens
catcatgcttgtgttggagaa

SEQ ID NO: 7924126 - DNA, 22 bp, Homo sapiens
catcatgccccgctacagtgca

SEQ ID NO: 7924127 - DNA, 22 bp, Homo sapiens
catcatgccccgctacagtgca

SEQ ID NO: 7924128 - DNA, 22 bp, Homo sapiens
catcatgtctgcaggaatgtgt

SEQ ID NO: 7924129 - DNA, 22 bp, Homo sapiens
catcattaccatcattagtagt

SEQ ID NO: 7924130 - DNA, 22 bp, Homo sapiens
catcattaccatcattagtagt

SEQ ID NO: 7924131 - DNA, 22 bp, Homo sapiens
catcattaccttgtaaccaata

SEQ ID NO: 7924132 - DNA, 22 bp, Homo sapiens
catcattaccttgtaaccaata

SEQ ID NO: 7924133 - DNA, 22 bp, Homo sapiens
catcattaccttgtaaccaata

SEQ ID NO: 7924134 - DNA, 22 bp, Homo sapiens
catcattcctaggtgcagagct

SEQ ID NO: 7924135 - DNA, 19 bp, Homo sapiens
catcattatcagttcactg

SEQ ID NO: 7924136 - DNA, 19 bp, Homo sapiens
catcattatcagttcactg

SEQ ID NO: 7924137 - DNA, 22 bp, Homo sapiens
catcattttgtatccaagggga

SEQ ID NO: 7924138 - DNA, 22 bp, Homo sapiens
catcatttttgtaagctggtag

SEQ ID NO: 7924139 - DNA, 22 bp, Homo sapiens
catcatttttgtaagctggtag

SEQ ID NO: 7924140 - DNA, 22 bp, Homo sapiens
catcattttattaaccaagaaa

SEQ ID NO: 7924141 - DNA, 22 bp, Homo sapiens
catcattttattaaccaagaaa

SEQ ID NO: 7924142 - DNA, 22 bp, Homo sapiens
catcattttattaaccaagaaa

SEQ ID NO: 7924143 - DNA, 22 bp, Homo sapiens
catcattttgtatccaagggga

SEQ ID NO: 7924144 - DNA, 22 bp, Homo sapiens
aggagtcacctgcccaaagtca

SEQ ID NO: 7924145 - DNA, 22 bp, Homo sapiens
aggagtatctaataatctgaga

SEQ ID NO: 7924146 - DNA, 22 bp, Homo sapiens
aggagtgggggcgagaagttaa

SEQ ID NO: 7924147 - DNA, 22 bp, Homo sapiens
aggagtatctaataatctgaga

SEQ ID NO: 7924148 - DNA, 22 bp, Homo sapiens
aggaggttgccagtctgggggt

SEQ ID NO: 7924149 - DNA, 22 bp, Homo sapiens
aggaggtgttgatagaaggttt

SEQ ID NO: 7924150 - DNA, 22 bp, Homo sapiens
aggagtggtgcaggacctgcca

SEQ ID NO: 7924151 - DNA, 22 bp, Homo sapiens
aggagtggtgcaggacctgcca

SEQ ID NO: 7924152 - DNA, 22 bp, Homo sapiens
aggagtggtgcaggacctgcca

SEQ ID NO: 7924153 - DNA, 22 bp, Homo sapiens
aggagtggtgcaggacctgcca

SEQ ID NO: 7924154 - DNA, 22 bp, Homo sapiens
aggagtggtgcaggacctgcca

SEQ ID NO: 7924155 - DNA, 22 bp, Homo sapiens
aggagtgggggcgagaagttaa

SEQ ID NO: 7924156 - DNA, 22 bp, Homo sapiens
aggagtgggggcgagaagttaa

SEQ ID NO: 7924157 - DNA, 22 bp, Homo sapiens
aggaggttgccagtctgggggt

SEQ ID NO: 7924158 - DNA, 22 bp, Homo sapiens
aggagtgttagagtagagctgg

SEQ ID NO: 7924159 - DNA, 22 bp, Homo sapiens
aggagtgttagagtagagctgg

SEQ ID NO: 7924160 - DNA, 22 bp, Homo sapiens
aggagtgtgaagagcctagatc

SEQ ID NO: 7924161 - DNA, 22 bp, Homo sapiens
aggagtgtggccagggctctgg

SEQ ID NO: 7924162 - DNA, 22 bp, Homo sapiens
aggagtggtgcaggacctgcca

SEQ ID NO: 7924163 - DNA, 22 bp, Homo sapiens
aggagtggtgcaggacctgcca

SEQ ID NO: 7924164 - DNA, 22 bp, Homo sapiens
aggagtgtgaagagcctagatc

SEQ ID NO: 7924165 - DNA, 22 bp, Homo sapiens
ctggctctttcctagctaggct

SEQ ID NO: 7924166 - DNA, 22 bp, Homo sapiens
ctggctctttcctagctaggct

SEQ ID NO: 7924167 - DNA, 22 bp, Homo sapiens
ctggctctttcctagctaggct

SEQ ID NO: 7924168 - DNA, 22 bp, Homo sapiens
ctggctctttcctagctaggct

SEQ ID NO: 7924169 - DNA, 22 bp, Homo sapiens
ctggctctttcctagctaggct

SEQ ID NO: 7924170 - DNA, 22 bp, Homo sapiens
ctggctctttcctagctaggct

SEQ ID NO: 7924171 - DNA, 22 bp, Homo sapiens
ctggctctttcagccgctggag

SEQ ID NO: 7924172 - DNA, 22 bp, Homo sapiens
ctggctctttcagccgctggag

SEQ ID NO: 7924173 - DNA, 19 bp, Homo sapiens
ctggctcttgggtggagga

SEQ ID NO: 7924174 - DNA, 22 bp, Homo sapiens
ctggctgaagctgggctctcct

SEQ ID NO: 7924175 - DNA, 22 bp, Homo sapiens
ctggctctttcctagctaggct

SEQ ID NO: 7924176 - DNA, 22 bp, Homo sapiens
ctggctgaatcctagtctcata

SEQ ID NO: 7924177 - DNA, 22 bp, Homo sapiens
ctggctgacacaaaggtatcga

SEQ ID NO: 7924178 - DNA, 22 bp, Homo sapiens
ctggctgacaccttgatagcag

SEQ ID NO: 7924179 - DNA, 22 bp, Homo sapiens
ctggctcttggctagggagagt

SEQ ID NO: 7924180 - DNA, 22 bp, Homo sapiens
ctggctcttggctagggagagt

SEQ ID NO: 7924181 - DNA, 22 bp, Homo sapiens
ctggctcttggctagggagagt

SEQ ID NO: 7924182 - DNA, 22 bp, Homo sapiens
ctggctcttggctagggagagt

SEQ ID NO: 7924183 - DNA, 19 bp, Homo sapiens
ctggctcttgggtggagga

SEQ ID NO: 7924184 - DNA, 19 bp, Homo sapiens
ctggctcttgggtggagga

SEQ ID NO: 7924185 - DNA, 19 bp, Homo sapiens
ctggctcttgggtggagga

SEQ ID NO: 7924186 - DNA, 19 bp, Homo sapiens
ctggctcttgggtggagga

SEQ ID NO: 7924187 - DNA, 22 bp, Homo sapiens
atataaagtgtttagaaagctg

SEQ ID NO: 7924188 - DNA, 22 bp, Homo sapiens
atataaagtgtttagaaagctg

SEQ ID NO: 7924189 - DNA, 22 bp, Homo sapiens
atataaagtgtttagaaagctg

SEQ ID NO: 7924190 - DNA, 22 bp, Homo sapiens
atataaagtgtttagaaagctg

SEQ ID NO: 7924191 - DNA, 23 bp, Homo sapiens
atataaacaccagatagattgta

SEQ ID NO: 7924192 - DNA, 23 bp, Homo sapiens
atataaacaccagatagattgta

SEQ ID NO: 7924193 - DNA, 23 bp, Homo sapiens
atagttttccctggttcttgcca

SEQ ID NO: 7924194 - DNA, 22 bp, Homo sapiens
atagttttctatgcactgttat

SEQ ID NO: 7924195 - DNA, 22 bp, Homo sapiens
atagttttctatgcactgttat

SEQ ID NO: 7924196 - DNA, 22 bp, Homo sapiens
atagttttaaaacctcaggaag

SEQ ID NO: 7924197 - DNA, 22 bp, Homo sapiens
atagttttaaaacctcaggaag

SEQ ID NO: 7924198 - DNA, 23 bp, Homo sapiens
atagttttccctggttcttgcca

SEQ ID NO: 7924199 - DNA, 22 bp, Homo sapiens
atagttttatagatattgtgta

SEQ ID NO: 7924200 - DNA, 22 bp, Homo sapiens
atagttttatagatattgtgta

SEQ ID NO: 7924201 - DNA, 22 bp, Homo sapiens
atataaagagcttagtatagtg

SEQ ID NO: 7924202 - DNA, 22 bp, Homo sapiens
atataaagagcttagtatagtg

SEQ ID NO: 7924203 - DNA, 22 bp, Homo sapiens
atataaagaagtggaaaatgag

SEQ ID NO: 7924204 - DNA, 22 bp, Homo sapiens
atataaagaagtggaaaatgag

SEQ ID NO: 7924205 - DNA, 23 bp, Homo sapiens
atataaacaccagatagattgta

SEQ ID NO: 7924206 - DNA, 22 bp, Homo sapiens
ctggcctgtgggctgtctccgg

SEQ ID NO: 7924207 - DNA, 19 bp, Homo sapiens
ctggcctgtgtcctgtgct

SEQ ID NO: 7924208 - DNA, 19 bp, Homo sapiens
ctggcctgtgtcctgtgct

SEQ ID NO: 7924209 - DNA, 19 bp, Homo sapiens
ctggcctgtgtcctgtgct

SEQ ID NO: 7924210 - DNA, 19 bp, Homo sapiens
ctggcctgtgtcctgtgct

SEQ ID NO: 7924211 - DNA, 19 bp, Homo sapiens
ctggcctgtgtcctgtgct

SEQ ID NO: 7924212 - DNA, 19 bp, Homo sapiens
ctggcctgtgtcctgtgct

SEQ ID NO: 7924213 - DNA, 22 bp, Homo sapiens
ctggcctctctgagcagggagc

SEQ ID NO: 7924214 - DNA, 22 bp, Homo sapiens
ctggcctctctgagcagggagc

SEQ ID NO: 7924215 - DNA, 22 bp, Homo sapiens
ctggcctctctgagcagggagc

SEQ ID NO: 7924216 - DNA, 22 bp, Homo sapiens
ctggcctctctgagcagggagc

SEQ ID NO: 7924217 - DNA, 22 bp, Homo sapiens
ctggcctctctgagcagggagc

SEQ ID NO: 7924218 - DNA, 22 bp, Homo sapiens
ctggcctctctgagcagggagc

SEQ ID NO: 7924219 - DNA, 22 bp, Homo sapiens
ctggcctctctgagcagggagc

SEQ ID NO: 7924220 - DNA, 22 bp, Homo sapiens
ctggcctctgtgttcaccatag

SEQ ID NO: 7924221 - DNA, 22 bp, Homo sapiens
ctggcctttcgtgagagctggg

SEQ ID NO: 7924222 - DNA, 22 bp, Homo sapiens
ctggccttttgtttctggagaa

SEQ ID NO: 7924223 - DNA, 22 bp, Homo sapiens
ctggcctttagccccagtgtct

SEQ ID NO: 7924224 - DNA, 22 bp, Homo sapiens
ctggcctttcgtgagagctggg

SEQ ID NO: 7924225 - DNA, 19 bp, Homo sapiens
ctggcctgtgtcctgtgct

SEQ ID NO: 7924226 - DNA, 21 bp, Homo sapiens
ctggccttcaactgattggat

SEQ ID NO: 7924227 - DNA, 22 bp, Homo sapiens
ctggccttcagactcggactga

SEQ ID NO: 7924228 - DNA, 22 bp, Homo sapiens
ctggccttgttcctccccaagt

SEQ ID NO: 7924229 - DNA, 22 bp, Homo sapiens
ctggccttgaggaggccaccaa

SEQ ID NO: 7924230 - DNA, 22 bp, Homo sapiens
atagtggggacaggatggttgg

SEQ ID NO: 7924231 - DNA, 22 bp, Homo sapiens
atagtgggtacaggggcagaga

SEQ ID NO: 7924232 - DNA, 22 bp, Homo sapiens
atagtgcattttattatcagca

SEQ ID NO: 7924233 - DNA, 22 bp, Homo sapiens
ctggctcacaggtgagatgcat

SEQ ID NO: 7924234 - DNA, 22 bp, Homo sapiens
ctggctcacaggtgagatgcat

SEQ ID NO: 7924235 - DNA, 22 bp, Homo sapiens
atagtgcagccccttttctatt

SEQ ID NO: 7924236 - DNA, 22 bp, Homo sapiens
atagtttgaaggctgttctact

SEQ ID NO: 7924237 - DNA, 22 bp, Homo sapiens
atagtttgctttaatacaactg

SEQ ID NO: 7924238 - DNA, 22 bp, Homo sapiens
atagtttgctttaatacaactg

SEQ ID NO: 7924239 - DNA, 22 bp, Homo sapiens
atagtttaccttccagatggct

SEQ ID NO: 7924240 - DNA, 22 bp, Homo sapiens
atagtttaccttccagatggct

SEQ ID NO: 7924241 - DNA, 22 bp, Homo sapiens
atagtggttggatatgtcagag

SEQ ID NO: 7924242 - DNA, 22 bp, Homo sapiens
ctggcgtgaaggtggccatgag

SEQ ID NO: 7924243 - DNA, 22 bp, Homo sapiens
ctggcgtgaaggtggccatgag

SEQ ID NO: 7924244 - DNA, 22 bp, Homo sapiens
ctggctaaagagcaagaagatg

SEQ ID NO: 7924245 - DNA, 22 bp, Homo sapiens
ctggctagataaaaccagccaa

SEQ ID NO: 7924246 - DNA, 22 bp, Homo sapiens
ctggctagataaaaccagccaa

SEQ ID NO: 7924247 - DNA, 22 bp, Homo sapiens
ctggctaattgtcagttgttac

SEQ ID NO: 7924248 - DNA, 22 bp, Homo sapiens
ctggcgagggtcgctggggact

SEQ ID NO: 7924249 - DNA, 22 bp, Homo sapiens
ctggcgagggtcgctggggact

SEQ ID NO: 7924250 - DNA, 22 bp, Homo sapiens
ctggcgagcaggaggcgacggc

SEQ ID NO: 7924251 - DNA, 22 bp, Homo sapiens
ctggcgtgaaggtggccatgag

SEQ ID NO: 7924252 - DNA, 22 bp, Homo sapiens
ctggctagcacctcagctcaga

SEQ ID NO: 7924253 - DNA, 22 bp, Homo sapiens
ctggctagcacctcagctcaga

SEQ ID NO: 7924254 - DNA, 22 bp, Homo sapiens
ctggctcaatttgtactgctgt

SEQ ID NO: 7924255 - DNA, 22 bp, Homo sapiens
ctggctcaataaatattagctg

SEQ ID NO: 7924256 - DNA, 22 bp, Homo sapiens
ctggctcaataaatattagctg

SEQ ID NO: 7924257 - DNA, 22 bp, Homo sapiens
ctggctcaatttgtactgctgt

SEQ ID NO: 7924258 - DNA, 22 bp, Homo sapiens
ctggctcaatttgtactgctgt

SEQ ID NO: 7924259 - DNA, 22 bp, Homo sapiens
ctggctcacaggtgagatgcat

SEQ ID NO: 7924260 - DNA, 22 bp, Homo sapiens
ctggctcaatttgtactgctgt

SEQ ID NO: 7924261 - DNA, 22 bp, Homo sapiens
atatactgaggagactttatat

SEQ ID NO: 7924262 - DNA, 22 bp, Homo sapiens
atatactgaggagactttatat

SEQ ID NO: 7924263 - DNA, 22 bp, Homo sapiens
atatacctcattctttgagtgc

SEQ ID NO: 7924264 - DNA, 22 bp, Homo sapiens
atatacctgaagttggtaatta

SEQ ID NO: 7924265 - DNA, 22 bp, Homo sapiens
atatacctgaagttggtaatta

SEQ ID NO: 7924266 - DNA, 22 bp, Homo sapiens
atatactgtaggccactataag

SEQ ID NO: 7924267 - DNA, 22 bp, Homo sapiens
atatactgatagctgcacttct

SEQ ID NO: 7924268 - DNA, 22 bp, Homo sapiens
atatactgtaggccactataag

SEQ ID NO: 7924269 - DNA, 22 bp, Homo sapiens
atatacttgatttaactgagca

SEQ ID NO: 7924270 - DNA, 22 bp, Homo sapiens
atatacttgatttaactgagca

SEQ ID NO: 7924271 - DNA, 22 bp, Homo sapiens
atatacttgatttaactgagca

SEQ ID NO: 7924272 - DNA, 22 bp, Homo sapiens
atatacttccccattatggggg

SEQ ID NO: 7924273 - DNA, 22 bp, Homo sapiens
atatactgtagtggtttagagc

SEQ ID NO: 7924274 - DNA, 19 bp, Homo sapiens
atatacatactgtgtgcat

SEQ ID NO: 7924275 - DNA, 22 bp, Homo sapiens
atatacatgggaatatgtggag

SEQ ID NO: 7924276 - DNA, 19 bp, Homo sapiens
atatacatactgtgtgcat

SEQ ID NO: 7924277 - DNA, 19 bp, Homo sapiens
atatacatactgtgtgcat

SEQ ID NO: 7924278 - DNA, 20 bp, Homo sapiens
atataccatcccacaacagg

SEQ ID NO: 7924279 - DNA, 20 bp, Homo sapiens
atataccatcccacaacagg

SEQ ID NO: 7924280 - DNA, 20 bp, Homo sapiens
atataccatcccacaacagg

SEQ ID NO: 7924281 - DNA, 22 bp, Homo sapiens
atatacatgggaatatgtggag

SEQ ID NO: 7924282 - DNA, 22 bp, Homo sapiens
atatacatgggaatatgtggag

SEQ ID NO: 7924283 - DNA, 22 bp, Homo sapiens
ctgggagctgtcaggagcgtgt

SEQ ID NO: 7924284 - DNA, 22 bp, Homo sapiens
ctgggagcttgttaggaatgca

SEQ ID NO: 7924285 - DNA, 22 bp, Homo sapiens
ctgggagcttggagcctttggt

SEQ ID NO: 7924286 - DNA, 22 bp, Homo sapiens
ctgggagctgtcaggagcgtgt

SEQ ID NO: 7924287 - DNA, 22 bp, Homo sapiens
ctgggagctgtcaggagcgtgt

SEQ ID NO: 7924288 - DNA, 22 bp, Homo sapiens
ctgggagctgtcaggagcgtgt

SEQ ID NO: 7924289 - DNA, 22 bp, Homo sapiens
ctgggagctggatgccctgccc

SEQ ID NO: 7924290 - DNA, 22 bp, Homo sapiens
ctgggagctggatgccctgccc

SEQ ID NO: 7924291 - DNA, 22 bp, Homo sapiens
ctgggagctggatgccctgccc

SEQ ID NO: 7924292 - DNA, 22 bp, Homo sapiens
ctgggagctggaatgggagaag

SEQ ID NO: 7924293 - DNA, 22 bp, Homo sapiens
ctgggagctggaatgggagaag

SEQ ID NO: 7924294 - DNA, 22 bp, Homo sapiens
ctgggagctggaatgggagaag

SEQ ID NO: 7924295 - DNA, 22 bp, Homo sapiens
ctgggagctggaatgggagaag

SEQ ID NO: 7924296 - DNA, 22 bp, Homo sapiens
ctgggagaggctgctccgctct

SEQ ID NO: 7924297 - DNA, 22 bp, Homo sapiens
ctgggagaggaacctcgagggt

SEQ ID NO: 7924298 - DNA, 22 bp, Homo sapiens
ctgggagaggaacctcgagggt

SEQ ID NO: 7924299 - DNA, 22 bp, Homo sapiens
ctgggagaggctgctccgctct

SEQ ID NO: 7924300 - DNA, 22 bp, Homo sapiens
atatacttggagactatcattg

SEQ ID NO: 7924301 - DNA, 22 bp, Homo sapiens
atatacttggagactatcattg

SEQ ID NO: 7924302 - DNA, 22 bp, Homo sapiens
atatacttggagactatcattg

SEQ ID NO: 7924303 - DNA, 22 bp, Homo sapiens
atatacttggagactatcattg

SEQ ID NO: 7924304 - DNA, 22 bp, Homo sapiens
atatacttggagactatcattg

SEQ ID NO: 7924305 - DNA, 22 bp, Homo sapiens
atatacttggagactatcattg

SEQ ID NO: 7924306 - DNA, 22 bp, Homo sapiens
ctgggagaggaacctcgagggt

SEQ ID NO: 7924307 - DNA, 22 bp, Homo sapiens
atatacacatttgcttatgtgt

SEQ ID NO: 7924308 - DNA, 22 bp, Homo sapiens
atatacacatgtgtatacattt

SEQ ID NO: 7924309 - DNA, 22 bp, Homo sapiens
atatacacatttgcttatgtgt

SEQ ID NO: 7924310 - DNA, 22 bp, Homo sapiens
atatacacatgtgtatacattt

SEQ ID NO: 7924311 - DNA, 19 bp, Homo sapiens
ctggctgcaatgccagggt

SEQ ID NO: 7924312 - DNA, 22 bp, Homo sapiens
atatacacatgtgtatacattt

SEQ ID NO: 7924313 - DNA, 19 bp, Homo sapiens
ctggctgcaatgccagggt

SEQ ID NO: 7924314 - DNA, 22 bp, Homo sapiens
atataatacaacctgctaagtg

SEQ ID NO: 7924315 - DNA, 19 bp, Homo sapiens
ctggctgcaatgccagggt

SEQ ID NO: 7924316 - DNA, 19 bp, Homo sapiens
ctggctgcaatgccagggt

SEQ ID NO: 7924317 - DNA, 22 bp, Homo sapiens
atataatacaacctgctaagtg

SEQ ID NO: 7924318 - DNA, 22 bp, Homo sapiens
atatacacatgtgtatacattt

SEQ ID NO: 7924319 - DNA, 22 bp, Homo sapiens
atataatagtttcataaaggct

SEQ ID NO: 7924320 - DNA, 22 bp, Homo sapiens
ctggctgagttactccactgag

SEQ ID NO: 7924321 - DNA, 22 bp, Homo sapiens
ctggctgaggtcaccagtagct

SEQ ID NO: 7924322 - DNA, 22 bp, Homo sapiens
ctggctgatctcaatcatggct

SEQ ID NO: 7924323 - DNA, 22 bp, Homo sapiens
ctggctgagttactccactgag

SEQ ID NO: 7924324 - DNA, 22 bp, Homo sapiens
ctggctgaggcagagcctgggg

SEQ ID NO: 7924325 - DNA, 22 bp, Homo sapiens
ctggctgaggcagagcctgggg

SEQ ID NO: 7924326 - DNA, 19 bp, Homo sapiens
ctggctgcaatgccagggt

SEQ ID NO: 7924327 - DNA, 19 bp, Homo sapiens
ctggctgcaatgccagggt

SEQ ID NO: 7924328 - DNA, 19 bp, Homo sapiens
ctggctgcaatgccagggt

SEQ ID NO: 7924329 - DNA, 19 bp, Homo sapiens
ctggctgcaatgccagggt

SEQ ID NO: 7924330 - DNA, 19 bp, Homo sapiens
ctggctgcaatgccagggt

SEQ ID NO: 7924331 - DNA, 19 bp, Homo sapiens
ctggctgcaatgccagggt

SEQ ID NO: 7924332 - DNA, 22 bp, Homo sapiens
ctggctgattttctcacttctc

SEQ ID NO: 7924333 - DNA, 22 bp, Homo sapiens
ctggctgcaaaatctattcact

SEQ ID NO: 7924334 - DNA, 22 bp, Homo sapiens
ctggctgcaaaatctattcact

SEQ ID NO: 7924335 - DNA, 22 bp, Homo sapiens
ctggctgatctcaatcatggct

SEQ ID NO: 7924336 - DNA, 22 bp, Homo sapiens
atatacactccactgatacagg

SEQ ID NO: 7924337 - DNA, 22 bp, Homo sapiens
atatacactccactgatacagg

SEQ ID NO: 7924338 - DNA, 22 bp, Homo sapiens
atatacactccactgatacagg

SEQ ID NO: 7924339 - DNA, 22 bp, Homo sapiens
atatacactcaccatggtattt

SEQ ID NO: 7924340 - DNA, 22 bp, Homo sapiens
atatacactcaccatggtattt

SEQ ID NO: 7924341 - DNA, 22 bp, Homo sapiens
atatacagggagaaacagctta

SEQ ID NO: 7924342 - DNA, 22 bp, Homo sapiens
atatacagggagaaacagctta

SEQ ID NO: 7924343 - DNA, 22 bp, Homo sapiens
atatacactgtttcagttgaag

SEQ ID NO: 7924344 - DNA, 22 bp, Homo sapiens
atatacactccactgatacagg

SEQ ID NO: 7924345 - DNA, 22 bp, Homo sapiens
atatacaggtggtatgtgtaaa

SEQ ID NO: 7924346 - DNA, 22 bp, Homo sapiens
atatacaggtggtatgtgtaaa

SEQ ID NO: 7924347 - DNA, 22 bp, Homo sapiens
atatacagggagaaacagctta

SEQ ID NO: 7924348 - DNA, 22 bp, Homo sapiens
atatacaggtggtatgtgtaaa

SEQ ID NO: 7924349 - DNA, 22 bp, Homo sapiens
atatacaggtggtatgtgtaaa

SEQ ID NO: 7924350 - DNA, 22 bp, Homo sapiens
atatacagtatgtactgtggtt

SEQ ID NO: 7924351 - DNA, 22 bp, Homo sapiens
atatacagtatgtactgtggtt

SEQ ID NO: 7924352 - DNA, 22 bp, Homo sapiens
atatacagtatgtactgtggtt

SEQ ID NO: 7924353 - DNA, 22 bp, Homo sapiens
atatacagtatgtactgtggtt

SEQ ID NO: 7924354 - DNA, 22 bp, Homo sapiens
atatacaggtggtatgtgtaaa

SEQ ID NO: 7924355 - DNA, 22 bp, Homo sapiens
atacacatgtgtatgtgcatgc

SEQ ID NO: 7924356 - DNA, 22 bp, Homo sapiens
atacacatgtgtatgtgcatgc

SEQ ID NO: 7924357 - DNA, 22 bp, Homo sapiens
atacacatgttattgtggaagc

SEQ ID NO: 7924358 - DNA, 22 bp, Homo sapiens
atacacattactttctgtctga

SEQ ID NO: 7924359 - DNA, 22 bp, Homo sapiens
atacacatgttattgtggaagc

SEQ ID NO: 7924360 - DNA, 20 bp, Homo sapiens
atacacatgcagacagatgc

SEQ ID NO: 7924361 - DNA, 22 bp, Homo sapiens
atacacatgtgtatgtgcatgc

SEQ ID NO: 7924362 - DNA, 20 bp, Homo sapiens
atacacatgcagacagatgc

SEQ ID NO: 7924363 - DNA, 22 bp, Homo sapiens
atacacattactttctgtctga

SEQ ID NO: 7924364 - DNA, 22 bp, Homo sapiens
atacacattactttctgtctga

SEQ ID NO: 7924365 - DNA, 20 bp, Homo sapiens
atacacattcatagaaaaat

SEQ ID NO: 7924366 - DNA, 20 bp, Homo sapiens
atacacattcatagaaaaat

SEQ ID NO: 7924367 - DNA, 20 bp, Homo sapiens
atacacattcatagaaaaat

SEQ ID NO: 7924368 - DNA, 22 bp, Homo sapiens
ctggagtggccggtgctgtggc

SEQ ID NO: 7924369 - DNA, 22 bp, Homo sapiens
ctggagtggccggtgctgtggc

SEQ ID NO: 7924370 - DNA, 22 bp, Homo sapiens
ctggcaagtactgggccagctc

SEQ ID NO: 7924371 - DNA, 22 bp, Homo sapiens
ctggcaagtactgggccagctc

SEQ ID NO: 7924372 - DNA, 22 bp, Homo sapiens
ctggcaagtactgggccagctc

SEQ ID NO: 7924373 - DNA, 20 bp, Homo sapiens
atacacattcatagaaaaat

SEQ ID NO: 7924374 - DNA, 22 bp, Homo sapiens
ctggagtgcagtggcatgatca

SEQ ID NO: 7924375 - DNA, 22 bp, Homo sapiens
ctggagtggccggtgctgtggc

SEQ ID NO: 7924376 - DNA, 22 bp, Homo sapiens
ctggcacaatgtcacttttgct

SEQ ID NO: 7924377 - DNA, 22 bp, Homo sapiens
ctggcacacaagtatttccttt

SEQ ID NO: 7924378 - DNA, 22 bp, Homo sapiens
ctggcacacagaggccctcggg

SEQ ID NO: 7924379 - DNA, 22 bp, Homo sapiens
ctggcacacagaggccctcggg

SEQ ID NO: 7924380 - DNA, 22 bp, Homo sapiens
ctggcacacagaggccctcggg

SEQ ID NO: 7924381 - DNA, 22 bp, Homo sapiens
ctggcacacagcaggctctcag

SEQ ID NO: 7924382 - DNA, 22 bp, Homo sapiens
ctggcacacagcaggctctcag

SEQ ID NO: 7924383 - DNA, 22 bp, Homo sapiens
ctggcacaaaagaaaactgcca

SEQ ID NO: 7924384 - DNA, 22 bp, Homo sapiens
ctggcacaaatggaaaccaagc

SEQ ID NO: 7924385 - DNA, 22 bp, Homo sapiens
ctggcacaactccacctcagcg

SEQ ID NO: 7924386 - DNA, 22 bp, Homo sapiens
ctggcacaactccacctcagcg

SEQ ID NO: 7924387 - DNA, 22 bp, Homo sapiens
ctggcacaactccacctcagcg

SEQ ID NO: 7924388 - DNA, 22 bp, Homo sapiens
ctggcaagtggttgggatggat

SEQ ID NO: 7924389 - DNA, 22 bp, Homo sapiens
ctggcaagtactgggccagctc

SEQ ID NO: 7924390 - DNA, 22 bp, Homo sapiens
ctggcacacagcaggctctcag

SEQ ID NO: 7924391 - DNA, 22 bp, Homo sapiens
ctggcacacagtaggcaccaat

SEQ ID NO: 7924392 - DNA, 22 bp, Homo sapiens
ctggcacacagtaggcaccaat

SEQ ID NO: 7924393 - DNA, 22 bp, Homo sapiens
ctggcacacagtaggcaccaat

SEQ ID NO: 7924394 - DNA, 22 bp, Homo sapiens
ctggcacacagtaggcaccaat

SEQ ID NO: 7924395 - DNA, 22 bp, Homo sapiens
ctggcacacagtaggcaccaat

SEQ ID NO: 7924396 - DNA, 22 bp, Homo sapiens
ctggcacacgtggcagggtagg

SEQ ID NO: 7924397 - DNA, 22 bp, Homo sapiens
ctggcacacgtggcagggtagg

SEQ ID NO: 7924398 - DNA, 22 bp, Homo sapiens
ctggcacacgtggcagggtagg

SEQ ID NO: 7924399 - DNA, 22 bp, Homo sapiens
ctggcacagagacagaaggatt

SEQ ID NO: 7924400 - DNA, 22 bp, Homo sapiens
ctggcacagccactgcaggcag

SEQ ID NO: 7924401 - DNA, 22 bp, Homo sapiens
ctggcacagccactgcaggcag

SEQ ID NO: 7924402 - DNA, 22 bp, Homo sapiens
ctggcacagccactgcaggcag

SEQ ID NO: 7924403 - DNA, 22 bp, Homo sapiens
ctggcacagagtgagcattcaa

SEQ ID NO: 7924404 - DNA, 22 bp, Homo sapiens
ctggcacagccactgcaggcag

SEQ ID NO: 7924405 - DNA, 22 bp, Homo sapiens
ctggcacagagacagaaggatt

SEQ ID NO: 7924406 - DNA, 22 bp, Homo sapiens
ctggcacagagtgagcattcaa

SEQ ID NO: 7924407 - DNA, 22 bp, Homo sapiens
ctggcacagagtgagcattcaa

SEQ ID NO: 7924408 - DNA, 22 bp, Homo sapiens
ctggcacagagtgagcattcaa

SEQ ID NO: 7924409 - DNA, 22 bp, Homo sapiens
atacatgtaactgcattgtaat

SEQ ID NO: 7924410 - DNA, 22 bp, Homo sapiens
atacatgtaactgcattgtaat

SEQ ID NO: 7924411 - DNA, 22 bp, Homo sapiens
atacatgtaactgcattgtaat

SEQ ID NO: 7924412 - DNA, 22 bp, Homo sapiens
atacatgtaactgcattgtaat

SEQ ID NO: 7924413 - DNA, 22 bp, Homo sapiens
atacatgtaactgcattgtaat

SEQ ID NO: 7924414 - DNA, 22 bp, Homo sapiens
atacatgtaactgcattgtaat

SEQ ID NO: 7924415 - DNA, 22 bp, Homo sapiens
atacatggaagatgcttagcac

SEQ ID NO: 7924416 - DNA, 23 bp, Homo sapiens
atacatggccggatatgatgttc

SEQ ID NO: 7924417 - DNA, 22 bp, Homo sapiens
atacatgggtctcctgtcttag

SEQ ID NO: 7924418 - DNA, 17 bp, Homo sapiens
atacatgtaaagtgctt

SEQ ID NO: 7924419 - DNA, 17 bp, Homo sapiens
atacatgtaaagtgctt

SEQ ID NO: 7924420 - DNA, 22 bp, Homo sapiens
atacatgcgccatgttggtgtg

SEQ ID NO: 7924421 - DNA, 22 bp, Homo sapiens
atacatgggtctcctgtcttag

SEQ ID NO: 7924422 - DNA, 19 bp, Homo sapiens
atacatgcatttacatgct

SEQ ID NO: 7924423 - DNA, 22 bp, Homo sapiens
ctggcacagttaacatatgcta

SEQ ID NO: 7924424 - DNA, 22 bp, Homo sapiens
ctggcacataattagtgatcct

SEQ ID NO: 7924425 - DNA, 22 bp, Homo sapiens
ctggcacataattagtgatcct

SEQ ID NO: 7924426 - DNA, 22 bp, Homo sapiens
ctggcacataattagtgatcct

SEQ ID NO: 7924427 - DNA, 22 bp, Homo sapiens
ctggcacagttaacatatgcta

SEQ ID NO: 7924428 - DNA, 20 bp, Homo sapiens
ctggcacagggtccgtcctt

SEQ ID NO: 7924429 - DNA, 22 bp, Homo sapiens
ctggcacaggatccgagacctt

SEQ ID NO: 7924430 - DNA, 22 bp, Homo sapiens
ctggcacagccactgcaggcag

SEQ ID NO: 7924431 - DNA, 22 bp, Homo sapiens
ctggcacagcttgggccccatc

SEQ ID NO: 7924432 - DNA, 22 bp, Homo sapiens
ctggcacagcttgggccccatc

SEQ ID NO: 7924433 - DNA, 22 bp, Homo sapiens
ctggcacagccactgcaggcag

SEQ ID NO: 7924434 - DNA, 22 bp, Homo sapiens
ctggcacaggatccgagacctt

SEQ ID NO: 7924435 - DNA, 22 bp, Homo sapiens
ctggcacagccactgcaggcag

SEQ ID NO: 7924436 - DNA, 22 bp, Homo sapiens
ctggcacagccactgcaggcag

SEQ ID NO: 7924437 - DNA, 22 bp, Homo sapiens
ctggcacagcttgggccccatc

SEQ ID NO: 7924438 - DNA, 22 bp, Homo sapiens
ctggcacagccactgcaggcag

SEQ ID NO: 7924439 - DNA, 22 bp, Homo sapiens
atacatgtgggtctaaacatat

SEQ ID NO: 7924440 - DNA, 22 bp, Homo sapiens
atacatgtgggtctaaacatat

SEQ ID NO: 7924441 - DNA, 22 bp, Homo sapiens
atacatgtcatcatatgtttgt

SEQ ID NO: 7924442 - DNA, 22 bp, Homo sapiens
atacatgtaactgcattgtaat

SEQ ID NO: 7924443 - DNA, 22 bp, Homo sapiens
atacatgtacataaatgtagca

SEQ ID NO: 7924444 - DNA, 22 bp, Homo sapiens
atacatgtcatcatatgtttgt

SEQ ID NO: 7924445 - DNA, 22 bp, Homo sapiens
atacatgtcatcatatgtttgt

SEQ ID NO: 7924446 - DNA, 22 bp, Homo sapiens
atacatgtcatcatatgtttgt

SEQ ID NO: 7924447 - DNA, 22 bp, Homo sapiens
atacatgtcatcatatgtttgt

SEQ ID NO: 7924448 - DNA, 22 bp, Homo sapiens
atacatgtacataaatgtagca

SEQ ID NO: 7924449 - DNA, 22 bp, Homo sapiens
atacatgtgtccctgatttatt

SEQ ID NO: 7924450 - DNA, 22 bp, Homo sapiens
atacatgtgtccctgatttatt

SEQ ID NO: 7924451 - DNA, 22 bp, Homo sapiens
atacatgtgtccctgatttatt

SEQ ID NO: 7924452 - DNA, 22 bp, Homo sapiens
atacatgtgggtctaaacatat

SEQ ID NO: 7924453 - DNA, 22 bp, Homo sapiens
atacatgtgtccctgatttatt

SEQ ID NO: 7924454 - DNA, 22 bp, Homo sapiens
atacatgtgggtctaaacatat

SEQ ID NO: 7924455 - DNA, 22 bp, Homo sapiens
atacatgtgggtctaaacatat

SEQ ID NO: 7924456 - DNA, 22 bp, Homo sapiens
ctggcagcttagcactctggtt

SEQ ID NO: 7924457 - DNA, 22 bp, Homo sapiens
ctggcagcttagcactctggtt

SEQ ID NO: 7924458 - DNA, 22 bp, Homo sapiens
atacatgtgtgtgcatacatgt

SEQ ID NO: 7924459 - DNA, 22 bp, Homo sapiens
atacatgtgtgtgcatacatgt

SEQ ID NO: 7924460 - DNA, 22 bp, Homo sapiens
ctggcctcatagccaagctgtg

SEQ ID NO: 7924461 - DNA, 22 bp, Homo sapiens
ctggcctcatagccaagctgtg

SEQ ID NO: 7924462 - DNA, 22 bp, Homo sapiens
ctggcctcatagccaagctgtg

SEQ ID NO: 7924463 - DNA, 22 bp, Homo sapiens
ctggcctcatagccaagctgtg

SEQ ID NO: 7924464 - DNA, 22 bp, Homo sapiens
ctggcctcatagccaagctgtg

SEQ ID NO: 7924465 - DNA, 23 bp, Homo sapiens
ctggcctccgacactggccaaga

SEQ ID NO: 7924466 - DNA, 23 bp, Homo sapiens
ctggcctccgacactggccaaga

SEQ ID NO: 7924467 - DNA, 22 bp, Homo sapiens
ctggcctcggcagcaggaacag

SEQ ID NO: 7924468 - DNA, 22 bp, Homo sapiens
ctggcctcacctcagacttact

SEQ ID NO: 7924469 - DNA, 22 bp, Homo sapiens
ctggcctcagagggtcatggtg

SEQ ID NO: 7924470 - DNA, 22 bp, Homo sapiens
ctggcctcagagggtcatggtg

SEQ ID NO: 7924471 - DNA, 22 bp, Homo sapiens
ctggcctcagagggtcatggtg

SEQ ID NO: 7924472 - DNA, 22 bp, Homo sapiens
ctggcctcagagggtcatggtg

SEQ ID NO: 7924473 - DNA, 22 bp, Homo sapiens
ctggcctcagagggtcatggtg

SEQ ID NO: 7924474 - DNA, 22 bp, Homo sapiens
ctggcctcagagggtcatggtg

SEQ ID NO: 7924475 - DNA, 22 bp, Homo sapiens
ctggcctcagagggtcatggtg

SEQ ID NO: 7924476 - DNA, 21 bp, Homo sapiens
ctggccgacccctctgtgctc

SEQ ID NO: 7924477 - DNA, 22 bp, Homo sapiens
ctggccgcagtgtggagttgtg

SEQ ID NO: 7924478 - DNA, 22 bp, Homo sapiens
ctggccgccgtcccaacctcga

SEQ ID NO: 7924479 - DNA, 22 bp, Homo sapiens
ctggccggtatttgcctctggg

SEQ ID NO: 7924480 - DNA, 22 bp, Homo sapiens
ctggccgcctggggccgggtga

SEQ ID NO: 7924481 - DNA, 22 bp, Homo sapiens
ctggcctaaaaatacagaacaa

SEQ ID NO: 7924482 - DNA, 22 bp, Homo sapiens
ctggccggtatttgcctctggg

SEQ ID NO: 7924483 - DNA, 22 bp, Homo sapiens
ctggccggtatttgcctctggg

SEQ ID NO: 7924484 - DNA, 22 bp, Homo sapiens
ctggcctcacctcagacttact

SEQ ID NO: 7924485 - DNA, 22 bp, Homo sapiens
ctggcctcacagaggctaagcc

SEQ ID NO: 7924486 - DNA, 22 bp, Homo sapiens
ctggcctcacagaggctaagcc

SEQ ID NO: 7924487 - DNA, 22 bp, Homo sapiens
ctggcctcacagaggctaagcc

SEQ ID NO: 7924488 - DNA, 22 bp, Homo sapiens
ctggcctcacagaggctaagcc

SEQ ID NO: 7924489 - DNA, 22 bp, Homo sapiens
ctggcctaggaatggttttccg

SEQ ID NO: 7924490 - DNA, 22 bp, Homo sapiens
ctggcctaggaatggttttccg

SEQ ID NO: 7924491 - DNA, 22 bp, Homo sapiens
ctggcccttctcttgcttcctg

SEQ ID NO: 7924492 - DNA, 22 bp, Homo sapiens
ctggcccttctcttgcttcctg

SEQ ID NO: 7924493 - DNA, 22 bp, Homo sapiens
ctggcccttgacttacagcagg

SEQ ID NO: 7924494 - DNA, 22 bp, Homo sapiens
ctggcccttgacttacagcagg

SEQ ID NO: 7924495 - DNA, 22 bp, Homo sapiens
ctggcccttgacttacagcagg

SEQ ID NO: 7924496 - DNA, 22 bp, Homo sapiens
ctggccctatgagcctcctgat

SEQ ID NO: 7924497 - DNA, 22 bp, Homo sapiens
ctggccctatgagcctcctgat

SEQ ID NO: 7924498 - DNA, 22 bp, Homo sapiens
ctggccctatgagcctcctgat

SEQ ID NO: 7924499 - DNA, 22 bp, Homo sapiens
ctggccctatgagcctcctgat

SEQ ID NO: 7924500 - DNA, 22 bp, Homo sapiens
ctggccctatgagcctcctgat

SEQ ID NO: 7924501 - DNA, 22 bp, Homo sapiens
ctggccctatgagcctcctgat

SEQ ID NO: 7924502 - DNA, 22 bp, Homo sapiens
ctggccagaggttcctctgccc

SEQ ID NO: 7924503 - DNA, 22 bp, Homo sapiens
ctggccagaggttcctctgccc

SEQ ID NO: 7924504 - DNA, 22 bp, Homo sapiens
ctggccagaggttcctctgccc

SEQ ID NO: 7924505 - DNA, 22 bp, Homo sapiens
ctggccagaggttcctctgccc

SEQ ID NO: 7924506 - DNA, 22 bp, Homo sapiens
ctggccctaggcaaacacagat

SEQ ID NO: 7924507 - DNA, 22 bp, Homo sapiens
ctggccctatgagcctcctgat

SEQ ID NO: 7924508 - DNA, 22 bp, Homo sapiens
ctggccagactacacatgtgtg

SEQ ID NO: 7924509 - DNA, 22 bp, Homo sapiens
ctggccagaggttcctctgccc

SEQ ID NO: 7924510 - DNA, 20 bp, Homo sapiens
ctggccagaacgcctacaca

SEQ ID NO: 7924511 - DNA, 22 bp, Homo sapiens
ctggccagaagcacctttggcg

SEQ ID NO: 7924512 - DNA, 22 bp, Homo sapiens
ctggccagaagcacctttggcg

SEQ ID NO: 7924513 - DNA, 22 bp, Homo sapiens
ctggccagaagcacctttggcg

SEQ ID NO: 7924514 - DNA, 22 bp, Homo sapiens
ctggccagaagcacctttggcg

SEQ ID NO: 7924515 - DNA, 22 bp, Homo sapiens
ctggccagactacacatgtgtg

SEQ ID NO: 7924516 - DNA, 22 bp, Homo sapiens
ctggccagactacacatgtgtg

SEQ ID NO: 7924517 - DNA, 22 bp, Homo sapiens
ctggccagactacacatgtgtg

SEQ ID NO: 7924518 - DNA, 22 bp, Homo sapiens
ctggccagactacacatgtgtg

SEQ ID NO: 7924519 - DNA, 22 bp, Homo sapiens
ctggcaggtttggtgtctggtg

SEQ ID NO: 7924520 - DNA, 22 bp, Homo sapiens
ctggcaggtttggtgtctggtg

SEQ ID NO: 7924521 - DNA, 22 bp, Homo sapiens
ctggccactgcgggcctctgcc

SEQ ID NO: 7924522 - DNA, 22 bp, Homo sapiens
ctggcagtattaagagaagtga

SEQ ID NO: 7924523 - DNA, 22 bp, Homo sapiens
ctggcaggtttggtgtctggtg

SEQ ID NO: 7924524 - DNA, 22 bp, Homo sapiens
ctggcaggtttggtgtctggtg

SEQ ID NO: 7924525 - DNA, 22 bp, Homo sapiens
ctggcaggttatagagctgccc

SEQ ID NO: 7924526 - DNA, 22 bp, Homo sapiens
ctggcaggtttggtgtctggtg

SEQ ID NO: 7924527 - DNA, 22 bp, Homo sapiens
ctggcaggtttggtgtctggtg

SEQ ID NO: 7924528 - DNA, 22 bp, Homo sapiens
ctggcaggttatagagctgccc

SEQ ID NO: 7924529 - DNA, 22 bp, Homo sapiens
ctggcaggttatagagctgccc

SEQ ID NO: 7924530 - DNA, 22 bp, Homo sapiens
ctggcaggttatagagctgccc

SEQ ID NO: 7924531 - DNA, 22 bp, Homo sapiens
ctggccactggtggtcataggc

SEQ ID NO: 7924532 - DNA, 22 bp, Homo sapiens
ctggccactggtggtcataggc

SEQ ID NO: 7924533 - DNA, 22 bp, Homo sapiens
ctggccactggtggtcataggc

SEQ ID NO: 7924534 - DNA, 22 bp, Homo sapiens
ctggccactggaggtggcaccc

SEQ ID NO: 7924535 - DNA, 22 bp, Homo sapiens
ctggccactggaggtggcaccc

SEQ ID NO: 7924536 - DNA, 22 bp, Homo sapiens
ctggccactggtggtcataggc

SEQ ID NO: 7924537 - DNA, 20 bp, Homo sapiens
ctggccagaacgcctacaca

SEQ ID NO: 7924538 - DNA, 20 bp, Homo sapiens
ctggccagaacgcctacaca

SEQ ID NO: 7924539 - DNA, 20 bp, Homo sapiens
ctggccagaacgcctacaca

SEQ ID NO: 7924540 - DNA, 20 bp, Homo sapiens
ctggccagaacgcctacaca

SEQ ID NO: 7924541 - DNA, 20 bp, Homo sapiens
ctggccagaacgcctacaca

SEQ ID NO: 7924542 - DNA, 22 bp, Homo sapiens
ctggccactgcgggcctctgcc

SEQ ID NO: 7924543 - DNA, 22 bp, Homo sapiens
ctggccactgcgggcctctgcc

SEQ ID NO: 7924544 - DNA, 22 bp, Homo sapiens
ctggccactggaggtggcaccc

SEQ ID NO: 7924545 - DNA, 22 bp, Homo sapiens
ctggccactgcgggcctctgcc

SEQ ID NO: 7924546 - DNA, 22 bp, Homo sapiens
ctggccactggaggtggcaccc

SEQ ID NO: 7924547 - DNA, 22 bp, Homo sapiens
ctggcaggttatagagctgccc

SEQ ID NO: 7924548 - DNA, 22 bp, Homo sapiens
ctggcaggttatagagctgccc

SEQ ID NO: 7924549 - DNA, 22 bp, Homo sapiens
ctggcaggttatagagctgccc

SEQ ID NO: 7924550 - DNA, 22 bp, Homo sapiens
ctggcaggttatagagctgccc

SEQ ID NO: 7924551 - DNA, 22 bp, Homo sapiens
ctggcaggttatagagctgccc

SEQ ID NO: 7924552 - DNA, 22 bp, Homo sapiens
ctggcaggttatagagctgccc

SEQ ID NO: 7924553 - DNA, 22 bp, Homo sapiens
ctggcaggttatagagctgccc

SEQ ID NO: 7924554 - DNA, 22 bp, Homo sapiens
ctggcaggtggaggttgcagtg

SEQ ID NO: 7924555 - DNA, 22 bp, Homo sapiens
ctggcaggtggaggttgcagtg

SEQ ID NO: 7924556 - DNA, 22 bp, Homo sapiens
ctggcaggtggaggttgcagtg

SEQ ID NO: 7924557 - DNA, 22 bp, Homo sapiens
ctggcaggtggaggttgcagtg

SEQ ID NO: 7924558 - DNA, 22 bp, Homo sapiens
ctggcaggtggatggggactcc

SEQ ID NO: 7924559 - DNA, 22 bp, Homo sapiens
ctggcaggtggatggggactcc

SEQ ID NO: 7924560 - DNA, 22 bp, Homo sapiens
ctggcaggtggatggggactcc

SEQ ID NO: 7924561 - DNA, 22 bp, Homo sapiens
ctggcaggtggaggttgcagtg

SEQ ID NO: 7924562 - DNA, 22 bp, Homo sapiens
ctggcaggtggatggggactcc

SEQ ID NO: 7924563 - DNA, 22 bp, Homo sapiens
ctggcaggtggatggggactcc

SEQ ID NO: 7924564 - DNA, 22 bp, Homo sapiens
ctggcaggtggaggttgcagtg

SEQ ID NO: 7924565 - DNA, 22 bp, Homo sapiens
ctggcaggtggaggttgcagtg

SEQ ID NO: 7924566 - DNA, 22 bp, Homo sapiens
ctggcaggtggaggttgcagtg

SEQ ID NO: 7924567 - DNA, 22 bp, Homo sapiens
ctggcaggtggaggttgcagtg

SEQ ID NO: 7924568 - DNA, 22 bp, Homo sapiens
ctggcaggtggaggttgcagtg

SEQ ID NO: 7924569 - DNA, 22 bp, Homo sapiens
ctggcaggtggaggttgcagtg

SEQ ID NO: 7924570 - DNA, 22 bp, Homo sapiens
ctggcaggtggaggttgcagtg

SEQ ID NO: 7924571 - DNA, 22 bp, Homo sapiens
ctggcaggtctcgctgacgtgt

SEQ ID NO: 7924572 - DNA, 22 bp, Homo sapiens
ctggcaggtctcgctgacgtgt

SEQ ID NO: 7924573 - DNA, 22 bp, Homo sapiens
ctggcaggtctcgctgacgtgt

SEQ ID NO: 7924574 - DNA, 22 bp, Homo sapiens
ctggcaggtctcgctgacgtgt

SEQ ID NO: 7924575 - DNA, 22 bp, Homo sapiens
ctggcaggtccagctggactca

SEQ ID NO: 7924576 - DNA, 22 bp, Homo sapiens
ctggcagcttcaggacactcgg

SEQ ID NO: 7924577 - DNA, 22 bp, Homo sapiens
ctggcaggtccagctggactca

SEQ ID NO: 7924578 - DNA, 22 bp, Homo sapiens
ctggcaggtccagctggactca

SEQ ID NO: 7924579 - DNA, 22 bp, Homo sapiens
ctggcagcttattagaaatgca

SEQ ID NO: 7924580 - DNA, 22 bp, Homo sapiens
ctggcaggtccagctggactca

SEQ ID NO: 7924581 - DNA, 22 bp, Homo sapiens
ctggcaggtccagctggactca

SEQ ID NO: 7924582 - DNA, 22 bp, Homo sapiens
ctggcaggtccagctggactca

SEQ ID NO: 7924583 - DNA, 22 bp, Homo sapiens
ctggcaggtctcgctgacgtgt

SEQ ID NO: 7924584 - DNA, 22 bp, Homo sapiens
atacaagttctcatgtgtatct

SEQ ID NO: 7924585 - DNA, 22 bp, Homo sapiens
atacaagttctcatgtgtatct

SEQ ID NO: 7924586 - DNA, 18 bp, Homo sapiens
ctgctgtgtcgtctgggc

SEQ ID NO: 7924587 - DNA, 18 bp, Homo sapiens
ctgctgtgtcgtctgggc

SEQ ID NO: 7924588 - DNA, 18 bp, Homo sapiens
ctgctgtgtcgtctgggc

SEQ ID NO: 7924589 - DNA, 18 bp, Homo sapiens
ctgctgtgtcgtctgggc

SEQ ID NO: 7924590 - DNA, 22 bp, Homo sapiens
ctgctgtgtcagagtccagggg

SEQ ID NO: 7924591 - DNA, 22 bp, Homo sapiens
ctgctgtgtcagagtccagggg

SEQ ID NO: 7924592 - DNA, 22 bp, Homo sapiens
ctgctgtgtcagagtccagggg

SEQ ID NO: 7924593 - DNA, 22 bp, Homo sapiens
ctgctgtgtcagagtccagggg

SEQ ID NO: 7924594 - DNA, 22 bp, Homo sapiens
ctgctgtggtgtcaagcatctc

SEQ ID NO: 7924595 - DNA, 22 bp, Homo sapiens
ctgctgtggtgtcaagcatctc

SEQ ID NO: 7924596 - DNA, 22 bp, Homo sapiens
ctgctgtgtatcattttagatg

SEQ ID NO: 7924597 - DNA, 22 bp, Homo sapiens
ctgctgtgggcagggtagctgg

SEQ ID NO: 7924598 - DNA, 21 bp, Homo sapiens
ctgctgtggcccccgacatgc

SEQ ID NO: 7924599 - DNA, 22 bp, Homo sapiens
ctgctgtggccagccaggtcaa

SEQ ID NO: 7924600 - DNA, 22 bp, Homo sapiens
ctgctgtggccagccaggtcaa

SEQ ID NO: 7924601 - DNA, 22 bp, Homo sapiens
ctgctgtggatgcaggacctca

SEQ ID NO: 7924602 - DNA, 22 bp, Homo sapiens
ctgctgtggatgcaggacctca

SEQ ID NO: 7924603 - DNA, 22 bp, Homo sapiens
ctgctgtgggcagggtagctgg

SEQ ID NO: 7924604 - DNA, 22 bp, Homo sapiens
ctgctgtgggttaagacactgt

SEQ ID NO: 7924605 - DNA, 22 bp, Homo sapiens
ctgctgtgggttaagacactgt

SEQ ID NO: 7924606 - DNA, 22 bp, Homo sapiens
ctgctgtgggttaagacactgt

SEQ ID NO: 7924607 - DNA, 20 bp, Homo sapiens
ctgctgtggtcctttatttt

SEQ ID NO: 7924608 - DNA, 22 bp, Homo sapiens
ctgctgtgcttgtggccacccg

SEQ ID NO: 7924609 - DNA, 22 bp, Homo sapiens
ctgctgtgcttgtggccacccg

SEQ ID NO: 7924610 - DNA, 22 bp, Homo sapiens
ctgctgtgcttgtggccacccg

SEQ ID NO: 7924611 - DNA, 22 bp, Homo sapiens
ctgctgtggatgcaggacctca

SEQ ID NO: 7924612 - DNA, 22 bp, Homo sapiens
ctgctgtggatgcaggacctca

SEQ ID NO: 7924613 - DNA, 22 bp, Homo sapiens
ctgctgtgccttaaaatgcaag

SEQ ID NO: 7924614 - DNA, 22 bp, Homo sapiens
ctgctgtgccttaaaatgcaag

SEQ ID NO: 7924615 - DNA, 22 bp, Homo sapiens
ctgctgtgcaggtgcctatgat

SEQ ID NO: 7924616 - DNA, 22 bp, Homo sapiens
ctgctgtgcaggtgcctatgat

SEQ ID NO: 7924617 - DNA, 22 bp, Homo sapiens
ctgctgtgcatatttatctagg

SEQ ID NO: 7924618 - DNA, 22 bp, Homo sapiens
ctgctgtgcctcttttcacgtg

SEQ ID NO: 7924619 - DNA, 22 bp, Homo sapiens
ctgctggggtcagagcactggg

SEQ ID NO: 7924620 - DNA, 22 bp, Homo sapiens
ctgctggggtcagagcactggg

SEQ ID NO: 7924621 - DNA, 22 bp, Homo sapiens
ctgctggggtcagagcactggg

SEQ ID NO: 7924622 - DNA, 22 bp, Homo sapiens
ctgctggggtcagagcactggg

SEQ ID NO: 7924623 - DNA, 22 bp, Homo sapiens
ctgctggggtcagagcactggg

SEQ ID NO: 7924624 - DNA, 22 bp, Homo sapiens
ctgctgtgcagacagactctct

SEQ ID NO: 7924625 - DNA, 22 bp, Homo sapiens
ctgctgggggacacaggtccgg

SEQ ID NO: 7924626 - DNA, 22 bp, Homo sapiens
ctgctgggggacacaggtccgg

SEQ ID NO: 7924627 - DNA, 22 bp, Homo sapiens
ctgctgggggacacaggtccgg

SEQ ID NO: 7924628 - DNA, 22 bp, Homo sapiens
ctgctgggggacacaggtccgg

SEQ ID NO: 7924629 - DNA, 22 bp, Homo sapiens
ctgctgggggacacaggtccgg

SEQ ID NO: 7924630 - DNA, 22 bp, Homo sapiens
ctgctggggtcagagcactggg

SEQ ID NO: 7924631 - DNA, 22 bp, Homo sapiens
ctgctggggtcagagcactggg

SEQ ID NO: 7924632 - DNA, 22 bp, Homo sapiens
atacacatatcaggtgtataca

SEQ ID NO: 7924633 - DNA, 22 bp, Homo sapiens
atacacatatatacacgtttaa

SEQ ID NO: 7924634 - DNA, 22 bp, Homo sapiens
atacacatatcaggtgtataca

SEQ ID NO: 7924635 - DNA, 22 bp, Homo sapiens
atacacatatatacacgtttaa

SEQ ID NO: 7924636 - DNA, 19 bp, Homo sapiens
atacacatacgtaaactga

SEQ ID NO: 7924637 - DNA, 21 bp, Homo sapiens
atacacatacacataaatgtg

SEQ ID NO: 7924638 - DNA, 19 bp, Homo sapiens
atacacatacgtaaactga

SEQ ID NO: 7924639 - DNA, 21 bp, Homo sapiens
atacacatacacataaatgtg

SEQ ID NO: 7924640 - DNA, 21 bp, Homo sapiens
atacacatacacataaatgtg

SEQ ID NO: 7924641 - DNA, 19 bp, Homo sapiens
atacacatacgtaaactga

SEQ ID NO: 7924642 - DNA, 19 bp, Homo sapiens
atacacatacgtaaactga

SEQ ID NO: 7924643 - DNA, 19 bp, Homo sapiens
atacacatacgtaaactga

SEQ ID NO: 7924644 - DNA, 21 bp, Homo sapiens
atacacatacacataaatgtg

SEQ ID NO: 7924645 - DNA, 21 bp, Homo sapiens
atacacatacacataaatgtg

SEQ ID NO: 7924646 - DNA, 21 bp, Homo sapiens
atacacatacacataaatgtg

SEQ ID NO: 7924647 - DNA, 21 bp, Homo sapiens
atacacatacacataaatgtg

SEQ ID NO: 7924648 - DNA, 21 bp, Homo sapiens
atacacatacacataaatgtg

SEQ ID NO: 7924649 - DNA, 21 bp, Homo sapiens
atacacatacacataaatgtg

SEQ ID NO: 7924650 - DNA, 22 bp, Homo sapiens
atacaagttgcccaaatgatta

SEQ ID NO: 7924651 - DNA, 22 bp, Homo sapiens
atacaagttgcccaaatgatta

SEQ ID NO: 7924652 - DNA, 22 bp, Homo sapiens
ctgctgtgtcagagtccagggg

SEQ ID NO: 7924653 - DNA, 22 bp, Homo sapiens
atacaagttgcccaaatgatta

SEQ ID NO: 7924654 - DNA, 22 bp, Homo sapiens
atacacaggcatgcttctgatt

SEQ ID NO: 7924655 - DNA, 22 bp, Homo sapiens
atacacaggtgctaggtcaata

SEQ ID NO: 7924656 - DNA, 22 bp, Homo sapiens
atacacaggcatgcttctgatt

SEQ ID NO: 7924657 - DNA, 22 bp, Homo sapiens
atacacatatgtgtgtatatgt

SEQ ID NO: 7924658 - DNA, 22 bp, Homo sapiens
atacacatatgtgtgtatatgt

SEQ ID NO: 7924659 - DNA, 22 bp, Homo sapiens
atacacatatgtgtgtatatgt

SEQ ID NO: 7924660 - DNA, 22 bp, Homo sapiens
atacacatatgtgtgtatatgt

SEQ ID NO: 7924661 - DNA, 22 bp, Homo sapiens
atacacatatgtgtgtatatgt

SEQ ID NO: 7924662 - DNA, 22 bp, Homo sapiens
atacacatatgtgtgtatatgt

SEQ ID NO: 7924663 - DNA, 20 bp, Homo sapiens
atacacatattcttgcaact

SEQ ID NO: 7924664 - DNA, 22 bp, Homo sapiens
atacacatatgtgtgtatatgt

SEQ ID NO: 7924665 - DNA, 20 bp, Homo sapiens
atacacatattcttgcaact

SEQ ID NO: 7924666 - DNA, 20 bp, Homo sapiens
atacacatattcttgcaact

SEQ ID NO: 7924667 - DNA, 20 bp, Homo sapiens
atacacatattcttgcaact

SEQ ID NO: 7924668 - DNA, 22 bp, Homo sapiens
atacacatgcacacatgtgtgt

SEQ ID NO: 7924669 - DNA, 22 bp, Homo sapiens
atacacatgcacacatgtgtgt

SEQ ID NO: 7924670 - DNA, 22 bp, Homo sapiens
atacacatgcacacatgtgtgt

SEQ ID NO: 7924671 - DNA, 22 bp, Homo sapiens
atacacatgcacacatgtgtgt

SEQ ID NO: 7924672 - DNA, 22 bp, Homo sapiens
atacacatgcacacatgtgtgt

SEQ ID NO: 7924673 - DNA, 20 bp, Homo sapiens
atacacatgcagacagatgc

SEQ ID NO: 7924674 - DNA, 22 bp, Homo sapiens
atacacatctatttaagagaca

SEQ ID NO: 7924675 - DNA, 22 bp, Homo sapiens
atacacatctatttaagagaca

SEQ ID NO: 7924676 - DNA, 22 bp, Homo sapiens
atacacatctatttaagagaca

SEQ ID NO: 7924677 - DNA, 20 bp, Homo sapiens
atacacatattcttgcaact

SEQ ID NO: 7924678 - DNA, 22 bp, Homo sapiens
atacacatctatttaagagaca

SEQ ID NO: 7924679 - DNA, 15 bp, Homo sapiens
atacacatgagggag

SEQ ID NO: 7924680 - DNA, 22 bp, Homo sapiens
ctgcctgggttcaagtcctgtt

SEQ ID NO: 7924681 - DNA, 22 bp, Homo sapiens
ctgcctggtactttaggcactt

SEQ ID NO: 7924682 - DNA, 22 bp, Homo sapiens
ctgcctggtactttaggcactt

SEQ ID NO: 7924683 - DNA, 22 bp, Homo sapiens
ctgcctggtactttaggcactt

SEQ ID NO: 7924684 - DNA, 22 bp, Homo sapiens
ctgcctgggttcaagtcctgtt

SEQ ID NO: 7924685 - DNA, 22 bp, Homo sapiens
ctgcctgggttcaagtcctgtt

SEQ ID NO: 7924686 - DNA, 22 bp, Homo sapiens
ctgcctggtctcaggcatgggg

SEQ ID NO: 7924687 - DNA, 22 bp, Homo sapiens
ctgcctggtctcaggcatgggg

SEQ ID NO: 7924688 - DNA, 22 bp, Homo sapiens
ctgcctggtactttaggcactt

SEQ ID NO: 7924689 - DNA, 22 bp, Homo sapiens
ctgcctggtctcaggcatgggg

SEQ ID NO: 7924690 - DNA, 22 bp, Homo sapiens
ctgcctggtctcaggcatgggg

SEQ ID NO: 7924691 - DNA, 22 bp, Homo sapiens
ctgcctggtctcaggcatgggg

SEQ ID NO: 7924692 - DNA, 22 bp, Homo sapiens
ataaagctttgaaatggagata

SEQ ID NO: 7924693 - DNA, 22 bp, Homo sapiens
ataaaggataatccattagact

SEQ ID NO: 7924694 - DNA, 22 bp, Homo sapiens
ataaaggataatccattagact

SEQ ID NO: 7924695 - DNA, 22 bp, Homo sapiens
ataaaggaaattccatgtctaa

SEQ ID NO: 7924696 - DNA, 22 bp, Homo sapiens
ataaaggaaattccatgtctaa

SEQ ID NO: 7924697 - DNA, 22 bp, Homo sapiens
ctgcctggggcatcagtcaagg

SEQ ID NO: 7924698 - DNA, 22 bp, Homo sapiens
ctgcctgggttcaagtcctgtt

SEQ ID NO: 7924699 - DNA, 22 bp, Homo sapiens
ctgcctggggcatcagtcaagg

SEQ ID NO: 7924700 - DNA, 22 bp, Homo sapiens
ctgcctgggttcaagtcctgtt

SEQ ID NO: 7924701 - DNA, 22 bp, Homo sapiens
ctgcctggaaggagcaagggga

SEQ ID NO: 7924702 - DNA, 22 bp, Homo sapiens
ctgcctggaaggagcaagggga

SEQ ID NO: 7924703 - DNA, 22 bp, Homo sapiens
ctgcctggaaggagcaagggga

SEQ ID NO: 7924704 - DNA, 22 bp, Homo sapiens
ctgcctggaaggagcaagggga

SEQ ID NO: 7924705 - DNA, 22 bp, Homo sapiens
ctgcctgtattgtctgcttggg

SEQ ID NO: 7924706 - DNA, 22 bp, Homo sapiens
ctgcctgtattgtctgcttggg

SEQ ID NO: 7924707 - DNA, 22 bp, Homo sapiens
ctgcctggtgcggtgcccaccc

SEQ ID NO: 7924708 - DNA, 22 bp, Homo sapiens
ctgcctgtaactttctgaagca

SEQ ID NO: 7924709 - DNA, 22 bp, Homo sapiens
ctgcctgtaactttctgaagca

SEQ ID NO: 7924710 - DNA, 22 bp, Homo sapiens
ctgcctggtgcggtgcccaccc

SEQ ID NO: 7924711 - DNA, 22 bp, Homo sapiens
ctgcctggtgcggtgcccaccc

SEQ ID NO: 7924712 - DNA, 22 bp, Homo sapiens
ctgcctggtgcggtgcccaccc

SEQ ID NO: 7924713 - DNA, 22 bp, Homo sapiens
ctgcctgtgatttttctctagt

SEQ ID NO: 7924714 - DNA, 22 bp, Homo sapiens
ctgcctgtgaacatactggggg

SEQ ID NO: 7924715 - DNA, 22 bp, Homo sapiens
ctgcctgtattgtctgcttggg

SEQ ID NO: 7924716 - DNA, 22 bp, Homo sapiens
ctgcctgtgaacatactggggg

SEQ ID NO: 7924717 - DNA, 22 bp, Homo sapiens
ctgcctgtgcatgcagtcagaa

SEQ ID NO: 7924718 - DNA, 22 bp, Homo sapiens
ctgcctgtgatttttctctagt

SEQ ID NO: 7924719 - DNA, 22 bp, Homo sapiens
ctgcctgtgcatgcagtcagaa

SEQ ID NO: 7924720 - DNA, 22 bp, Homo sapiens
ctgctaaacctctctgagagct

SEQ ID NO: 7924721 - DNA, 22 bp, Homo sapiens
ctgcgtttgggtagaggcgagt

SEQ ID NO: 7924722 - DNA, 22 bp, Homo sapiens
ctgcgttttgacatttcggggc

SEQ ID NO: 7924723 - DNA, 22 bp, Homo sapiens
ctgctacagtttaaaggggaag

SEQ ID NO: 7924724 - DNA, 22 bp, Homo sapiens
ctgcgtttagagtaggaggcat

SEQ ID NO: 7924725 - DNA, 22 bp, Homo sapiens
ctgcctgtgccaatgctccttt

SEQ ID NO: 7924726 - DNA, 22 bp, Homo sapiens
ctgcctgtgccaatgctccttt

SEQ ID NO: 7924727 - DNA, 22 bp, Homo sapiens
ctgcctgtgccaccgcctcatt

SEQ ID NO: 7924728 - DNA, 22 bp, Homo sapiens
ctgctagggttcagcagtgcct

SEQ ID NO: 7924729 - DNA, 22 bp, Homo sapiens
ctgctagggttcagcagtgcct

SEQ ID NO: 7924730 - DNA, 22 bp, Homo sapiens
ctgctagcccgccggccagcga

SEQ ID NO: 7924731 - DNA, 22 bp, Homo sapiens
ctgctcacgccaccgttcatca

SEQ ID NO: 7924732 - DNA, 22 bp, Homo sapiens
ctgctcaagtgcgcacccaggg

SEQ ID NO: 7924733 - DNA, 22 bp, Homo sapiens
ctgctattggaaggaggcatga

SEQ ID NO: 7924734 - DNA, 22 bp, Homo sapiens
ctgctagcccgccggccagcga

SEQ ID NO: 7924735 - DNA, 22 bp, Homo sapiens
ctgctagcccaggatgcaggga

SEQ ID NO: 7924736 - DNA, 22 bp, Homo sapiens
ctgctagcccaggatgcaggga

SEQ ID NO: 7924737 - DNA, 21 bp, Homo sapiens
ctgctacttttcttactgtag

SEQ ID NO: 7924738 - DNA, 22 bp, Homo sapiens
ctgctacttttgcctgagtaac

SEQ ID NO: 7924739 - DNA, 22 bp, Homo sapiens
ctgctacttaccagctgtgtaa

SEQ ID NO: 7924740 - DNA, 21 bp, Homo sapiens
ctgctacttcatggaaaatag

SEQ ID NO: 7924741 - DNA, 22 bp, Homo sapiens
ctgctactggttctgcttgttc

SEQ ID NO: 7924742 - DNA, 19 bp, Homo sapiens
ctgctcagagcagctccag

SEQ ID NO: 7924743 - DNA, 19 bp, Homo sapiens
ctgctcagagcagctccag

SEQ ID NO: 7924744 - DNA, 20 bp, Homo sapiens
ctgctcagaccaactcttct

SEQ ID NO: 7924745 - DNA, 20 bp, Homo sapiens
ctgctcagaccaactcttct

SEQ ID NO: 7924746 - DNA, 19 bp, Homo sapiens
ctgctcagagcagctccag

SEQ ID NO: 7924747 - DNA, 22 bp, Homo sapiens
ctgctcagcggaaggaagagcg

SEQ ID NO: 7924748 - DNA, 22 bp, Homo sapiens
ctgctcagaggaaggaatgtct

SEQ ID NO: 7924749 - DNA, 19 bp, Homo sapiens
ctgctcaggtcagtctgtc

SEQ ID NO: 7924750 - DNA, 19 bp, Homo sapiens
ctgctcaggtcagtctgtc

SEQ ID NO: 7924751 - DNA, 22 bp, Homo sapiens
ctgctgggcctggtctctgagg

SEQ ID NO: 7924752 - DNA, 22 bp, Homo sapiens
ctgctgggcctggtctctgagg

SEQ ID NO: 7924753 - DNA, 22 bp, Homo sapiens
ctgctgggcctggtctctgagg

SEQ ID NO: 7924754 - DNA, 22 bp, Homo sapiens
ctgctgggcctggtctctgagg

SEQ ID NO: 7924755 - DNA, 22 bp, Homo sapiens
ctgctgggcctggtctctgagg

SEQ ID NO: 7924756 - DNA, 22 bp, Homo sapiens
ctgctgggcctggtctctgagg

SEQ ID NO: 7924757 - DNA, 22 bp, Homo sapiens
ctgctgggcagaggctgcatga

SEQ ID NO: 7924758 - DNA, 22 bp, Homo sapiens
ctgctgggcctggtctctgagg

SEQ ID NO: 7924759 - DNA, 22 bp, Homo sapiens
ctgctgggcagaggctgcatga

SEQ ID NO: 7924760 - DNA, 22 bp, Homo sapiens
ctgctagggttcagcagtgcct

SEQ ID NO: 7924761 - DNA, 22 bp, Homo sapiens
ctgctgcccagtgtgcattggg

SEQ ID NO: 7924762 - DNA, 19 bp, Homo sapiens
ctgctcaggtcagtctgtc

SEQ ID NO: 7924763 - DNA, 22 bp, Homo sapiens
ctgctgggctcctcatgtgact

SEQ ID NO: 7924764 - DNA, 22 bp, Homo sapiens
ctgctgggctcctcatgtgact

SEQ ID NO: 7924765 - DNA, 22 bp, Homo sapiens
ctgctgggctcctcatgtgact

SEQ ID NO: 7924766 - DNA, 22 bp, Homo sapiens
ctgctgggctcctcatgtgact

SEQ ID NO: 7924767 - DNA, 22 bp, Homo sapiens
ctgctgggctcctcatgtgact

SEQ ID NO: 7924768 - DNA, 22 bp, Homo sapiens
ctgctggggaggcgcctcgacg

SEQ ID NO: 7924769 - DNA, 22 bp, Homo sapiens
ctgctggggaggcgcctcgacg

SEQ ID NO: 7924770 - DNA, 22 bp, Homo sapiens
ctgctggggaggcgcctcgacg

SEQ ID NO: 7924771 - DNA, 22 bp, Homo sapiens
ctgctgggctcctcatgtgact

SEQ ID NO: 7924772 - DNA, 22 bp, Homo sapiens
ctgctgggggacacaggtccgg

SEQ ID NO: 7924773 - DNA, 22 bp, Homo sapiens
ctgctgggggacacaggtccgg

SEQ ID NO: 7924774 - DNA, 22 bp, Homo sapiens
ctgctggggaggcgcctcgacg

SEQ ID NO: 7924775 - DNA, 22 bp, Homo sapiens
ctgctggggaggcgcctcgacg

SEQ ID NO: 7924776 - DNA, 22 bp, Homo sapiens
ataaagcaggtccccagacact

SEQ ID NO: 7924777 - DNA, 22 bp, Homo sapiens
ataaagcaggtccccagacact

SEQ ID NO: 7924778 - DNA, 22 bp, Homo sapiens
ataaagcaatagattgtgtaat

SEQ ID NO: 7924779 - DNA, 22 bp, Homo sapiens
ataaagcaaataggactattgc

SEQ ID NO: 7924780 - DNA, 22 bp, Homo sapiens
ataaagcaagcataccattaag

SEQ ID NO: 7924781 - DNA, 22 bp, Homo sapiens
ataaagcaagcataccattaag

SEQ ID NO: 7924782 - DNA, 22 bp, Homo sapiens
ataaagctaagacttacatgaa

SEQ ID NO: 7924783 - DNA, 22 bp, Homo sapiens
ataaagcatgcttgtttggaga

SEQ ID NO: 7924784 - DNA, 22 bp, Homo sapiens
ataaagcatctagtctgtcact

SEQ ID NO: 7924785 - DNA, 22 bp, Homo sapiens
ataaagatttctttttctctac

SEQ ID NO: 7924786 - DNA, 22 bp, Homo sapiens
ataaagatttctttttctctac

SEQ ID NO: 7924787 - DNA, 22 bp, Homo sapiens
ataaagatttttaggcatttct

SEQ ID NO: 7924788 - DNA, 22 bp, Homo sapiens
ataaagatttttaggcatttct

SEQ ID NO: 7924789 - DNA, 22 bp, Homo sapiens
ataaagaggatgtatttacagc

SEQ ID NO: 7924790 - DNA, 22 bp, Homo sapiens
ataaagaggatgtatttacagc

SEQ ID NO: 7924791 - DNA, 22 bp, Homo sapiens
ataaagagtctgggaggcccac

SEQ ID NO: 7924792 - DNA, 22 bp, Homo sapiens
ataaagatttctttttctctac

SEQ ID NO: 7924793 - DNA, 22 bp, Homo sapiens
ataaagaggatgtatttacagc

SEQ ID NO: 7924794 - DNA, 22 bp, Homo sapiens
ataaagaggatgtatttacagc

SEQ ID NO: 7924795 - DNA, 22 bp, Homo sapiens
ataaagaccagtatcttatgtt

SEQ ID NO: 7924796 - DNA, 22 bp, Homo sapiens
ataaagaggatgtatttacagc

SEQ ID NO: 7924797 - DNA, 22 bp, Homo sapiens
ataaactggtaggaaaacagta

SEQ ID NO: 7924798 - DNA, 22 bp, Homo sapiens
ataaactgggtatcaagaggcc

SEQ ID NO: 7924799 - DNA, 22 bp, Homo sapiens
ataaactgggtatcaagaggcc

SEQ ID NO: 7924800 - DNA, 23 bp, Homo sapiens
ataaactgtcaaaagccagccct

SEQ ID NO: 7924801 - DNA, 22 bp, Homo sapiens
ataaacttgagtctcagagtat

SEQ ID NO: 7924802 - DNA, 22 bp, Homo sapiens
ataaacttgagtctcagagtat

SEQ ID NO: 7924803 - DNA, 21 bp, Homo sapiens
ataaagacaaacactatttgg

SEQ ID NO: 7924804 - DNA, 22 bp, Homo sapiens
ctgcagggaactgaggcccaga

SEQ ID NO: 7924805 - DNA, 22 bp, Homo sapiens
ctgcagggaccacaagcaggtt

SEQ ID NO: 7924806 - DNA, 22 bp, Homo sapiens
ctgcaggcttccagggctgtgg

SEQ ID NO: 7924807 - DNA, 22 bp, Homo sapiens
ctgcaggcttccagggctgtgg

SEQ ID NO: 7924808 - DNA, 22 bp, Homo sapiens
ctgcagggaactgaggcccaga

SEQ ID NO: 7924809 - DNA, 22 bp, Homo sapiens
ctgcaggcttccagggctgtgg

SEQ ID NO: 7924810 - DNA, 22 bp, Homo sapiens
ctgcaggctgagcgcctgccgg

SEQ ID NO: 7924811 - DNA, 22 bp, Homo sapiens
ctgcaggctgagcgcctgccgg

SEQ ID NO: 7924812 - DNA, 22 bp, Homo sapiens
ctgcagggaccacaagcaggtt

SEQ ID NO: 7924813 - DNA, 22 bp, Homo sapiens
ctgcagggaccacaagcaggtt

SEQ ID NO: 7924814 - DNA, 22 bp, Homo sapiens
ctgcagggaactgaggcccaga

SEQ ID NO: 7924815 - DNA, 22 bp, Homo sapiens
ctgcagggaccacaagcaggtt

SEQ ID NO: 7924816 - DNA, 22 bp, Homo sapiens
ctgcagggaccacaagcaggtt

SEQ ID NO: 7924817 - DNA, 22 bp, Homo sapiens
ctgcagggaccacaagcaggtt

SEQ ID NO: 7924818 - DNA, 22 bp, Homo sapiens
ctgcagggagaggggacagcct

SEQ ID NO: 7924819 - DNA, 22 bp, Homo sapiens
ctgcagggagaggggacagcct

SEQ ID NO: 7924820 - DNA, 22 bp, Homo sapiens
ctgcagggagaggggacagcct

SEQ ID NO: 7924821 - DNA, 22 bp, Homo sapiens
ctgcagggacccaagtctttgg

SEQ ID NO: 7924822 - DNA, 22 bp, Homo sapiens
ataaactcatgccaagaaatga

SEQ ID NO: 7924823 - DNA, 22 bp, Homo sapiens
ataaactcatgctgaaaaccca

SEQ ID NO: 7924824 - DNA, 22 bp, Homo sapiens
ataaactaattggggtatagtt

SEQ ID NO: 7924825 - DNA, 22 bp, Homo sapiens
ataaactcatgccaagaaatga

SEQ ID NO: 7924826 - DNA, 22 bp, Homo sapiens
ataaaccagaagtaaaagctac

SEQ ID NO: 7924827 - DNA, 22 bp, Homo sapiens
ataaactctgcctcagaagagc

SEQ ID NO: 7924828 - DNA, 22 bp, Homo sapiens
ataaactgaagggaacactgag

SEQ ID NO: 7924829 - DNA, 22 bp, Homo sapiens
ataaactctgcctcagaagagc

SEQ ID NO: 7924830 - DNA, 22 bp, Homo sapiens
ataaactctattttgaggagat

SEQ ID NO: 7924831 - DNA, 22 bp, Homo sapiens
ataaaatctttatgtgctctgc

SEQ ID NO: 7924832 - DNA, 22 bp, Homo sapiens
ataaacatctgtttctcttctg

SEQ ID NO: 7924833 - DNA, 22 bp, Homo sapiens
ataaacatctgtttctcttctg

SEQ ID NO: 7924834 - DNA, 22 bp, Homo sapiens
ataaacatctgtttctcttctg

SEQ ID NO: 7924835 - DNA, 22 bp, Homo sapiens
ataaacatctgtttctcttctg

SEQ ID NO: 7924836 - DNA, 22 bp, Homo sapiens
ataaaagatcccttctgagctc

SEQ ID NO: 7924837 - DNA, 22 bp, Homo sapiens
ataaaagaagttttggtacttg

SEQ ID NO: 7924838 - DNA, 22 bp, Homo sapiens
ataaaagaagttttggtacttg

SEQ ID NO: 7924839 - DNA, 22 bp, Homo sapiens
ataaaagaagttttggtacttg

SEQ ID NO: 7924840 - DNA, 22 bp, Homo sapiens
ataaaagaagttttggtacttg

SEQ ID NO: 7924841 - DNA, 22 bp, Homo sapiens
ataaaagatcccttctgagctc

SEQ ID NO: 7924842 - DNA, 22 bp, Homo sapiens
ataaaagatcccttctgagctc

SEQ ID NO: 7924843 - DNA, 22 bp, Homo sapiens
ctgcaggctcgaagacacggat

SEQ ID NO: 7924844 - DNA, 22 bp, Homo sapiens
ctgcaggctgagcgcctgccgg

SEQ ID NO: 7924845 - DNA, 22 bp, Homo sapiens
ataaaacttattagaattgtgt

SEQ ID NO: 7924846 - DNA, 22 bp, Homo sapiens
ataaaacttattagaattgtgt

SEQ ID NO: 7924847 - DNA, 22 bp, Homo sapiens
ataaaacttattagaattgtgt

SEQ ID NO: 7924848 - DNA, 22 bp, Homo sapiens
ataaaacttattagaattgtgt

SEQ ID NO: 7924849 - DNA, 22 bp, Homo sapiens
ataaaacttattagaattgtgt

SEQ ID NO: 7924850 - DNA, 22 bp, Homo sapiens
ataaaacttgggtatgatccct

SEQ ID NO: 7924851 - DNA, 22 bp, Homo sapiens
ataaaacttgggtatgatccct

SEQ ID NO: 7924852 - DNA, 22 bp, Homo sapiens
ataaaacttgggtatgatccct

SEQ ID NO: 7924853 - DNA, 22 bp, Homo sapiens
ataaaacttgggtatgatccct

SEQ ID NO: 7924854 - DNA, 22 bp, Homo sapiens
ataaaagaagttttggtacttg

SEQ ID NO: 7924855 - DNA, 22 bp, Homo sapiens
ataaaacttgggtatgatccct

SEQ ID NO: 7924856 - DNA, 22 bp, Homo sapiens
ataaaaactgacccatcctttg

SEQ ID NO: 7924857 - DNA, 22 bp, Homo sapiens
agttttgtaattctcaaaaata

SEQ ID NO: 7924858 - DNA, 22 bp, Homo sapiens
agttttgtaattctcaaaaata

SEQ ID NO: 7924859 - DNA, 17 bp, Homo sapiens
agttttgatataatggc

SEQ ID NO: 7924860 - DNA, 22 bp, Homo sapiens
agttttgtaattctcaaaaata

SEQ ID NO: 7924861 - DNA, 22 bp, Homo sapiens
agttcttcataaccttactgtg

SEQ ID NO: 7924862 - DNA, 22 bp, Homo sapiens
agttcttattttggaactgagg

SEQ ID NO: 7924863 - DNA, 22 bp, Homo sapiens
agttcttacaggggacctttga

SEQ ID NO: 7924864 - DNA, 22 bp, Homo sapiens
agttcttattgaatagaaatca

SEQ ID NO: 7924865 - DNA, 22 bp, Homo sapiens
agttctgttgtctagggaagcc

SEQ ID NO: 7924866 - DNA, 22 bp, Homo sapiens
agttctgttgtctagggaagcc

SEQ ID NO: 7924867 - DNA, 21 bp, Homo sapiens
agttctgttatgctggactca

SEQ ID NO: 7924868 - DNA, 22 bp, Homo sapiens
ataaaaaggacagatgtggtct

SEQ ID NO: 7924869 - DNA, 22 bp, Homo sapiens
ataaaaaggacagatgtggtct

SEQ ID NO: 7924870 - DNA, 22 bp, Homo sapiens
ataaaaaggacagatgtggtct

SEQ ID NO: 7924871 - DNA, 22 bp, Homo sapiens
ataaaaaggacagatgtggtct

SEQ ID NO: 7924872 - DNA, 22 bp, Homo sapiens
ataaaaaggacagatgtggtct

SEQ ID NO: 7924873 - DNA, 22 bp, Homo sapiens
ataaaaaggacagatgtggtct

SEQ ID NO: 7924874 - DNA, 22 bp, Homo sapiens
ataaaaaggacagatgtggtct

SEQ ID NO: 7924875 - DNA, 22 bp, Homo sapiens
ataaaaaggacagatgtggtct

SEQ ID NO: 7924876 - DNA, 22 bp, Homo sapiens
ataaaaatgagggcggtagcta

SEQ ID NO: 7924877 - DNA, 22 bp, Homo sapiens
ataaaaatgagggcggtagcta

SEQ ID NO: 7924878 - DNA, 22 bp, Homo sapiens
ataaaaatgagggcggtagcta

SEQ ID NO: 7924879 - DNA, 22 bp, Homo sapiens
ataaaaccaaagcagcagtgtt

SEQ ID NO: 7924880 - DNA, 22 bp, Homo sapiens
ataaaaccaaagcagcagtgtt

SEQ ID NO: 7924881 - DNA, 22 bp, Homo sapiens
ataaaaatgagggcggtagcta

SEQ ID NO: 7924882 - DNA, 22 bp, Homo sapiens
ataaaaatgagggcggtagcta

SEQ ID NO: 7924883 - DNA, 22 bp, Homo sapiens
agttctcttggaagttatgtga

SEQ ID NO: 7924884 - DNA, 22 bp, Homo sapiens
agttctctggctcctttccaga

SEQ ID NO: 7924885 - DNA, 22 bp, Homo sapiens
agttctctttagctcatatggt

SEQ ID NO: 7924886 - DNA, 22 bp, Homo sapiens
agttctctttagctcatatggt

SEQ ID NO: 7924887 - DNA, 22 bp, Homo sapiens
agttctgcctatatagaaactc

SEQ ID NO: 7924888 - DNA, 22 bp, Homo sapiens
agttctgctatcttgtcttctt

SEQ ID NO: 7924889 - DNA, 22 bp, Homo sapiens
agttctggtggtttggagatct

SEQ ID NO: 7924890 - DNA, 22 bp, Homo sapiens
agttctggtggtttggagatct

SEQ ID NO: 7924891 - DNA, 22 bp, Homo sapiens
agttctgggaaaaacatggcca

SEQ ID NO: 7924892 - DNA, 22 bp, Homo sapiens
agttctggcggctgtcggcact

SEQ ID NO: 7924893 - DNA, 22 bp, Homo sapiens
agttctggcgcccatgagcaga

SEQ ID NO: 7924894 - DNA, 22 bp, Homo sapiens
agttctggaactctacagcaac

SEQ ID NO: 7924895 - DNA, 22 bp, Homo sapiens
agttctgtggctgtgccctgta

SEQ ID NO: 7924896 - DNA, 22 bp, Homo sapiens
agttctgtgacaatatcattac

SEQ ID NO: 7924897 - DNA, 22 bp, Homo sapiens
agttctgtcctccccactcttt

SEQ ID NO: 7924898 - DNA, 22 bp, Homo sapiens
agttctggttgcccatgacatc

SEQ ID NO: 7924899 - DNA, 22 bp, Homo sapiens
agttctctatgaagtctattgt

SEQ ID NO: 7924900 - DNA, 22 bp, Homo sapiens
agttctcgagcgtccctgtttc

SEQ ID NO: 7924901 - DNA, 22 bp, Homo sapiens
agttctcattgcatgagacaga

SEQ ID NO: 7924902 - DNA, 23 bp, Homo sapiens
agttctcattcatcacggcctat

SEQ ID NO: 7924903 - DNA, 23 bp, Homo sapiens
agttctcattcatcacggcctat

SEQ ID NO: 7924904 - DNA, 22 bp, Homo sapiens
agttctcataaacgtccttgga

SEQ ID NO: 7924905 - DNA, 22 bp, Homo sapiens
agttctcagaattgcacctcaa

SEQ ID NO: 7924906 - DNA, 22 bp, Homo sapiens
agttctcagaattgcacctcaa

SEQ ID NO: 7924907 - DNA, 22 bp, Homo sapiens
agttctcaagacaattacctgt

SEQ ID NO: 7924908 - DNA, 22 bp, Homo sapiens
agttctcaaggttaggaaaagt

SEQ ID NO: 7924909 - DNA, 22 bp, Homo sapiens
agttctcataaacgtccttgga

SEQ ID NO: 7924910 - DNA, 22 bp, Homo sapiens
agttctcagcttagtatgctgt

SEQ ID NO: 7924911 - DNA, 22 bp, Homo sapiens
agttctcaggtcagctgagtct

SEQ ID NO: 7924912 - DNA, 22 bp, Homo sapiens
agttctcagcttagtatgctgt

SEQ ID NO: 7924913 - DNA, 22 bp, Homo sapiens
agttctcagaattgcacctcaa

SEQ ID NO: 7924914 - DNA, 22 bp, Homo sapiens
agttcgagatctgctgatgaga

SEQ ID NO: 7924915 - DNA, 22 bp, Homo sapiens
agttccttttatctgagtctaa

SEQ ID NO: 7924916 - DNA, 22 bp, Homo sapiens
agttctaagatgctccacagag

SEQ ID NO: 7924917 - DNA, 22 bp, Homo sapiens
agttccttttatctgagtctaa

SEQ ID NO: 7924918 - DNA, 22 bp, Homo sapiens
agttccttgatgttctatggac

SEQ ID NO: 7924919 - DNA, 22 bp, Homo sapiens
agttctaagtaaatattttata

SEQ ID NO: 7924920 - DNA, 23 bp, Homo sapiens
agttctcaaaaccagcttgacaa

SEQ ID NO: 7924921 - DNA, 22 bp, Homo sapiens
agttctatttctaacatgttat

SEQ ID NO: 7924922 - DNA, 22 bp, Homo sapiens
agttctcaagacaattacctgt

SEQ ID NO: 7924923 - DNA, 22 bp, Homo sapiens
agttctatttctaacatgttat

SEQ ID NO: 7924924 - DNA, 21 bp, Homo sapiens
agttctatagtcttcacagcc

SEQ ID NO: 7924925 - DNA, 22 bp, Homo sapiens
agttctattgggtaggttctgt

SEQ ID NO: 7924926 - DNA, 22 bp, Homo sapiens
agttctatttctaacatgttat

SEQ ID NO: 7924927 - DNA, 22 bp, Homo sapiens
agttctatttctaacatgttat

SEQ ID NO: 7924928 - DNA, 22 bp, Homo sapiens
agttctattgggtaggttctgt

SEQ ID NO: 7924929 - DNA, 22 bp, Homo sapiens
agttctataattaaaatgaagg

SEQ ID NO: 7924930 - DNA, 22 bp, Homo sapiens
atctgttaacaaagaagacagc

SEQ ID NO: 7924931 - DNA, 22 bp, Homo sapiens
atctgtgtgttcaggaagtcct

SEQ ID NO: 7924932 - DNA, 22 bp, Homo sapiens
atctgttatttacccatctctg

SEQ ID NO: 7924933 - DNA, 22 bp, Homo sapiens
atctgttcccctatgctctcta

SEQ ID NO: 7924934 - DNA, 22 bp, Homo sapiens
atctgttatttacccatctctg

SEQ ID NO: 7924935 - DNA, 22 bp, Homo sapiens
atcttatttaacacagcaaaac

SEQ ID NO: 7924936 - DNA, 22 bp, Homo sapiens
atctgttcttgtgtcagtaatt

SEQ ID NO: 7924937 - DNA, 22 bp, Homo sapiens
atctgttcttgtgtcagtaatt

SEQ ID NO: 7924938 - DNA, 23 bp, Homo sapiens
atctgttcatctgacacagattc

SEQ ID NO: 7924939 - DNA, 22 bp, Homo sapiens
atctgttcccctatgctctcta

SEQ ID NO: 7924940 - DNA, 22 bp, Homo sapiens
atcttatttaacacagcaaaac

SEQ ID NO: 7924941 - DNA, 22 bp, Homo sapiens
atcttatttaacacagcaaaac

SEQ ID NO: 7924942 - DNA, 22 bp, Homo sapiens
atcttcaaagaatttcttgtcc

SEQ ID NO: 7924943 - DNA, 22 bp, Homo sapiens
atctgtgtgttattgtttatca

SEQ ID NO: 7924944 - DNA, 22 bp, Homo sapiens
atctgtgtatgtgaccttatct

SEQ ID NO: 7924945 - DNA, 22 bp, Homo sapiens
atctgtgtccttataagagaca

SEQ ID NO: 7924946 - DNA, 23 bp, Homo sapiens
atctgtgtgtgggtagggatgat

SEQ ID NO: 7924947 - DNA, 22 bp, Homo sapiens
atctgtggcagtgatgagtctt

SEQ ID NO: 7924948 - DNA, 22 bp, Homo sapiens
atctgtgtatgaaagtataact

SEQ ID NO: 7924949 - DNA, 22 bp, Homo sapiens
atctgtggatatgaccttcctg

SEQ ID NO: 7924950 - DNA, 22 bp, Homo sapiens
atctgtgagaaaggcttgtgct

SEQ ID NO: 7924951 - DNA, 22 bp, Homo sapiens
atctgtcttttattcatgagct

SEQ ID NO: 7924952 - DNA, 22 bp, Homo sapiens
atctgtcttttaatgttaatgc

SEQ ID NO: 7924953 - DNA, 22 bp, Homo sapiens
atctgtcttttattcatgagct

SEQ ID NO: 7924954 - DNA, 22 bp, Homo sapiens
atctgtcttttattcatgagct

SEQ ID NO: 7924955 - DNA, 22 bp, Homo sapiens
atctgtcttccaccacacatcc

SEQ ID NO: 7924956 - DNA, 22 bp, Homo sapiens
atctgtctgggtgcagcagtcc

SEQ ID NO: 7924957 - DNA, 22 bp, Homo sapiens
atctgtcttccaccacacatcc

SEQ ID NO: 7924958 - DNA, 22 bp, Homo sapiens
atctgtcttgccttgcatattt

SEQ ID NO: 7924959 - DNA, 22 bp, Homo sapiens
atctgtcttgccttgcatattt

SEQ ID NO: 7924960 - DNA, 22 bp, Homo sapiens
atctgtcttgccttgcatattt

SEQ ID NO: 7924961 - DNA, 22 bp, Homo sapiens
atctgtctggaggcctggcatg

SEQ ID NO: 7924962 - DNA, 22 bp, Homo sapiens
atctgtctggaggcctggcatg

SEQ ID NO: 7924963 - DNA, 22 bp, Homo sapiens
atctgtctatgatatagtctgt

SEQ ID NO: 7924964 - DNA, 22 bp, Homo sapiens
atctgtcctgtgacagtgggag

SEQ ID NO: 7924965 - DNA, 22 bp, Homo sapiens
atctgtcctccagcatctccat

SEQ ID NO: 7924966 - DNA, 22 bp, Homo sapiens
atctgtcctctgtctggaggct

SEQ ID NO: 7924967 - DNA, 22 bp, Homo sapiens
atctggtgacacgaggagctgg

SEQ ID NO: 7924968 - DNA, 22 bp, Homo sapiens
atctggctctctcatttacaaa

SEQ ID NO: 7924969 - DNA, 22 bp, Homo sapiens
atctgggtttcaaagaagcctt

SEQ ID NO: 7924970 - DNA, 22 bp, Homo sapiens
atctggctcacttagtctagga

SEQ ID NO: 7924971 - DNA, 22 bp, Homo sapiens
cttcttaaatatttggctgact

SEQ ID NO: 7924972 - DNA, 22 bp, Homo sapiens
cttcttaaagattacacaatga

SEQ ID NO: 7924973 - DNA, 22 bp, Homo sapiens
cttcttaaagattacacaatga

SEQ ID NO: 7924974 - DNA, 22 bp, Homo sapiens
cttcttaatcccttatatattt

SEQ ID NO: 7924975 - DNA, 22 bp, Homo sapiens
cttcttaactgtatatactatg

SEQ ID NO: 7924976 - DNA, 22 bp, Homo sapiens
atctggttttggctgtgtccct

SEQ ID NO: 7924977 - DNA, 22 bp, Homo sapiens
atctggttcttcttaggcatca

SEQ ID NO: 7924978 - DNA, 22 bp, Homo sapiens
atctggttcttcttaggcatca

SEQ ID NO: 7924979 - DNA, 22 bp, Homo sapiens
atctgtaaataaaaagggaggt

SEQ ID NO: 7924980 - DNA, 22 bp, Homo sapiens
atctgtaacacacagaggagaa

SEQ ID NO: 7924981 - DNA, 22 bp, Homo sapiens
atctgtaacatcagtagcagaa

SEQ ID NO: 7924982 - DNA, 22 bp, Homo sapiens
atctgtaacacacagaggagaa

SEQ ID NO: 7924983 - DNA, 22 bp, Homo sapiens
atctgtaacatcagtagcagaa

SEQ ID NO: 7924984 - DNA, 22 bp, Homo sapiens
atctgtaattttgaatgcaaat

SEQ ID NO: 7924985 - DNA, 22 bp, Homo sapiens
atctgtaattttgaatgcaaat

SEQ ID NO: 7924986 - DNA, 22 bp, Homo sapiens
atctgtaattttgaatgcaaat

SEQ ID NO: 7924987 - DNA, 22 bp, Homo sapiens
atctgtactaattaattaatgt

SEQ ID NO: 7924988 - DNA, 22 bp, Homo sapiens
atctgtagaagatactctgaga

SEQ ID NO: 7924989 - DNA, 22 bp, Homo sapiens
atctgtacaagattttatgcgt

SEQ ID NO: 7924990 - DNA, 22 bp, Homo sapiens
atctgtagaagatactctgaga

SEQ ID NO: 7924991 - DNA, 22 bp, Homo sapiens
atctgtcatcagcaccacaggt

SEQ ID NO: 7924992 - DNA, 22 bp, Homo sapiens
atctgtcaggagcaaggactac

SEQ ID NO: 7924993 - DNA, 22 bp, Homo sapiens
atctgtcagcctgggattaggg

SEQ ID NO: 7924994 - DNA, 22 bp, Homo sapiens
atctgtcaagatagactctgca

SEQ ID NO: 7924995 - DNA, 22 bp, Homo sapiens
atctgtcaggagcaaggactac

SEQ ID NO: 7924996 - DNA, 22 bp, Homo sapiens
atctgtcaagatagactctgca

SEQ ID NO: 7924997 - DNA, 22 bp, Homo sapiens
atctgtatgttgacctcctaga

SEQ ID NO: 7924998 - DNA, 22 bp, Homo sapiens
cttctgtggtaaactttgttgt

SEQ ID NO: 7924999 - DNA, 22 bp, Homo sapiens
cttctgtggatgttggatgcat

SEQ ID NO: 7925000 - DNA, 22 bp, Homo sapiens
cttctgtggatatgttctctct

SEQ ID NO: 7925001 - DNA, 22 bp, Homo sapiens
cttctgtggatatgttctctct

SEQ ID NO: 7925002 - DNA, 22 bp, Homo sapiens
cttctgtgcttcacagttgcca

SEQ ID NO: 7925003 - DNA, 22 bp, Homo sapiens
cttctgtgttttactatatgta

SEQ ID NO: 7925004 - DNA, 22 bp, Homo sapiens
cttctgtgttaaatgagtcttt

SEQ ID NO: 7925005 - DNA, 22 bp, Homo sapiens
cttctgttactgttagctgaag

SEQ ID NO: 7925006 - DNA, 22 bp, Homo sapiens
cttctgtgtagaaaggtagccc

SEQ ID NO: 7925007 - DNA, 22 bp, Homo sapiens
cttctgtgttaaatgagtcttt

SEQ ID NO: 7925008 - DNA, 22 bp, Homo sapiens
cttctgtgcgcctctattccct

SEQ ID NO: 7925009 - DNA, 22 bp, Homo sapiens
cttctgtgcttcacagttgcca

SEQ ID NO: 7925010 - DNA, 22 bp, Homo sapiens
cttctgtgcaattgtggaggag

SEQ ID NO: 7925011 - DNA, 23 bp, Homo sapiens
cttctgtgcaagagggagggaaa

SEQ ID NO: 7925012 - DNA, 22 bp, Homo sapiens
cttctgtgcaattgtggaggag

SEQ ID NO: 7925013 - DNA, 22 bp, Homo sapiens
cttctgcccctgtagcctgagt

SEQ ID NO: 7925014 - DNA, 22 bp, Homo sapiens
cttctgctgccgcctcggcaca

SEQ ID NO: 7925015 - DNA, 22 bp, Homo sapiens
cttctgctgccgcctcggcaca

SEQ ID NO: 7925016 - DNA, 22 bp, Homo sapiens
cttctgtgatttggttaggata

SEQ ID NO: 7925017 - DNA, 22 bp, Homo sapiens
cttctgtgatttggttaggata

SEQ ID NO: 7925018 - DNA, 19 bp, Homo sapiens
cttctgcagggtgacagtg

SEQ ID NO: 7925019 - DNA, 19 bp, Homo sapiens
cttctgcagggtgacagtg

SEQ ID NO: 7925020 - DNA, 19 bp, Homo sapiens
cttctgcagggtgacagtg

SEQ ID NO: 7925021 - DNA, 19 bp, Homo sapiens
cttctgcagggtgacagtg

SEQ ID NO: 7925022 - DNA, 22 bp, Homo sapiens
cttctgcccctgtagcctgagt

SEQ ID NO: 7925023 - DNA, 22 bp, Homo sapiens
cttctgcccctgtagcctgagt

SEQ ID NO: 7925024 - DNA, 22 bp, Homo sapiens
cttctgagcagacctcctgggg

SEQ ID NO: 7925025 - DNA, 22 bp, Homo sapiens
cttctgagcagacctcctgggg

SEQ ID NO: 7925026 - DNA, 22 bp, Homo sapiens
cttctgagatgttgttttacag

SEQ ID NO: 7925027 - DNA, 22 bp, Homo sapiens
cttctgagatgttgttttacag

SEQ ID NO: 7925028 - DNA, 22 bp, Homo sapiens
cttctgagatgttgttttacag

SEQ ID NO: 7925029 - DNA, 22 bp, Homo sapiens
cttctgagatgttgttttacag

SEQ ID NO: 7925030 - DNA, 22 bp, Homo sapiens
cttctgaggcagctattcagtt

SEQ ID NO: 7925031 - DNA, 22 bp, Homo sapiens
cttctgaggactctaaagagga

SEQ ID NO: 7925032 - DNA, 22 bp, Homo sapiens
cttctgaggactctaaagagga

SEQ ID NO: 7925033 - DNA, 22 bp, Homo sapiens
cttctgaggactctaaagagga

SEQ ID NO: 7925034 - DNA, 22 bp, Homo sapiens
cttctgagttaacagtagattt

SEQ ID NO: 7925035 - DNA, 22 bp, Homo sapiens
cttctgagttaacagtagattt

SEQ ID NO: 7925036 - DNA, 22 bp, Homo sapiens
cttctgagggcctttgcttcca

SEQ ID NO: 7925037 - DNA, 22 bp, Homo sapiens
cttctgagggcctttgcttcca

SEQ ID NO: 7925038 - DNA, 22 bp, Homo sapiens
cttctgcaggccctgtctgacc

SEQ ID NO: 7925039 - DNA, 22 bp, Homo sapiens
cttctgcaggccctgtctgacc

SEQ ID NO: 7925040 - DNA, 22 bp, Homo sapiens
cttctgcaggccctgtctgacc

SEQ ID NO: 7925041 - DNA, 22 bp, Homo sapiens
cttctgcaggccctgtctgacc

SEQ ID NO: 7925042 - DNA, 22 bp, Homo sapiens
cttctgcagaattaattcacta

SEQ ID NO: 7925043 - DNA, 22 bp, Homo sapiens
cttctgcaggagtcaactctgg

SEQ ID NO: 7925044 - DNA, 22 bp, Homo sapiens
cttctgcagaattaattcacta

SEQ ID NO: 7925045 - DNA, 19 bp, Homo sapiens
cttctgcagggtgacagtg

SEQ ID NO: 7925046 - DNA, 22 bp, Homo sapiens
cttctgcaagagcatcagttgt

SEQ ID NO: 7925047 - DNA, 22 bp, Homo sapiens
cttctcggccgtgtggatgcgc

SEQ ID NO: 7925048 - DNA, 22 bp, Homo sapiens
cttctccttatatgtcccgttc

SEQ ID NO: 7925049 - DNA, 22 bp, Homo sapiens
cttctccttatatgtcccgttc

SEQ ID NO: 7925050 - DNA, 22 bp, Homo sapiens
cttctccttatatgtcccgttc

SEQ ID NO: 7925051 - DNA, 23 bp, Homo sapiens
atctctctttattcttggggata

SEQ ID NO: 7925052 - DNA, 22 bp, Homo sapiens
cttctgagatgttgttttacag

SEQ ID NO: 7925053 - DNA, 22 bp, Homo sapiens
cttctgagatgttgttttacag

SEQ ID NO: 7925054 - DNA, 22 bp, Homo sapiens
cttctgagatgttgttttacag

SEQ ID NO: 7925055 - DNA, 22 bp, Homo sapiens
cttctgagatgttgttttacag

SEQ ID NO: 7925056 - DNA, 22 bp, Homo sapiens
cttctgagatgttgttttacag

SEQ ID NO: 7925057 - DNA, 22 bp, Homo sapiens
cttctgagatgttgttttacag

SEQ ID NO: 7925058 - DNA, 22 bp, Homo sapiens
cttctgagaggggctaggagca

SEQ ID NO: 7925059 - DNA, 22 bp, Homo sapiens
cttctgacccctggtctacagc

SEQ ID NO: 7925060 - DNA, 23 bp, Homo sapiens
atctctctggtggtcacagtcag

SEQ ID NO: 7925061 - DNA, 23 bp, Homo sapiens
atctctctggtggtcacagtcag

SEQ ID NO: 7925062 - DNA, 22 bp, Homo sapiens
atctctctgcccaggggctgtg

SEQ ID NO: 7925063 - DNA, 22 bp, Homo sapiens
atctctccttcagctgaggccc

SEQ ID NO: 7925064 - DNA, 22 bp, Homo sapiens
atctctctatgcactgaggact

SEQ ID NO: 7925065 - DNA, 22 bp, Homo sapiens
atctctccttatgaagcattat

SEQ ID NO: 7925066 - DNA, 22 bp, Homo sapiens
atctctatctttattgaaatct

SEQ ID NO: 7925067 - DNA, 22 bp, Homo sapiens
atctctagctaaccctctggca

SEQ ID NO: 7925068 - DNA, 22 bp, Homo sapiens
atctctagctaaccctctggca

SEQ ID NO: 7925069 - DNA, 17 bp, Homo sapiens
atctctctaaggcaggc

SEQ ID NO: 7925070 - DNA, 22 bp, Homo sapiens
atctctccttcagctgaggccc

SEQ ID NO: 7925071 - DNA, 22 bp, Homo sapiens
atctctccttatgaagcattat

SEQ ID NO: 7925072 - DNA, 22 bp, Homo sapiens
atctctagtcttctccatggga

SEQ ID NO: 7925073 - DNA, 22 bp, Homo sapiens
atctctccttatgaagcattat

SEQ ID NO: 7925074 - DNA, 18 bp, Homo sapiens
atctcccattggccaagg

SEQ ID NO: 7925075 - DNA, 18 bp, Homo sapiens
atctcccattggccaagg

SEQ ID NO: 7925076 - DNA, 22 bp, Homo sapiens
atctccccgagcttacctcctg

SEQ ID NO: 7925077 - DNA, 21 bp, Homo sapiens
atctccccttccttgtaggtg

SEQ ID NO: 7925078 - DNA, 22 bp, Homo sapiens
atctccccgagcttacctcctg

SEQ ID NO: 7925079 - DNA, 22 bp, Homo sapiens
atctccccgagcttacctcctg

SEQ ID NO: 7925080 - DNA, 22 bp, Homo sapiens
cttccttgtggtccttctcatt

SEQ ID NO: 7925081 - DNA, 22 bp, Homo sapiens
cttcctttcagaggaaggcctg

SEQ ID NO: 7925082 - DNA, 22 bp, Homo sapiens
cttcctttcagaggaaggcctg

SEQ ID NO: 7925083 - DNA, 22 bp, Homo sapiens
cttcctttcagaggaaggcctg

SEQ ID NO: 7925084 - DNA, 22 bp, Homo sapiens
cttcctttcagaggaaggcctg

SEQ ID NO: 7925085 - DNA, 22 bp, Homo sapiens
cttccttggcttctggggtgtg

SEQ ID NO: 7925086 - DNA, 22 bp, Homo sapiens
cttccttgtggtccttctcatt

SEQ ID NO: 7925087 - DNA, 22 bp, Homo sapiens
cttccttgtggtccttctcatt

SEQ ID NO: 7925088 - DNA, 22 bp, Homo sapiens
cttccttggcttctggggtgtg

SEQ ID NO: 7925089 - DNA, 22 bp, Homo sapiens
cttccttgtggtccttctcatt

SEQ ID NO: 7925090 - DNA, 20 bp, Homo sapiens
atctcctgctaccacccatt

SEQ ID NO: 7925091 - DNA, 23 bp, Homo sapiens
atctcctgagaacccacagtggt

SEQ ID NO: 7925092 - DNA, 22 bp, Homo sapiens
atctccttggatcacgtttagt

SEQ ID NO: 7925093 - DNA, 23 bp, Homo sapiens
atctcctgagaacccacagtggt

SEQ ID NO: 7925094 - DNA, 23 bp, Homo sapiens
atctcctgagaacccacagtggt

SEQ ID NO: 7925095 - DNA, 23 bp, Homo sapiens
atctcctgagaacccacagtggt

SEQ ID NO: 7925096 - DNA, 22 bp, Homo sapiens
atctcctaaaagaagacagggc

SEQ ID NO: 7925097 - DNA, 22 bp, Homo sapiens
atctcctaaagtttccagaaga

SEQ ID NO: 7925098 - DNA, 22 bp, Homo sapiens
atctcctcccgcgccgagctcg

SEQ ID NO: 7925099 - DNA, 21 bp, Homo sapiens
atctcgggcttctcgcccagc

SEQ ID NO: 7925100 - DNA, 21 bp, Homo sapiens
atctcgggcttctcgcccagc

SEQ ID NO: 7925101 - DNA, 19 bp, Homo sapiens
atctcctttcttcaagctt

SEQ ID NO: 7925102 - DNA, 19 bp, Homo sapiens
atctcctttcttcaagctt

SEQ ID NO: 7925103 - DNA, 19 bp, Homo sapiens
atctcctttcttcaagctt

SEQ ID NO: 7925104 - DNA, 22 bp, Homo sapiens
atctctaatcaccagctctagc

SEQ ID NO: 7925105 - DNA, 22 bp, Homo sapiens
atctcgttttgagaactgtgtt

SEQ ID NO: 7925106 - DNA, 22 bp, Homo sapiens
atctctaaagtctgttcagctc

SEQ ID NO: 7925107 - DNA, 22 bp, Homo sapiens
atcatacagcctttgttagtgt

SEQ ID NO: 7925108 - DNA, 22 bp, Homo sapiens
atcatacagcctttgttagtgt

SEQ ID NO: 7925109 - DNA, 22 bp, Homo sapiens
atcatacatacatggtcctcag

SEQ ID NO: 7925110 - DNA, 22 bp, Homo sapiens
atcatacatgtaactaagtaaa

SEQ ID NO: 7925111 - DNA, 22 bp, Homo sapiens
atcatacagaacctgagcactt

SEQ ID NO: 7925112 - DNA, 22 bp, Homo sapiens
atcatacagaacctgagcactt

SEQ ID NO: 7925113 - DNA, 22 bp, Homo sapiens
atcatacagaacctgagcactt

SEQ ID NO: 7925114 - DNA, 19 bp, Homo sapiens
atcatacatgttacactct

SEQ ID NO: 7925115 - DNA, 19 bp, Homo sapiens
atcatacatgttacactct

SEQ ID NO: 7925116 - DNA, 22 bp, Homo sapiens
atcatagaggaaaatccacgtt

SEQ ID NO: 7925117 - DNA, 22 bp, Homo sapiens
atcatacatgtaactaagtaaa

SEQ ID NO: 7925118 - DNA, 19 bp, Homo sapiens
atcatacatgttacactct

SEQ ID NO: 7925119 - DNA, 22 bp, Homo sapiens
atcatacatgtaactaagtaaa

SEQ ID NO: 7925120 - DNA, 22 bp, Homo sapiens
atcatacatgtaactaagtaaa

SEQ ID NO: 7925121 - DNA, 22 bp, Homo sapiens
ctgtttctcccatgtccaagtg

SEQ ID NO: 7925122 - DNA, 22 bp, Homo sapiens
cttaaattttcatctacaagaa

SEQ ID NO: 7925123 - DNA, 22 bp, Homo sapiens
ctgtttctcccatgtccaagtg

SEQ ID NO: 7925124 - DNA, 22 bp, Homo sapiens
cttaacaaacagtgtggatata

SEQ ID NO: 7925125 - DNA, 22 bp, Homo sapiens
atcatcagggacatttctgtgc

SEQ ID NO: 7925126 - DNA, 22 bp, Homo sapiens
atcatcatcaacaagaaacatt

SEQ ID NO: 7925127 - DNA, 22 bp, Homo sapiens
atcatcatcaacaagaaacatt

SEQ ID NO: 7925128 - DNA, 22 bp, Homo sapiens
ctgtttctccacactcttccca

SEQ ID NO: 7925129 - DNA, 22 bp, Homo sapiens
cttaagaaattgcattctaatc

SEQ ID NO: 7925130 - DNA, 22 bp, Homo sapiens
cttaagaaattgcattctaatc

SEQ ID NO: 7925131 - DNA, 22 bp, Homo sapiens
cttaagaaattgcattctaatc

SEQ ID NO: 7925132 - DNA, 21 bp, Homo sapiens
cttaacattttaaatgaaagg

SEQ ID NO: 7925133 - DNA, 21 bp, Homo sapiens
cttaacattttaaatgaaagg

SEQ ID NO: 7925134 - DNA, 21 bp, Homo sapiens
cttaacattttaaatgaaagg

SEQ ID NO: 7925135 - DNA, 22 bp, Homo sapiens
cttaaccagaaaatgcacttgt

SEQ ID NO: 7925136 - DNA, 20 bp, Homo sapiens
cttaacacttctttgccagt

SEQ ID NO: 7925137 - DNA, 22 bp, Homo sapiens
cttaacagagagaagtgttgct

SEQ ID NO: 7925138 - DNA, 22 bp, Homo sapiens
cttaagaagcaagtctcagcaa

SEQ ID NO: 7925139 - DNA, 22 bp, Homo sapiens
cttaagaagcaagtctcagcaa

SEQ ID NO: 7925140 - DNA, 22 bp, Homo sapiens
cttaagaagcaagtctcagcaa

SEQ ID NO: 7925141 - DNA, 22 bp, Homo sapiens
cttaagatgaggtcatgctata

SEQ ID NO: 7925142 - DNA, 22 bp, Homo sapiens
cttaagagtctttctgtgttta

SEQ ID NO: 7925143 - DNA, 21 bp, Homo sapiens
cttaagatggcatagtacgaa

SEQ ID NO: 7925144 - DNA, 22 bp, Homo sapiens
cttaagatgaggtcatgctata

SEQ ID NO: 7925145 - DNA, 22 bp, Homo sapiens
cttaagatttgagatacctaat

SEQ ID NO: 7925146 - DNA, 22 bp, Homo sapiens
cttaagattgtcagcttcagcc

SEQ ID NO: 7925147 - DNA, 22 bp, Homo sapiens
cttaagattgtcagcttcagcc

SEQ ID NO: 7925148 - DNA, 22 bp, Homo sapiens
cttaagatttgagatacctaat

SEQ ID NO: 7925149 - DNA, 22 bp, Homo sapiens
cttaagcaaaatattctttcac

SEQ ID NO: 7925150 - DNA, 22 bp, Homo sapiens
cttaagatttgcgatacctaat

SEQ ID NO: 7925151 - DNA, 22 bp, Homo sapiens
cttaagatttgcgatacctaat

SEQ ID NO: 7925152 - DNA, 22 bp, Homo sapiens
cttaaggaaaagtctcttttaa

SEQ ID NO: 7925153 - DNA, 22 bp, Homo sapiens
cttaaggaaaagtctcttttaa

SEQ ID NO: 7925154 - DNA, 22 bp, Homo sapiens
cttaatgtcctctttctgagct

SEQ ID NO: 7925155 - DNA, 22 bp, Homo sapiens
cttaatgtcctctttctgagct

SEQ ID NO: 7925156 - DNA, 22 bp, Homo sapiens
cttaatgaaaggttgcacatgg

SEQ ID NO: 7925157 - DNA, 22 bp, Homo sapiens
cttaatctcacctgcaaagtcc

SEQ ID NO: 7925158 - DNA, 22 bp, Homo sapiens
cttaatctcacctgcaaagtcc

SEQ ID NO: 7925159 - DNA, 22 bp, Homo sapiens
cttaatctcacctgcaaagtcc

SEQ ID NO: 7925160 - DNA, 22 bp, Homo sapiens
cttaatctcacctgcaaagtcc

SEQ ID NO: 7925161 - DNA, 22 bp, Homo sapiens
cttaatctcacctgcaaagtcc

SEQ ID NO: 7925162 - DNA, 22 bp, Homo sapiens
cttaatctcacctgcaaagtcc

SEQ ID NO: 7925163 - DNA, 22 bp, Homo sapiens
cttaaggcttcagcacaggtat

SEQ ID NO: 7925164 - DNA, 22 bp, Homo sapiens
cttaaggcttcagcacaggtat

SEQ ID NO: 7925165 - DNA, 22 bp, Homo sapiens
cttaataaatggtagctgttat

SEQ ID NO: 7925166 - DNA, 22 bp, Homo sapiens
cttaataaatggtagctgttat

SEQ ID NO: 7925167 - DNA, 22 bp, Homo sapiens
cttaataataggtgaggctatg

SEQ ID NO: 7925168 - DNA, 21 bp, Homo sapiens
atccatccatcttggcctaac

SEQ ID NO: 7925169 - DNA, 22 bp, Homo sapiens
atccatccactgatgtttctga

SEQ ID NO: 7925170 - DNA, 22 bp, Homo sapiens
atccatcccatcttcaccaggg

SEQ ID NO: 7925171 - DNA, 22 bp, Homo sapiens
atccatccacgtaacatgtatt

SEQ ID NO: 7925172 - DNA, 22 bp, Homo sapiens
atccatccactgatgtttctga

SEQ ID NO: 7925173 - DNA, 22 bp, Homo sapiens
atccatcatttcaccgccacta

SEQ ID NO: 7925174 - DNA, 20 bp, Homo sapiens
atccatcatgtccatgactt

SEQ ID NO: 7925175 - DNA, 22 bp, Homo sapiens
cttaatgtggacctggtttcta

SEQ ID NO: 7925176 - DNA, 20 bp, Homo sapiens
atccatcagagaaaataaag

SEQ ID NO: 7925177 - DNA, 22 bp, Homo sapiens
atccatgaccctctcaacaacc

SEQ ID NO: 7925178 - DNA, 22 bp, Homo sapiens
atccatcctgccatctgagtag

SEQ ID NO: 7925179 - DNA, 22 bp, Homo sapiens
atccatcctgccatctgagtag

SEQ ID NO: 7925180 - DNA, 21 bp, Homo sapiens
atccatccatcttggcctaac

SEQ ID NO: 7925181 - DNA, 22 bp, Homo sapiens
atccatcctaatgtgagtacca

SEQ ID NO: 7925182 - DNA, 22 bp, Homo sapiens
atccatcggttcctacattcaa

SEQ ID NO: 7925183 - DNA, 22 bp, Homo sapiens
atccatcgttccaaaagaagtg

SEQ ID NO: 7925184 - DNA, 22 bp, Homo sapiens
atccatcttgatgtaatagcca

SEQ ID NO: 7925185 - DNA, 22 bp, Homo sapiens
cttagcaaatgcctgtgctgct

SEQ ID NO: 7925186 - DNA, 22 bp, Homo sapiens
cttagcaagaatcagctgctgg

SEQ ID NO: 7925187 - DNA, 22 bp, Homo sapiens
cttatctgagaaagatgctaca

SEQ ID NO: 7925188 - DNA, 22 bp, Homo sapiens
cttagatgaagtcacagaaccc

SEQ ID NO: 7925189 - DNA, 22 bp, Homo sapiens
cttagattttcaatgtgaacta

SEQ ID NO: 7925190 - DNA, 22 bp, Homo sapiens
atccatttcctccactataaag

SEQ ID NO: 7925191 - DNA, 22 bp, Homo sapiens
atccatttctatcttgctgagg

SEQ ID NO: 7925192 - DNA, 22 bp, Homo sapiens
atccatttgacataatttcagc

SEQ ID NO: 7925193 - DNA, 23 bp, Homo sapiens
atccatgcttaagtaatcatttg

SEQ ID NO: 7925194 - DNA, 22 bp, Homo sapiens
atccatggaggacaagagcaat

SEQ ID NO: 7925195 - DNA, 22 bp, Homo sapiens
atccatgattgcccagaggtgt

SEQ ID NO: 7925196 - DNA, 22 bp, Homo sapiens
atccattattgggccaataaag

SEQ ID NO: 7925197 - DNA, 23 bp, Homo sapiens
atccatgtgagaatagactagca

SEQ ID NO: 7925198 - DNA, 22 bp, Homo sapiens
atccatttaattgaggggaagg

SEQ ID NO: 7925199 - DNA, 22 bp, Homo sapiens
atccatttcagtgttccacttg

SEQ ID NO: 7925200 - DNA, 22 bp, Homo sapiens
atccatttaattgaggggaagg

SEQ ID NO: 7925201 - DNA, 22 bp, Homo sapiens
atccatttcctccactataaag

SEQ ID NO: 7925202 - DNA, 22 bp, Homo sapiens
atccatttcagtgttccacttg

SEQ ID NO: 7925203 - DNA, 21 bp, Homo sapiens
atccattctccggttaatgag

SEQ ID NO: 7925204 - DNA, 22 bp, Homo sapiens
atccattctatgtgaaatgtcc

SEQ ID NO: 7925205 - DNA, 22 bp, Homo sapiens
atccattatctatcaacaggga

SEQ ID NO: 7925206 - DNA, 22 bp, Homo sapiens
atccattattgggccaataaag

SEQ ID NO: 7925207 - DNA, 22 bp, Homo sapiens
atccattgtcttgttggcttct

SEQ ID NO: 7925208 - DNA, 22 bp, Homo sapiens
atccattgtggtcttgtacatt

SEQ ID NO: 7925209 - DNA, 22 bp, Homo sapiens
cttcaatttttggtatgatgga

SEQ ID NO: 7925210 - DNA, 22 bp, Homo sapiens
cttcacaaaatatttcattata

SEQ ID NO: 7925211 - DNA, 22 bp, Homo sapiens
cttcaatttttggtatgatgga

SEQ ID NO: 7925212 - DNA, 20 bp, Homo sapiens
cttcaagttatggttggcaa

SEQ ID NO: 7925213 - DNA, 21 bp, Homo sapiens
cttcaattcaacactgccatg

SEQ ID NO: 7925214 - DNA, 22 bp, Homo sapiens
cttcaataggaactgcatggca

SEQ ID NO: 7925215 - DNA, 22 bp, Homo sapiens
cttcctctatgttcaggtagaa

SEQ ID NO: 7925216 - DNA, 22 bp, Homo sapiens
cttcacaaatggcctagagttc

SEQ ID NO: 7925217 - DNA, 22 bp, Homo sapiens
cttcacaaagctctctttatgt

SEQ ID NO: 7925218 - DNA, 22 bp, Homo sapiens
cttcaagatccatagatattgc

SEQ ID NO: 7925219 - DNA, 22 bp, Homo sapiens
cttcaagtaattctgatggcta

SEQ ID NO: 7925220 - DNA, 22 bp, Homo sapiens
cttcaagtaattctgatggcta

SEQ ID NO: 7925221 - DNA, 22 bp, Homo sapiens
cttcaaggcttattccagttgt

SEQ ID NO: 7925222 - DNA, 22 bp, Homo sapiens
cttcaaggcttattccagttgt

SEQ ID NO: 7925223 - DNA, 22 bp, Homo sapiens
cttcaaggaagccacgttggga

SEQ ID NO: 7925224 - DNA, 22 bp, Homo sapiens
cttcaagttgggcggcgggcag

SEQ ID NO: 7925225 - DNA, 22 bp, Homo sapiens
cttcaagttgtctgagggtggg

SEQ ID NO: 7925226 - DNA, 22 bp, Homo sapiens
cttcaagtcgccaaatgctgaa

SEQ ID NO: 7925227 - DNA, 22 bp, Homo sapiens
cttccttctgtaagaccagttg

SEQ ID NO: 7925228 - DNA, 22 bp, Homo sapiens
cttccttctgtaagaccagttg

SEQ ID NO: 7925229 - DNA, 22 bp, Homo sapiens
cttccttctgaagcatagaagc

SEQ ID NO: 7925230 - DNA, 22 bp, Homo sapiens
cttccttgcggcccctgcctag

SEQ ID NO: 7925231 - DNA, 22 bp, Homo sapiens
cttccttgcggcccctgcctag

SEQ ID NO: 7925232 - DNA, 22 bp, Homo sapiens
cttccttgcggcccctgcctag

SEQ ID NO: 7925233 - DNA, 22 bp, Homo sapiens
cttccttgcggcccctgcctag

SEQ ID NO: 7925234 - DNA, 19 bp, Homo sapiens
cttccttgctccccatgtg

SEQ ID NO: 7925235 - DNA, 19 bp, Homo sapiens
cttccttgctccccatgtg

SEQ ID NO: 7925236 - DNA, 22 bp, Homo sapiens
cttccttgctgtctgctccagg

SEQ ID NO: 7925237 - DNA, 22 bp, Homo sapiens
cttccttgctgtctgctccagg

SEQ ID NO: 7925238 - DNA, 22 bp, Homo sapiens
cttccttgctgtctgctccagg

SEQ ID NO: 7925239 - DNA, 19 bp, Homo sapiens
cttccttgctccccatgtg

SEQ ID NO: 7925240 - DNA, 22 bp, Homo sapiens
cttccttgctgtctgctccagg

SEQ ID NO: 7925241 - DNA, 22 bp, Homo sapiens
cttccttgctgtctgctccagg

SEQ ID NO: 7925242 - DNA, 22 bp, Homo sapiens
cttccttctcactagcagcgcc

SEQ ID NO: 7925243 - DNA, 22 bp, Homo sapiens
cttccttccttccccgaaatgc

SEQ ID NO: 7925244 - DNA, 22 bp, Homo sapiens
cttccttccacaccttcagaat

SEQ ID NO: 7925245 - DNA, 22 bp, Homo sapiens
cttccttccacaccttcagaat

SEQ ID NO: 7925246 - DNA, 22 bp, Homo sapiens
cttccttctcactagcagcgcc

SEQ ID NO: 7925247 - DNA, 22 bp, Homo sapiens
cttattaatggaatcctaatga

SEQ ID NO: 7925248 - DNA, 22 bp, Homo sapiens
cttattaatggaatcctaatga

SEQ ID NO: 7925249 - DNA, 22 bp, Homo sapiens
cttattaatggaatcctaatga

SEQ ID NO: 7925250 - DNA, 22 bp, Homo sapiens
cttattaatggaatcctaatga

SEQ ID NO: 7925251 - DNA, 22 bp, Homo sapiens
cttatgtatgctactttgtggt

SEQ ID NO: 7925252 - DNA, 22 bp, Homo sapiens
cttattataaaatcctgtttga

SEQ ID NO: 7925253 - DNA, 22 bp, Homo sapiens
cttatgtaaactacagataata

SEQ ID NO: 7925254 - DNA, 22 bp, Homo sapiens
cttatgtacacacatatattgt

SEQ ID NO: 7925255 - DNA, 22 bp, Homo sapiens
cttatgtacacacatatattgt

SEQ ID NO: 7925256 - DNA, 22 bp, Homo sapiens
cttatgtatatttggaacgtac

SEQ ID NO: 7925257 - DNA, 22 bp, Homo sapiens
cttatgtataatgttccacata

SEQ ID NO: 7925258 - DNA, 22 bp, Homo sapiens
cttatctgagaaagatgctaca

SEQ ID NO: 7925259 - DNA, 22 bp, Homo sapiens
cttatctcatttaatcatcaca

SEQ ID NO: 7925260 - DNA, 22 bp, Homo sapiens
cttatggaagaaacctcagaga

SEQ ID NO: 7925261 - DNA, 22 bp, Homo sapiens
cttatgtaaaacggaaagggaa

SEQ ID NO: 7925262 - DNA, 22 bp, Homo sapiens
cttatggaagaaacctcagaga

SEQ ID NO: 7925263 - DNA, 22 bp, Homo sapiens
cttatgctgagaatgaaagaat

SEQ ID NO: 7925264 - DNA, 22 bp, Homo sapiens
cttattcagaaggagaaatgga

SEQ ID NO: 7925265 - DNA, 21 bp, Homo sapiens
cttattcactgttatttatca

SEQ ID NO: 7925266 - DNA, 21 bp, Homo sapiens
cttattcactgttatttatca

SEQ ID NO: 7925267 - DNA, 22 bp, Homo sapiens
cttattcagcacttgctctgta

SEQ ID NO: 7925268 - DNA, 22 bp, Homo sapiens
cttattcagaccttggattctt

SEQ ID NO: 7925269 - DNA, 22 bp, Homo sapiens
cttattcagcaagtttgggtac

SEQ ID NO: 7925270 - DNA, 22 bp, Homo sapiens
cttattcagatacagactcttg

SEQ ID NO: 7925271 - DNA, 22 bp, Homo sapiens
cttcaaatgtgattttaataac

SEQ ID NO: 7925272 - DNA, 22 bp, Homo sapiens
cttcaaatgtgattttaataac

SEQ ID NO: 7925273 - DNA, 22 bp, Homo sapiens
cttcaacttccctagatgtcat

SEQ ID NO: 7925274 - DNA, 22 bp, Homo sapiens
cttcaactttgtaagtagaatt

SEQ ID NO: 7925275 - DNA, 22 bp, Homo sapiens
cttcaagaagacagcagagcat

SEQ ID NO: 7925276 - DNA, 22 bp, Homo sapiens
cttcaacctggttttataagtg

SEQ ID NO: 7925277 - DNA, 22 bp, Homo sapiens
cttcaacatacacagagagagg

SEQ ID NO: 7925278 - DNA, 22 bp, Homo sapiens
cttcaacagttttagaacactg

SEQ ID NO: 7925279 - DNA, 22 bp, Homo sapiens
cttcaaattcgaggagtagatg

SEQ ID NO: 7925280 - DNA, 22 bp, Homo sapiens
cttcaaattcgaggagtagatg

SEQ ID NO: 7925281 - DNA, 20 bp, Homo sapiens
ctgggtggcaagcaaggggg

SEQ ID NO: 7925282 - DNA, 20 bp, Homo sapiens
ctgggtggcaagcaaggggg

SEQ ID NO: 7925283 - DNA, 20 bp, Homo sapiens
ctgggtggcaagcaaggggg

SEQ ID NO: 7925284 - DNA, 20 bp, Homo sapiens
ctgggtggcaagcaaggggg

SEQ ID NO: 7925285 - DNA, 22 bp, Homo sapiens
ctgggtggcagagcctgcagtg

SEQ ID NO: 7925286 - DNA, 22 bp, Homo sapiens
ctgggtggcagagcctgcagtg

SEQ ID NO: 7925287 - DNA, 20 bp, Homo sapiens
ctgggtggcaagcaaggggg

SEQ ID NO: 7925288 - DNA, 22 bp, Homo sapiens
ctgggtggcagagcctgcagtg

SEQ ID NO: 7925289 - DNA, 22 bp, Homo sapiens
ctgggtggcagagcctgcagtg

SEQ ID NO: 7925290 - DNA, 22 bp, Homo sapiens
ctgggtggcagagcctgcagtg

SEQ ID NO: 7925291 - DNA, 22 bp, Homo sapiens
ctgggtggcagagcctgcagtg

SEQ ID NO: 7925292 - DNA, 22 bp, Homo sapiens
ctgggtggcgtctggggccagt

SEQ ID NO: 7925293 - DNA, 22 bp, Homo sapiens
ctgggtggcagagcctgcagtg

SEQ ID NO: 7925294 - DNA, 22 bp, Homo sapiens
ctgggtggatcgcagccccagg

SEQ ID NO: 7925295 - DNA, 22 bp, Homo sapiens
ctgggtggatcgcagccccagg

SEQ ID NO: 7925296 - DNA, 22 bp, Homo sapiens
ctgggtggagcctggtcatctg

SEQ ID NO: 7925297 - DNA, 22 bp, Homo sapiens
ctgggtggagcctggtcatctg

SEQ ID NO: 7925298 - DNA, 22 bp, Homo sapiens
ctgggtggatcgcagccccagg

SEQ ID NO: 7925299 - DNA, 20 bp, Homo sapiens
ctgggtggcaagcaaggggg

SEQ ID NO: 7925300 - DNA, 20 bp, Homo sapiens
ctgggtggcaagcaaggggg

SEQ ID NO: 7925301 - DNA, 20 bp, Homo sapiens
ctgggtggcaagcaaggggg

SEQ ID NO: 7925302 - DNA, 22 bp, Homo sapiens
ctgggtggatcgcagccccagg

SEQ ID NO: 7925303 - DNA, 22 bp, Homo sapiens
ctgggtggagcctggtcatctg

SEQ ID NO: 7925304 - DNA, 22 bp, Homo sapiens
atattcactgagcataaagcca

SEQ ID NO: 7925305 - DNA, 18 bp, Homo sapiens
ctgggtctccaggctgcc

SEQ ID NO: 7925306 - DNA, 18 bp, Homo sapiens
ctgggtctccaggctgcc

SEQ ID NO: 7925307 - DNA, 18 bp, Homo sapiens
ctgggtctccaggctgcc

SEQ ID NO: 7925308 - DNA, 22 bp, Homo sapiens
ctgggtctccggcagcctcggg

SEQ ID NO: 7925309 - DNA, 22 bp, Homo sapiens
atattcaaattacatttactaa

SEQ ID NO: 7925310 - DNA, 18 bp, Homo sapiens
atattcaagaagacagag

SEQ ID NO: 7925311 - DNA, 22 bp, Homo sapiens
atattcaaattacatttactaa

SEQ ID NO: 7925312 - DNA, 22 bp, Homo sapiens
atattcaaattacatttactaa

SEQ ID NO: 7925313 - DNA, 22 bp, Homo sapiens
atattattttccctggagttgt

SEQ ID NO: 7925314 - DNA, 22 bp, Homo sapiens
atattcaaattacatttactaa

SEQ ID NO: 7925315 - DNA, 22 bp, Homo sapiens
atattcaaattacatttactaa

SEQ ID NO: 7925316 - DNA, 22 bp, Homo sapiens
atattattttccctggagttgt

SEQ ID NO: 7925317 - DNA, 22 bp, Homo sapiens
atattattttccctggagttgt

SEQ ID NO: 7925318 - DNA, 22 bp, Homo sapiens
atattattttccctggagttgt

SEQ ID NO: 7925319 - DNA, 22 bp, Homo sapiens
atattattttccctggagttgt

SEQ ID NO: 7925320 - DNA, 22 bp, Homo sapiens
atattattctagtaacagtgat

SEQ ID NO: 7925321 - DNA, 22 bp, Homo sapiens
atattattctagtaacagtgat

SEQ ID NO: 7925322 - DNA, 22 bp, Homo sapiens
atattcacagatagaaggttct

SEQ ID NO: 7925323 - DNA, 23 bp, Homo sapiens
atattcacgccgccagaggtccc

SEQ ID NO: 7925324 - DNA, 22 bp, Homo sapiens
atattcactcctggtgagacta

SEQ ID NO: 7925325 - DNA, 18 bp, Homo sapiens
atattcaagaagacagag

SEQ ID NO: 7925326 - DNA, 18 bp, Homo sapiens
atattcaagaagacagag

SEQ ID NO: 7925327 - DNA, 22 bp, Homo sapiens
atattcacactgtttagttaca

SEQ ID NO: 7925328 - DNA, 22 bp, Homo sapiens
atattcaagtgaggatggctaa

SEQ ID NO: 7925329 - DNA, 18 bp, Homo sapiens
atattcaagaagacagag

SEQ ID NO: 7925330 - DNA, 22 bp, Homo sapiens
ctggtccctgcagtgtgctggg

SEQ ID NO: 7925331 - DNA, 22 bp, Homo sapiens
ctggtccctgcagtgtgctggg

SEQ ID NO: 7925332 - DNA, 22 bp, Homo sapiens
ctggtccctgcagtgtgctggg

SEQ ID NO: 7925333 - DNA, 22 bp, Homo sapiens
ctggtccctggacctccctgga

SEQ ID NO: 7925334 - DNA, 22 bp, Homo sapiens
ctggtccctggacctccctgga

SEQ ID NO: 7925335 - DNA, 22 bp, Homo sapiens
atcaagaacttattttggaaat

SEQ ID NO: 7925336 - DNA, 22 bp, Homo sapiens
atcaagaacttattttggaaat

SEQ ID NO: 7925337 - DNA, 22 bp, Homo sapiens
atcaagaaaagtgctttcggct

SEQ ID NO: 7925338 - DNA, 22 bp, Homo sapiens
atcaagaatgttcattcttcta

SEQ ID NO: 7925339 - DNA, 22 bp, Homo sapiens
ctggtccctgtaggtatttgac

SEQ ID NO: 7925340 - DNA, 22 bp, Homo sapiens
ctggtcctccttgccttcagat

SEQ ID NO: 7925341 - DNA, 22 bp, Homo sapiens
ctggtcctaaagccctactcca

SEQ ID NO: 7925342 - DNA, 22 bp, Homo sapiens
ctggtcccagaggcaagagatg

SEQ ID NO: 7925343 - DNA, 22 bp, Homo sapiens
ctggtccagtggatgctgaggg

SEQ ID NO: 7925344 - DNA, 22 bp, Homo sapiens
ctggtccagtggatgctgaggg

SEQ ID NO: 7925345 - DNA, 22 bp, Homo sapiens
ctggtccattctctccctgaag

SEQ ID NO: 7925346 - DNA, 22 bp, Homo sapiens
ctggtccagttgtctcctaagc

SEQ ID NO: 7925347 - DNA, 22 bp, Homo sapiens
ctggtccagttgtctcctaagc

SEQ ID NO: 7925348 - DNA, 22 bp, Homo sapiens
ctggtcccagcagagctctgag

SEQ ID NO: 7925349 - DNA, 22 bp, Homo sapiens
ctggtcccagcagagctctgag

SEQ ID NO: 7925350 - DNA, 22 bp, Homo sapiens
ctggtcccagcagagctctgag

SEQ ID NO: 7925351 - DNA, 22 bp, Homo sapiens
ctggtcccagcagagctctgag

SEQ ID NO: 7925352 - DNA, 22 bp, Homo sapiens
ctggtcccagcagagctctgag

SEQ ID NO: 7925353 - DNA, 22 bp, Homo sapiens
ctggtcccagctctgccaccaa

SEQ ID NO: 7925354 - DNA, 22 bp, Homo sapiens
ctggtcccagctctgccaccaa

SEQ ID NO: 7925355 - DNA, 22 bp, Homo sapiens
ctggtccccagactgggcttag

SEQ ID NO: 7925356 - DNA, 22 bp, Homo sapiens
ctggtccccagactgggcttag

SEQ ID NO: 7925357 - DNA, 22 bp, Homo sapiens
ctggtcccatcctggcttcatg

SEQ ID NO: 7925358 - DNA, 22 bp, Homo sapiens
ctggtcccatcctggcttcatg

SEQ ID NO: 7925359 - DNA, 22 bp, Homo sapiens
ctggtcccagctctgccaccaa

SEQ ID NO: 7925360 - DNA, 22 bp, Homo sapiens
ctgggtggctgtccagccagcc

SEQ ID NO: 7925361 - DNA, 22 bp, Homo sapiens
ctgggtggctgtccagccagcc

SEQ ID NO: 7925362 - DNA, 22 bp, Homo sapiens
ctggtcaggaaggtggggacag

SEQ ID NO: 7925363 - DNA, 22 bp, Homo sapiens
ctgggtggctgtccagccagcc

SEQ ID NO: 7925364 - DNA, 22 bp, Homo sapiens
ctgggtggcgtctggggccagt

SEQ ID NO: 7925365 - DNA, 22 bp, Homo sapiens
ctgggtggctgtccagccagcc

SEQ ID NO: 7925366 - DNA, 22 bp, Homo sapiens
ctgggtggctgtccagccagcc

SEQ ID NO: 7925367 - DNA, 22 bp, Homo sapiens
ctgggtggctgtccagccagcc

SEQ ID NO: 7925368 - DNA, 22 bp, Homo sapiens
ctgggtggctgtccagccagcc

SEQ ID NO: 7925369 - DNA, 22 bp, Homo sapiens
ctgggtggcgtctggggccagt

SEQ ID NO: 7925370 - DNA, 22 bp, Homo sapiens
ctgggtggctgtccagccagcc

SEQ ID NO: 7925371 - DNA, 22 bp, Homo sapiens
ctgggtggcgtctggggccagt

SEQ ID NO: 7925372 - DNA, 22 bp, Homo sapiens
ctgggtggcgtctggggccagt

SEQ ID NO: 7925373 - DNA, 22 bp, Homo sapiens
ctgggtggcgtctggggccagt

SEQ ID NO: 7925374 - DNA, 22 bp, Homo sapiens
ctggtcaggggatggggctcag

SEQ ID NO: 7925375 - DNA, 22 bp, Homo sapiens
ctggtcaggggatggggctcag

SEQ ID NO: 7925376 - DNA, 22 bp, Homo sapiens
ctggtcagggtagtgttgcaga

SEQ ID NO: 7925377 - DNA, 22 bp, Homo sapiens
ctggtcagggtagtgttgcaga

SEQ ID NO: 7925378 - DNA, 22 bp, Homo sapiens
ctggtcaggggatggggctcag

SEQ ID NO: 7925379 - DNA, 22 bp, Homo sapiens
ctggtcagggctctttgggagc

SEQ ID NO: 7925380 - DNA, 18 bp, Homo sapiens
ctggtcagggcaatgggc

SEQ ID NO: 7925381 - DNA, 18 bp, Homo sapiens
ctggtcagggcaatgggc

SEQ ID NO: 7925382 - DNA, 22 bp, Homo sapiens
ctggtcaggaaggtggggacag

SEQ ID NO: 7925383 - DNA, 22 bp, Homo sapiens
ctggtcaggctgaactgccaca

SEQ ID NO: 7925384 - DNA, 22 bp, Homo sapiens
ctggtcaggaaggtggggacag

SEQ ID NO: 7925385 - DNA, 18 bp, Homo sapiens
ctggtcagggcaatgggc

SEQ ID NO: 7925386 - DNA, 22 bp, Homo sapiens
ctggtcaggctgaactgccaca

SEQ ID NO: 7925387 - DNA, 22 bp, Homo sapiens
atattattctagctcttgtgtg

SEQ ID NO: 7925388 - DNA, 22 bp, Homo sapiens
atattattctagctcttgtgtg

SEQ ID NO: 7925389 - DNA, 22 bp, Homo sapiens
ctgggggcaatggtcagagtgt

SEQ ID NO: 7925390 - DNA, 22 bp, Homo sapiens
ctgggggcaatggtcagagtgt

SEQ ID NO: 7925391 - DNA, 22 bp, Homo sapiens
ctgggggcaagcagacagctgt

SEQ ID NO: 7925392 - DNA, 22 bp, Homo sapiens
ctgggggcaagcagacagctgt

SEQ ID NO: 7925393 - DNA, 22 bp, Homo sapiens
ctgggggcaatggtcagagtgt

SEQ ID NO: 7925394 - DNA, 22 bp, Homo sapiens
atattattctagctcttgtgtg

SEQ ID NO: 7925395 - DNA, 22 bp, Homo sapiens
atattattctagctcttgtgtg

SEQ ID NO: 7925396 - DNA, 22 bp, Homo sapiens
atattattctagtaacagtgat

SEQ ID NO: 7925397 - DNA, 22 bp, Homo sapiens
atattattctagtaacagtgat

SEQ ID NO: 7925398 - DNA, 22 bp, Homo sapiens
atattattctagtaacagtgat

SEQ ID NO: 7925399 - DNA, 19 bp, Homo sapiens
ctggggctttggtactgcc

SEQ ID NO: 7925400 - DNA, 19 bp, Homo sapiens
ctggggctttggtactgcc

SEQ ID NO: 7925401 - DNA, 19 bp, Homo sapiens
ctggggctttggtactgcc

SEQ ID NO: 7925402 - DNA, 19 bp, Homo sapiens
ctggggctttggtactgcc

SEQ ID NO: 7925403 - DNA, 19 bp, Homo sapiens
ctggggctttggtactgcc

SEQ ID NO: 7925404 - DNA, 19 bp, Homo sapiens
ctggggctttggtactgcc

SEQ ID NO: 7925405 - DNA, 23 bp, Homo sapiens
ctggggctttcaaatctgggcag

SEQ ID NO: 7925406 - DNA, 22 bp, Homo sapiens
ctgggggcaagcagacagctgt

SEQ ID NO: 7925407 - DNA, 22 bp, Homo sapiens
ctgggggcaagcagacagctgt

SEQ ID NO: 7925408 - DNA, 22 bp, Homo sapiens
ctgggggcaagcagacagctgt

SEQ ID NO: 7925409 - DNA, 22 bp, Homo sapiens
ctgggggcaagcagacagctgt

SEQ ID NO: 7925410 - DNA, 19 bp, Homo sapiens
ctggggctttggtactgcc

SEQ ID NO: 7925411 - DNA, 19 bp, Homo sapiens
ctggggctttggtactgcc

SEQ ID NO: 7925412 - DNA, 19 bp, Homo sapiens
ctggggctttggtactgcc

SEQ ID NO: 7925413 - DNA, 22 bp, Homo sapiens
ctggggctgtgggagacaaggc

SEQ ID NO: 7925414 - DNA, 22 bp, Homo sapiens
ctggggctgtgggagacaaggc

SEQ ID NO: 7925415 - DNA, 22 bp, Homo sapiens
ctggggctgtgggagacaaggc

SEQ ID NO: 7925416 - DNA, 22 bp, Homo sapiens
ctggggcttcaatgcttcggtg

SEQ ID NO: 7925417 - DNA, 22 bp, Homo sapiens
ctggggcttcaatgcttcggtg

SEQ ID NO: 7925418 - DNA, 22 bp, Homo sapiens
ctggggctgtgggagacaaggc

SEQ ID NO: 7925419 - DNA, 23 bp, Homo sapiens
ctggggctttcaaatctgggcag

SEQ ID NO: 7925420 - DNA, 22 bp, Homo sapiens
ctggggcttcaatgcttcggtg

SEQ ID NO: 7925421 - DNA, 22 bp, Homo sapiens
ctggggcttcaatgcttcggtg

SEQ ID NO: 7925422 - DNA, 23 bp, Homo sapiens
ctggggctttcaaatctgggcag

SEQ ID NO: 7925423 - DNA, 23 bp, Homo sapiens
ctggggctttcaaatctgggcag

SEQ ID NO: 7925424 - DNA, 19 bp, Homo sapiens
ctgggaggtgttcagagaa

SEQ ID NO: 7925425 - DNA, 19 bp, Homo sapiens
ctgggaggtgttcagagaa

SEQ ID NO: 7925426 - DNA, 19 bp, Homo sapiens
ctgggaggtgttcagagaa

SEQ ID NO: 7925427 - DNA, 22 bp, Homo sapiens
ctggggcatgggcccctagagg

SEQ ID NO: 7925428 - DNA, 22 bp, Homo sapiens
ctggggcatctgacagataaat

SEQ ID NO: 7925429 - DNA, 22 bp, Homo sapiens
ctggggcatctgacagataaat

SEQ ID NO: 7925430 - DNA, 22 bp, Homo sapiens
ctggggcatgggcccctagagg

SEQ ID NO: 7925431 - DNA, 22 bp, Homo sapiens
ctggggcatgggcccctagagg

SEQ ID NO: 7925432 - DNA, 22 bp, Homo sapiens
ctggggctgtaggaggacttat

SEQ ID NO: 7925433 - DNA, 22 bp, Homo sapiens
ctggggctgtaggaggacttat

SEQ ID NO: 7925434 - DNA, 22 bp, Homo sapiens
ctggggctgtaggaggacttat

SEQ ID NO: 7925435 - DNA, 22 bp, Homo sapiens
ctggggctgtgggagacaaggc

SEQ ID NO: 7925436 - DNA, 22 bp, Homo sapiens
ctggggcatgggcccctagagg

SEQ ID NO: 7925437 - DNA, 20 bp, Homo sapiens
ctgggaggtcttccaaatca

SEQ ID NO: 7925438 - DNA, 20 bp, Homo sapiens
ctgggaggtcttccaaatca

SEQ ID NO: 7925439 - DNA, 22 bp, Homo sapiens
ctgggaggggtagccaatccta

SEQ ID NO: 7925440 - DNA, 22 bp, Homo sapiens
ctgggaggggtagccaatccta

SEQ ID NO: 7925441 - DNA, 22 bp, Homo sapiens
ctgggaggcggaggttgtagtg

SEQ ID NO: 7925442 - DNA, 22 bp, Homo sapiens
ctgggaggcggaggttgtagtg

SEQ ID NO: 7925443 - DNA, 22 bp, Homo sapiens
ctgggaggggtagccaatccta

SEQ ID NO: 7925444 - DNA, 22 bp, Homo sapiens
ctgggaggggtagccaatccta

SEQ ID NO: 7925445 - DNA, 22 bp, Homo sapiens
ctgggaggcggaggttgtagtg

SEQ ID NO: 7925446 - DNA, 22 bp, Homo sapiens
ctgggaggcggaggttgtagtg

SEQ ID NO: 7925447 - DNA, 22 bp, Homo sapiens
ctgggaggcggaggttgtagtg

SEQ ID NO: 7925448 - DNA, 22 bp, Homo sapiens
ctgggaggcggaggttgtagtg

SEQ ID NO: 7925449 - DNA, 22 bp, Homo sapiens
ctgggaggcggaggttgtagtg

SEQ ID NO: 7925450 - DNA, 22 bp, Homo sapiens
ctgggaggtgaacagaaaaact

SEQ ID NO: 7925451 - DNA, 22 bp, Homo sapiens
ctgggaggtgaacagaaaaact

SEQ ID NO: 7925452 - DNA, 20 bp, Homo sapiens
ctgggaggtcttccaaatca

SEQ ID NO: 7925453 - DNA, 22 bp, Homo sapiens
ctgggaggtgaacagaaaaact

SEQ ID NO: 7925454 - DNA, 22 bp, Homo sapiens
ctgggaggtgaacagaaaaact

SEQ ID NO: 7925455 - DNA, 22 bp, Homo sapiens
ctgggaggtgaacagaaaaact

SEQ ID NO: 7925456 - DNA, 22 bp, Homo sapiens
ctgggaggtgcagcaaaaatca

SEQ ID NO: 7925457 - DNA, 22 bp, Homo sapiens
ctgggaggtgcagcaaaaatca

SEQ ID NO: 7925458 - DNA, 22 bp, Homo sapiens
ctgggaggtggaggttgcattg

SEQ ID NO: 7925459 - DNA, 22 bp, Homo sapiens
ctgggaggtggaggttgcattg

SEQ ID NO: 7925460 - DNA, 22 bp, Homo sapiens
ctgggaggtggaggttgcattg

SEQ ID NO: 7925461 - DNA, 22 bp, Homo sapiens
ctgggaggtggaggttgcattg

SEQ ID NO: 7925462 - DNA, 19 bp, Homo sapiens
ctgggaggtgttcagagaa

SEQ ID NO: 7925463 - DNA, 22 bp, Homo sapiens
ctgggaggattcattgaggtga

SEQ ID NO: 7925464 - DNA, 22 bp, Homo sapiens
ctgggaggcggaggttgcagtg

SEQ ID NO: 7925465 - DNA, 22 bp, Homo sapiens
ctgggaggattcattgaggtga

SEQ ID NO: 7925466 - DNA, 22 bp, Homo sapiens
ctgggaggattcattgaggtga

SEQ ID NO: 7925467 - DNA, 22 bp, Homo sapiens
ctgggaggcggaggttgcagtg

SEQ ID NO: 7925468 - DNA, 22 bp, Homo sapiens
ctgggaggatacacaagatcag

SEQ ID NO: 7925469 - DNA, 22 bp, Homo sapiens
ctgggaggatacacaagatcag

SEQ ID NO: 7925470 - DNA, 22 bp, Homo sapiens
ctgggaggatacacaagatcag

SEQ ID NO: 7925471 - DNA, 22 bp, Homo sapiens
ctgggaggatacacaagatcag

SEQ ID NO: 7925472 - DNA, 22 bp, Homo sapiens
ctgggaggatacacaagatcag

SEQ ID NO: 7925473 - DNA, 22 bp, Homo sapiens
ctgggaggacaacttggagctc

SEQ ID NO: 7925474 - DNA, 22 bp, Homo sapiens
ctgggaggacaacttggagctc

SEQ ID NO: 7925475 - DNA, 22 bp, Homo sapiens
ctgggaggacaacttggagctc

SEQ ID NO: 7925476 - DNA, 22 bp, Homo sapiens
ctgggaggacaacttggagctc

SEQ ID NO: 7925477 - DNA, 22 bp, Homo sapiens
ctgggagcttttagaaatgcag

SEQ ID NO: 7925478 - DNA, 22 bp, Homo sapiens
ctgggaggacaacttggagctc

SEQ ID NO: 7925479 - DNA, 22 bp, Homo sapiens
ctgggaggacaacttggagctc

SEQ ID NO: 7925480 - DNA, 22 bp, Homo sapiens
ctgggaggacaacttggagctc

SEQ ID NO: 7925481 - DNA, 22 bp, Homo sapiens
ctgggaggacaacttggagctc

SEQ ID NO: 7925482 - DNA, 22 bp, Homo sapiens
ctgggaggacaacttggagctc

SEQ ID NO: 7925483 - DNA, 22 bp, Homo sapiens
ctgggagcttgttaggaatgca

SEQ ID NO: 7925484 - DNA, 22 bp, Homo sapiens
ctgggagcttgttaggaatgca

SEQ ID NO: 7925485 - DNA, 22 bp, Homo sapiens
ctgtaacctcctctttccattc

SEQ ID NO: 7925486 - DNA, 22 bp, Homo sapiens
ctgtaactctgccaagaaggct

SEQ ID NO: 7925487 - DNA, 22 bp, Homo sapiens
ctgtaacttagcatggttacta

SEQ ID NO: 7925488 - DNA, 22 bp, Homo sapiens
ctgtaacttaatgagaggcaga

SEQ ID NO: 7925489 - DNA, 22 bp, Homo sapiens
ctgtaatcccagctacctggga

SEQ ID NO: 7925490 - DNA, 22 bp, Homo sapiens
ctgtaatcccagctacctggga

SEQ ID NO: 7925491 - DNA, 22 bp, Homo sapiens
ctgtaatcccagctacctggga

SEQ ID NO: 7925492 - DNA, 22 bp, Homo sapiens
ctgtaatcccagctacctggga

SEQ ID NO: 7925493 - DNA, 22 bp, Homo sapiens
ctgtaatcccagctacctggga

SEQ ID NO: 7925494 - DNA, 22 bp, Homo sapiens
ctgtaatcccagctactcggga

SEQ ID NO: 7925495 - DNA, 22 bp, Homo sapiens
ctgtaatcccagctactcggga

SEQ ID NO: 7925496 - DNA, 22 bp, Homo sapiens
ctgtaatcccagctactcggga

SEQ ID NO: 7925497 - DNA, 22 bp, Homo sapiens
ctgtaatcccagctactcggga

SEQ ID NO: 7925498 - DNA, 22 bp, Homo sapiens
atcagagccctgatgacagact

SEQ ID NO: 7925499 - DNA, 22 bp, Homo sapiens
ctgtaatcccagctactcggga

SEQ ID NO: 7925500 - DNA, 22 bp, Homo sapiens
atcagagccttatgcttctcat

SEQ ID NO: 7925501 - DNA, 22 bp, Homo sapiens
ctgtaatcccagctacctggga

SEQ ID NO: 7925502 - DNA, 22 bp, Homo sapiens
ctgtaatcccagctacctggga

SEQ ID NO: 7925503 - DNA, 22 bp, Homo sapiens
ctgtaatcccagctacctggga

SEQ ID NO: 7925504 - DNA, 22 bp, Homo sapiens
ctgtaatcccagctacctggga

SEQ ID NO: 7925505 - DNA, 22 bp, Homo sapiens
ctgtaatcccagctactcggga

SEQ ID NO: 7925506 - DNA, 22 bp, Homo sapiens
ctgtaatcccagctactcggga

SEQ ID NO: 7925507 - DNA, 22 bp, Homo sapiens
atcagcatcgggtggtggtggg

SEQ ID NO: 7925508 - DNA, 22 bp, Homo sapiens
atcagcatctttaacaattacc

SEQ ID NO: 7925509 - DNA, 22 bp, Homo sapiens
atcagcccaccatcttcataac

SEQ ID NO: 7925510 - DNA, 22 bp, Homo sapiens
atcagccaattacagaacatga

SEQ ID NO: 7925511 - DNA, 22 bp, Homo sapiens
atcagctagataagtcaagcaa

SEQ ID NO: 7925512 - DNA, 19 bp, Homo sapiens
atcagctgaagccttcaga

SEQ ID NO: 7925513 - DNA, 22 bp, Homo sapiens
atcagctgaaaaacaggcagca

SEQ ID NO: 7925514 - DNA, 19 bp, Homo sapiens
atcagctgaagccttcaga

SEQ ID NO: 7925515 - DNA, 22 bp, Homo sapiens
atcagctcttgatgcctttctt

SEQ ID NO: 7925516 - DNA, 22 bp, Homo sapiens
atcagcacaacgtacagagaaa

SEQ ID NO: 7925517 - DNA, 22 bp, Homo sapiens
atcagcaatctcgtgtattagg

SEQ ID NO: 7925518 - DNA, 22 bp, Homo sapiens
atcagagctagtacttgcaggt

SEQ ID NO: 7925519 - DNA, 22 bp, Homo sapiens
atcagagctagtacttgcaggt

SEQ ID NO: 7925520 - DNA, 22 bp, Homo sapiens
atcagcagatgctcaatgaaca

SEQ ID NO: 7925521 - DNA, 22 bp, Homo sapiens
atcagcagaccattttccaaat

SEQ ID NO: 7925522 - DNA, 22 bp, Homo sapiens
atcagcagaccattttccaaat

SEQ ID NO: 7925523 - DNA, 22 bp, Homo sapiens
atcagcagctaaggaactaaca

SEQ ID NO: 7925524 - DNA, 22 bp, Homo sapiens
atcagcagatgctcaatgaaca

SEQ ID NO: 7925525 - DNA, 22 bp, Homo sapiens
atcagcaggtgctggtggagac

SEQ ID NO: 7925526 - DNA, 22 bp, Homo sapiens
atcagcaggtgctggtggagac

SEQ ID NO: 7925527 - DNA, 22 bp, Homo sapiens
atcagcaggtgctggtggagac

SEQ ID NO: 7925528 - DNA, 22 bp, Homo sapiens
atcagcagtgagtggctttcat

SEQ ID NO: 7925529 - DNA, 22 bp, Homo sapiens
atcagcagtgagtggctttcat

SEQ ID NO: 7925530 - DNA, 22 bp, Homo sapiens
atcagcagtgtctacctcggtg

SEQ ID NO: 7925531 - DNA, 22 bp, Homo sapiens
atcagcagtgtctacctcggtg

SEQ ID NO: 7925532 - DNA, 22 bp, Homo sapiens
atcagcaggtgctggtggagac

SEQ ID NO: 7925533 - DNA, 22 bp, Homo sapiens
atcagcaggtgctggtggagac

SEQ ID NO: 7925534 - DNA, 22 bp, Homo sapiens
atcagcaggaagggcaccttta

SEQ ID NO: 7925535 - DNA, 22 bp, Homo sapiens
atcagcaggaagggcaccttta

SEQ ID NO: 7925536 - DNA, 22 bp, Homo sapiens
atcagcaggcatattaactgaa

SEQ ID NO: 7925537 - DNA, 22 bp, Homo sapiens
atcagcaggcatattaactgaa

SEQ ID NO: 7925538 - DNA, 22 bp, Homo sapiens
atcacacagagcattaggggcc

SEQ ID NO: 7925539 - DNA, 22 bp, Homo sapiens
atcacaatgtacgttaaaatgt

SEQ ID NO: 7925540 - DNA, 22 bp, Homo sapiens
atcacacagagcattaggggcc

SEQ ID NO: 7925541 - DNA, 22 bp, Homo sapiens
atcacacagcaaggtggaggca

SEQ ID NO: 7925542 - DNA, 22 bp, Homo sapiens
atcacactggacattggatact

SEQ ID NO: 7925543 - DNA, 22 bp, Homo sapiens
atcacacagcaaggtggaggca

SEQ ID NO: 7925544 - DNA, 22 bp, Homo sapiens
atcacactggacattggatact

SEQ ID NO: 7925545 - DNA, 22 bp, Homo sapiens
atcacaatcttcaaatcgattc

SEQ ID NO: 7925546 - DNA, 22 bp, Homo sapiens
atcacaatccctctctctgata

SEQ ID NO: 7925547 - DNA, 22 bp, Homo sapiens
atcacaatgtacgttaaaatgt

SEQ ID NO: 7925548 - DNA, 22 bp, Homo sapiens
atcacaatgtacgttaaaatgt

SEQ ID NO: 7925549 - DNA, 22 bp, Homo sapiens
atcacaaaggtctcagagcaca

SEQ ID NO: 7925550 - DNA, 22 bp, Homo sapiens
atcaagaattgggagctattga

SEQ ID NO: 7925551 - DNA, 22 bp, Homo sapiens
atcaagaattgggagctattga

SEQ ID NO: 7925552 - DNA, 22 bp, Homo sapiens
atcaagaattgggagctattga

SEQ ID NO: 7925553 - DNA, 22 bp, Homo sapiens
atcaagaatgttcattcttcta

SEQ ID NO: 7925554 - DNA, 22 bp, Homo sapiens
atcaagaatgttcattcttcta

SEQ ID NO: 7925555 - DNA, 22 bp, Homo sapiens
atcacaaagggttttctctgag

SEQ ID NO: 7925556 - DNA, 22 bp, Homo sapiens
atcacaaaggctgcttcatgat

SEQ ID NO: 7925557 - DNA, 22 bp, Homo sapiens
atcacaaagggttttctctgag

SEQ ID NO: 7925558 - DNA, 22 bp, Homo sapiens
atcacaaagggttttctctgag

SEQ ID NO: 7925559 - DNA, 22 bp, Homo sapiens
atcacaaagggttttctctgag

SEQ ID NO: 7925560 - DNA, 22 bp, Homo sapiens
atcacaaaggtctcagagcaca

SEQ ID NO: 7925561 - DNA, 22 bp, Homo sapiens
atcacaaaggtctcagagcaca

SEQ ID NO: 7925562 - DNA, 22 bp, Homo sapiens
atcacaaaggtctcagagcaca

SEQ ID NO: 7925563 - DNA, 22 bp, Homo sapiens
atcacaaaggtctcagagcaca

SEQ ID NO: 7925564 - DNA, 22 bp, Homo sapiens
atcacaaaggtctcagagcaca

SEQ ID NO: 7925565 - DNA, 22 bp, Homo sapiens
atcacacttttgtaaccatcag

SEQ ID NO: 7925566 - DNA, 22 bp, Homo sapiens
atcacagacaattgtcagacca

SEQ ID NO: 7925567 - DNA, 22 bp, Homo sapiens
atcacagacaattgtcagacca

SEQ ID NO: 7925568 - DNA, 22 bp, Homo sapiens
atcacagagattgcttttaaaa

SEQ ID NO: 7925569 - DNA, 19 bp, Homo sapiens
atcacagacgtgcctcatc

SEQ ID NO: 7925570 - DNA, 19 bp, Homo sapiens
atcacagacgtgcctcatc

SEQ ID NO: 7925571 - DNA, 19 bp, Homo sapiens
atcacagacgtgcctcatc

SEQ ID NO: 7925572 - DNA, 19 bp, Homo sapiens
atcacagacgtgcctcatc

SEQ ID NO: 7925573 - DNA, 22 bp, Homo sapiens
atcacagattgtgaataactat

SEQ ID NO: 7925574 - DNA, 22 bp, Homo sapiens
atcacagattgtgaataactat

SEQ ID NO: 7925575 - DNA, 22 bp, Homo sapiens
atcacagattgtgaataactat

SEQ ID NO: 7925576 - DNA, 22 bp, Homo sapiens
atcacagattgtgaataactat

SEQ ID NO: 7925577 - DNA, 22 bp, Homo sapiens
atcacagattgtgaataactat

SEQ ID NO: 7925578 - DNA, 22 bp, Homo sapiens
atcacagagctcccttccactg

SEQ ID NO: 7925579 - DNA, 22 bp, Homo sapiens
atcacagagattgcttttaaaa

SEQ ID NO: 7925580 - DNA, 22 bp, Homo sapiens
atcacagagattgcttttaaaa

SEQ ID NO: 7925581 - DNA, 22 bp, Homo sapiens
atcacagagctcccttccactg

SEQ ID NO: 7925582 - DNA, 22 bp, Homo sapiens
ctgtaaagacactaactatgga

SEQ ID NO: 7925583 - DNA, 22 bp, Homo sapiens
ctgtaaacttctggaggtcaag

SEQ ID NO: 7925584 - DNA, 22 bp, Homo sapiens
ctgtaaatatgaagaatatatg

SEQ ID NO: 7925585 - DNA, 22 bp, Homo sapiens
ctgtaaatatgaagaatatatg

SEQ ID NO: 7925586 - DNA, 22 bp, Homo sapiens
ctgtaaagtaagaggtaagtta

SEQ ID NO: 7925587 - DNA, 22 bp, Homo sapiens
ctgtaaataatgacagttgact

SEQ ID NO: 7925588 - DNA, 22 bp, Homo sapiens
ctgtaaatggaactatgtagta

SEQ ID NO: 7925589 - DNA, 20 bp, Homo sapiens
ctgtaaactgcgtctgtaat

SEQ ID NO: 7925590 - DNA, 22 bp, Homo sapiens
ctgtaaactaggtcatttttaa

SEQ ID NO: 7925591 - DNA, 22 bp, Homo sapiens
ctgtaaactaggtcatttttaa

SEQ ID NO: 7925592 - DNA, 22 bp, Homo sapiens
atcacagctagtaagtggagga

SEQ ID NO: 7925593 - DNA, 22 bp, Homo sapiens
atcacagcacacctgacatgta

SEQ ID NO: 7925594 - DNA, 22 bp, Homo sapiens
atcacagatttgatacttttgt

SEQ ID NO: 7925595 - DNA, 22 bp, Homo sapiens
ctgtctcagcaggaagtcatca

SEQ ID NO: 7925596 - DNA, 22 bp, Homo sapiens
ctgtctcaagactgcaggcact

SEQ ID NO: 7925597 - DNA, 22 bp, Homo sapiens
ctgtctcaagactgcaggcact

SEQ ID NO: 7925598 - DNA, 22 bp, Homo sapiens
ctgtctcaagactgcaggcact

SEQ ID NO: 7925599 - DNA, 22 bp, Homo sapiens
ctgtctccagggcaggtgcagg

SEQ ID NO: 7925600 - DNA, 22 bp, Homo sapiens
ctgtctccagggcaggtgcagg

SEQ ID NO: 7925601 - DNA, 22 bp, Homo sapiens
ctgtctccagggcaggtgcagg

SEQ ID NO: 7925602 - DNA, 22 bp, Homo sapiens
ctgtctccagggcaggtgcagg

SEQ ID NO: 7925603 - DNA, 22 bp, Homo sapiens
ctgtctagttaggatgccagca

SEQ ID NO: 7925604 - DNA, 22 bp, Homo sapiens
ctgtcgctgccaacagggctgg

SEQ ID NO: 7925605 - DNA, 22 bp, Homo sapiens
ctgtcgtctgtgctgtaggatg

SEQ ID NO: 7925606 - DNA, 22 bp, Homo sapiens
ctgtcgctgccaacagggctgg

SEQ ID NO: 7925607 - DNA, 20 bp, Homo sapiens
ctgtccttttgttggaagac

SEQ ID NO: 7925608 - DNA, 23 bp, Homo sapiens
ctgtccttggtcttggctgagtg

SEQ ID NO: 7925609 - DNA, 20 bp, Homo sapiens
ctgtccttttgttggaagac

SEQ ID NO: 7925610 - DNA, 19 bp, Homo sapiens
atcagctgaagccttcaga

SEQ ID NO: 7925611 - DNA, 22 bp, Homo sapiens
atcagctggaacaagtgtctga

SEQ ID NO: 7925612 - DNA, 22 bp, Homo sapiens
atcagctgctacattggcctct

SEQ ID NO: 7925613 - DNA, 22 bp, Homo sapiens
atcagctgatgaatggatgaat

SEQ ID NO: 7925614 - DNA, 22 bp, Homo sapiens
atcagctgatgaatggatgaat

SEQ ID NO: 7925615 - DNA, 22 bp, Homo sapiens
atcagctgctacattggcctct

SEQ ID NO: 7925616 - DNA, 20 bp, Homo sapiens
atcagctggagaacattatg

SEQ ID NO: 7925617 - DNA, 22 bp, Homo sapiens
atcagctggaacaagtgtctga

SEQ ID NO: 7925618 - DNA, 22 bp, Homo sapiens
atcagcttaattctcaacaggt

SEQ ID NO: 7925619 - DNA, 22 bp, Homo sapiens
atcagcttaattctcaacaggt

SEQ ID NO: 7925620 - DNA, 22 bp, Homo sapiens
atcaggaaagaaaagcttggcg

SEQ ID NO: 7925621 - DNA, 22 bp, Homo sapiens
atcaggaaagagtggaactctg

SEQ ID NO: 7925622 - DNA, 22 bp, Homo sapiens
atcaggaaagaaaagcttggcg

SEQ ID NO: 7925623 - DNA, 22 bp, Homo sapiens
atcaggaaaaattgtgaaaggg

SEQ ID NO: 7925624 - DNA, 22 bp, Homo sapiens
atcagcttggaccaataagatg

SEQ ID NO: 7925625 - DNA, 22 bp, Homo sapiens
atcagcttggaccaataagatg

SEQ ID NO: 7925626 - DNA, 22 bp, Homo sapiens
atcagcttcataaagttggtca

SEQ ID NO: 7925627 - DNA, 22 bp, Homo sapiens
atcagcttttctcatcagaaat

SEQ ID NO: 7925628 - DNA, 22 bp, Homo sapiens
atcagcttttctcatcagaaat

SEQ ID NO: 7925629 - DNA, 22 bp, Homo sapiens
atcaggaaaaattgtgaaaggg

SEQ ID NO: 7925630 - DNA, 22 bp, Homo sapiens
ctgtctctgataagctcgaggg

SEQ ID NO: 7925631 - DNA, 22 bp, Homo sapiens
ctgtctctgataagctcgaggg

SEQ ID NO: 7925632 - DNA, 22 bp, Homo sapiens
ctgtctctctaggacactgggg

SEQ ID NO: 7925633 - DNA, 22 bp, Homo sapiens
ctgtctctgataagctcgaggg

SEQ ID NO: 7925634 - DNA, 22 bp, Homo sapiens
ctgtctctgataagctcgaggg

SEQ ID NO: 7925635 - DNA, 22 bp, Homo sapiens
atcaggtagatttaatattctg

SEQ ID NO: 7925636 - DNA, 22 bp, Homo sapiens
ctgtctctgtcttaactcccag

SEQ ID NO: 7925637 - DNA, 22 bp, Homo sapiens
ctgtctctgtcttaactcccag

SEQ ID NO: 7925638 - DNA, 22 bp, Homo sapiens
ctgtctctgataagctcgaggg

SEQ ID NO: 7925639 - DNA, 22 bp, Homo sapiens
atcagggtcttctttcagccta

SEQ ID NO: 7925640 - DNA, 22 bp, Homo sapiens
atcaggtgatgctctggttccc

SEQ ID NO: 7925641 - DNA, 23 bp, Homo sapiens
ctgtctcctgggctaggtggaat

SEQ ID NO: 7925642 - DNA, 23 bp, Homo sapiens
ctgtctcctgggctaggtggaat

SEQ ID NO: 7925643 - DNA, 23 bp, Homo sapiens
ctgtctcctgggctaggtggaat

SEQ ID NO: 7925644 - DNA, 22 bp, Homo sapiens
ctgtctcctcctttgttcttaa

SEQ ID NO: 7925645 - DNA, 22 bp, Homo sapiens
ctgtctcctcctttgttcttaa

SEQ ID NO: 7925646 - DNA, 22 bp, Homo sapiens
ctgtctcctcctttgttcttaa

SEQ ID NO: 7925647 - DNA, 22 bp, Homo sapiens
ctgtctcctcctttgttcttaa

SEQ ID NO: 7925648 - DNA, 22 bp, Homo sapiens
ctgtctcctccactgcatggga

SEQ ID NO: 7925649 - DNA, 22 bp, Homo sapiens
ctgtctcctccactgcatggga

SEQ ID NO: 7925650 - DNA, 22 bp, Homo sapiens
ctgtctcctccactgcatggga

SEQ ID NO: 7925651 - DNA, 22 bp, Homo sapiens
ctgtctccagggcaggtgcagg

SEQ ID NO: 7925652 - DNA, 22 bp, Homo sapiens
ctgtctccgccctcttggtagg

SEQ ID NO: 7925653 - DNA, 22 bp, Homo sapiens
ctgtctccgccctcttggtagg

SEQ ID NO: 7925654 - DNA, 22 bp, Homo sapiens
ctgtctccgccctcttggtagg

SEQ ID NO: 7925655 - DNA, 22 bp, Homo sapiens
ctgtctcctccactgcatggga

SEQ ID NO: 7925656 - DNA, 22 bp, Homo sapiens
ctgtctcctccactgcatggga

SEQ ID NO: 7925657 - DNA, 22 bp, Homo sapiens
ctgtctcctccactgcatggga

SEQ ID NO: 7925658 - DNA, 22 bp, Homo sapiens
ctgtctcctccactgcatggga

SEQ ID NO: 7925659 - DNA, 22 bp, Homo sapiens
ctgtctccgccctcttggtagg

SEQ ID NO: 7925660 - DNA, 22 bp, Homo sapiens
ctgtctcctccactgcatggga

SEQ ID NO: 7925661 - DNA, 22 bp, Homo sapiens
atcataaaccactttgtaatct

SEQ ID NO: 7925662 - DNA, 22 bp, Homo sapiens
atcataaagtgctatctgattg

SEQ ID NO: 7925663 - DNA, 22 bp, Homo sapiens
atcataaagtgctatctgattg

SEQ ID NO: 7925664 - DNA, 22 bp, Homo sapiens
atcataaagtgctatctgattg

SEQ ID NO: 7925665 - DNA, 22 bp, Homo sapiens
atcataaagtgctatctgattg

SEQ ID NO: 7925666 - DNA, 22 bp, Homo sapiens
atcataaaccactttgtaatct

SEQ ID NO: 7925667 - DNA, 22 bp, Homo sapiens
atcataaaccactttgtaatct

SEQ ID NO: 7925668 - DNA, 22 bp, Homo sapiens
atcataaaccactttgtaatct

SEQ ID NO: 7925669 - DNA, 22 bp, Homo sapiens
atcataattgctccagtgatat

SEQ ID NO: 7925670 - DNA, 22 bp, Homo sapiens
atcatacactcacataaacaga

SEQ ID NO: 7925671 - DNA, 22 bp, Homo sapiens
atcatacactcacataaacaga

SEQ ID NO: 7925672 - DNA, 22 bp, Homo sapiens
atcatacactcacataaacaga

SEQ ID NO: 7925673 - DNA, 22 bp, Homo sapiens
atcatacactcacataaacaga

SEQ ID NO: 7925674 - DNA, 22 bp, Homo sapiens
atcatacactcacataaacaga

SEQ ID NO: 7925675 - DNA, 22 bp, Homo sapiens
atcataagacccagccagtatt

SEQ ID NO: 7925676 - DNA, 22 bp, Homo sapiens
atcataactgtaattcatctac

SEQ ID NO: 7925677 - DNA, 22 bp, Homo sapiens
atcataaagtgctatctgattg

SEQ ID NO: 7925678 - DNA, 22 bp, Homo sapiens
atcataaaattgcaccatttct

SEQ ID NO: 7925679 - DNA, 22 bp, Homo sapiens
atcataaaattgcaccatttct

SEQ ID NO: 7925680 - DNA, 22 bp, Homo sapiens
atcataaaattgcaccatttct

SEQ ID NO: 7925681 - DNA, 22 bp, Homo sapiens
atcataaaattgcaccatttct

SEQ ID NO: 7925682 - DNA, 22 bp, Homo sapiens
atcagttttgttcactactata

SEQ ID NO: 7925683 - DNA, 22 bp, Homo sapiens
atcagtttgtatatgaaacact

SEQ ID NO: 7925684 - DNA, 22 bp, Homo sapiens
atcagtttgtatatgaaacact

SEQ ID NO: 7925685 - DNA, 22 bp, Homo sapiens
atcagtttgtatatgaaacact

SEQ ID NO: 7925686 - DNA, 22 bp, Homo sapiens
atcagtttggaacattcaggcc

SEQ ID NO: 7925687 - DNA, 22 bp, Homo sapiens
atcagtttctgtgaagaacaca

SEQ ID NO: 7925688 - DNA, 22 bp, Homo sapiens
atcagtttatacttataaatct

SEQ ID NO: 7925689 - DNA, 22 bp, Homo sapiens
atcagtttatacttataaatct

SEQ ID NO: 7925690 - DNA, 22 bp, Homo sapiens
atcagtttctgtgaagaacaca

SEQ ID NO: 7925691 - DNA, 22 bp, Homo sapiens
atcagtttctgtgaagaacaca

SEQ ID NO: 7925692 - DNA, 22 bp, Homo sapiens
agtgtctgggctcccttggagc

SEQ ID NO: 7925693 - DNA, 22 bp, Homo sapiens
agtgtctggtctctgaactaaa

SEQ ID NO: 7925694 - DNA, 20 bp, Homo sapiens
agtgtctgggcctcaggccc

SEQ ID NO: 7925695 - DNA, 22 bp, Homo sapiens
agtgtctgggctcccttggagc

SEQ ID NO: 7925696 - DNA, 22 bp, Homo sapiens
agtgtcctcctctgggagccag

SEQ ID NO: 7925697 - DNA, 22 bp, Homo sapiens
agtgtctttgtcaaattacagg

SEQ ID NO: 7925698 - DNA, 22 bp, Homo sapiens
agtgtctttctctctccaagtg

SEQ ID NO: 7925699 - DNA, 22 bp, Homo sapiens
agtgtctggtctctgaactaaa

SEQ ID NO: 7925700 - DNA, 22 bp, Homo sapiens
agtgtctgggctcccttggagc

SEQ ID NO: 7925701 - DNA, 22 bp, Homo sapiens
agtgtctggtctctgaactaaa

SEQ ID NO: 7925702 - DNA, 22 bp, Homo sapiens
agtgtcccctctgaggagtgag

SEQ ID NO: 7925703 - DNA, 22 bp, Homo sapiens
agtgtcctacagctcctgcctg

SEQ ID NO: 7925704 - DNA, 22 bp, Homo sapiens
agtgtcctcaggctttgttcct

SEQ ID NO: 7925705 - DNA, 22 bp, Homo sapiens
agtgtccaagtcttctgtttgt

SEQ ID NO: 7925706 - DNA, 22 bp, Homo sapiens
agtgtccaactcagcttgtcaa

SEQ ID NO: 7925707 - DNA, 22 bp, Homo sapiens
agtgtccaactcagcttgtcaa

SEQ ID NO: 7925708 - DNA, 22 bp, Homo sapiens
agtgtgacattttcatgaattt

SEQ ID NO: 7925709 - DNA, 22 bp, Homo sapiens
agtgtgaagagcagcacaaatg

SEQ ID NO: 7925710 - DNA, 22 bp, Homo sapiens
agtgtgacataagagccctgga

SEQ ID NO: 7925711 - DNA, 22 bp, Homo sapiens
agtgtgactacattacaagagt

SEQ ID NO: 7925712 - DNA, 22 bp, Homo sapiens
agtgtgactacattacaagagt

SEQ ID NO: 7925713 - DNA, 22 bp, Homo sapiens
agtgtctttgtctctcaagcac

SEQ ID NO: 7925714 - DNA, 22 bp, Homo sapiens
agtgtctttgtctctcaagcac

SEQ ID NO: 7925715 - DNA, 22 bp, Homo sapiens
agtgtgaagagcagcacaaatg

SEQ ID NO: 7925716 - DNA, 22 bp, Homo sapiens
agtgtctttgtctctcaagcac

SEQ ID NO: 7925717 - DNA, 22 bp, Homo sapiens
agtgtgagatgattgaggagca

SEQ ID NO: 7925718 - DNA, 22 bp, Homo sapiens
agtgtgagaacggactaataaa

SEQ ID NO: 7925719 - DNA, 23 bp, Homo sapiens
agtgtgacttttttgactgtcac

SEQ ID NO: 7925720 - DNA, 22 bp, Homo sapiens
agtgtgagatgattgaggagca

SEQ ID NO: 7925721 - DNA, 22 bp, Homo sapiens
agtgtgagcctacaggccaaag

SEQ ID NO: 7925722 - DNA, 22 bp, Homo sapiens
agtgtgagctaatagcagagcc

SEQ ID NO: 7925723 - DNA, 22 bp, Homo sapiens
agtgtgagtaattcagggaggg

SEQ ID NO: 7925724 - DNA, 22 bp, Homo sapiens
agtgtgagctaatagcagagcc

SEQ ID NO: 7925725 - DNA, 22 bp, Homo sapiens
agtgtgagtaattcagggaggg

SEQ ID NO: 7925726 - DNA, 22 bp, Homo sapiens
agtgtgagtaattgagtctgtc

SEQ ID NO: 7925727 - DNA, 19 bp, Homo sapiens
agtgtatttttttctgtag

SEQ ID NO: 7925728 - DNA, 19 bp, Homo sapiens
agtgtatttttttctgtag

SEQ ID NO: 7925729 - DNA, 20 bp, Homo sapiens
agtgtatttgggtagagtgt

SEQ ID NO: 7925730 - DNA, 22 bp, Homo sapiens
agtgtatttgagcatctcctta

SEQ ID NO: 7925731 - DNA, 22 bp, Homo sapiens
agtgtatttgagcatctcctta

SEQ ID NO: 7925732 - DNA, 22 bp, Homo sapiens
agtgtatttgcctataaaaatg

SEQ ID NO: 7925733 - DNA, 22 bp, Homo sapiens
agtgtatttgcctataaaaatg

SEQ ID NO: 7925734 - DNA, 19 bp, Homo sapiens
agtgtatttttttctgtag

SEQ ID NO: 7925735 - DNA, 22 bp, Homo sapiens
agtgtcaaatcagcatctgggt

SEQ ID NO: 7925736 - DNA, 19 bp, Homo sapiens
agtgtatttttttctgtag

SEQ ID NO: 7925737 - DNA, 22 bp, Homo sapiens
agtgtcaaatgtgtgccaagct

SEQ ID NO: 7925738 - DNA, 22 bp, Homo sapiens
agtgtcaaattaaataatctgg

SEQ ID NO: 7925739 - DNA, 22 bp, Homo sapiens
agtgtcaactcggaataaggat

SEQ ID NO: 7925740 - DNA, 22 bp, Homo sapiens
agtgtattctgcatgggagact

SEQ ID NO: 7925741 - DNA, 22 bp, Homo sapiens
agtgtattcagaatgtagcaaa

SEQ ID NO: 7925742 - DNA, 22 bp, Homo sapiens
agtgtattcagaatgtagcaaa

SEQ ID NO: 7925743 - DNA, 22 bp, Homo sapiens
agtgtattgattggaacagcct

SEQ ID NO: 7925744 - DNA, 22 bp, Homo sapiens
agtgtattgctttcatcatttt

SEQ ID NO: 7925745 - DNA, 22 bp, Homo sapiens
agtgtattgctttcatcatttt

SEQ ID NO: 7925746 - DNA, 22 bp, Homo sapiens
agtgtattatgcagcggaggtc

SEQ ID NO: 7925747 - DNA, 22 bp, Homo sapiens
ctctggatatgcactgggtgag

SEQ ID NO: 7925748 - DNA, 22 bp, Homo sapiens
agtgtacaaaatgatagataaa

SEQ ID NO: 7925749 - DNA, 22 bp, Homo sapiens
agtgtacaaaatgatagataaa

SEQ ID NO: 7925750 - DNA, 21 bp, Homo sapiens
ctctggagtttgaaggctggg

SEQ ID NO: 7925751 - DNA, 21 bp, Homo sapiens
ctctggagtttgaaggctggg

SEQ ID NO: 7925752 - DNA, 22 bp, Homo sapiens
agtgtcagcctgggcaaggaac

SEQ ID NO: 7925753 - DNA, 22 bp, Homo sapiens
agtgtcagcctgggcaaggaac

SEQ ID NO: 7925754 - DNA, 22 bp, Homo sapiens
agtgtcagctaattattcatga

SEQ ID NO: 7925755 - DNA, 17 bp, Homo sapiens
agtgtcagggcccttcc

SEQ ID NO: 7925756 - DNA, 18 bp, Homo sapiens
agtgtcagctgcagctca

SEQ ID NO: 7925757 - DNA, 22 bp, Homo sapiens
agtgtcataaggagaaattaca

SEQ ID NO: 7925758 - DNA, 22 bp, Homo sapiens
agtgtcatatgccactgcatcc

SEQ ID NO: 7925759 - DNA, 22 bp, Homo sapiens
agtgtcatgaatcaaagattat

SEQ ID NO: 7925760 - DNA, 19 bp, Homo sapiens
agtgtcatcagctactcag

SEQ ID NO: 7925761 - DNA, 22 bp, Homo sapiens
agtgtcatttccacgacattca

SEQ ID NO: 7925762 - DNA, 21 bp, Homo sapiens
agtgtcattcccaagctgtga

SEQ ID NO: 7925763 - DNA, 21 bp, Homo sapiens
agtgtcatttgatcattgtta

SEQ ID NO: 7925764 - DNA, 22 bp, Homo sapiens
agtgtcattccagggaccctcg

SEQ ID NO: 7925765 - DNA, 22 bp, Homo sapiens
agtgtcaatgccaacagtatat

SEQ ID NO: 7925766 - DNA, 22 bp, Homo sapiens
agtgtcaatgccaacagtatat

SEQ ID NO: 7925767 - DNA, 22 bp, Homo sapiens
agtgtcaatgctctgttaaaaa

SEQ ID NO: 7925768 - DNA, 22 bp, Homo sapiens
agtgtcaatgctctgttaaaaa

SEQ ID NO: 7925769 - DNA, 22 bp, Homo sapiens
agtgtcaactgtctacagggag

SEQ ID NO: 7925770 - DNA, 22 bp, Homo sapiens
agtgtcaaggttgagaaaccct

SEQ ID NO: 7925771 - DNA, 22 bp, Homo sapiens
agtgtcaagtacatggtagtga

SEQ ID NO: 7925772 - DNA, 22 bp, Homo sapiens
agtgtcaagtgaggagggaaag

SEQ ID NO: 7925773 - DNA, 22 bp, Homo sapiens
agtgtcaataatttctttttgg

SEQ ID NO: 7925774 - DNA, 17 bp, Homo sapiens
agtgtcagaagacagtt

SEQ ID NO: 7925775 - DNA, 22 bp, Homo sapiens
agtgtcacagacccaatcagga

SEQ ID NO: 7925776 - DNA, 17 bp, Homo sapiens
agtgtcagaagacagtt

SEQ ID NO: 7925777 - DNA, 17 bp, Homo sapiens
agtgtcagaagacagtt

SEQ ID NO: 7925778 - DNA, 17 bp, Homo sapiens
agtgtcagaagacagtt

SEQ ID NO: 7925779 - DNA, 22 bp, Homo sapiens
agtgtcagcctgggcaaggaac

SEQ ID NO: 7925780 - DNA, 19 bp, Homo sapiens
agtgtcagaattcattgaa

SEQ ID NO: 7925781 - DNA, 22 bp, Homo sapiens
agtgtcacagacccaatcagga

SEQ ID NO: 7925782 - DNA, 22 bp, Homo sapiens
agtgtcaattctcaaatctcgg

SEQ ID NO: 7925783 - DNA, 22 bp, Homo sapiens
agtggcctggagccccgcctgg

SEQ ID NO: 7925784 - DNA, 22 bp, Homo sapiens
agtggcctggagccccgcctgg

SEQ ID NO: 7925785 - DNA, 22 bp, Homo sapiens
agtggcctggagccccgcctgg

SEQ ID NO: 7925786 - DNA, 22 bp, Homo sapiens
agtggcccttagtggcaaagtc

SEQ ID NO: 7925787 - DNA, 22 bp, Homo sapiens
agtggcctggagccccgcctgg

SEQ ID NO: 7925788 - DNA, 22 bp, Homo sapiens
agtggcctggagccccgcctgg

SEQ ID NO: 7925789 - DNA, 22 bp, Homo sapiens
agtggcctggagccccgcctgg

SEQ ID NO: 7925790 - DNA, 22 bp, Homo sapiens
agtggcctggagccccgcctgg

SEQ ID NO: 7925791 - DNA, 22 bp, Homo sapiens
agtggctatgcatgactggaat

SEQ ID NO: 7925792 - DNA, 22 bp, Homo sapiens
agtggctatgcatgactggaat

SEQ ID NO: 7925793 - DNA, 22 bp, Homo sapiens
agtggctcagagtctattgagg

SEQ ID NO: 7925794 - DNA, 22 bp, Homo sapiens
agtggctcagagtctattgagg

SEQ ID NO: 7925795 - DNA, 22 bp, Homo sapiens
agtggctagatcatgagtgagc

SEQ ID NO: 7925796 - DNA, 22 bp, Homo sapiens
agtggctaataacagctaaaca

SEQ ID NO: 7925797 - DNA, 22 bp, Homo sapiens
agtggcggggattagcagtgtt

SEQ ID NO: 7925798 - DNA, 22 bp, Homo sapiens
agtggcggggattagcagtgtt

SEQ ID NO: 7925799 - DNA, 22 bp, Homo sapiens
agtggccagtgctgctctgggg

SEQ ID NO: 7925800 - DNA, 22 bp, Homo sapiens
agtggccagtgctgctctgggg

SEQ ID NO: 7925801 - DNA, 22 bp, Homo sapiens
agtggccatccctcaggtaggc

SEQ ID NO: 7925802 - DNA, 22 bp, Homo sapiens
agtggccagtgaaggcggcagc

SEQ ID NO: 7925803 - DNA, 22 bp, Homo sapiens
agtggccagtgctgctctgggg

SEQ ID NO: 7925804 - DNA, 22 bp, Homo sapiens
agtggccagtgaaggcggcagc

SEQ ID NO: 7925805 - DNA, 22 bp, Homo sapiens
agtggccagtgaaggcggcagc

SEQ ID NO: 7925806 - DNA, 22 bp, Homo sapiens
agtggccatccctcaggtaggc

SEQ ID NO: 7925807 - DNA, 22 bp, Homo sapiens
agtggccatccctcaggtaggc

SEQ ID NO: 7925808 - DNA, 22 bp, Homo sapiens
agtggccatggcaggtgagcat

SEQ ID NO: 7925809 - DNA, 22 bp, Homo sapiens
agtggccatggcaggtgagcat

SEQ ID NO: 7925810 - DNA, 22 bp, Homo sapiens
agtggccatggcaggtgagcat

SEQ ID NO: 7925811 - DNA, 22 bp, Homo sapiens
agtggccatggcaggtgagcat

SEQ ID NO: 7925812 - DNA, 22 bp, Homo sapiens
agtggcccctagggaacagcct

SEQ ID NO: 7925813 - DNA, 22 bp, Homo sapiens
agtggccctggagtgactcgta

SEQ ID NO: 7925814 - DNA, 22 bp, Homo sapiens
agtgggtgagcttggtctagat

SEQ ID NO: 7925815 - DNA, 22 bp, Homo sapiens
agtgggtgagcttggtctagat

SEQ ID NO: 7925816 - DNA, 22 bp, Homo sapiens
agtgggtgagcttggtctagat

SEQ ID NO: 7925817 - DNA, 22 bp, Homo sapiens
agtgggtgagcttggtctagat

SEQ ID NO: 7925818 - DNA, 22 bp, Homo sapiens
agtgggtactgggcaggcagag

SEQ ID NO: 7925819 - DNA, 22 bp, Homo sapiens
agtgggtgacagtgaacacgta

SEQ ID NO: 7925820 - DNA, 22 bp, Homo sapiens
agtgggtgagcttggtctagat

SEQ ID NO: 7925821 - DNA, 22 bp, Homo sapiens
agtgggtcagagagctccagat

SEQ ID NO: 7925822 - DNA, 21 bp, Homo sapiens
agtggctctcagcttgctaag

SEQ ID NO: 7925823 - DNA, 22 bp, Homo sapiens
agtggctctccaagaagtcaca

SEQ ID NO: 7925824 - DNA, 22 bp, Homo sapiens
agtggctcccatgtcttgcact

SEQ ID NO: 7925825 - DNA, 21 bp, Homo sapiens
agtggctctcagcttgctaag

SEQ ID NO: 7925826 - DNA, 22 bp, Homo sapiens
agtggctccaaaccgtagtcat

SEQ ID NO: 7925827 - DNA, 22 bp, Homo sapiens
agtggctcccatgtcttgcact

SEQ ID NO: 7925828 - DNA, 22 bp, Homo sapiens
agtggctccaaaccgtagtcat

SEQ ID NO: 7925829 - DNA, 22 bp, Homo sapiens
agtggctctccaagaagtcaca

SEQ ID NO: 7925830 - DNA, 22 bp, Homo sapiens
agtggctctccaagaagtcaca

SEQ ID NO: 7925831 - DNA, 22 bp, Homo sapiens
agtggctcttgggtcactgggc

SEQ ID NO: 7925832 - DNA, 22 bp, Homo sapiens
agtggctcttgggtcactgggc

SEQ ID NO: 7925833 - DNA, 22 bp, Homo sapiens
agtggctcttgggtcactgggc

SEQ ID NO: 7925834 - DNA, 22 bp, Homo sapiens
agtggctcttgggtcactgggc

SEQ ID NO: 7925835 - DNA, 22 bp, Homo sapiens
agtggctgaagcatcaaaggca

SEQ ID NO: 7925836 - DNA, 22 bp, Homo sapiens
agtggggagtttccagatgtgt

SEQ ID NO: 7925837 - DNA, 22 bp, Homo sapiens
agtggggccgcggtcctgccct

SEQ ID NO: 7925838 - DNA, 22 bp, Homo sapiens
agtggtagcattgggacttgca

SEQ ID NO: 7925839 - DNA, 22 bp, Homo sapiens
ctctggagtgggtggccgggag

SEQ ID NO: 7925840 - DNA, 22 bp, Homo sapiens
agtggtcctgcaaacccgtgtg

SEQ ID NO: 7925841 - DNA, 19 bp, Homo sapiens
agtggtagatgagcaggag

SEQ ID NO: 7925842 - DNA, 22 bp, Homo sapiens
agtggtagaaaatgcagctcga

SEQ ID NO: 7925843 - DNA, 22 bp, Homo sapiens
agtgggtgggtgtctgacagtt

SEQ ID NO: 7925844 - DNA, 22 bp, Homo sapiens
agtgggtggcgcagaggaggaa

SEQ ID NO: 7925845 - DNA, 22 bp, Homo sapiens
agtgggtgggtgtctgacagtt

SEQ ID NO: 7925846 - DNA, 22 bp, Homo sapiens
agtgggtgggtgtctgacagtt

SEQ ID NO: 7925847 - DNA, 22 bp, Homo sapiens
agtgggtgggtgtctgacagtt

SEQ ID NO: 7925848 - DNA, 22 bp, Homo sapiens
agtgggtggcgcagaggaggaa

SEQ ID NO: 7925849 - DNA, 22 bp, Homo sapiens
agtgggtggcgcagaggaggaa

SEQ ID NO: 7925850 - DNA, 22 bp, Homo sapiens
agtgggtggcgcagaggaggaa

SEQ ID NO: 7925851 - DNA, 22 bp, Homo sapiens
agtgggtggcgcagaggaggaa

SEQ ID NO: 7925852 - DNA, 22 bp, Homo sapiens
agtgggtggcgcagaggaggaa

SEQ ID NO: 7925853 - DNA, 22 bp, Homo sapiens
agtgggtggcgcagaggaggaa

SEQ ID NO: 7925854 - DNA, 22 bp, Homo sapiens
agtgggtggcgcagaggaggaa

SEQ ID NO: 7925855 - DNA, 22 bp, Homo sapiens
agtgggtgcaaccatggctagg

SEQ ID NO: 7925856 - DNA, 21 bp, Homo sapiens
ctctggagtttgaaggctggg

SEQ ID NO: 7925857 - DNA, 21 bp, Homo sapiens
ctctggagtttgaaggctggg

SEQ ID NO: 7925858 - DNA, 20 bp, Homo sapiens
ctctggagttggggaacatt

SEQ ID NO: 7925859 - DNA, 20 bp, Homo sapiens
ctctggagttggggaacatt

SEQ ID NO: 7925860 - DNA, 22 bp, Homo sapiens
ctctggagttcttcaagctact

SEQ ID NO: 7925861 - DNA, 22 bp, Homo sapiens
ctctggagttctcatgaggaac

SEQ ID NO: 7925862 - DNA, 22 bp, Homo sapiens
ctctggagttctcatgaggaac

SEQ ID NO: 7925863 - DNA, 22 bp, Homo sapiens
ctctggagttctcatgaggaac

SEQ ID NO: 7925864 - DNA, 22 bp, Homo sapiens
ctctggagttctcatgaggaac

SEQ ID NO: 7925865 - DNA, 22 bp, Homo sapiens
ctctggagtgtctggccagggt

SEQ ID NO: 7925866 - DNA, 22 bp, Homo sapiens
ctctggagtgtctggccagggt

SEQ ID NO: 7925867 - DNA, 22 bp, Homo sapiens
ctctggagtgtctggccagggt

SEQ ID NO: 7925868 - DNA, 22 bp, Homo sapiens
ctctggagtgtctggccagggt

SEQ ID NO: 7925869 - DNA, 22 bp, Homo sapiens
ctctggagtgtctggccagggt

SEQ ID NO: 7925870 - DNA, 22 bp, Homo sapiens
ctctggagttcccttgatctga

SEQ ID NO: 7925871 - DNA, 22 bp, Homo sapiens
ctctggagttcccttgatctga

SEQ ID NO: 7925872 - DNA, 22 bp, Homo sapiens
ctctggagttcccttgatctga

SEQ ID NO: 7925873 - DNA, 22 bp, Homo sapiens
ctctggagttagtgatctgggc

SEQ ID NO: 7925874 - DNA, 22 bp, Homo sapiens
ctctggagttagtgatctgggc

SEQ ID NO: 7925875 - DNA, 22 bp, Homo sapiens
agtgtttgagtttgcggcattg

SEQ ID NO: 7925876 - DNA, 22 bp, Homo sapiens
agtgtttgagacacatttcact

SEQ ID NO: 7925877 - DNA, 22 bp, Homo sapiens
agtgtttgcatctcattgattt

SEQ ID NO: 7925878 - DNA, 20 bp, Homo sapiens
agtgtttgctcacagtctcc

SEQ ID NO: 7925879 - DNA, 20 bp, Homo sapiens
agtgtttgctcacagtctcc

SEQ ID NO: 7925880 - DNA, 20 bp, Homo sapiens
agtgtttgctcacagtctcc

SEQ ID NO: 7925881 - DNA, 22 bp, Homo sapiens
agtgtttctggcaaatgaaagt

SEQ ID NO: 7925882 - DNA, 22 bp, Homo sapiens
agtgtttctggcaaatgaaagt

SEQ ID NO: 7925883 - DNA, 22 bp, Homo sapiens
agtgtttgagacacatttcact

SEQ ID NO: 7925884 - DNA, 22 bp, Homo sapiens
agtgtttgagacacatttcact

SEQ ID NO: 7925885 - DNA, 22 bp, Homo sapiens
agtgtttctggaatcagtgttt

SEQ ID NO: 7925886 - DNA, 17 bp, Homo sapiens
agtgtttccttatcatt

SEQ ID NO: 7925887 - DNA, 20 bp, Homo sapiens
agtgtttctcaacatggggc

SEQ ID NO: 7925888 - DNA, 19 bp, Homo sapiens
agtgtttcatgtgctttta

SEQ ID NO: 7925889 - DNA, 22 bp, Homo sapiens
agtgtttcaccgtatgttctca

SEQ ID NO: 7925890 - DNA, 22 bp, Homo sapiens
agtgtttcacagcactttttct

SEQ ID NO: 7925891 - DNA, 22 bp, Homo sapiens
agtgtttgtaaactacagatct

SEQ ID NO: 7925892 - DNA, 22 bp, Homo sapiens
agtgtttgtcccgttagaaatg

SEQ ID NO: 7925893 - DNA, 22 bp, Homo sapiens
agtgttttattagaacacagcc

SEQ ID NO: 7925894 - DNA, 22 bp, Homo sapiens
agtgttttggagtgggaaggca

SEQ ID NO: 7925895 - DNA, 22 bp, Homo sapiens
agtgtttttgggtagggtgagt

SEQ ID NO: 7925896 - DNA, 22 bp, Homo sapiens
agtgttttggagtgggaaggca

SEQ ID NO: 7925897 - DNA, 22 bp, Homo sapiens
agtgtttttcaggagcagaaca

SEQ ID NO: 7925898 - DNA, 22 bp, Homo sapiens
agtgtttttgggtagggtgagt

SEQ ID NO: 7925899 - DNA, 22 bp, Homo sapiens
agttaaatgtcagtagcttaac

SEQ ID NO: 7925900 - DNA, 22 bp, Homo sapiens
agttaaatgtcagtagcttaac

SEQ ID NO: 7925901 - DNA, 22 bp, Homo sapiens
agttaaatgtcagtagcttaac

SEQ ID NO: 7925902 - DNA, 22 bp, Homo sapiens
agttaaatgtgttagccagggt

SEQ ID NO: 7925903 - DNA, 22 bp, Homo sapiens
agttaacacaagtaagattcca

SEQ ID NO: 7925904 - DNA, 22 bp, Homo sapiens
agttaaatcattactgacagag

SEQ ID NO: 7925905 - DNA, 22 bp, Homo sapiens
agttaaatcatggccattggaa

SEQ ID NO: 7925906 - DNA, 22 bp, Homo sapiens
agttaaagaaagataattcgcc

SEQ ID NO: 7925907 - DNA, 22 bp, Homo sapiens
agttaaagtctgaaatagagaa

SEQ ID NO: 7925908 - DNA, 22 bp, Homo sapiens
agttaaagaaagataattcgcc

SEQ ID NO: 7925909 - DNA, 18 bp, Homo sapiens
agtgttctcgttttataa

SEQ ID NO: 7925910 - DNA, 22 bp, Homo sapiens
agtgtgggggctttggtgtcac

SEQ ID NO: 7925911 - DNA, 18 bp, Homo sapiens
agtgttctcgttttataa

SEQ ID NO: 7925912 - DNA, 17 bp, Homo sapiens
agtgttctgggttgccc

SEQ ID NO: 7925913 - DNA, 19 bp, Homo sapiens
agtgttctgagtactcctc

SEQ ID NO: 7925914 - DNA, 22 bp, Homo sapiens
agtgtttattgtgtgccacaca

SEQ ID NO: 7925915 - DNA, 22 bp, Homo sapiens
agtgtttattgtgtgccacaca

SEQ ID NO: 7925916 - DNA, 22 bp, Homo sapiens
agtgtttatttacagatggttt

SEQ ID NO: 7925917 - DNA, 22 bp, Homo sapiens
agtgtttcaagtgatgctttgg

SEQ ID NO: 7925918 - DNA, 22 bp, Homo sapiens
agtgtttcaagtgatgctttgg

SEQ ID NO: 7925919 - DNA, 22 bp, Homo sapiens
agtgtggctgcgtagggctctc

SEQ ID NO: 7925920 - DNA, 22 bp, Homo sapiens
agtgtggcaggaatgactagaa

SEQ ID NO: 7925921 - DNA, 22 bp, Homo sapiens
agtgtggccaatgaggatgggc

SEQ ID NO: 7925922 - DNA, 22 bp, Homo sapiens
agtgtgggcccccaggttagcc

SEQ ID NO: 7925923 - DNA, 22 bp, Homo sapiens
agtgtgggcccccaggttagcc

SEQ ID NO: 7925924 - DNA, 22 bp, Homo sapiens
agtgtgggggctttggtgtcac

SEQ ID NO: 7925925 - DNA, 22 bp, Homo sapiens
agtgtgggccacgcagctgagc

SEQ ID NO: 7925926 - DNA, 22 bp, Homo sapiens
agtgtgggccacgcagctgagc

SEQ ID NO: 7925927 - DNA, 22 bp, Homo sapiens
agtgtgggccacgcagctgagc

SEQ ID NO: 7925928 - DNA, 22 bp, Homo sapiens
agtgtgggcccccaggttagcc

SEQ ID NO: 7925929 - DNA, 22 bp, Homo sapiens
agtgtgctattgcaccatcata

SEQ ID NO: 7925930 - DNA, 22 bp, Homo sapiens
agtgtgctcaattcaagtcttt

SEQ ID NO: 7925931 - DNA, 22 bp, Homo sapiens
agtgtgctagcaagaactgggg

SEQ ID NO: 7925932 - DNA, 22 bp, Homo sapiens
agtgtgcccagtaattggctga

SEQ ID NO: 7925933 - DNA, 22 bp, Homo sapiens
agtgtgcattcctctcctcagg

SEQ ID NO: 7925934 - DNA, 22 bp, Homo sapiens
agtgtgcatttgcagaagaccc

SEQ ID NO: 7925935 - DNA, 22 bp, Homo sapiens
agtgtgagttacaaagtgtgaa

SEQ ID NO: 7925936 - DNA, 22 bp, Homo sapiens
agtgtggattggctggagctat

SEQ ID NO: 7925937 - DNA, 22 bp, Homo sapiens
agtgtggagccactgagtggct

SEQ ID NO: 7925938 - DNA, 22 bp, Homo sapiens
agtgtgctgtttccagaagggc

SEQ ID NO: 7925939 - DNA, 22 bp, Homo sapiens
agtgtgcttaagtttatcagga

SEQ ID NO: 7925940 - DNA, 22 bp, Homo sapiens
agtgtgcttcactgggaggtga

SEQ ID NO: 7925941 - DNA, 22 bp, Homo sapiens
agtgtgctgtttccagaagggc

SEQ ID NO: 7925942 - DNA, 22 bp, Homo sapiens
agtgtgctgcttaaacagttgt

SEQ ID NO: 7925943 - DNA, 22 bp, Homo sapiens
agtgtgctctggttgccatgct

SEQ ID NO: 7925944 - DNA, 22 bp, Homo sapiens
agtgtgctctggttgccatgct

SEQ ID NO: 7925945 - DNA, 22 bp, Homo sapiens
agtgtgctgagcaggtgggggt

SEQ ID NO: 7925946 - DNA, 22 bp, Homo sapiens
agtgtgctgagcaggtgggggt

SEQ ID NO: 7925947 - DNA, 19 bp, Homo sapiens
ctgagcagcggcagcactt

SEQ ID NO: 7925948 - DNA, 22 bp, Homo sapiens
ctgagcagccccaccagccatt

SEQ ID NO: 7925949 - DNA, 22 bp, Homo sapiens
agttaactcattttataatgcc

SEQ ID NO: 7925950 - DNA, 22 bp, Homo sapiens
ctgagcagccccaccagccatt

SEQ ID NO: 7925951 - DNA, 22 bp, Homo sapiens
agttaactattttaagattgtt

SEQ ID NO: 7925952 - DNA, 22 bp, Homo sapiens
agttaacacatccagaatagag

SEQ ID NO: 7925953 - DNA, 22 bp, Homo sapiens
agttaacacaagtaagattcca

SEQ ID NO: 7925954 - DNA, 22 bp, Homo sapiens
agttaacatttgagctaaaagg

SEQ ID NO: 7925955 - DNA, 22 bp, Homo sapiens
agttaacacatccagaatagag

SEQ ID NO: 7925956 - DNA, 22 bp, Homo sapiens
agttaactaaactgtgagtaaa

SEQ ID NO: 7925957 - DNA, 22 bp, Homo sapiens
ctgagccactgcttgttcagtg

SEQ ID NO: 7925958 - DNA, 22 bp, Homo sapiens
ctgagccactgcttgttcagtg

SEQ ID NO: 7925959 - DNA, 22 bp, Homo sapiens
ctgagccagcgggctcactttt

SEQ ID NO: 7925960 - DNA, 22 bp, Homo sapiens
ctgagccagcgggctcactttt

SEQ ID NO: 7925961 - DNA, 22 bp, Homo sapiens
ctgagccaaggggacagtgaca

SEQ ID NO: 7925962 - DNA, 22 bp, Homo sapiens
ctgagccaaggggacagtgaca

SEQ ID NO: 7925963 - DNA, 22 bp, Homo sapiens
ctgagccaccggcagggacatc

SEQ ID NO: 7925964 - DNA, 22 bp, Homo sapiens
ctgagccaccggcagggacatc

SEQ ID NO: 7925965 - DNA, 22 bp, Homo sapiens
ctgagccactgcttgttcagtg

SEQ ID NO: 7925966 - DNA, 22 bp, Homo sapiens
ctgagccactgcttgttcagtg

SEQ ID NO: 7925967 - DNA, 22 bp, Homo sapiens
ctgagccagcgggctcactttt

SEQ ID NO: 7925968 - DNA, 22 bp, Homo sapiens
ctgagccagctggcatgtgcta

SEQ ID NO: 7925969 - DNA, 22 bp, Homo sapiens
ctgagccagctggcatgtgcta

SEQ ID NO: 7925970 - DNA, 22 bp, Homo sapiens
ctgagccagctggcatgtgcta

SEQ ID NO: 7925971 - DNA, 22 bp, Homo sapiens
ctgagccagctggcatgtgcta

SEQ ID NO: 7925972 - DNA, 22 bp, Homo sapiens
ctgagccagctggcatgtgcta

SEQ ID NO: 7925973 - DNA, 22 bp, Homo sapiens
ctgagccagctggcatgtgcta

SEQ ID NO: 7925974 - DNA, 22 bp, Homo sapiens
ctgagccagggccacacatgga

SEQ ID NO: 7925975 - DNA, 22 bp, Homo sapiens
ctgagccagggccacacatgga

SEQ ID NO: 7925976 - DNA, 22 bp, Homo sapiens
ctgagccagggccacacatgga

SEQ ID NO: 7925977 - DNA, 22 bp, Homo sapiens
ctgagccagggccacacatgga

SEQ ID NO: 7925978 - DNA, 22 bp, Homo sapiens
ctgagctcaagcgatcctccca

SEQ ID NO: 7925979 - DNA, 22 bp, Homo sapiens
ctgagctatggaggcaagacat

SEQ ID NO: 7925980 - DNA, 22 bp, Homo sapiens
ctgagctcaagcgatcctccca

SEQ ID NO: 7925981 - DNA, 22 bp, Homo sapiens
ctgagctatgaactgcagccta

SEQ ID NO: 7925982 - DNA, 22 bp, Homo sapiens
ctgagctattttccactactat

SEQ ID NO: 7925983 - DNA, 22 bp, Homo sapiens
ctgagctctaatgtcagccttg

SEQ ID NO: 7925984 - DNA, 22 bp, Homo sapiens
ctgagctcacgccattctcctt

SEQ ID NO: 7925985 - DNA, 22 bp, Homo sapiens
ctgagctcaagtgatctgccca

SEQ ID NO: 7925986 - DNA, 22 bp, Homo sapiens
ctgagctcagtcccagctctac

SEQ ID NO: 7925987 - DNA, 22 bp, Homo sapiens
agttccagtgtgagagaacatg

SEQ ID NO: 7925988 - DNA, 22 bp, Homo sapiens
agttccatgtctgggtttgtga

SEQ ID NO: 7925989 - DNA, 22 bp, Homo sapiens
agttccagaactggaaaaggac

SEQ ID NO: 7925990 - DNA, 20 bp, Homo sapiens
agttccacatggctggggag

SEQ ID NO: 7925991 - DNA, 22 bp, Homo sapiens
agttccagctgtgaccagaaaa

SEQ ID NO: 7925992 - DNA, 22 bp, Homo sapiens
agttccagctgtgaccagaaaa

SEQ ID NO: 7925993 - DNA, 22 bp, Homo sapiens
agttcctaatttagtattgccg

SEQ ID NO: 7925994 - DNA, 23 bp, Homo sapiens
agttcctaagggctttgaactta

SEQ ID NO: 7925995 - DNA, 22 bp, Homo sapiens
agttccctccacaacttctcac

SEQ ID NO: 7925996 - DNA, 18 bp, Homo sapiens
agttccttaaattggtgt

SEQ ID NO: 7925997 - DNA, 21 bp, Homo sapiens
agttcctgcttcattgtcttt

SEQ ID NO: 7925998 - DNA, 22 bp, Homo sapiens
agttcctggatttggggttgca

SEQ ID NO: 7925999 - DNA, 22 bp, Homo sapiens
agttccttcctgagctattgct

SEQ ID NO: 7926000 - DNA, 22 bp, Homo sapiens
agttccttacatgtactgttaa

SEQ ID NO: 7926001 - DNA, 23 bp, Homo sapiens
agttccagaaaaatgctcaagca

SEQ ID NO: 7926002 - DNA, 22 bp, Homo sapiens
agttccaccatttaggatctgt

SEQ ID NO: 7926003 - DNA, 22 bp, Homo sapiens
agttccactgatggcctacaaa

SEQ ID NO: 7926004 - DNA, 22 bp, Homo sapiens
agttccaatcctggcatttatt

SEQ ID NO: 7926005 - DNA, 20 bp, Homo sapiens
agttccacatggctggggag

SEQ ID NO: 7926006 - DNA, 19 bp, Homo sapiens
agttccacactttatctgg

SEQ ID NO: 7926007 - DNA, 22 bp, Homo sapiens
agttcatattgaaagcaggtga

SEQ ID NO: 7926008 - DNA, 21 bp, Homo sapiens
agttcatactgagtaacaaaa

SEQ ID NO: 7926009 - DNA, 21 bp, Homo sapiens
agttcatactgagtaacaaaa

SEQ ID NO: 7926010 - DNA, 19 bp, Homo sapiens
agttatttctaaatttacc

SEQ ID NO: 7926011 - DNA, 19 bp, Homo sapiens
agttatttctaaatttacc

SEQ ID NO: 7926012 - DNA, 22 bp, Homo sapiens
ctgagctgcggcaggcacctgg

SEQ ID NO: 7926013 - DNA, 22 bp, Homo sapiens
ctgagctgcggcaggcacctgg

SEQ ID NO: 7926014 - DNA, 22 bp, Homo sapiens
ctgagctgctcccgctgcagcg

SEQ ID NO: 7926015 - DNA, 22 bp, Homo sapiens
ctgagctgctcccgctgcagcg

SEQ ID NO: 7926016 - DNA, 22 bp, Homo sapiens
ctgagctgctcccgctgcagcg

SEQ ID NO: 7926017 - DNA, 22 bp, Homo sapiens
ctgagctgctcccgctgcagcg

SEQ ID NO: 7926018 - DNA, 22 bp, Homo sapiens
ctgagctgcggcaggcacctgg

SEQ ID NO: 7926019 - DNA, 22 bp, Homo sapiens
ctgagctgctttgcttttgggg

SEQ ID NO: 7926020 - DNA, 22 bp, Homo sapiens
ctgagctgctttgcttttgggg

SEQ ID NO: 7926021 - DNA, 22 bp, Homo sapiens
ctgagctgctcccgctgcagcg

SEQ ID NO: 7926022 - DNA, 22 bp, Homo sapiens
ctgagctgaaacttgagaggct

SEQ ID NO: 7926023 - DNA, 22 bp, Homo sapiens
ctgagctgaaacttgagaggct

SEQ ID NO: 7926024 - DNA, 20 bp, Homo sapiens
ctgagctgagctccatgggt

SEQ ID NO: 7926025 - DNA, 20 bp, Homo sapiens
ctgagctgagctccatgggt

SEQ ID NO: 7926026 - DNA, 20 bp, Homo sapiens
ctgagctgagctccatgggt

SEQ ID NO: 7926027 - DNA, 20 bp, Homo sapiens
ctgagctgagctccatgggt

SEQ ID NO: 7926028 - DNA, 22 bp, Homo sapiens
ctgagctgagccaaatctgtct

SEQ ID NO: 7926029 - DNA, 22 bp, Homo sapiens
ctgagctgacatcttcctcttt

SEQ ID NO: 7926030 - DNA, 20 bp, Homo sapiens
ctgagctgagctccatgggt

SEQ ID NO: 7926031 - DNA, 20 bp, Homo sapiens
ctgagctgagctccatgggt

SEQ ID NO: 7926032 - DNA, 20 bp, Homo sapiens
ctgagctgagctccatgggt

SEQ ID NO: 7926033 - DNA, 22 bp, Homo sapiens
ctgagctgcagtcctggctctg

SEQ ID NO: 7926034 - DNA, 22 bp, Homo sapiens
ctgagctgcagtcctggctctg

SEQ ID NO: 7926035 - DNA, 22 bp, Homo sapiens
ctgagctgcagtcctggctctg

SEQ ID NO: 7926036 - DNA, 22 bp, Homo sapiens
ctgagctgcagtcctggctctg

SEQ ID NO: 7926037 - DNA, 22 bp, Homo sapiens
ctgagctgcagtcctggctctg

SEQ ID NO: 7926038 - DNA, 22 bp, Homo sapiens
agtggcagtggggcagggccct

SEQ ID NO: 7926039 - DNA, 22 bp, Homo sapiens
agtggcagtggggcagggccct

SEQ ID NO: 7926040 - DNA, 22 bp, Homo sapiens
agtggcagtggggcagggccct

SEQ ID NO: 7926041 - DNA, 22 bp, Homo sapiens
agtggcagtggggcagggccct

SEQ ID NO: 7926042 - DNA, 22 bp, Homo sapiens
agtggcagttttatatttcatg

SEQ ID NO: 7926043 - DNA, 22 bp, Homo sapiens
agtggcagtttgggagctacag

SEQ ID NO: 7926044 - DNA, 22 bp, Homo sapiens
agtggcagtggggcagggccct

SEQ ID NO: 7926045 - DNA, 22 bp, Homo sapiens
agtggcagtttgggagctacag

SEQ ID NO: 7926046 - DNA, 22 bp, Homo sapiens
agtggcatccctttaacagggt

SEQ ID NO: 7926047 - DNA, 22 bp, Homo sapiens
agtggcatcaaatcaaggtttg

SEQ ID NO: 7926048 - DNA, 22 bp, Homo sapiens
agtggccaacttatatgaaaaa

SEQ ID NO: 7926049 - DNA, 22 bp, Homo sapiens
agtggccaatatgtcatgctct

SEQ ID NO: 7926050 - DNA, 22 bp, Homo sapiens
agtggcattttaatggatgtca

SEQ ID NO: 7926051 - DNA, 20 bp, Homo sapiens
agtggccactgcagagatgc

SEQ ID NO: 7926052 - DNA, 20 bp, Homo sapiens
agtggccactgcagagatgc

SEQ ID NO: 7926053 - DNA, 20 bp, Homo sapiens
agtggccactgcagagatgc

SEQ ID NO: 7926054 - DNA, 20 bp, Homo sapiens
agtggccactgcagagatgc

SEQ ID NO: 7926055 - DNA, 22 bp, Homo sapiens
agtggccactgacttggaaatc

SEQ ID NO: 7926056 - DNA, 20 bp, Homo sapiens
agtggccactgcagagatgc

SEQ ID NO: 7926057 - DNA, 22 bp, Homo sapiens
agtggccagcagcctagcctag

SEQ ID NO: 7926058 - DNA, 22 bp, Homo sapiens
agtggccagcagcctagcctag

SEQ ID NO: 7926059 - DNA, 22 bp, Homo sapiens
agtggccaggaaaggtccagcc

SEQ ID NO: 7926060 - DNA, 22 bp, Homo sapiens
agtggccaggaaaggtccagcc

SEQ ID NO: 7926061 - DNA, 22 bp, Homo sapiens
agtggccactagaagctcagct

SEQ ID NO: 7926062 - DNA, 22 bp, Homo sapiens
agtggccactagaagctcagct

SEQ ID NO: 7926063 - DNA, 22 bp, Homo sapiens
agtggccacccactgagacagg

SEQ ID NO: 7926064 - DNA, 22 bp, Homo sapiens
agtggccactagaagctcagct

SEQ ID NO: 7926065 - DNA, 22 bp, Homo sapiens
agtggccaccatgccagctctc

SEQ ID NO: 7926066 - DNA, 22 bp, Homo sapiens
agtggccaccatgccagctctc

SEQ ID NO: 7926067 - DNA, 22 bp, Homo sapiens
agtggagtgagtggcagaagga

SEQ ID NO: 7926068 - DNA, 22 bp, Homo sapiens
agtggaggttattgagttaagg

SEQ ID NO: 7926069 - DNA, 22 bp, Homo sapiens
agtggagttgagttgatggatt

SEQ ID NO: 7926070 - DNA, 22 bp, Homo sapiens
agtggagttgagttgatggatt

SEQ ID NO: 7926071 - DNA, 22 bp, Homo sapiens
agtggatggtattgggaccagg

SEQ ID NO: 7926072 - DNA, 22 bp, Homo sapiens
agtggatggtattgggaccagg

SEQ ID NO: 7926073 - DNA, 22 bp, Homo sapiens
agtggagttgagttgatggatt

SEQ ID NO: 7926074 - DNA, 22 bp, Homo sapiens
agtggatggtattgggaccagg

SEQ ID NO: 7926075 - DNA, 22 bp, Homo sapiens
agtggatggtcactgatccagt

SEQ ID NO: 7926076 - DNA, 22 bp, Homo sapiens
agtggattctgtgtgagatgta

SEQ ID NO: 7926077 - DNA, 22 bp, Homo sapiens
agtggcaaagtcttcagaagtt

SEQ ID NO: 7926078 - DNA, 22 bp, Homo sapiens
agtggcaatgggagtggagaca

SEQ ID NO: 7926079 - DNA, 22 bp, Homo sapiens
agtggcagaactacctttttat

SEQ ID NO: 7926080 - DNA, 22 bp, Homo sapiens
agtggcagaagccaagtctgca

SEQ ID NO: 7926081 - DNA, 22 bp, Homo sapiens
agtggcagaactacctttttat

SEQ ID NO: 7926082 - DNA, 22 bp, Homo sapiens
agtggcaggcggagatgtagga

SEQ ID NO: 7926083 - DNA, 20 bp, Homo sapiens
agtggcagggaaatggaaag

SEQ ID NO: 7926084 - DNA, 22 bp, Homo sapiens
agtggcagggacttcatataaa

SEQ ID NO: 7926085 - DNA, 20 bp, Homo sapiens
agtggcagggaaatggaaag

SEQ ID NO: 7926086 - DNA, 20 bp, Homo sapiens
agtggcagggaaatggaaag

SEQ ID NO: 7926087 - DNA, 22 bp, Homo sapiens
agtggcaggcggagatgtagga

SEQ ID NO: 7926088 - DNA, 22 bp, Homo sapiens
agtggcagtggggcagggccct

SEQ ID NO: 7926089 - DNA, 22 bp, Homo sapiens
agtggcagtggggcagggccct

SEQ ID NO: 7926090 - DNA, 22 bp, Homo sapiens
agtggcagtggggcagggccct

SEQ ID NO: 7926091 - DNA, 22 bp, Homo sapiens
agtggcagggacttcatataaa

SEQ ID NO: 7926092 - DNA, 22 bp, Homo sapiens
agtggcagggctggctgctgca

SEQ ID NO: 7926093 - DNA, 22 bp, Homo sapiens
agtggcagtggggcagggccct

SEQ ID NO: 7926094 - DNA, 22 bp, Homo sapiens
agtggagaagaggatggtctcc

SEQ ID NO: 7926095 - DNA, 22 bp, Homo sapiens
agtggagaagaggatggtctcc

SEQ ID NO: 7926096 - DNA, 22 bp, Homo sapiens
agtggaccagaagactgaagct

SEQ ID NO: 7926097 - DNA, 22 bp, Homo sapiens
agtggagaccccacttctacat

SEQ ID NO: 7926098 - DNA, 22 bp, Homo sapiens
agtggagaatatgcagaaagcc

SEQ ID NO: 7926099 - DNA, 22 bp, Homo sapiens
agtggagacaggacagtcgata

SEQ ID NO: 7926100 - DNA, 22 bp, Homo sapiens
agtggagaatatgcagaaagcc

SEQ ID NO: 7926101 - DNA, 22 bp, Homo sapiens
agtggagaagaggatggtctcc

SEQ ID NO: 7926102 - DNA, 22 bp, Homo sapiens
agtggagaatatgcagaaagcc

SEQ ID NO: 7926103 - DNA, 22 bp, Homo sapiens
agtggaggcactaattggattt

SEQ ID NO: 7926104 - DNA, 22 bp, Homo sapiens
agtggaggcactaattggattt

SEQ ID NO: 7926105 - DNA, 22 bp, Homo sapiens
agtggagcttttcctatcagag

SEQ ID NO: 7926106 - DNA, 22 bp, Homo sapiens
agtggaggcactaattggattt

SEQ ID NO: 7926107 - DNA, 22 bp, Homo sapiens
agtggagcagagaggggatctt

SEQ ID NO: 7926108 - DNA, 22 bp, Homo sapiens
agtggagcttttcctatcagag

SEQ ID NO: 7926109 - DNA, 22 bp, Homo sapiens
agtggagcaggcggcgctcact

SEQ ID NO: 7926110 - DNA, 22 bp, Homo sapiens
agtggaggttacagctgtacat

SEQ ID NO: 7926111 - DNA, 22 bp, Homo sapiens
agtggaggttacagctgtacat

SEQ ID NO: 7926112 - DNA, 22 bp, Homo sapiens
agtggaggttacagctgtacat

SEQ ID NO: 7926113 - DNA, 22 bp, Homo sapiens
agtggaggttacagctgtacat

SEQ ID NO: 7926114 - DNA, 22 bp, Homo sapiens
agtggaggcactaattggattt

SEQ ID NO: 7926115 - DNA, 22 bp, Homo sapiens
agtggaggttattgagttaagg

SEQ ID NO: 7926116 - DNA, 22 bp, Homo sapiens
agtggaggttattgagttaagg

SEQ ID NO: 7926117 - DNA, 22 bp, Homo sapiens
agtggaggttacagctgtacat

SEQ ID NO: 7926118 - DNA, 22 bp, Homo sapiens
agtggaggttacagctgtacat

SEQ ID NO: 7926119 - DNA, 22 bp, Homo sapiens
agtggaaggtcaggggacagtg

SEQ ID NO: 7926120 - DNA, 22 bp, Homo sapiens
agtggaaggtcaggggacagtg

SEQ ID NO: 7926121 - DNA, 22 bp, Homo sapiens
agtggaaggtcaggggacagtg

SEQ ID NO: 7926122 - DNA, 22 bp, Homo sapiens
agtggaaggtcaggggacagtg

SEQ ID NO: 7926123 - DNA, 22 bp, Homo sapiens
agtggacaaccatgctgagatt

SEQ ID NO: 7926124 - DNA, 22 bp, Homo sapiens
agtggaatttcatgaagatcca

SEQ ID NO: 7926125 - DNA, 22 bp, Homo sapiens
agtggaatttcatgaagatcca

SEQ ID NO: 7926126 - DNA, 22 bp, Homo sapiens
agtggaagagccatgttccaac

SEQ ID NO: 7926127 - DNA, 22 bp, Homo sapiens
agtggaaggtcaggggacagtg

SEQ ID NO: 7926128 - DNA, 22 bp, Homo sapiens
agtggaaggtcaggggacagtg

SEQ ID NO: 7926129 - DNA, 18 bp, Homo sapiens
agtggaaaacaaatacac

SEQ ID NO: 7926130 - DNA, 18 bp, Homo sapiens
agtggaaaacaaatacac

SEQ ID NO: 7926131 - DNA, 22 bp, Homo sapiens
agtgcgcaaaaatagaagctgt

SEQ ID NO: 7926132 - DNA, 22 bp, Homo sapiens
agtggaacactacattgttgtt

SEQ ID NO: 7926133 - DNA, 21 bp, Homo sapiens
agtggaacccttagggtcagg

SEQ ID NO: 7926134 - DNA, 22 bp, Homo sapiens
agtgcttttgtcattgaatctt

SEQ ID NO: 7926135 - DNA, 22 bp, Homo sapiens
agtgcttttgtcattgaatctt

SEQ ID NO: 7926136 - DNA, 18 bp, Homo sapiens
agtggaaaacaaatacac

SEQ ID NO: 7926137 - DNA, 22 bp, Homo sapiens
agtgcttttattatatacagga

SEQ ID NO: 7926138 - DNA, 22 bp, Homo sapiens
agtgcttttatatcattaatcc

SEQ ID NO: 7926139 - DNA, 22 bp, Homo sapiens
agtgctttgtggagaatttgta

SEQ ID NO: 7926140 - DNA, 22 bp, Homo sapiens
agtgcttttatatcattaatcc

SEQ ID NO: 7926141 - DNA, 22 bp, Homo sapiens
agtgcttttatatcattaatcc

SEQ ID NO: 7926142 - DNA, 22 bp, Homo sapiens
agtgctttgtgctctcactgca

SEQ ID NO: 7926143 - DNA, 22 bp, Homo sapiens
agtgctgtcagttttatagata

SEQ ID NO: 7926144 - DNA, 22 bp, Homo sapiens
agtgctgggtactgttcccatt

SEQ ID NO: 7926145 - DNA, 22 bp, Homo sapiens
agtgctgtaacaacttatttgg

SEQ ID NO: 7926146 - DNA, 22 bp, Homo sapiens
agtgcccggggtgccagacaca

SEQ ID NO: 7926147 - DNA, 22 bp, Homo sapiens
agtgcccggggtgccagacaca

SEQ ID NO: 7926148 - DNA, 22 bp, Homo sapiens
agtgcccggacaactggacaga

SEQ ID NO: 7926149 - DNA, 22 bp, Homo sapiens
agtgcccggacaactggacaga

SEQ ID NO: 7926150 - DNA, 22 bp, Homo sapiens
agtgcccagttaggttggagca

SEQ ID NO: 7926151 - DNA, 20 bp, Homo sapiens
agtgccctccgacattgttt

SEQ ID NO: 7926152 - DNA, 22 bp, Homo sapiens
agtgccctgggccttccaggac

SEQ ID NO: 7926153 - DNA, 22 bp, Homo sapiens
agtgccctggacggcggcccca

SEQ ID NO: 7926154 - DNA, 20 bp, Homo sapiens
agtgccagggcaggtgagag

SEQ ID NO: 7926155 - DNA, 18 bp, Homo sapiens
agtgccagctctgctttc

SEQ ID NO: 7926156 - DNA, 20 bp, Homo sapiens
agtgccagggcaggtgagag

SEQ ID NO: 7926157 - DNA, 20 bp, Homo sapiens
agtgccagggcaggtgagag

SEQ ID NO: 7926158 - DNA, 22 bp, Homo sapiens
agtgccattcaagttttaaggg

SEQ ID NO: 7926159 - DNA, 23 bp, Homo sapiens
agtgccattgaccctatgtctat

SEQ ID NO: 7926160 - DNA, 23 bp, Homo sapiens
agtgccattgaccctatgtctat

SEQ ID NO: 7926161 - DNA, 21 bp, Homo sapiens
agtgccagtaggtatggagga

SEQ ID NO: 7926162 - DNA, 22 bp, Homo sapiens
agtgccatggaggaacagatgc

SEQ ID NO: 7926163 - DNA, 22 bp, Homo sapiens
agtgccatgtagtccagcagaa

SEQ ID NO: 7926164 - DNA, 22 bp, Homo sapiens
agtgccatgtagtccagcagaa

SEQ ID NO: 7926165 - DNA, 18 bp, Homo sapiens
agtgccagctctgctttc

SEQ ID NO: 7926166 - DNA, 22 bp, Homo sapiens
agtgccaggagcaaggagctcc

SEQ ID NO: 7926167 - DNA, 23 bp, Homo sapiens
agtgccagggagatcaggacgga

SEQ ID NO: 7926168 - DNA, 20 bp, Homo sapiens
agtgccagggcaggtgagag

SEQ ID NO: 7926169 - DNA, 20 bp, Homo sapiens
agtgccagggcaggtgagag

SEQ ID NO: 7926170 - DNA, 22 bp, Homo sapiens
agtgcctggcacatggaaggtg

SEQ ID NO: 7926171 - DNA, 22 bp, Homo sapiens
agtgccttaaacagcatcggag

SEQ ID NO: 7926172 - DNA, 22 bp, Homo sapiens
agtgccttctctgggctaggtc

SEQ ID NO: 7926173 - DNA, 22 bp, Homo sapiens
agtgccttacaagagtgagggg

SEQ ID NO: 7926174 - DNA, 22 bp, Homo sapiens
agtgcctggaccccatgacata

SEQ ID NO: 7926175 - DNA, 22 bp, Homo sapiens
agtgcctggcacatggaaggtg

SEQ ID NO: 7926176 - DNA, 22 bp, Homo sapiens
agtgcctggaccccatgacata

SEQ ID NO: 7926177 - DNA, 22 bp, Homo sapiens
agtgcctggaccccatgacata

SEQ ID NO: 7926178 - DNA, 22 bp, Homo sapiens
agtgccctttacaacttcttga

SEQ ID NO: 7926179 - DNA, 22 bp, Homo sapiens
agtgccctggttataggtgtgg

SEQ ID NO: 7926180 - DNA, 22 bp, Homo sapiens
agtgccctgtcactggaactga

SEQ ID NO: 7926181 - DNA, 22 bp, Homo sapiens
agtgcgtgggcaggcatggaag

SEQ ID NO: 7926182 - DNA, 22 bp, Homo sapiens
agtgcgtggtttacagctagtt

SEQ ID NO: 7926183 - DNA, 22 bp, Homo sapiens
agtgctgtcagttttatagata

SEQ ID NO: 7926184 - DNA, 22 bp, Homo sapiens
agtgctgtaacaacttatttgg

SEQ ID NO: 7926185 - DNA, 22 bp, Homo sapiens
agtgcgtggacccctggctgct

SEQ ID NO: 7926186 - DNA, 22 bp, Homo sapiens
agtgcgtgggcaggcatggaag

SEQ ID NO: 7926187 - DNA, 22 bp, Homo sapiens
agtgcgtggacccctggctgct

SEQ ID NO: 7926188 - DNA, 22 bp, Homo sapiens
agtgccttgtgtgtgggcagcc

SEQ ID NO: 7926189 - DNA, 22 bp, Homo sapiens
agtgccttgtgtgtgggcagcc

SEQ ID NO: 7926190 - DNA, 22 bp, Homo sapiens
agtgccttgtgtgtgggcagcc

SEQ ID NO: 7926191 - DNA, 22 bp, Homo sapiens
agtgccttgggtattttgagta

SEQ ID NO: 7926192 - DNA, 22 bp, Homo sapiens
agtgccttggctgtgatgggga

SEQ ID NO: 7926193 - DNA, 19 bp, Homo sapiens
agtgccttgctctctaggt

SEQ ID NO: 7926194 - DNA, 22 bp, Homo sapiens
agtgccttgggtattttgagta

SEQ ID NO: 7926195 - DNA, 22 bp, Homo sapiens
agtgccttggctgtgatgggga

SEQ ID NO: 7926196 - DNA, 22 bp, Homo sapiens
agtgatgtgggagagtatagct

SEQ ID NO: 7926197 - DNA, 22 bp, Homo sapiens
agtgatgtgggagagtatagct

SEQ ID NO: 7926198 - DNA, 22 bp, Homo sapiens
agtgatgtcttttaaattacat

SEQ ID NO: 7926199 - DNA, 23 bp, Homo sapiens
agtgatgtcacccacagacaagg

SEQ ID NO: 7926200 - DNA, 22 bp, Homo sapiens
agtgatgtctcagagacggaag

SEQ ID NO: 7926201 - DNA, 22 bp, Homo sapiens
agtgatgtctaacttgatccct

SEQ ID NO: 7926202 - DNA, 22 bp, Homo sapiens
agtgatgtctaacttgatccct

SEQ ID NO: 7926203 - DNA, 22 bp, Homo sapiens
agtgatgttgactagctataag

SEQ ID NO: 7926204 - DNA, 22 bp, Homo sapiens
agtgatgttaataaatgatgtt

SEQ ID NO: 7926205 - DNA, 22 bp, Homo sapiens
agtgatgttaataaatgatgtt

SEQ ID NO: 7926206 - DNA, 22 bp, Homo sapiens
agtgatgtgggagagtatagct

SEQ ID NO: 7926207 - DNA, 22 bp, Homo sapiens
agtgatgttgattttaccactt

SEQ ID NO: 7926208 - DNA, 22 bp, Homo sapiens
agtgatgttgactagctataag

SEQ ID NO: 7926209 - DNA, 22 bp, Homo sapiens
agtgatttcatcattttatcaa

SEQ ID NO: 7926210 - DNA, 22 bp, Homo sapiens
agtgatttcatcattttatcaa

SEQ ID NO: 7926211 - DNA, 22 bp, Homo sapiens
agtgatttcatcattttatcaa

SEQ ID NO: 7926212 - DNA, 22 bp, Homo sapiens
agtgatttcatcattttatcaa

SEQ ID NO: 7926213 - DNA, 22 bp, Homo sapiens
agtgatttatgtatgtgcacgt

SEQ ID NO: 7926214 - DNA, 22 bp, Homo sapiens
agtgcagggcctgcccagcagg

SEQ ID NO: 7926215 - DNA, 22 bp, Homo sapiens
agtgcagggggaaagggtgtct

SEQ ID NO: 7926216 - DNA, 22 bp, Homo sapiens
agtgcagggcctgcccagcagg

SEQ ID NO: 7926217 - DNA, 20 bp, Homo sapiens
agtgatttatctttttccac

SEQ ID NO: 7926218 - DNA, 22 bp, Homo sapiens
agtgatttactaccatattggg

SEQ ID NO: 7926219 - DNA, 22 bp, Homo sapiens
agtgattctttaaagtggtatt

SEQ ID NO: 7926220 - DNA, 22 bp, Homo sapiens
agtgattgcttgcttaaggaca

SEQ ID NO: 7926221 - DNA, 22 bp, Homo sapiens
agtgattcccagacttcctggg

SEQ ID NO: 7926222 - DNA, 22 bp, Homo sapiens
agtgcagggggaaagggtgtct

SEQ ID NO: 7926223 - DNA, 22 bp, Homo sapiens
agtgcatgttcactggcatggt

SEQ ID NO: 7926224 - DNA, 22 bp, Homo sapiens
agtgcagggggaaagggtgtct

SEQ ID NO: 7926225 - DNA, 22 bp, Homo sapiens
agtgcagggggaaagggtgtct

SEQ ID NO: 7926226 - DNA, 22 bp, Homo sapiens
agtgcattctccatcatctagg

SEQ ID NO: 7926227 - DNA, 22 bp, Homo sapiens
agtgcagggcctgcccagcagg

SEQ ID NO: 7926228 - DNA, 22 bp, Homo sapiens
agtgccaaggtattaatttata

SEQ ID NO: 7926229 - DNA, 22 bp, Homo sapiens
agtgccaagtagaaatgaattt

SEQ ID NO: 7926230 - DNA, 22 bp, Homo sapiens
agtgccaagtagaaatgaattt

SEQ ID NO: 7926231 - DNA, 22 bp, Homo sapiens
agtgccaagagtgagccatgag

SEQ ID NO: 7926232 - DNA, 22 bp, Homo sapiens
agtgccaagagtgagccatgag

SEQ ID NO: 7926233 - DNA, 22 bp, Homo sapiens
agtgccaagagtgagccatgag

SEQ ID NO: 7926234 - DNA, 19 bp, Homo sapiens
agtgccaagggtggattgt

SEQ ID NO: 7926235 - DNA, 22 bp, Homo sapiens
agtgccaaggtattaatttata

SEQ ID NO: 7926236 - DNA, 22 bp, Homo sapiens
agtgccagctccacacagcagc

SEQ ID NO: 7926237 - DNA, 22 bp, Homo sapiens
agtgccagagacgtgcacttta

SEQ ID NO: 7926238 - DNA, 19 bp, Homo sapiens
agtgcattttatgtttcaa

SEQ ID NO: 7926239 - DNA, 22 bp, Homo sapiens
agtgccaaaaaaaggacttaat

SEQ ID NO: 7926240 - DNA, 22 bp, Homo sapiens
agtgcatttggggtagtggaag

SEQ ID NO: 7926241 - DNA, 22 bp, Homo sapiens
agtgccaacggggcaggagagg

SEQ ID NO: 7926242 - DNA, 20 bp, Homo sapiens
agtgccaaatgttgtttgtt

SEQ ID NO: 7926243 - DNA, 22 bp, Homo sapiens
agtgccaaatcgagggctctga

SEQ ID NO: 7926244 - DNA, 22 bp, Homo sapiens
agtgccaaacagtacataacat

SEQ ID NO: 7926245 - DNA, 22 bp, Homo sapiens
agtgccaaatattgctggtgta

SEQ ID NO: 7926246 - DNA, 21 bp, Homo sapiens
agtgccaaaacggaaggtggc

SEQ ID NO: 7926247 - DNA, 22 bp, Homo sapiens
agtgccaaacagtacataacat

SEQ ID NO: 7926248 - DNA, 22 bp, Homo sapiens
ctcacatgagatctgtacatcc

SEQ ID NO: 7926249 - DNA, 22 bp, Homo sapiens
ctcacagttttctgtagtccaa

SEQ ID NO: 7926250 - DNA, 22 bp, Homo sapiens
ctcacagttttctgtagtccaa

SEQ ID NO: 7926251 - DNA, 22 bp, Homo sapiens
ctcacagtttcacagtgtagat

SEQ ID NO: 7926252 - DNA, 22 bp, Homo sapiens
ctcacagttggctcattaatga

SEQ ID NO: 7926253 - DNA, 22 bp, Homo sapiens
ctcacagttgtggtacctggtt

SEQ ID NO: 7926254 - DNA, 22 bp, Homo sapiens
ctcacagttggctcattaatga

SEQ ID NO: 7926255 - DNA, 22 bp, Homo sapiens
ctcacagttggctcattaatga

SEQ ID NO: 7926256 - DNA, 22 bp, Homo sapiens
ctcacagttggagaatttagat

SEQ ID NO: 7926257 - DNA, 22 bp, Homo sapiens
ctcacagtctctccctaatttt

SEQ ID NO: 7926258 - DNA, 22 bp, Homo sapiens
ctcacagtgtcaacattaacta

SEQ ID NO: 7926259 - DNA, 22 bp, Homo sapiens
ctcacagtgtaatattgaaccc

SEQ ID NO: 7926260 - DNA, 22 bp, Homo sapiens
ctcacagtgtaatattgaaccc

SEQ ID NO: 7926261 - DNA, 22 bp, Homo sapiens
ctcacagtgtcaacattaacta

SEQ ID NO: 7926262 - DNA, 23 bp, Homo sapiens
ctcaccaagcgccgccgctgtgt

SEQ ID NO: 7926263 - DNA, 22 bp, Homo sapiens
ctcaccacaccgtcggcctcct

SEQ ID NO: 7926264 - DNA, 23 bp, Homo sapiens
ctcaccaagcgccgccgctgtgt

SEQ ID NO: 7926265 - DNA, 23 bp, Homo sapiens
ctcaccaagcgccgccgctgtgt

SEQ ID NO: 7926266 - DNA, 22 bp, Homo sapiens
ctcacagttttttcctgttaat

SEQ ID NO: 7926267 - DNA, 22 bp, Homo sapiens
ctcaccacagagcctgtccagc

SEQ ID NO: 7926268 - DNA, 22 bp, Homo sapiens
ctcaccagacatggaacctgtc

SEQ ID NO: 7926269 - DNA, 22 bp, Homo sapiens
agtctttatttagagttaggac

SEQ ID NO: 7926270 - DNA, 22 bp, Homo sapiens
agtctttatttagagttaggac

SEQ ID NO: 7926271 - DNA, 22 bp, Homo sapiens
agtctttatttagagttaggac

SEQ ID NO: 7926272 - DNA, 22 bp, Homo sapiens
agtctttattgtcgtcactaga

SEQ ID NO: 7926273 - DNA, 22 bp, Homo sapiens
agtctttattgtcgtcactaga

SEQ ID NO: 7926274 - DNA, 18 bp, Homo sapiens
agtctttatttctttcat

SEQ ID NO: 7926275 - DNA, 19 bp, Homo sapiens
agtctttcccactcgtctt

SEQ ID NO: 7926276 - DNA, 19 bp, Homo sapiens
agtctttgcctggggcctt

SEQ ID NO: 7926277 - DNA, 19 bp, Homo sapiens
agtctttgcctggggcctt

SEQ ID NO: 7926278 - DNA, 21 bp, Homo sapiens
agtctttgataaagacaaagt

SEQ ID NO: 7926279 - DNA, 21 bp, Homo sapiens
agtctttgataaagacaaagt

SEQ ID NO: 7926280 - DNA, 22 bp, Homo sapiens
agtctttgaagttctgacagag

SEQ ID NO: 7926281 - DNA, 22 bp, Homo sapiens
agtctttcctgcttgactgttc

SEQ ID NO: 7926282 - DNA, 22 bp, Homo sapiens
agtctttgaagttctgacagag

SEQ ID NO: 7926283 - DNA, 22 bp, Homo sapiens
agtctttcctgcttgactgttc

SEQ ID NO: 7926284 - DNA, 22 bp, Homo sapiens
agtctttatacagaaatatatg

SEQ ID NO: 7926285 - DNA, 22 bp, Homo sapiens
agtctttatacagaaatatatg

SEQ ID NO: 7926286 - DNA, 22 bp, Homo sapiens
agtctttatctcgctcctggat

SEQ ID NO: 7926287 - DNA, 22 bp, Homo sapiens
agtctttatacagaaatatatg

SEQ ID NO: 7926288 - DNA, 22 bp, Homo sapiens
agtctttatacagaaatatatg

SEQ ID NO: 7926289 - DNA, 22 bp, Homo sapiens
agtctttatgattgtcaaagta

SEQ ID NO: 7926290 - DNA, 22 bp, Homo sapiens
agtctttattcagccaagtact

SEQ ID NO: 7926291 - DNA, 22 bp, Homo sapiens
agtctttattcactattgataa

SEQ ID NO: 7926292 - DNA, 18 bp, Homo sapiens
agtcttctgatccatttt

SEQ ID NO: 7926293 - DNA, 18 bp, Homo sapiens
agtcttctgatccatttt

SEQ ID NO: 7926294 - DNA, 22 bp, Homo sapiens
ctcaccagacatggaacctgtc

SEQ ID NO: 7926295 - DNA, 22 bp, Homo sapiens
agtctttatacagaaatatatg

SEQ ID NO: 7926296 - DNA, 22 bp, Homo sapiens
agtcttctgggtgtttccagag

SEQ ID NO: 7926297 - DNA, 22 bp, Homo sapiens
agtctttagggaggtcagagtt

SEQ ID NO: 7926298 - DNA, 22 bp, Homo sapiens
agtcttctgctctgtcactaac

SEQ ID NO: 7926299 - DNA, 22 bp, Homo sapiens
agtctttagggaggtcagagtt

SEQ ID NO: 7926300 - DNA, 22 bp, Homo sapiens
agtcttctgctctgtcactaac

SEQ ID NO: 7926301 - DNA, 22 bp, Homo sapiens
agtctacaagaactccagtgca

SEQ ID NO: 7926302 - DNA, 22 bp, Homo sapiens
agtctacaatcttaaatgaact

SEQ ID NO: 7926303 - DNA, 22 bp, Homo sapiens
agtcctgggtctggagaatgga

SEQ ID NO: 7926304 - DNA, 22 bp, Homo sapiens
agtcctgggtctggagaatgga

SEQ ID NO: 7926305 - DNA, 22 bp, Homo sapiens
agtctacagttccctcaggtcc

SEQ ID NO: 7926306 - DNA, 18 bp, Homo sapiens
agtctacactggttctta

SEQ ID NO: 7926307 - DNA, 22 bp, Homo sapiens
agtctacatttttgttaatggt

SEQ ID NO: 7926308 - DNA, 22 bp, Homo sapiens
agtctacaatcttaaatgaact

SEQ ID NO: 7926309 - DNA, 22 bp, Homo sapiens
agtctagaatgtgcaccaagct

SEQ ID NO: 7926310 - DNA, 22 bp, Homo sapiens
agtctagaatgtgcaccaagct

SEQ ID NO: 7926311 - DNA, 22 bp, Homo sapiens
agtctagaaacaaggtagagct

SEQ ID NO: 7926312 - DNA, 22 bp, Homo sapiens
agtctagaaacaaggtagagct

SEQ ID NO: 7926313 - DNA, 22 bp, Homo sapiens
agtctagaggatgggtccagat

SEQ ID NO: 7926314 - DNA, 22 bp, Homo sapiens
agtctagaatgtgcaccaagct

SEQ ID NO: 7926315 - DNA, 22 bp, Homo sapiens
agtctagagattctgaagggaa

SEQ ID NO: 7926316 - DNA, 22 bp, Homo sapiens
agtctagaggatgggtccagat

SEQ ID NO: 7926317 - DNA, 22 bp, Homo sapiens
agtctagatccccagtgctgtc

SEQ ID NO: 7926318 - DNA, 22 bp, Homo sapiens
agtctagatccccagtgctgtc

SEQ ID NO: 7926319 - DNA, 22 bp, Homo sapiens
agtctagatgatcctaggaata

SEQ ID NO: 7926320 - DNA, 22 bp, Homo sapiens
agtctagatgatcctaggaata

SEQ ID NO: 7926321 - DNA, 22 bp, Homo sapiens
agtctagggattgaagcatgat

SEQ ID NO: 7926322 - DNA, 22 bp, Homo sapiens
agtctagatccccagtgctgtc

SEQ ID NO: 7926323 - DNA, 22 bp, Homo sapiens
agtctagcttaggagcctagct

SEQ ID NO: 7926324 - DNA, 22 bp, Homo sapiens
agtctagatgtgtactaggtta

SEQ ID NO: 7926325 - DNA, 22 bp, Homo sapiens
agtctagatgtgtactaggtta

SEQ ID NO: 7926326 - DNA, 22 bp, Homo sapiens
agtctatattgtgaaagtaaaa

SEQ ID NO: 7926327 - DNA, 22 bp, Homo sapiens
agtctcagaaaatatgcttttt

SEQ ID NO: 7926328 - DNA, 22 bp, Homo sapiens
agtctcagaaaagaagcatgga

SEQ ID NO: 7926329 - DNA, 22 bp, Homo sapiens
agtctcagaaaagaagcatgga

SEQ ID NO: 7926330 - DNA, 22 bp, Homo sapiens
agtctcaagtgttagtattatt

SEQ ID NO: 7926331 - DNA, 20 bp, Homo sapiens
ctcacagtcaatgcagaggt

SEQ ID NO: 7926332 - DNA, 21 bp, Homo sapiens
ctcacagtctgttttccttgc

SEQ ID NO: 7926333 - DNA, 22 bp, Homo sapiens
ctcacagtgatgtcttatgaca

SEQ ID NO: 7926334 - DNA, 22 bp, Homo sapiens
ctcacagtgtaatattgaaccc

SEQ ID NO: 7926335 - DNA, 22 bp, Homo sapiens
agtctcaagtgttagtattatt

SEQ ID NO: 7926336 - DNA, 23 bp, Homo sapiens
agtctcaagctggagaattacct

SEQ ID NO: 7926337 - DNA, 23 bp, Homo sapiens
agtctcaagctggagaattacct

SEQ ID NO: 7926338 - DNA, 22 bp, Homo sapiens
agtctatttttggttcttcggg

SEQ ID NO: 7926339 - DNA, 22 bp, Homo sapiens
agtctcaaagtcagtgtcatgg

SEQ ID NO: 7926340 - DNA, 22 bp, Homo sapiens
agtctcaagcaccgaaagctgt

SEQ ID NO: 7926341 - DNA, 22 bp, Homo sapiens
agtctattttcagaagcagttt

SEQ ID NO: 7926342 - DNA, 22 bp, Homo sapiens
agtctattttagctgcatatgt

SEQ ID NO: 7926343 - DNA, 22 bp, Homo sapiens
agtgaaaacactagttcttgcc

SEQ ID NO: 7926344 - DNA, 22 bp, Homo sapiens
agtgaaaacactagttcttgcc

SEQ ID NO: 7926345 - DNA, 22 bp, Homo sapiens
agtctttggttataagagacag

SEQ ID NO: 7926346 - DNA, 22 bp, Homo sapiens
agtgaaaacctaatcatgcagt

SEQ ID NO: 7926347 - DNA, 22 bp, Homo sapiens
agtgaaaacctaatcatgcagt

SEQ ID NO: 7926348 - DNA, 22 bp, Homo sapiens
agtgaaaacctaatcatgcagt

SEQ ID NO: 7926349 - DNA, 22 bp, Homo sapiens
agtgaaaacctaatcatgcagt

SEQ ID NO: 7926350 - DNA, 22 bp, Homo sapiens
agtgaaaacctaatcatgcagt

SEQ ID NO: 7926351 - DNA, 22 bp, Homo sapiens
agtgaaaacctaatcatgcagt

SEQ ID NO: 7926352 - DNA, 22 bp, Homo sapiens
agtgaaaagatgcatttctctg

SEQ ID NO: 7926353 - DNA, 22 bp, Homo sapiens
agtgaaaagatgcatttctctg

SEQ ID NO: 7926354 - DNA, 22 bp, Homo sapiens
agtgaaaggaaaaactgatatt

SEQ ID NO: 7926355 - DNA, 22 bp, Homo sapiens
agtgaaaggaaaaactgatatt

SEQ ID NO: 7926356 - DNA, 22 bp, Homo sapiens
agtgaaatagcatttatgaagc

SEQ ID NO: 7926357 - DNA, 22 bp, Homo sapiens
agtgaaaggttgagaatattct

SEQ ID NO: 7926358 - DNA, 22 bp, Homo sapiens
agtgaaaggttgagaatattct

SEQ ID NO: 7926359 - DNA, 22 bp, Homo sapiens
agtgaaataaagctgcctatgg

SEQ ID NO: 7926360 - DNA, 22 bp, Homo sapiens
agtgaaatagcatttatgaagc

SEQ ID NO: 7926361 - DNA, 22 bp, Homo sapiens
agtgaaatatgcccattgctgt

SEQ ID NO: 7926362 - DNA, 22 bp, Homo sapiens
agtgaaatcaggttttgactgc

SEQ ID NO: 7926363 - DNA, 19 bp, Homo sapiens
agtgaaatggagtattcaa

SEQ ID NO: 7926364 - DNA, 22 bp, Homo sapiens
agtgaaatgattctgagcaaga

SEQ ID NO: 7926365 - DNA, 22 bp, Homo sapiens
agtgaaatgatagtgtaaatac

SEQ ID NO: 7926366 - DNA, 22 bp, Homo sapiens
agtgaaatgactgaatcagata

SEQ ID NO: 7926367 - DNA, 22 bp, Homo sapiens
agtgaaatgactgaatcagata

SEQ ID NO: 7926368 - DNA, 22 bp, Homo sapiens
agtgaaatgactgaatcagata

SEQ ID NO: 7926369 - DNA, 22 bp, Homo sapiens
agtgaaatcctggtcaacaggt

SEQ ID NO: 7926370 - DNA, 22 bp, Homo sapiens
agtgaaatcctggtcaacaggt

SEQ ID NO: 7926371 - DNA, 22 bp, Homo sapiens
agtgaaatcctggtcaacaggt

SEQ ID NO: 7926372 - DNA, 22 bp, Homo sapiens
agtgaggctaataggcaatggt

SEQ ID NO: 7926373 - DNA, 22 bp, Homo sapiens
agtgaggctaataggcaatggt

SEQ ID NO: 7926374 - DNA, 22 bp, Homo sapiens
agtgagggactagtgctgggga

SEQ ID NO: 7926375 - DNA, 22 bp, Homo sapiens
agtgacttcttaaaccatggtc

SEQ ID NO: 7926376 - DNA, 22 bp, Homo sapiens
agtgaggtcaggatctcaggga

SEQ ID NO: 7926377 - DNA, 22 bp, Homo sapiens
agtgaggtcaggatctcaggga

SEQ ID NO: 7926378 - DNA, 22 bp, Homo sapiens
agtgaggtaattagagctgctg

SEQ ID NO: 7926379 - DNA, 22 bp, Homo sapiens
agtgaggtcatactggagaggg

SEQ ID NO: 7926380 - DNA, 22 bp, Homo sapiens
agtgaggggcagctgagtgggc

SEQ ID NO: 7926381 - DNA, 22 bp, Homo sapiens
agtgaggggcagctgagtgggc

SEQ ID NO: 7926382 - DNA, 22 bp, Homo sapiens
agtgagtggatgtaggaattgg

SEQ ID NO: 7926383 - DNA, 22 bp, Homo sapiens
agtgagtggagagctctaggtt

SEQ ID NO: 7926384 - DNA, 22 bp, Homo sapiens
agtgagtcaaacatatcctgac

SEQ ID NO: 7926385 - DNA, 22 bp, Homo sapiens
agtgaggtcatactggagaggg

SEQ ID NO: 7926386 - DNA, 22 bp, Homo sapiens
agtgagggactccatgactcct

SEQ ID NO: 7926387 - DNA, 22 bp, Homo sapiens
agtgagggactccatgactcct

SEQ ID NO: 7926388 - DNA, 22 bp, Homo sapiens
agtgaggggattcaggcaaggt

SEQ ID NO: 7926389 - DNA, 22 bp, Homo sapiens
agtgaggggattcaggcaaggt

SEQ ID NO: 7926390 - DNA, 22 bp, Homo sapiens
agtgaggggattcaggcaaggt

SEQ ID NO: 7926391 - DNA, 22 bp, Homo sapiens
agtgaggggattcaggcaaggt

SEQ ID NO: 7926392 - DNA, 22 bp, Homo sapiens
agtgagtttagggtgcaggtgt

SEQ ID NO: 7926393 - DNA, 20 bp, Homo sapiens
agtgagttatcagctacagt

SEQ ID NO: 7926394 - DNA, 20 bp, Homo sapiens
agtgagttatcagctacagt

SEQ ID NO: 7926395 - DNA, 19 bp, Homo sapiens
agtgagtggggaaggccct

SEQ ID NO: 7926396 - DNA, 22 bp, Homo sapiens
agtgataaccatgtgtgaatta

SEQ ID NO: 7926397 - DNA, 22 bp, Homo sapiens
agtgataaaggtgtgatatgaa

SEQ ID NO: 7926398 - DNA, 22 bp, Homo sapiens
agtgataatgtggtaattattt

SEQ ID NO: 7926399 - DNA, 22 bp, Homo sapiens
agtgatcagtgagtgaagcagg

SEQ ID NO: 7926400 - DNA, 22 bp, Homo sapiens
agtgatagcaaataaaatgtaa

SEQ ID NO: 7926401 - DNA, 22 bp, Homo sapiens
agtgatcttttaaaaagaagtg

SEQ ID NO: 7926402 - DNA, 22 bp, Homo sapiens
agtgatctgactcccagttaga

SEQ ID NO: 7926403 - DNA, 22 bp, Homo sapiens
agtgatggagcttcctctgcta

SEQ ID NO: 7926404 - DNA, 22 bp, Homo sapiens
agtgatggcatatatagatgtg

SEQ ID NO: 7926405 - DNA, 22 bp, Homo sapiens
agtgatggcatcgggtccagca

SEQ ID NO: 7926406 - DNA, 22 bp, Homo sapiens
agtgatggggccctgcactgat

SEQ ID NO: 7926407 - DNA, 22 bp, Homo sapiens
agtgatgtaacaaacagagtta

SEQ ID NO: 7926408 - DNA, 22 bp, Homo sapiens
agtgatggtttccagtcactga

SEQ ID NO: 7926409 - DNA, 22 bp, Homo sapiens
agtgatggtttccagtcactga

SEQ ID NO: 7926410 - DNA, 22 bp, Homo sapiens
agtgatgtaacaaacagagtta

SEQ ID NO: 7926411 - DNA, 22 bp, Homo sapiens
agtgatggtgagtgagaagctc

SEQ ID NO: 7926412 - DNA, 22 bp, Homo sapiens
agtgatggggccctgcactgat

SEQ ID NO: 7926413 - DNA, 20 bp, Homo sapiens
aggtcctggttctctgggat

SEQ ID NO: 7926414 - DNA, 22 bp, Homo sapiens
aggtcctggtcttgagtcttaa

SEQ ID NO: 7926415 - DNA, 22 bp, Homo sapiens
aggtcctggtgaccatggagtt

SEQ ID NO: 7926416 - DNA, 22 bp, Homo sapiens
aggtcctggtgaccatggagtt

SEQ ID NO: 7926417 - DNA, 22 bp, Homo sapiens
aggtcctggtgaccatggagtt

SEQ ID NO: 7926418 - DNA, 22 bp, Homo sapiens
aggtcctgggagttctagtgtg

SEQ ID NO: 7926419 - DNA, 22 bp, Homo sapiens
aggtcctggtcttgagtcttaa

SEQ ID NO: 7926420 - DNA, 22 bp, Homo sapiens
aggtcctggtcttgagtcttaa

SEQ ID NO: 7926421 - DNA, 22 bp, Homo sapiens
aggtcctgggagttctagtgtg

SEQ ID NO: 7926422 - DNA, 22 bp, Homo sapiens
aggtcctgggagttctagtgtg

SEQ ID NO: 7926423 - DNA, 20 bp, Homo sapiens
aggtcctgggactggcagag

SEQ ID NO: 7926424 - DNA, 20 bp, Homo sapiens
aggtcctgggactggcagag

SEQ ID NO: 7926425 - DNA, 22 bp, Homo sapiens
aggtcctgggagttctagtgtg

SEQ ID NO: 7926426 - DNA, 20 bp, Homo sapiens
aggtcctgggactggcagag

SEQ ID NO: 7926427 - DNA, 22 bp, Homo sapiens
aggtcctggactgctcttgtta

SEQ ID NO: 7926428 - DNA, 22 bp, Homo sapiens
aggtcctggactgctcttgtta

SEQ ID NO: 7926429 - DNA, 22 bp, Homo sapiens
aggtcctggactgctcttgtta

SEQ ID NO: 7926430 - DNA, 22 bp, Homo sapiens
aggtcctggactgctcttgtta

SEQ ID NO: 7926431 - DNA, 23 bp, Homo sapiens
aggtcctggacatatgtgcatca

SEQ ID NO: 7926432 - DNA, 22 bp, Homo sapiens
aggtcctgatgatctctgagag

SEQ ID NO: 7926433 - DNA, 19 bp, Homo sapiens
aggtcctgatcagcaagga

SEQ ID NO: 7926434 - DNA, 23 bp, Homo sapiens
aggtcctggacatatgtgcatca

SEQ ID NO: 7926435 - DNA, 22 bp, Homo sapiens
aggtcctgatgatctctgagag

SEQ ID NO: 7926436 - DNA, 22 bp, Homo sapiens
aggtcctgatgatctctgagag

SEQ ID NO: 7926437 - DNA, 22 bp, Homo sapiens
cctgggctttgagggcaggatg

SEQ ID NO: 7926438 - DNA, 20 bp, Homo sapiens
aggtcctggttctctgggat

SEQ ID NO: 7926439 - DNA, 20 bp, Homo sapiens
aggtcctggttctctgggat

SEQ ID NO: 7926440 - DNA, 22 bp, Homo sapiens
cctgggctttgagggcaggatg

SEQ ID NO: 7926441 - DNA, 22 bp, Homo sapiens
cctgggctttgagggcaggatg

SEQ ID NO: 7926442 - DNA, 22 bp, Homo sapiens
cctgggctttgagggcaggatg

SEQ ID NO: 7926443 - DNA, 22 bp, Homo sapiens
cctggggctccagagcagcgga

SEQ ID NO: 7926444 - DNA, 22 bp, Homo sapiens
cctggggctccagagcagcgga

SEQ ID NO: 7926445 - DNA, 22 bp, Homo sapiens
cctgggctttgagggcaggatg

SEQ ID NO: 7926446 - DNA, 22 bp, Homo sapiens
cctggggctctgcacagagcag

SEQ ID NO: 7926447 - DNA, 22 bp, Homo sapiens
cctggggctctgcacagagcag

SEQ ID NO: 7926448 - DNA, 22 bp, Homo sapiens
cctggggctctgcacagagcag

SEQ ID NO: 7926449 - DNA, 20 bp, Homo sapiens
cctggggtacactggcatgt

SEQ ID NO: 7926450 - DNA, 20 bp, Homo sapiens
cctggggtacactggcatgt

SEQ ID NO: 7926451 - DNA, 22 bp, Homo sapiens
cctgggggccaggaaggtgtga

SEQ ID NO: 7926452 - DNA, 22 bp, Homo sapiens
cctggggctctgcacagagcag

SEQ ID NO: 7926453 - DNA, 22 bp, Homo sapiens
cctggggctctgcacagagcag

SEQ ID NO: 7926454 - DNA, 22 bp, Homo sapiens
cctggggctctgcacagagcag

SEQ ID NO: 7926455 - DNA, 22 bp, Homo sapiens
cctggggctttctttgtatcat

SEQ ID NO: 7926456 - DNA, 22 bp, Homo sapiens
cctgtgggagcccaggcagata

SEQ ID NO: 7926457 - DNA, 21 bp, Homo sapiens
cctgtgccagtctatgtgttc

SEQ ID NO: 7926458 - DNA, 22 bp, Homo sapiens
cctgtgggagcccaggcagata

SEQ ID NO: 7926459 - DNA, 22 bp, Homo sapiens
cctgtgggagcccaggcagata

SEQ ID NO: 7926460 - DNA, 22 bp, Homo sapiens
cctgtgccagctgggccctgcc

SEQ ID NO: 7926461 - DNA, 21 bp, Homo sapiens
cctgtgccagtctatgtgttc

SEQ ID NO: 7926462 - DNA, 21 bp, Homo sapiens
cctgtgccagtctatgtgttc

SEQ ID NO: 7926463 - DNA, 22 bp, Homo sapiens
aggtgcagctggtggagtctgg

SEQ ID NO: 7926464 - DNA, 22 bp, Homo sapiens
aggtgcagctggtggagtctgg

SEQ ID NO: 7926465 - DNA, 22 bp, Homo sapiens
aggtgcagctggtggagtctgg

SEQ ID NO: 7926466 - DNA, 22 bp, Homo sapiens
aggtgcaggagctgtgcaggga

SEQ ID NO: 7926467 - DNA, 22 bp, Homo sapiens
cctgtgccagctgggccctgcc

SEQ ID NO: 7926468 - DNA, 22 bp, Homo sapiens
aggtgcagctggtggagtctgg

SEQ ID NO: 7926469 - DNA, 22 bp, Homo sapiens
aggtgcagctgacaccatgtgg

SEQ ID NO: 7926470 - DNA, 22 bp, Homo sapiens
aggtgcagctgacaccatgtgg

SEQ ID NO: 7926471 - DNA, 18 bp, Homo sapiens
aggtgcagcctctgaggc

SEQ ID NO: 7926472 - DNA, 22 bp, Homo sapiens
aggtgcagctggtggagtctgg

SEQ ID NO: 7926473 - DNA, 22 bp, Homo sapiens
aggtgcagctggtggagtctgg

SEQ ID NO: 7926474 - DNA, 22 bp, Homo sapiens
aggtgcagctggtggagtctgg

SEQ ID NO: 7926475 - DNA, 18 bp, Homo sapiens
aggtgcagcctctgaggc

SEQ ID NO: 7926476 - DNA, 23 bp, Homo sapiens
aggtgcagccctggacctgcccc

SEQ ID NO: 7926477 - DNA, 23 bp, Homo sapiens
aggtgcagccctggacctgcccc

SEQ ID NO: 7926478 - DNA, 22 bp, Homo sapiens
aggtgcagcatgagtccaacgg

SEQ ID NO: 7926479 - DNA, 21 bp, Homo sapiens
aggtgcagaggcctcactcac

SEQ ID NO: 7926480 - DNA, 22 bp, Homo sapiens
aggtgcagcatgagtccaacgg

SEQ ID NO: 7926481 - DNA, 22 bp, Homo sapiens
aggtgcagcatgagtccaacgg

SEQ ID NO: 7926482 - DNA, 22 bp, Homo sapiens
cctggggtcacttgcagccgca

SEQ ID NO: 7926483 - DNA, 22 bp, Homo sapiens
cctggggtatataggtgaatat

SEQ ID NO: 7926484 - DNA, 22 bp, Homo sapiens
cctgggtagactttgaagcatt

SEQ ID NO: 7926485 - DNA, 22 bp, Homo sapiens
cctgggtacgcagggctcctct

SEQ ID NO: 7926486 - DNA, 22 bp, Homo sapiens
cctgggtacccttggcggcctt

SEQ ID NO: 7926487 - DNA, 22 bp, Homo sapiens
cctgggtcaccaggcccaggca

SEQ ID NO: 7926488 - DNA, 22 bp, Homo sapiens
cctgggtcaccaggcccaggca

SEQ ID NO: 7926489 - DNA, 22 bp, Homo sapiens
cctgggtcaccaggcccaggca

SEQ ID NO: 7926490 - DNA, 22 bp, Homo sapiens
cctgggtatagaagagccgctg

SEQ ID NO: 7926491 - DNA, 22 bp, Homo sapiens
cctgggtcaccaggcccaggca

SEQ ID NO: 7926492 - DNA, 22 bp, Homo sapiens
cctgggtcactcaggcaggcgg

SEQ ID NO: 7926493 - DNA, 22 bp, Homo sapiens
cctgggtcactcaggcaggcgg

SEQ ID NO: 7926494 - DNA, 22 bp, Homo sapiens
cctgggtcactcaggcaggcgg

SEQ ID NO: 7926495 - DNA, 22 bp, Homo sapiens
cctgggtcactcaggcaggcgg

SEQ ID NO: 7926496 - DNA, 22 bp, Homo sapiens
cctgggtcactcaggcaggcgg

SEQ ID NO: 7926497 - DNA, 22 bp, Homo sapiens
cctgggtccaccctgtgaagta

SEQ ID NO: 7926498 - DNA, 22 bp, Homo sapiens
cctgggtccaccctgtgaagta

SEQ ID NO: 7926499 - DNA, 22 bp, Homo sapiens
cctgggtccaattctggcttgt

SEQ ID NO: 7926500 - DNA, 21 bp, Homo sapiens
aggtgcagagccagggaccag

SEQ ID NO: 7926501 - DNA, 17 bp, Homo sapiens
aggtgcagaggcagagc

SEQ ID NO: 7926502 - DNA, 17 bp, Homo sapiens
aggtgcagaggcagagc

SEQ ID NO: 7926503 - DNA, 17 bp, Homo sapiens
aggtgcagaggcagagc

SEQ ID NO: 7926504 - DNA, 17 bp, Homo sapiens
aggtgcagaggcagagc

SEQ ID NO: 7926505 - DNA, 17 bp, Homo sapiens
aggtgcagaggcagagc

SEQ ID NO: 7926506 - DNA, 17 bp, Homo sapiens
aggtgcagaggcagagc

SEQ ID NO: 7926507 - DNA, 17 bp, Homo sapiens
aggtgcagaggcagagc

SEQ ID NO: 7926508 - DNA, 17 bp, Homo sapiens
aggtgcagaggcagagc

SEQ ID NO: 7926509 - DNA, 17 bp, Homo sapiens
aggtgcagaggcagagc

SEQ ID NO: 7926510 - DNA, 17 bp, Homo sapiens
aggtgcagaggcagagc

SEQ ID NO: 7926511 - DNA, 17 bp, Homo sapiens
aggtgcagaggcagagc

SEQ ID NO: 7926512 - DNA, 22 bp, Homo sapiens
ccttccaagtgctgctttttcc

SEQ ID NO: 7926513 - DNA, 22 bp, Homo sapiens
ccttccaagtgctgctttttcc

SEQ ID NO: 7926514 - DNA, 22 bp, Homo sapiens
ccttccaagtgcttgccgcttt

SEQ ID NO: 7926515 - DNA, 22 bp, Homo sapiens
ccttccaagtgcttgccgcttt

SEQ ID NO: 7926516 - DNA, 22 bp, Homo sapiens
ccttccaagtgcttgccgcttt

SEQ ID NO: 7926517 - DNA, 21 bp, Homo sapiens
ccttccaccttctgccatgtg

SEQ ID NO: 7926518 - DNA, 19 bp, Homo sapiens
ccttccagaactaaattaa

SEQ ID NO: 7926519 - DNA, 19 bp, Homo sapiens
ccttccagaactaaattaa

SEQ ID NO: 7926520 - DNA, 22 bp, Homo sapiens
ccttccagaggcgtgacaccct

SEQ ID NO: 7926521 - DNA, 22 bp, Homo sapiens
ccttccagaaagcacttagtta

SEQ ID NO: 7926522 - DNA, 22 bp, Homo sapiens
ccttccagaaagcacttagtta

SEQ ID NO: 7926523 - DNA, 22 bp, Homo sapiens
ccttccagaggcgtgacaccct

SEQ ID NO: 7926524 - DNA, 22 bp, Homo sapiens
ccttccagaggcgtgacaccct

SEQ ID NO: 7926525 - DNA, 22 bp, Homo sapiens
ccttccagaggcgtgacaccct

SEQ ID NO: 7926526 - DNA, 22 bp, Homo sapiens
ccttccagagttcagtctgccc

SEQ ID NO: 7926527 - DNA, 22 bp, Homo sapiens
ccttccagagttcagtctgccc

SEQ ID NO: 7926528 - DNA, 22 bp, Homo sapiens
ccttccagagttcagtctgccc

SEQ ID NO: 7926529 - DNA, 22 bp, Homo sapiens
ccttccagagttcagtctgccc

SEQ ID NO: 7926530 - DNA, 22 bp, Homo sapiens
ccttccagaggcgtgacaccct

SEQ ID NO: 7926531 - DNA, 22 bp, Homo sapiens
ccttccagaggcgtgacaccct

SEQ ID NO: 7926532 - DNA, 22 bp, Homo sapiens
ccttccagatgtaagagctgat

SEQ ID NO: 7926533 - DNA, 22 bp, Homo sapiens
ccttccagatgtaagagctgat

SEQ ID NO: 7926534 - DNA, 22 bp, Homo sapiens
ccttccagccccatctcatcgt

SEQ ID NO: 7926535 - DNA, 22 bp, Homo sapiens
ccttccagccccatctcatcgt

SEQ ID NO: 7926536 - DNA, 22 bp, Homo sapiens
ccttccagccccatctcatcgt

SEQ ID NO: 7926537 - DNA, 22 bp, Homo sapiens
ccttccagatgtaagagctgat

SEQ ID NO: 7926538 - DNA, 22 bp, Homo sapiens
ccttccagatgtaagagctgat

SEQ ID NO: 7926539 - DNA, 22 bp, Homo sapiens
ccttccagatgtaagagctgat

SEQ ID NO: 7926540 - DNA, 22 bp, Homo sapiens
ccttccaggagtctctgcaggt

SEQ ID NO: 7926541 - DNA, 22 bp, Homo sapiens
ccttccaggagtctctgcaggt

SEQ ID NO: 7926542 - DNA, 22 bp, Homo sapiens
ccttccaggagtctctgcaggt

SEQ ID NO: 7926543 - DNA, 19 bp, Homo sapiens
ccttccagctccttttcag

SEQ ID NO: 7926544 - DNA, 19 bp, Homo sapiens
ccttccagctccttttcag

SEQ ID NO: 7926545 - DNA, 22 bp, Homo sapiens
ccttccagccccatctcatcgt

SEQ ID NO: 7926546 - DNA, 22 bp, Homo sapiens
ccttccaggagtctctgcaggt

SEQ ID NO: 7926547 - DNA, 22 bp, Homo sapiens
ccttccaggagtctctgcaggt

SEQ ID NO: 7926548 - DNA, 22 bp, Homo sapiens
ccttccaggctggaggcttggg

SEQ ID NO: 7926549 - DNA, 22 bp, Homo sapiens
ccttccaggagtctctgcaggt

SEQ ID NO: 7926550 - DNA, 22 bp, Homo sapiens
ccttccaggctggaggcttggg

SEQ ID NO: 7926551 - DNA, 22 bp, Homo sapiens
ccttccagggagcaggcagtgt

SEQ ID NO: 7926552 - DNA, 22 bp, Homo sapiens
ccttccaggctggaggcttggg

SEQ ID NO: 7926553 - DNA, 22 bp, Homo sapiens
ccttccaggctggaggcttggg

SEQ ID NO: 7926554 - DNA, 22 bp, Homo sapiens
ccttccagggagcaggcagtgt

SEQ ID NO: 7926555 - DNA, 22 bp, Homo sapiens
ccttccagggagcaggcagtgt

SEQ ID NO: 7926556 - DNA, 22 bp, Homo sapiens
ccttccagggagcaggcagtgt

SEQ ID NO: 7926557 - DNA, 22 bp, Homo sapiens
ccttccagggagcaggcagtgt

SEQ ID NO: 7926558 - DNA, 22 bp, Homo sapiens
ccttccagggctctccagaacc

SEQ ID NO: 7926559 - DNA, 22 bp, Homo sapiens
aggtggcaggaggtcagagaaa

SEQ ID NO: 7926560 - DNA, 22 bp, Homo sapiens
aggtggcaggaggtcagagaaa

SEQ ID NO: 7926561 - DNA, 22 bp, Homo sapiens
aggtggcaggaggtcagagaaa

SEQ ID NO: 7926562 - DNA, 22 bp, Homo sapiens
aggtggcaggaggtcagagaaa

SEQ ID NO: 7926563 - DNA, 22 bp, Homo sapiens
aggtggcagccgagacataagg

SEQ ID NO: 7926564 - DNA, 22 bp, Homo sapiens
aggtggcagccgagacataagg

SEQ ID NO: 7926565 - DNA, 22 bp, Homo sapiens
aggtggcaggaggtcagagaaa

SEQ ID NO: 7926566 - DNA, 22 bp, Homo sapiens
cctgtttaccactgaggggcag

SEQ ID NO: 7926567 - DNA, 22 bp, Homo sapiens
cctgttgtttagcacttagaac

SEQ ID NO: 7926568 - DNA, 22 bp, Homo sapiens
aggtggcagttgtggaaccatc

SEQ ID NO: 7926569 - DNA, 22 bp, Homo sapiens
cctgtttatctatctagagatg

SEQ ID NO: 7926570 - DNA, 22 bp, Homo sapiens
cctgtttcagaatttttagtga

SEQ ID NO: 7926571 - DNA, 22 bp, Homo sapiens
cctgtttggtacaatctgccaa

SEQ ID NO: 7926572 - DNA, 22 bp, Homo sapiens
ccttccaagtgctgctttttcc

SEQ ID NO: 7926573 - DNA, 22 bp, Homo sapiens
ccttcattgcatctttaagaga

SEQ ID NO: 7926574 - DNA, 22 bp, Homo sapiens
ccttccaaaggagccacatctg

SEQ ID NO: 7926575 - DNA, 22 bp, Homo sapiens
ccttccaaaggagccacatctg

SEQ ID NO: 7926576 - DNA, 22 bp, Homo sapiens
ccttcattcattaatttagccc

SEQ ID NO: 7926577 - DNA, 22 bp, Homo sapiens
aggtggcagatgggggtgctcg

SEQ ID NO: 7926578 - DNA, 22 bp, Homo sapiens
aggtggcagatgggggtgctcg

SEQ ID NO: 7926579 - DNA, 22 bp, Homo sapiens
aggtggcagagtgacaggctga

SEQ ID NO: 7926580 - DNA, 22 bp, Homo sapiens
aggtggcagagtgacaggctga

SEQ ID NO: 7926581 - DNA, 22 bp, Homo sapiens
aggtggcagcagaatcagggag

SEQ ID NO: 7926582 - DNA, 22 bp, Homo sapiens
aggtggcagatgggggtgctcg

SEQ ID NO: 7926583 - DNA, 22 bp, Homo sapiens
aggtggcagatgggggtgctcg

SEQ ID NO: 7926584 - DNA, 22 bp, Homo sapiens
aggtggcagcagcctggtgaaa

SEQ ID NO: 7926585 - DNA, 22 bp, Homo sapiens
aggtggcagcagcctggtgaaa

SEQ ID NO: 7926586 - DNA, 22 bp, Homo sapiens
aggtggcagcaggagatgtgga

SEQ ID NO: 7926587 - DNA, 22 bp, Homo sapiens
aggtggcagcagcctggtgaaa

SEQ ID NO: 7926588 - DNA, 22 bp, Homo sapiens
aggtggcagcagcctggtgaaa

SEQ ID NO: 7926589 - DNA, 22 bp, Homo sapiens
aggtggcagcagcctggtgaaa

SEQ ID NO: 7926590 - DNA, 22 bp, Homo sapiens
aggtggcagcagaatcagggag

SEQ ID NO: 7926591 - DNA, 22 bp, Homo sapiens
cctgtgggcttgagtgtagggt

SEQ ID NO: 7926592 - DNA, 22 bp, Homo sapiens
cctgtgggcttgagtgtagggt

SEQ ID NO: 7926593 - DNA, 22 bp, Homo sapiens
cctgtggggagagatctcttag

SEQ ID NO: 7926594 - DNA, 22 bp, Homo sapiens
cctgtggggccatctcagtcac

SEQ ID NO: 7926595 - DNA, 22 bp, Homo sapiens
cctgtgggtacaacagggtcac

SEQ ID NO: 7926596 - DNA, 22 bp, Homo sapiens
cctgtgggtcacatgggtgact

SEQ ID NO: 7926597 - DNA, 22 bp, Homo sapiens
aggtggcaaggggcgcctctct

SEQ ID NO: 7926598 - DNA, 22 bp, Homo sapiens
cctgtggggctgaaagaggctt

SEQ ID NO: 7926599 - DNA, 22 bp, Homo sapiens
aggtggcagagctggcccagcg

SEQ ID NO: 7926600 - DNA, 22 bp, Homo sapiens
aggtggcagagctggcccagcg

SEQ ID NO: 7926601 - DNA, 22 bp, Homo sapiens
aggtggcagagctggcccagcg

SEQ ID NO: 7926602 - DNA, 22 bp, Homo sapiens
aggtggcagactaacagaagga

SEQ ID NO: 7926603 - DNA, 22 bp, Homo sapiens
aggtggcagactaacagaagga

SEQ ID NO: 7926604 - DNA, 22 bp, Homo sapiens
aggtggcagagctggcccagcg

SEQ ID NO: 7926605 - DNA, 22 bp, Homo sapiens
aggtggcagactaacagaagga

SEQ ID NO: 7926606 - DNA, 22 bp, Homo sapiens
aggtggcagaggactcctcctg

SEQ ID NO: 7926607 - DNA, 22 bp, Homo sapiens
aggtggcagaggactcctcctg

SEQ ID NO: 7926608 - DNA, 22 bp, Homo sapiens
aggtggcagaggactcctcctg

SEQ ID NO: 7926609 - DNA, 22 bp, Homo sapiens
aggtggcagagtgacaggctga

SEQ ID NO: 7926610 - DNA, 22 bp, Homo sapiens
aggtggcagagtgacaggctga

SEQ ID NO: 7926611 - DNA, 22 bp, Homo sapiens
aggtggcagagtgacaggctga

SEQ ID NO: 7926612 - DNA, 22 bp, Homo sapiens
aggtggcagagtgacaggctga

SEQ ID NO: 7926613 - DNA, 22 bp, Homo sapiens
cctgtgggagggagcggctgga

SEQ ID NO: 7926614 - DNA, 22 bp, Homo sapiens
cctgtgggagggagcggctgga

SEQ ID NO: 7926615 - DNA, 22 bp, Homo sapiens
cctgtgggaggttctgtgagtc

SEQ ID NO: 7926616 - DNA, 22 bp, Homo sapiens
cctgtgggaggttctgtgagtc

SEQ ID NO: 7926617 - DNA, 22 bp, Homo sapiens
cctgtgggaggggcctggcgcg

SEQ ID NO: 7926618 - DNA, 22 bp, Homo sapiens
cctgtgggaggggcctggcgcg

SEQ ID NO: 7926619 - DNA, 22 bp, Homo sapiens
cctgtgggaggttctgtgagtc

SEQ ID NO: 7926620 - DNA, 22 bp, Homo sapiens
cctgtgggaggttctgtgagtc

SEQ ID NO: 7926621 - DNA, 22 bp, Homo sapiens
cctgtgggaggttctgtgagtc

SEQ ID NO: 7926622 - DNA, 23 bp, Homo sapiens
cctgtgggatggcttaatatttt

SEQ ID NO: 7926623 - DNA, 22 bp, Homo sapiens
cctgtgggccctggacagagac

SEQ ID NO: 7926624 - DNA, 22 bp, Homo sapiens
cctgtgggccaaggacctgcca

SEQ ID NO: 7926625 - DNA, 22 bp, Homo sapiens
cctgtgggccaaggacctgcca

SEQ ID NO: 7926626 - DNA, 22 bp, Homo sapiens
cctgtgggccctggacagagac

SEQ ID NO: 7926627 - DNA, 22 bp, Homo sapiens
cctgtgggccctggacagagac

SEQ ID NO: 7926628 - DNA, 22 bp, Homo sapiens
cctgtgggctgagaacaagggc

SEQ ID NO: 7926629 - DNA, 22 bp, Homo sapiens
cctgtgggcgcagctggagtca

SEQ ID NO: 7926630 - DNA, 22 bp, Homo sapiens
cctgtgggcctgcacgtgggga

SEQ ID NO: 7926631 - DNA, 21 bp, Homo sapiens
aggtcagcccagctctggaag

SEQ ID NO: 7926632 - DNA, 21 bp, Homo sapiens
aggtcagcccagctctggaag

SEQ ID NO: 7926633 - DNA, 22 bp, Homo sapiens
aggtcagccctctctgggcagg

SEQ ID NO: 7926634 - DNA, 21 bp, Homo sapiens
aggtcagcccagctctggaag

SEQ ID NO: 7926635 - DNA, 22 bp, Homo sapiens
aggtcagcatgctcctctctgt

SEQ ID NO: 7926636 - DNA, 22 bp, Homo sapiens
aggtcagatgggagatgggatg

SEQ ID NO: 7926637 - DNA, 22 bp, Homo sapiens
aggtcagatgggagatgggatg

SEQ ID NO: 7926638 - DNA, 22 bp, Homo sapiens
aggtcagatgggagatgggatg

SEQ ID NO: 7926639 - DNA, 22 bp, Homo sapiens
aggtcagatgggagatgggatg

SEQ ID NO: 7926640 - DNA, 22 bp, Homo sapiens
aggtcagcaggccaggggcgaa

SEQ ID NO: 7926641 - DNA, 18 bp, Homo sapiens
aggtcaggaaagcagagt

SEQ ID NO: 7926642 - DNA, 22 bp, Homo sapiens
aggtcaggaggcctctgccatt

SEQ ID NO: 7926643 - DNA, 22 bp, Homo sapiens
aggtcaggaggcctctgccatt

SEQ ID NO: 7926644 - DNA, 22 bp, Homo sapiens
aggtcaggaggcctctgccatt

SEQ ID NO: 7926645 - DNA, 22 bp, Homo sapiens
aggtcagctgtgtgtgcatgag

SEQ ID NO: 7926646 - DNA, 22 bp, Homo sapiens
aggtcagctgtgtgtgcatgag

SEQ ID NO: 7926647 - DNA, 18 bp, Homo sapiens
aggtcaggaaagcagagt

SEQ ID NO: 7926648 - DNA, 18 bp, Homo sapiens
aggtcaggaaagcagagt

SEQ ID NO: 7926649 - DNA, 22 bp, Homo sapiens
aggtcagctgcactggtgtaat

SEQ ID NO: 7926650 - DNA, 22 bp, Homo sapiens
aggtcagctgctgataggcagc

SEQ ID NO: 7926651 - DNA, 22 bp, Homo sapiens
aggtcagctgctgataggcagc

SEQ ID NO: 7926652 - DNA, 22 bp, Homo sapiens
aggtcagaaaaggagagcattg

SEQ ID NO: 7926653 - DNA, 22 bp, Homo sapiens
aggtcagaagtgccagggaatt

SEQ ID NO: 7926654 - DNA, 22 bp, Homo sapiens
aggtcagaaaaggagagcattg

SEQ ID NO: 7926655 - DNA, 22 bp, Homo sapiens
aggtcagacagggtgtctttct

SEQ ID NO: 7926656 - DNA, 22 bp, Homo sapiens
aggtcagacacagtgctgggtg

SEQ ID NO: 7926657 - DNA, 22 bp, Homo sapiens
aggtcagaagtgccagggaatt

SEQ ID NO: 7926658 - DNA, 22 bp, Homo sapiens
aggtcacccgtttgactatcca

SEQ ID NO: 7926659 - DNA, 22 bp, Homo sapiens
aggtcacgtcctgtgatgtcat

SEQ ID NO: 7926660 - DNA, 22 bp, Homo sapiens
aggtcacgtcctgtgatgtcat

SEQ ID NO: 7926661 - DNA, 22 bp, Homo sapiens
aggtcagaaaaggagagcattg

SEQ ID NO: 7926662 - DNA, 22 bp, Homo sapiens
aggtcacttggtgttattcagc

SEQ ID NO: 7926663 - DNA, 22 bp, Homo sapiens
aggtcagaaaaggagagcattg

SEQ ID NO: 7926664 - DNA, 22 bp, Homo sapiens
aggtcacttcctgtctggataa

SEQ ID NO: 7926665 - DNA, 22 bp, Homo sapiens
aggtcacagggttgaagtactt

SEQ ID NO: 7926666 - DNA, 22 bp, Homo sapiens
aggtcacaggctttgaaatcaa

SEQ ID NO: 7926667 - DNA, 22 bp, Homo sapiens
aggtcacagctttctcgtgagg

SEQ ID NO: 7926668 - DNA, 22 bp, Homo sapiens
aggtcacagggttgaagtactt

SEQ ID NO: 7926669 - DNA, 22 bp, Homo sapiens
aggtcacagggttgaagtactt

SEQ ID NO: 7926670 - DNA, 22 bp, Homo sapiens
aggtcacatggataatgatcag

SEQ ID NO: 7926671 - DNA, 22 bp, Homo sapiens
aggtcaccatggcatgctccac

SEQ ID NO: 7926672 - DNA, 22 bp, Homo sapiens
aggtcacccgtttgactatcca

SEQ ID NO: 7926673 - DNA, 22 bp, Homo sapiens
aggtcacccgtttgactatcca

SEQ ID NO: 7926674 - DNA, 22 bp, Homo sapiens
aggtcaccatggcatgctccac

SEQ ID NO: 7926675 - DNA, 22 bp, Homo sapiens
aggtcaccatggcatgctccac

SEQ ID NO: 7926676 - DNA, 22 bp, Homo sapiens
aggtcaccatggcatgctccac

SEQ ID NO: 7926677 - DNA, 22 bp, Homo sapiens
cctgggaggctgtgggtctgct

SEQ ID NO: 7926678 - DNA, 22 bp, Homo sapiens
cctgggaggctgtgggtctgct

SEQ ID NO: 7926679 - DNA, 22 bp, Homo sapiens
cctgggaggctgtgggtctgct

SEQ ID NO: 7926680 - DNA, 22 bp, Homo sapiens
cctgggaggctgaggctgcagt

SEQ ID NO: 7926681 - DNA, 22 bp, Homo sapiens
cctgggaggctgaggctgcagt

SEQ ID NO: 7926682 - DNA, 22 bp, Homo sapiens
cctgggaggctgaggctgcagt

SEQ ID NO: 7926683 - DNA, 22 bp, Homo sapiens
cctgggaggctgaggctgcagt

SEQ ID NO: 7926684 - DNA, 21 bp, Homo sapiens
cctgggagaattgggtgtggc

SEQ ID NO: 7926685 - DNA, 21 bp, Homo sapiens
cctgggagaattgggtgtggc

SEQ ID NO: 7926686 - DNA, 22 bp, Homo sapiens
cctgggaggctgaggctgcagt

SEQ ID NO: 7926687 - DNA, 21 bp, Homo sapiens
cctgggagaattgggtgtggc

SEQ ID NO: 7926688 - DNA, 22 bp, Homo sapiens
aggtcagttttaggaaagagca

SEQ ID NO: 7926689 - DNA, 22 bp, Homo sapiens
aggtcaggtatcagcaggtatt

SEQ ID NO: 7926690 - DNA, 22 bp, Homo sapiens
aggtcagtgtagtggtttgggc

SEQ ID NO: 7926691 - DNA, 19 bp, Homo sapiens
aggtcagtggctcaggcat

SEQ ID NO: 7926692 - DNA, 19 bp, Homo sapiens
aggtcagtggctcaggcat

SEQ ID NO: 7926693 - DNA, 20 bp, Homo sapiens
aggtcagtagaatgattttg

SEQ ID NO: 7926694 - DNA, 22 bp, Homo sapiens
aggtcaggaggttaagagtctt

SEQ ID NO: 7926695 - DNA, 22 bp, Homo sapiens
aggtcagggtattcacgtctgt

SEQ ID NO: 7926696 - DNA, 22 bp, Homo sapiens
aggtcaggaggttaagagtctt

SEQ ID NO: 7926697 - DNA, 22 bp, Homo sapiens
aggtcagggtattcacgtctgt

SEQ ID NO: 7926698 - DNA, 22 bp, Homo sapiens
aggtcaggtatcagcaggtatt

SEQ ID NO: 7926699 - DNA, 22 bp, Homo sapiens
aggtcaggtatcagcaggtatt

SEQ ID NO: 7926700 - DNA, 22 bp, Homo sapiens
aggtcaggtatcagcaggtatt

SEQ ID NO: 7926701 - DNA, 22 bp, Homo sapiens
cctgggaggtggaggttgcagc

SEQ ID NO: 7926702 - DNA, 22 bp, Homo sapiens
cctgggagggcaagtgctgatg

SEQ ID NO: 7926703 - DNA, 22 bp, Homo sapiens
cctgggaggtggaggttgcagc

SEQ ID NO: 7926704 - DNA, 22 bp, Homo sapiens
cctgggaggtggaggttgcagt

SEQ ID NO: 7926705 - DNA, 22 bp, Homo sapiens
cctgggaggtggaggttgcagt

SEQ ID NO: 7926706 - DNA, 22 bp, Homo sapiens
cctgggaggctgtgggtctgct

SEQ ID NO: 7926707 - DNA, 22 bp, Homo sapiens
cctgggaggctgtttccagcct

SEQ ID NO: 7926708 - DNA, 22 bp, Homo sapiens
cctgggaggctgtgggtctgct

SEQ ID NO: 7926709 - DNA, 22 bp, Homo sapiens
cctgggaggctgtgggtctgct

SEQ ID NO: 7926710 - DNA, 22 bp, Homo sapiens
cctgggagggcaagtgctgatg

SEQ ID NO: 7926711 - DNA, 22 bp, Homo sapiens
cctgggagggcaagtgctgatg

SEQ ID NO: 7926712 - DNA, 22 bp, Homo sapiens
cctgggagggcaagtgctgatg

SEQ ID NO: 7926713 - DNA, 22 bp, Homo sapiens
cctgggagggcaagtgctgatg

SEQ ID NO: 7926714 - DNA, 22 bp, Homo sapiens
aggtattccagtggtcaccaag

SEQ ID NO: 7926715 - DNA, 22 bp, Homo sapiens
aggtattgaccacctccttgat

SEQ ID NO: 7926716 - DNA, 17 bp, Homo sapiens
aggtatttaaggagctg

SEQ ID NO: 7926717 - DNA, 22 bp, Homo sapiens
aggtacagcaatataagaggtc

SEQ ID NO: 7926718 - DNA, 22 bp, Homo sapiens
aggtacagcaatataagaggtc

SEQ ID NO: 7926719 - DNA, 22 bp, Homo sapiens
aggtatttatgagagcacatat

SEQ ID NO: 7926720 - DNA, 22 bp, Homo sapiens
aggtatttatgagagcacatat

SEQ ID NO: 7926721 - DNA, 22 bp, Homo sapiens
aggtatttatgagagcacatat

SEQ ID NO: 7926722 - DNA, 22 bp, Homo sapiens
aggtcacacaactgtcagaggc

SEQ ID NO: 7926723 - DNA, 22 bp, Homo sapiens
aggtcacacaactgtcagaggc

SEQ ID NO: 7926724 - DNA, 22 bp, Homo sapiens
aggtcacacaactgtcagaggc

SEQ ID NO: 7926725 - DNA, 22 bp, Homo sapiens
aggtcacacttggatcatagaa

SEQ ID NO: 7926726 - DNA, 22 bp, Homo sapiens
aggtcacaggctttgaaatcaa

SEQ ID NO: 7926727 - DNA, 22 bp, Homo sapiens
aggtcacagctttctcgtgagg

SEQ ID NO: 7926728 - DNA, 22 bp, Homo sapiens
aggtcacagctttctcgtgagg

SEQ ID NO: 7926729 - DNA, 22 bp, Homo sapiens
aggtacagatgaaagtctagtt

SEQ ID NO: 7926730 - DNA, 22 bp, Homo sapiens
aggtacagatgaaagtctagtt

SEQ ID NO: 7926731 - DNA, 22 bp, Homo sapiens
aggtacagatgaaagtctagtt

SEQ ID NO: 7926732 - DNA, 22 bp, Homo sapiens
aggtaattttgtgttaatgatt

SEQ ID NO: 7926733 - DNA, 22 bp, Homo sapiens
aggtaatttctccaaacatgct

SEQ ID NO: 7926734 - DNA, 22 bp, Homo sapiens
aggtaatgcaactactttgcta

SEQ ID NO: 7926735 - DNA, 22 bp, Homo sapiens
aggtaatgcatataaagtgctt

SEQ ID NO: 7926736 - DNA, 22 bp, Homo sapiens
aggtaaggtttggaggcagtgg

SEQ ID NO: 7926737 - DNA, 22 bp, Homo sapiens
aggtaaggtttggaggcagtgg

SEQ ID NO: 7926738 - DNA, 22 bp, Homo sapiens
aggtaatagggttcagaattat

SEQ ID NO: 7926739 - DNA, 22 bp, Homo sapiens
aggtaaggaaattgaggcaatt

SEQ ID NO: 7926740 - DNA, 22 bp, Homo sapiens
aggtaagcatggtggctgctgt

SEQ ID NO: 7926741 - DNA, 22 bp, Homo sapiens
aggtaactgtggctaggtaact

SEQ ID NO: 7926742 - DNA, 22 bp, Homo sapiens
aggtaactgtggctaggtaact

SEQ ID NO: 7926743 - DNA, 22 bp, Homo sapiens
aggtaactggctaactgaacga

SEQ ID NO: 7926744 - DNA, 22 bp, Homo sapiens
aggtaaggctgtaagctaagcc

SEQ ID NO: 7926745 - DNA, 22 bp, Homo sapiens
aggtaaggctgtaagctaagcc

SEQ ID NO: 7926746 - DNA, 22 bp, Homo sapiens
aggtaaggctgtaagctaagcc

SEQ ID NO: 7926747 - DNA, 22 bp, Homo sapiens
aggtaaggctgtaagctaagcc

SEQ ID NO: 7926748 - DNA, 22 bp, Homo sapiens
aggtaaatgtcagagcctttaa

SEQ ID NO: 7926749 - DNA, 22 bp, Homo sapiens
aggtaaagactgcaaggagaat

SEQ ID NO: 7926750 - DNA, 22 bp, Homo sapiens
aggtaaagaaaggtgtaacatt

SEQ ID NO: 7926751 - DNA, 22 bp, Homo sapiens
aggtaaagacagtgaaagaggg

SEQ ID NO: 7926752 - DNA, 22 bp, Homo sapiens
aggtaacactacttagtatact

SEQ ID NO: 7926753 - DNA, 22 bp, Homo sapiens
aggtaacactacttagtatact

SEQ ID NO: 7926754 - DNA, 22 bp, Homo sapiens
aggtaacagcttcagcttcaga

SEQ ID NO: 7926755 - DNA, 22 bp, Homo sapiens
aggtaacatgtggtgctataag

SEQ ID NO: 7926756 - DNA, 22 bp, Homo sapiens
aggtaacactacttagtatact

SEQ ID NO: 7926757 - DNA, 22 bp, Homo sapiens
aggtaaattcagcagtgacatt

SEQ ID NO: 7926758 - DNA, 22 bp, Homo sapiens
aggtaaattcagcagtgacatt

SEQ ID NO: 7926759 - DNA, 22 bp, Homo sapiens
agggttcagtccagggcctggg

SEQ ID NO: 7926760 - DNA, 22 bp, Homo sapiens
agggttcccatcacctccttcc

SEQ ID NO: 7926761 - DNA, 20 bp, Homo sapiens
agggttcccttgttcagcag

SEQ ID NO: 7926762 - DNA, 22 bp, Homo sapiens
agggtgggctagactcttcccc

SEQ ID NO: 7926763 - DNA, 22 bp, Homo sapiens
agggtgggctagactcttcccc

SEQ ID NO: 7926764 - DNA, 22 bp, Homo sapiens
agggtgggctagactcttcccc

SEQ ID NO: 7926765 - DNA, 22 bp, Homo sapiens
agggtgggctagactcttcccc

SEQ ID NO: 7926766 - DNA, 19 bp, Homo sapiens
agggttacccgctgccacc

SEQ ID NO: 7926767 - DNA, 22 bp, Homo sapiens
agggttaggtcacgctgcctgg

SEQ ID NO: 7926768 - DNA, 22 bp, Homo sapiens
agggttctgccagtgtcttgag

SEQ ID NO: 7926769 - DNA, 22 bp, Homo sapiens
agggttgaagtctggtcctcat

SEQ ID NO: 7926770 - DNA, 22 bp, Homo sapiens
agggttgcatttttagaggctc

SEQ ID NO: 7926771 - DNA, 22 bp, Homo sapiens
agggttgcaggggccatgccca

SEQ ID NO: 7926772 - DNA, 22 bp, Homo sapiens
aggtaaaatagatagtatttct

SEQ ID NO: 7926773 - DNA, 22 bp, Homo sapiens
aggtaaacaggagaaaatgaga

SEQ ID NO: 7926774 - DNA, 22 bp, Homo sapiens
aggtaaaatgagtctccattat

SEQ ID NO: 7926775 - DNA, 22 bp, Homo sapiens
aggtaaagaaaggtgtaacatt

SEQ ID NO: 7926776 - DNA, 22 bp, Homo sapiens
cctgagtcccataatgttgcca

SEQ ID NO: 7926777 - DNA, 22 bp, Homo sapiens
cctgagtcccataatgttgcca

SEQ ID NO: 7926778 - DNA, 22 bp, Homo sapiens
agggtgggctagactcttcccc

SEQ ID NO: 7926779 - DNA, 22 bp, Homo sapiens
cctgagtagctggaattaaagg

SEQ ID NO: 7926780 - DNA, 22 bp, Homo sapiens
cctgagtccaaaagtctttagc

SEQ ID NO: 7926781 - DNA, 22 bp, Homo sapiens
cctgagtccaaaagtctttagc

SEQ ID NO: 7926782 - DNA, 22 bp, Homo sapiens
cctgagtcaagatgtatggtaa

SEQ ID NO: 7926783 - DNA, 22 bp, Homo sapiens
cctgaggtttttggatagttgt

SEQ ID NO: 7926784 - DNA, 22 bp, Homo sapiens
cctgaggtttttggatagttgt

SEQ ID NO: 7926785 - DNA, 22 bp, Homo sapiens
cctgagtaacatggtgagaacc

SEQ ID NO: 7926786 - DNA, 22 bp, Homo sapiens
cctgagtagctggaattaaagg

SEQ ID NO: 7926787 - DNA, 22 bp, Homo sapiens
cctgagtagctggaattaaagg

SEQ ID NO: 7926788 - DNA, 22 bp, Homo sapiens
cctgaggtttttggatagttgt

SEQ ID NO: 7926789 - DNA, 22 bp, Homo sapiens
cctgaggtttttggatagttgt

SEQ ID NO: 7926790 - DNA, 22 bp, Homo sapiens
cctgaggttgaagtataaattg

SEQ ID NO: 7926791 - DNA, 21 bp, Homo sapiens
cctgaggtttctggcctctgt

SEQ ID NO: 7926792 - DNA, 22 bp, Homo sapiens
cctgaggtggctgcagcactgc

SEQ ID NO: 7926793 - DNA, 22 bp, Homo sapiens
cctgaggtggctgcagcactgc

SEQ ID NO: 7926794 - DNA, 18 bp, Homo sapiens
cctgaggtgggaggaagg

SEQ ID NO: 7926795 - DNA, 22 bp, Homo sapiens
cctgaggtggctgcagcactgc

SEQ ID NO: 7926796 - DNA, 18 bp, Homo sapiens
cctgaggtgggaggaagg

SEQ ID NO: 7926797 - DNA, 18 bp, Homo sapiens
cctgaggtgggaggaagg

SEQ ID NO: 7926798 - DNA, 19 bp, Homo sapiens
cctgaggtggggtggaagg

SEQ ID NO: 7926799 - DNA, 18 bp, Homo sapiens
cctgaggtgggaggaagg

SEQ ID NO: 7926800 - DNA, 22 bp, Homo sapiens
cctgaggttatccatctacctg

SEQ ID NO: 7926801 - DNA, 22 bp, Homo sapiens
cctgaggttatccatctacctg

SEQ ID NO: 7926802 - DNA, 22 bp, Homo sapiens
cctgaggttgaagtataaattg

SEQ ID NO: 7926803 - DNA, 22 bp, Homo sapiens
cctgaggttgaagtataaattg

SEQ ID NO: 7926804 - DNA, 19 bp, Homo sapiens
cctgaggtggggtggaagg

SEQ ID NO: 7926805 - DNA, 19 bp, Homo sapiens
cctgaggtggggtggaagg

SEQ ID NO: 7926806 - DNA, 22 bp, Homo sapiens
cctgaggttatccatctacctg

SEQ ID NO: 7926807 - DNA, 22 bp, Homo sapiens
agtcagcactcctgaggatcac

SEQ ID NO: 7926808 - DNA, 22 bp, Homo sapiens
agtcagcagcctggccaggaga

SEQ ID NO: 7926809 - DNA, 22 bp, Homo sapiens
agtcagcagcctggccaggaga

SEQ ID NO: 7926810 - DNA, 22 bp, Homo sapiens
agtcagcagtgaaagcacagcc

SEQ ID NO: 7926811 - DNA, 22 bp, Homo sapiens
agtcagcagtgaaagcacagcc

SEQ ID NO: 7926812 - DNA, 22 bp, Homo sapiens
agtcagcagtgaaagcacagcc

SEQ ID NO: 7926813 - DNA, 22 bp, Homo sapiens
agtcagcagtgaaagcacagcc

SEQ ID NO: 7926814 - DNA, 22 bp, Homo sapiens
agtcagcatctgcactgtgctg

SEQ ID NO: 7926815 - DNA, 22 bp, Homo sapiens
agtcagcatctgcactgtgctg

SEQ ID NO: 7926816 - DNA, 22 bp, Homo sapiens
agtcagcatatatggagtaagg

SEQ ID NO: 7926817 - DNA, 22 bp, Homo sapiens
agtcagcattttcactgagcta

SEQ ID NO: 7926818 - DNA, 22 bp, Homo sapiens
agtcagctggatactcttgtag

SEQ ID NO: 7926819 - DNA, 22 bp, Homo sapiens
agtcagctgctgcacacagcag

SEQ ID NO: 7926820 - DNA, 22 bp, Homo sapiens
agtcagctgcagcagctttggt

SEQ ID NO: 7926821 - DNA, 19 bp, Homo sapiens
agtcagctagttcctatac

SEQ ID NO: 7926822 - DNA, 22 bp, Homo sapiens
agtcagctacaagttcattcac

SEQ ID NO: 7926823 - DNA, 22 bp, Homo sapiens
agtcagctgcagcagctttggt

SEQ ID NO: 7926824 - DNA, 19 bp, Homo sapiens
agtcagctagttcctatac

SEQ ID NO: 7926825 - DNA, 22 bp, Homo sapiens
agtcagcttggctcctcccatg

SEQ ID NO: 7926826 - DNA, 22 bp, Homo sapiens
agtcagcttggctcctcccatg

SEQ ID NO: 7926827 - DNA, 22 bp, Homo sapiens
agtcagcttggctcctcccatg

SEQ ID NO: 7926828 - DNA, 22 bp, Homo sapiens
agtcaggaacctcagcaagtct

SEQ ID NO: 7926829 - DNA, 22 bp, Homo sapiens
agtcaggaacctcagcaagtct

SEQ ID NO: 7926830 - DNA, 22 bp, Homo sapiens
agtcaggaaaagctttcctgga

SEQ ID NO: 7926831 - DNA, 22 bp, Homo sapiens
agtcaggaagctggagctgggg

SEQ ID NO: 7926832 - DNA, 22 bp, Homo sapiens
agtcaggaagctggagctgggg

SEQ ID NO: 7926833 - DNA, 22 bp, Homo sapiens
agtcaggaagctggagctgggg

SEQ ID NO: 7926834 - DNA, 22 bp, Homo sapiens
agtcaggacacagcatgaacat

SEQ ID NO: 7926835 - DNA, 22 bp, Homo sapiens
agtcaggacagattttctgggg

SEQ ID NO: 7926836 - DNA, 22 bp, Homo sapiens
agtcaggacacagcatgaacat

SEQ ID NO: 7926837 - DNA, 22 bp, Homo sapiens
agtcaggagatattttgatatg

SEQ ID NO: 7926838 - DNA, 22 bp, Homo sapiens
agtcaggagctgctgcattgta

SEQ ID NO: 7926839 - DNA, 22 bp, Homo sapiens
agtcaggatatgccttgtgggc

SEQ ID NO: 7926840 - DNA, 22 bp, Homo sapiens
agtcaggagctgctgcattgta

SEQ ID NO: 7926841 - DNA, 22 bp, Homo sapiens
agtcaggagatattttgatatg

SEQ ID NO: 7926842 - DNA, 22 bp, Homo sapiens
ctagtgaaatttgcaagtaatt

SEQ ID NO: 7926843 - DNA, 22 bp, Homo sapiens
ctagtctgtgtgggaccagggc

SEQ ID NO: 7926844 - DNA, 22 bp, Homo sapiens
ctatatatatcatcttccagtt

SEQ ID NO: 7926845 - DNA, 22 bp, Homo sapiens
agtcaggatttaaactcagaca

SEQ ID NO: 7926846 - DNA, 22 bp, Homo sapiens
ctatattggtggccatttggaa

SEQ ID NO: 7926847 - DNA, 22 bp, Homo sapiens
ctatattggtaatatttgctca

SEQ ID NO: 7926848 - DNA, 22 bp, Homo sapiens
ctatattctggaatgtccattt

SEQ ID NO: 7926849 - DNA, 22 bp, Homo sapiens
ctatatcataaatctgaagagg

SEQ ID NO: 7926850 - DNA, 22 bp, Homo sapiens
ctatatctacatttgctgtttg

SEQ ID NO: 7926851 - DNA, 22 bp, Homo sapiens
ctatattctggaatgtccattt

SEQ ID NO: 7926852 - DNA, 22 bp, Homo sapiens
ctatatttcttggctttaaaca

SEQ ID NO: 7926853 - DNA, 22 bp, Homo sapiens
ctatcaaacagccattaatata

SEQ ID NO: 7926854 - DNA, 22 bp, Homo sapiens
ctatatttcttggctttaaaca

SEQ ID NO: 7926855 - DNA, 22 bp, Homo sapiens
ctatcattttacatggttggtg

SEQ ID NO: 7926856 - DNA, 22 bp, Homo sapiens
ctatccattaaagccttggaaa

SEQ ID NO: 7926857 - DNA, 22 bp, Homo sapiens
ctatcaagaggtagcagtgact

SEQ ID NO: 7926858 - DNA, 22 bp, Homo sapiens
ctatcacagagggttgttttga

SEQ ID NO: 7926859 - DNA, 22 bp, Homo sapiens
ctatcaaacagccattaatata

SEQ ID NO: 7926860 - DNA, 22 bp, Homo sapiens
ctattgtagtaagggaaagcca

SEQ ID NO: 7926861 - DNA, 22 bp, Homo sapiens
ctatttaagaataaaaggggca

SEQ ID NO: 7926862 - DNA, 22 bp, Homo sapiens
ctattgggtcagccttctggct

SEQ ID NO: 7926863 - DNA, 22 bp, Homo sapiens
ctattgggtcagccttctggct

SEQ ID NO: 7926864 - DNA, 22 bp, Homo sapiens
ctattgggtcagaaatgagaaa

SEQ ID NO: 7926865 - DNA, 22 bp, Homo sapiens
ctattgggtcagaaatgagaaa

SEQ ID NO: 7926866 - DNA, 22 bp, Homo sapiens
ctattgggtatttattgagcac

SEQ ID NO: 7926867 - DNA, 22 bp, Homo sapiens
ctattgggccaaagaagatgcc

SEQ ID NO: 7926868 - DNA, 17 bp, Homo sapiens
ctattgggccatttctt

SEQ ID NO: 7926869 - DNA, 22 bp, Homo sapiens
ctattgggccaaagaagatgcc

SEQ ID NO: 7926870 - DNA, 17 bp, Homo sapiens
ctattgggccatttctt

SEQ ID NO: 7926871 - DNA, 22 bp, Homo sapiens
ctattgggtatttattgagcac

SEQ ID NO: 7926872 - DNA, 22 bp, Homo sapiens
agtcctgggtctggagaatgga

SEQ ID NO: 7926873 - DNA, 22 bp, Homo sapiens
agtcctgggtctggagaatgga

SEQ ID NO: 7926874 - DNA, 22 bp, Homo sapiens
agtcctgggtctggagaatgga

SEQ ID NO: 7926875 - DNA, 22 bp, Homo sapiens
agtcctgggtccagcaggtcct

SEQ ID NO: 7926876 - DNA, 22 bp, Homo sapiens
ctatttatctatttctgaatga

SEQ ID NO: 7926877 - DNA, 22 bp, Homo sapiens
ctatttatctatttctgaatga

SEQ ID NO: 7926878 - DNA, 22 bp, Homo sapiens
ctattgaattaactattaaagt

SEQ ID NO: 7926879 - DNA, 22 bp, Homo sapiens
ctattgaattaactattaaagt

SEQ ID NO: 7926880 - DNA, 22 bp, Homo sapiens
ctattgaattaactattaaagt

SEQ ID NO: 7926881 - DNA, 22 bp, Homo sapiens
ctattgaattaactattaaagt

SEQ ID NO: 7926882 - DNA, 22 bp, Homo sapiens
ctattgaaagtgtacaattcaa

SEQ ID NO: 7926883 - DNA, 22 bp, Homo sapiens
ctattgaatagcccaaatcatt

SEQ ID NO: 7926884 - DNA, 19 bp, Homo sapiens
ctattgcacatagctgaag

SEQ ID NO: 7926885 - DNA, 22 bp, Homo sapiens
ctattgaattaactattaaagt

SEQ ID NO: 7926886 - DNA, 22 bp, Homo sapiens
ctattgcatcctccacctcgat

SEQ ID NO: 7926887 - DNA, 19 bp, Homo sapiens
ctattgcacatagctgaag

SEQ ID NO: 7926888 - DNA, 22 bp, Homo sapiens
ctattgcatttgcatcttcatc

SEQ ID NO: 7926889 - DNA, 21 bp, Homo sapiens
ctattggaaaagaaaatattt

SEQ ID NO: 7926890 - DNA, 22 bp, Homo sapiens
ctattgggatcctgacaaatct

SEQ ID NO: 7926891 - DNA, 22 bp, Homo sapiens
ctattgggatcctgacaaatct

SEQ ID NO: 7926892 - DNA, 22 bp, Homo sapiens
ctatctgtaaatttgaggttct

SEQ ID NO: 7926893 - DNA, 22 bp, Homo sapiens
ctatctcttgttttcctgaagc

SEQ ID NO: 7926894 - DNA, 22 bp, Homo sapiens
ctatctgtaaatttgaggttct

SEQ ID NO: 7926895 - DNA, 18 bp, Homo sapiens
ctatccctggagcttggg

SEQ ID NO: 7926896 - DNA, 22 bp, Homo sapiens
ctatcccatccttctagctgac

SEQ ID NO: 7926897 - DNA, 22 bp, Homo sapiens
ctatccattttcctatgacact

SEQ ID NO: 7926898 - DNA, 22 bp, Homo sapiens
ctatcccatccttctagctgac

SEQ ID NO: 7926899 - DNA, 20 bp, Homo sapiens
ctatctcctggcgtgccttc

SEQ ID NO: 7926900 - DNA, 22 bp, Homo sapiens
ctatctcatgcatcaactcttc

SEQ ID NO: 7926901 - DNA, 22 bp, Homo sapiens
ctatctctccacaatgccagtg

SEQ ID NO: 7926902 - DNA, 22 bp, Homo sapiens
ctattctgattaccagatattg

SEQ ID NO: 7926903 - DNA, 22 bp, Homo sapiens
ctattctagattacagtataaa

SEQ ID NO: 7926904 - DNA, 22 bp, Homo sapiens
ctattctagattacagtataaa

SEQ ID NO: 7926905 - DNA, 22 bp, Homo sapiens
ctattctagtctgtcatgtcca

SEQ ID NO: 7926906 - DNA, 22 bp, Homo sapiens
ctatgacacaggccattatata

SEQ ID NO: 7926907 - DNA, 22 bp, Homo sapiens
ctatgacacaggccattatata

SEQ ID NO: 7926908 - DNA, 22 bp, Homo sapiens
ctatgaccccagcatgaataag

SEQ ID NO: 7926909 - DNA, 23 bp, Homo sapiens
ctagaattttgctaaaagactag

SEQ ID NO: 7926910 - DNA, 22 bp, Homo sapiens
ctagaattgcattctatgaata

SEQ ID NO: 7926911 - DNA, 22 bp, Homo sapiens
agtcacatgggattagaaccca

SEQ ID NO: 7926912 - DNA, 22 bp, Homo sapiens
ctagagaaaatgatagcaggaa

SEQ ID NO: 7926913 - DNA, 23 bp, Homo sapiens
ctagacttggaggtcttgaggac

SEQ ID NO: 7926914 - DNA, 22 bp, Homo sapiens
ctagctccatataaagcaggat

SEQ ID NO: 7926915 - DNA, 22 bp, Homo sapiens
ctagcttagggaaactgacaga

SEQ ID NO: 7926916 - DNA, 22 bp, Homo sapiens
ctagctgtaagagggatgtggc

SEQ ID NO: 7926917 - DNA, 22 bp, Homo sapiens
ctagctttgtccattgtcttgc

SEQ ID NO: 7926918 - DNA, 22 bp, Homo sapiens
ctagctttttatgacaatcttg

SEQ ID NO: 7926919 - DNA, 22 bp, Homo sapiens
ctagctttttatgacaatcttg

SEQ ID NO: 7926920 - DNA, 22 bp, Homo sapiens
ctaggcaagagtttattatggt

SEQ ID NO: 7926921 - DNA, 22 bp, Homo sapiens
ctaggcaagagtttattatggt

SEQ ID NO: 7926922 - DNA, 22 bp, Homo sapiens
ctaggaggcgggggctgcagta

SEQ ID NO: 7926923 - DNA, 22 bp, Homo sapiens
ctaggcacactgggccctttac

SEQ ID NO: 7926924 - DNA, 18 bp, Homo sapiens
ctaggcaccaggcacccc

SEQ ID NO: 7926925 - DNA, 22 bp, Homo sapiens
ctaggcacctgggccctgtggc

SEQ ID NO: 7926926 - DNA, 22 bp, Homo sapiens
ctaggcagactgagctctaggg

SEQ ID NO: 7926927 - DNA, 22 bp, Homo sapiens
ctaggcagactgagctctaggg

SEQ ID NO: 7926928 - DNA, 22 bp, Homo sapiens
ctaggcagactgagctctaggg

SEQ ID NO: 7926929 - DNA, 22 bp, Homo sapiens
ctaggcactcacgtggctttag

SEQ ID NO: 7926930 - DNA, 22 bp, Homo sapiens
ctaggcacttgtaaggccgctc

SEQ ID NO: 7926931 - DNA, 22 bp, Homo sapiens
ctaggaccactgtaacaaagta

SEQ ID NO: 7926932 - DNA, 22 bp, Homo sapiens
ctaggaccactgtaacaaagta

SEQ ID NO: 7926933 - DNA, 22 bp, Homo sapiens
ctaggaggcgggggctgcagta

SEQ ID NO: 7926934 - DNA, 22 bp, Homo sapiens
ctaggaggcgggggctgcagta

SEQ ID NO: 7926935 - DNA, 20 bp, Homo sapiens
ctaggaactatggtctggct

SEQ ID NO: 7926936 - DNA, 22 bp, Homo sapiens
ctaggaaatgaatacagtacac

SEQ ID NO: 7926937 - DNA, 22 bp, Homo sapiens
ctaggaaatgaatacagtacac

SEQ ID NO: 7926938 - DNA, 22 bp, Homo sapiens
ctaggaaagacacagagagttt

SEQ ID NO: 7926939 - DNA, 22 bp, Homo sapiens
ctaggaaagacacagagagttt

SEQ ID NO: 7926940 - DNA, 22 bp, Homo sapiens
ctaggaaagacacagagagttt

SEQ ID NO: 7926941 - DNA, 22 bp, Homo sapiens
ctaggaaagtgattcttcaatt

SEQ ID NO: 7926942 - DNA, 22 bp, Homo sapiens
ctaggaaatactgtttcaaggc

SEQ ID NO: 7926943 - DNA, 22 bp, Homo sapiens
agtcacagttcctacccagtaa

SEQ ID NO: 7926944 - DNA, 22 bp, Homo sapiens
agtcacagttcctacccagtaa

SEQ ID NO: 7926945 - DNA, 22 bp, Homo sapiens
agtcacagttcctacccagtaa

SEQ ID NO: 7926946 - DNA, 22 bp, Homo sapiens
agtcacagttcctacccagtaa

SEQ ID NO: 7926947 - DNA, 22 bp, Homo sapiens
agtcacagttagactacccaag

SEQ ID NO: 7926948 - DNA, 22 bp, Homo sapiens
agtcacagttagactacccaag

SEQ ID NO: 7926949 - DNA, 22 bp, Homo sapiens
agtcacaggttcttgggattag

SEQ ID NO: 7926950 - DNA, 20 bp, Homo sapiens
agtcacagtatcagtcttag

SEQ ID NO: 7926951 - DNA, 20 bp, Homo sapiens
agtcacagtatcagtcttag

SEQ ID NO: 7926952 - DNA, 22 bp, Homo sapiens
agtcacagtttccctgagagag

SEQ ID NO: 7926953 - DNA, 22 bp, Homo sapiens
agtcacagtttccctgagagag

SEQ ID NO: 7926954 - DNA, 22 bp, Homo sapiens
agtcacagttctgctgtctgag

SEQ ID NO: 7926955 - DNA, 22 bp, Homo sapiens
agtcacagttctgctgtctgag

SEQ ID NO: 7926956 - DNA, 22 bp, Homo sapiens
agtcacagttctgctgtctgag

SEQ ID NO: 7926957 - DNA, 22 bp, Homo sapiens
agtcacagttctgctgtctgag

SEQ ID NO: 7926958 - DNA, 22 bp, Homo sapiens
agtcacagtttccctgagagag

SEQ ID NO: 7926959 - DNA, 20 bp, Homo sapiens
agtcacatgcatacacaagt

SEQ ID NO: 7926960 - DNA, 20 bp, Homo sapiens
agtcacatgcatacacaagt

SEQ ID NO: 7926961 - DNA, 22 bp, Homo sapiens
agtcacatcgattataaaattt

SEQ ID NO: 7926962 - DNA, 22 bp, Homo sapiens
agtcacagaaacccaggtgtgg

SEQ ID NO: 7926963 - DNA, 22 bp, Homo sapiens
agtcacagaatgatggctccag

SEQ ID NO: 7926964 - DNA, 22 bp, Homo sapiens
agtcacagaatgatggctccag

SEQ ID NO: 7926965 - DNA, 22 bp, Homo sapiens
agtcacagaatgatggctccag

SEQ ID NO: 7926966 - DNA, 22 bp, Homo sapiens
agtcacagaaacccaggtgtgg

SEQ ID NO: 7926967 - DNA, 22 bp, Homo sapiens
agtcacagaaacccaggtgtgg

SEQ ID NO: 7926968 - DNA, 22 bp, Homo sapiens
agtcacagaaacccaggtgtgg

SEQ ID NO: 7926969 - DNA, 22 bp, Homo sapiens
agtcacacactgtcagttctgc

SEQ ID NO: 7926970 - DNA, 22 bp, Homo sapiens
agtcacaataccgtgtgtcagt

SEQ ID NO: 7926971 - DNA, 22 bp, Homo sapiens
agtcacagaaacccaggtgtgg

SEQ ID NO: 7926972 - DNA, 22 bp, Homo sapiens
agtcacacttcgtatctctagc

SEQ ID NO: 7926973 - DNA, 22 bp, Homo sapiens
agtcaattcttttcaactcaag

SEQ ID NO: 7926974 - DNA, 22 bp, Homo sapiens
agtcaattatctctaggtcatc

SEQ ID NO: 7926975 - DNA, 19 bp, Homo sapiens
agtcacagaccttgtctcc

SEQ ID NO: 7926976 - DNA, 19 bp, Homo sapiens
agtcacagaccttgtctcc

SEQ ID NO: 7926977 - DNA, 19 bp, Homo sapiens
agtcacagaccttgtctcc

SEQ ID NO: 7926978 - DNA, 22 bp, Homo sapiens
agtcacaggcaagagggctcca

SEQ ID NO: 7926979 - DNA, 22 bp, Homo sapiens
agtcacaggcaagagggctcca

SEQ ID NO: 7926980 - DNA, 20 bp, Homo sapiens
agtcacaggcctggaacatg

SEQ ID NO: 7926981 - DNA, 20 bp, Homo sapiens
agtcacaggcctggaacatg

SEQ ID NO: 7926982 - DNA, 22 bp, Homo sapiens
agtcacaggcaagagggctcca

SEQ ID NO: 7926983 - DNA, 22 bp, Homo sapiens
agtcacaggcaagagggctcca

SEQ ID NO: 7926984 - DNA, 20 bp, Homo sapiens
agtcacaggcctggaacatg

SEQ ID NO: 7926985 - DNA, 22 bp, Homo sapiens
agtcacaggcaagagggctcca

SEQ ID NO: 7926986 - DNA, 22 bp, Homo sapiens
agtcacagggggcccctgcaac

SEQ ID NO: 7926987 - DNA, 22 bp, Homo sapiens
agtcacagggggcccctgcaac

SEQ ID NO: 7926988 - DNA, 19 bp, Homo sapiens
agtcacagggaagaggaac

SEQ ID NO: 7926989 - DNA, 19 bp, Homo sapiens
agtcacagggaagaggaac

SEQ ID NO: 7926990 - DNA, 19 bp, Homo sapiens
agtcacagggaagaggaac

SEQ ID NO: 7926991 - DNA, 22 bp, Homo sapiens
agtcacagggggcccctgcaac

SEQ ID NO: 7926992 - DNA, 22 bp, Homo sapiens
agtcacagggggcccctgcaac

SEQ ID NO: 7926993 - DNA, 22 bp, Homo sapiens
agtcacagggggcccctgcaac

SEQ ID NO: 7926994 - DNA, 22 bp, Homo sapiens
agtcacagggtacacaaggatt

SEQ ID NO: 7926995 - DNA, 22 bp, Homo sapiens
agtcacagggtacacaaggatt

SEQ ID NO: 7926996 - DNA, 18 bp, Homo sapiens
agtaaagcttattacatg

SEQ ID NO: 7926997 - DNA, 18 bp, Homo sapiens
agtaaagcttattacatg

SEQ ID NO: 7926998 - DNA, 22 bp, Homo sapiens
agtaaagcttagtagtaggaaa

SEQ ID NO: 7926999 - DNA, 22 bp, Homo sapiens
agtaaagcggtgtcacagaatg

SEQ ID NO: 7927000 - DNA, 22 bp, Homo sapiens
agtaaagcggtgtcacagaatg

SEQ ID NO: 7927001 - DNA, 22 bp, Homo sapiens
agtaaagcggtgtcacagaatg

SEQ ID NO: 7927002 - DNA, 22 bp, Homo sapiens
agtaaataacagagaaaatggg

SEQ ID NO: 7927003 - DNA, 22 bp, Homo sapiens
agtaaataacagagaaaatggg

SEQ ID NO: 7927004 - DNA, 22 bp, Homo sapiens
agtaaataacagagaaaatggg

SEQ ID NO: 7927005 - DNA, 22 bp, Homo sapiens
agtaaataacagagaaaatggg

SEQ ID NO: 7927006 - DNA, 22 bp, Homo sapiens
agtaaataacagagaaaatggg

SEQ ID NO: 7927007 - DNA, 22 bp, Homo sapiens
agtaaataacagagaaaatggg

SEQ ID NO: 7927008 - DNA, 22 bp, Homo sapiens
agtaaataacagagaaaatggg

SEQ ID NO: 7927009 - DNA, 22 bp, Homo sapiens
agtaaataacagagaaaatggg

SEQ ID NO: 7927010 - DNA, 22 bp, Homo sapiens
agtaaatggtggtttttatcat

SEQ ID NO: 7927011 - DNA, 18 bp, Homo sapiens
agtaaatggtttattttc

SEQ ID NO: 7927012 - DNA, 18 bp, Homo sapiens
agtaaatggtttattttc

SEQ ID NO: 7927013 - DNA, 22 bp, Homo sapiens
agtaaatgattattttgccaac

SEQ ID NO: 7927014 - DNA, 22 bp, Homo sapiens
agtaaatgaaagcaattttaga

SEQ ID NO: 7927015 - DNA, 22 bp, Homo sapiens
agtaaatgaaagcaattttaga

SEQ ID NO: 7927016 - DNA, 22 bp, Homo sapiens
agtaaattatttagcttccaga

SEQ ID NO: 7927017 - DNA, 18 bp, Homo sapiens
agtaaatgttaaatattg

SEQ ID NO: 7927018 - DNA, 18 bp, Homo sapiens
agtaaatgttaaatattg

SEQ ID NO: 7927019 - DNA, 22 bp, Homo sapiens
agtaacaaagaaagcctttgga

SEQ ID NO: 7927020 - DNA, 22 bp, Homo sapiens
agtaacaaagaaagcctttgga

SEQ ID NO: 7927021 - DNA, 22 bp, Homo sapiens
agtaaagcagagttgcagtaca

SEQ ID NO: 7927022 - DNA, 22 bp, Homo sapiens
agtaaagcagagttgcagtaca

SEQ ID NO: 7927023 - DNA, 22 bp, Homo sapiens
agtaaagcagagttgcagtaca

SEQ ID NO: 7927024 - DNA, 22 bp, Homo sapiens
agtaaagcagagttgcagtaca

SEQ ID NO: 7927025 - DNA, 22 bp, Homo sapiens
agtaaagcattgtcttcagagt

SEQ ID NO: 7927026 - DNA, 22 bp, Homo sapiens
agtaaagcctactcaaccacac

SEQ ID NO: 7927027 - DNA, 22 bp, Homo sapiens
agtaaagcggtgtcacagaatg

SEQ ID NO: 7927028 - DNA, 22 bp, Homo sapiens
agtaaacattttcatattttct

SEQ ID NO: 7927029 - DNA, 22 bp, Homo sapiens
agtaaactgtgggtacagatgt

SEQ ID NO: 7927030 - DNA, 22 bp, Homo sapiens
agtaaactgtgggtacagatgt

SEQ ID NO: 7927031 - DNA, 22 bp, Homo sapiens
agtaaactgtgtgcctttgact

SEQ ID NO: 7927032 - DNA, 21 bp, Homo sapiens
agtaaactgtctgcttgagca

SEQ ID NO: 7927033 - DNA, 22 bp, Homo sapiens
agtaaacataatttacctgtag

SEQ ID NO: 7927034 - DNA, 22 bp, Homo sapiens
agtaaacatagaatgttcttcc

SEQ ID NO: 7927035 - DNA, 22 bp, Homo sapiens
agtaaacatagaatgttcttcc

SEQ ID NO: 7927036 - DNA, 22 bp, Homo sapiens
agtaaacatagaatgttcttcc

SEQ ID NO: 7927037 - DNA, 22 bp, Homo sapiens
agtaaacatagaatgttcttcc

SEQ ID NO: 7927038 - DNA, 22 bp, Homo sapiens
agtaaacagtttcttagaagaa

SEQ ID NO: 7927039 - DNA, 22 bp, Homo sapiens
agtaaacatttcagatttattt

SEQ ID NO: 7927040 - DNA, 22 bp, Homo sapiens
agtaaacatttcagatttattt

SEQ ID NO: 7927041 - DNA, 22 bp, Homo sapiens
agtaaacatgtaattgttcatt

SEQ ID NO: 7927042 - DNA, 22 bp, Homo sapiens
agtaaacagtttcttagaagaa

SEQ ID NO: 7927043 - DNA, 22 bp, Homo sapiens
agtaaacatgtaattgttcatt

SEQ ID NO: 7927044 - DNA, 22 bp, Homo sapiens
agtaaacatgtaattgttcatt

SEQ ID NO: 7927045 - DNA, 22 bp, Homo sapiens
ccttctctctgaagaccccaaa

SEQ ID NO: 7927046 - DNA, 22 bp, Homo sapiens
ccttctctctgaagaccccaaa

SEQ ID NO: 7927047 - DNA, 22 bp, Homo sapiens
agtaaaaattgaggtgcaaaat

SEQ ID NO: 7927048 - DNA, 22 bp, Homo sapiens
agtaaaaattgaggtgcaaaat

SEQ ID NO: 7927049 - DNA, 22 bp, Homo sapiens
agtaaaaatatgcttgtggcta

SEQ ID NO: 7927050 - DNA, 22 bp, Homo sapiens
agtaaaaatatgcttgtggcta

SEQ ID NO: 7927051 - DNA, 22 bp, Homo sapiens
agtaaaaattgaggtgcaaaat

SEQ ID NO: 7927052 - DNA, 22 bp, Homo sapiens
agtaaacagtttcttagaagaa

SEQ ID NO: 7927053 - DNA, 22 bp, Homo sapiens
agtaaacagtttcttagaagaa

SEQ ID NO: 7927054 - DNA, 22 bp, Homo sapiens
agtaaacagtttcttagaagaa

SEQ ID NO: 7927055 - DNA, 22 bp, Homo sapiens
agtaaacagtatctttagtgtc

SEQ ID NO: 7927056 - DNA, 22 bp, Homo sapiens
ccttctccctctgagaggaacc

SEQ ID NO: 7927057 - DNA, 22 bp, Homo sapiens
ccttctccctctgagaggaacc

SEQ ID NO: 7927058 - DNA, 22 bp, Homo sapiens
ccttctccctctgagaggaacc

SEQ ID NO: 7927059 - DNA, 22 bp, Homo sapiens
ccttctccctctgagaggaacc

SEQ ID NO: 7927060 - DNA, 22 bp, Homo sapiens
ccttctcctgccttgggttcat

SEQ ID NO: 7927061 - DNA, 22 bp, Homo sapiens
ccttctcctgccttgggttcat

SEQ ID NO: 7927062 - DNA, 22 bp, Homo sapiens
ccttctcctgccttgggttcat

SEQ ID NO: 7927063 - DNA, 21 bp, Homo sapiens
ccttctccattacagtaagct

SEQ ID NO: 7927064 - DNA, 22 bp, Homo sapiens
ccttctcctgccttgggttcat

SEQ ID NO: 7927065 - DNA, 22 bp, Homo sapiens
ccttctctaccatgtgaggaaa

SEQ ID NO: 7927066 - DNA, 22 bp, Homo sapiens
ccttctcctgccttgggttcat

SEQ ID NO: 7927067 - DNA, 22 bp, Homo sapiens
ccttctctactcctgatgcatg

SEQ ID NO: 7927068 - DNA, 22 bp, Homo sapiens
ccttctctactcctgatgcatg

SEQ ID NO: 7927069 - DNA, 21 bp, Homo sapiens
ccttctccattacagtaagct

SEQ ID NO: 7927070 - DNA, 21 bp, Homo sapiens
ccttctccattacagtaagct

SEQ ID NO: 7927071 - DNA, 20 bp, Homo sapiens
ccttctccagcttgttcttg

SEQ ID NO: 7927072 - DNA, 20 bp, Homo sapiens
ccttctccagcttgttcttg

SEQ ID NO: 7927073 - DNA, 20 bp, Homo sapiens
ccttctccagcttgttcttg

SEQ ID NO: 7927074 - DNA, 22 bp, Homo sapiens
ccttctcccctctgcagggtgt

SEQ ID NO: 7927075 - DNA, 22 bp, Homo sapiens
ccttctcccctctgcagggtgt

SEQ ID NO: 7927076 - DNA, 22 bp, Homo sapiens
ccttctccctctgagaggaacc

SEQ ID NO: 7927077 - DNA, 21 bp, Homo sapiens
ccttctccattacagtaagct

SEQ ID NO: 7927078 - DNA, 22 bp, Homo sapiens
ccttctcccctctgcagggtgt

SEQ ID NO: 7927079 - DNA, 22 bp, Homo sapiens
ccttctcccctctgcagggtgt

SEQ ID NO: 7927080 - DNA, 22 bp, Homo sapiens
ccttctcccctctgcagggtgt

SEQ ID NO: 7927081 - DNA, 21 bp, Homo sapiens
ccttctccattacagtaagct

SEQ ID NO: 7927082 - DNA, 22 bp, Homo sapiens
ccttccaggtgcaggcaagcct

SEQ ID NO: 7927083 - DNA, 22 bp, Homo sapiens
ccttccaggtgcaggcaagcct

SEQ ID NO: 7927084 - DNA, 22 bp, Homo sapiens
ccttccaggtgcaggcaagcct

SEQ ID NO: 7927085 - DNA, 22 bp, Homo sapiens
ccttccagggtttttgccaatc

SEQ ID NO: 7927086 - DNA, 22 bp, Homo sapiens
ccttccagggtttttgccaatc

SEQ ID NO: 7927087 - DNA, 22 bp, Homo sapiens
ccttccagggctctccagaacc

SEQ ID NO: 7927088 - DNA, 22 bp, Homo sapiens
ccttccagggctctccagaacc

SEQ ID NO: 7927089 - DNA, 22 bp, Homo sapiens
ccttccagggctctccagaacc

SEQ ID NO: 7927090 - DNA, 22 bp, Homo sapiens
ccttccagggctctccagaacc

SEQ ID NO: 7927091 - DNA, 22 bp, Homo sapiens
ccttccaggttttggctccatt

SEQ ID NO: 7927092 - DNA, 22 bp, Homo sapiens
ccttccaggttttggctccatt

SEQ ID NO: 7927093 - DNA, 22 bp, Homo sapiens
ccttccaggttttggctccatt

SEQ ID NO: 7927094 - DNA, 22 bp, Homo sapiens
ccttccaggttttggctccatt

SEQ ID NO: 7927095 - DNA, 22 bp, Homo sapiens
ccttccaggttttggctccatt

SEQ ID NO: 7927096 - DNA, 22 bp, Homo sapiens
ccttccaggttttggctccatt

SEQ ID NO: 7927097 - DNA, 22 bp, Homo sapiens
ccttccagtatgttaagatggt

SEQ ID NO: 7927098 - DNA, 22 bp, Homo sapiens
ccttccaggttttggctccatt

SEQ ID NO: 7927099 - DNA, 16 bp, Homo sapiens
ccttccagtccagcag

SEQ ID NO: 7927100 - DNA, 22 bp, Homo sapiens
ccttccagtatgttaagatggt

SEQ ID NO: 7927101 - DNA, 22 bp, Homo sapiens
ccttccagtatgttaagatggt

SEQ ID NO: 7927102 - DNA, 22 bp, Homo sapiens
ccttccagtatgttaagatggt

SEQ ID NO: 7927103 - DNA, 22 bp, Homo sapiens
ccttccagtgactaaggaggaa

SEQ ID NO: 7927104 - DNA, 16 bp, Homo sapiens
ccttccagtccagcag

SEQ ID NO: 7927105 - DNA, 16 bp, Homo sapiens
ccttccagtccagcag

SEQ ID NO: 7927106 - DNA, 22 bp, Homo sapiens
ccttccagtgactaaggaggaa

SEQ ID NO: 7927107 - DNA, 22 bp, Homo sapiens
ccttccagtgactaaggaggaa

SEQ ID NO: 7927108 - DNA, 22 bp, Homo sapiens
agtaggactaggggttgaggca

SEQ ID NO: 7927109 - DNA, 22 bp, Homo sapiens
agtaggaggcgggagcatgaag

SEQ ID NO: 7927110 - DNA, 22 bp, Homo sapiens
agtagccatttcatgagtttgt

SEQ ID NO: 7927111 - DNA, 22 bp, Homo sapiens
agtagccaattaagtggcaagc

SEQ ID NO: 7927112 - DNA, 22 bp, Homo sapiens
agtagccattcttttatttctt

SEQ ID NO: 7927113 - DNA, 22 bp, Homo sapiens
agtagcatgtgcacagtaattt

SEQ ID NO: 7927114 - DNA, 22 bp, Homo sapiens
agtagccaccaaccatgtgtgg

SEQ ID NO: 7927115 - DNA, 22 bp, Homo sapiens
agtagccaattaagtggcaagc

SEQ ID NO: 7927116 - DNA, 22 bp, Homo sapiens
agtagccaaagatagagccgtt

SEQ ID NO: 7927117 - DNA, 22 bp, Homo sapiens
agtagccaacatttatgatcca

SEQ ID NO: 7927118 - DNA, 22 bp, Homo sapiens
agtagccaacttttcttagact

SEQ ID NO: 7927119 - DNA, 20 bp, Homo sapiens
agtaggcaaaggaaagatct

SEQ ID NO: 7927120 - DNA, 22 bp, Homo sapiens
agtaggcagaagtggcattcgg

SEQ ID NO: 7927121 - DNA, 18 bp, Homo sapiens
agtaggcactgtggggtt

SEQ ID NO: 7927122 - DNA, 18 bp, Homo sapiens
agtaggcactgtggggtt

SEQ ID NO: 7927123 - DNA, 22 bp, Homo sapiens
agtaggaggcgggagcatgaag

SEQ ID NO: 7927124 - DNA, 22 bp, Homo sapiens
agtaggaggcgggagcatgaag

SEQ ID NO: 7927125 - DNA, 22 bp, Homo sapiens
agtagcagtgacagctgaggta

SEQ ID NO: 7927126 - DNA, 20 bp, Homo sapiens
agtagcagtgtgacattgac

SEQ ID NO: 7927127 - DNA, 22 bp, Homo sapiens
agtagcagtttggctgaattta

SEQ ID NO: 7927128 - DNA, 20 bp, Homo sapiens
agtagcagtgtgacattgac

SEQ ID NO: 7927129 - DNA, 20 bp, Homo sapiens
agtagcagtgtgacattgac

SEQ ID NO: 7927130 - DNA, 20 bp, Homo sapiens
agtagcagtaatatggaaga

SEQ ID NO: 7927131 - DNA, 22 bp, Homo sapiens
agtagcagtgacagctgaggta

SEQ ID NO: 7927132 - DNA, 22 bp, Homo sapiens
agtagcagtgacagctgaggta

SEQ ID NO: 7927133 - DNA, 22 bp, Homo sapiens
agtagcagtgacagctgaggta

SEQ ID NO: 7927134 - DNA, 22 bp, Homo sapiens
agtagcagaaggtcttgaaggg

SEQ ID NO: 7927135 - DNA, 22 bp, Homo sapiens
agtagcagaaggtcttgaaggg

SEQ ID NO: 7927136 - DNA, 20 bp, Homo sapiens
agtagcagtaatatggaaga

SEQ ID NO: 7927137 - DNA, 20 bp, Homo sapiens
agtagcagtaatatggaaga

SEQ ID NO: 7927138 - DNA, 22 bp, Homo sapiens
agtagcagagttggactatgca

SEQ ID NO: 7927139 - DNA, 22 bp, Homo sapiens
agtagcagagttggactatgca

SEQ ID NO: 7927140 - DNA, 22 bp, Homo sapiens
agtagcagagttggactatgca

SEQ ID NO: 7927141 - DNA, 22 bp, Homo sapiens
agtaggcattgtgaaactgcat

SEQ ID NO: 7927142 - DNA, 22 bp, Homo sapiens
agtaggcatttaataaacatga

SEQ ID NO: 7927143 - DNA, 22 bp, Homo sapiens
agtaggcagaagtggcattcgg

SEQ ID NO: 7927144 - DNA, 22 bp, Homo sapiens
agtaggcatagaaagaagcacc

SEQ ID NO: 7927145 - DNA, 22 bp, Homo sapiens
agtaggcatagaaagaagcacc

SEQ ID NO: 7927146 - DNA, 22 bp, Homo sapiens
agtaggcattgtgaaactgcat

SEQ ID NO: 7927147 - DNA, 22 bp, Homo sapiens
agtagggaatacattggggtaa

SEQ ID NO: 7927148 - DNA, 20 bp, Homo sapiens
agtaggggaatgcaagagca

SEQ ID NO: 7927149 - DNA, 22 bp, Homo sapiens
agtagggagaccggaggccgcc

SEQ ID NO: 7927150 - DNA, 20 bp, Homo sapiens
agtaggggaatgcaagagca

SEQ ID NO: 7927151 - DNA, 20 bp, Homo sapiens
agtaggggaatgcaagagca

SEQ ID NO: 7927152 - DNA, 20 bp, Homo sapiens
agtaggggaatgcaagagca

SEQ ID NO: 7927153 - DNA, 20 bp, Homo sapiens
agtaggggaatgcaagagca

SEQ ID NO: 7927154 - DNA, 22 bp, Homo sapiens
agtcaagattctggcactagca

SEQ ID NO: 7927155 - DNA, 23 bp, Homo sapiens
agtcaagatgcatctgtgaggaa

SEQ ID NO: 7927156 - DNA, 22 bp, Homo sapiens
agtcaagagacttaaaatattt

SEQ ID NO: 7927157 - DNA, 22 bp, Homo sapiens
agtcaatattcaagtgtaaata

SEQ ID NO: 7927158 - DNA, 22 bp, Homo sapiens
agtcaatattcaagtgtaaata

SEQ ID NO: 7927159 - DNA, 22 bp, Homo sapiens
agtcaagagacttaaaatattt

SEQ ID NO: 7927160 - DNA, 22 bp, Homo sapiens
agtatttcttcatatgattact

SEQ ID NO: 7927161 - DNA, 22 bp, Homo sapiens
agtatttcttcatatgattact

SEQ ID NO: 7927162 - DNA, 22 bp, Homo sapiens
agtatttctgaatattatcata

SEQ ID NO: 7927163 - DNA, 22 bp, Homo sapiens
agtagaaatgtaagaaggatta

SEQ ID NO: 7927164 - DNA, 22 bp, Homo sapiens
agtagaaatgtagtgtagagaa

SEQ ID NO: 7927165 - DNA, 22 bp, Homo sapiens
agtagaaatgtagtgtagagaa

SEQ ID NO: 7927166 - DNA, 22 bp, Homo sapiens
agtagaaatgtaagaaggatta

SEQ ID NO: 7927167 - DNA, 22 bp, Homo sapiens
agtagaaatgtaagaaggatta

SEQ ID NO: 7927168 - DNA, 22 bp, Homo sapiens
agtagaaatgtaagaaggatta

SEQ ID NO: 7927169 - DNA, 22 bp, Homo sapiens
agtagaaagttgcaggaggaat

SEQ ID NO: 7927170 - DNA, 22 bp, Homo sapiens
agtaacagagcatgggttcaga

SEQ ID NO: 7927171 - DNA, 22 bp, Homo sapiens
agtaacagaaggcctgacttaa

SEQ ID NO: 7927172 - DNA, 22 bp, Homo sapiens
agtaacagcatctccactggaa

SEQ ID NO: 7927173 - DNA, 22 bp, Homo sapiens
agtacagtggtcataatataaa

SEQ ID NO: 7927174 - DNA, 22 bp, Homo sapiens
agtacagtggtcataatataaa

SEQ ID NO: 7927175 - DNA, 22 bp, Homo sapiens
agtacatacttcaaatgtactt

SEQ ID NO: 7927176 - DNA, 22 bp, Homo sapiens
agtacatacttcaaatgtactt

SEQ ID NO: 7927177 - DNA, 22 bp, Homo sapiens
agtacatacttcaaatgtactt

SEQ ID NO: 7927178 - DNA, 22 bp, Homo sapiens
agtaacagagcatgggttcaga

SEQ ID NO: 7927179 - DNA, 22 bp, Homo sapiens
agtaacaaagtgggagaatgat

SEQ ID NO: 7927180 - DNA, 22 bp, Homo sapiens
agtaacaaatagctgcctttaa

SEQ ID NO: 7927181 - DNA, 22 bp, Homo sapiens
agtaacaaatagctgcctttaa

SEQ ID NO: 7927182 - DNA, 22 bp, Homo sapiens
agtaacaaatagctgcctttaa

SEQ ID NO: 7927183 - DNA, 22 bp, Homo sapiens
agtaacaaatattcattggatt

SEQ ID NO: 7927184 - DNA, 22 bp, Homo sapiens
agtaacaagtgccaacgttaga

SEQ ID NO: 7927185 - DNA, 22 bp, Homo sapiens
agtaacagaaggcctgacttaa

SEQ ID NO: 7927186 - DNA, 22 bp, Homo sapiens
agtaacagaaggcctgacttaa

SEQ ID NO: 7927187 - DNA, 22 bp, Homo sapiens
agtaacacaagaggtccttgcg

SEQ ID NO: 7927188 - DNA, 22 bp, Homo sapiens
agtagatttttgaatgtaagtt

SEQ ID NO: 7927189 - DNA, 22 bp, Homo sapiens
agtagcaatgtttgagaagcac

SEQ ID NO: 7927190 - DNA, 19 bp, Homo sapiens
agtagcagaaagtgcagtg

SEQ ID NO: 7927191 - DNA, 19 bp, Homo sapiens
agtagcagaaagtgcagtg

SEQ ID NO: 7927192 - DNA, 19 bp, Homo sapiens
agtagcagaaagtgcagtg

SEQ ID NO: 7927193 - DNA, 19 bp, Homo sapiens
agtagcagaaagtgcagtg

SEQ ID NO: 7927194 - DNA, 22 bp, Homo sapiens
agtagattttagattacatagt

SEQ ID NO: 7927195 - DNA, 22 bp, Homo sapiens
agtagatttttgaatgtaagtt

SEQ ID NO: 7927196 - DNA, 22 bp, Homo sapiens
agtagattctcattgatctggt

SEQ ID NO: 7927197 - DNA, 22 bp, Homo sapiens
agtagatttctgctgaagcttt

SEQ ID NO: 7927198 - DNA, 22 bp, Homo sapiens
agtagatagattctaagcacta

SEQ ID NO: 7927199 - DNA, 22 bp, Homo sapiens
agtagaggagataggattgtta

SEQ ID NO: 7927200 - DNA, 22 bp, Homo sapiens
agtagaggccaggcctccctgg

SEQ ID NO: 7927201 - DNA, 22 bp, Homo sapiens
agtagaggccaggcctccctgg

SEQ ID NO: 7927202 - DNA, 22 bp, Homo sapiens
agtagaatgttctatgtcaatg

SEQ ID NO: 7927203 - DNA, 20 bp, Homo sapiens
agtagacaactgcaggtgtg

SEQ ID NO: 7927204 - DNA, 20 bp, Homo sapiens
agtagacaactgcaggtgtg

SEQ ID NO: 7927205 - DNA, 22 bp, Homo sapiens
agtagacaataattcaactccc

SEQ ID NO: 7927206 - DNA, 22 bp, Homo sapiens
agtagacaataattcaactccc

SEQ ID NO: 7927207 - DNA, 22 bp, Homo sapiens
agtagaataattggattacagt

SEQ ID NO: 7927208 - DNA, 22 bp, Homo sapiens
agtagaataattggattacagt

SEQ ID NO: 7927209 - DNA, 22 bp, Homo sapiens
agtagacatgagcaatgataat

SEQ ID NO: 7927210 - DNA, 22 bp, Homo sapiens
agtagacatgagcaatgataat

SEQ ID NO: 7927211 - DNA, 22 bp, Homo sapiens
agtagacagccttgctcctgag

SEQ ID NO: 7927212 - DNA, 22 bp, Homo sapiens
agtagacagccttgctcctgag

SEQ ID NO: 7927213 - DNA, 22 bp, Homo sapiens
agtagacaatatggatttaatg

SEQ ID NO: 7927214 - DNA, 22 bp, Homo sapiens
agtagacagacccatggcttta

SEQ ID NO: 7927215 - DNA, 19 bp, Homo sapiens
agtagacattttcatgttt

SEQ ID NO: 7927216 - DNA, 22 bp, Homo sapiens
agtagacattttgcaacatctg

SEQ ID NO: 7927217 - DNA, 22 bp, Homo sapiens
agtagacatgagcaatgataat

SEQ ID NO: 7927218 - DNA, 22 bp, Homo sapiens
agtagacatgagcaatgataat

SEQ ID NO: 7927219 - DNA, 22 bp, Homo sapiens
agtagacatgagcaatgataat

SEQ ID NO: 7927220 - DNA, 22 bp, Homo sapiens
actgcctcttggtgctgagaga

SEQ ID NO: 7927221 - DNA, 22 bp, Homo sapiens
actgcctcttggtgctgagaga

SEQ ID NO: 7927222 - DNA, 19 bp, Homo sapiens
actgcctgaggctcacagg

SEQ ID NO: 7927223 - DNA, 22 bp, Homo sapiens
actgcctcttggtgctgagaga

SEQ ID NO: 7927224 - DNA, 22 bp, Homo sapiens
actgccgtgcatcagaagctga

SEQ ID NO: 7927225 - DNA, 22 bp, Homo sapiens
actgccctggcaccacacatgc

SEQ ID NO: 7927226 - DNA, 22 bp, Homo sapiens
actgccctgtaactgccaggta

SEQ ID NO: 7927227 - DNA, 22 bp, Homo sapiens
actgccctgtaactgccaggta

SEQ ID NO: 7927228 - DNA, 22 bp, Homo sapiens
actgccctgtaactgccaggta

SEQ ID NO: 7927229 - DNA, 22 bp, Homo sapiens
actgcccttgtcctggcacacc

SEQ ID NO: 7927230 - DNA, 22 bp, Homo sapiens
actgcccagaagagatgaaagt

SEQ ID NO: 7927231 - DNA, 22 bp, Homo sapiens
actgcccaggaatctcaaagaa

SEQ ID NO: 7927232 - DNA, 22 bp, Homo sapiens
actgcccaggaatctcaaagaa

SEQ ID NO: 7927233 - DNA, 22 bp, Homo sapiens
actgcccaggaatctcaaagaa

SEQ ID NO: 7927234 - DNA, 22 bp, Homo sapiens
actgcccatgtgcatcaagtag

SEQ ID NO: 7927235 - DNA, 22 bp, Homo sapiens
actgccctcccatctattgcaa

SEQ ID NO: 7927236 - DNA, 22 bp, Homo sapiens
actgccctcccatctattgcaa

SEQ ID NO: 7927237 - DNA, 22 bp, Homo sapiens
actgccctggagacagcagagt

SEQ ID NO: 7927238 - DNA, 22 bp, Homo sapiens
actgccctggagacagcagagt

SEQ ID NO: 7927239 - DNA, 22 bp, Homo sapiens
actgccctcccatctattgcaa

SEQ ID NO: 7927240 - DNA, 22 bp, Homo sapiens
actgcccattaaaggtgctttg

SEQ ID NO: 7927241 - DNA, 22 bp, Homo sapiens
actgcccattatggtagtcact

SEQ ID NO: 7927242 - DNA, 22 bp, Homo sapiens
actgccctccagcctgggtgac

SEQ ID NO: 7927243 - DNA, 22 bp, Homo sapiens
actgccctccagcctgggtgac

SEQ ID NO: 7927244 - DNA, 22 bp, Homo sapiens
actgccaatggtagtttgatgg

SEQ ID NO: 7927245 - DNA, 22 bp, Homo sapiens
actgccaatggtagtttgatgg

SEQ ID NO: 7927246 - DNA, 22 bp, Homo sapiens
actgccaatggtagtttgatgg

SEQ ID NO: 7927247 - DNA, 22 bp, Homo sapiens
actgccacctggtggtcctgga

SEQ ID NO: 7927248 - DNA, 22 bp, Homo sapiens
actgccagaatcattcaaggaa

SEQ ID NO: 7927249 - DNA, 22 bp, Homo sapiens
actgccagcctcagtgaaggca

SEQ ID NO: 7927250 - DNA, 22 bp, Homo sapiens
actgccagaatcattcaaggaa

SEQ ID NO: 7927251 - DNA, 23 bp, Homo sapiens
actgccagttttaccacagacgg

SEQ ID NO: 7927252 - DNA, 22 bp, Homo sapiens
actgccaggatggcactagagg

SEQ ID NO: 7927253 - DNA, 21 bp, Homo sapiens
actgccaggagagtaggggga

SEQ ID NO: 7927254 - DNA, 22 bp, Homo sapiens
actgccaggtgctccatctgaa

SEQ ID NO: 7927255 - DNA, 22 bp, Homo sapiens
actgccaggtaagtgctcctgc

SEQ ID NO: 7927256 - DNA, 22 bp, Homo sapiens
actgccaggtaagtgctcctgc

SEQ ID NO: 7927257 - DNA, 18 bp, Homo sapiens
actgcctggcgaagatag

SEQ ID NO: 7927258 - DNA, 21 bp, Homo sapiens
actgcctggggtgctggccaa

SEQ ID NO: 7927259 - DNA, 22 bp, Homo sapiens
actgcctgctcataacattgct

SEQ ID NO: 7927260 - DNA, 22 bp, Homo sapiens
actgcctggcctggcctcactg

SEQ ID NO: 7927261 - DNA, 22 bp, Homo sapiens
actgcctggcagaggtttgcaa

SEQ ID NO: 7927262 - DNA, 22 bp, Homo sapiens
actgcctgctcctggctccaca

SEQ ID NO: 7927263 - DNA, 22 bp, Homo sapiens
actgcctgcctctgattctgca

SEQ ID NO: 7927264 - DNA, 22 bp, Homo sapiens
actgcctgcctctgattctgca

SEQ ID NO: 7927265 - DNA, 19 bp, Homo sapiens
actgcctgaggctcacagg

SEQ ID NO: 7927266 - DNA, 19 bp, Homo sapiens
actgcctgaggctcacagg

SEQ ID NO: 7927267 - DNA, 22 bp, Homo sapiens
actgcctgatgtggttctaaat

SEQ ID NO: 7927268 - DNA, 22 bp, Homo sapiens
actgcctgatgtggttctaaat

SEQ ID NO: 7927269 - DNA, 19 bp, Homo sapiens
actgcctgcaggtgttggg

SEQ ID NO: 7927270 - DNA, 22 bp, Homo sapiens
actggctgcgttcctgtgagac

SEQ ID NO: 7927271 - DNA, 22 bp, Homo sapiens
actggctgcgttcctgtgagac

SEQ ID NO: 7927272 - DNA, 22 bp, Homo sapiens
actggctgcgttcctgtgagac

SEQ ID NO: 7927273 - DNA, 22 bp, Homo sapiens
actggctgcgttcctgtgagac

SEQ ID NO: 7927274 - DNA, 22 bp, Homo sapiens
actggctgcggggtggaagaag

SEQ ID NO: 7927275 - DNA, 22 bp, Homo sapiens
actggctggactctgacctctt

SEQ ID NO: 7927276 - DNA, 22 bp, Homo sapiens
actggctggactctgacctctt

SEQ ID NO: 7927277 - DNA, 22 bp, Homo sapiens
actggctggagttgccaaggct

SEQ ID NO: 7927278 - DNA, 22 bp, Homo sapiens
actggctgatcacctgcctcag

SEQ ID NO: 7927279 - DNA, 22 bp, Homo sapiens
actggctgatcacctgcctcag

SEQ ID NO: 7927280 - DNA, 21 bp, Homo sapiens
actggccaccactggcagggg

SEQ ID NO: 7927281 - DNA, 22 bp, Homo sapiens
actggcatctgtgggtagaggc

SEQ ID NO: 7927282 - DNA, 22 bp, Homo sapiens
actggcatctgtgggtagaggc

SEQ ID NO: 7927283 - DNA, 22 bp, Homo sapiens
actggcatcccactggtacagg

SEQ ID NO: 7927284 - DNA, 22 bp, Homo sapiens
actgcctgtagctcttcatctc

SEQ ID NO: 7927285 - DNA, 22 bp, Homo sapiens
actgggaggcaaagagcaagga

SEQ ID NO: 7927286 - DNA, 22 bp, Homo sapiens
actgggaggcaaagagcaagga

SEQ ID NO: 7927287 - DNA, 22 bp, Homo sapiens
actgggcaccatcatgagatgg

SEQ ID NO: 7927288 - DNA, 22 bp, Homo sapiens
actgggcagggaaggagaccga

SEQ ID NO: 7927289 - DNA, 22 bp, Homo sapiens
actgggcagcagctcgagccgc

SEQ ID NO: 7927290 - DNA, 20 bp, Homo sapiens
actgggcatacctgtcctgt

SEQ ID NO: 7927291 - DNA, 22 bp, Homo sapiens
actgggcagggaaggagaccga

SEQ ID NO: 7927292 - DNA, 22 bp, Homo sapiens
actgggaggcaaagagcaagga

SEQ ID NO: 7927293 - DNA, 22 bp, Homo sapiens
actgggaggcaaagagcaagga

SEQ ID NO: 7927294 - DNA, 21 bp, Homo sapiens
agtgtctctggaagcacgtgt

SEQ ID NO: 7927295 - DNA, 22 bp, Homo sapiens
agtgtctcagccccaactagag

SEQ ID NO: 7927296 - DNA, 21 bp, Homo sapiens
agtgtccttttactgtgaata

SEQ ID NO: 7927297 - DNA, 22 bp, Homo sapiens
agtgtcctttctgttccagcca

SEQ ID NO: 7927298 - DNA, 22 bp, Homo sapiens
agtgtccttgttattactgctc

SEQ ID NO: 7927299 - DNA, 22 bp, Homo sapiens
agtgtccttgttattactgctc

SEQ ID NO: 7927300 - DNA, 22 bp, Homo sapiens
agtgtccttgaggttcctagga

SEQ ID NO: 7927301 - DNA, 22 bp, Homo sapiens
agtgtccttgattcctgttgtt

SEQ ID NO: 7927302 - DNA, 21 bp, Homo sapiens
agtgtccttgatcttgccttg

SEQ ID NO: 7927303 - DNA, 22 bp, Homo sapiens
agtgtcctgtgtcccagactgt

SEQ ID NO: 7927304 - DNA, 22 bp, Homo sapiens
agtgtccttagttagctttggg

SEQ ID NO: 7927305 - DNA, 22 bp, Homo sapiens
agtgtcctgtgtcccagactgt

SEQ ID NO: 7927306 - DNA, 21 bp, Homo sapiens
actggctggctgagtttcctg

SEQ ID NO: 7927307 - DNA, 22 bp, Homo sapiens
actggctggccgcgctcttcgc

SEQ ID NO: 7927308 - DNA, 22 bp, Homo sapiens
actggctggccgcgctcttcgc

SEQ ID NO: 7927309 - DNA, 22 bp, Homo sapiens
actggctggccgcgctcttcgc

SEQ ID NO: 7927310 - DNA, 22 bp, Homo sapiens
actggctgtgcagagggcagta

SEQ ID NO: 7927311 - DNA, 22 bp, Homo sapiens
actggctgtgcccatagagctc

SEQ ID NO: 7927312 - DNA, 22 bp, Homo sapiens
actggctgtgcccatagagctc

SEQ ID NO: 7927313 - DNA, 22 bp, Homo sapiens
actggctgtgtaacctcaggca

SEQ ID NO: 7927314 - DNA, 22 bp, Homo sapiens
actggctgtgtaacctcaggca

SEQ ID NO: 7927315 - DNA, 22 bp, Homo sapiens
actggcttcaaaccgtttcacc

SEQ ID NO: 7927316 - DNA, 22 bp, Homo sapiens
actggcttcaaaccgtttcacc

SEQ ID NO: 7927317 - DNA, 22 bp, Homo sapiens
actggcttcagggggaaagtcc

SEQ ID NO: 7927318 - DNA, 22 bp, Homo sapiens
actggcttgaagtagattcaaa

SEQ ID NO: 7927319 - DNA, 22 bp, Homo sapiens
actggcttggcaggaggaagat

SEQ ID NO: 7927320 - DNA, 22 bp, Homo sapiens
actggcttggcaggaggaagat

SEQ ID NO: 7927321 - DNA, 22 bp, Homo sapiens
agtgtcctggcaagggtttcag

SEQ ID NO: 7927322 - DNA, 22 bp, Homo sapiens
agtgtcctggcaagggtttcag

SEQ ID NO: 7927323 - DNA, 22 bp, Homo sapiens
agtgtcctggggccctaaggcc

SEQ ID NO: 7927324 - DNA, 22 bp, Homo sapiens
actgggcattttgaacgttctt

SEQ ID NO: 7927325 - DNA, 22 bp, Homo sapiens
actgggcattttgaacgttctt

SEQ ID NO: 7927326 - DNA, 22 bp, Homo sapiens
actgggcatgatgagtcaccta

SEQ ID NO: 7927327 - DNA, 22 bp, Homo sapiens
actgggcatgatgagtcaccta

SEQ ID NO: 7927328 - DNA, 20 bp, Homo sapiens
actgggcatacctgtcctgt

SEQ ID NO: 7927329 - DNA, 22 bp, Homo sapiens
actgggcatcccatggcagagc

SEQ ID NO: 7927330 - DNA, 22 bp, Homo sapiens
actgggccagacactgattccc

SEQ ID NO: 7927331 - DNA, 22 bp, Homo sapiens
actgggccagatcagagcaact

SEQ ID NO: 7927332 - DNA, 22 bp, Homo sapiens
actgggccagacactgattccc

SEQ ID NO: 7927333 - DNA, 22 bp, Homo sapiens
actgggccagacactgattccc

SEQ ID NO: 7927334 - DNA, 22 bp, Homo sapiens
actgggccacatagacctgctg

SEQ ID NO: 7927335 - DNA, 22 bp, Homo sapiens
actgggccacatagacctgctg

SEQ ID NO: 7927336 - DNA, 22 bp, Homo sapiens
actgggccacatagacctgctg

SEQ ID NO: 7927337 - DNA, 22 bp, Homo sapiens
actgggccaactatttgttcta

SEQ ID NO: 7927338 - DNA, 22 bp, Homo sapiens
actgggccaactatttgttcta

SEQ ID NO: 7927339 - DNA, 22 bp, Homo sapiens
actgggccagatcagagcaact

SEQ ID NO: 7927340 - DNA, 18 bp, Homo sapiens
actgggccagcaggcagg

SEQ ID NO: 7927341 - DNA, 22 bp, Homo sapiens
actgggccagatcagagcaact

SEQ ID NO: 7927342 - DNA, 22 bp, Homo sapiens
actgggccagatcagagcaact

SEQ ID NO: 7927343 - DNA, 22 bp, Homo sapiens
actgggccagatcagagcaact

SEQ ID NO: 7927344 - DNA, 18 bp, Homo sapiens
actgggccagcaggcagg

SEQ ID NO: 7927345 - DNA, 23 bp, Homo sapiens
actgggccagctacttagcactg

SEQ ID NO: 7927346 - DNA, 23 bp, Homo sapiens
actgggccagctacttagcactg

SEQ ID NO: 7927347 - DNA, 23 bp, Homo sapiens
actgggccagctacttagcactg

SEQ ID NO: 7927348 - DNA, 22 bp, Homo sapiens
actgggccaggtgtgggtgagt

SEQ ID NO: 7927349 - DNA, 22 bp, Homo sapiens
actgggccaggtgtgggtgagt

SEQ ID NO: 7927350 - DNA, 22 bp, Homo sapiens
actgggccaggtgtgggtgagt

SEQ ID NO: 7927351 - DNA, 22 bp, Homo sapiens
actgggcccagtggtgtggctg

SEQ ID NO: 7927352 - DNA, 22 bp, Homo sapiens
actgggcccagtggtgtggctg

SEQ ID NO: 7927353 - DNA, 22 bp, Homo sapiens
actgggcccagtggtgtggctg

SEQ ID NO: 7927354 - DNA, 22 bp, Homo sapiens
actgggccaggggctttggagc

SEQ ID NO: 7927355 - DNA, 22 bp, Homo sapiens
actgggccaggggctttggagc

SEQ ID NO: 7927356 - DNA, 22 bp, Homo sapiens
actgggccaggggctttggagc

SEQ ID NO: 7927357 - DNA, 22 bp, Homo sapiens
actgggccaggtgtgggtgagt

SEQ ID NO: 7927358 - DNA, 22 bp, Homo sapiens
actgggcctggattggcgtgtc

SEQ ID NO: 7927359 - DNA, 22 bp, Homo sapiens
actgggcctggattggcgtgtc

SEQ ID NO: 7927360 - DNA, 22 bp, Homo sapiens
actgggcctggattggcgtgtc

SEQ ID NO: 7927361 - DNA, 22 bp, Homo sapiens
actgggcctgtacagagaaaac

SEQ ID NO: 7927362 - DNA, 22 bp, Homo sapiens
actgggcctgtacagagaaaac

SEQ ID NO: 7927363 - DNA, 22 bp, Homo sapiens
actgggcctgtacagagaaaac

SEQ ID NO: 7927364 - DNA, 22 bp, Homo sapiens
actgggcctgtacagagaaaac

SEQ ID NO: 7927365 - DNA, 22 bp, Homo sapiens
actgggcctgtacagagaaaac

SEQ ID NO: 7927366 - DNA, 22 bp, Homo sapiens
actgggccttgccatggcagcc

SEQ ID NO: 7927367 - DNA, 22 bp, Homo sapiens
actgggccttgccatggcagcc

SEQ ID NO: 7927368 - DNA, 22 bp, Homo sapiens
actgggccttgccatggcagcc

SEQ ID NO: 7927369 - DNA, 20 bp, Homo sapiens
actgggcctaggggaggcat

SEQ ID NO: 7927370 - DNA, 20 bp, Homo sapiens
actgggcctaggggaggcat

SEQ ID NO: 7927371 - DNA, 22 bp, Homo sapiens
actgggcctgattgggtcggag

SEQ ID NO: 7927372 - DNA, 22 bp, Homo sapiens
actgggcctgattgggtcggag

SEQ ID NO: 7927373 - DNA, 22 bp, Homo sapiens
actgggcctggattggcgtgtc

SEQ ID NO: 7927374 - DNA, 22 bp, Homo sapiens
actgggcctgattgggtcggag

SEQ ID NO: 7927375 - DNA, 22 bp, Homo sapiens
actgggcctgattgggtcggag

SEQ ID NO: 7927376 - DNA, 22 bp, Homo sapiens
actgggcctggattggcgtgtc

SEQ ID NO: 7927377 - DNA, 22 bp, Homo sapiens
actgggcctggattggcgtgtc

SEQ ID NO: 7927378 - DNA, 22 bp, Homo sapiens
actgggccgaaatggacagaat

SEQ ID NO: 7927379 - DNA, 22 bp, Homo sapiens
actgggcccatatactcagtct

SEQ ID NO: 7927380 - DNA, 22 bp, Homo sapiens
actgggcccagtggtgtggctg

SEQ ID NO: 7927381 - DNA, 22 bp, Homo sapiens
actgggcccatatactcagtct

SEQ ID NO: 7927382 - DNA, 22 bp, Homo sapiens
actgggcccatatactcagtct

SEQ ID NO: 7927383 - DNA, 22 bp, Homo sapiens
actgggccgcgctgcagagggc

SEQ ID NO: 7927384 - DNA, 22 bp, Homo sapiens
actgggccgcgctgcagagggc

SEQ ID NO: 7927385 - DNA, 22 bp, Homo sapiens
actgggccgcgctgcagagggc

SEQ ID NO: 7927386 - DNA, 22 bp, Homo sapiens
actgggccgaaatggacagaat

SEQ ID NO: 7927387 - DNA, 22 bp, Homo sapiens
actgggccggtgcagagtagtt

SEQ ID NO: 7927388 - DNA, 22 bp, Homo sapiens
actgggccggtgcagagtagtt

SEQ ID NO: 7927389 - DNA, 22 bp, Homo sapiens
actgggccggtgcagagtagtt

SEQ ID NO: 7927390 - DNA, 22 bp, Homo sapiens
actgggccggtgcagagtagtt

SEQ ID NO: 7927391 - DNA, 22 bp, Homo sapiens
actgggcctacccagattggca

SEQ ID NO: 7927392 - DNA, 22 bp, Homo sapiens
actgggcctacccagattggca

SEQ ID NO: 7927393 - DNA, 22 bp, Homo sapiens
actgggcctacccagattggca

SEQ ID NO: 7927394 - DNA, 22 bp, Homo sapiens
actgggcctacccagattggca

SEQ ID NO: 7927395 - DNA, 22 bp, Homo sapiens
actgagatgagttgcatagatt

SEQ ID NO: 7927396 - DNA, 22 bp, Homo sapiens
actgagatgctggatgaccctg

SEQ ID NO: 7927397 - DNA, 23 bp, Homo sapiens
actgagcaatgtttacatacttg

SEQ ID NO: 7927398 - DNA, 22 bp, Homo sapiens
actgagcaagtgctgctcacgt

SEQ ID NO: 7927399 - DNA, 22 bp, Homo sapiens
actgagcaagtgctgctcacgt

SEQ ID NO: 7927400 - DNA, 22 bp, Homo sapiens
actgagagttgaaaagggagga

SEQ ID NO: 7927401 - DNA, 22 bp, Homo sapiens
actgagagttgaaaagggagga

SEQ ID NO: 7927402 - DNA, 22 bp, Homo sapiens
actgagagttgtgcattcatgc

SEQ ID NO: 7927403 - DNA, 22 bp, Homo sapiens
actgagatgaatagatggcaag

SEQ ID NO: 7927404 - DNA, 22 bp, Homo sapiens
actgagagttgtgcattcatgc

SEQ ID NO: 7927405 - DNA, 22 bp, Homo sapiens
actgagcaggagaatcacttta

SEQ ID NO: 7927406 - DNA, 22 bp, Homo sapiens
actgagcagaagagatctgtga

SEQ ID NO: 7927407 - DNA, 22 bp, Homo sapiens
actgagcataaatatgtgtcca

SEQ ID NO: 7927408 - DNA, 22 bp, Homo sapiens
actgagcactcacttttgttat

SEQ ID NO: 7927409 - DNA, 22 bp, Homo sapiens
actgagagcgtgtacaaactta

SEQ ID NO: 7927410 - DNA, 22 bp, Homo sapiens
actgagagcgtgtacaaactta

SEQ ID NO: 7927411 - DNA, 22 bp, Homo sapiens
actgagagggaggctgtccggt

SEQ ID NO: 7927412 - DNA, 22 bp, Homo sapiens
actgagaggaaattgagactat

SEQ ID NO: 7927413 - DNA, 21 bp, Homo sapiens
actgagagatgttggatcata

SEQ ID NO: 7927414 - DNA, 22 bp, Homo sapiens
actgagagagctgggtatctcc

SEQ ID NO: 7927415 - DNA, 22 bp, Homo sapiens
actgacaaatatagcttcgtct

SEQ ID NO: 7927416 - DNA, 22 bp, Homo sapiens
actgagagtcaagatagcatgg

SEQ ID NO: 7927417 - DNA, 22 bp, Homo sapiens
actgagagtcttagaaacacat

SEQ ID NO: 7927418 - DNA, 22 bp, Homo sapiens
actgagagtcaagatagcatgg

SEQ ID NO: 7927419 - DNA, 22 bp, Homo sapiens
actgagagtcaagatagcatgg

SEQ ID NO: 7927420 - DNA, 22 bp, Homo sapiens
actgagaggtgatagtgacatt

SEQ ID NO: 7927421 - DNA, 22 bp, Homo sapiens
actgagaggtgatagtgacatt

SEQ ID NO: 7927422 - DNA, 23 bp, Homo sapiens
actgagcattagtatttttataa

SEQ ID NO: 7927423 - DNA, 22 bp, Homo sapiens
actgagcctctcttcccacctc

SEQ ID NO: 7927424 - DNA, 22 bp, Homo sapiens
actgagcctgtgccctcatcag

SEQ ID NO: 7927425 - DNA, 22 bp, Homo sapiens
actgagcatggctcacagagag

SEQ ID NO: 7927426 - DNA, 22 bp, Homo sapiens
actgagcatggctcacagagag

SEQ ID NO: 7927427 - DNA, 22 bp, Homo sapiens
actgagcatggctcacagagag

SEQ ID NO: 7927428 - DNA, 22 bp, Homo sapiens
actgagcataaatatgtgtcca

SEQ ID NO: 7927429 - DNA, 22 bp, Homo sapiens
actgagcctgtgccctcatcag

SEQ ID NO: 7927430 - DNA, 22 bp, Homo sapiens
actgagcctctcttcccacctc

SEQ ID NO: 7927431 - DNA, 22 bp, Homo sapiens
actgagccttgaagctagatag

SEQ ID NO: 7927432 - DNA, 22 bp, Homo sapiens
actgagctccctgagggcaggc

SEQ ID NO: 7927433 - DNA, 22 bp, Homo sapiens
actgagctccaagcctggaatc

SEQ ID NO: 7927434 - DNA, 22 bp, Homo sapiens
actgagctccctgagggcaggc

SEQ ID NO: 7927435 - DNA, 22 bp, Homo sapiens
actgagctctaggttttgaacc

SEQ ID NO: 7927436 - DNA, 22 bp, Homo sapiens
actgagctctaggttttgaacc

SEQ ID NO: 7927437 - DNA, 22 bp, Homo sapiens
agtgaaatttgtttagataggt

SEQ ID NO: 7927438 - DNA, 22 bp, Homo sapiens
agtgaaatttgtttagataggt

SEQ ID NO: 7927439 - DNA, 22 bp, Homo sapiens
agtgaacaaaggtagtgagcat

SEQ ID NO: 7927440 - DNA, 22 bp, Homo sapiens
agtgaacaaggatgccacctct

SEQ ID NO: 7927441 - DNA, 22 bp, Homo sapiens
agtgaacaaaggtagtgagcat

SEQ ID NO: 7927442 - DNA, 22 bp, Homo sapiens
agtgaacaagttaagaacacta

SEQ ID NO: 7927443 - DNA, 22 bp, Homo sapiens
agtgaacaagtcgcgatgtttt

SEQ ID NO: 7927444 - DNA, 19 bp, Homo sapiens
agtgaacacaaagagaagg

SEQ ID NO: 7927445 - DNA, 22 bp, Homo sapiens
agtgaacagtttggaacacatg

SEQ ID NO: 7927446 - DNA, 22 bp, Homo sapiens
agtgaacagtttggaacacatg

SEQ ID NO: 7927447 - DNA, 22 bp, Homo sapiens
agtgaacagtttggaacacatg

SEQ ID NO: 7927448 - DNA, 22 bp, Homo sapiens
agtgaacagtttggaacacatg

SEQ ID NO: 7927449 - DNA, 19 bp, Homo sapiens
agtgaactccatatcaggt

SEQ ID NO: 7927450 - DNA, 22 bp, Homo sapiens
actctgaaccagagatcatacc

SEQ ID NO: 7927451 - DNA, 22 bp, Homo sapiens
actctgaaatagaggctggtgg

SEQ ID NO: 7927452 - DNA, 22 bp, Homo sapiens
actctgaaatagaggctggtgg

SEQ ID NO: 7927453 - DNA, 22 bp, Homo sapiens
actctgaaccagagatcatacc

SEQ ID NO: 7927454 - DNA, 22 bp, Homo sapiens
actctgaactccaggaggctca

SEQ ID NO: 7927455 - DNA, 22 bp, Homo sapiens
actctgaagaagacttccagac

SEQ ID NO: 7927456 - DNA, 22 bp, Homo sapiens
actctgaagaagacttccagac

SEQ ID NO: 7927457 - DNA, 22 bp, Homo sapiens
actctgaactccaggaggctca

SEQ ID NO: 7927458 - DNA, 22 bp, Homo sapiens
actctgaatgtgcatgtaaatc

SEQ ID NO: 7927459 - DNA, 22 bp, Homo sapiens
actctgaagaagacttccagac

SEQ ID NO: 7927460 - DNA, 22 bp, Homo sapiens
actctgagaactgagattccct

SEQ ID NO: 7927461 - DNA, 22 bp, Homo sapiens
actctgagccaccagatcccca

SEQ ID NO: 7927462 - DNA, 19 bp, Homo sapiens
actctgaggctgagacaag

SEQ ID NO: 7927463 - DNA, 22 bp, Homo sapiens
actgaattttaattagatctgc

SEQ ID NO: 7927464 - DNA, 22 bp, Homo sapiens
actgaatttgtgtagatggtct

SEQ ID NO: 7927465 - DNA, 22 bp, Homo sapiens
actgaatttgtgtagatggtct

SEQ ID NO: 7927466 - DNA, 22 bp, Homo sapiens
actgaatttattagtatagtct

SEQ ID NO: 7927467 - DNA, 22 bp, Homo sapiens
actctgcctttcagcagatgaa

SEQ ID NO: 7927468 - DNA, 22 bp, Homo sapiens
actctgccttagtcctggggct

SEQ ID NO: 7927469 - DNA, 22 bp, Homo sapiens
actctgccatcccaggtgctgt

SEQ ID NO: 7927470 - DNA, 22 bp, Homo sapiens
actctgccctaggcctctgggg

SEQ ID NO: 7927471 - DNA, 22 bp, Homo sapiens
actctgccctaggcctctgggg

SEQ ID NO: 7927472 - DNA, 22 bp, Homo sapiens
agtgctcctcagaagagttgga

SEQ ID NO: 7927473 - DNA, 22 bp, Homo sapiens
agtgctccctagagttgtgcaa

SEQ ID NO: 7927474 - DNA, 22 bp, Homo sapiens
agtgctcctatggatcagttgt

SEQ ID NO: 7927475 - DNA, 22 bp, Homo sapiens
agtgctcctgaagcttgaggca

SEQ ID NO: 7927476 - DNA, 22 bp, Homo sapiens
agtgctcctgccagctttctgg

SEQ ID NO: 7927477 - DNA, 22 bp, Homo sapiens
agtgctcctgccagctttctgg

SEQ ID NO: 7927478 - DNA, 22 bp, Homo sapiens
agtgctcctttcattgctgccc

SEQ ID NO: 7927479 - DNA, 22 bp, Homo sapiens
agtgctcctttcattgctgccc

SEQ ID NO: 7927480 - DNA, 22 bp, Homo sapiens
actgcagccttgaactctgggc

SEQ ID NO: 7927481 - DNA, 22 bp, Homo sapiens
actgcattctttatcccacaac

SEQ ID NO: 7927482 - DNA, 22 bp, Homo sapiens
actgcagcctagggaccacagt

SEQ ID NO: 7927483 - DNA, 23 bp, Homo sapiens
actgcagcctccgcctgccgggt

SEQ ID NO: 7927484 - DNA, 23 bp, Homo sapiens
actgcagcctccgcctgccgggt

SEQ ID NO: 7927485 - DNA, 23 bp, Homo sapiens
actgcagcctccgcctgccgggt

SEQ ID NO: 7927486 - DNA, 22 bp, Homo sapiens
actgccaatggtagtttgatgg

SEQ ID NO: 7927487 - DNA, 22 bp, Homo sapiens
actgcatttggtaaagtcaaga

SEQ ID NO: 7927488 - DNA, 22 bp, Homo sapiens
actgcagcaggtaagagcattt

SEQ ID NO: 7927489 - DNA, 22 bp, Homo sapiens
actgcagcaggtaagagcattt

SEQ ID NO: 7927490 - DNA, 22 bp, Homo sapiens
agtgctgaacatagaatggaca

SEQ ID NO: 7927491 - DNA, 22 bp, Homo sapiens
agtgctgaacatagaatggaca

SEQ ID NO: 7927492 - DNA, 21 bp, Homo sapiens
agtgctgaaaaagcatgtctc

SEQ ID NO: 7927493 - DNA, 23 bp, Homo sapiens
agtgctcccaggacctggggcag

SEQ ID NO: 7927494 - DNA, 23 bp, Homo sapiens
agtgctcccaggacctggggcag

SEQ ID NO: 7927495 - DNA, 22 bp, Homo sapiens
agtgctccacattgcactattc

SEQ ID NO: 7927496 - DNA, 22 bp, Homo sapiens
agtgctccaaaggttggtcatt

SEQ ID NO: 7927497 - DNA, 22 bp, Homo sapiens
agtgctcatgcacatttatagt

SEQ ID NO: 7927498 - DNA, 22 bp, Homo sapiens
agtgctcataaaaatgtgaaac

SEQ ID NO: 7927499 - DNA, 22 bp, Homo sapiens
agtgctccaaaggttggtcatt

SEQ ID NO: 7927500 - DNA, 22 bp, Homo sapiens
actgcacttcagcctgggtgac

SEQ ID NO: 7927501 - DNA, 22 bp, Homo sapiens
agtgctatcgagttctaatgct

SEQ ID NO: 7927502 - DNA, 22 bp, Homo sapiens
actgcacttcagcctgggtgac

SEQ ID NO: 7927503 - DNA, 22 bp, Homo sapiens
agtgctcactctccacagtgcc

SEQ ID NO: 7927504 - DNA, 22 bp, Homo sapiens
agtgctcacctgtcaggtcaag

SEQ ID NO: 7927505 - DNA, 22 bp, Homo sapiens
agtgctcactctccacagtgcc

SEQ ID NO: 7927506 - DNA, 23 bp, Homo sapiens
agtgctcagggcattaggctaga

SEQ ID NO: 7927507 - DNA, 22 bp, Homo sapiens
actgcacttcaccctgggtgac

SEQ ID NO: 7927508 - DNA, 22 bp, Homo sapiens
actgcacttcaccctgggtgac

SEQ ID NO: 7927509 - DNA, 22 bp, Homo sapiens
actgcacttcaccctgggtgac

SEQ ID NO: 7927510 - DNA, 22 bp, Homo sapiens
actgcacttcaccctgggtgac

SEQ ID NO: 7927511 - DNA, 22 bp, Homo sapiens
actgcacttcaccctgggtgac

SEQ ID NO: 7927512 - DNA, 22 bp, Homo sapiens
actgcacttcaccctgggtgac

SEQ ID NO: 7927513 - DNA, 22 bp, Homo sapiens
actgcacttcaccctgggtgac

SEQ ID NO: 7927514 - DNA, 22 bp, Homo sapiens
actgcacttcaccctgggtgac

SEQ ID NO: 7927515 - DNA, 22 bp, Homo sapiens
actgcacttcaccctgggtgac

SEQ ID NO: 7927516 - DNA, 22 bp, Homo sapiens
actgcacttcaccctgggtgac

SEQ ID NO: 7927517 - DNA, 22 bp, Homo sapiens
actgcacttcaccctgggtgac

SEQ ID NO: 7927518 - DNA, 22 bp, Homo sapiens
actgcacttcaccctgggtgac

SEQ ID NO: 7927519 - DNA, 22 bp, Homo sapiens
actgcacttcagcctgggtgac

SEQ ID NO: 7927520 - DNA, 22 bp, Homo sapiens
actgcactcctgcctgggtaac

SEQ ID NO: 7927521 - DNA, 22 bp, Homo sapiens
actgcactcctgcctgggtaac

SEQ ID NO: 7927522 - DNA, 22 bp, Homo sapiens
actgcactcctgcctgggtaac

SEQ ID NO: 7927523 - DNA, 22 bp, Homo sapiens
actgcactcctgcctgggtaac

SEQ ID NO: 7927524 - DNA, 22 bp, Homo sapiens
actgcactcctgcctgggtaac

SEQ ID NO: 7927525 - DNA, 22 bp, Homo sapiens
actgcactcctgcctgggtaac

SEQ ID NO: 7927526 - DNA, 22 bp, Homo sapiens
actgcactcctgcctgggtaac

SEQ ID NO: 7927527 - DNA, 22 bp, Homo sapiens
actgcactcctgcctgggtaac

SEQ ID NO: 7927528 - DNA, 22 bp, Homo sapiens
actgcacttacatagaggaggc

SEQ ID NO: 7927529 - DNA, 22 bp, Homo sapiens
actgcacttcaccctgggtgac

SEQ ID NO: 7927530 - DNA, 22 bp, Homo sapiens
actgcacttacatagaggaggc

SEQ ID NO: 7927531 - DNA, 22 bp, Homo sapiens
actgcactcctgcctgggtaac

SEQ ID NO: 7927532 - DNA, 22 bp, Homo sapiens
actgcactcctgcctgggtaac

SEQ ID NO: 7927533 - DNA, 22 bp, Homo sapiens
actgcactcctgcctgggtaac

SEQ ID NO: 7927534 - DNA, 22 bp, Homo sapiens
actgcactcctgcctgggtaac

SEQ ID NO: 7927535 - DNA, 22 bp, Homo sapiens
actgcactccagcctgggtgat

SEQ ID NO: 7927536 - DNA, 22 bp, Homo sapiens
actgcactccagcctgggtgat

SEQ ID NO: 7927537 - DNA, 22 bp, Homo sapiens
actgcactccagcctgggtgat

SEQ ID NO: 7927538 - DNA, 22 bp, Homo sapiens
actgcactccagcctgggtgat

SEQ ID NO: 7927539 - DNA, 22 bp, Homo sapiens
actgcactccagcctgggtgat

SEQ ID NO: 7927540 - DNA, 22 bp, Homo sapiens
actgcactccagcctgggtgat

SEQ ID NO: 7927541 - DNA, 22 bp, Homo sapiens
actgcactccagcctgggtgat

SEQ ID NO: 7927542 - DNA, 22 bp, Homo sapiens
actgcactccagcctgggtgat

SEQ ID NO: 7927543 - DNA, 22 bp, Homo sapiens
actgcactccagcctgggtgat

SEQ ID NO: 7927544 - DNA, 22 bp, Homo sapiens
actgcactccagcctgggtgat

SEQ ID NO: 7927545 - DNA, 22 bp, Homo sapiens
actgcactccagcctgggtgat

SEQ ID NO: 7927546 - DNA, 22 bp, Homo sapiens
actgcactccagcctgggtgat

SEQ ID NO: 7927547 - DNA, 22 bp, Homo sapiens
actgcactccagcctgggtgat

SEQ ID NO: 7927548 - DNA, 22 bp, Homo sapiens
actgcactccagcctgggtgat

SEQ ID NO: 7927549 - DNA, 22 bp, Homo sapiens
agtgaagatatactgttgtcct

SEQ ID NO: 7927550 - DNA, 22 bp, Homo sapiens
agtgaagatatactgttgtcct

SEQ ID NO: 7927551 - DNA, 21 bp, Homo sapiens
agtgaagagtgaaacacatgg

SEQ ID NO: 7927552 - DNA, 21 bp, Homo sapiens
agtgaagagtgaaacacatgg

SEQ ID NO: 7927553 - DNA, 22 bp, Homo sapiens
agtgaagaggaagtggggcaca

SEQ ID NO: 7927554 - DNA, 22 bp, Homo sapiens
agtgaagatatactgttgtcct

SEQ ID NO: 7927555 - DNA, 21 bp, Homo sapiens
agtgaagagtgaaacacatgg

SEQ ID NO: 7927556 - DNA, 21 bp, Homo sapiens
agtgaagagtgaaacacatgg

SEQ ID NO: 7927557 - DNA, 22 bp, Homo sapiens
agtgaaggtttacagggcccct

SEQ ID NO: 7927558 - DNA, 22 bp, Homo sapiens
agtgaaggtttacagggcccct

SEQ ID NO: 7927559 - DNA, 22 bp, Homo sapiens
agtgaaggaagtttgtcttggg

SEQ ID NO: 7927560 - DNA, 22 bp, Homo sapiens
agtgaaggtttacagggcccct

SEQ ID NO: 7927561 - DNA, 22 bp, Homo sapiens
agtgaaggaaacaattggttga

SEQ ID NO: 7927562 - DNA, 22 bp, Homo sapiens
agtgaaggaagtttgtcttggg

SEQ ID NO: 7927563 - DNA, 22 bp, Homo sapiens
agtgaaggaaacaattggttga

SEQ ID NO: 7927564 - DNA, 22 bp, Homo sapiens
actgcactccagcctgggtgac

SEQ ID NO: 7927565 - DNA, 22 bp, Homo sapiens
actgcactccaacctgggtgac

SEQ ID NO: 7927566 - DNA, 22 bp, Homo sapiens
actgcacagattaagttagatt

SEQ ID NO: 7927567 - DNA, 22 bp, Homo sapiens
actgcacagtcccagaggatgc

SEQ ID NO: 7927568 - DNA, 22 bp, Homo sapiens
actgcacagtcccagaggatgc

SEQ ID NO: 7927569 - DNA, 20 bp, Homo sapiens
agtgaatagagacattgccc

SEQ ID NO: 7927570 - DNA, 22 bp, Homo sapiens
agtgaagtgatagtttgcctag

SEQ ID NO: 7927571 - DNA, 22 bp, Homo sapiens
agtgaatacatgtcactcagca

SEQ ID NO: 7927572 - DNA, 22 bp, Homo sapiens
agtgaagtaaaagatgtgcatc

SEQ ID NO: 7927573 - DNA, 22 bp, Homo sapiens
agtgaatatgcagcaagaagtt

SEQ ID NO: 7927574 - DNA, 22 bp, Homo sapiens
agtgaagcctgctgaaagtggc

SEQ ID NO: 7927575 - DNA, 22 bp, Homo sapiens
agtgaatatgcagcaagaagtt

SEQ ID NO: 7927576 - DNA, 20 bp, Homo sapiens
agtgaatagagacattgccc

SEQ ID NO: 7927577 - DNA, 22 bp, Homo sapiens
aggtggggaaaccagcgatccc

SEQ ID NO: 7927578 - DNA, 22 bp, Homo sapiens
aggtggggaaaccagcgatccc

SEQ ID NO: 7927579 - DNA, 22 bp, Homo sapiens
aggtggggaaaccagcgatccc

SEQ ID NO: 7927580 - DNA, 22 bp, Homo sapiens
aggtggggaaaccagcgatccc

SEQ ID NO: 7927581 - DNA, 22 bp, Homo sapiens
aggtggggaaaccagcgatccc

SEQ ID NO: 7927582 - DNA, 22 bp, Homo sapiens
aggtggggaaaccagcgatccc

SEQ ID NO: 7927583 - DNA, 22 bp, Homo sapiens
aggtgggcggattcatgaggtc

SEQ ID NO: 7927584 - DNA, 22 bp, Homo sapiens
aggtgggcggattcatgaggtc

SEQ ID NO: 7927585 - DNA, 22 bp, Homo sapiens
aggtgggcccagtgggctccag

SEQ ID NO: 7927586 - DNA, 22 bp, Homo sapiens
aggtgggcgctgctcccgctgg

SEQ ID NO: 7927587 - DNA, 22 bp, Homo sapiens
aggtgggcgctgctcccgctgg

SEQ ID NO: 7927588 - DNA, 22 bp, Homo sapiens
aggtgggcggatcacaaggtca

SEQ ID NO: 7927589 - DNA, 22 bp, Homo sapiens
aggtgggcggattcatgaggtc

SEQ ID NO: 7927590 - DNA, 22 bp, Homo sapiens
aggtgggcggattcatgaggtc

SEQ ID NO: 7927591 - DNA, 22 bp, Homo sapiens
aggtgggcggattcatgaggtc

SEQ ID NO: 7927592 - DNA, 22 bp, Homo sapiens
aggtgggcggatcacaaggtca

SEQ ID NO: 7927593 - DNA, 21 bp, Homo sapiens
aggtgggcaggtggagtggcc

SEQ ID NO: 7927594 - DNA, 21 bp, Homo sapiens
aggtgggcaggtggagtggcc

SEQ ID NO: 7927595 - DNA, 22 bp, Homo sapiens
agtaccattatccagtaaagga

SEQ ID NO: 7927596 - DNA, 22 bp, Homo sapiens
agtaccattatccagtaaagga

SEQ ID NO: 7927597 - DNA, 23 bp, Homo sapiens
agtaccatgtgttccttctcgtt

SEQ ID NO: 7927598 - DNA, 22 bp, Homo sapiens
agtaccatctctgcctctgcct

SEQ ID NO: 7927599 - DNA, 23 bp, Homo sapiens
agtacatttgacccaaataagct

SEQ ID NO: 7927600 - DNA, 23 bp, Homo sapiens
agtacatttgacccaaataagct

SEQ ID NO: 7927601 - DNA, 22 bp, Homo sapiens
agtaataatagctgtaaagtgc

SEQ ID NO: 7927602 - DNA, 22 bp, Homo sapiens
agtaataatttatattagggag

SEQ ID NO: 7927603 - DNA, 22 bp, Homo sapiens
aggtggggaaaccagcgatccc

SEQ ID NO: 7927604 - DNA, 22 bp, Homo sapiens
agtacatatagtaatttagcca

SEQ ID NO: 7927605 - DNA, 22 bp, Homo sapiens
agtacatatagtaatttagcca

SEQ ID NO: 7927606 - DNA, 22 bp, Homo sapiens
agtacatattgagtggtgatat

SEQ ID NO: 7927607 - DNA, 21 bp, Homo sapiens
agtacatctcaaatgtaaatc

SEQ ID NO: 7927608 - DNA, 22 bp, Homo sapiens
agtacatttattaatggtaaaa

SEQ ID NO: 7927609 - DNA, 22 bp, Homo sapiens
agtacatttattaatggtaaaa

SEQ ID NO: 7927610 - DNA, 23 bp, Homo sapiens
agtacattcgaaaaattctgtga

SEQ ID NO: 7927611 - DNA, 22 bp, Homo sapiens
agtacatttagtttatgaacat

SEQ ID NO: 7927612 - DNA, 22 bp, Homo sapiens
agtacatgtggtcctggccaga

SEQ ID NO: 7927613 - DNA, 22 bp, Homo sapiens
agtatacagtaatgacatatct

SEQ ID NO: 7927614 - DNA, 22 bp, Homo sapiens
agtatacagtaatgacatatct

SEQ ID NO: 7927615 - DNA, 22 bp, Homo sapiens
agtatacatatattagccttcg

SEQ ID NO: 7927616 - DNA, 22 bp, Homo sapiens
agtatacaaataaatgtgtaat

SEQ ID NO: 7927617 - DNA, 22 bp, Homo sapiens
agtatacaaataaatgtgtaat

SEQ ID NO: 7927618 - DNA, 22 bp, Homo sapiens
agtatacaaataaatgtgtaat

SEQ ID NO: 7927619 - DNA, 22 bp, Homo sapiens
agtatacagtaatgacatatct

SEQ ID NO: 7927620 - DNA, 22 bp, Homo sapiens
agtataatttacatttggtatt

SEQ ID NO: 7927621 - DNA, 22 bp, Homo sapiens
agtataattagatatcaaaagt

SEQ ID NO: 7927622 - DNA, 22 bp, Homo sapiens
agtataaagtggttttcagcac

SEQ ID NO: 7927623 - DNA, 22 bp, Homo sapiens
agtataaagtggttttcagcac

SEQ ID NO: 7927624 - DNA, 22 bp, Homo sapiens
agtataaagtggttttcagcac

SEQ ID NO: 7927625 - DNA, 22 bp, Homo sapiens
agtataaagtggttttcagcac

SEQ ID NO: 7927626 - DNA, 22 bp, Homo sapiens
agtataaagtggttttcagcac

SEQ ID NO: 7927627 - DNA, 21 bp, Homo sapiens
agtagtttagcacagggtttg

SEQ ID NO: 7927628 - DNA, 22 bp, Homo sapiens
agtagtttgggcagtgacagat

SEQ ID NO: 7927629 - DNA, 22 bp, Homo sapiens
agtagtttccatttctgagttt

SEQ ID NO: 7927630 - DNA, 21 bp, Homo sapiens
agtagtttagcacagggtttg

SEQ ID NO: 7927631 - DNA, 21 bp, Homo sapiens
agtagtttagcacagggtttg

SEQ ID NO: 7927632 - DNA, 22 bp, Homo sapiens
agtagaaagaaggcactgggcc

SEQ ID NO: 7927633 - DNA, 22 bp, Homo sapiens
agtagaaagttgcaggaggaat

SEQ ID NO: 7927634 - DNA, 22 bp, Homo sapiens
agtagaaagaaggcactgggcc

SEQ ID NO: 7927635 - DNA, 22 bp, Homo sapiens
agtagtcagcagataatatagg

SEQ ID NO: 7927636 - DNA, 22 bp, Homo sapiens
agtagtggcttcctggagtgct

SEQ ID NO: 7927637 - DNA, 22 bp, Homo sapiens
agtagtgaacagccacaggatt

SEQ ID NO: 7927638 - DNA, 22 bp, Homo sapiens
agtagtggcttcctggagtgct

SEQ ID NO: 7927639 - DNA, 22 bp, Homo sapiens
agtagtggggccagggtttgaa

SEQ ID NO: 7927640 - DNA, 20 bp, Homo sapiens
agtaccttttgtatgttacc

SEQ ID NO: 7927641 - DNA, 20 bp, Homo sapiens
agtaccttttgtatgttacc

SEQ ID NO: 7927642 - DNA, 22 bp, Homo sapiens
agtacctttgcatggatttttt

SEQ ID NO: 7927643 - DNA, 22 bp, Homo sapiens
agtacctgatttcacagaccag

SEQ ID NO: 7927644 - DNA, 22 bp, Homo sapiens
agtactttacttcttacagttt

SEQ ID NO: 7927645 - DNA, 22 bp, Homo sapiens
agtacttcagaggctgcccagg

SEQ ID NO: 7927646 - DNA, 22 bp, Homo sapiens
agtacttagaaagttaatataa

SEQ ID NO: 7927647 - DNA, 22 bp, Homo sapiens
agtacctggtatatgattatga

SEQ ID NO: 7927648 - DNA, 22 bp, Homo sapiens
agtactgtcagcagggtgttga

SEQ ID NO: 7927649 - DNA, 22 bp, Homo sapiens
agtactgtcagcagggtgttga

SEQ ID NO: 7927650 - DNA, 22 bp, Homo sapiens
agtactttagcataaagcagtt

SEQ ID NO: 7927651 - DNA, 22 bp, Homo sapiens
agtactttttgttcaattgtgc

SEQ ID NO: 7927652 - DNA, 22 bp, Homo sapiens
agtactttgcactttgctcaga

SEQ ID NO: 7927653 - DNA, 22 bp, Homo sapiens
agtactttgcactttgctcaga

SEQ ID NO: 7927654 - DNA, 22 bp, Homo sapiens
agtcaccctccaactctccact

SEQ ID NO: 7927655 - DNA, 22 bp, Homo sapiens
agtcaccattttcacctgcctc

SEQ ID NO: 7927656 - DNA, 22 bp, Homo sapiens
agtcaccatctgtggcagcctg

SEQ ID NO: 7927657 - DNA, 22 bp, Homo sapiens
actcctgggttccggagattct

SEQ ID NO: 7927658 - DNA, 22 bp, Homo sapiens
actcctgggttccggagattct

SEQ ID NO: 7927659 - DNA, 22 bp, Homo sapiens
actcctgggtgctgaccagcgt

SEQ ID NO: 7927660 - DNA, 22 bp, Homo sapiens
actcctgggtgctgaccagcgt

SEQ ID NO: 7927661 - DNA, 22 bp, Homo sapiens
actcctgggtgctgaccagcgt

SEQ ID NO: 7927662 - DNA, 22 bp, Homo sapiens
actcctggaaaagaacgcaggg

SEQ ID NO: 7927663 - DNA, 22 bp, Homo sapiens
actcctggggatccattccttt

SEQ ID NO: 7927664 - DNA, 22 bp, Homo sapiens
actcctggaaaagaacgcaggg

SEQ ID NO: 7927665 - DNA, 22 bp, Homo sapiens
actcctggggatccattccttt

SEQ ID NO: 7927666 - DNA, 22 bp, Homo sapiens
actcctgggtgcatttctgatt

SEQ ID NO: 7927667 - DNA, 22 bp, Homo sapiens
actcctgggtgctgaccagcgt

SEQ ID NO: 7927668 - DNA, 22 bp, Homo sapiens
actcctgggtgcatttctgatt

SEQ ID NO: 7927669 - DNA, 22 bp, Homo sapiens
actcctggggctgccatcacag

SEQ ID NO: 7927670 - DNA, 22 bp, Homo sapiens
actcctcagccagcatcaggga

SEQ ID NO: 7927671 - DNA, 22 bp, Homo sapiens
actcctcagccagcatcaggga

SEQ ID NO: 7927672 - DNA, 22 bp, Homo sapiens
actcccttgtgaactcattctt

SEQ ID NO: 7927673 - DNA, 22 bp, Homo sapiens
actcccttgtgaactcattctt

SEQ ID NO: 7927674 - DNA, 22 bp, Homo sapiens
actccctgtacttgcctctctt

SEQ ID NO: 7927675 - DNA, 22 bp, Homo sapiens
actcctcagtcaaatagttggt

SEQ ID NO: 7927676 - DNA, 22 bp, Homo sapiens
actcctcagtcaaatagttggt

SEQ ID NO: 7927677 - DNA, 22 bp, Homo sapiens
actcctcagttgcttcttagtt

SEQ ID NO: 7927678 - DNA, 22 bp, Homo sapiens
actcctgccacacagatgctgt

SEQ ID NO: 7927679 - DNA, 22 bp, Homo sapiens
actcctgctgtcactgcagttc

SEQ ID NO: 7927680 - DNA, 22 bp, Homo sapiens
actcctgcttcttccctgagga

SEQ ID NO: 7927681 - DNA, 22 bp, Homo sapiens
actcctgcttcttccctgagga

SEQ ID NO: 7927682 - DNA, 21 bp, Homo sapiens
actccctgcataagtgattta

SEQ ID NO: 7927683 - DNA, 22 bp, Homo sapiens
actccctctctagtccttgcaa

SEQ ID NO: 7927684 - DNA, 22 bp, Homo sapiens
actccctctctagtccttgcaa

SEQ ID NO: 7927685 - DNA, 22 bp, Homo sapiens
actccctctctagtccttgcaa

SEQ ID NO: 7927686 - DNA, 22 bp, Homo sapiens
actccctccaaatctgcacagt

SEQ ID NO: 7927687 - DNA, 22 bp, Homo sapiens
actccagggttttgcacctgga

SEQ ID NO: 7927688 - DNA, 22 bp, Homo sapiens
actccagggttttgcacctgga

SEQ ID NO: 7927689 - DNA, 22 bp, Homo sapiens
actccagggtgactctgtctga

SEQ ID NO: 7927690 - DNA, 22 bp, Homo sapiens
actccagggttttgcacctgga

SEQ ID NO: 7927691 - DNA, 22 bp, Homo sapiens
actccagggtgactctgtctga

SEQ ID NO: 7927692 - DNA, 22 bp, Homo sapiens
agtcacttaataggttcatctg

SEQ ID NO: 7927693 - DNA, 22 bp, Homo sapiens
agtcactgtttaatctagctaa

SEQ ID NO: 7927694 - DNA, 22 bp, Homo sapiens
agtcactgtttcagaactgagt

SEQ ID NO: 7927695 - DNA, 22 bp, Homo sapiens
agtcactgtttcagaactgagt

SEQ ID NO: 7927696 - DNA, 22 bp, Homo sapiens
agtcactgtttcagaactgagt

SEQ ID NO: 7927697 - DNA, 22 bp, Homo sapiens
actctaaatagataaccatgca

SEQ ID NO: 7927698 - DNA, 22 bp, Homo sapiens
actctaaatagataaccatgca

SEQ ID NO: 7927699 - DNA, 22 bp, Homo sapiens
agtcacttccagacacctgcct

SEQ ID NO: 7927700 - DNA, 22 bp, Homo sapiens
actctaaaatgctatgagatct

SEQ ID NO: 7927701 - DNA, 22 bp, Homo sapiens
agtcactgttctgtcatgtcaa

SEQ ID NO: 7927702 - DNA, 22 bp, Homo sapiens
agtcactgtcttgcaaaggtca

SEQ ID NO: 7927703 - DNA, 22 bp, Homo sapiens
agtcactgttctgtcatgtcaa

SEQ ID NO: 7927704 - DNA, 22 bp, Homo sapiens
agtcactgtcaaagccacacac

SEQ ID NO: 7927705 - DNA, 22 bp, Homo sapiens
agtcactggttctgtaattaat

SEQ ID NO: 7927706 - DNA, 22 bp, Homo sapiens
agtcactgtcaaagccacacac

SEQ ID NO: 7927707 - DNA, 22 bp, Homo sapiens
agtcactgggctgcttcctata

SEQ ID NO: 7927708 - DNA, 22 bp, Homo sapiens
agtcactggttctgtaattaat

SEQ ID NO: 7927709 - DNA, 22 bp, Homo sapiens
agtcactgctttgtccctgtgt

SEQ ID NO: 7927710 - DNA, 22 bp, Homo sapiens
agtcactgggctgcttcctata

SEQ ID NO: 7927711 - DNA, 22 bp, Homo sapiens
agtcactgctttgtccctgtgt

SEQ ID NO: 7927712 - DNA, 22 bp, Homo sapiens
agtcactgagatggtgaggcta

SEQ ID NO: 7927713 - DNA, 22 bp, Homo sapiens
agtcactgagatggtgaggcta

SEQ ID NO: 7927714 - DNA, 22 bp, Homo sapiens
agtcactgaataccttaatgtt

SEQ ID NO: 7927715 - DNA, 22 bp, Homo sapiens
actctcccttggagcctcaggc

SEQ ID NO: 7927716 - DNA, 22 bp, Homo sapiens
actctaaatagcctcttaaaca

SEQ ID NO: 7927717 - DNA, 22 bp, Homo sapiens
actctcccttggagcctcaggc

SEQ ID NO: 7927718 - DNA, 23 bp, Homo sapiens
actctctaaggatttgatgcaaa

SEQ ID NO: 7927719 - DNA, 22 bp, Homo sapiens
actctctcacacacgcctatat

SEQ ID NO: 7927720 - DNA, 22 bp, Homo sapiens
actctctcacagcttggctgat

SEQ ID NO: 7927721 - DNA, 22 bp, Homo sapiens
actctctcacacacgcctatat

SEQ ID NO: 7927722 - DNA, 22 bp, Homo sapiens
actctctcacagcttggctgat

SEQ ID NO: 7927723 - DNA, 22 bp, Homo sapiens
actctctgtggttctactttgc

SEQ ID NO: 7927724 - DNA, 22 bp, Homo sapiens
actctcttgggggagagcagag

SEQ ID NO: 7927725 - DNA, 22 bp, Homo sapiens
actctctgtgatggaggccagc

SEQ ID NO: 7927726 - DNA, 22 bp, Homo sapiens
actctctgtctaaatgcagttt

SEQ ID NO: 7927727 - DNA, 22 bp, Homo sapiens
actctctgtgatggaggccagc

SEQ ID NO: 7927728 - DNA, 22 bp, Homo sapiens
actctctgtctaaatgcagttt

SEQ ID NO: 7927729 - DNA, 22 bp, Homo sapiens
actctctgggcatgccccacca

SEQ ID NO: 7927730 - DNA, 22 bp, Homo sapiens
actctctggtattggcaagttt

SEQ ID NO: 7927731 - DNA, 22 bp, Homo sapiens
actctctggtgtagaaagacct

SEQ ID NO: 7927732 - DNA, 22 bp, Homo sapiens
actctctgagctaccaggtgag

SEQ ID NO: 7927733 - DNA, 22 bp, Homo sapiens
aggtcaaaatgcttttcaggtc

SEQ ID NO: 7927734 - DNA, 22 bp, Homo sapiens
aggtcaaaatcaggcagggaag

SEQ ID NO: 7927735 - DNA, 22 bp, Homo sapiens
aggtcaaaatcaggcagggaag

SEQ ID NO: 7927736 - DNA, 22 bp, Homo sapiens
aggtcaaaagcaaggccaggtt

SEQ ID NO: 7927737 - DNA, 22 bp, Homo sapiens
aggtcaaagaacctagctatag

SEQ ID NO: 7927738 - DNA, 23 bp, Homo sapiens
aggtcaaccacaagctgacaaac

SEQ ID NO: 7927739 - DNA, 22 bp, Homo sapiens
aggtcaaggccaaaagagtggt

SEQ ID NO: 7927740 - DNA, 22 bp, Homo sapiens
aggtcaaggccaaaagagtggt

SEQ ID NO: 7927741 - DNA, 22 bp, Homo sapiens
aggtcaagagtaaatttgggta

SEQ ID NO: 7927742 - DNA, 22 bp, Homo sapiens
aggtcaaggttcacaggggatc

SEQ ID NO: 7927743 - DNA, 22 bp, Homo sapiens
aggtcaaggttcacaggggatc

SEQ ID NO: 7927744 - DNA, 22 bp, Homo sapiens
aggtcaagggcaagagtgaggt

SEQ ID NO: 7927745 - DNA, 22 bp, Homo sapiens
aggtcaagggcaagagtgaggt

SEQ ID NO: 7927746 - DNA, 22 bp, Homo sapiens
aggtcaagggcaagagtgaggt

SEQ ID NO: 7927747 - DNA, 22 bp, Homo sapiens
aggtcaagggagctgagggcca

SEQ ID NO: 7927748 - DNA, 22 bp, Homo sapiens
aggtcaaggctgcagtgagctg

SEQ ID NO: 7927749 - DNA, 22 bp, Homo sapiens
aggtcaaggctgcagtgagctg

SEQ ID NO: 7927750 - DNA, 22 bp, Homo sapiens
aggtcaagtttagatagagtta

SEQ ID NO: 7927751 - DNA, 22 bp, Homo sapiens
aggtccaaggtagggcccagac

SEQ ID NO: 7927752 - DNA, 22 bp, Homo sapiens
aggtccaaatgttgagactgat

SEQ ID NO: 7927753 - DNA, 22 bp, Homo sapiens
aggtccacagttcagctgccca

SEQ ID NO: 7927754 - DNA, 22 bp, Homo sapiens
aggtcacacaactgtcagaggc

SEQ ID NO: 7927755 - DNA, 22 bp, Homo sapiens
aggtcatttccttagaggcaga

SEQ ID NO: 7927756 - DNA, 22 bp, Homo sapiens
acccttggttttgcagagctgt

SEQ ID NO: 7927757 - DNA, 22 bp, Homo sapiens
accctttaggttggatgaggat

SEQ ID NO: 7927758 - DNA, 22 bp, Homo sapiens
accctttagaaggcatctcagt

SEQ ID NO: 7927759 - DNA, 19 bp, Homo sapiens
aggtagctcagactcaaag

SEQ ID NO: 7927760 - DNA, 22 bp, Homo sapiens
aggtagctggtgctgggctcct

SEQ ID NO: 7927761 - DNA, 20 bp, Homo sapiens
aggtagctttgcatttttgt

SEQ ID NO: 7927762 - DNA, 22 bp, Homo sapiens
aggtagcttggtgctttcattc

SEQ ID NO: 7927763 - DNA, 22 bp, Homo sapiens
acccttggttttgcagagctgt

SEQ ID NO: 7927764 - DNA, 22 bp, Homo sapiens
acccttcatagaggagaagctg

SEQ ID NO: 7927765 - DNA, 22 bp, Homo sapiens
accctgttatggtgtaacattt

SEQ ID NO: 7927766 - DNA, 22 bp, Homo sapiens
accctgtgtcacagtggcctgt

SEQ ID NO: 7927767 - DNA, 22 bp, Homo sapiens
accctgtgcagagaagtgagcg

SEQ ID NO: 7927768 - DNA, 22 bp, Homo sapiens
accctgtgcagagaagtgagcg

SEQ ID NO: 7927769 - DNA, 22 bp, Homo sapiens
aggtatttcatggagcaagcag

SEQ ID NO: 7927770 - DNA, 22 bp, Homo sapiens
aggtatttcatggagcaagcag

SEQ ID NO: 7927771 - DNA, 22 bp, Homo sapiens
aggtatttcaaagcccacttcc

SEQ ID NO: 7927772 - DNA, 22 bp, Homo sapiens
aggtatttatgagagcacatat

SEQ ID NO: 7927773 - DNA, 22 bp, Homo sapiens
aggtatttcctttaaagaaact

SEQ ID NO: 7927774 - DNA, 22 bp, Homo sapiens
aggtatttcctttaaagaaact

SEQ ID NO: 7927775 - DNA, 19 bp, Homo sapiens
aggtatttgggagatatat

SEQ ID NO: 7927776 - DNA, 22 bp, Homo sapiens
aggtattttatagataagtaaa

SEQ ID NO: 7927777 - DNA, 22 bp, Homo sapiens
aggtattttatagataagtaaa

SEQ ID NO: 7927778 - DNA, 22 bp, Homo sapiens
aggtattttaagtccaccagag

SEQ ID NO: 7927779 - DNA, 22 bp, Homo sapiens
aggtatttgttacagcagcacc

SEQ ID NO: 7927780 - DNA, 22 bp, Homo sapiens
aggtatttgttacagcagcacc

SEQ ID NO: 7927781 - DNA, 19 bp, Homo sapiens
acctttcctttctcagatg

SEQ ID NO: 7927782 - DNA, 19 bp, Homo sapiens
acctttcctttctcagatg

SEQ ID NO: 7927783 - DNA, 22 bp, Homo sapiens
acctttctgcaagttctgggac

SEQ ID NO: 7927784 - DNA, 22 bp, Homo sapiens
acctttgacgctatttaatttg

SEQ ID NO: 7927785 - DNA, 22 bp, Homo sapiens
acctttcacggtatcagacatc

SEQ ID NO: 7927786 - DNA, 22 bp, Homo sapiens
acctttcacggtatcagacatc

SEQ ID NO: 7927787 - DNA, 22 bp, Homo sapiens
acctttcacctcccatcctgtt

SEQ ID NO: 7927788 - DNA, 20 bp, Homo sapiens
acctttcaaatgattcagca

SEQ ID NO: 7927789 - DNA, 22 bp, Homo sapiens
acctttcaggtagtggtgagga

SEQ ID NO: 7927790 - DNA, 22 bp, Homo sapiens
acctttcacggtatcagacatc

SEQ ID NO: 7927791 - DNA, 22 bp, Homo sapiens
acctttccaagtatcaggtggt

SEQ ID NO: 7927792 - DNA, 22 bp, Homo sapiens
acctttcctggctgaccgagga

SEQ ID NO: 7927793 - DNA, 22 bp, Homo sapiens
acctttcattaaagtctgtagt

SEQ ID NO: 7927794 - DNA, 22 bp, Homo sapiens
acctttcattaaagtctgtagt

SEQ ID NO: 7927795 - DNA, 22 bp, Homo sapiens
acctttcagtgccctttctgtc

SEQ ID NO: 7927796 - DNA, 22 bp, Homo sapiens
aggtccagtgctcttggtggtt

SEQ ID NO: 7927797 - DNA, 21 bp, Homo sapiens
aggtccagttctgtcttggac

SEQ ID NO: 7927798 - DNA, 22 bp, Homo sapiens
aggtccagttgccagaatggcc

SEQ ID NO: 7927799 - DNA, 22 bp, Homo sapiens
acctttatgtttgattacaatt

SEQ ID NO: 7927800 - DNA, 22 bp, Homo sapiens
accttcctctaagacatttagc

SEQ ID NO: 7927801 - DNA, 20 bp, Homo sapiens
acctttcaaatgattcagca

SEQ ID NO: 7927802 - DNA, 22 bp, Homo sapiens
acctttcaaagtggctatcact

SEQ ID NO: 7927803 - DNA, 22 bp, Homo sapiens
acctttcaaagtggctatcact

SEQ ID NO: 7927804 - DNA, 22 bp, Homo sapiens
acctttatgtttgattacaatt

SEQ ID NO: 7927805 - DNA, 22 bp, Homo sapiens
aggtccagaggttgaacggtgg

SEQ ID NO: 7927806 - DNA, 22 bp, Homo sapiens
aggtccagaggttgaacggtgg

SEQ ID NO: 7927807 - DNA, 22 bp, Homo sapiens
aggtccagagttgagatacaga

SEQ ID NO: 7927808 - DNA, 22 bp, Homo sapiens
aggtccagcctgccctctctcc

SEQ ID NO: 7927809 - DNA, 22 bp, Homo sapiens
aggtccagactgtgtaccctag

SEQ ID NO: 7927810 - DNA, 22 bp, Homo sapiens
aggtccagaacgtgcctactct

SEQ ID NO: 7927811 - DNA, 22 bp, Homo sapiens
aggtccacagttcagctgccca

SEQ ID NO: 7927812 - DNA, 20 bp, Homo sapiens
aggtccactgaggctgcctc

SEQ ID NO: 7927813 - DNA, 22 bp, Homo sapiens
aggtccagaacgtgcctactct

SEQ ID NO: 7927814 - DNA, 22 bp, Homo sapiens
aggtccagaacgtgcctactct

SEQ ID NO: 7927815 - DNA, 20 bp, Homo sapiens
aggtccactgaggctgcctc

SEQ ID NO: 7927816 - DNA, 22 bp, Homo sapiens
aggtccaggatttgtggggtct

SEQ ID NO: 7927817 - DNA, 22 bp, Homo sapiens
aggtccaggcatttgggttggg

SEQ ID NO: 7927818 - DNA, 22 bp, Homo sapiens
aggtccaggcatttgggttggg

SEQ ID NO: 7927819 - DNA, 22 bp, Homo sapiens
aggtccagctgttgcagcctcc

SEQ ID NO: 7927820 - DNA, 22 bp, Homo sapiens
aggtccagctgttgcagcctcc

SEQ ID NO: 7927821 - DNA, 22 bp, Homo sapiens
aggtccagctgttgcagcctcc

SEQ ID NO: 7927822 - DNA, 22 bp, Homo sapiens
aggtccaggagatttggcaatt

SEQ ID NO: 7927823 - DNA, 22 bp, Homo sapiens
actacatttctcagtacctgaa

SEQ ID NO: 7927824 - DNA, 22 bp, Homo sapiens
actacatttgcagagaagcaat

SEQ ID NO: 7927825 - DNA, 22 bp, Homo sapiens
actaccttatacaaaatgtagg

SEQ ID NO: 7927826 - DNA, 22 bp, Homo sapiens
actacagtccctcatatgttgg

SEQ ID NO: 7927827 - DNA, 22 bp, Homo sapiens
actactggaaactgtagataat

SEQ ID NO: 7927828 - DNA, 22 bp, Homo sapiens
actacttgagctgaggctagca

SEQ ID NO: 7927829 - DNA, 22 bp, Homo sapiens
actactgaatattagttctgaa

SEQ ID NO: 7927830 - DNA, 22 bp, Homo sapiens
actacagtactatatctatagg

SEQ ID NO: 7927831 - DNA, 22 bp, Homo sapiens
actacagtaagggaggcagcat

SEQ ID NO: 7927832 - DNA, 22 bp, Homo sapiens
actacagtactatatctatagg

SEQ ID NO: 7927833 - DNA, 22 bp, Homo sapiens
actaaatctgcagagtttagtg

SEQ ID NO: 7927834 - DNA, 22 bp, Homo sapiens
actaaatatttgagaggtgtag

SEQ ID NO: 7927835 - DNA, 23 bp, Homo sapiens
actacagatactcctgctgtttg

SEQ ID NO: 7927836 - DNA, 22 bp, Homo sapiens
actaaatatttgagaggtgtag

SEQ ID NO: 7927837 - DNA, 22 bp, Homo sapiens
aggtgagaaaacgagggttgca

SEQ ID NO: 7927838 - DNA, 22 bp, Homo sapiens
aggtgagaaaacgagggttgca

SEQ ID NO: 7927839 - DNA, 22 bp, Homo sapiens
aggtgacttaggctgtggctcg

SEQ ID NO: 7927840 - DNA, 22 bp, Homo sapiens
aggtgacttaggctgtggctcg

SEQ ID NO: 7927841 - DNA, 22 bp, Homo sapiens
aggtgactggtttatctggcag

SEQ ID NO: 7927842 - DNA, 22 bp, Homo sapiens
aggtgactggtttatctggcag

SEQ ID NO: 7927843 - DNA, 23 bp, Homo sapiens
actagaaaatgactttctccctg

SEQ ID NO: 7927844 - DNA, 22 bp, Homo sapiens
actagaaaattcctagaaacta

SEQ ID NO: 7927845 - DNA, 22 bp, Homo sapiens
actactttgggccatttgttta

SEQ ID NO: 7927846 - DNA, 22 bp, Homo sapiens
actagaaagaagttttttgaga

SEQ ID NO: 7927847 - DNA, 22 bp, Homo sapiens
actagaaagcaaaagccatttc

SEQ ID NO: 7927848 - DNA, 22 bp, Homo sapiens
actagaaagcactaagctaggc

SEQ ID NO: 7927849 - DNA, 22 bp, Homo sapiens
actagaaattactcagaataaa

SEQ ID NO: 7927850 - DNA, 22 bp, Homo sapiens
actagaaattactcagaataaa

SEQ ID NO: 7927851 - DNA, 22 bp, Homo sapiens
actagaaattactcagaataaa

SEQ ID NO: 7927852 - DNA, 22 bp, Homo sapiens
actagaaattactcagaataaa

SEQ ID NO: 7927853 - DNA, 22 bp, Homo sapiens
aggtgggcaccaggcttgtggt

SEQ ID NO: 7927854 - DNA, 22 bp, Homo sapiens
actagaaagtttccagagttat

SEQ ID NO: 7927855 - DNA, 22 bp, Homo sapiens
actagaaagtttccagagttat

SEQ ID NO: 7927856 - DNA, 22 bp, Homo sapiens
actagaaagtttccagagttat

SEQ ID NO: 7927857 - DNA, 22 bp, Homo sapiens
actagaaagtttccagagttat

SEQ ID NO: 7927858 - DNA, 22 bp, Homo sapiens
aggtgggcaccaggcttgtggt

SEQ ID NO: 7927859 - DNA, 22 bp, Homo sapiens
aggtgggcactccgctcgaggt

SEQ ID NO: 7927860 - DNA, 22 bp, Homo sapiens
aggtgggcactccgctcgaggt

SEQ ID NO: 7927861 - DNA, 22 bp, Homo sapiens
aggtgggcactccgctcgaggt

SEQ ID NO: 7927862 - DNA, 22 bp, Homo sapiens
aggtgggcactccgctcgaggt

SEQ ID NO: 7927863 - DNA, 22 bp, Homo sapiens
aggtgggcactccgctcgaggt

SEQ ID NO: 7927864 - DNA, 21 bp, Homo sapiens
aggtgggcaggtggagtggcc

SEQ ID NO: 7927865 - DNA, 22 bp, Homo sapiens
acgaataaatctatttcacaca

SEQ ID NO: 7927866 - DNA, 22 bp, Homo sapiens
acgacagcacaacagcatcctc

SEQ ID NO: 7927867 - DNA, 22 bp, Homo sapiens
acgagagacagtacatagtctg

SEQ ID NO: 7927868 - DNA, 22 bp, Homo sapiens
accttttttcagaactctaaag

SEQ ID NO: 7927869 - DNA, 22 bp, Homo sapiens
accttttttcagaactctaaag

SEQ ID NO: 7927870 - DNA, 22 bp, Homo sapiens
accttttttcagaactctaaag

SEQ ID NO: 7927871 - DNA, 22 bp, Homo sapiens
accttttttcagaactctaaag

SEQ ID NO: 7927872 - DNA, 22 bp, Homo sapiens
acgaggttggagagttgtttgg

SEQ ID NO: 7927873 - DNA, 22 bp, Homo sapiens
acgaggtgcttccaccatttca

SEQ ID NO: 7927874 - DNA, 22 bp, Homo sapiens
acgatatactgcaagtatggct

SEQ ID NO: 7927875 - DNA, 22 bp, Homo sapiens
aggtctgttggtaccagtgtgg

SEQ ID NO: 7927876 - DNA, 22 bp, Homo sapiens
acgatgatgaaagagaacattc

SEQ ID NO: 7927877 - DNA, 22 bp, Homo sapiens
aggtctgttggtaccagtgtgg

SEQ ID NO: 7927878 - DNA, 22 bp, Homo sapiens
aggtctgtttaacaaagtcagg

SEQ ID NO: 7927879 - DNA, 22 bp, Homo sapiens
aggtcttaggagcatggtgctg

SEQ ID NO: 7927880 - DNA, 22 bp, Homo sapiens
acctttttgttctgttctcagc

SEQ ID NO: 7927881 - DNA, 22 bp, Homo sapiens
acctttttccaaagcttcttac

SEQ ID NO: 7927882 - DNA, 22 bp, Homo sapiens
acctttttccaaagcttcttac

SEQ ID NO: 7927883 - DNA, 22 bp, Homo sapiens
acctttttccaatgagggaagt

SEQ ID NO: 7927884 - DNA, 22 bp, Homo sapiens
accttttccagcttctagaggc

SEQ ID NO: 7927885 - DNA, 22 bp, Homo sapiens
acctttttccaatgagggaagt

SEQ ID NO: 7927886 - DNA, 22 bp, Homo sapiens
accttttccagcttctagaggc

SEQ ID NO: 7927887 - DNA, 22 bp, Homo sapiens
accttttccagcttctagaggc

SEQ ID NO: 7927888 - DNA, 22 bp, Homo sapiens
accttttccagcttctagaggc

SEQ ID NO: 7927889 - DNA, 22 bp, Homo sapiens
accttttcatctgaaactttta

SEQ ID NO: 7927890 - DNA, 22 bp, Homo sapiens
accttttcatctgaaactttta

SEQ ID NO: 7927891 - DNA, 22 bp, Homo sapiens
accttttcatctgaaactttta

SEQ ID NO: 7927892 - DNA, 22 bp, Homo sapiens
aggtgacatcccggcagcagag

SEQ ID NO: 7927893 - DNA, 22 bp, Homo sapiens
aggtgacatgaaaaatgttgag

SEQ ID NO: 7927894 - DNA, 22 bp, Homo sapiens
aggtgactggtttatctggcag

SEQ ID NO: 7927895 - DNA, 22 bp, Homo sapiens
aggtgactggtttatctggcag

SEQ ID NO: 7927896 - DNA, 22 bp, Homo sapiens
aggtgactactattttaaaata

SEQ ID NO: 7927897 - DNA, 19 bp, Homo sapiens
aggtgacatgtgacagcct

SEQ ID NO: 7927898 - DNA, 22 bp, Homo sapiens
aggtgacaggacaggagctggt

SEQ ID NO: 7927899 - DNA, 22 bp, Homo sapiens
aggtgacaggatgcagataaac

SEQ ID NO: 7927900 - DNA, 22 bp, Homo sapiens
aggtgacatcccggcagcagag

SEQ ID NO: 7927901 - DNA, 22 bp, Homo sapiens
aggtgacatcccggcagcagag

SEQ ID NO: 7927902 - DNA, 22 bp, Homo sapiens
aggtgaagttgaggaggcagaa

SEQ ID NO: 7927903 - DNA, 22 bp, Homo sapiens
aggtgaagttaaaaaccagtct

SEQ ID NO: 7927904 - DNA, 20 bp, Homo sapiens
aggtcttccaatcagctcct

SEQ ID NO: 7927905 - DNA, 22 bp, Homo sapiens
aggtcttgatgtgataagagga

SEQ ID NO: 7927906 - DNA, 22 bp, Homo sapiens
aggtgaatgcctgaggcctctg

SEQ ID NO: 7927907 - DNA, 22 bp, Homo sapiens
aggtgacaggacaggagctggt

SEQ ID NO: 7927908 - DNA, 22 bp, Homo sapiens
aggtgaagttgaggaggcagaa

SEQ ID NO: 7927909 - DNA, 22 bp, Homo sapiens
aggtgaagttgaggaggcagaa

SEQ ID NO: 7927910 - DNA, 22 bp, Homo sapiens
aggtgaagttgaggaggcagaa

SEQ ID NO: 7927911 - DNA, 22 bp, Homo sapiens
aggtgaagttgaggaggcagaa

SEQ ID NO: 7927912 - DNA, 22 bp, Homo sapiens
atacatcatttcccatcaatcg

SEQ ID NO: 7927913 - DNA, 22 bp, Homo sapiens
atacatcatttatggaataagg

SEQ ID NO: 7927914 - DNA, 22 bp, Homo sapiens
atacatcatttcccatcaatcg

SEQ ID NO: 7927915 - DNA, 22 bp, Homo sapiens
atacatcatgctccatatattt

SEQ ID NO: 7927916 - DNA, 22 bp, Homo sapiens
atacatcatttatgatgtgtgt

SEQ ID NO: 7927917 - DNA, 22 bp, Homo sapiens
atacatcatgctccatatattt

SEQ ID NO: 7927918 - DNA, 22 bp, Homo sapiens
atacatcatgctccatatattt

SEQ ID NO: 7927919 - DNA, 22 bp, Homo sapiens
actttctgtcatctagacaagt

SEQ ID NO: 7927920 - DNA, 22 bp, Homo sapiens
actttctgtcatctagacaagt

SEQ ID NO: 7927921 - DNA, 22 bp, Homo sapiens
actttctgtcatctagacaagt

SEQ ID NO: 7927922 - DNA, 22 bp, Homo sapiens
actttctgccttacaggagtcc

SEQ ID NO: 7927923 - DNA, 22 bp, Homo sapiens
actttctgccttacaggagtcc

SEQ ID NO: 7927924 - DNA, 22 bp, Homo sapiens
actttctgcagtgttggaaatg

SEQ ID NO: 7927925 - DNA, 22 bp, Homo sapiens
actttgcaatgggcagaaccca

SEQ ID NO: 7927926 - DNA, 22 bp, Homo sapiens
actttgcaaggtactaactgta

SEQ ID NO: 7927927 - DNA, 18 bp, Homo sapiens
actttgcaggctcccatt

SEQ ID NO: 7927928 - DNA, 22 bp, Homo sapiens
actttgcagagccagaagagaa

SEQ ID NO: 7927929 - DNA, 23 bp, Homo sapiens
actttgcagagccccttgaaaca

SEQ ID NO: 7927930 - DNA, 22 bp, Homo sapiens
actttgcaggtacatgagcatc

SEQ ID NO: 7927931 - DNA, 22 bp, Homo sapiens
actttgcaggtacatgagcatc

SEQ ID NO: 7927932 - DNA, 22 bp, Homo sapiens
actttggaaattgtctataaga

SEQ ID NO: 7927933 - DNA, 22 bp, Homo sapiens
actttggaagatggctgtattt

SEQ ID NO: 7927934 - DNA, 22 bp, Homo sapiens
actttggaaattgtctataaga

SEQ ID NO: 7927935 - DNA, 22 bp, Homo sapiens
actttgctgcaggtttaaagag

SEQ ID NO: 7927936 - DNA, 22 bp, Homo sapiens
actttggaaattgtctataaga

SEQ ID NO: 7927937 - DNA, 22 bp, Homo sapiens
actttggaagatggctgtattt

SEQ ID NO: 7927938 - DNA, 22 bp, Homo sapiens
actttggaagatggctgtattt

SEQ ID NO: 7927939 - DNA, 22 bp, Homo sapiens
actttggaataagctatataac

SEQ ID NO: 7927940 - DNA, 22 bp, Homo sapiens
actttggaataagctatataac

SEQ ID NO: 7927941 - DNA, 22 bp, Homo sapiens
actttggacaatttattactgt

SEQ ID NO: 7927942 - DNA, 22 bp, Homo sapiens
actttgctcatattgagtttct

SEQ ID NO: 7927943 - DNA, 22 bp, Homo sapiens
actttgctcatattgagtttct

SEQ ID NO: 7927944 - DNA, 22 bp, Homo sapiens
actttgccttcttactgtgttg

SEQ ID NO: 7927945 - DNA, 20 bp, Homo sapiens
atagatatcatctttagaag

SEQ ID NO: 7927946 - DNA, 20 bp, Homo sapiens
atagatatcatctttagaag

SEQ ID NO: 7927947 - DNA, 22 bp, Homo sapiens
atagatatttgagttgtttcca

SEQ ID NO: 7927948 - DNA, 22 bp, Homo sapiens
atagatatttgagttgtttcca

SEQ ID NO: 7927949 - DNA, 22 bp, Homo sapiens
atagatattagcaaaattttat

SEQ ID NO: 7927950 - DNA, 22 bp, Homo sapiens
atagatattagcaaaattttat

SEQ ID NO: 7927951 - DNA, 22 bp, Homo sapiens
actttgttcctttcacaaagaa

SEQ ID NO: 7927952 - DNA, 22 bp, Homo sapiens
actttgttcctttcacaaagaa

SEQ ID NO: 7927953 - DNA, 23 bp, Homo sapiens
acttttcaattagctatgcttaa

SEQ ID NO: 7927954 - DNA, 23 bp, Homo sapiens
acttttcaattagctatgcttaa

SEQ ID NO: 7927955 - DNA, 22 bp, Homo sapiens
acttttcaaatgggaaactcag

SEQ ID NO: 7927956 - DNA, 23 bp, Homo sapiens
acttttcaattagctatgcttaa

SEQ ID NO: 7927957 - DNA, 22 bp, Homo sapiens
actttgtgcccaacagaaagaa

SEQ ID NO: 7927958 - DNA, 22 bp, Homo sapiens
atagatcaattctgcttccaca

SEQ ID NO: 7927959 - DNA, 22 bp, Homo sapiens
atagatcaatgagcaatttaat

SEQ ID NO: 7927960 - DNA, 22 bp, Homo sapiens
atagatcaatgagcaatttaat

SEQ ID NO: 7927961 - DNA, 22 bp, Homo sapiens
actttgggacccagccaaccct

SEQ ID NO: 7927962 - DNA, 22 bp, Homo sapiens
atagagtacagtctttgattat

SEQ ID NO: 7927963 - DNA, 22 bp, Homo sapiens
atagagttttattttccaataa

SEQ ID NO: 7927964 - DNA, 22 bp, Homo sapiens
atagagtgatgtaaggtatgtg

SEQ ID NO: 7927965 - DNA, 22 bp, Homo sapiens
atagagttgagttcaaatatgt

SEQ ID NO: 7927966 - DNA, 22 bp, Homo sapiens
atagagttttattttccaataa

SEQ ID NO: 7927967 - DNA, 22 bp, Homo sapiens
atagatacattgttatatttgt

SEQ ID NO: 7927968 - DNA, 22 bp, Homo sapiens
atagatacattaggtaacttgt

SEQ ID NO: 7927969 - DNA, 22 bp, Homo sapiens
atagatacattgttatatttgt

SEQ ID NO: 7927970 - DNA, 22 bp, Homo sapiens
actttggcacagaacttccatt

SEQ ID NO: 7927971 - DNA, 22 bp, Homo sapiens
actttggattgggtccctccca

SEQ ID NO: 7927972 - DNA, 22 bp, Homo sapiens
actttgggaagctgcaattgcc

SEQ ID NO: 7927973 - DNA, 22 bp, Homo sapiens
actttgggaagctgcaattgcc

SEQ ID NO: 7927974 - DNA, 22 bp, Homo sapiens
actttggagggtgttgtagatg

SEQ ID NO: 7927975 - DNA, 22 bp, Homo sapiens
actttggagggtgttgtagatg

SEQ ID NO: 7927976 - DNA, 22 bp, Homo sapiens
actttggatctgatgtaatcag

SEQ ID NO: 7927977 - DNA, 22 bp, Homo sapiens
actttggatctgatgtaatcag

SEQ ID NO: 7927978 - DNA, 22 bp, Homo sapiens
actttggacaatttattactgt

SEQ ID NO: 7927979 - DNA, 22 bp, Homo sapiens
actttggacaatttattactgt

SEQ ID NO: 7927980 - DNA, 22 bp, Homo sapiens
actttggacgccatgctgtttg

SEQ ID NO: 7927981 - DNA, 22 bp, Homo sapiens
actttggacgccatgctgtttg

SEQ ID NO: 7927982 - DNA, 22 bp, Homo sapiens
actttggacgccatgctgtttg

SEQ ID NO: 7927983 - DNA, 17 bp, Homo sapiens
actttggaggcagctgt

SEQ ID NO: 7927984 - DNA, 22 bp, Homo sapiens
actttggagggtgttgtagatg

SEQ ID NO: 7927985 - DNA, 17 bp, Homo sapiens
actttggaggcagctgt

SEQ ID NO: 7927986 - DNA, 22 bp, Homo sapiens
atacaaaaattagccgggagta

SEQ ID NO: 7927987 - DNA, 22 bp, Homo sapiens
atacaaaatatatactggagac

SEQ ID NO: 7927988 - DNA, 22 bp, Homo sapiens
atacaaaaattagccgggagta

SEQ ID NO: 7927989 - DNA, 22 bp, Homo sapiens
ataatttttgtttgatgtccaa

SEQ ID NO: 7927990 - DNA, 22 bp, Homo sapiens
ataatttttgtttgatgtccaa

SEQ ID NO: 7927991 - DNA, 22 bp, Homo sapiens
ataatttttgtttgatgtccaa

SEQ ID NO: 7927992 - DNA, 22 bp, Homo sapiens
atacaaaaattagccgggagta

SEQ ID NO: 7927993 - DNA, 22 bp, Homo sapiens
atacaaaaattagccgggagta

SEQ ID NO: 7927994 - DNA, 22 bp, Homo sapiens
atacaaaaattagccgggagta

SEQ ID NO: 7927995 - DNA, 22 bp, Homo sapiens
atacaaaaattagccgggagta

SEQ ID NO: 7927996 - DNA, 22 bp, Homo sapiens
atacaaaaattagccgggagta

SEQ ID NO: 7927997 - DNA, 22 bp, Homo sapiens
atacaaaaattagccgggagta

SEQ ID NO: 7927998 - DNA, 22 bp, Homo sapiens
atacaaaaattagccgggagta

SEQ ID NO: 7927999 - DNA, 22 bp, Homo sapiens
atacaaaaattagccgggagta

SEQ ID NO: 7928000 - DNA, 22 bp, Homo sapiens
acttctctggttgaggtccaat

SEQ ID NO: 7928001 - DNA, 22 bp, Homo sapiens
ataatttttgtttgatgtccaa

SEQ ID NO: 7928002 - DNA, 22 bp, Homo sapiens
ataatttttgtttgatgtccaa

SEQ ID NO: 7928003 - DNA, 22 bp, Homo sapiens
ataatttttgtttgatgtccaa

SEQ ID NO: 7928004 - DNA, 22 bp, Homo sapiens
acttctcttcataggtggcaat

SEQ ID NO: 7928005 - DNA, 22 bp, Homo sapiens
acttctcttcataggtggcaat

SEQ ID NO: 7928006 - DNA, 22 bp, Homo sapiens
acttctctgctacctgcaaaga

SEQ ID NO: 7928007 - DNA, 22 bp, Homo sapiens
acttctctgctacctgcaaaga

SEQ ID NO: 7928008 - DNA, 22 bp, Homo sapiens
acttctctgctacctgcaaaga

SEQ ID NO: 7928009 - DNA, 22 bp, Homo sapiens
acttctctgctacctgcaaaga

SEQ ID NO: 7928010 - DNA, 22 bp, Homo sapiens
acttctctcattcagacatagc

SEQ ID NO: 7928011 - DNA, 22 bp, Homo sapiens
acttctctcattcagacatagc

SEQ ID NO: 7928012 - DNA, 22 bp, Homo sapiens
acttctctccacccaagtccct

SEQ ID NO: 7928013 - DNA, 22 bp, Homo sapiens
acttctctcattcagacatagc

SEQ ID NO: 7928014 - DNA, 22 bp, Homo sapiens
acttctctccacccaagtccct

SEQ ID NO: 7928015 - DNA, 22 bp, Homo sapiens
atacaaaatatatactggagac

SEQ ID NO: 7928016 - DNA, 22 bp, Homo sapiens
atacaaaatatatactggagac

SEQ ID NO: 7928017 - DNA, 22 bp, Homo sapiens
atacaaaatatatactggagac

SEQ ID NO: 7928018 - DNA, 22 bp, Homo sapiens
atacaaaatatatactggagac

SEQ ID NO: 7928019 - DNA, 22 bp, Homo sapiens
atacaaaatatatactggagac

SEQ ID NO: 7928020 - DNA, 22 bp, Homo sapiens
atacaaaatatatactggagac

SEQ ID NO: 7928021 - DNA, 22 bp, Homo sapiens
atacaaaatatatactggagac

SEQ ID NO: 7928022 - DNA, 22 bp, Homo sapiens
atacaaaatatatactggagac

SEQ ID NO: 7928023 - DNA, 22 bp, Homo sapiens
atacaaaatatatactggagac

SEQ ID NO: 7928024 - DNA, 22 bp, Homo sapiens
atacaaaatatatactggagac

SEQ ID NO: 7928025 - DNA, 22 bp, Homo sapiens
atacaaaatatatactggagac

SEQ ID NO: 7928026 - DNA, 22 bp, Homo sapiens
atacaaaatatatactggagac

SEQ ID NO: 7928027 - DNA, 22 bp, Homo sapiens
atacaaaatatatactggagac

SEQ ID NO: 7928028 - DNA, 22 bp, Homo sapiens
atacaaaatatatactggagac

SEQ ID NO: 7928029 - DNA, 22 bp, Homo sapiens
actttaaaactgatcatcagag

SEQ ID NO: 7928030 - DNA, 22 bp, Homo sapiens
actttaaaactgatcatcagag

SEQ ID NO: 7928031 - DNA, 22 bp, Homo sapiens
atacaaagacaaatctcaatct

SEQ ID NO: 7928032 - DNA, 22 bp, Homo sapiens
acttggttgcttctgaaatgac

SEQ ID NO: 7928033 - DNA, 22 bp, Homo sapiens
acttggttggtctcaccctgtt

SEQ ID NO: 7928034 - DNA, 22 bp, Homo sapiens
actttaaaactgatcatcagag

SEQ ID NO: 7928035 - DNA, 22 bp, Homo sapiens
actttaaaactgatcatcagag

SEQ ID NO: 7928036 - DNA, 22 bp, Homo sapiens
atacaaaatatatactggagac

SEQ ID NO: 7928037 - DNA, 23 bp, Homo sapiens
atacaaaccttgcaggacatgtt

SEQ ID NO: 7928038 - DNA, 23 bp, Homo sapiens
atacaaaccttgcaggacatgtt

SEQ ID NO: 7928039 - DNA, 22 bp, Homo sapiens
atacaaagacaaatctcaatct

SEQ ID NO: 7928040 - DNA, 22 bp, Homo sapiens
acttggttgcaaatgaattatt

SEQ ID NO: 7928041 - DNA, 22 bp, Homo sapiens
acttggttgatgtcataaggtt

SEQ ID NO: 7928042 - DNA, 22 bp, Homo sapiens
acttggttgcaaatgaattatt

SEQ ID NO: 7928043 - DNA, 22 bp, Homo sapiens
atacatatccacaggagataaa

SEQ ID NO: 7928044 - DNA, 22 bp, Homo sapiens
atacatatccacaggagataaa

SEQ ID NO: 7928045 - DNA, 20 bp, Homo sapiens
actttacagagaagactgac

SEQ ID NO: 7928046 - DNA, 20 bp, Homo sapiens
actttacagagaagactgac

SEQ ID NO: 7928047 - DNA, 21 bp, Homo sapiens
actttacaatttacatagtga

SEQ ID NO: 7928048 - DNA, 22 bp, Homo sapiens
atacatcacctatatattcaca

SEQ ID NO: 7928049 - DNA, 22 bp, Homo sapiens
atacatcatgctccatatattt

SEQ ID NO: 7928050 - DNA, 22 bp, Homo sapiens
atacatcacctatatattcaca

SEQ ID NO: 7928051 - DNA, 22 bp, Homo sapiens
atacatcaatttcttagttatc

SEQ ID NO: 7928052 - DNA, 22 bp, Homo sapiens
atacatcacctatatattcaca

SEQ ID NO: 7928053 - DNA, 22 bp, Homo sapiens
atacatcacctatatattcaca

SEQ ID NO: 7928054 - DNA, 22 bp, Homo sapiens
atacatcaatttcttagttatc

SEQ ID NO: 7928055 - DNA, 22 bp, Homo sapiens
atacatcaaggatgatggtgta

SEQ ID NO: 7928056 - DNA, 22 bp, Homo sapiens
atacatcaatttcttagttatc

SEQ ID NO: 7928057 - DNA, 22 bp, Homo sapiens
atacatatgaatgatttggctc

SEQ ID NO: 7928058 - DNA, 22 bp, Homo sapiens
atacatatgaatgatttggctc

SEQ ID NO: 7928059 - DNA, 22 bp, Homo sapiens
atacatcaaggatgatggtgta

SEQ ID NO: 7928060 - DNA, 21 bp, Homo sapiens
actttaatatacatgaggagg

SEQ ID NO: 7928061 - DNA, 22 bp, Homo sapiens
actttaagatatttgaaaacag

SEQ ID NO: 7928062 - DNA, 22 bp, Homo sapiens
actttaactgttattactcacc

SEQ ID NO: 7928063 - DNA, 22 bp, Homo sapiens
actttaaagcagaatggctatg

SEQ ID NO: 7928064 - DNA, 22 bp, Homo sapiens
actttaaggaggcactcatctc

SEQ ID NO: 7928065 - DNA, 22 bp, Homo sapiens
actttaaagcagaatggctatg

SEQ ID NO: 7928066 - DNA, 22 bp, Homo sapiens
actttaaagcagaatggctatg

SEQ ID NO: 7928067 - DNA, 22 bp, Homo sapiens
actttaaagcagaatggctatg

SEQ ID NO: 7928068 - DNA, 22 bp, Homo sapiens
actttaaagcagaatggctatg

SEQ ID NO: 7928069 - DNA, 22 bp, Homo sapiens
actttaaagcagaatggctatg

SEQ ID NO: 7928070 - DNA, 22 bp, Homo sapiens
actttacaagcttatagcctag

SEQ ID NO: 7928071 - DNA, 22 bp, Homo sapiens
actttacaatatcctgtgactt

SEQ ID NO: 7928072 - DNA, 21 bp, Homo sapiens
actttacaatttacatagtga

SEQ ID NO: 7928073 - DNA, 21 bp, Homo sapiens
actttacaatttacatagtga

SEQ ID NO: 7928074 - DNA, 21 bp, Homo sapiens
actttacaatttacatagtga

SEQ ID NO: 7928075 - DNA, 21 bp, Homo sapiens
actttacaatttacatagtga

SEQ ID NO: 7928076 - DNA, 22 bp, Homo sapiens
acttccttgtactgactccatt

SEQ ID NO: 7928077 - DNA, 22 bp, Homo sapiens
acttccttttgggaaactgttt

SEQ ID NO: 7928078 - DNA, 18 bp, Homo sapiens
acttctcatttctctgca

SEQ ID NO: 7928079 - DNA, 22 bp, Homo sapiens
acttctatgcacagagcttgga

SEQ ID NO: 7928080 - DNA, 22 bp, Homo sapiens
acttctatgcacagagcttgga

SEQ ID NO: 7928081 - DNA, 22 bp, Homo sapiens
acttcctgtaaatagaattcca

SEQ ID NO: 7928082 - DNA, 22 bp, Homo sapiens
acttcctgtaaatagaattcca

SEQ ID NO: 7928083 - DNA, 22 bp, Homo sapiens
acttcctgggtgttgtaaggtc

SEQ ID NO: 7928084 - DNA, 22 bp, Homo sapiens
acttcctgtatttatccatagc

SEQ ID NO: 7928085 - DNA, 22 bp, Homo sapiens
acttcctgtaaatagaattcca

SEQ ID NO: 7928086 - DNA, 22 bp, Homo sapiens
acttcctgggcatgcagagtcc

SEQ ID NO: 7928087 - DNA, 22 bp, Homo sapiens
acttcctgttatgtgtgcctct

SEQ ID NO: 7928088 - DNA, 22 bp, Homo sapiens
acttcctgttatgtgtgcctct

SEQ ID NO: 7928089 - DNA, 22 bp, Homo sapiens
acttccttccaaacattcattt

SEQ ID NO: 7928090 - DNA, 22 bp, Homo sapiens
acttcctgtatttatccatagc

SEQ ID NO: 7928091 - DNA, 19 bp, Homo sapiens
ataaataaaaagtgggaga

SEQ ID NO: 7928092 - DNA, 19 bp, Homo sapiens
ataaataaaaagtgggaga

SEQ ID NO: 7928093 - DNA, 19 bp, Homo sapiens
ataaataaaaagtgggaga

SEQ ID NO: 7928094 - DNA, 22 bp, Homo sapiens
acttccagcaacttggtgctat

SEQ ID NO: 7928095 - DNA, 22 bp, Homo sapiens
acttccagcaacttggtgctat

SEQ ID NO: 7928096 - DNA, 22 bp, Homo sapiens
acttccagcacctcaagcggaa

SEQ ID NO: 7928097 - DNA, 19 bp, Homo sapiens
ataaataaaaagtgggaga

SEQ ID NO: 7928098 - DNA, 22 bp, Homo sapiens
acttccagcacctcaagcggaa

SEQ ID NO: 7928099 - DNA, 22 bp, Homo sapiens
acttccagcacctcaagcggaa

SEQ ID NO: 7928100 - DNA, 22 bp, Homo sapiens
acttccagcacctcaagcggaa

SEQ ID NO: 7928101 - DNA, 22 bp, Homo sapiens
acttccagcccctgtcagcaaa

SEQ ID NO: 7928102 - DNA, 22 bp, Homo sapiens
acttccagcccctgtcagcaaa

SEQ ID NO: 7928103 - DNA, 22 bp, Homo sapiens
acttccagcccctgtcagcaaa

SEQ ID NO: 7928104 - DNA, 22 bp, Homo sapiens
acttccagctaggttctgctaa

SEQ ID NO: 7928105 - DNA, 22 bp, Homo sapiens
acttccagctaggttctgctaa

SEQ ID NO: 7928106 - DNA, 22 bp, Homo sapiens
ataaagtttaaaagtcaatagt

SEQ ID NO: 7928107 - DNA, 22 bp, Homo sapiens
ataaagtttaaaagtcaatagt

SEQ ID NO: 7928108 - DNA, 22 bp, Homo sapiens
ataaagtttaaaagtcaatagt

SEQ ID NO: 7928109 - DNA, 22 bp, Homo sapiens
ataaagtttaaaagtcaatagt

SEQ ID NO: 7928110 - DNA, 22 bp, Homo sapiens
ataaagttctgctggcatatat

SEQ ID NO: 7928111 - DNA, 22 bp, Homo sapiens
ataaagttctgctggcatatat

SEQ ID NO: 7928112 - DNA, 19 bp, Homo sapiens
ataaataaaaagtgggaga

SEQ ID NO: 7928113 - DNA, 19 bp, Homo sapiens
ataaataaaaagtgggaga

SEQ ID NO: 7928114 - DNA, 19 bp, Homo sapiens
ataaataaaaagtgggaga

SEQ ID NO: 7928115 - DNA, 19 bp, Homo sapiens
ataaataaaaagtgggaga

SEQ ID NO: 7928116 - DNA, 21 bp, Homo sapiens
ataaagttttacaggaatgca

SEQ ID NO: 7928117 - DNA, 21 bp, Homo sapiens
ataaagttttacaggaatgca

SEQ ID NO: 7928118 - DNA, 21 bp, Homo sapiens
ataaagttttacaggaatgca

SEQ ID NO: 7928119 - DNA, 22 bp, Homo sapiens
actgtttagtaaattgaaatgg

SEQ ID NO: 7928120 - DNA, 22 bp, Homo sapiens
actgtttagtaaattgaaatgg

SEQ ID NO: 7928121 - DNA, 22 bp, Homo sapiens
actgtttctcaaattatgtggt

SEQ ID NO: 7928122 - DNA, 22 bp, Homo sapiens
actgtttctgccacaatagccc

SEQ ID NO: 7928123 - DNA, 22 bp, Homo sapiens
actgtttctcaaattatgtggt

SEQ ID NO: 7928124 - DNA, 22 bp, Homo sapiens
actgtttctgccacaatagccc

SEQ ID NO: 7928125 - DNA, 22 bp, Homo sapiens
actgttttctgtaaagggccag

SEQ ID NO: 7928126 - DNA, 22 bp, Homo sapiens
actgttttctgtaaagggccag

SEQ ID NO: 7928127 - DNA, 22 bp, Homo sapiens
actgttttctaaagaacagatg

SEQ ID NO: 7928128 - DNA, 22 bp, Homo sapiens
actgttttctgtaaagggccag

SEQ ID NO: 7928129 - DNA, 22 bp, Homo sapiens
actgtttgctgatagatattta

SEQ ID NO: 7928130 - DNA, 22 bp, Homo sapiens
actgtttctgccacaatagccc

SEQ ID NO: 7928131 - DNA, 22 bp, Homo sapiens
actgttttcctaatgagcaaga

SEQ ID NO: 7928132 - DNA, 22 bp, Homo sapiens
actgttttcttagctccctgct

SEQ ID NO: 7928133 - DNA, 22 bp, Homo sapiens
actgttttctgtaaagggccag

SEQ ID NO: 7928134 - DNA, 22 bp, Homo sapiens
actgttttctgtaaagggccag

SEQ ID NO: 7928135 - DNA, 22 bp, Homo sapiens
actgttttcttagctccctgct

SEQ ID NO: 7928136 - DNA, 22 bp, Homo sapiens
acttaaaaagaatcttttcacg

SEQ ID NO: 7928137 - DNA, 22 bp, Homo sapiens
acttaaaaacagatccagcagg

SEQ ID NO: 7928138 - DNA, 22 bp, Homo sapiens
acttaaaaacagatccagcagg

SEQ ID NO: 7928139 - DNA, 22 bp, Homo sapiens
acttaaaaacagatccagcagg

SEQ ID NO: 7928140 - DNA, 22 bp, Homo sapiens
acttaaaaacagatccagcagg

SEQ ID NO: 7928141 - DNA, 22 bp, Homo sapiens
acttaaaaacagatccagcagg

SEQ ID NO: 7928142 - DNA, 18 bp, Homo sapiens
ataaagtgctaataatgg

SEQ ID NO: 7928143 - DNA, 18 bp, Homo sapiens
ataaagtgctaataatgg

SEQ ID NO: 7928144 - DNA, 18 bp, Homo sapiens
ataaagtgctaataatgg

SEQ ID NO: 7928145 - DNA, 18 bp, Homo sapiens
ataaagtgctaataatgg

SEQ ID NO: 7928146 - DNA, 22 bp, Homo sapiens
ataaagtctgggccaggcatgg

SEQ ID NO: 7928147 - DNA, 22 bp, Homo sapiens
ataaagtctaccgtattaaaga

SEQ ID NO: 7928148 - DNA, 22 bp, Homo sapiens
ataaagtcatggcagctagaat

SEQ ID NO: 7928149 - DNA, 22 bp, Homo sapiens
ataaagtcatggcagctagaat

SEQ ID NO: 7928150 - DNA, 22 bp, Homo sapiens
acttaaaaagaatcttttcacg

SEQ ID NO: 7928151 - DNA, 22 bp, Homo sapiens
acttaaaaagaatcttttcacg

SEQ ID NO: 7928152 - DNA, 22 bp, Homo sapiens
acttaaaaagaatcttttcacg

SEQ ID NO: 7928153 - DNA, 22 bp, Homo sapiens
acttaaaaccagacagcgtcat

SEQ ID NO: 7928154 - DNA, 22 bp, Homo sapiens
acttaaaaccagacagcgtcat

SEQ ID NO: 7928155 - DNA, 22 bp, Homo sapiens
acttaaaaccagacagcgtcat

SEQ ID NO: 7928156 - DNA, 22 bp, Homo sapiens
acttaaagtagttttactgtgg

SEQ ID NO: 7928157 - DNA, 22 bp, Homo sapiens
acttaaagtagttttactgtgg

SEQ ID NO: 7928158 - DNA, 22 bp, Homo sapiens
acttaaagaggctacttttggt

SEQ ID NO: 7928159 - DNA, 22 bp, Homo sapiens
ataaagtagctttcagtgccaa

SEQ ID NO: 7928160 - DNA, 22 bp, Homo sapiens
agtttttcctgattttacagaa

SEQ ID NO: 7928161 - DNA, 22 bp, Homo sapiens
agtttttcctgattttacagaa

SEQ ID NO: 7928162 - DNA, 22 bp, Homo sapiens
agtttttcctgattttacagaa

SEQ ID NO: 7928163 - DNA, 22 bp, Homo sapiens
agtttttccgtggctacgataa

SEQ ID NO: 7928164 - DNA, 21 bp, Homo sapiens
agtttttactcttaactgtgg

SEQ ID NO: 7928165 - DNA, 18 bp, Homo sapiens
agtttttaggaagaaatg

SEQ ID NO: 7928166 - DNA, 21 bp, Homo sapiens
agtttttactcttaactgtgg

SEQ ID NO: 7928167 - DNA, 21 bp, Homo sapiens
agtttttactcttaactgtgg

SEQ ID NO: 7928168 - DNA, 21 bp, Homo sapiens
agtttttactcttaactgtgg

SEQ ID NO: 7928169 - DNA, 23 bp, Homo sapiens
agtttttaatggtcatagctgag

SEQ ID NO: 7928170 - DNA, 23 bp, Homo sapiens
agtttttaatggtcatagctgag

SEQ ID NO: 7928171 - DNA, 23 bp, Homo sapiens
agtttttaatggtcatagctgag

SEQ ID NO: 7928172 - DNA, 23 bp, Homo sapiens
agtttttaatggtcatagctgag

SEQ ID NO: 7928173 - DNA, 22 bp, Homo sapiens
agttttatgtagacaattcatt

SEQ ID NO: 7928174 - DNA, 22 bp, Homo sapiens
agttttatgtagacaattcatt

SEQ ID NO: 7928175 - DNA, 22 bp, Homo sapiens
agttttatggctcaacctaata

SEQ ID NO: 7928176 - DNA, 22 bp, Homo sapiens
agttttatgtagacaattcatt

SEQ ID NO: 7928177 - DNA, 22 bp, Homo sapiens
agttttatgtagacaattcatt

SEQ ID NO: 7928178 - DNA, 22 bp, Homo sapiens
actgtttaaaggcttcctttct

SEQ ID NO: 7928179 - DNA, 22 bp, Homo sapiens
actgtttaaaggcttcctttct

SEQ ID NO: 7928180 - DNA, 22 bp, Homo sapiens
actgtttaggaggcttatatgc

SEQ ID NO: 7928181 - DNA, 22 bp, Homo sapiens
actgtttaggaggcttatatgc

SEQ ID NO: 7928182 - DNA, 22 bp, Homo sapiens
actgtttaaatatttgggctgg

SEQ ID NO: 7928183 - DNA, 22 bp, Homo sapiens
actgttgtcaggctgctttgga

SEQ ID NO: 7928184 - DNA, 22 bp, Homo sapiens
actgttgtcaggctgctttgga

SEQ ID NO: 7928185 - DNA, 22 bp, Homo sapiens
actgttcaagcaaatgacattg

SEQ ID NO: 7928186 - DNA, 21 bp, Homo sapiens
actgttattcccattttcacc

SEQ ID NO: 7928187 - DNA, 22 bp, Homo sapiens
ataaaaactgacccatcctttg

SEQ ID NO: 7928188 - DNA, 22 bp, Homo sapiens
ataaaaactgacccatcctttg

SEQ ID NO: 7928189 - DNA, 22 bp, Homo sapiens
actgttatttcaccactactga

SEQ ID NO: 7928190 - DNA, 22 bp, Homo sapiens
actgttatttgtaatccattat

SEQ ID NO: 7928191 - DNA, 22 bp, Homo sapiens
agtttttctcccctggcttcat

SEQ ID NO: 7928192 - DNA, 22 bp, Homo sapiens
agtttttctcccctggcttcat

SEQ ID NO: 7928193 - DNA, 23 bp, Homo sapiens
agtttttctgcatggttctgtat

SEQ ID NO: 7928194 - DNA, 23 bp, Homo sapiens
agtttttctgcatggttctgtat

SEQ ID NO: 7928195 - DNA, 22 bp, Homo sapiens
agtttttctgctggtctcacta

SEQ ID NO: 7928196 - DNA, 22 bp, Homo sapiens
agtttttctgggaggcactgct

SEQ ID NO: 7928197 - DNA, 22 bp, Homo sapiens
ataaaaactgacccatcctttg

SEQ ID NO: 7928198 - DNA, 22 bp, Homo sapiens
ataaaaactgacccatcctttg

SEQ ID NO: 7928199 - DNA, 19 bp, Homo sapiens
agtttttggaaatcctgct

SEQ ID NO: 7928200 - DNA, 22 bp, Homo sapiens
agtttttgctgatagcatgctt

SEQ ID NO: 7928201 - DNA, 22 bp, Homo sapiens
agtttttgagaatttactatgt

SEQ ID NO: 7928202 - DNA, 22 bp, Homo sapiens
actgggctcccaggcttgtcat

SEQ ID NO: 7928203 - DNA, 22 bp, Homo sapiens
agtttctaccggtacattcagg

SEQ ID NO: 7928204 - DNA, 22 bp, Homo sapiens
actgggctcccaggcttgtcat

SEQ ID NO: 7928205 - DNA, 22 bp, Homo sapiens
agtttctaccggtacattcagg

SEQ ID NO: 7928206 - DNA, 22 bp, Homo sapiens
agtttctaccggtacattcagg

SEQ ID NO: 7928207 - DNA, 22 bp, Homo sapiens
actgggctcataatgtcataga

SEQ ID NO: 7928208 - DNA, 22 bp, Homo sapiens
actgggctcataatgtcataga

SEQ ID NO: 7928209 - DNA, 21 bp, Homo sapiens
actgggctagcctgacttctg

SEQ ID NO: 7928210 - DNA, 22 bp, Homo sapiens
actgggctccagatgtgatacg

SEQ ID NO: 7928211 - DNA, 22 bp, Homo sapiens
actgggctccaaggacctggag

SEQ ID NO: 7928212 - DNA, 22 bp, Homo sapiens
actgggctccaaggacctggag

SEQ ID NO: 7928213 - DNA, 22 bp, Homo sapiens
actgggctccaaggacctggag

SEQ ID NO: 7928214 - DNA, 22 bp, Homo sapiens
actgggctccaaggacctggag

SEQ ID NO: 7928215 - DNA, 22 bp, Homo sapiens
actgggctaccccaccattacc

SEQ ID NO: 7928216 - DNA, 22 bp, Homo sapiens
actgggccttgtgtgtctcatc

SEQ ID NO: 7928217 - DNA, 22 bp, Homo sapiens
actgggccttgtgtgtctcatc

SEQ ID NO: 7928218 - DNA, 22 bp, Homo sapiens
actgggccttgccatggcagcc

SEQ ID NO: 7928219 - DNA, 22 bp, Homo sapiens
actgggccttgtgtgtctcatc

SEQ ID NO: 7928220 - DNA, 22 bp, Homo sapiens
actgggccttgtgtgtctcatc

SEQ ID NO: 7928221 - DNA, 22 bp, Homo sapiens
actgggccttgtgtgtctcatc

SEQ ID NO: 7928222 - DNA, 22 bp, Homo sapiens
actgggctcaagtgattgtcct

SEQ ID NO: 7928223 - DNA, 21 bp, Homo sapiens
actgggctagcctgacttctg

SEQ ID NO: 7928224 - DNA, 21 bp, Homo sapiens
actgggctagcctgacttctg

SEQ ID NO: 7928225 - DNA, 22 bp, Homo sapiens
actgggctagagtggaagctgg

SEQ ID NO: 7928226 - DNA, 22 bp, Homo sapiens
actgggctagagtggaagctgg

SEQ ID NO: 7928227 - DNA, 22 bp, Homo sapiens
actgggctagagtggaagctgg

SEQ ID NO: 7928228 - DNA, 22 bp, Homo sapiens
actgggctagagtggaagctgg

SEQ ID NO: 7928229 - DNA, 22 bp, Homo sapiens
actgggctagagtggaagctgg

SEQ ID NO: 7928230 - DNA, 21 bp, Homo sapiens
agttttatattataagctaaa

SEQ ID NO: 7928231 - DNA, 22 bp, Homo sapiens
agttttataaaggcacctcagt

SEQ ID NO: 7928232 - DNA, 22 bp, Homo sapiens
agttttagagtaagaattactg

SEQ ID NO: 7928233 - DNA, 22 bp, Homo sapiens
agttttaagatgcgcttctgtt

SEQ ID NO: 7928234 - DNA, 22 bp, Homo sapiens
agttttaagatgcgcttctgtt

SEQ ID NO: 7928235 - DNA, 22 bp, Homo sapiens
agttttaaatgatggtggtggt

SEQ ID NO: 7928236 - DNA, 22 bp, Homo sapiens
agttttatctgtaagctgttca

SEQ ID NO: 7928237 - DNA, 22 bp, Homo sapiens
agttttatctgtaagctgttca

SEQ ID NO: 7928238 - DNA, 21 bp, Homo sapiens
agttttatattataagctaaa

SEQ ID NO: 7928239 - DNA, 22 bp, Homo sapiens
agttttatctgtaagctgttca

SEQ ID NO: 7928240 - DNA, 22 bp, Homo sapiens
agttttatgcagtgttctgata

SEQ ID NO: 7928241 - DNA, 22 bp, Homo sapiens
agttttatgcagtgttctgata

SEQ ID NO: 7928242 - DNA, 22 bp, Homo sapiens
agttttatgcagtgttctgata

SEQ ID NO: 7928243 - DNA, 22 bp, Homo sapiens
acttttcttatcagaaaggcca

SEQ ID NO: 7928244 - DNA, 22 bp, Homo sapiens
acttttctgcagatgatctctt

SEQ ID NO: 7928245 - DNA, 22 bp, Homo sapiens
acttttcttatcagaaaggcca

SEQ ID NO: 7928246 - DNA, 22 bp, Homo sapiens
acttttctgcagatgatctctt

SEQ ID NO: 7928247 - DNA, 22 bp, Homo sapiens
acttttgaagaattatgcaaaa

SEQ ID NO: 7928248 - DNA, 22 bp, Homo sapiens
acttttgtgcaggtctctccca

SEQ ID NO: 7928249 - DNA, 22 bp, Homo sapiens
acttttgaggactttattgtat

SEQ ID NO: 7928250 - DNA, 22 bp, Homo sapiens
acttttggttctgtaactgtga

SEQ ID NO: 7928251 - DNA, 22 bp, Homo sapiens
actttttacagggtgtatacca

SEQ ID NO: 7928252 - DNA, 22 bp, Homo sapiens
actttttacagggtgtatacca

SEQ ID NO: 7928253 - DNA, 22 bp, Homo sapiens
actttttacagggtgtatacca

SEQ ID NO: 7928254 - DNA, 22 bp, Homo sapiens
acttttcccttggtagagttgc

SEQ ID NO: 7928255 - DNA, 22 bp, Homo sapiens
acttttcccttggtagagttgc

SEQ ID NO: 7928256 - DNA, 22 bp, Homo sapiens
acttttcccttggtagagttgc

SEQ ID NO: 7928257 - DNA, 23 bp, Homo sapiens
acttttcaattagctatgcttaa

SEQ ID NO: 7928258 - DNA, 16 bp, Homo sapiens
acttttccaccttttt

SEQ ID NO: 7928259 - DNA, 16 bp, Homo sapiens
acttttccaccttttt

SEQ ID NO: 7928260 - DNA, 22 bp, Homo sapiens
acttttctaagcaatggtcttg

SEQ ID NO: 7928261 - DNA, 22 bp, Homo sapiens
acttttctaagcaatggtcttg

SEQ ID NO: 7928262 - DNA, 22 bp, Homo sapiens
acttttctccctcctgccttca

SEQ ID NO: 7928263 - DNA, 22 bp, Homo sapiens
acttttctccctcctgccttca

SEQ ID NO: 7928264 - DNA, 22 bp, Homo sapiens
acttttctaagcaatggtcttg

SEQ ID NO: 7928265 - DNA, 22 bp, Homo sapiens
acttttctgcagatgatctctt

SEQ ID NO: 7928266 - DNA, 22 bp, Homo sapiens
acttttctccctcctgccttca

SEQ ID NO: 7928267 - DNA, 22 bp, Homo sapiens
acttttctccctcctgccttca

SEQ ID NO: 7928268 - DNA, 22 bp, Homo sapiens
acttttctccctcctgccttca

SEQ ID NO: 7928269 - DNA, 21 bp, Homo sapiens
agaaaaacacgatataagccc

SEQ ID NO: 7928270 - DNA, 21 bp, Homo sapiens
agaaaaacacgatataagccc

SEQ ID NO: 7928271 - DNA, 23 bp, Homo sapiens
agaaaaacaggattgtgttccta

SEQ ID NO: 7928272 - DNA, 21 bp, Homo sapiens
agaaaaaccagcatgttttca

SEQ ID NO: 7928273 - DNA, 21 bp, Homo sapiens
agaaaaacacgatataagccc

SEQ ID NO: 7928274 - DNA, 21 bp, Homo sapiens
agaaaaacacgatataagccc

SEQ ID NO: 7928275 - DNA, 21 bp, Homo sapiens
agaaaaacacgatataagccc

SEQ ID NO: 7928276 - DNA, 21 bp, Homo sapiens
agaaaaacacgatataagccc

SEQ ID NO: 7928277 - DNA, 21 bp, Homo sapiens
agaaaaacacgatataagccc

SEQ ID NO: 7928278 - DNA, 21 bp, Homo sapiens
agaaaaacacgatataagccc

SEQ ID NO: 7928279 - DNA, 22 bp, Homo sapiens
actttttagtttcctcaaacat

SEQ ID NO: 7928280 - DNA, 22 bp, Homo sapiens
actttttagtttcctcaaacat

SEQ ID NO: 7928281 - DNA, 22 bp, Homo sapiens
actttttagtttcctcaaacat

SEQ ID NO: 7928282 - DNA, 22 bp, Homo sapiens
actttttacagggtgtatacca

SEQ ID NO: 7928283 - DNA, 22 bp, Homo sapiens
actttttctcagaaggattggt

SEQ ID NO: 7928284 - DNA, 22 bp, Homo sapiens
acttttttataaggaagaagat

SEQ ID NO: 7928285 - DNA, 22 bp, Homo sapiens
agaaaaacacaatcgggcctcc

SEQ ID NO: 7928286 - DNA, 22 bp, Homo sapiens
acttttttataaggaagaagat

SEQ ID NO: 7928287 - DNA, 22 bp, Homo sapiens
acttttttataaggaagaagat

SEQ ID NO: 7928288 - DNA, 22 bp, Homo sapiens
actttttgctggtctcttccat

SEQ ID NO: 7928289 - DNA, 22 bp, Homo sapiens
acttttttataaggaagaagat

SEQ ID NO: 7928290 - DNA, 22 bp, Homo sapiens
acttttttataaggaagaagat

SEQ ID NO: 7928291 - DNA, 22 bp, Homo sapiens
atattttggtagctctcaatga

SEQ ID NO: 7928292 - DNA, 22 bp, Homo sapiens
atattttgtaacttggaatagg

SEQ ID NO: 7928293 - DNA, 22 bp, Homo sapiens
atatttttccatgtgggactct

SEQ ID NO: 7928294 - DNA, 22 bp, Homo sapiens
atatttttccatgtgggactct

SEQ ID NO: 7928295 - DNA, 22 bp, Homo sapiens
atatttttccatgtgggactct

SEQ ID NO: 7928296 - DNA, 22 bp, Homo sapiens
atatttttccatgtgggactct

SEQ ID NO: 7928297 - DNA, 21 bp, Homo sapiens
atatttttgtttggactgtca

SEQ ID NO: 7928298 - DNA, 21 bp, Homo sapiens
atatttttgtttggactgtca

SEQ ID NO: 7928299 - DNA, 21 bp, Homo sapiens
atatttttgtttggactgtca

SEQ ID NO: 7928300 - DNA, 21 bp, Homo sapiens
atatttttgtttggactgtca

SEQ ID NO: 7928301 - DNA, 22 bp, Homo sapiens
atatttttccatgtgggactct

SEQ ID NO: 7928302 - DNA, 22 bp, Homo sapiens
atcaaaaccttgacttttaatg

SEQ ID NO: 7928303 - DNA, 22 bp, Homo sapiens
atcaaaaccttgacttttaatg

SEQ ID NO: 7928304 - DNA, 21 bp, Homo sapiens
atatttttgtttggactgtca

SEQ ID NO: 7928305 - DNA, 21 bp, Homo sapiens
atatttttgtttggactgtca

SEQ ID NO: 7928306 - DNA, 22 bp, Homo sapiens
agaaaaagaaagtggatttgtc

SEQ ID NO: 7928307 - DNA, 22 bp, Homo sapiens
agaaaaagtcaaggaattggac

SEQ ID NO: 7928308 - DNA, 22 bp, Homo sapiens
agaaaaactaagagtgggtggt

SEQ ID NO: 7928309 - DNA, 19 bp, Homo sapiens
agaaaaactggtactgctg

SEQ ID NO: 7928310 - DNA, 19 bp, Homo sapiens
agaaaaactggtactgctg

SEQ ID NO: 7928311 - DNA, 21 bp, Homo sapiens
agaaaaaccagcatgttttca

SEQ ID NO: 7928312 - DNA, 21 bp, Homo sapiens
agaaaaaccagcatgttttca

SEQ ID NO: 7928313 - DNA, 22 bp, Homo sapiens
agaaaaagtcaaggaattggac

SEQ ID NO: 7928314 - DNA, 22 bp, Homo sapiens
agaaaaagtcaaggaattggac

SEQ ID NO: 7928315 - DNA, 22 bp, Homo sapiens
agaaaaagtcaaggaattggac

SEQ ID NO: 7928316 - DNA, 22 bp, Homo sapiens
agaaaaagtcaaggaattggac

SEQ ID NO: 7928317 - DNA, 22 bp, Homo sapiens
agaaaaagtcaaggaattggac

SEQ ID NO: 7928318 - DNA, 22 bp, Homo sapiens
agaaaaagtcaaggaattggac

SEQ ID NO: 7928319 - DNA, 22 bp, Homo sapiens
atatttctccaaatgttttcaa

SEQ ID NO: 7928320 - DNA, 22 bp, Homo sapiens
atatttctccaaatgttttcaa

SEQ ID NO: 7928321 - DNA, 21 bp, Homo sapiens
atatttctcataaggttatgg

SEQ ID NO: 7928322 - DNA, 22 bp, Homo sapiens
agaaaaagtcaaggaattggac

SEQ ID NO: 7928323 - DNA, 22 bp, Homo sapiens
atattttggggtgatgtgcatc

SEQ ID NO: 7928324 - DNA, 22 bp, Homo sapiens
atattttggggtgatgtgcatc

SEQ ID NO: 7928325 - DNA, 22 bp, Homo sapiens
atattttggtagctctcaatga

SEQ ID NO: 7928326 - DNA, 22 bp, Homo sapiens
atattttggtagctctcaatga

SEQ ID NO: 7928327 - DNA, 22 bp, Homo sapiens
atatttctccaaatgttttcaa

SEQ ID NO: 7928328 - DNA, 22 bp, Homo sapiens
agaaatcaggaacagtaaggag

SEQ ID NO: 7928329 - DNA, 23 bp, Homo sapiens
agaaatcatctccaccccatgtc

SEQ ID NO: 7928330 - DNA, 22 bp, Homo sapiens
agaaatcaggaacagtaaggag

SEQ ID NO: 7928331 - DNA, 22 bp, Homo sapiens
agaaatcaggaacagtaaggag

SEQ ID NO: 7928332 - DNA, 22 bp, Homo sapiens
agaaatcaggaacagtaaggag

SEQ ID NO: 7928333 - DNA, 22 bp, Homo sapiens
atcagtttaaatgggctgttgg

SEQ ID NO: 7928334 - DNA, 22 bp, Homo sapiens
atcagttatttttaagctataa

SEQ ID NO: 7928335 - DNA, 22 bp, Homo sapiens
atcagttatttttaagctataa

SEQ ID NO: 7928336 - DNA, 22 bp, Homo sapiens
atcagtgtttcaaatgtaatct

SEQ ID NO: 7928337 - DNA, 22 bp, Homo sapiens
atcagtgtttgcatgggagctt

SEQ ID NO: 7928338 - DNA, 22 bp, Homo sapiens
atcagtgtttgcatgggagctt

SEQ ID NO: 7928339 - DNA, 22 bp, Homo sapiens
agaaatcatgtcttatttctat

SEQ ID NO: 7928340 - DNA, 22 bp, Homo sapiens
agaaatcatgtcttatttctat

SEQ ID NO: 7928341 - DNA, 22 bp, Homo sapiens
agaaatcattcccaaacccata

SEQ ID NO: 7928342 - DNA, 22 bp, Homo sapiens
agaaatcatgtcttatttctat

SEQ ID NO: 7928343 - DNA, 22 bp, Homo sapiens
agaaatcatgactaagagcagt

SEQ ID NO: 7928344 - DNA, 22 bp, Homo sapiens
agaaatcatgactaagagcagt

SEQ ID NO: 7928345 - DNA, 22 bp, Homo sapiens
agaaatcatgactaagagcagt

SEQ ID NO: 7928346 - DNA, 22 bp, Homo sapiens
agaaatcatgactaagagcagt

SEQ ID NO: 7928347 - DNA, 22 bp, Homo sapiens
agaaatcatgtcttatttctat

SEQ ID NO: 7928348 - DNA, 22 bp, Homo sapiens
agaaatcatgtcttatttctat

SEQ ID NO: 7928349 - DNA, 22 bp, Homo sapiens
agaaatcatgtcttatttctat

SEQ ID NO: 7928350 - DNA, 22 bp, Homo sapiens
agaaatcatgtcttatttctat

SEQ ID NO: 7928351 - DNA, 22 bp, Homo sapiens
atcagtaaatattcattgtgca

SEQ ID NO: 7928352 - DNA, 21 bp, Homo sapiens
atcagtaaggttggaggaaga

SEQ ID NO: 7928353 - DNA, 21 bp, Homo sapiens
atcagtaaggttggaggaaga

SEQ ID NO: 7928354 - DNA, 22 bp, Homo sapiens
atcagtcatatccaaattagca

SEQ ID NO: 7928355 - DNA, 22 bp, Homo sapiens
atcagtagtgtgaaaacagact

SEQ ID NO: 7928356 - DNA, 17 bp, Homo sapiens
atcagtagcatatcaga

SEQ ID NO: 7928357 - DNA, 18 bp, Homo sapiens
atcagtcctgggagggta

SEQ ID NO: 7928358 - DNA, 22 bp, Homo sapiens
atcagtccacttgatgaaatcg

SEQ ID NO: 7928359 - DNA, 18 bp, Homo sapiens
atcagtcctgggagggta

SEQ ID NO: 7928360 - DNA, 22 bp, Homo sapiens
atcagtccaccatactcatctt

SEQ ID NO: 7928361 - DNA, 22 bp, Homo sapiens
atcagtccacttgatgaaatcg

SEQ ID NO: 7928362 - DNA, 22 bp, Homo sapiens
atcagtccaccatactcatctt

SEQ ID NO: 7928363 - DNA, 22 bp, Homo sapiens
atcagtcttttaatgatacctt

SEQ ID NO: 7928364 - DNA, 22 bp, Homo sapiens
atcagtctgttggaatatcgct

SEQ ID NO: 7928365 - DNA, 22 bp, Homo sapiens
atcagtgttgttgattggatag

SEQ ID NO: 7928366 - DNA, 22 bp, Homo sapiens
atcagtgttccttgagactgcc

SEQ ID NO: 7928367 - DNA, 22 bp, Homo sapiens
atcagtgtattcatagggaata

SEQ ID NO: 7928368 - DNA, 22 bp, Homo sapiens
atcagtgtgtcaaaagcacaaa

SEQ ID NO: 7928369 - DNA, 22 bp, Homo sapiens
atcagtgttccttgagactgcc

SEQ ID NO: 7928370 - DNA, 22 bp, Homo sapiens
atcagtgtattcatagggaata

SEQ ID NO: 7928371 - DNA, 22 bp, Homo sapiens
atcagtgtattcatagggaata

SEQ ID NO: 7928372 - DNA, 22 bp, Homo sapiens
atcagtgtaccttatggatttt

SEQ ID NO: 7928373 - DNA, 22 bp, Homo sapiens
atcagtggggacgagaagttta

SEQ ID NO: 7928374 - DNA, 22 bp, Homo sapiens
atcagtgcttcatagccctggt

SEQ ID NO: 7928375 - DNA, 22 bp, Homo sapiens
atcagtgctgggagatgtcaga

SEQ ID NO: 7928376 - DNA, 22 bp, Homo sapiens
atcagtgctgggagatgtcaga

SEQ ID NO: 7928377 - DNA, 22 bp, Homo sapiens
atcagtgcttcatagccctggt

SEQ ID NO: 7928378 - DNA, 22 bp, Homo sapiens
atcagtgacctgaaatgttttt

SEQ ID NO: 7928379 - DNA, 22 bp, Homo sapiens
atcagtgatcttgtttgccaga

SEQ ID NO: 7928380 - DNA, 22 bp, Homo sapiens
atcagtgcatcctgccacaaag

SEQ ID NO: 7928381 - DNA, 19 bp, Homo sapiens
atcagtgcatgagtgctgt

SEQ ID NO: 7928382 - DNA, 22 bp, Homo sapiens
atcagtgctaagagagggcctg

SEQ ID NO: 7928383 - DNA, 22 bp, Homo sapiens
atcagtgctgagagactatcaa

SEQ ID NO: 7928384 - DNA, 22 bp, Homo sapiens
atcagtgctaaagcaaatgccc

SEQ ID NO: 7928385 - DNA, 22 bp, Homo sapiens
atcagtgccccatggctaatgc

SEQ ID NO: 7928386 - DNA, 22 bp, Homo sapiens
agaaagcatctccattgtaggt

SEQ ID NO: 7928387 - DNA, 22 bp, Homo sapiens
agaaagcatctccattgtaggt

SEQ ID NO: 7928388 - DNA, 22 bp, Homo sapiens
agaaagcatctccattgtaggt

SEQ ID NO: 7928389 - DNA, 22 bp, Homo sapiens
agaaagcatctccattgtaggt

SEQ ID NO: 7928390 - DNA, 22 bp, Homo sapiens
agaaagcagtcccttccgaccg

SEQ ID NO: 7928391 - DNA, 22 bp, Homo sapiens
agaaagcatctccattgtaggt

SEQ ID NO: 7928392 - DNA, 22 bp, Homo sapiens
agaaagcagcatttatgatctc

SEQ ID NO: 7928393 - DNA, 22 bp, Homo sapiens
agaaagcagcatttatgatctc

SEQ ID NO: 7928394 - DNA, 22 bp, Homo sapiens
agaaagcagcatttatgatctc

SEQ ID NO: 7928395 - DNA, 22 bp, Homo sapiens
agaaagcagcatttatgatctc

SEQ ID NO: 7928396 - DNA, 22 bp, Homo sapiens
agaaagcagtcccttccgaccg

SEQ ID NO: 7928397 - DNA, 22 bp, Homo sapiens
agaaagcagcatttatgatctc

SEQ ID NO: 7928398 - DNA, 22 bp, Homo sapiens
atcagcaatcaaattgcagagt

SEQ ID NO: 7928399 - DNA, 22 bp, Homo sapiens
atcagcaatctcgtgtattagg

SEQ ID NO: 7928400 - DNA, 22 bp, Homo sapiens
atcagcaatcaaattgcagagt

SEQ ID NO: 7928401 - DNA, 22 bp, Homo sapiens
atcagcaatctcgtgtattagg

SEQ ID NO: 7928402 - DNA, 22 bp, Homo sapiens
atcaggtgggttttgaagaaac

SEQ ID NO: 7928403 - DNA, 22 bp, Homo sapiens
agaaagccttatgtacagaggc

SEQ ID NO: 7928404 - DNA, 22 bp, Homo sapiens
agaaagccttatgtacagaggc

SEQ ID NO: 7928405 - DNA, 22 bp, Homo sapiens
agaaagcctcaatcttcaggcc

SEQ ID NO: 7928406 - DNA, 22 bp, Homo sapiens
agaaagcctgagcagacggagc

SEQ ID NO: 7928407 - DNA, 22 bp, Homo sapiens
agaaagcaccctgcactttctg

SEQ ID NO: 7928408 - DNA, 22 bp, Homo sapiens
agaaagcaccctgcactttctg

SEQ ID NO: 7928409 - DNA, 22 bp, Homo sapiens
agaaagcacagcgggtccattt

SEQ ID NO: 7928410 - DNA, 22 bp, Homo sapiens
agaaagcacagcgggtccattt

SEQ ID NO: 7928411 - DNA, 22 bp, Homo sapiens
agaaagcacagcgggtccattt

SEQ ID NO: 7928412 - DNA, 22 bp, Homo sapiens
agaaagcacagcgggtccattt

SEQ ID NO: 7928413 - DNA, 22 bp, Homo sapiens
agaaagcacgggccccaggctc

SEQ ID NO: 7928414 - DNA, 22 bp, Homo sapiens
agaaagcacgggccccaggctc

SEQ ID NO: 7928415 - DNA, 22 bp, Homo sapiens
agaaagcacgggccccaggctc

SEQ ID NO: 7928416 - DNA, 22 bp, Homo sapiens
agaaagcactctgtcttttacc

SEQ ID NO: 7928417 - DNA, 22 bp, Homo sapiens
agaaagcactctgtcttttacc

SEQ ID NO: 7928418 - DNA, 22 bp, Homo sapiens
agaaagcactctgtcttttacc

SEQ ID NO: 7928419 - DNA, 22 bp, Homo sapiens
atcaaaatgctccagtgatggt

SEQ ID NO: 7928420 - DNA, 22 bp, Homo sapiens
atcaaaacttctttagagttta

SEQ ID NO: 7928421 - DNA, 22 bp, Homo sapiens
atcaaaacttctttagagttta

SEQ ID NO: 7928422 - DNA, 20 bp, Homo sapiens
atcaaaatcctattgaggtt

SEQ ID NO: 7928423 - DNA, 22 bp, Homo sapiens
atcaaaatgctccagtgatggt

SEQ ID NO: 7928424 - DNA, 22 bp, Homo sapiens
agaaagattttcaacaggaggt

SEQ ID NO: 7928425 - DNA, 22 bp, Homo sapiens
agaaagatccttctggctgcct

SEQ ID NO: 7928426 - DNA, 22 bp, Homo sapiens
agaaagatccttctggctgcct

SEQ ID NO: 7928427 - DNA, 22 bp, Homo sapiens
agaaatctgactgctgtgcaca

SEQ ID NO: 7928428 - DNA, 22 bp, Homo sapiens
agaaatctgactgctgtgcaca

SEQ ID NO: 7928429 - DNA, 22 bp, Homo sapiens
agaaatctgactgctgtgcaca

SEQ ID NO: 7928430 - DNA, 22 bp, Homo sapiens
agaaatcttatcaagaaatgcc

SEQ ID NO: 7928431 - DNA, 22 bp, Homo sapiens
agaaatcttatcaagaaatgcc

SEQ ID NO: 7928432 - DNA, 22 bp, Homo sapiens
agaaatcttatcaagaaatgcc

SEQ ID NO: 7928433 - DNA, 22 bp, Homo sapiens
atccaggaaggatggcattgag

SEQ ID NO: 7928434 - DNA, 22 bp, Homo sapiens
atccaggaaggatggcattgag

SEQ ID NO: 7928435 - DNA, 22 bp, Homo sapiens
agaaatcttatcaagaaatgcc

SEQ ID NO: 7928436 - DNA, 22 bp, Homo sapiens
agaaatcttatcaagaaatgcc

SEQ ID NO: 7928437 - DNA, 22 bp, Homo sapiens
atccaggagggctgactcctta

SEQ ID NO: 7928438 - DNA, 22 bp, Homo sapiens
atccaggagggctgactcctta

SEQ ID NO: 7928439 - DNA, 22 bp, Homo sapiens
atccaggagtcgtggcgctcag

SEQ ID NO: 7928440 - DNA, 22 bp, Homo sapiens
atccaggagtcgtggcgctcag

SEQ ID NO: 7928441 - DNA, 20 bp, Homo sapiens
atccaggatgttgatttgaa

SEQ ID NO: 7928442 - DNA, 22 bp, Homo sapiens
atccattttaactgttagtgca

SEQ ID NO: 7928443 - DNA, 22 bp, Homo sapiens
atccatttgtttactgatggac

SEQ ID NO: 7928444 - DNA, 22 bp, Homo sapiens
atccattttccttggcagcagg

SEQ ID NO: 7928445 - DNA, 22 bp, Homo sapiens
atccattttctctctgtggggt

SEQ ID NO: 7928446 - DNA, 22 bp, Homo sapiens
agaaatctatgttttggttaga

SEQ ID NO: 7928447 - DNA, 22 bp, Homo sapiens
agaaatctatgttttggttaga

SEQ ID NO: 7928448 - DNA, 22 bp, Homo sapiens
agaaatctatgttttggttaga

SEQ ID NO: 7928449 - DNA, 22 bp, Homo sapiens
agaaatcattttaggcttgatg

SEQ ID NO: 7928450 - DNA, 22 bp, Homo sapiens
agaaatcattttaggcttgatg

SEQ ID NO: 7928451 - DNA, 22 bp, Homo sapiens
agaaatcccaaggcatcaacca

SEQ ID NO: 7928452 - DNA, 22 bp, Homo sapiens
agaaatcattgaattatttgct

SEQ ID NO: 7928453 - DNA, 22 bp, Homo sapiens
agaaatcattcccaaacccata

SEQ ID NO: 7928454 - DNA, 19 bp, Homo sapiens
agaaatctcgagatttgtt

SEQ ID NO: 7928455 - DNA, 22 bp, Homo sapiens
agaaatctgactgctgtgcaca

SEQ ID NO: 7928456 - DNA, 22 bp, Homo sapiens
agaaatctctagcacatcgaat

SEQ ID NO: 7928457 - DNA, 22 bp, Homo sapiens
agaaatctcagtatctcaggga

SEQ ID NO: 7928458 - DNA, 22 bp, Homo sapiens
agaaatctattatttcagagtt

SEQ ID NO: 7928459 - DNA, 22 bp, Homo sapiens
atcccaggggttgtatcttccc

SEQ ID NO: 7928460 - DNA, 22 bp, Homo sapiens
atcccatagggttatcataggg

SEQ ID NO: 7928461 - DNA, 22 bp, Homo sapiens
atcccattcccataagtggaaa

SEQ ID NO: 7928462 - DNA, 22 bp, Homo sapiens
atcccatttcctagtacatcat

SEQ ID NO: 7928463 - DNA, 22 bp, Homo sapiens
atcccaggcggcacaggttgca

SEQ ID NO: 7928464 - DNA, 22 bp, Homo sapiens
atcccaggcggcacaggttgca

SEQ ID NO: 7928465 - DNA, 22 bp, Homo sapiens
atcccaggcggcacaggttgca

SEQ ID NO: 7928466 - DNA, 21 bp, Homo sapiens
atcccagcacccaggagtgca

SEQ ID NO: 7928467 - DNA, 21 bp, Homo sapiens
atcccagcacccaggagtgca

SEQ ID NO: 7928468 - DNA, 22 bp, Homo sapiens
atcccaggaggctgcgcagtta

SEQ ID NO: 7928469 - DNA, 22 bp, Homo sapiens
atcccaggaggctgcgcagtta

SEQ ID NO: 7928470 - DNA, 22 bp, Homo sapiens
atcccagatggaggctggtcac

SEQ ID NO: 7928471 - DNA, 22 bp, Homo sapiens
atcccagatggaggctggtcac

SEQ ID NO: 7928472 - DNA, 22 bp, Homo sapiens
atcccagatagtgaccctcagg

SEQ ID NO: 7928473 - DNA, 22 bp, Homo sapiens
atcccacacccctacaacatat

SEQ ID NO: 7928474 - DNA, 22 bp, Homo sapiens
atcccacctcaatctgaagctc

SEQ ID NO: 7928475 - DNA, 22 bp, Homo sapiens
atcccacacccctacaacatat

SEQ ID NO: 7928476 - DNA, 22 bp, Homo sapiens
atcccagagaataatgatcagg

SEQ ID NO: 7928477 - DNA, 23 bp, Homo sapiens
atcccacttcccttatagtttct

SEQ ID NO: 7928478 - DNA, 22 bp, Homo sapiens
atcccagatagtgaccctcagg

SEQ ID NO: 7928479 - DNA, 22 bp, Homo sapiens
atcccacctcaatctgaagctc

SEQ ID NO: 7928480 - DNA, 22 bp, Homo sapiens
atcccagatagtgaccctcagg

SEQ ID NO: 7928481 - DNA, 22 bp, Homo sapiens
atcccagagaataatgatcagg

SEQ ID NO: 7928482 - DNA, 22 bp, Homo sapiens
atccattttttcagaatgctct

SEQ ID NO: 7928483 - DNA, 19 bp, Homo sapiens
atcccaaggagctgggact

SEQ ID NO: 7928484 - DNA, 22 bp, Homo sapiens
atcccacacccctacaacatat

SEQ ID NO: 7928485 - DNA, 22 bp, Homo sapiens
agaacatatctgttttctaact

SEQ ID NO: 7928486 - DNA, 22 bp, Homo sapiens
agaacatatctgttttctaact

SEQ ID NO: 7928487 - DNA, 22 bp, Homo sapiens
agaacatatctgttttctaact

SEQ ID NO: 7928488 - DNA, 22 bp, Homo sapiens
agaacatatctgttttctaact

SEQ ID NO: 7928489 - DNA, 22 bp, Homo sapiens
agaacatatctgttttctaact

SEQ ID NO: 7928490 - DNA, 22 bp, Homo sapiens
agaacatagtggactttggcaa

SEQ ID NO: 7928491 - DNA, 22 bp, Homo sapiens
agaacatagatacctaagacag

SEQ ID NO: 7928492 - DNA, 22 bp, Homo sapiens
agaacatagatacctaagacag

SEQ ID NO: 7928493 - DNA, 22 bp, Homo sapiens
agaacataattatcataaactg

SEQ ID NO: 7928494 - DNA, 22 bp, Homo sapiens
agaacataattatcataaactg

SEQ ID NO: 7928495 - DNA, 22 bp, Homo sapiens
agaacagtgctgataaatcata

SEQ ID NO: 7928496 - DNA, 22 bp, Homo sapiens
agaacagtttgttggagactgt

SEQ ID NO: 7928497 - DNA, 23 bp, Homo sapiens
agaacagtgactaatatagagag

SEQ ID NO: 7928498 - DNA, 23 bp, Homo sapiens
agaacagtgactaatatagagag

SEQ ID NO: 7928499 - DNA, 22 bp, Homo sapiens
atccccacgatatagccaaagc

SEQ ID NO: 7928500 - DNA, 22 bp, Homo sapiens
atccccacgatatagccaaagc

SEQ ID NO: 7928501 - DNA, 22 bp, Homo sapiens
atccccacgatatagccaaagc

SEQ ID NO: 7928502 - DNA, 22 bp, Homo sapiens
atcccatttcctgttttgtcaa

SEQ ID NO: 7928503 - DNA, 22 bp, Homo sapiens
atcccatttcctagtacatcat

SEQ ID NO: 7928504 - DNA, 22 bp, Homo sapiens
atccccagaaaataggtgccta

SEQ ID NO: 7928505 - DNA, 22 bp, Homo sapiens
atccccactgctgctggtgtag

SEQ ID NO: 7928506 - DNA, 22 bp, Homo sapiens
atccccagaaaataggtgccta

SEQ ID NO: 7928507 - DNA, 22 bp, Homo sapiens
agaacagtcgtggtgagagaaa

SEQ ID NO: 7928508 - DNA, 22 bp, Homo sapiens
agaacagtcgtggtgagagaaa

SEQ ID NO: 7928509 - DNA, 19 bp, Homo sapiens
agaaccactgctctcttca

SEQ ID NO: 7928510 - DNA, 22 bp, Homo sapiens
agaaccagtttaagatttgggt

SEQ ID NO: 7928511 - DNA, 22 bp, Homo sapiens
agaaccattttgacagatatac

SEQ ID NO: 7928512 - DNA, 22 bp, Homo sapiens
agaaccattttgacagatatac

SEQ ID NO: 7928513 - DNA, 22 bp, Homo sapiens
agaaccagctagtcttgctttt

SEQ ID NO: 7928514 - DNA, 22 bp, Homo sapiens
agaaccatgagtttgagtatct

SEQ ID NO: 7928515 - DNA, 21 bp, Homo sapiens
agaacccagcagcactgttct

SEQ ID NO: 7928516 - DNA, 22 bp, Homo sapiens
agaacatttgtcaaaaagccaa

SEQ ID NO: 7928517 - DNA, 22 bp, Homo sapiens
agaacatggattgtcaaaggta

SEQ ID NO: 7928518 - DNA, 22 bp, Homo sapiens
agaacatctgaagatacaaagt

SEQ ID NO: 7928519 - DNA, 22 bp, Homo sapiens
agaaccctatctttctgaggtt

SEQ ID NO: 7928520 - DNA, 20 bp, Homo sapiens
agaacctaagttaaaacaca

SEQ ID NO: 7928521 - DNA, 22 bp, Homo sapiens
agaacctcaattatttttgcac

SEQ ID NO: 7928522 - DNA, 22 bp, Homo sapiens
agaaccttcagattaggaggtg

SEQ ID NO: 7928523 - DNA, 22 bp, Homo sapiens
agaacctcacgagattccttca

SEQ ID NO: 7928524 - DNA, 22 bp, Homo sapiens
atctcaggggttccttctagag

SEQ ID NO: 7928525 - DNA, 22 bp, Homo sapiens
atctctggcaatgcagcatcgt

SEQ ID NO: 7928526 - DNA, 22 bp, Homo sapiens
atctctggcccctggggtccga

SEQ ID NO: 7928527 - DNA, 22 bp, Homo sapiens
atctctggcaatgcagcatcgt

SEQ ID NO: 7928528 - DNA, 22 bp, Homo sapiens
atctctggcaatgcagcatcgt

SEQ ID NO: 7928529 - DNA, 22 bp, Homo sapiens
atctctggcaatgcagcatcgt

SEQ ID NO: 7928530 - DNA, 22 bp, Homo sapiens
agaagccacaggaaagcagctt

SEQ ID NO: 7928531 - DNA, 22 bp, Homo sapiens
agaagccacaggcctcgtctgg

SEQ ID NO: 7928532 - DNA, 22 bp, Homo sapiens
agaagccacaggaaagcagctt

SEQ ID NO: 7928533 - DNA, 22 bp, Homo sapiens
agaagccacaggaaagcagctt

SEQ ID NO: 7928534 - DNA, 22 bp, Homo sapiens
agaagccacaggaaagcagctt

SEQ ID NO: 7928535 - DNA, 22 bp, Homo sapiens
agaagccaattctgtgtgagtc

SEQ ID NO: 7928536 - DNA, 22 bp, Homo sapiens
agaagccaattctgtgtgagtc

SEQ ID NO: 7928537 - DNA, 22 bp, Homo sapiens
agaagccaatccttgtctctct

SEQ ID NO: 7928538 - DNA, 22 bp, Homo sapiens
agaagccaattctgtgtgagtc

SEQ ID NO: 7928539 - DNA, 22 bp, Homo sapiens
agaagccaatcagctctctgct

SEQ ID NO: 7928540 - DNA, 22 bp, Homo sapiens
agaagccaatccttgtctctct

SEQ ID NO: 7928541 - DNA, 22 bp, Homo sapiens
agaagccaatccttgtctctct

SEQ ID NO: 7928542 - DNA, 22 bp, Homo sapiens
agaagccaagaacagacagtgc

SEQ ID NO: 7928543 - DNA, 22 bp, Homo sapiens
agaagccaagaacagacagtgc

SEQ ID NO: 7928544 - DNA, 20 bp, Homo sapiens
agaagccaagtgacatgttt

SEQ ID NO: 7928545 - DNA, 22 bp, Homo sapiens
agaagccaatcagctctctgct

SEQ ID NO: 7928546 - DNA, 20 bp, Homo sapiens
agaagccaagtgacatgttt

SEQ ID NO: 7928547 - DNA, 20 bp, Homo sapiens
agaagccaagtgacatgttt

SEQ ID NO: 7928548 - DNA, 22 bp, Homo sapiens
agaagccaatcagctctctgct

SEQ ID NO: 7928549 - DNA, 22 bp, Homo sapiens
atctctttgatggctcctgtga

SEQ ID NO: 7928550 - DNA, 22 bp, Homo sapiens
atctctttgatggctcctgtga

SEQ ID NO: 7928551 - DNA, 22 bp, Homo sapiens
atctctttgatggctcctgtga

SEQ ID NO: 7928552 - DNA, 22 bp, Homo sapiens
agaagccaacagggcaggagag

SEQ ID NO: 7928553 - DNA, 22 bp, Homo sapiens
agaagccaagaacagacagtgc

SEQ ID NO: 7928554 - DNA, 22 bp, Homo sapiens
agaagccaagaacagacagtgc

SEQ ID NO: 7928555 - DNA, 22 bp, Homo sapiens
atctctgtgccatcattgcccc

SEQ ID NO: 7928556 - DNA, 22 bp, Homo sapiens
atctcttagcagtctagtgacc

SEQ ID NO: 7928557 - DNA, 22 bp, Homo sapiens
atctctggttgttttgctccca

SEQ ID NO: 7928558 - DNA, 22 bp, Homo sapiens
atctctgtaaaccataaattga

SEQ ID NO: 7928559 - DNA, 22 bp, Homo sapiens
atctctgtaaaccataaattga

SEQ ID NO: 7928560 - DNA, 22 bp, Homo sapiens
atctctgtaattacatgatatt

SEQ ID NO: 7928561 - DNA, 22 bp, Homo sapiens
atctcttctagctctgaaatta

SEQ ID NO: 7928562 - DNA, 22 bp, Homo sapiens
atctcttctcccaacacctggc

SEQ ID NO: 7928563 - DNA, 22 bp, Homo sapiens
atctctttgatggctcctgtga

SEQ ID NO: 7928564 - DNA, 21 bp, Homo sapiens
atctcttcaaggctgatttac

SEQ ID NO: 7928565 - DNA, 21 bp, Homo sapiens
atctcttcaaggctgatttac

SEQ ID NO: 7928566 - DNA, 22 bp, Homo sapiens
atctcttatgtcacataaacca

SEQ ID NO: 7928567 - DNA, 22 bp, Homo sapiens
atctcttatgtcacataaacca

SEQ ID NO: 7928568 - DNA, 21 bp, Homo sapiens
atctcttcaaggctgatttac

SEQ ID NO: 7928569 - DNA, 22 bp, Homo sapiens
atctcttctagctctgaaatta

SEQ ID NO: 7928570 - DNA, 22 bp, Homo sapiens
atctctggccttccttttccaa

SEQ ID NO: 7928571 - DNA, 22 bp, Homo sapiens
atctctgggctttgagtttgtt

SEQ ID NO: 7928572 - DNA, 22 bp, Homo sapiens
atctctgggctttgagtttgtt

SEQ ID NO: 7928573 - DNA, 22 bp, Homo sapiens
atctctggcccctggggtccga

SEQ ID NO: 7928574 - DNA, 22 bp, Homo sapiens
atctctggccttccttttccaa

SEQ ID NO: 7928575 - DNA, 22 bp, Homo sapiens
atctctggccttccttttccaa

SEQ ID NO: 7928576 - DNA, 22 bp, Homo sapiens
atctctgggtccatagaagaga

SEQ ID NO: 7928577 - DNA, 22 bp, Homo sapiens
atctctgggtccatagaagaga

SEQ ID NO: 7928578 - DNA, 22 bp, Homo sapiens
atctctggtccaaatgttacct

SEQ ID NO: 7928579 - DNA, 22 bp, Homo sapiens
atctctgggctttgagtttgtt

SEQ ID NO: 7928580 - DNA, 22 bp, Homo sapiens
atctctggttgttttgctccca

SEQ ID NO: 7928581 - DNA, 22 bp, Homo sapiens
atctctggtccaaatgttacct

SEQ ID NO: 7928582 - DNA, 22 bp, Homo sapiens
atctctggttgttttgctccca

SEQ ID NO: 7928583 - DNA, 22 bp, Homo sapiens
agaaggagtgtacaggtcatgc

SEQ ID NO: 7928584 - DNA, 22 bp, Homo sapiens
agaaggagtgtacaggtcatgc

SEQ ID NO: 7928585 - DNA, 22 bp, Homo sapiens
agaagctgtggtatgaaatgtg

SEQ ID NO: 7928586 - DNA, 22 bp, Homo sapiens
agaagctgtggtatgaaatgtg

SEQ ID NO: 7928587 - DNA, 22 bp, Homo sapiens
agaagctgtggtatgaaatgtg

SEQ ID NO: 7928588 - DNA, 22 bp, Homo sapiens
agaaggagtgtacaggtcatgc

SEQ ID NO: 7928589 - DNA, 19 bp, Homo sapiens
agaagctgtgaaatgaagg

SEQ ID NO: 7928590 - DNA, 19 bp, Homo sapiens
agaagctgtgaaatgaagg

SEQ ID NO: 7928591 - DNA, 23 bp, Homo sapiens
agaagctgggagcctggggatgg

SEQ ID NO: 7928592 - DNA, 22 bp, Homo sapiens
agaagctgtggtatgaaatgtg

SEQ ID NO: 7928593 - DNA, 23 bp, Homo sapiens
agaagctgggagcctggggatgg

SEQ ID NO: 7928594 - DNA, 22 bp, Homo sapiens
agaagccacaggcctcgtctgg

SEQ ID NO: 7928595 - DNA, 22 bp, Homo sapiens
agaagccacaggcctcgtctgg

SEQ ID NO: 7928596 - DNA, 21 bp, Homo sapiens
agaaggcaaaagcagacatct

SEQ ID NO: 7928597 - DNA, 21 bp, Homo sapiens
agaaggcaaaagcagacatct

SEQ ID NO: 7928598 - DNA, 22 bp, Homo sapiens
agaaggagtgtacaggtcatgc

SEQ ID NO: 7928599 - DNA, 22 bp, Homo sapiens
agaaggagtgtacaggtcatgc

SEQ ID NO: 7928600 - DNA, 22 bp, Homo sapiens
agaaggcacagtgctgctaaga

SEQ ID NO: 7928601 - DNA, 22 bp, Homo sapiens
agaaggcacagtgctgctaaga

SEQ ID NO: 7928602 - DNA, 21 bp, Homo sapiens
agaaggcaccagcaaggactg

SEQ ID NO: 7928603 - DNA, 21 bp, Homo sapiens
agaaggcaccagcaaggactg

SEQ ID NO: 7928604 - DNA, 21 bp, Homo sapiens
agaaggcaccagcaaggactg

SEQ ID NO: 7928605 - DNA, 21 bp, Homo sapiens
agaaggcaccagcaaggactg

SEQ ID NO: 7928606 - DNA, 22 bp, Homo sapiens
agaaggcaccgtggccaatatt

SEQ ID NO: 7928607 - DNA, 22 bp, Homo sapiens
agaaggcaccgtggccaatatt

SEQ ID NO: 7928608 - DNA, 22 bp, Homo sapiens
agaaggcaccgtggccaatatt

SEQ ID NO: 7928609 - DNA, 22 bp, Homo sapiens
agaaggcaccgtggccaatatt

SEQ ID NO: 7928610 - DNA, 22 bp, Homo sapiens
agaaggcagaaagtccaggtat

SEQ ID NO: 7928611 - DNA, 22 bp, Homo sapiens
agaaggcactcacactggcacg

SEQ ID NO: 7928612 - DNA, 22 bp, Homo sapiens
agaaggcactcacactggcacg

SEQ ID NO: 7928613 - DNA, 22 bp, Homo sapiens
agaaggcactcacactggcacg

SEQ ID NO: 7928614 - DNA, 22 bp, Homo sapiens
agaaggcactcacactggcacg

SEQ ID NO: 7928615 - DNA, 22 bp, Homo sapiens
agaaggcactcacactggcacg

SEQ ID NO: 7928616 - DNA, 22 bp, Homo sapiens
agaaggcagatgggacggagca

SEQ ID NO: 7928617 - DNA, 22 bp, Homo sapiens
agaaggcagatgggacggagca

SEQ ID NO: 7928618 - DNA, 22 bp, Homo sapiens
agaaggcagatgggacggagca

SEQ ID NO: 7928619 - DNA, 22 bp, Homo sapiens
agaaggcagatgggacggagca

SEQ ID NO: 7928620 - DNA, 22 bp, Homo sapiens
agaaggcagatgggacggagca

SEQ ID NO: 7928621 - DNA, 22 bp, Homo sapiens
agaaggcagatgggacggagca

SEQ ID NO: 7928622 - DNA, 22 bp, Homo sapiens
agaaggcagatgggacggagca

SEQ ID NO: 7928623 - DNA, 22 bp, Homo sapiens
agaaggcagatgggacggagca

SEQ ID NO: 7928624 - DNA, 22 bp, Homo sapiens
agaaggcaggttttaaaatgtc

SEQ ID NO: 7928625 - DNA, 22 bp, Homo sapiens
agaaggcaggttttaaaatgtc

SEQ ID NO: 7928626 - DNA, 22 bp, Homo sapiens
agaaggcatcagaagtgtgtag

SEQ ID NO: 7928627 - DNA, 22 bp, Homo sapiens
agaaggcaggttttaaaatgtc

SEQ ID NO: 7928628 - DNA, 20 bp, Homo sapiens
agaaggcaggagacaaaagg

SEQ ID NO: 7928629 - DNA, 22 bp, Homo sapiens
agaaggcatcagaagtgtgtag

SEQ ID NO: 7928630 - DNA, 22 bp, Homo sapiens
atctgccaagagaacgtgggtc

SEQ ID NO: 7928631 - DNA, 22 bp, Homo sapiens
atctgccaatgccatgagaaga

SEQ ID NO: 7928632 - DNA, 22 bp, Homo sapiens
atctgccaatgccatgagaaga

SEQ ID NO: 7928633 - DNA, 22 bp, Homo sapiens
atctgcccatctgtcctgcttc

SEQ ID NO: 7928634 - DNA, 22 bp, Homo sapiens
accacaggaattgctctgtggt

SEQ ID NO: 7928635 - DNA, 22 bp, Homo sapiens
accacagctttgcaccaggtgt

SEQ ID NO: 7928636 - DNA, 22 bp, Homo sapiens
accacagctttgcaccaggtgt

SEQ ID NO: 7928637 - DNA, 22 bp, Homo sapiens
accacaggaattgctctgtggt

SEQ ID NO: 7928638 - DNA, 22 bp, Homo sapiens
accacaggaattgctctgtggt

SEQ ID NO: 7928639 - DNA, 22 bp, Homo sapiens
accacaggaattgctctgtggt

SEQ ID NO: 7928640 - DNA, 22 bp, Homo sapiens
accacaggaattgctctgtggt

SEQ ID NO: 7928641 - DNA, 22 bp, Homo sapiens
accagctgaactgcagcccagg

SEQ ID NO: 7928642 - DNA, 22 bp, Homo sapiens
accagctgagtaggggagggcc

SEQ ID NO: 7928643 - DNA, 22 bp, Homo sapiens
accagctgagtaggggagggcc

SEQ ID NO: 7928644 - DNA, 22 bp, Homo sapiens
accaggaacaagccatggagga

SEQ ID NO: 7928645 - DNA, 22 bp, Homo sapiens
accaggaacaagccatggagga

SEQ ID NO: 7928646 - DNA, 22 bp, Homo sapiens
accaggaacaagccatggagga

SEQ ID NO: 7928647 - DNA, 22 bp, Homo sapiens
accacaggaattgctctgtggt

SEQ ID NO: 7928648 - DNA, 22 bp, Homo sapiens
accacaaacttagtggtgcaaa

SEQ ID NO: 7928649 - DNA, 22 bp, Homo sapiens
accacagaggaatttgaagagg

SEQ ID NO: 7928650 - DNA, 22 bp, Homo sapiens
accaatgcatgattttgtctgg

SEQ ID NO: 7928651 - DNA, 20 bp, Homo sapiens
accaatgttagcttagtact

SEQ ID NO: 7928652 - DNA, 22 bp, Homo sapiens
accaatgtgatgatattaggag

SEQ ID NO: 7928653 - DNA, 17 bp, Homo sapiens
accaatgtcagacaaag

SEQ ID NO: 7928654 - DNA, 22 bp, Homo sapiens
accaatcaaaatgtatggagct

SEQ ID NO: 7928655 - DNA, 22 bp, Homo sapiens
accaatgcatgattttgtctgg

SEQ ID NO: 7928656 - DNA, 22 bp, Homo sapiens
accaaggagtttggtattttag

SEQ ID NO: 7928657 - DNA, 22 bp, Homo sapiens
accaagagtccaagtgaggttg

SEQ ID NO: 7928658 - DNA, 22 bp, Homo sapiens
accaagagccctcatgctaaga

SEQ ID NO: 7928659 - DNA, 22 bp, Homo sapiens
accaagagccctcatgctaaga

SEQ ID NO: 7928660 - DNA, 22 bp, Homo sapiens
accaagcacaaagatgagtaaa

SEQ ID NO: 7928661 - DNA, 22 bp, Homo sapiens
accaacatgtcctcacacagcc

SEQ ID NO: 7928662 - DNA, 23 bp, Homo sapiens
accaacaagcctctggagagtgg

SEQ ID NO: 7928663 - DNA, 22 bp, Homo sapiens
accaacatgtcctcacacagcc

SEQ ID NO: 7928664 - DNA, 22 bp, Homo sapiens
accaaccagggacttggctccc

SEQ ID NO: 7928665 - DNA, 22 bp, Homo sapiens
accaagctctcttcccggctct

SEQ ID NO: 7928666 - DNA, 22 bp, Homo sapiens
accaaggaagagattctcagtt

SEQ ID NO: 7928667 - DNA, 22 bp, Homo sapiens
accaaggagaaggtgcaagctt

SEQ ID NO: 7928668 - DNA, 22 bp, Homo sapiens
accaaggagacaaaggtgtatt

SEQ ID NO: 7928669 - DNA, 22 bp, Homo sapiens
aggcttcctcgtgccttagata

SEQ ID NO: 7928670 - DNA, 23 bp, Homo sapiens
aggcttcctatcttagagctggg

SEQ ID NO: 7928671 - DNA, 23 bp, Homo sapiens
aggcttcctatcttagagctggg

SEQ ID NO: 7928672 - DNA, 23 bp, Homo sapiens
aggcttcctatcttagagctggg

SEQ ID NO: 7928673 - DNA, 22 bp, Homo sapiens
accaaaggcagagctgaacact

SEQ ID NO: 7928674 - DNA, 22 bp, Homo sapiens
accaaagggcagaacatgagca

SEQ ID NO: 7928675 - DNA, 22 bp, Homo sapiens
accaaaggctcctgaagaactg

SEQ ID NO: 7928676 - DNA, 22 bp, Homo sapiens
accaaatgcttggctgctgtga

SEQ ID NO: 7928677 - DNA, 22 bp, Homo sapiens
accaaatgctgacagcatgact

SEQ ID NO: 7928678 - DNA, 22 bp, Homo sapiens
accaaatgctgacagcatgact

SEQ ID NO: 7928679 - DNA, 23 bp, Homo sapiens
accaacaagcctctggagagtgg

SEQ ID NO: 7928680 - DNA, 22 bp, Homo sapiens
accaaatgtttttccagaaatg

SEQ ID NO: 7928681 - DNA, 22 bp, Homo sapiens
accaaatgctgacagcatgact

SEQ ID NO: 7928682 - DNA, 22 bp, Homo sapiens
accaaaggtgatcaggatcacc

SEQ ID NO: 7928683 - DNA, 20 bp, Homo sapiens
accaggagatggaggcaggg

SEQ ID NO: 7928684 - DNA, 20 bp, Homo sapiens
accaggagatggaggcaggg

SEQ ID NO: 7928685 - DNA, 20 bp, Homo sapiens
accaggagatggaggcaggg

SEQ ID NO: 7928686 - DNA, 20 bp, Homo sapiens
accaggagatggaggcaggg

SEQ ID NO: 7928687 - DNA, 22 bp, Homo sapiens
accaggagccacaggaggagcc

SEQ ID NO: 7928688 - DNA, 23 bp, Homo sapiens
accaggagccaagatctccctgg

SEQ ID NO: 7928689 - DNA, 22 bp, Homo sapiens
accaggagccacaggaggagcc

SEQ ID NO: 7928690 - DNA, 22 bp, Homo sapiens
accaggagccacaggaggagcc

SEQ ID NO: 7928691 - DNA, 22 bp, Homo sapiens
accaggagccacaggaggagcc

SEQ ID NO: 7928692 - DNA, 22 bp, Homo sapiens
accaggaggctacactgtccca

SEQ ID NO: 7928693 - DNA, 22 bp, Homo sapiens
accaggaggcctggagcacaaa

SEQ ID NO: 7928694 - DNA, 22 bp, Homo sapiens
accaggaggcctggagcacaaa

SEQ ID NO: 7928695 - DNA, 22 bp, Homo sapiens
accaggaggcctggagcacaaa

SEQ ID NO: 7928696 - DNA, 22 bp, Homo sapiens
accaggaggcctggagcacaaa

SEQ ID NO: 7928697 - DNA, 22 bp, Homo sapiens
accaggaggaagtgttaatgat

SEQ ID NO: 7928698 - DNA, 22 bp, Homo sapiens
accaggagccatagagtcaggc

SEQ ID NO: 7928699 - DNA, 22 bp, Homo sapiens
accaggagccatagagtcaggc

SEQ ID NO: 7928700 - DNA, 22 bp, Homo sapiens
accaggagccatagagtcaggc

SEQ ID NO: 7928701 - DNA, 22 bp, Homo sapiens
accaggagccatagagtcaggc

SEQ ID NO: 7928702 - DNA, 22 bp, Homo sapiens
accaggagaggcacttgcaatg

SEQ ID NO: 7928703 - DNA, 20 bp, Homo sapiens
accaggagatggaggcaggg

SEQ ID NO: 7928704 - DNA, 19 bp, Homo sapiens
accaggagacagtgagctt

SEQ ID NO: 7928705 - DNA, 22 bp, Homo sapiens
accaggagacatgaccaatgag

SEQ ID NO: 7928706 - DNA, 20 bp, Homo sapiens
accaggaatcttttctgagc

SEQ ID NO: 7928707 - DNA, 20 bp, Homo sapiens
accaggaatcttttctgagc

SEQ ID NO: 7928708 - DNA, 22 bp, Homo sapiens
accaggactttgtattcagctt

SEQ ID NO: 7928709 - DNA, 19 bp, Homo sapiens
accaggagacagtgagctt

SEQ ID NO: 7928710 - DNA, 19 bp, Homo sapiens
accaggagacagtgagctt

SEQ ID NO: 7928711 - DNA, 19 bp, Homo sapiens
accaggagacagtgagctt

SEQ ID NO: 7928712 - DNA, 22 bp, Homo sapiens
accaggaagaacaggcaaggca

SEQ ID NO: 7928713 - DNA, 22 bp, Homo sapiens
accaggaagaacaggcaaggca

SEQ ID NO: 7928714 - DNA, 22 bp, Homo sapiens
accaggaagagattccaattta

SEQ ID NO: 7928715 - DNA, 22 bp, Homo sapiens
accaggaagagattccaattta

SEQ ID NO: 7928716 - DNA, 19 bp, Homo sapiens
accaggaacttccctaggc

SEQ ID NO: 7928717 - DNA, 22 bp, Homo sapiens
accaggaagaacaggcaaggca

SEQ ID NO: 7928718 - DNA, 22 bp, Homo sapiens
accaggaactcacccgcagagg

SEQ ID NO: 7928719 - DNA, 22 bp, Homo sapiens
accaggaacaagccatggagga

SEQ ID NO: 7928720 - DNA, 22 bp, Homo sapiens
accaggaacaagccatggagga

SEQ ID NO: 7928721 - DNA, 22 bp, Homo sapiens
accaggaacaagccatggagga

SEQ ID NO: 7928722 - DNA, 19 bp, Homo sapiens
accaggaacttccctaggc

SEQ ID NO: 7928723 - DNA, 19 bp, Homo sapiens
accaggaacttccctaggc

SEQ ID NO: 7928724 - DNA, 22 bp, Homo sapiens
accaggaagctgtgagaccttt

SEQ ID NO: 7928725 - DNA, 22 bp, Homo sapiens
accaggaagcatccctttgtaa

SEQ ID NO: 7928726 - DNA, 22 bp, Homo sapiens
accaggaagagattccaattta

SEQ ID NO: 7928727 - DNA, 22 bp, Homo sapiens
accaggaagcatccctttgtaa

SEQ ID NO: 7928728 - DNA, 18 bp, Homo sapiens
accaggaagcttcttgtc

SEQ ID NO: 7928729 - DNA, 22 bp, Homo sapiens
accaggaagctgtgagaccttt

SEQ ID NO: 7928730 - DNA, 20 bp, Homo sapiens
accaggaatcttttctgagc

SEQ ID NO: 7928731 - DNA, 22 bp, Homo sapiens
accaggaatattttgctcattt

SEQ ID NO: 7928732 - DNA, 22 bp, Homo sapiens
accaggaatattttgctcattt

SEQ ID NO: 7928733 - DNA, 22 bp, Homo sapiens
accaggaagtgtgggccaacgt

SEQ ID NO: 7928734 - DNA, 22 bp, Homo sapiens
accaggaagtgtgggccaacgt

SEQ ID NO: 7928735 - DNA, 18 bp, Homo sapiens
accaggaagcttcttgtc

SEQ ID NO: 7928736 - DNA, 22 bp, Homo sapiens
accagtctgttgttgcagagtg

SEQ ID NO: 7928737 - DNA, 22 bp, Homo sapiens
accagtctaggcaatgggggct

SEQ ID NO: 7928738 - DNA, 22 bp, Homo sapiens
accagtccgcggagctccgggg

SEQ ID NO: 7928739 - DNA, 22 bp, Homo sapiens
accagtccgcggagctccgggg

SEQ ID NO: 7928740 - DNA, 22 bp, Homo sapiens
accagtatgtgccttcagtgtc

SEQ ID NO: 7928741 - DNA, 22 bp, Homo sapiens
accagtatgtgccttcagtgtc

SEQ ID NO: 7928742 - DNA, 21 bp, Homo sapiens
accagtccctagtcttatcct

SEQ ID NO: 7928743 - DNA, 22 bp, Homo sapiens
accaggtggccccagcgtggtt

SEQ ID NO: 7928744 - DNA, 22 bp, Homo sapiens
accaggtaccttacacttggct

SEQ ID NO: 7928745 - DNA, 22 bp, Homo sapiens
accaggtaatgtaaagcagggt

SEQ ID NO: 7928746 - DNA, 22 bp, Homo sapiens
accagggttgagtcagctgcgt

SEQ ID NO: 7928747 - DNA, 22 bp, Homo sapiens
accagggttgagtcagctgcgt

SEQ ID NO: 7928748 - DNA, 22 bp, Homo sapiens
accaggttggtgtccttctggc

SEQ ID NO: 7928749 - DNA, 20 bp, Homo sapiens
accaggtggctgatgacacc

SEQ ID NO: 7928750 - DNA, 20 bp, Homo sapiens
accaggtggctgatgacacc

SEQ ID NO: 7928751 - DNA, 22 bp, Homo sapiens
accagtcttgttgccatgtctg

SEQ ID NO: 7928752 - DNA, 22 bp, Homo sapiens
accagtcttgttgccatgtctg

SEQ ID NO: 7928753 - DNA, 22 bp, Homo sapiens
accagtgagtatttgtaacaga

SEQ ID NO: 7928754 - DNA, 22 bp, Homo sapiens
accagtgacttcattcctaaaa

SEQ ID NO: 7928755 - DNA, 22 bp, Homo sapiens
accagtggatactgcttgcttt

SEQ ID NO: 7928756 - DNA, 22 bp, Homo sapiens
accagtgcttcctgctggagct

SEQ ID NO: 7928757 - DNA, 22 bp, Homo sapiens
accagttaaagggaaattgaaa

SEQ ID NO: 7928758 - DNA, 22 bp, Homo sapiens
accagttaaagaatatgaggcc

SEQ ID NO: 7928759 - DNA, 22 bp, Homo sapiens
accagtgtcttattgaccatct

SEQ ID NO: 7928760 - DNA, 22 bp, Homo sapiens
accagtgtcaccccaaccagga

SEQ ID NO: 7928761 - DNA, 22 bp, Homo sapiens
accagtgggtgtcattccctta

SEQ ID NO: 7928762 - DNA, 22 bp, Homo sapiens
accagtggatgaatgctggacc

SEQ ID NO: 7928763 - DNA, 22 bp, Homo sapiens
accagtggatgaatgctggacc

SEQ ID NO: 7928764 - DNA, 21 bp, Homo sapiens
agggcctctcatttgtgccag

SEQ ID NO: 7928765 - DNA, 22 bp, Homo sapiens
agggcctcgaaggcagagggat

SEQ ID NO: 7928766 - DNA, 22 bp, Homo sapiens
agggcctcgggctcagtgggtc

SEQ ID NO: 7928767 - DNA, 22 bp, Homo sapiens
agggcctcgggctcagtgggtc

SEQ ID NO: 7928768 - DNA, 23 bp, Homo sapiens
agggcccaagcctggacagcagg

SEQ ID NO: 7928769 - DNA, 23 bp, Homo sapiens
agggcccaagcctggacagcagg

SEQ ID NO: 7928770 - DNA, 22 bp, Homo sapiens
agggccagttctacctctgaat

SEQ ID NO: 7928771 - DNA, 22 bp, Homo sapiens
agggccatttgctggagctttg

SEQ ID NO: 7928772 - DNA, 23 bp, Homo sapiens
agggcccaagcctggacagcagg

SEQ ID NO: 7928773 - DNA, 23 bp, Homo sapiens
agggcccaagcctggacagcagg

SEQ ID NO: 7928774 - DNA, 22 bp, Homo sapiens
agggcctcctaatttcctcata

SEQ ID NO: 7928775 - DNA, 23 bp, Homo sapiens
agggcccaagcctggacagcagg

SEQ ID NO: 7928776 - DNA, 22 bp, Homo sapiens
agggcctcctaatttcctcata

SEQ ID NO: 7928777 - DNA, 22 bp, Homo sapiens
agggcctcctaatttcctcata

SEQ ID NO: 7928778 - DNA, 22 bp, Homo sapiens
agggcctcctaatttcctcata

SEQ ID NO: 7928779 - DNA, 22 bp, Homo sapiens
accatacttgaaatggatagga

SEQ ID NO: 7928780 - DNA, 22 bp, Homo sapiens
accatagttataacaaagtgtt

SEQ ID NO: 7928781 - DNA, 22 bp, Homo sapiens
accatagactggaggatctcct

SEQ ID NO: 7928782 - DNA, 20 bp, Homo sapiens
accataatgttaattacaaa

SEQ ID NO: 7928783 - DNA, 22 bp, Homo sapiens
accataattacttggctttttc

SEQ ID NO: 7928784 - DNA, 22 bp, Homo sapiens
accatacacaatttgcaacggt

SEQ ID NO: 7928785 - DNA, 22 bp, Homo sapiens
accagttttttatacatcttct

SEQ ID NO: 7928786 - DNA, 22 bp, Homo sapiens
accagttattagccctacaact

SEQ ID NO: 7928787 - DNA, 22 bp, Homo sapiens
accagttacatcttagcaagca

SEQ ID NO: 7928788 - DNA, 22 bp, Homo sapiens
accagttattagccctacaact

SEQ ID NO: 7928789 - DNA, 22 bp, Homo sapiens
accaggagggaccctggtggcc

SEQ ID NO: 7928790 - DNA, 22 bp, Homo sapiens
accaggaggtgtttgctcaagt

SEQ ID NO: 7928791 - DNA, 22 bp, Homo sapiens
accaggaggtgtttgctcaagt

SEQ ID NO: 7928792 - DNA, 22 bp, Homo sapiens
accaggagtaacagtgagtggt

SEQ ID NO: 7928793 - DNA, 22 bp, Homo sapiens
accaggagggaccctggtggcc

SEQ ID NO: 7928794 - DNA, 22 bp, Homo sapiens
accaggagggaccctggtggcc

SEQ ID NO: 7928795 - DNA, 22 bp, Homo sapiens
accaggagggaccctggtggcc

SEQ ID NO: 7928796 - DNA, 19 bp, Homo sapiens
accaggagtatcagagctg

SEQ ID NO: 7928797 - DNA, 19 bp, Homo sapiens
accaggagtatcagagctg

SEQ ID NO: 7928798 - DNA, 19 bp, Homo sapiens
accaggagtatcagagctg

SEQ ID NO: 7928799 - DNA, 19 bp, Homo sapiens
accaggagtatcagagctg

SEQ ID NO: 7928800 - DNA, 22 bp, Homo sapiens
accaggagtagaatatctgtga

SEQ ID NO: 7928801 - DNA, 22 bp, Homo sapiens
accaggagtaacagtgagtggt

SEQ ID NO: 7928802 - DNA, 22 bp, Homo sapiens
accaggagtaacagtgagtggt

SEQ ID NO: 7928803 - DNA, 22 bp, Homo sapiens
accaggagtctagcctagtcaa

SEQ ID NO: 7928804 - DNA, 22 bp, Homo sapiens
accaggagttgggggtgggacc

SEQ ID NO: 7928805 - DNA, 22 bp, Homo sapiens
accaggctgtgaagtgagacta

SEQ ID NO: 7928806 - DNA, 22 bp, Homo sapiens
accaggctgtgaagtgagacta

SEQ ID NO: 7928807 - DNA, 22 bp, Homo sapiens
accaggagtctagcctagtcaa

SEQ ID NO: 7928808 - DNA, 22 bp, Homo sapiens
accagggcacattccggccaga

SEQ ID NO: 7928809 - DNA, 22 bp, Homo sapiens
accaggctgttgggcccagtgt

SEQ ID NO: 7928810 - DNA, 22 bp, Homo sapiens
accaggctgttgggcccagtgt

SEQ ID NO: 7928811 - DNA, 22 bp, Homo sapiens
accaggctgttgggcccagtgt

SEQ ID NO: 7928812 - DNA, 22 bp, Homo sapiens
accaggctgtgaagtgagacta

SEQ ID NO: 7928813 - DNA, 22 bp, Homo sapiens
accagggcagccgaggtgtgtc

SEQ ID NO: 7928814 - DNA, 22 bp, Homo sapiens
accagggcagccgaggtgtgtc

SEQ ID NO: 7928815 - DNA, 22 bp, Homo sapiens
accagggcacattccggccaga

SEQ ID NO: 7928816 - DNA, 22 bp, Homo sapiens
accagggcttacagcagtagct

SEQ ID NO: 7928817 - DNA, 22 bp, Homo sapiens
accagggcttacagcagtagct

SEQ ID NO: 7928818 - DNA, 22 bp, Homo sapiens
accaggggatggttggcactgt

SEQ ID NO: 7928819 - DNA, 22 bp, Homo sapiens
accaggggtgtcaacagcattt

SEQ ID NO: 7928820 - DNA, 22 bp, Homo sapiens
accaggggtgtcaacagcattt

SEQ ID NO: 7928821 - DNA, 22 bp, Homo sapiens
accagggcttacagcagtagct

SEQ ID NO: 7928822 - DNA, 22 bp, Homo sapiens
accagggcttacagcagtagct

SEQ ID NO: 7928823 - DNA, 22 bp, Homo sapiens
accagggctgggataggtcagg

SEQ ID NO: 7928824 - DNA, 22 bp, Homo sapiens
accagggcttacagcagtagct

SEQ ID NO: 7928825 - DNA, 22 bp, Homo sapiens
accagggctgggataggtcagg

SEQ ID NO: 7928826 - DNA, 22 bp, Homo sapiens
accagggctgggataggtcagg

SEQ ID NO: 7928827 - DNA, 22 bp, Homo sapiens
accagggcggcttgaggaggca

SEQ ID NO: 7928828 - DNA, 22 bp, Homo sapiens
accagggcggcttgaggaggca

SEQ ID NO: 7928829 - DNA, 22 bp, Homo sapiens
accagggccgcgggcgactagc

SEQ ID NO: 7928830 - DNA, 22 bp, Homo sapiens
accagggcggcttgaggaggca

SEQ ID NO: 7928831 - DNA, 22 bp, Homo sapiens
accagggcggcttgaggaggca

SEQ ID NO: 7928832 - DNA, 22 bp, Homo sapiens
accagggcccgggagagctctc

SEQ ID NO: 7928833 - DNA, 22 bp, Homo sapiens
accagggcccgggagagctctc

SEQ ID NO: 7928834 - DNA, 22 bp, Homo sapiens
accagggcccgggagagctctc

SEQ ID NO: 7928835 - DNA, 22 bp, Homo sapiens
accagggcccgggagagctctc

SEQ ID NO: 7928836 - DNA, 22 bp, Homo sapiens
accagggcccgggagagctctc

SEQ ID NO: 7928837 - DNA, 22 bp, Homo sapiens
accagggcagccgaggtgtgtc

SEQ ID NO: 7928838 - DNA, 22 bp, Homo sapiens
accagggcagccgaggtgtgtc

SEQ ID NO: 7928839 - DNA, 22 bp, Homo sapiens
acccagggtagagtgcagtggc

SEQ ID NO: 7928840 - DNA, 22 bp, Homo sapiens
acccagggtcaccccgtagggt

SEQ ID NO: 7928841 - DNA, 22 bp, Homo sapiens
acccagggtagagtgcagtggc

SEQ ID NO: 7928842 - DNA, 22 bp, Homo sapiens
acccagggtagagtgcagtggc

SEQ ID NO: 7928843 - DNA, 22 bp, Homo sapiens
acccagggtagaacctcagagc

SEQ ID NO: 7928844 - DNA, 22 bp, Homo sapiens
acccagggagtgctcctgttct

SEQ ID NO: 7928845 - DNA, 22 bp, Homo sapiens
acccagggtagagtgcagtggc

SEQ ID NO: 7928846 - DNA, 22 bp, Homo sapiens
acccaggctggcgtgcagtggc

SEQ ID NO: 7928847 - DNA, 22 bp, Homo sapiens
acccagagcagagcttggcttc

SEQ ID NO: 7928848 - DNA, 22 bp, Homo sapiens
acccagggaccccgctgacgcc

SEQ ID NO: 7928849 - DNA, 17 bp, Homo sapiens
acccagagaaggaggtc

SEQ ID NO: 7928850 - DNA, 22 bp, Homo sapiens
acccagagatggacctggctgc

SEQ ID NO: 7928851 - DNA, 22 bp, Homo sapiens
acccagagactagcacggtaca

SEQ ID NO: 7928852 - DNA, 22 bp, Homo sapiens
acccagagactagcacggtaca

SEQ ID NO: 7928853 - DNA, 22 bp, Homo sapiens
acccagagatgtcaatggcttt

SEQ ID NO: 7928854 - DNA, 22 bp, Homo sapiens
acccagagcacagatgcaacgt

SEQ ID NO: 7928855 - DNA, 22 bp, Homo sapiens
acccagagcacagatgcaacgt

SEQ ID NO: 7928856 - DNA, 22 bp, Homo sapiens
acccaggctggcgtgcagtggc

SEQ ID NO: 7928857 - DNA, 22 bp, Homo sapiens
acccagagcactgggtgtgggc

SEQ ID NO: 7928858 - DNA, 22 bp, Homo sapiens
acccagagcactgggtgtgggc

SEQ ID NO: 7928859 - DNA, 22 bp, Homo sapiens
acccagagcacagatgcaacgt

SEQ ID NO: 7928860 - DNA, 22 bp, Homo sapiens
acccagggtttgagctctgcag

SEQ ID NO: 7928861 - DNA, 22 bp, Homo sapiens
acccagggtttgagctctgcag

SEQ ID NO: 7928862 - DNA, 22 bp, Homo sapiens
acccagtcatcctggtgtgaga

SEQ ID NO: 7928863 - DNA, 22 bp, Homo sapiens
acccagtctggagtgcagtgac

SEQ ID NO: 7928864 - DNA, 22 bp, Homo sapiens
acccagtgacatcctttacctg

SEQ ID NO: 7928865 - DNA, 22 bp, Homo sapiens
acccagtgacatcctttacctg

SEQ ID NO: 7928866 - DNA, 22 bp, Homo sapiens
acccagtgttgggcagaactgt

SEQ ID NO: 7928867 - DNA, 22 bp, Homo sapiens
acccatacacacatatttatgt

SEQ ID NO: 7928868 - DNA, 18 bp, Homo sapiens
acccagtttgaaggaaag

SEQ ID NO: 7928869 - DNA, 19 bp, Homo sapiens
acccagggttgatgtccag

SEQ ID NO: 7928870 - DNA, 22 bp, Homo sapiens
acccagggtttgagctctgcag

SEQ ID NO: 7928871 - DNA, 19 bp, Homo sapiens
acccagggttgatgtccag

SEQ ID NO: 7928872 - DNA, 19 bp, Homo sapiens
acccagggttgatgtccag

SEQ ID NO: 7928873 - DNA, 22 bp, Homo sapiens
acccagggttcctgggtcccag

SEQ ID NO: 7928874 - DNA, 22 bp, Homo sapiens
acccagggtagagtgcagtggc

SEQ ID NO: 7928875 - DNA, 22 bp, Homo sapiens
acccagggttcctgggtcccag

SEQ ID NO: 7928876 - DNA, 22 bp, Homo sapiens
acccagggtcaccccgtagggt

SEQ ID NO: 7928877 - DNA, 22 bp, Homo sapiens
acccagggtcaccccgtagggt

SEQ ID NO: 7928878 - DNA, 22 bp, Homo sapiens
acccacgaagatgagcggcatg

SEQ ID NO: 7928879 - DNA, 22 bp, Homo sapiens
acccactgtcatctctgaccac

SEQ ID NO: 7928880 - DNA, 22 bp, Homo sapiens
acccactgtagccactctgggt

SEQ ID NO: 7928881 - DNA, 22 bp, Homo sapiens
acccagagaactgtgccttgag

SEQ ID NO: 7928882 - DNA, 22 bp, Homo sapiens
acccagagaactgaggcatgaa

SEQ ID NO: 7928883 - DNA, 22 bp, Homo sapiens
acccagagaactgtgccttgag

SEQ ID NO: 7928884 - DNA, 22 bp, Homo sapiens
acccagagaactgtgccttgag

SEQ ID NO: 7928885 - DNA, 22 bp, Homo sapiens
acccagagaactgaggcatgaa

SEQ ID NO: 7928886 - DNA, 22 bp, Homo sapiens
acccagagaactgaggcatgaa

SEQ ID NO: 7928887 - DNA, 22 bp, Homo sapiens
acccagagaactgaggcatgaa

SEQ ID NO: 7928888 - DNA, 22 bp, Homo sapiens
agggcctgagctctcctccagt

SEQ ID NO: 7928889 - DNA, 22 bp, Homo sapiens
agggcctgagctctcctccagt

SEQ ID NO: 7928890 - DNA, 19 bp, Homo sapiens
agggcctgagcagatgttg

SEQ ID NO: 7928891 - DNA, 22 bp, Homo sapiens
agggcctgagctctcctccagt

SEQ ID NO: 7928892 - DNA, 22 bp, Homo sapiens
acccaccctactagcagtgtcc

SEQ ID NO: 7928893 - DNA, 22 bp, Homo sapiens
acccaccacagtggctggcaca

SEQ ID NO: 7928894 - DNA, 22 bp, Homo sapiens
acccaccctactagcagtgtcc

SEQ ID NO: 7928895 - DNA, 22 bp, Homo sapiens
acccaccctactagcagtgtcc

SEQ ID NO: 7928896 - DNA, 22 bp, Homo sapiens
acccaccctactagcagtgtcc

SEQ ID NO: 7928897 - DNA, 22 bp, Homo sapiens
acccaccctactagcagtgtcc

SEQ ID NO: 7928898 - DNA, 22 bp, Homo sapiens
acccacagccgctgtgcgtccc

SEQ ID NO: 7928899 - DNA, 22 bp, Homo sapiens
agggcctctgacgcccccagcc

SEQ ID NO: 7928900 - DNA, 22 bp, Homo sapiens
agggcctctctgggcctttcct

SEQ ID NO: 7928901 - DNA, 21 bp, Homo sapiens
agggcctctcatttgtgccag

SEQ ID NO: 7928902 - DNA, 21 bp, Homo sapiens
agggcctctcatttgtgccag

SEQ ID NO: 7928903 - DNA, 22 bp, Homo sapiens
agggcctctctgggcctttcct

SEQ ID NO: 7928904 - DNA, 22 bp, Homo sapiens
agggcctctgagccagttctgg

SEQ ID NO: 7928905 - DNA, 22 bp, Homo sapiens
agggcctctggaacactgaggg

SEQ ID NO: 7928906 - DNA, 22 bp, Homo sapiens
agggcctctgagccagttctgg

SEQ ID NO: 7928907 - DNA, 22 bp, Homo sapiens
agggcctctgagccagttctgg

SEQ ID NO: 7928908 - DNA, 23 bp, Homo sapiens
agggcctctgtcccccagcactc

SEQ ID NO: 7928909 - DNA, 21 bp, Homo sapiens
agggcctctgtgtactggggg

SEQ ID NO: 7928910 - DNA, 23 bp, Homo sapiens
agggcctctgtcccccagcactc

SEQ ID NO: 7928911 - DNA, 23 bp, Homo sapiens
agggcctctgtcccccagcactc

SEQ ID NO: 7928912 - DNA, 23 bp, Homo sapiens
agggcctctgtcccccagcactc

SEQ ID NO: 7928913 - DNA, 22 bp, Homo sapiens
agggcctctggaacactgaggg

SEQ ID NO: 7928914 - DNA, 22 bp, Homo sapiens
agggcctctggaacactgaggg

SEQ ID NO: 7928915 - DNA, 22 bp, Homo sapiens
agggcctctggaacactgaggg

SEQ ID NO: 7928916 - DNA, 22 bp, Homo sapiens
agggcctctggaacactgaggg

SEQ ID NO: 7928917 - DNA, 19 bp, Homo sapiens
agggcctgagcagatgttg

SEQ ID NO: 7928918 - DNA, 22 bp, Homo sapiens
agggcctgagaccgtggcttga

SEQ ID NO: 7928919 - DNA, 22 bp, Homo sapiens
agggcctgacacccttgccagc

SEQ ID NO: 7928920 - DNA, 22 bp, Homo sapiens
agggcctgacacccttgccagc

SEQ ID NO: 7928921 - DNA, 22 bp, Homo sapiens
agggcctgacacccttgccagc

SEQ ID NO: 7928922 - DNA, 22 bp, Homo sapiens
agggcctgacacccttgccagc

SEQ ID NO: 7928923 - DNA, 22 bp, Homo sapiens
agggcctgagaccgtggcttga

SEQ ID NO: 7928924 - DNA, 22 bp, Homo sapiens
accctgggtcatatacagtgtg

SEQ ID NO: 7928925 - DNA, 22 bp, Homo sapiens
accctgggtatttcccaaactt

SEQ ID NO: 7928926 - DNA, 22 bp, Homo sapiens
accctggggtcacccttctctg

SEQ ID NO: 7928927 - DNA, 22 bp, Homo sapiens
accctgggcttggcctgctcag

SEQ ID NO: 7928928 - DNA, 22 bp, Homo sapiens
accctgggcttggcctgctcag

SEQ ID NO: 7928929 - DNA, 22 bp, Homo sapiens
accctgggggtggccagtgcca

SEQ ID NO: 7928930 - DNA, 22 bp, Homo sapiens
accctggggtcacccttctctg

SEQ ID NO: 7928931 - DNA, 22 bp, Homo sapiens
accctgggggtggccagtgcca

SEQ ID NO: 7928932 - DNA, 22 bp, Homo sapiens
accctgggggtggccagtgcca

SEQ ID NO: 7928933 - DNA, 22 bp, Homo sapiens
accctgggtgagaggcaaacag

SEQ ID NO: 7928934 - DNA, 22 bp, Homo sapiens
accctgggttcccgcagcacca

SEQ ID NO: 7928935 - DNA, 22 bp, Homo sapiens
accctgggtctcaatcatccta

SEQ ID NO: 7928936 - DNA, 22 bp, Homo sapiens
accctgggtgagaggcaaacag

SEQ ID NO: 7928937 - DNA, 22 bp, Homo sapiens
accctgggttcccgcagcacca

SEQ ID NO: 7928938 - DNA, 22 bp, Homo sapiens
accctgggttcccgcagcacca

SEQ ID NO: 7928939 - DNA, 22 bp, Homo sapiens
accctggtctctacttcacaga

SEQ ID NO: 7928940 - DNA, 22 bp, Homo sapiens
accctggagcaataatccctgg

SEQ ID NO: 7928941 - DNA, 22 bp, Homo sapiens
accctggagcttttctggccct

SEQ ID NO: 7928942 - DNA, 22 bp, Homo sapiens
accctggagcttttctggccct

SEQ ID NO: 7928943 - DNA, 22 bp, Homo sapiens
accctggaggtctacagtgcag

SEQ ID NO: 7928944 - DNA, 22 bp, Homo sapiens
accctggaggtggaggtgcagt

SEQ ID NO: 7928945 - DNA, 22 bp, Homo sapiens
accctggattgggaaccagaag

SEQ ID NO: 7928946 - DNA, 22 bp, Homo sapiens
accctggcccattgctgtgcct

SEQ ID NO: 7928947 - DNA, 18 bp, Homo sapiens
accctggcatgctcttcc

SEQ ID NO: 7928948 - DNA, 22 bp, Homo sapiens
accctggcagccttctgtcctg

SEQ ID NO: 7928949 - DNA, 22 bp, Homo sapiens
accctggcagccttctgtcctg

SEQ ID NO: 7928950 - DNA, 22 bp, Homo sapiens
accctggcctggttcatgtgat

SEQ ID NO: 7928951 - DNA, 22 bp, Homo sapiens
accctggctctctggccaccgc

SEQ ID NO: 7928952 - DNA, 22 bp, Homo sapiens
accctggcccattgctgtgcct

SEQ ID NO: 7928953 - DNA, 22 bp, Homo sapiens
accctggcctggttcatgtgat

SEQ ID NO: 7928954 - DNA, 22 bp, Homo sapiens
accctgggacctggaggtggat

SEQ ID NO: 7928955 - DNA, 22 bp, Homo sapiens
accctgggacctggaggtggat

SEQ ID NO: 7928956 - DNA, 22 bp, Homo sapiens
accctgggcttggcctgctcag

SEQ ID NO: 7928957 - DNA, 22 bp, Homo sapiens
accccagcgcatatggtctgcg

SEQ ID NO: 7928958 - DNA, 22 bp, Homo sapiens
accccagccctgcttctgggag

SEQ ID NO: 7928959 - DNA, 22 bp, Homo sapiens
accccagaggcggaggctgcag

SEQ ID NO: 7928960 - DNA, 22 bp, Homo sapiens
accccagcgcatatggtctgcg

SEQ ID NO: 7928961 - DNA, 22 bp, Homo sapiens
accccagcgcatatggtctgcg

SEQ ID NO: 7928962 - DNA, 22 bp, Homo sapiens
accctgcctgacaacagaggat

SEQ ID NO: 7928963 - DNA, 22 bp, Homo sapiens
accctcttgagggaagcacttt

SEQ ID NO: 7928964 - DNA, 18 bp, Homo sapiens
accctctggcttctgagc

SEQ ID NO: 7928965 - DNA, 22 bp, Homo sapiens
accctggactggggctgaggct

SEQ ID NO: 7928966 - DNA, 22 bp, Homo sapiens
accctggactggggctgaggct

SEQ ID NO: 7928967 - DNA, 22 bp, Homo sapiens
accctggactggggctgaggct

SEQ ID NO: 7928968 - DNA, 22 bp, Homo sapiens
accctggacatcttgtcatagc

SEQ ID NO: 7928969 - DNA, 22 bp, Homo sapiens
accccaagacagtagaagagaa

SEQ ID NO: 7928970 - DNA, 20 bp, Homo sapiens
accccacagagtccattgca

SEQ ID NO: 7928971 - DNA, 22 bp, Homo sapiens
accccaagacagtagaagagaa

SEQ ID NO: 7928972 - DNA, 22 bp, Homo sapiens
acccatttttaaatataacttg

SEQ ID NO: 7928973 - DNA, 22 bp, Homo sapiens
accccactcacacatggacctg

SEQ ID NO: 7928974 - DNA, 22 bp, Homo sapiens
acccatgtgctcttttgtaccc

SEQ ID NO: 7928975 - DNA, 22 bp, Homo sapiens
acccatttcataaacatgcttt

SEQ ID NO: 7928976 - DNA, 23 bp, Homo sapiens
acccatctctcctgtcatgcaga

SEQ ID NO: 7928977 - DNA, 23 bp, Homo sapiens
acccatctctcctgtcatgcaga

SEQ ID NO: 7928978 - DNA, 22 bp, Homo sapiens
acccatgagtgtatctttaaaa

SEQ ID NO: 7928979 - DNA, 22 bp, Homo sapiens
acccatgagcttcttaaaatat

SEQ ID NO: 7928980 - DNA, 22 bp, Homo sapiens
acccatcagcggctggagctgg

SEQ ID NO: 7928981 - DNA, 22 bp, Homo sapiens
acccatcacttttaggctttgc

SEQ ID NO: 7928982 - DNA, 22 bp, Homo sapiens
acccatccagtgtccctgctag

SEQ ID NO: 7928983 - DNA, 17 bp, Homo sapiens
acccatccccagggcag

SEQ ID NO: 7928984 - DNA, 23 bp, Homo sapiens
acccatctctcctgtcatgcaga

SEQ ID NO: 7928985 - DNA, 20 bp, Homo sapiens
acatgaaaggaaacaggaaa

SEQ ID NO: 7928986 - DNA, 20 bp, Homo sapiens
acatgaaaggaaacaggaaa

SEQ ID NO: 7928987 - DNA, 20 bp, Homo sapiens
acatgaaaggaaacaggaaa

SEQ ID NO: 7928988 - DNA, 22 bp, Homo sapiens
aggccaggtggtcatgcttgct

SEQ ID NO: 7928989 - DNA, 22 bp, Homo sapiens
aggccaggtggtcatgcttgct

SEQ ID NO: 7928990 - DNA, 20 bp, Homo sapiens
acatgaaaggaaacaggaaa

SEQ ID NO: 7928991 - DNA, 22 bp, Homo sapiens
acatgaaacctgagtctaactc

SEQ ID NO: 7928992 - DNA, 21 bp, Homo sapiens
aggcccagctttcctcttgct

SEQ ID NO: 7928993 - DNA, 21 bp, Homo sapiens
aggcccagctttcctcttgct

SEQ ID NO: 7928994 - DNA, 22 bp, Homo sapiens
aggcccagcttgaagtgggaag

SEQ ID NO: 7928995 - DNA, 22 bp, Homo sapiens
aggcccagcttgaagtgggaag

SEQ ID NO: 7928996 - DNA, 22 bp, Homo sapiens
aggcccagcttgaagtgggaag

SEQ ID NO: 7928997 - DNA, 22 bp, Homo sapiens
aggcccagctgggccaggaaca

SEQ ID NO: 7928998 - DNA, 22 bp, Homo sapiens
aggcccagcttgaagtgggaag

SEQ ID NO: 7928999 - DNA, 22 bp, Homo sapiens
aggcccagcttgaagtgggaag

SEQ ID NO: 7929000 - DNA, 22 bp, Homo sapiens
aggcccagcttgaagtgggaag

SEQ ID NO: 7929001 - DNA, 22 bp, Homo sapiens
aggcccagctgggccaggaaca

SEQ ID NO: 7929002 - DNA, 22 bp, Homo sapiens
aggcccagctgggccaggaaca

SEQ ID NO: 7929003 - DNA, 22 bp, Homo sapiens
aggccaggtggtcatgcttgct

SEQ ID NO: 7929004 - DNA, 22 bp, Homo sapiens
aggccaggtggtcatgcttgct

SEQ ID NO: 7929005 - DNA, 22 bp, Homo sapiens
aggccaggtggtcatgcttgct

SEQ ID NO: 7929006 - DNA, 22 bp, Homo sapiens
aggccaggtggtcatgcttgct

SEQ ID NO: 7929007 - DNA, 22 bp, Homo sapiens
aggccctgagaaaatccctgca

SEQ ID NO: 7929008 - DNA, 22 bp, Homo sapiens
aggccctgagaaaatccctgca

SEQ ID NO: 7929009 - DNA, 22 bp, Homo sapiens
aggccctgagaaaatccctgca

SEQ ID NO: 7929010 - DNA, 22 bp, Homo sapiens
aggccctgagaaaatccctgca

SEQ ID NO: 7929011 - DNA, 22 bp, Homo sapiens
aggcccagtagtcgacggcgct

SEQ ID NO: 7929012 - DNA, 23 bp, Homo sapiens
aggcccaggtatgtttgttttgg

SEQ ID NO: 7929013 - DNA, 22 bp, Homo sapiens
aggcccagtagtcgacggcgct

SEQ ID NO: 7929014 - DNA, 22 bp, Homo sapiens
aggccctgatccgaatccagat

SEQ ID NO: 7929015 - DNA, 22 bp, Homo sapiens
aggccctgatccgaatccagat

SEQ ID NO: 7929016 - DNA, 22 bp, Homo sapiens
aggccctgatccgaatccagat

SEQ ID NO: 7929017 - DNA, 22 bp, Homo sapiens
aggccctgagcatccgagggca

SEQ ID NO: 7929018 - DNA, 22 bp, Homo sapiens
aggccctgagcatccgagggca

SEQ ID NO: 7929019 - DNA, 22 bp, Homo sapiens
aggccctgagcatccgagggca

SEQ ID NO: 7929020 - DNA, 22 bp, Homo sapiens
aggccctgagcatccgagggca

SEQ ID NO: 7929021 - DNA, 21 bp, Homo sapiens
aggcccaggaatatgcatttt

SEQ ID NO: 7929022 - DNA, 21 bp, Homo sapiens
aggcccagctttcctcttgct

SEQ ID NO: 7929023 - DNA, 21 bp, Homo sapiens
aggcccaggaatatgcatttt

SEQ ID NO: 7929024 - DNA, 21 bp, Homo sapiens
aggcccagctttcctcttgct

SEQ ID NO: 7929025 - DNA, 21 bp, Homo sapiens
aggcccagctttcctcttgct

SEQ ID NO: 7929026 - DNA, 22 bp, Homo sapiens
aggcccagggctgctctctgaa

SEQ ID NO: 7929027 - DNA, 22 bp, Homo sapiens
aggcccagggctgctctctgaa

SEQ ID NO: 7929028 - DNA, 22 bp, Homo sapiens
aggcccagggctgctctctgaa

SEQ ID NO: 7929029 - DNA, 21 bp, Homo sapiens
aggcccaggaatatgcatttt

SEQ ID NO: 7929030 - DNA, 22 bp, Homo sapiens
aggcccagggctgctctctgaa

SEQ ID NO: 7929031 - DNA, 22 bp, Homo sapiens
aggcccagggctgctctctgaa

SEQ ID NO: 7929032 - DNA, 22 bp, Homo sapiens
aggcccagggctgctctctgaa

SEQ ID NO: 7929033 - DNA, 23 bp, Homo sapiens
aggcccaggtatgtttgttttgg

SEQ ID NO: 7929034 - DNA, 22 bp, Homo sapiens
aggcccagggctgctctctgaa

SEQ ID NO: 7929035 - DNA, 22 bp, Homo sapiens
aggcccagggctgctctctgaa

SEQ ID NO: 7929036 - DNA, 22 bp, Homo sapiens
aggcccagggctgctctctgaa

SEQ ID NO: 7929037 - DNA, 22 bp, Homo sapiens
acatctttgctcttatagagct

SEQ ID NO: 7929038 - DNA, 22 bp, Homo sapiens
acatctttgctcttatagagct

SEQ ID NO: 7929039 - DNA, 22 bp, Homo sapiens
aggccagcctcaggcagggacc

SEQ ID NO: 7929040 - DNA, 22 bp, Homo sapiens
acatctttgctcttatagagct

SEQ ID NO: 7929041 - DNA, 22 bp, Homo sapiens
aggccagcctcaggcagggacc

SEQ ID NO: 7929042 - DNA, 22 bp, Homo sapiens
aggccagcctcaggcagggacc

SEQ ID NO: 7929043 - DNA, 22 bp, Homo sapiens
aggccagccctgggctgagaga

SEQ ID NO: 7929044 - DNA, 22 bp, Homo sapiens
aggccagccctgggctgagaga

SEQ ID NO: 7929045 - DNA, 22 bp, Homo sapiens
acatctttttggaaacggctga

SEQ ID NO: 7929046 - DNA, 22 bp, Homo sapiens
acatcttttttctctaattgtg

SEQ ID NO: 7929047 - DNA, 22 bp, Homo sapiens
acatctttttggaaacggctga

SEQ ID NO: 7929048 - DNA, 22 bp, Homo sapiens
acatctttgtttcttagtgtat

SEQ ID NO: 7929049 - DNA, 22 bp, Homo sapiens
acatcttttactctggttcggg

SEQ ID NO: 7929050 - DNA, 22 bp, Homo sapiens
acatctttgctcttatagagct

SEQ ID NO: 7929051 - DNA, 22 bp, Homo sapiens
acatctttgctcttatagagct

SEQ ID NO: 7929052 - DNA, 22 bp, Homo sapiens
acatctttgtttcttagtgtat

SEQ ID NO: 7929053 - DNA, 22 bp, Homo sapiens
acatctttgtttcttagtgtat

SEQ ID NO: 7929054 - DNA, 22 bp, Homo sapiens
acatgaaaagactatctgatta

SEQ ID NO: 7929055 - DNA, 22 bp, Homo sapiens
acatcttttttctctaattgtg

SEQ ID NO: 7929056 - DNA, 22 bp, Homo sapiens
acatgaaaaatgtttgcagttt

SEQ ID NO: 7929057 - DNA, 22 bp, Homo sapiens
acatgaaaactggttccttcag

SEQ ID NO: 7929058 - DNA, 22 bp, Homo sapiens
acatctttttggaaacggctga

SEQ ID NO: 7929059 - DNA, 18 bp, Homo sapiens
aggccagccctgctactg

SEQ ID NO: 7929060 - DNA, 22 bp, Homo sapiens
aggccagccctcacctgtgttc

SEQ ID NO: 7929061 - DNA, 22 bp, Homo sapiens
aggccagccctcacctgtgttc

SEQ ID NO: 7929062 - DNA, 22 bp, Homo sapiens
aggccagccctcacctgtgttc

SEQ ID NO: 7929063 - DNA, 22 bp, Homo sapiens
aggccagccctcacctgtgttc

SEQ ID NO: 7929064 - DNA, 22 bp, Homo sapiens
aggccagccctcacctgtgttc

SEQ ID NO: 7929065 - DNA, 22 bp, Homo sapiens
aggccagccctcacctgtgttc

SEQ ID NO: 7929066 - DNA, 22 bp, Homo sapiens
aggccagccctgggctgagaga

SEQ ID NO: 7929067 - DNA, 22 bp, Homo sapiens
aggccagccctgggctgagaga

SEQ ID NO: 7929068 - DNA, 22 bp, Homo sapiens
aggccagccctgggctgagaga

SEQ ID NO: 7929069 - DNA, 18 bp, Homo sapiens
aggccagccctgctactg

SEQ ID NO: 7929070 - DNA, 22 bp, Homo sapiens
aggccagccctgggctgagaga

SEQ ID NO: 7929071 - DNA, 22 bp, Homo sapiens
aggccagccctgggctgagaga

SEQ ID NO: 7929072 - DNA, 22 bp, Homo sapiens
aggccagccctcacctgtgttc

SEQ ID NO: 7929073 - DNA, 18 bp, Homo sapiens
aggccagccctgctactg

SEQ ID NO: 7929074 - DNA, 18 bp, Homo sapiens
aggccagccctgctactg

SEQ ID NO: 7929075 - DNA, 18 bp, Homo sapiens
aggccagccctgctactg

SEQ ID NO: 7929076 - DNA, 22 bp, Homo sapiens
aggccagcatgcagttctaagg

SEQ ID NO: 7929077 - DNA, 22 bp, Homo sapiens
aggccagcagcatgacggcatc

SEQ ID NO: 7929078 - DNA, 22 bp, Homo sapiens
aggccagcagcatgacggcatc

SEQ ID NO: 7929079 - DNA, 22 bp, Homo sapiens
aggccagcagacgtgggactga

SEQ ID NO: 7929080 - DNA, 22 bp, Homo sapiens
aggccagcagacgtgggactga

SEQ ID NO: 7929081 - DNA, 22 bp, Homo sapiens
aggccagcacgacagccgcagg

SEQ ID NO: 7929082 - DNA, 22 bp, Homo sapiens
aggccagcattctctctccagg

SEQ ID NO: 7929083 - DNA, 22 bp, Homo sapiens
aggccagcattctctctccagg

SEQ ID NO: 7929084 - DNA, 22 bp, Homo sapiens
aggccagcattctctctccagg

SEQ ID NO: 7929085 - DNA, 22 bp, Homo sapiens
aggccagcattctctctccagg

SEQ ID NO: 7929086 - DNA, 22 bp, Homo sapiens
aggcatggctttaggcaggcgt

SEQ ID NO: 7929087 - DNA, 22 bp, Homo sapiens
aggcatggctttaggcaggcgt

SEQ ID NO: 7929088 - DNA, 22 bp, Homo sapiens
aggcatggctttaggcaggcgt

SEQ ID NO: 7929089 - DNA, 22 bp, Homo sapiens
aggcatggctttaggcaggcgt

SEQ ID NO: 7929090 - DNA, 19 bp, Homo sapiens
aggcatgggaagagaagtc

SEQ ID NO: 7929091 - DNA, 19 bp, Homo sapiens
aggcatgggaagagaagtc

SEQ ID NO: 7929092 - DNA, 19 bp, Homo sapiens
aggcatgggaagagaagtc

SEQ ID NO: 7929093 - DNA, 19 bp, Homo sapiens
aggcatgggaagagaagtc

SEQ ID NO: 7929094 - DNA, 19 bp, Homo sapiens
aggcatgggaagagaagtc

SEQ ID NO: 7929095 - DNA, 20 bp, Homo sapiens
aggcatgggatgcccagatt

SEQ ID NO: 7929096 - DNA, 19 bp, Homo sapiens
aggcatgggaagagaagtc

SEQ ID NO: 7929097 - DNA, 20 bp, Homo sapiens
aggcatgggatgcccagatt

SEQ ID NO: 7929098 - DNA, 20 bp, Homo sapiens
aggcatgggatgcccagatt

SEQ ID NO: 7929099 - DNA, 20 bp, Homo sapiens
aggcatgggatgcccagatt

SEQ ID NO: 7929100 - DNA, 20 bp, Homo sapiens
aggcatgggatgcccagatt

SEQ ID NO: 7929101 - DNA, 22 bp, Homo sapiens
aggcatggggctgcagtcaggt

SEQ ID NO: 7929102 - DNA, 22 bp, Homo sapiens
aggcatggggctgcagtcaggt

SEQ ID NO: 7929103 - DNA, 22 bp, Homo sapiens
aggcatggggctgcagtcaggt

SEQ ID NO: 7929104 - DNA, 22 bp, Homo sapiens
aggcatggggctgcagtcaggt

SEQ ID NO: 7929105 - DNA, 22 bp, Homo sapiens
aggcatggggctgcagtcaggt

SEQ ID NO: 7929106 - DNA, 22 bp, Homo sapiens
aggcatggggctgcagtcaggt

SEQ ID NO: 7929107 - DNA, 20 bp, Homo sapiens
aggcatgggatgcccagatt

SEQ ID NO: 7929108 - DNA, 22 bp, Homo sapiens
aggcatggggctgcagtcaggt

SEQ ID NO: 7929109 - DNA, 22 bp, Homo sapiens
aggcatggggctgcagtcaggt

SEQ ID NO: 7929110 - DNA, 22 bp, Homo sapiens
aggcatgggtagaagagaagcc

SEQ ID NO: 7929111 - DNA, 22 bp, Homo sapiens
acatacatggttctcagccctt

SEQ ID NO: 7929112 - DNA, 22 bp, Homo sapiens
acatacatgtaaaggaaattat

SEQ ID NO: 7929113 - DNA, 22 bp, Homo sapiens
acatacatgtaaaggaaattat

SEQ ID NO: 7929114 - DNA, 22 bp, Homo sapiens
acatacatggtgctttcttggt

SEQ ID NO: 7929115 - DNA, 22 bp, Homo sapiens
aggcagtgttcttctaagggca

SEQ ID NO: 7929116 - DNA, 22 bp, Homo sapiens
aggcagtgttcttctaagggca

SEQ ID NO: 7929117 - DNA, 22 bp, Homo sapiens
aggcagtgttcttctaagggca

SEQ ID NO: 7929118 - DNA, 22 bp, Homo sapiens
aggcatggctttaggcaggcgt

SEQ ID NO: 7929119 - DNA, 20 bp, Homo sapiens
aggcagttagaaggagatga

SEQ ID NO: 7929120 - DNA, 22 bp, Homo sapiens
acatacatggtgctttcttggt

SEQ ID NO: 7929121 - DNA, 22 bp, Homo sapiens
acatacatgggattaaaaaatt

SEQ ID NO: 7929122 - DNA, 22 bp, Homo sapiens
acatacatgggattaaaaaatt

SEQ ID NO: 7929123 - DNA, 22 bp, Homo sapiens
acatacatgggattaaaaaatt

SEQ ID NO: 7929124 - DNA, 22 bp, Homo sapiens
acatacatgggattaaaaaatt

SEQ ID NO: 7929125 - DNA, 22 bp, Homo sapiens
acatacatggattcatggattc

SEQ ID NO: 7929126 - DNA, 22 bp, Homo sapiens
acatacatggattcatggattc

SEQ ID NO: 7929127 - DNA, 22 bp, Homo sapiens
acatacatggattcatggattc

SEQ ID NO: 7929128 - DNA, 22 bp, Homo sapiens
acatacatgggattaaaaaatt

SEQ ID NO: 7929129 - DNA, 22 bp, Homo sapiens
acatacatggattcatggattc

SEQ ID NO: 7929130 - DNA, 22 bp, Homo sapiens
acatacatgggattaaaaaatt

SEQ ID NO: 7929131 - DNA, 22 bp, Homo sapiens
acatacatgggattaaaaaatt

SEQ ID NO: 7929132 - DNA, 22 bp, Homo sapiens
aggccacagcctgggaggtgac

SEQ ID NO: 7929133 - DNA, 22 bp, Homo sapiens
aggccacagcctgggaggtgac

SEQ ID NO: 7929134 - DNA, 22 bp, Homo sapiens
aggccacagcctgggaggtgac

SEQ ID NO: 7929135 - DNA, 22 bp, Homo sapiens
aggccacaggagtactgtcggt

SEQ ID NO: 7929136 - DNA, 22 bp, Homo sapiens
aggccacaggattgcacagcat

SEQ ID NO: 7929137 - DNA, 22 bp, Homo sapiens
aggccacaggattgcacagcat

SEQ ID NO: 7929138 - DNA, 22 bp, Homo sapiens
aggccacaggattgcacagcat

SEQ ID NO: 7929139 - DNA, 22 bp, Homo sapiens
aggccacaggattgcacagcat

SEQ ID NO: 7929140 - DNA, 22 bp, Homo sapiens
aggccacaggcaccctgtgttc

SEQ ID NO: 7929141 - DNA, 22 bp, Homo sapiens
aggccacaggtggaagccagag

SEQ ID NO: 7929142 - DNA, 22 bp, Homo sapiens
aggccacaggtggaagccagag

SEQ ID NO: 7929143 - DNA, 22 bp, Homo sapiens
aggccacaggcaccctgtgttc

SEQ ID NO: 7929144 - DNA, 22 bp, Homo sapiens
aggccacaggtggaagccagag

SEQ ID NO: 7929145 - DNA, 22 bp, Homo sapiens
aggccagcaccagagtcaagaa

SEQ ID NO: 7929146 - DNA, 22 bp, Homo sapiens
aggccagcaccagagtcaagaa

SEQ ID NO: 7929147 - DNA, 22 bp, Homo sapiens
aggccagcacgacagccgcagg

SEQ ID NO: 7929148 - DNA, 22 bp, Homo sapiens
aggccagcagacgtgggactga

SEQ ID NO: 7929149 - DNA, 22 bp, Homo sapiens
aggccagcacgacagccgcagg

SEQ ID NO: 7929150 - DNA, 22 bp, Homo sapiens
aggccagcagacgtgggactga

SEQ ID NO: 7929151 - DNA, 22 bp, Homo sapiens
aggccagcacgacagccgcagg

SEQ ID NO: 7929152 - DNA, 22 bp, Homo sapiens
aggcatgggtagaagagaagcc

SEQ ID NO: 7929153 - DNA, 22 bp, Homo sapiens
aggcatgggtagaagagaagcc

SEQ ID NO: 7929154 - DNA, 22 bp, Homo sapiens
aggcatgggtagaagagaagcc

SEQ ID NO: 7929155 - DNA, 22 bp, Homo sapiens
aggcatgggtagaagagaagcc

SEQ ID NO: 7929156 - DNA, 17 bp, Homo sapiens
aggcatggtctggggtg

SEQ ID NO: 7929157 - DNA, 17 bp, Homo sapiens
aggcatggtctggggtg

SEQ ID NO: 7929158 - DNA, 22 bp, Homo sapiens
aggcatgggtagaagagaagcc

SEQ ID NO: 7929159 - DNA, 17 bp, Homo sapiens
aggcatggtctggggtg

SEQ ID NO: 7929160 - DNA, 18 bp, Homo sapiens
aggcatggtggtgcgcac

SEQ ID NO: 7929161 - DNA, 18 bp, Homo sapiens
aggcatggtggtgcgcac

SEQ ID NO: 7929162 - DNA, 18 bp, Homo sapiens
aggcatggtggtgcgcac

SEQ ID NO: 7929163 - DNA, 22 bp, Homo sapiens
aggccacaagaactaccccatc

SEQ ID NO: 7929164 - DNA, 22 bp, Homo sapiens
aggcatgtatatgtgcacatgt

SEQ ID NO: 7929165 - DNA, 22 bp, Homo sapiens
aggccacagagagtgcatgtgc

SEQ ID NO: 7929166 - DNA, 22 bp, Homo sapiens
aggccacagatactgtgaagta

SEQ ID NO: 7929167 - DNA, 22 bp, Homo sapiens
aggccacagatactgtgaagta

SEQ ID NO: 7929168 - DNA, 22 bp, Homo sapiens
aggccacagagagtgcatgtgc

SEQ ID NO: 7929169 - DNA, 22 bp, Homo sapiens
aggccacagagagtgcatgtgc

SEQ ID NO: 7929170 - DNA, 22 bp, Homo sapiens
aggccacagagagtgcatgtgc

SEQ ID NO: 7929171 - DNA, 22 bp, Homo sapiens
aggccacagagagtgcatgtgc

SEQ ID NO: 7929172 - DNA, 18 bp, Homo sapiens
aggccacactccagaaca

SEQ ID NO: 7929173 - DNA, 18 bp, Homo sapiens
aggccacactccagaaca

SEQ ID NO: 7929174 - DNA, 18 bp, Homo sapiens
aggccacactccagaaca

SEQ ID NO: 7929175 - DNA, 22 bp, Homo sapiens
aggccacaatttgatttggttt

SEQ ID NO: 7929176 - DNA, 22 bp, Homo sapiens
aggccacacaactcttagagat

SEQ ID NO: 7929177 - DNA, 22 bp, Homo sapiens
aggccacacaactcttagagat

SEQ ID NO: 7929178 - DNA, 22 bp, Homo sapiens
acattcctgaatgggcacattt

SEQ ID NO: 7929179 - DNA, 22 bp, Homo sapiens
acattcctgaatgggcacattt

SEQ ID NO: 7929180 - DNA, 22 bp, Homo sapiens
acattcctgaatgggcacattt

SEQ ID NO: 7929181 - DNA, 22 bp, Homo sapiens
acattcctcagtgccagttgag

SEQ ID NO: 7929182 - DNA, 22 bp, Homo sapiens
acattcctgaggaaatacattc

SEQ ID NO: 7929183 - DNA, 22 bp, Homo sapiens
acattcctcagtgccagttgag

SEQ ID NO: 7929184 - DNA, 22 bp, Homo sapiens
acattcctcagtgccagttgag

SEQ ID NO: 7929185 - DNA, 22 bp, Homo sapiens
acattcctacctgctcgggtgt

SEQ ID NO: 7929186 - DNA, 22 bp, Homo sapiens
acattcccttggcttgaagcag

SEQ ID NO: 7929187 - DNA, 22 bp, Homo sapiens
acattcctacctgctcgggtgt

SEQ ID NO: 7929188 - DNA, 22 bp, Homo sapiens
acattcctcagtgccagttgag

SEQ ID NO: 7929189 - DNA, 19 bp, Homo sapiens
acattcccatcagcaatgt

SEQ ID NO: 7929190 - DNA, 22 bp, Homo sapiens
acattcccttggcttgaagcag

SEQ ID NO: 7929191 - DNA, 19 bp, Homo sapiens
acattcccatcagcaatgt

SEQ ID NO: 7929192 - DNA, 22 bp, Homo sapiens
acattcccaccaacagtgtaaa

SEQ ID NO: 7929193 - DNA, 22 bp, Homo sapiens
acattcctttcttgagcacagt

SEQ ID NO: 7929194 - DNA, 22 bp, Homo sapiens
acattcctttcttgagcacagt

SEQ ID NO: 7929195 - DNA, 22 bp, Homo sapiens
acattcctttcttgagcacagt

SEQ ID NO: 7929196 - DNA, 22 bp, Homo sapiens
acattctaaagcatgctcagga

SEQ ID NO: 7929197 - DNA, 22 bp, Homo sapiens
acattctaaagcatgctcagga

SEQ ID NO: 7929198 - DNA, 22 bp, Homo sapiens
acattcctgaggaaatacattc

SEQ ID NO: 7929199 - DNA, 22 bp, Homo sapiens
acattcctgaggaaatacattc

SEQ ID NO: 7929200 - DNA, 22 bp, Homo sapiens
acattcctgcctccccggagat

SEQ ID NO: 7929201 - DNA, 22 bp, Homo sapiens
acattcctgcctccccggagat

SEQ ID NO: 7929202 - DNA, 22 bp, Homo sapiens
acattcctgccataaatttttt

SEQ ID NO: 7929203 - DNA, 22 bp, Homo sapiens
acattcctgccataaatttttt

SEQ ID NO: 7929204 - DNA, 22 bp, Homo sapiens
acattctaacattgtacagata

SEQ ID NO: 7929205 - DNA, 22 bp, Homo sapiens
acattctaacattgtacagata

SEQ ID NO: 7929206 - DNA, 22 bp, Homo sapiens
acattctaacattgtacagata

SEQ ID NO: 7929207 - DNA, 22 bp, Homo sapiens
acattctaacattgtacagata

SEQ ID NO: 7929208 - DNA, 22 bp, Homo sapiens
acattctacagttaaccattag

SEQ ID NO: 7929209 - DNA, 22 bp, Homo sapiens
acattctacagttaaccattag

SEQ ID NO: 7929210 - DNA, 22 bp, Homo sapiens
acattctacagttaaccattag

SEQ ID NO: 7929211 - DNA, 22 bp, Homo sapiens
acattcttgaagtgaagtttat

SEQ ID NO: 7929212 - DNA, 22 bp, Homo sapiens
acattctatggttgatgagttg

SEQ ID NO: 7929213 - DNA, 22 bp, Homo sapiens
acattcttggactccactctag

SEQ ID NO: 7929214 - DNA, 22 bp, Homo sapiens
acattctttcgatgtctgattt

SEQ ID NO: 7929215 - DNA, 22 bp, Homo sapiens
acattcttggactccactctag

SEQ ID NO: 7929216 - DNA, 22 bp, Homo sapiens
acattgaaagcatattatctcc

SEQ ID NO: 7929217 - DNA, 22 bp, Homo sapiens
acattgaaagcatattatctcc

SEQ ID NO: 7929218 - DNA, 22 bp, Homo sapiens
acattctttgagttttgttaaa

SEQ ID NO: 7929219 - DNA, 22 bp, Homo sapiens
acattctagatatgttatattt

SEQ ID NO: 7929220 - DNA, 22 bp, Homo sapiens
acattctagatatgttatattt

SEQ ID NO: 7929221 - DNA, 22 bp, Homo sapiens
acattctagatatgttatattt

SEQ ID NO: 7929222 - DNA, 22 bp, Homo sapiens
acattctagaagtctttgcaat

SEQ ID NO: 7929223 - DNA, 22 bp, Homo sapiens
acattctacagttaaccattag

SEQ ID NO: 7929224 - DNA, 22 bp, Homo sapiens
acattctagaagtctttgcaat

SEQ ID NO: 7929225 - DNA, 22 bp, Homo sapiens
acattctagaagagcttcactt

SEQ ID NO: 7929226 - DNA, 22 bp, Homo sapiens
acattctagaagagcttcactt

SEQ ID NO: 7929227 - DNA, 22 bp, Homo sapiens
acattctagaagtctttgcaat

SEQ ID NO: 7929228 - DNA, 22 bp, Homo sapiens
acattctatagcaagctgatct

SEQ ID NO: 7929229 - DNA, 22 bp, Homo sapiens
acattctatagcaagctgatct

SEQ ID NO: 7929230 - DNA, 22 bp, Homo sapiens
acattctagatatgttatattt

SEQ ID NO: 7929231 - DNA, 22 bp, Homo sapiens
acattctatagcaagctgatct

SEQ ID NO: 7929232 - DNA, 22 bp, Homo sapiens
acattctagatatgttatattt

SEQ ID NO: 7929233 - DNA, 22 bp, Homo sapiens
acattctagatatgttatattt

SEQ ID NO: 7929234 - DNA, 22 bp, Homo sapiens
acattctatgaagataatttta

SEQ ID NO: 7929235 - DNA, 22 bp, Homo sapiens
acattctatgaagataatttta

SEQ ID NO: 7929236 - DNA, 22 bp, Homo sapiens
acattctatgaagataatttta

SEQ ID NO: 7929237 - DNA, 22 bp, Homo sapiens
acattctatggttgatgagttg

SEQ ID NO: 7929238 - DNA, 20 bp, Homo sapiens
aggccctgccagggacggag

SEQ ID NO: 7929239 - DNA, 22 bp, Homo sapiens
acattaatgaggtgatgacaca

SEQ ID NO: 7929240 - DNA, 20 bp, Homo sapiens
aggccctgccagggacggag

SEQ ID NO: 7929241 - DNA, 22 bp, Homo sapiens
acattacactgtggtcctgttc

SEQ ID NO: 7929242 - DNA, 22 bp, Homo sapiens
acattcaagatgcattcactta

SEQ ID NO: 7929243 - DNA, 22 bp, Homo sapiens
acattcaagatgcattcactta

SEQ ID NO: 7929244 - DNA, 23 bp, Homo sapiens
acattacacgcagtaattgcccc

SEQ ID NO: 7929245 - DNA, 22 bp, Homo sapiens
aggccctgcaggaagcaggatg

SEQ ID NO: 7929246 - DNA, 22 bp, Homo sapiens
aggccctgcaggaagcaggatg

SEQ ID NO: 7929247 - DNA, 22 bp, Homo sapiens
aggccctgcaggaagcaggatg

SEQ ID NO: 7929248 - DNA, 22 bp, Homo sapiens
aggccctgcaggaagcaggatg

SEQ ID NO: 7929249 - DNA, 22 bp, Homo sapiens
aggccctgcaggaagcaggatg

SEQ ID NO: 7929250 - DNA, 22 bp, Homo sapiens
aggccctgcaggaagcaggatg

SEQ ID NO: 7929251 - DNA, 22 bp, Homo sapiens
aggccctgcaggagtggggaca

SEQ ID NO: 7929252 - DNA, 22 bp, Homo sapiens
aggccctgcaggagtggggaca

SEQ ID NO: 7929253 - DNA, 22 bp, Homo sapiens
aggccctgcaggagtggggaca

SEQ ID NO: 7929254 - DNA, 22 bp, Homo sapiens
aggccctgcaggagtggggaca

SEQ ID NO: 7929255 - DNA, 22 bp, Homo sapiens
aggccctgcaggaagcaggatg

SEQ ID NO: 7929256 - DNA, 22 bp, Homo sapiens
aggccctgcaggagtggggaca

SEQ ID NO: 7929257 - DNA, 22 bp, Homo sapiens
aggccctgcattgtactgaggg

SEQ ID NO: 7929258 - DNA, 22 bp, Homo sapiens
aggccctgcattgtactgaggg

SEQ ID NO: 7929259 - DNA, 22 bp, Homo sapiens
aggccctgcattgtactgaggg

SEQ ID NO: 7929260 - DNA, 22 bp, Homo sapiens
aggccctgcattgtactgaggg

SEQ ID NO: 7929261 - DNA, 22 bp, Homo sapiens
acattcacaagcctacaaggtt

SEQ ID NO: 7929262 - DNA, 22 bp, Homo sapiens
acattcaagtttctgctcatgg

SEQ ID NO: 7929263 - DNA, 21 bp, Homo sapiens
acattcacaggatattatcat

SEQ ID NO: 7929264 - DNA, 21 bp, Homo sapiens
acattcacaggatattatcat

SEQ ID NO: 7929265 - DNA, 22 bp, Homo sapiens
acattcacgctctcaaagctga

SEQ ID NO: 7929266 - DNA, 22 bp, Homo sapiens
acattcaaggccttctgacaca

SEQ ID NO: 7929267 - DNA, 22 bp, Homo sapiens
acattcaaggccttctgacaca

SEQ ID NO: 7929268 - DNA, 22 bp, Homo sapiens
acattcaaggccttctgacaca

SEQ ID NO: 7929269 - DNA, 22 bp, Homo sapiens
acattcaaggcagcactgagtg

SEQ ID NO: 7929270 - DNA, 22 bp, Homo sapiens
acattcatgggttttacattat

SEQ ID NO: 7929271 - DNA, 22 bp, Homo sapiens
acattcatgggttttacattat

SEQ ID NO: 7929272 - DNA, 22 bp, Homo sapiens
acattcatgtcccacttctagc

SEQ ID NO: 7929273 - DNA, 22 bp, Homo sapiens
acattcatgtcccacttctagc

SEQ ID NO: 7929274 - DNA, 22 bp, Homo sapiens
acattcatgtcccacttctagc

SEQ ID NO: 7929275 - DNA, 22 bp, Homo sapiens
acattcattccaggtcagtcag

SEQ ID NO: 7929276 - DNA, 22 bp, Homo sapiens
acattcattccaggtcagtcag

SEQ ID NO: 7929277 - DNA, 22 bp, Homo sapiens
acattcattgagcaacaacaat

SEQ ID NO: 7929278 - DNA, 22 bp, Homo sapiens
acattgacttggatgggtagca

SEQ ID NO: 7929279 - DNA, 22 bp, Homo sapiens
acattgagtgctccataaatca

SEQ ID NO: 7929280 - DNA, 22 bp, Homo sapiens
acattgatactgagatacaaag

SEQ ID NO: 7929281 - DNA, 22 bp, Homo sapiens
acattgatactgagatacaaag

SEQ ID NO: 7929282 - DNA, 22 bp, Homo sapiens
acattgacaaagattgagctgt

SEQ ID NO: 7929283 - DNA, 22 bp, Homo sapiens
aggctccacggtcactggctct

SEQ ID NO: 7929284 - DNA, 22 bp, Homo sapiens
aggctccacggtcactggctct

SEQ ID NO: 7929285 - DNA, 22 bp, Homo sapiens
acattgatatttcaaatacagg

SEQ ID NO: 7929286 - DNA, 22 bp, Homo sapiens
aggctccacggtcactggctct

SEQ ID NO: 7929287 - DNA, 23 bp, Homo sapiens
aggctccactccctgggatgtgg

SEQ ID NO: 7929288 - DNA, 23 bp, Homo sapiens
aggctccactccctgggatgtgg

SEQ ID NO: 7929289 - DNA, 23 bp, Homo sapiens
aggctccactccctgggatgtgg

SEQ ID NO: 7929290 - DNA, 23 bp, Homo sapiens
aggctccactccctgggatgtgg

SEQ ID NO: 7929291 - DNA, 22 bp, Homo sapiens
aggctccagcagccagaggaag

SEQ ID NO: 7929292 - DNA, 22 bp, Homo sapiens
aggctccagcagccagaggaag

SEQ ID NO: 7929293 - DNA, 22 bp, Homo sapiens
aggctccagcagccagaggaag

SEQ ID NO: 7929294 - DNA, 22 bp, Homo sapiens
aggctccagcagccagaggaag

SEQ ID NO: 7929295 - DNA, 22 bp, Homo sapiens
aggctccagcagccagaggaag

SEQ ID NO: 7929296 - DNA, 22 bp, Homo sapiens
aggctccagcagccagaggaag

SEQ ID NO: 7929297 - DNA, 22 bp, Homo sapiens
aggctccagcagccagaggaag

SEQ ID NO: 7929298 - DNA, 22 bp, Homo sapiens
aggctccagcccaaggctgcag

SEQ ID NO: 7929299 - DNA, 22 bp, Homo sapiens
aggctccagcccaaggctgcag

SEQ ID NO: 7929300 - DNA, 22 bp, Homo sapiens
aggctccagcccaaggctgcag

SEQ ID NO: 7929301 - DNA, 22 bp, Homo sapiens
aggctccagccaatgggtctgt

SEQ ID NO: 7929302 - DNA, 22 bp, Homo sapiens
aggctccagccaatgggtctgt

SEQ ID NO: 7929303 - DNA, 22 bp, Homo sapiens
acattgaagctgtgaaatcaaa

SEQ ID NO: 7929304 - DNA, 22 bp, Homo sapiens
acattgaactacttgtaatgag

SEQ ID NO: 7929305 - DNA, 22 bp, Homo sapiens
acattgaaccagtagacacaaa

SEQ ID NO: 7929306 - DNA, 22 bp, Homo sapiens
acattgaacagtacaaatgatc

SEQ ID NO: 7929307 - DNA, 22 bp, Homo sapiens
acattgaacagtacaaatgatc

SEQ ID NO: 7929308 - DNA, 22 bp, Homo sapiens
acattgaagggaatgcaaagat

SEQ ID NO: 7929309 - DNA, 22 bp, Homo sapiens
acattgaagggctatccaatag

SEQ ID NO: 7929310 - DNA, 22 bp, Homo sapiens
acattgaagggctatccaatag

SEQ ID NO: 7929311 - DNA, 22 bp, Homo sapiens
acattgaatgtatgtgatgaaa

SEQ ID NO: 7929312 - DNA, 22 bp, Homo sapiens
acattgaattcaaaattactga

SEQ ID NO: 7929313 - DNA, 22 bp, Homo sapiens
acattgaattcaaaattactga

SEQ ID NO: 7929314 - DNA, 22 bp, Homo sapiens
aggcttcagttgtaccttcttg

SEQ ID NO: 7929315 - DNA, 22 bp, Homo sapiens
aggcttcagttgtaccttcttg

SEQ ID NO: 7929316 - DNA, 22 bp, Homo sapiens
aggcttcagtattcaccgcatg

SEQ ID NO: 7929317 - DNA, 19 bp, Homo sapiens
aggcttcatcctgggcagc

SEQ ID NO: 7929318 - DNA, 22 bp, Homo sapiens
aggcttcatgtagatggttccc

SEQ ID NO: 7929319 - DNA, 22 bp, Homo sapiens
aggcttcattacagtggttcaa

SEQ ID NO: 7929320 - DNA, 22 bp, Homo sapiens
aggcttcagtagggagcatgtc

SEQ ID NO: 7929321 - DNA, 19 bp, Homo sapiens
aggcttcaggccacatgct

SEQ ID NO: 7929322 - DNA, 22 bp, Homo sapiens
aggcttcagtagggagcatgtc

SEQ ID NO: 7929323 - DNA, 19 bp, Homo sapiens
aggcttcaggccacatgct

SEQ ID NO: 7929324 - DNA, 19 bp, Homo sapiens
aggcttcaggccacatgct

SEQ ID NO: 7929325 - DNA, 22 bp, Homo sapiens
aggcttcagggcttttgagggt

SEQ ID NO: 7929326 - DNA, 22 bp, Homo sapiens
aggcttcccagctgagctcagc

SEQ ID NO: 7929327 - DNA, 22 bp, Homo sapiens
aggcttcattacagtggttcaa

SEQ ID NO: 7929328 - DNA, 22 bp, Homo sapiens
aggcttcccaagcagctgcaaa

SEQ ID NO: 7929329 - DNA, 18 bp, Homo sapiens
aggcttcccaggcaggcc

SEQ ID NO: 7929330 - DNA, 18 bp, Homo sapiens
aggcttcccaggcaggcc

SEQ ID NO: 7929331 - DNA, 23 bp, Homo sapiens
aggcttcctatcttagagctggg

SEQ ID NO: 7929332 - DNA, 22 bp, Homo sapiens
aggcttccgagtagctgggact

SEQ ID NO: 7929333 - DNA, 22 bp, Homo sapiens
aggctccaggcaaaatttcgga

SEQ ID NO: 7929334 - DNA, 22 bp, Homo sapiens
aggctccaggcaaaatttcgga

SEQ ID NO: 7929335 - DNA, 22 bp, Homo sapiens
aggctccagcccaaggctgcag

SEQ ID NO: 7929336 - DNA, 22 bp, Homo sapiens
aggctccaggcaatgtttctga

SEQ ID NO: 7929337 - DNA, 22 bp, Homo sapiens
aggctccaggcccttcaccagc

SEQ ID NO: 7929338 - DNA, 22 bp, Homo sapiens
aggctccaggcaatgtttctga

SEQ ID NO: 7929339 - DNA, 22 bp, Homo sapiens
aggctccaggcccttcaccagc

SEQ ID NO: 7929340 - DNA, 22 bp, Homo sapiens
aggctccaggcccttcaccagc

SEQ ID NO: 7929341 - DNA, 22 bp, Homo sapiens
aggctccaggcccttcaccagc

SEQ ID NO: 7929342 - DNA, 22 bp, Homo sapiens
aggctgtgattccaccactctc

SEQ ID NO: 7929343 - DNA, 22 bp, Homo sapiens
aggctgtgcaattagggtaaga

SEQ ID NO: 7929344 - DNA, 22 bp, Homo sapiens
aggctccagtctcctctggcag

SEQ ID NO: 7929345 - DNA, 22 bp, Homo sapiens
aggctccagtctcctctggcag

SEQ ID NO: 7929346 - DNA, 22 bp, Homo sapiens
aggctccaggcctccctgcatg

SEQ ID NO: 7929347 - DNA, 22 bp, Homo sapiens
aggctccaggcctccctgcatg

SEQ ID NO: 7929348 - DNA, 22 bp, Homo sapiens
aggctccagggctgtgtgggag

SEQ ID NO: 7929349 - DNA, 22 bp, Homo sapiens
aggctccagggctgtgtgggag

SEQ ID NO: 7929350 - DNA, 22 bp, Homo sapiens
aggcttcaggaagtctcctggg

SEQ ID NO: 7929351 - DNA, 22 bp, Homo sapiens
aggcttcaggaagtctcctggg

SEQ ID NO: 7929352 - DNA, 22 bp, Homo sapiens
aggcttcaggaagtctcctggg

SEQ ID NO: 7929353 - DNA, 22 bp, Homo sapiens
aggcttcagcctagagctggag

SEQ ID NO: 7929354 - DNA, 22 bp, Homo sapiens
aggcttcagcctagagctggag

SEQ ID NO: 7929355 - DNA, 22 bp, Homo sapiens
aggcttcagcagccctctcttg

SEQ ID NO: 7929356 - DNA, 22 bp, Homo sapiens
aggcttcagcagccctctcttg

SEQ ID NO: 7929357 - DNA, 22 bp, Homo sapiens
aggcttcagaggaagtgcggcc

SEQ ID NO: 7929358 - DNA, 22 bp, Homo sapiens
acatacatatgacaactttcct

SEQ ID NO: 7929359 - DNA, 22 bp, Homo sapiens
acatacatatgacaactttcct

SEQ ID NO: 7929360 - DNA, 22 bp, Homo sapiens
acatacatatgacaactttcct

SEQ ID NO: 7929361 - DNA, 21 bp, Homo sapiens
acatacataccttaccacctt

SEQ ID NO: 7929362 - DNA, 21 bp, Homo sapiens
acatacataccttaccacctt

SEQ ID NO: 7929363 - DNA, 22 bp, Homo sapiens
acatacatcaagtatcacaaga

SEQ ID NO: 7929364 - DNA, 22 bp, Homo sapiens
acatacatatgtttaaatgcat

SEQ ID NO: 7929365 - DNA, 22 bp, Homo sapiens
acatacatatgtttaaatgcat

SEQ ID NO: 7929366 - DNA, 22 bp, Homo sapiens
acatacatcaagtatcacaaga

SEQ ID NO: 7929367 - DNA, 22 bp, Homo sapiens
acatacatcaagtatcacaaga

SEQ ID NO: 7929368 - DNA, 22 bp, Homo sapiens
acatacatcaagtatcacaaga

SEQ ID NO: 7929369 - DNA, 22 bp, Homo sapiens
acatacatcaagtatcacaaga

SEQ ID NO: 7929370 - DNA, 22 bp, Homo sapiens
acatacatcaagtatcacaaga

SEQ ID NO: 7929371 - DNA, 23 bp, Homo sapiens
acatacatggagataaagtgatg

SEQ ID NO: 7929372 - DNA, 22 bp, Homo sapiens
acatacatcaagtatcacaaga

SEQ ID NO: 7929373 - DNA, 23 bp, Homo sapiens
acatacatggagataaagtgatg

SEQ ID NO: 7929374 - DNA, 23 bp, Homo sapiens
acatacatggagataaagtgatg

SEQ ID NO: 7929375 - DNA, 23 bp, Homo sapiens
acatacatggagataaagtgatg

SEQ ID NO: 7929376 - DNA, 23 bp, Homo sapiens
acatacataagcaccacattttg

SEQ ID NO: 7929377 - DNA, 23 bp, Homo sapiens
acatacataagcaccacattttg

SEQ ID NO: 7929378 - DNA, 23 bp, Homo sapiens
acatacataagcaccacattttg

SEQ ID NO: 7929379 - DNA, 22 bp, Homo sapiens
acatacacatgaatatattttt

SEQ ID NO: 7929380 - DNA, 22 bp, Homo sapiens
acatacacgggaaacctctttt

SEQ ID NO: 7929381 - DNA, 22 bp, Homo sapiens
acatacacgggaaacctctttt

SEQ ID NO: 7929382 - DNA, 22 bp, Homo sapiens
acatacacgggaaacctctttt

SEQ ID NO: 7929383 - DNA, 23 bp, Homo sapiens
acatacataagcaccacattttg

SEQ ID NO: 7929384 - DNA, 22 bp, Homo sapiens
acatacacacatactttctcct

SEQ ID NO: 7929385 - DNA, 22 bp, Homo sapiens
acatacacacatactttctcct

SEQ ID NO: 7929386 - DNA, 22 bp, Homo sapiens
acatacacaagcgtacatgaac

SEQ ID NO: 7929387 - DNA, 22 bp, Homo sapiens
acatacacatgaatatattttt

SEQ ID NO: 7929388 - DNA, 22 bp, Homo sapiens
acatacacatgaatatattttt

SEQ ID NO: 7929389 - DNA, 22 bp, Homo sapiens
acatacacatgaatatattttt

SEQ ID NO: 7929390 - DNA, 22 bp, Homo sapiens
acatacacaagcgtacatgaac

SEQ ID NO: 7929391 - DNA, 22 bp, Homo sapiens
acatacacaagcgtacatgaac

SEQ ID NO: 7929392 - DNA, 22 bp, Homo sapiens
acataaatttcactgttccgtg

SEQ ID NO: 7929393 - DNA, 22 bp, Homo sapiens
aggcacagatttggggaaagca

SEQ ID NO: 7929394 - DNA, 22 bp, Homo sapiens
aggcacagatttggggaaagca

SEQ ID NO: 7929395 - DNA, 18 bp, Homo sapiens
aggcacagagcatacata

SEQ ID NO: 7929396 - DNA, 18 bp, Homo sapiens
aggcacagagcatacata

SEQ ID NO: 7929397 - DNA, 18 bp, Homo sapiens
aggcacagagcatacata

SEQ ID NO: 7929398 - DNA, 22 bp, Homo sapiens
aggcacagatttggggaaagca

SEQ ID NO: 7929399 - DNA, 22 bp, Homo sapiens
aggcacagatttggggaaagca

SEQ ID NO: 7929400 - DNA, 22 bp, Homo sapiens
aggcacagatttggggaaagca

SEQ ID NO: 7929401 - DNA, 22 bp, Homo sapiens
aggcacagatttggggaaagca

SEQ ID NO: 7929402 - DNA, 22 bp, Homo sapiens
aggcacagatttggggaaagca

SEQ ID NO: 7929403 - DNA, 22 bp, Homo sapiens
aggcacagatttggggaaagca

SEQ ID NO: 7929404 - DNA, 22 bp, Homo sapiens
aggcacagagaatgccctccat

SEQ ID NO: 7929405 - DNA, 22 bp, Homo sapiens
aggcacagagaatgccctccat

SEQ ID NO: 7929406 - DNA, 22 bp, Homo sapiens
aggcacagaatggcattcagtg

SEQ ID NO: 7929407 - DNA, 22 bp, Homo sapiens
aggcacagaatggcattcagtg

SEQ ID NO: 7929408 - DNA, 22 bp, Homo sapiens
aggcacagaatggcattcagtg

SEQ ID NO: 7929409 - DNA, 22 bp, Homo sapiens
aggcacagaatggcattcagtg

SEQ ID NO: 7929410 - DNA, 22 bp, Homo sapiens
aggcacagaatggcattcagtg

SEQ ID NO: 7929411 - DNA, 18 bp, Homo sapiens
aggcacagagcatacata

SEQ ID NO: 7929412 - DNA, 18 bp, Homo sapiens
aggcacagagcatacata

SEQ ID NO: 7929413 - DNA, 18 bp, Homo sapiens
aggcacagagcatacata

SEQ ID NO: 7929414 - DNA, 22 bp, Homo sapiens
aggcacaaagacagaaaagcac

SEQ ID NO: 7929415 - DNA, 22 bp, Homo sapiens
aggcacaaagacagaaaagcac

SEQ ID NO: 7929416 - DNA, 22 bp, Homo sapiens
aggcaactaggcctctgcctca

SEQ ID NO: 7929417 - DNA, 22 bp, Homo sapiens
aggcaacatgggccaggcagaa

SEQ ID NO: 7929418 - DNA, 22 bp, Homo sapiens
aggcacagaatggcattcagtg

SEQ ID NO: 7929419 - DNA, 22 bp, Homo sapiens
aggcacagaatggcattcagtg

SEQ ID NO: 7929420 - DNA, 22 bp, Homo sapiens
aggcacagaatggcattcagtg

SEQ ID NO: 7929421 - DNA, 19 bp, Homo sapiens
aggcacaattctgagaagc

SEQ ID NO: 7929422 - DNA, 22 bp, Homo sapiens
aggcacaagaaactgctcccca

SEQ ID NO: 7929423 - DNA, 22 bp, Homo sapiens
aggcaaattgtgagaaaatgaa

SEQ ID NO: 7929424 - DNA, 22 bp, Homo sapiens
aggcaacaagggtagtcagtga

SEQ ID NO: 7929425 - DNA, 22 bp, Homo sapiens
aggcaacaggaaaccacatgat

SEQ ID NO: 7929426 - DNA, 22 bp, Homo sapiens
aggcaacaggaaaccacatgat

SEQ ID NO: 7929427 - DNA, 22 bp, Homo sapiens
aggcaacatgggccaggcagaa

SEQ ID NO: 7929428 - DNA, 22 bp, Homo sapiens
aggcaacatgggccaggcagaa

SEQ ID NO: 7929429 - DNA, 22 bp, Homo sapiens
aggcaacataacacgaaagtct

SEQ ID NO: 7929430 - DNA, 22 bp, Homo sapiens
aggcaacatgactcacttgcac

SEQ ID NO: 7929431 - DNA, 22 bp, Homo sapiens
aggcaacataacacgaaagtct

SEQ ID NO: 7929432 - DNA, 22 bp, Homo sapiens
aggagggacaccaatatatgtt

SEQ ID NO: 7929433 - DNA, 22 bp, Homo sapiens
aggagggacaccaatatatgtt

SEQ ID NO: 7929434 - DNA, 22 bp, Homo sapiens
aggagggaataagaaagagtca

SEQ ID NO: 7929435 - DNA, 22 bp, Homo sapiens
aggagggaataagaaagagtca

SEQ ID NO: 7929436 - DNA, 22 bp, Homo sapiens
aggagggaataagaaagagtca

SEQ ID NO: 7929437 - DNA, 17 bp, Homo sapiens
aggagggaaatagcttg

SEQ ID NO: 7929438 - DNA, 17 bp, Homo sapiens
aggagggaaatagcttg

SEQ ID NO: 7929439 - DNA, 22 bp, Homo sapiens
aggagggaataagaaagagtca

SEQ ID NO: 7929440 - DNA, 17 bp, Homo sapiens
aggagggaaatagcttg

SEQ ID NO: 7929441 - DNA, 17 bp, Homo sapiens
aggagggaaatagcttg

SEQ ID NO: 7929442 - DNA, 17 bp, Homo sapiens
aggagggaaatagcttg

SEQ ID NO: 7929443 - DNA, 17 bp, Homo sapiens
aggagggaaatagcttg

SEQ ID NO: 7929444 - DNA, 22 bp, Homo sapiens
aggaggcttttgcaggtgccac

SEQ ID NO: 7929445 - DNA, 22 bp, Homo sapiens
aggaggcttttgcaggtgccac

SEQ ID NO: 7929446 - DNA, 22 bp, Homo sapiens
aggaggctgtggagcactccat

SEQ ID NO: 7929447 - DNA, 22 bp, Homo sapiens
aggaggctgtggagcactccat

SEQ ID NO: 7929448 - DNA, 22 bp, Homo sapiens
aggaggcttttgcaggtgccac

SEQ ID NO: 7929449 - DNA, 22 bp, Homo sapiens
aggaggctgtggagcactccat

SEQ ID NO: 7929450 - DNA, 22 bp, Homo sapiens
aggaggccgctgatgggctccc

SEQ ID NO: 7929451 - DNA, 22 bp, Homo sapiens
aggaggccgctgatgggctccc

SEQ ID NO: 7929452 - DNA, 22 bp, Homo sapiens
aggaggctgtggagcactccat

SEQ ID NO: 7929453 - DNA, 22 bp, Homo sapiens
aggaggctgtggagcactccat

SEQ ID NO: 7929454 - DNA, 22 bp, Homo sapiens
aggaggctgtggagcactccat

SEQ ID NO: 7929455 - DNA, 22 bp, Homo sapiens
aggaggccgctgatgggctccc

SEQ ID NO: 7929456 - DNA, 22 bp, Homo sapiens
aggaggccgatttcagaggtcg

SEQ ID NO: 7929457 - DNA, 22 bp, Homo sapiens
aggaggccgatttcagaggtcg

SEQ ID NO: 7929458 - DNA, 22 bp, Homo sapiens
aggagggagatgcccatcctgg

SEQ ID NO: 7929459 - DNA, 22 bp, Homo sapiens
aggaggggcatagaaatgtaat

SEQ ID NO: 7929460 - DNA, 22 bp, Homo sapiens
aggaggggcatagaaatgtaat

SEQ ID NO: 7929461 - DNA, 22 bp, Homo sapiens
aggaggggcatagaaatgtaat

SEQ ID NO: 7929462 - DNA, 22 bp, Homo sapiens
aggaggggcatagaaatgtaat

SEQ ID NO: 7929463 - DNA, 22 bp, Homo sapiens
aggagggagatgcccatcctgg

SEQ ID NO: 7929464 - DNA, 22 bp, Homo sapiens
aggaggggcatagaaatgtaat

SEQ ID NO: 7929465 - DNA, 22 bp, Homo sapiens
aggaggggcatagaaatgtaat

SEQ ID NO: 7929466 - DNA, 22 bp, Homo sapiens
aggaggggcatagaaatgtaat

SEQ ID NO: 7929467 - DNA, 21 bp, Homo sapiens
aggaggggtctttcccactga

SEQ ID NO: 7929468 - DNA, 21 bp, Homo sapiens
aggaggggtctttcccactga

SEQ ID NO: 7929469 - DNA, 20 bp, Homo sapiens
aggagggacctggattggcg

SEQ ID NO: 7929470 - DNA, 20 bp, Homo sapiens
aggagggacctggattggcg

SEQ ID NO: 7929471 - DNA, 20 bp, Homo sapiens
aggagggacctggattggcg

SEQ ID NO: 7929472 - DNA, 22 bp, Homo sapiens
aggagggacctaggaatattgc

SEQ ID NO: 7929473 - DNA, 22 bp, Homo sapiens
aggagggacaccaatatatgtt

SEQ ID NO: 7929474 - DNA, 20 bp, Homo sapiens
aggagggacctggattggcg

SEQ ID NO: 7929475 - DNA, 20 bp, Homo sapiens
aggagggacctggattggcg

SEQ ID NO: 7929476 - DNA, 20 bp, Homo sapiens
aggagggacctggattggcg

SEQ ID NO: 7929477 - DNA, 20 bp, Homo sapiens
aggagggacctggattggcg

SEQ ID NO: 7929478 - DNA, 22 bp, Homo sapiens
aggagggagatgcccatcctgg

SEQ ID NO: 7929479 - DNA, 22 bp, Homo sapiens
aggagggagatgcccatcctgg

SEQ ID NO: 7929480 - DNA, 22 bp, Homo sapiens
aggaggggttctcgggtgctga

SEQ ID NO: 7929481 - DNA, 22 bp, Homo sapiens
aggaggggttctcgggtgctga

SEQ ID NO: 7929482 - DNA, 22 bp, Homo sapiens
aggaggggttctcgggtgctga

SEQ ID NO: 7929483 - DNA, 22 bp, Homo sapiens
aggaggggttctcgggtgctga

SEQ ID NO: 7929484 - DNA, 22 bp, Homo sapiens
aggaggggttctcgggtgctga

SEQ ID NO: 7929485 - DNA, 22 bp, Homo sapiens
aggaggggttctcgggtgctga

SEQ ID NO: 7929486 - DNA, 22 bp, Homo sapiens
aggaggggttctcgggtgctga

SEQ ID NO: 7929487 - DNA, 21 bp, Homo sapiens
aggaggggtctttcccactga

SEQ ID NO: 7929488 - DNA, 21 bp, Homo sapiens
aggaggggtctttcccactga

SEQ ID NO: 7929489 - DNA, 21 bp, Homo sapiens
aggaggggtctttcccactga

SEQ ID NO: 7929490 - DNA, 21 bp, Homo sapiens
aggaggggtctttcccactga

SEQ ID NO: 7929491 - DNA, 21 bp, Homo sapiens
aggaggggtctttcccactga

SEQ ID NO: 7929492 - DNA, 22 bp, Homo sapiens
aggagggtacaatgggtggaaa

SEQ ID NO: 7929493 - DNA, 22 bp, Homo sapiens
aggaggggttctcgggtgctga

SEQ ID NO: 7929494 - DNA, 22 bp, Homo sapiens
aggaggggttctcgggtgctga

SEQ ID NO: 7929495 - DNA, 22 bp, Homo sapiens
aggaggggttctcgggtgctga

SEQ ID NO: 7929496 - DNA, 20 bp, Homo sapiens
aggatggcaagcaagtgcat

SEQ ID NO: 7929497 - DNA, 20 bp, Homo sapiens
aggatggcaagcaagtgcat

SEQ ID NO: 7929498 - DNA, 20 bp, Homo sapiens
aggatggcaagcaagtgcat

SEQ ID NO: 7929499 - DNA, 22 bp, Homo sapiens
aggagggtacaatgggtggaaa

SEQ ID NO: 7929500 - DNA, 22 bp, Homo sapiens
aggagggtacaatgggtggaaa

SEQ ID NO: 7929501 - DNA, 22 bp, Homo sapiens
aggagggtcatgttgaagtgta

SEQ ID NO: 7929502 - DNA, 22 bp, Homo sapiens
aggagggtacaatgggtggaaa

SEQ ID NO: 7929503 - DNA, 22 bp, Homo sapiens
aggagggtacaatgggtggaaa

SEQ ID NO: 7929504 - DNA, 22 bp, Homo sapiens
aggagggtacaatgggtggaaa

SEQ ID NO: 7929505 - DNA, 22 bp, Homo sapiens
aggcaaagcgataccagagcta

SEQ ID NO: 7929506 - DNA, 22 bp, Homo sapiens
aggcaaagaggatattttgggg

SEQ ID NO: 7929507 - DNA, 22 bp, Homo sapiens
aggcaaagcgataccagagcta

SEQ ID NO: 7929508 - DNA, 22 bp, Homo sapiens
aggcaaagaggatattttgggg

SEQ ID NO: 7929509 - DNA, 22 bp, Homo sapiens
aggcaaagagccagcaaatctg

SEQ ID NO: 7929510 - DNA, 22 bp, Homo sapiens
aggcaaagagccagcaaatctg

SEQ ID NO: 7929511 - DNA, 22 bp, Homo sapiens
aggcaaagagccagcaaatctg

SEQ ID NO: 7929512 - DNA, 22 bp, Homo sapiens
aggcaaattattgtatgcagtt

SEQ ID NO: 7929513 - DNA, 22 bp, Homo sapiens
aggcaaattattgtatgcagtt

SEQ ID NO: 7929514 - DNA, 22 bp, Homo sapiens
aggcaaattattgtatgcagtt

SEQ ID NO: 7929515 - DNA, 22 bp, Homo sapiens
aggcaaattattgtatgcagtt

SEQ ID NO: 7929516 - DNA, 22 bp, Homo sapiens
aggcaaatctcagttggcctct

SEQ ID NO: 7929517 - DNA, 22 bp, Homo sapiens
aggcaaagaagttggtcaggag

SEQ ID NO: 7929518 - DNA, 22 bp, Homo sapiens
aggcaaagaagttggtcaggag

SEQ ID NO: 7929519 - DNA, 22 bp, Homo sapiens
aggcaaagaagttggtcaggag

SEQ ID NO: 7929520 - DNA, 22 bp, Homo sapiens
aggcaaaattacaaagttatta

SEQ ID NO: 7929521 - DNA, 22 bp, Homo sapiens
aggcaaaattacaaagttatta

SEQ ID NO: 7929522 - DNA, 22 bp, Homo sapiens
aggcaaaattacaaagttatta

SEQ ID NO: 7929523 - DNA, 22 bp, Homo sapiens
aggcaaaataagcctctcctgt

SEQ ID NO: 7929524 - DNA, 21 bp, Homo sapiens
aggattttgttgaagtttctg

SEQ ID NO: 7929525 - DNA, 22 bp, Homo sapiens
aggcaaaagaatgtcataaatg

SEQ ID NO: 7929526 - DNA, 22 bp, Homo sapiens
aggcaaaagaatgtcataaatg

SEQ ID NO: 7929527 - DNA, 22 bp, Homo sapiens
aggcaaaagaatgtcataaatg

SEQ ID NO: 7929528 - DNA, 22 bp, Homo sapiens
aggcaaaagaatgtcataaatg

SEQ ID NO: 7929529 - DNA, 22 bp, Homo sapiens
aggcaaaagaatgtcataaatg

SEQ ID NO: 7929530 - DNA, 22 bp, Homo sapiens
aggatggcgattcgagcacctc

SEQ ID NO: 7929531 - DNA, 22 bp, Homo sapiens
aggatggcgattcgagcacctc

SEQ ID NO: 7929532 - DNA, 22 bp, Homo sapiens
aggatggcttgcaggaggctgt

SEQ ID NO: 7929533 - DNA, 22 bp, Homo sapiens
aggagctggaatggtccttttg

SEQ ID NO: 7929534 - DNA, 22 bp, Homo sapiens
aggagctggaatggtccttttg

SEQ ID NO: 7929535 - DNA, 21 bp, Homo sapiens
aggagctggagaaaactttcc

SEQ ID NO: 7929536 - DNA, 21 bp, Homo sapiens
aggagctggagaaaactttcc

SEQ ID NO: 7929537 - DNA, 22 bp, Homo sapiens
aggagctggagtccaggcaagt

SEQ ID NO: 7929538 - DNA, 22 bp, Homo sapiens
aggagctggaatggtccttttg

SEQ ID NO: 7929539 - DNA, 22 bp, Homo sapiens
aggagctgctttggtgcggttt

SEQ ID NO: 7929540 - DNA, 22 bp, Homo sapiens
aggagctgctttggtgcggttt

SEQ ID NO: 7929541 - DNA, 22 bp, Homo sapiens
aggagctgcttaaatggttggt

SEQ ID NO: 7929542 - DNA, 22 bp, Homo sapiens
aggagctgcatggatacctggt

SEQ ID NO: 7929543 - DNA, 22 bp, Homo sapiens
aggagctgcatggatacctggt

SEQ ID NO: 7929544 - DNA, 22 bp, Homo sapiens
aggagctgcagattctgccttg

SEQ ID NO: 7929545 - DNA, 22 bp, Homo sapiens
aggagctgcagattctgccttg

SEQ ID NO: 7929546 - DNA, 22 bp, Homo sapiens
aggagctgcagattctgccttg

SEQ ID NO: 7929547 - DNA, 22 bp, Homo sapiens
aggagctgcagattctgccttg

SEQ ID NO: 7929548 - DNA, 22 bp, Homo sapiens
aggagctgcagattctgccttg

SEQ ID NO: 7929549 - DNA, 22 bp, Homo sapiens
aggagctgcactgggagttttt

SEQ ID NO: 7929550 - DNA, 22 bp, Homo sapiens
aggagccctgcgggaggcagag

SEQ ID NO: 7929551 - DNA, 22 bp, Homo sapiens
aggagcccctcttcagtcctgg

SEQ ID NO: 7929552 - DNA, 22 bp, Homo sapiens
aggagccctccgttgcttcatc

SEQ ID NO: 7929553 - DNA, 22 bp, Homo sapiens
aggagcccagcctgggctcgga

SEQ ID NO: 7929554 - DNA, 22 bp, Homo sapiens
aggagcccagcctgggctcgga

SEQ ID NO: 7929555 - DNA, 22 bp, Homo sapiens
aggagcccctcttcagtcctgg

SEQ ID NO: 7929556 - DNA, 23 bp, Homo sapiens
aggagcccctaattctgggcagc

SEQ ID NO: 7929557 - DNA, 22 bp, Homo sapiens
aggagcctgaatcagagggtga

SEQ ID NO: 7929558 - DNA, 22 bp, Homo sapiens
aggagcctccatggtcacattc

SEQ ID NO: 7929559 - DNA, 22 bp, Homo sapiens
aggagcctccatggtcacattc

SEQ ID NO: 7929560 - DNA, 22 bp, Homo sapiens
aggagcctggctggcccacagg

SEQ ID NO: 7929561 - DNA, 22 bp, Homo sapiens
aggagctgatgattctttgatc

SEQ ID NO: 7929562 - DNA, 22 bp, Homo sapiens
aggagctgcaaaaccggccgct

SEQ ID NO: 7929563 - DNA, 22 bp, Homo sapiens
aggagctgcaaaaccggccgct

SEQ ID NO: 7929564 - DNA, 22 bp, Homo sapiens
aggagctgcaaatattagtaat

SEQ ID NO: 7929565 - DNA, 22 bp, Homo sapiens
aggagccatgagtgacatcaca

SEQ ID NO: 7929566 - DNA, 22 bp, Homo sapiens
aggagcagaccgtagtcctgca

SEQ ID NO: 7929567 - DNA, 22 bp, Homo sapiens
aggagcagaccgtagtcctgca

SEQ ID NO: 7929568 - DNA, 22 bp, Homo sapiens
aggagcagaccgtagtcctgca

SEQ ID NO: 7929569 - DNA, 22 bp, Homo sapiens
aggagccatggaggtgaggcgg

SEQ ID NO: 7929570 - DNA, 22 bp, Homo sapiens
aggagccatggaggtgaggcgg

SEQ ID NO: 7929571 - DNA, 23 bp, Homo sapiens
aggagccatgagttggatatgtt

SEQ ID NO: 7929572 - DNA, 23 bp, Homo sapiens
aggagccatgagttggatatgtt

SEQ ID NO: 7929573 - DNA, 23 bp, Homo sapiens
aggagccatgagttggatatgtt

SEQ ID NO: 7929574 - DNA, 22 bp, Homo sapiens
aggagccattttccaagggcga

SEQ ID NO: 7929575 - DNA, 22 bp, Homo sapiens
aggagccattttccaagggcga

SEQ ID NO: 7929576 - DNA, 22 bp, Homo sapiens
aggagccattttccaagggcga

SEQ ID NO: 7929577 - DNA, 22 bp, Homo sapiens
aggagccattgcaggatggcag

SEQ ID NO: 7929578 - DNA, 22 bp, Homo sapiens
aggagccattgcaggatggcag

SEQ ID NO: 7929579 - DNA, 22 bp, Homo sapiens
aggagccattgcaggatggcag

SEQ ID NO: 7929580 - DNA, 20 bp, Homo sapiens
aggagccattgactgcagca

SEQ ID NO: 7929581 - DNA, 21 bp, Homo sapiens
aggagccatgtggtctgatgg

SEQ ID NO: 7929582 - DNA, 21 bp, Homo sapiens
aggagccatgtggtctgatgg

SEQ ID NO: 7929583 - DNA, 20 bp, Homo sapiens
aggagccattgactgcagca

SEQ ID NO: 7929584 - DNA, 20 bp, Homo sapiens
aggagccattgactgcagca

SEQ ID NO: 7929585 - DNA, 22 bp, Homo sapiens
acagggtgaatgtgacattatc

SEQ ID NO: 7929586 - DNA, 22 bp, Homo sapiens
acagggtgactttgtgacagat

SEQ ID NO: 7929587 - DNA, 22 bp, Homo sapiens
acagggtgactttgtgacagat

SEQ ID NO: 7929588 - DNA, 22 bp, Homo sapiens
acagggtgactttgtgacagat

SEQ ID NO: 7929589 - DNA, 22 bp, Homo sapiens
acagggtgactttgtgacagat

SEQ ID NO: 7929590 - DNA, 22 bp, Homo sapiens
acagggtgactttgtgacagat

SEQ ID NO: 7929591 - DNA, 22 bp, Homo sapiens
acagggtgactttgtgacagat

SEQ ID NO: 7929592 - DNA, 22 bp, Homo sapiens
acagggtggggatggtgagctt

SEQ ID NO: 7929593 - DNA, 22 bp, Homo sapiens
acagggtgactttgtgacagat

SEQ ID NO: 7929594 - DNA, 22 bp, Homo sapiens
acagggtggggatggtgagctt

SEQ ID NO: 7929595 - DNA, 22 bp, Homo sapiens
acaggggctccgaaggtgaggg

SEQ ID NO: 7929596 - DNA, 22 bp, Homo sapiens
acaggggctccgaaggtgaggg

SEQ ID NO: 7929597 - DNA, 22 bp, Homo sapiens
acaggggctccgaaggtgaggg

SEQ ID NO: 7929598 - DNA, 22 bp, Homo sapiens
acaggggctccgaaggtgaggg

SEQ ID NO: 7929599 - DNA, 22 bp, Homo sapiens
acaggggtgcatggtgcatggt

SEQ ID NO: 7929600 - DNA, 22 bp, Homo sapiens
acagggtgaatgtgacattatc

SEQ ID NO: 7929601 - DNA, 22 bp, Homo sapiens
aggaaggcatgaggtgttcaca

SEQ ID NO: 7929602 - DNA, 22 bp, Homo sapiens
aggaaggcacattgttggctaa

SEQ ID NO: 7929603 - DNA, 22 bp, Homo sapiens
aggaaggcacattgttggctaa

SEQ ID NO: 7929604 - DNA, 22 bp, Homo sapiens
aggaaggcacattgttggctaa

SEQ ID NO: 7929605 - DNA, 23 bp, Homo sapiens
aggaaggaggtcctaacagtatc

SEQ ID NO: 7929606 - DNA, 23 bp, Homo sapiens
aggaaggaggtcctaacagtatc

SEQ ID NO: 7929607 - DNA, 23 bp, Homo sapiens
aggaaggaggtcctaacagtatc

SEQ ID NO: 7929608 - DNA, 23 bp, Homo sapiens
aggaaggaggtcctaacagtatc

SEQ ID NO: 7929609 - DNA, 23 bp, Homo sapiens
aggaaggaggtcctaacagtatc

SEQ ID NO: 7929610 - DNA, 22 bp, Homo sapiens
aggaaggagggcagatattaag

SEQ ID NO: 7929611 - DNA, 22 bp, Homo sapiens
aggaaggagggcagatattaag

SEQ ID NO: 7929612 - DNA, 22 bp, Homo sapiens
aggaaggagggcagatattaag

SEQ ID NO: 7929613 - DNA, 22 bp, Homo sapiens
aggaaggagggcagatattaag

SEQ ID NO: 7929614 - DNA, 20 bp, Homo sapiens
aggaaggagaatctgagcaa

SEQ ID NO: 7929615 - DNA, 20 bp, Homo sapiens
aggaaggctgttggccttgc

SEQ ID NO: 7929616 - DNA, 22 bp, Homo sapiens
aggaaggctgatcactgcttgt

SEQ ID NO: 7929617 - DNA, 22 bp, Homo sapiens
aggaaggctgatcactgcttgt

SEQ ID NO: 7929618 - DNA, 19 bp, Homo sapiens
aggaaggcggcggctgccc

SEQ ID NO: 7929619 - DNA, 22 bp, Homo sapiens
aggaaggcatgaggtgttcaca

SEQ ID NO: 7929620 - DNA, 22 bp, Homo sapiens
aggaaggctgatcactgcttgt

SEQ ID NO: 7929621 - DNA, 22 bp, Homo sapiens
aggaagggatacataggatagt

SEQ ID NO: 7929622 - DNA, 22 bp, Homo sapiens
aggaagggatacataggatagt

SEQ ID NO: 7929623 - DNA, 22 bp, Homo sapiens
aggaagggatacataggatagt

SEQ ID NO: 7929624 - DNA, 22 bp, Homo sapiens
aggaaggcttctttggtcttct

SEQ ID NO: 7929625 - DNA, 22 bp, Homo sapiens
aggaaggcttctttggtcttct

SEQ ID NO: 7929626 - DNA, 22 bp, Homo sapiens
aggaaggcttctttggtcttct

SEQ ID NO: 7929627 - DNA, 22 bp, Homo sapiens
aggaagggagcagtttgttgtt

SEQ ID NO: 7929628 - DNA, 22 bp, Homo sapiens
aggaagggagcagtttgttgtt

SEQ ID NO: 7929629 - DNA, 22 bp, Homo sapiens
aggaagggagcagtttgttgtt

SEQ ID NO: 7929630 - DNA, 22 bp, Homo sapiens
aggaagggagcagtttgttgtt

SEQ ID NO: 7929631 - DNA, 22 bp, Homo sapiens
aggaagctaaccagggagtgag

SEQ ID NO: 7929632 - DNA, 22 bp, Homo sapiens
aggaagctaaccagggagtgag

SEQ ID NO: 7929633 - DNA, 23 bp, Homo sapiens
aggaagctaagtgtggctgcgga

SEQ ID NO: 7929634 - DNA, 23 bp, Homo sapiens
aggaagctaagtgtggctgcgga

SEQ ID NO: 7929635 - DNA, 22 bp, Homo sapiens
aggaagctagagccaccggact

SEQ ID NO: 7929636 - DNA, 23 bp, Homo sapiens
aggaagctaccaattttgtaggc

SEQ ID NO: 7929637 - DNA, 23 bp, Homo sapiens
aggaagctaccaattttgtaggc

SEQ ID NO: 7929638 - DNA, 22 bp, Homo sapiens
aggaagctagaaggtcttcttt

SEQ ID NO: 7929639 - DNA, 22 bp, Homo sapiens
aggaagctagaaggtcttcttt

SEQ ID NO: 7929640 - DNA, 17 bp, Homo sapiens
aggaagcgagctggcct

SEQ ID NO: 7929641 - DNA, 22 bp, Homo sapiens
aggaagcgtgggtctggctgga

SEQ ID NO: 7929642 - DNA, 22 bp, Homo sapiens
aggaagcgtgggtctggctgga

SEQ ID NO: 7929643 - DNA, 17 bp, Homo sapiens
aggaagcgagctggcct

SEQ ID NO: 7929644 - DNA, 22 bp, Homo sapiens
aggaagcctgggaggtttggga

SEQ ID NO: 7929645 - DNA, 22 bp, Homo sapiens
aggaagcctggggctgccctcg

SEQ ID NO: 7929646 - DNA, 22 bp, Homo sapiens
aggaagcctggggctgccctcg

SEQ ID NO: 7929647 - DNA, 22 bp, Homo sapiens
aggaagccatggtggacgtcta

SEQ ID NO: 7929648 - DNA, 22 bp, Homo sapiens
aggaagcccaagtctcatcttc

SEQ ID NO: 7929649 - DNA, 23 bp, Homo sapiens
aggaagcccattttagtctacct

SEQ ID NO: 7929650 - DNA, 22 bp, Homo sapiens
aggaagcctgcaggtgactgct

SEQ ID NO: 7929651 - DNA, 22 bp, Homo sapiens
aggaagcctggcattaaaaagc

SEQ ID NO: 7929652 - DNA, 22 bp, Homo sapiens
acaggggctccgaaggtgaggg

SEQ ID NO: 7929653 - DNA, 22 bp, Homo sapiens
acaggggctccgaaggtgaggg

SEQ ID NO: 7929654 - DNA, 22 bp, Homo sapiens
aggagactcagagacctggccg

SEQ ID NO: 7929655 - DNA, 22 bp, Homo sapiens
aggagaccttttgagtgtgaga

SEQ ID NO: 7929656 - DNA, 22 bp, Homo sapiens
aggagacccagaatgttgctgt

SEQ ID NO: 7929657 - DNA, 22 bp, Homo sapiens
aggagaccttcaccacttccac

SEQ ID NO: 7929658 - DNA, 21 bp, Homo sapiens
aggagaccggcttgtttgtgc

SEQ ID NO: 7929659 - DNA, 22 bp, Homo sapiens
aggagacccaatgccagaaaga

SEQ ID NO: 7929660 - DNA, 22 bp, Homo sapiens
aggagacccagaatgttgctgt

SEQ ID NO: 7929661 - DNA, 22 bp, Homo sapiens
aggagacatactataggaatat

SEQ ID NO: 7929662 - DNA, 22 bp, Homo sapiens
aggagacatactataggaatat

SEQ ID NO: 7929663 - DNA, 22 bp, Homo sapiens
aggagacataactatgatgaga

SEQ ID NO: 7929664 - DNA, 22 bp, Homo sapiens
aggagacatactataggaatat

SEQ ID NO: 7929665 - DNA, 22 bp, Homo sapiens
aggagacatctaactgtaggtt

SEQ ID NO: 7929666 - DNA, 22 bp, Homo sapiens
aggagacatctaactgtaggtt

SEQ ID NO: 7929667 - DNA, 22 bp, Homo sapiens
aggagacatggaatagtgaggc

SEQ ID NO: 7929668 - DNA, 22 bp, Homo sapiens
aggagacatggaatagtgaggc

SEQ ID NO: 7929669 - DNA, 20 bp, Homo sapiens
aggagaccaagccaagtgga

SEQ ID NO: 7929670 - DNA, 22 bp, Homo sapiens
aggactttaacatattaactgt

SEQ ID NO: 7929671 - DNA, 22 bp, Homo sapiens
aggagacagccaggggcctgag

SEQ ID NO: 7929672 - DNA, 23 bp, Homo sapiens
aggagacagggaagtgcctggct

SEQ ID NO: 7929673 - DNA, 23 bp, Homo sapiens
aggagacagggaagtgcctggct

SEQ ID NO: 7929674 - DNA, 22 bp, Homo sapiens
aggagacataactatgatgaga

SEQ ID NO: 7929675 - DNA, 22 bp, Homo sapiens
aggagacagtttggacgtgtag

SEQ ID NO: 7929676 - DNA, 22 bp, Homo sapiens
aggagacataactatgatgaga

SEQ ID NO: 7929677 - DNA, 23 bp, Homo sapiens
aggagacagggaagtgcctggct

SEQ ID NO: 7929678 - DNA, 20 bp, Homo sapiens
aggacttgtttgggcagagt

SEQ ID NO: 7929679 - DNA, 20 bp, Homo sapiens
aggacttgtttgggcagagt

SEQ ID NO: 7929680 - DNA, 22 bp, Homo sapiens
aggaagggctgtttctccaaga

SEQ ID NO: 7929681 - DNA, 17 bp, Homo sapiens
aggaagggcaagtttct

SEQ ID NO: 7929682 - DNA, 17 bp, Homo sapiens
aggaagggcaagtttct

SEQ ID NO: 7929683 - DNA, 22 bp, Homo sapiens
aggaagggatacataggatagt

SEQ ID NO: 7929684 - DNA, 22 bp, Homo sapiens
aggaagggatacataggatagt

SEQ ID NO: 7929685 - DNA, 17 bp, Homo sapiens
aggaagggcaagtttct

SEQ ID NO: 7929686 - DNA, 17 bp, Homo sapiens
aggaagggcaagtttct

SEQ ID NO: 7929687 - DNA, 17 bp, Homo sapiens
aggaagggcaagtttct

SEQ ID NO: 7929688 - DNA, 22 bp, Homo sapiens
agctgcaggagtcgcctaggat

SEQ ID NO: 7929689 - DNA, 22 bp, Homo sapiens
agctgcaggattatggaatgga

SEQ ID NO: 7929690 - DNA, 22 bp, Homo sapiens
agctgcaggcccatgctcagtc

SEQ ID NO: 7929691 - DNA, 22 bp, Homo sapiens
agctgctcattactttctgttg

SEQ ID NO: 7929692 - DNA, 22 bp, Homo sapiens
agctgctcattactttctgttg

SEQ ID NO: 7929693 - DNA, 22 bp, Homo sapiens
agctgctgggatacagtagtga

SEQ ID NO: 7929694 - DNA, 22 bp, Homo sapiens
agctgctcattactttctgttg

SEQ ID NO: 7929695 - DNA, 22 bp, Homo sapiens
agctgctcagatcccggggaag

SEQ ID NO: 7929696 - DNA, 22 bp, Homo sapiens
agctgcaggcccatgctcagtc

SEQ ID NO: 7929697 - DNA, 22 bp, Homo sapiens
agctgctcaggagagccaggtc

SEQ ID NO: 7929698 - DNA, 22 bp, Homo sapiens
agctgctcaggagagccaggtc

SEQ ID NO: 7929699 - DNA, 22 bp, Homo sapiens
agctgcagctacagtgttggtt

SEQ ID NO: 7929700 - DNA, 22 bp, Homo sapiens
agctgcagctacagtgttggtt

SEQ ID NO: 7929701 - DNA, 22 bp, Homo sapiens
agctgcagctgttttctgagtg

SEQ ID NO: 7929702 - DNA, 22 bp, Homo sapiens
agctgcagctgttttctgagtg

SEQ ID NO: 7929703 - DNA, 22 bp, Homo sapiens
agctgcagcttcctagtccagc

SEQ ID NO: 7929704 - DNA, 22 bp, Homo sapiens
agctgcaggaagtagaagcgga

SEQ ID NO: 7929705 - DNA, 22 bp, Homo sapiens
agctgcaggagtcgcctaggat

SEQ ID NO: 7929706 - DNA, 22 bp, Homo sapiens
agctgcaggagtcgcctaggat

SEQ ID NO: 7929707 - DNA, 22 bp, Homo sapiens
agctgcaggagtcgcctaggat

SEQ ID NO: 7929708 - DNA, 22 bp, Homo sapiens
agctgcagccgcagctgtggcc

SEQ ID NO: 7929709 - DNA, 22 bp, Homo sapiens
agctgcagccgcagctgtggcc

SEQ ID NO: 7929710 - DNA, 22 bp, Homo sapiens
agctgcagccgcagctgtggcc

SEQ ID NO: 7929711 - DNA, 22 bp, Homo sapiens
agctgcagccgcagctgtggcc

SEQ ID NO: 7929712 - DNA, 22 bp, Homo sapiens
agctgcagccgcagctgtggcc

SEQ ID NO: 7929713 - DNA, 22 bp, Homo sapiens
agctgcagccgcagctgtggcc

SEQ ID NO: 7929714 - DNA, 22 bp, Homo sapiens
agctgcagcctcatgattcggt

SEQ ID NO: 7929715 - DNA, 22 bp, Homo sapiens
agctgcagcctcatgattcggt

SEQ ID NO: 7929716 - DNA, 22 bp, Homo sapiens
agctgcagccctcctgcatggc

SEQ ID NO: 7929717 - DNA, 22 bp, Homo sapiens
agctgcagccctcctgcatggc

SEQ ID NO: 7929718 - DNA, 22 bp, Homo sapiens
acagcccaagtcacctgcagga

SEQ ID NO: 7929719 - DNA, 22 bp, Homo sapiens
agctgcagccctcctgcatggc

SEQ ID NO: 7929720 - DNA, 22 bp, Homo sapiens
agctgcagccctcctgcatggc

SEQ ID NO: 7929721 - DNA, 22 bp, Homo sapiens
acagccagtgctccgtgaggac

SEQ ID NO: 7929722 - DNA, 22 bp, Homo sapiens
acagccagtgctccgtgaggac

SEQ ID NO: 7929723 - DNA, 22 bp, Homo sapiens
acagccagtgactggacaagct

SEQ ID NO: 7929724 - DNA, 22 bp, Homo sapiens
acagccagtgactggacaagct

SEQ ID NO: 7929725 - DNA, 23 bp, Homo sapiens
acagccagttcacctctccttgg

SEQ ID NO: 7929726 - DNA, 23 bp, Homo sapiens
acagccagttcacctctccttgg

SEQ ID NO: 7929727 - DNA, 23 bp, Homo sapiens
acagccagttcacctctccttgg

SEQ ID NO: 7929728 - DNA, 23 bp, Homo sapiens
acagccagttcacctctccttgg

SEQ ID NO: 7929729 - DNA, 23 bp, Homo sapiens
acagccagttcacctctccttgg

SEQ ID NO: 7929730 - DNA, 22 bp, Homo sapiens
acagccatagatgcttatgtaa

SEQ ID NO: 7929731 - DNA, 22 bp, Homo sapiens
acagccatagatgcttatgtaa

SEQ ID NO: 7929732 - DNA, 22 bp, Homo sapiens
acagcccaagtcacctgcagga

SEQ ID NO: 7929733 - DNA, 22 bp, Homo sapiens
acagcccaagtcacctgcagga

SEQ ID NO: 7929734 - DNA, 22 bp, Homo sapiens
acagcccaagtcacctgcagga

SEQ ID NO: 7929735 - DNA, 22 bp, Homo sapiens
agctcccagaagccagagtcgg

SEQ ID NO: 7929736 - DNA, 22 bp, Homo sapiens
agctcccagaagccagagtcgg

SEQ ID NO: 7929737 - DNA, 22 bp, Homo sapiens
agctcccagaaggccctgcgcc

SEQ ID NO: 7929738 - DNA, 22 bp, Homo sapiens
agctcccagaaggccctgcgcc

SEQ ID NO: 7929739 - DNA, 22 bp, Homo sapiens
acagccagaggtggtcctgggt

SEQ ID NO: 7929740 - DNA, 22 bp, Homo sapiens
acagccagaggtggtcctgggt

SEQ ID NO: 7929741 - DNA, 20 bp, Homo sapiens
agctccatgaagtagtcact

SEQ ID NO: 7929742 - DNA, 20 bp, Homo sapiens
agctccatgaagtagtcact

SEQ ID NO: 7929743 - DNA, 22 bp, Homo sapiens
agctcccaattgacttgaacta

SEQ ID NO: 7929744 - DNA, 22 bp, Homo sapiens
agctccagtttcctgactgagc

SEQ ID NO: 7929745 - DNA, 22 bp, Homo sapiens
agctccagtttcctgactgagc

SEQ ID NO: 7929746 - DNA, 22 bp, Homo sapiens
agctccagtttcctgactgagc

SEQ ID NO: 7929747 - DNA, 18 bp, Homo sapiens
agctccatctgtcagcat

SEQ ID NO: 7929748 - DNA, 22 bp, Homo sapiens
agctccaggtgcaagtcatggt

SEQ ID NO: 7929749 - DNA, 22 bp, Homo sapiens
agctccaggtgcaagtcatggt

SEQ ID NO: 7929750 - DNA, 22 bp, Homo sapiens
agctccaggtgcaagtcatggt

SEQ ID NO: 7929751 - DNA, 22 bp, Homo sapiens
agctccaggtgcaagtcatggt

SEQ ID NO: 7929752 - DNA, 22 bp, Homo sapiens
agctccaggtgcaagtcatggt

SEQ ID NO: 7929753 - DNA, 22 bp, Homo sapiens
agctccaggtgcaagtcatggt

SEQ ID NO: 7929754 - DNA, 22 bp, Homo sapiens
agctccaggtgcaagtcatggt

SEQ ID NO: 7929755 - DNA, 22 bp, Homo sapiens
agctccaggtgcaagtcatggt

SEQ ID NO: 7929756 - DNA, 22 bp, Homo sapiens
agctccaggtgcaagtcatggt

SEQ ID NO: 7929757 - DNA, 22 bp, Homo sapiens
agctccaggtgcaagtcatggt

SEQ ID NO: 7929758 - DNA, 22 bp, Homo sapiens
agctccaggtgcaagtcatggt

SEQ ID NO: 7929759 - DNA, 20 bp, Homo sapiens
agctccagtgctgacgcttc

SEQ ID NO: 7929760 - DNA, 22 bp, Homo sapiens
agctccaggtgcaagtcatggt

SEQ ID NO: 7929761 - DNA, 20 bp, Homo sapiens
agctccagtgctgacgcttc

SEQ ID NO: 7929762 - DNA, 22 bp, Homo sapiens
agctccagttacttacctagag

SEQ ID NO: 7929763 - DNA, 22 bp, Homo sapiens
agctccagttacttacctagag

SEQ ID NO: 7929764 - DNA, 20 bp, Homo sapiens
agctccagtgctgacgcttc

SEQ ID NO: 7929765 - DNA, 20 bp, Homo sapiens
agctccagtgctgacgcttc

SEQ ID NO: 7929766 - DNA, 22 bp, Homo sapiens
acagccagtcatctcagcaggg

SEQ ID NO: 7929767 - DNA, 22 bp, Homo sapiens
acagccagtcatctcagcaggg

SEQ ID NO: 7929768 - DNA, 22 bp, Homo sapiens
acagccagtcatctcagcaggg

SEQ ID NO: 7929769 - DNA, 22 bp, Homo sapiens
acagccagtaatctacccctgt

SEQ ID NO: 7929770 - DNA, 22 bp, Homo sapiens
acagccagtaatctacccctgt

SEQ ID NO: 7929771 - DNA, 22 bp, Homo sapiens
acagccagtgactgcagaccct

SEQ ID NO: 7929772 - DNA, 22 bp, Homo sapiens
acagccagtgactgcagaccct

SEQ ID NO: 7929773 - DNA, 22 bp, Homo sapiens
acagccagtcctcccacagggt

SEQ ID NO: 7929774 - DNA, 22 bp, Homo sapiens
acagccagtcctcccacagggt

SEQ ID NO: 7929775 - DNA, 22 bp, Homo sapiens
acagccagtcctcccacagggt

SEQ ID NO: 7929776 - DNA, 22 bp, Homo sapiens
acagccagtcctcccacagggt

SEQ ID NO: 7929777 - DNA, 22 bp, Homo sapiens
acagccagtcctcccacagggt

SEQ ID NO: 7929778 - DNA, 22 bp, Homo sapiens
acagccagaggtggtcctgggt

SEQ ID NO: 7929779 - DNA, 22 bp, Homo sapiens
acagccagaggtggtcctgggt

SEQ ID NO: 7929780 - DNA, 22 bp, Homo sapiens
acagccagggtctcaggaggcg

SEQ ID NO: 7929781 - DNA, 22 bp, Homo sapiens
acagccaggtaaaggcatggca

SEQ ID NO: 7929782 - DNA, 22 bp, Homo sapiens
acagccaggtaaaggcatggca

SEQ ID NO: 7929783 - DNA, 22 bp, Homo sapiens
acagccaggtaaaggcatggca

SEQ ID NO: 7929784 - DNA, 22 bp, Homo sapiens
acagccaggtaaaggcatggca

SEQ ID NO: 7929785 - DNA, 22 bp, Homo sapiens
acagccaggtaaaggcatggca

SEQ ID NO: 7929786 - DNA, 22 bp, Homo sapiens
acagccagtaaggaaagaccca

SEQ ID NO: 7929787 - DNA, 22 bp, Homo sapiens
acagccagtaaggaaagaccca

SEQ ID NO: 7929788 - DNA, 22 bp, Homo sapiens
acagccagtaaggaaagaccca

SEQ ID NO: 7929789 - DNA, 22 bp, Homo sapiens
agctggctatgccctgtgaacc

SEQ ID NO: 7929790 - DNA, 22 bp, Homo sapiens
agctggctatgccctgtgaacc

SEQ ID NO: 7929791 - DNA, 22 bp, Homo sapiens
agctggctcagccgggtggtct

SEQ ID NO: 7929792 - DNA, 22 bp, Homo sapiens
agctggctatgccctgtgaacc

SEQ ID NO: 7929793 - DNA, 21 bp, Homo sapiens
agctggctatagttagtgatg

SEQ ID NO: 7929794 - DNA, 22 bp, Homo sapiens
agctggctatgccctgtgaacc

SEQ ID NO: 7929795 - DNA, 22 bp, Homo sapiens
agctggctatgccctgtgaacc

SEQ ID NO: 7929796 - DNA, 21 bp, Homo sapiens
agctggctctctctggagaga

SEQ ID NO: 7929797 - DNA, 21 bp, Homo sapiens
agctggctctctctggagaga

SEQ ID NO: 7929798 - DNA, 21 bp, Homo sapiens
agctggctctctctggagaga

SEQ ID NO: 7929799 - DNA, 21 bp, Homo sapiens
agctggctctctctggagaga

SEQ ID NO: 7929800 - DNA, 21 bp, Homo sapiens
agctggctctctctggagaga

SEQ ID NO: 7929801 - DNA, 21 bp, Homo sapiens
agctggctctctctggagaga

SEQ ID NO: 7929802 - DNA, 22 bp, Homo sapiens
agctggctcagccgggtggtct

SEQ ID NO: 7929803 - DNA, 21 bp, Homo sapiens
agctggctctctctggagaga

SEQ ID NO: 7929804 - DNA, 22 bp, Homo sapiens
agctggctatacttgaaaagtc

SEQ ID NO: 7929805 - DNA, 22 bp, Homo sapiens
agctggctatacttgaaaagtc

SEQ ID NO: 7929806 - DNA, 22 bp, Homo sapiens
agctggctatacttgaaaagtc

SEQ ID NO: 7929807 - DNA, 21 bp, Homo sapiens
agctggctatagttagtgatg

SEQ ID NO: 7929808 - DNA, 22 bp, Homo sapiens
agctggctatacttgaaaagtc

SEQ ID NO: 7929809 - DNA, 22 bp, Homo sapiens
agctggctatacttgaaaagtc

SEQ ID NO: 7929810 - DNA, 22 bp, Homo sapiens
agctggccttcggtgtcactgg

SEQ ID NO: 7929811 - DNA, 22 bp, Homo sapiens
agctggccttcggtgtcactgg

SEQ ID NO: 7929812 - DNA, 22 bp, Homo sapiens
agctggccttagtgagcacctg

SEQ ID NO: 7929813 - DNA, 22 bp, Homo sapiens
agctggcctgttagagctgagt

SEQ ID NO: 7929814 - DNA, 22 bp, Homo sapiens
agctggccttagtgagcacctg

SEQ ID NO: 7929815 - DNA, 22 bp, Homo sapiens
acagcctgcagccccaggtcgc

SEQ ID NO: 7929816 - DNA, 22 bp, Homo sapiens
agctggcagctctcaggggtac

SEQ ID NO: 7929817 - DNA, 22 bp, Homo sapiens
agctggcagctctcaggggtac

SEQ ID NO: 7929818 - DNA, 22 bp, Homo sapiens
acagcctgcagccccaggtcgc

SEQ ID NO: 7929819 - DNA, 19 bp, Homo sapiens
agctggcagcttccacttc

SEQ ID NO: 7929820 - DNA, 19 bp, Homo sapiens
agctggcagcttccacttc

SEQ ID NO: 7929821 - DNA, 22 bp, Homo sapiens
agctggcaggggttcacactgc

SEQ ID NO: 7929822 - DNA, 22 bp, Homo sapiens
agctggcaggggttcacactgc

SEQ ID NO: 7929823 - DNA, 22 bp, Homo sapiens
agctggcaggggttcacactgc

SEQ ID NO: 7929824 - DNA, 20 bp, Homo sapiens
agctggcctgtcctaggcct

SEQ ID NO: 7929825 - DNA, 22 bp, Homo sapiens
agctggcaggggttcacactgc

SEQ ID NO: 7929826 - DNA, 20 bp, Homo sapiens
agctggcctgtcctaggcct

SEQ ID NO: 7929827 - DNA, 20 bp, Homo sapiens
agctggcctgtcctaggcct

SEQ ID NO: 7929828 - DNA, 20 bp, Homo sapiens
agctggcctgtcctaggcct

SEQ ID NO: 7929829 - DNA, 22 bp, Homo sapiens
agctggcctgttagagctgagt

SEQ ID NO: 7929830 - DNA, 22 bp, Homo sapiens
agctggcctgttagagctgagt

SEQ ID NO: 7929831 - DNA, 20 bp, Homo sapiens
agctggcctgtcctaggcct

SEQ ID NO: 7929832 - DNA, 22 bp, Homo sapiens
acagcctgacttttgttgtcac

SEQ ID NO: 7929833 - DNA, 22 bp, Homo sapiens
acagcctgacttttgttgtcac

SEQ ID NO: 7929834 - DNA, 22 bp, Homo sapiens
acagcctgacttttgttgtcac

SEQ ID NO: 7929835 - DNA, 22 bp, Homo sapiens
acagcctgacttttgttgtcac

SEQ ID NO: 7929836 - DNA, 22 bp, Homo sapiens
acagcctgagagtggagctggc

SEQ ID NO: 7929837 - DNA, 22 bp, Homo sapiens
acagcctgacttttgttgtcac

SEQ ID NO: 7929838 - DNA, 22 bp, Homo sapiens
acagcctgagagtggagctggc

SEQ ID NO: 7929839 - DNA, 22 bp, Homo sapiens
acagcctgatttatggagcagt

SEQ ID NO: 7929840 - DNA, 22 bp, Homo sapiens
acagcctgatttatggagcagt

SEQ ID NO: 7929841 - DNA, 22 bp, Homo sapiens
acagcctgagagtggagctggc

SEQ ID NO: 7929842 - DNA, 22 bp, Homo sapiens
acagcctgatttatggagcagt

SEQ ID NO: 7929843 - DNA, 22 bp, Homo sapiens
acagcctgcagccccaggtcgc

SEQ ID NO: 7929844 - DNA, 22 bp, Homo sapiens
acagcctgatttatggagcagt

SEQ ID NO: 7929845 - DNA, 22 bp, Homo sapiens
acagcctgatttatggagcagt

SEQ ID NO: 7929846 - DNA, 22 bp, Homo sapiens
acagcccagaaagcctaagggg

SEQ ID NO: 7929847 - DNA, 21 bp, Homo sapiens
agctgctttcagctcctagag

SEQ ID NO: 7929848 - DNA, 22 bp, Homo sapiens
acagcccagaaagcctaagggg

SEQ ID NO: 7929849 - DNA, 18 bp, Homo sapiens
agctgcttgcaggccttc

SEQ ID NO: 7929850 - DNA, 22 bp, Homo sapiens
agctgcttgggaaccatcaatt

SEQ ID NO: 7929851 - DNA, 22 bp, Homo sapiens
agctgcttagagtctcttctta

SEQ ID NO: 7929852 - DNA, 22 bp, Homo sapiens
agctgcttagagtcctcaggat

SEQ ID NO: 7929853 - DNA, 22 bp, Homo sapiens
agctgcttagagtctcttctta

SEQ ID NO: 7929854 - DNA, 22 bp, Homo sapiens
agctgcttataagatttgggag

SEQ ID NO: 7929855 - DNA, 22 bp, Homo sapiens
agctgcttattcattgatcgat

SEQ ID NO: 7929856 - DNA, 22 bp, Homo sapiens
agctgcttcaaaatgggctcct

SEQ ID NO: 7929857 - DNA, 22 bp, Homo sapiens
agctgcttcaaaatgggctcct

SEQ ID NO: 7929858 - DNA, 22 bp, Homo sapiens
agctgcttcaaaatgggctcct

SEQ ID NO: 7929859 - DNA, 22 bp, Homo sapiens
agctgcttcctctttgatgtca

SEQ ID NO: 7929860 - DNA, 18 bp, Homo sapiens
agctgcttgcaggccttc

SEQ ID NO: 7929861 - DNA, 22 bp, Homo sapiens
acagcccaggactccagtgggc

SEQ ID NO: 7929862 - DNA, 22 bp, Homo sapiens
acagcccaggactccagtgggc

SEQ ID NO: 7929863 - DNA, 23 bp, Homo sapiens
acagccccatgcaggtgtgtttg

SEQ ID NO: 7929864 - DNA, 22 bp, Homo sapiens
acagccccagcgcggcggggtc

SEQ ID NO: 7929865 - DNA, 22 bp, Homo sapiens
acagcccaggactccagtgggc

SEQ ID NO: 7929866 - DNA, 22 bp, Homo sapiens
acagccccccgctcagtttcca

SEQ ID NO: 7929867 - DNA, 22 bp, Homo sapiens
acagccccccgctcagtttcca

SEQ ID NO: 7929868 - DNA, 23 bp, Homo sapiens
acagccccatgcaggtgtgtttg

SEQ ID NO: 7929869 - DNA, 21 bp, Homo sapiens
acagcctccatctcctgggct

SEQ ID NO: 7929870 - DNA, 22 bp, Homo sapiens
acagcccgtgtcatcagctgct

SEQ ID NO: 7929871 - DNA, 22 bp, Homo sapiens
acagcccgttctctggcacaca

SEQ ID NO: 7929872 - DNA, 22 bp, Homo sapiens
agctgctgtttggtgagtcttg

SEQ ID NO: 7929873 - DNA, 22 bp, Homo sapiens
agctgctgtttggtgagtcttg

SEQ ID NO: 7929874 - DNA, 22 bp, Homo sapiens
agctgctgtttcttgcacgtat

SEQ ID NO: 7929875 - DNA, 22 bp, Homo sapiens
agctgctgtttggtgagtcttg

SEQ ID NO: 7929876 - DNA, 22 bp, Homo sapiens
agctgctgtttggtgagtcttg

SEQ ID NO: 7929877 - DNA, 22 bp, Homo sapiens
agctgctgtttggtgagtcttg

SEQ ID NO: 7929878 - DNA, 22 bp, Homo sapiens
agctgctgtttcttgcacgtat

SEQ ID NO: 7929879 - DNA, 22 bp, Homo sapiens
agctgctgtttcttgcacgtat

SEQ ID NO: 7929880 - DNA, 22 bp, Homo sapiens
agctgctgtttcttgcacgtat

SEQ ID NO: 7929881 - DNA, 22 bp, Homo sapiens
agctgctgtgtgctcaggcagg

SEQ ID NO: 7929882 - DNA, 22 bp, Homo sapiens
agctgctgtgtgctcaggcagg

SEQ ID NO: 7929883 - DNA, 22 bp, Homo sapiens
agctgctgtgtgctcaggcagg

SEQ ID NO: 7929884 - DNA, 22 bp, Homo sapiens
agctgctgtggggctcggcctg

SEQ ID NO: 7929885 - DNA, 22 bp, Homo sapiens
agctgctgtggggctcggcctg

SEQ ID NO: 7929886 - DNA, 22 bp, Homo sapiens
agctgctgtggggctcggcctg

SEQ ID NO: 7929887 - DNA, 22 bp, Homo sapiens
agctgctgtggggctcggcctg

SEQ ID NO: 7929888 - DNA, 21 bp, Homo sapiens
agctgctgtggccagaatcca

SEQ ID NO: 7929889 - DNA, 22 bp, Homo sapiens
agctgctgtggccacatctggc

SEQ ID NO: 7929890 - DNA, 21 bp, Homo sapiens
agctgctgtggccagaatcca

SEQ ID NO: 7929891 - DNA, 23 bp, Homo sapiens
agctgctgggcctgccgtggcct

SEQ ID NO: 7929892 - DNA, 23 bp, Homo sapiens
agctgctgggcctgccgtggcct

SEQ ID NO: 7929893 - DNA, 23 bp, Homo sapiens
agctgctgggcctgccgtggcct

SEQ ID NO: 7929894 - DNA, 23 bp, Homo sapiens
agctgctgggcctgccgtggcct

SEQ ID NO: 7929895 - DNA, 23 bp, Homo sapiens
agctgctgggcctgccgtggcct

SEQ ID NO: 7929896 - DNA, 22 bp, Homo sapiens
agctgctggggagggcagacac

SEQ ID NO: 7929897 - DNA, 22 bp, Homo sapiens
agctgctggggagggcagacac

SEQ ID NO: 7929898 - DNA, 22 bp, Homo sapiens
agctgctggggagggcagacac

SEQ ID NO: 7929899 - DNA, 22 bp, Homo sapiens
agctgctggggagggcagacac

SEQ ID NO: 7929900 - DNA, 22 bp, Homo sapiens
agctgctggggagggcagacac

SEQ ID NO: 7929901 - DNA, 22 bp, Homo sapiens
agctgctggtttaagggatggg

SEQ ID NO: 7929902 - DNA, 22 bp, Homo sapiens
agctgctggtttaagggatggg

SEQ ID NO: 7929903 - DNA, 22 bp, Homo sapiens
agctgctggtttaagggatggg

SEQ ID NO: 7929904 - DNA, 22 bp, Homo sapiens
agctgctggtttaagggatggg

SEQ ID NO: 7929905 - DNA, 22 bp, Homo sapiens
agctgctggggagggcagacac

SEQ ID NO: 7929906 - DNA, 22 bp, Homo sapiens
agctgctggtttaagggatggg

SEQ ID NO: 7929907 - DNA, 22 bp, Homo sapiens
agctgctgtcctaggcactgta

SEQ ID NO: 7929908 - DNA, 22 bp, Homo sapiens
agctgctgtcctaggcactgta

SEQ ID NO: 7929909 - DNA, 22 bp, Homo sapiens
agctgctgtcctaggcactgta

SEQ ID NO: 7929910 - DNA, 22 bp, Homo sapiens
agctgctgtcctaggcactgta

SEQ ID NO: 7929911 - DNA, 22 bp, Homo sapiens
agctgctggtttaagggatggg

SEQ ID NO: 7929912 - DNA, 22 bp, Homo sapiens
agctgctgtcctaggcactgta

SEQ ID NO: 7929913 - DNA, 22 bp, Homo sapiens
agctgctgtggccacatctggc

SEQ ID NO: 7929914 - DNA, 22 bp, Homo sapiens
agctgctgtcctaggcactgta

SEQ ID NO: 7929915 - DNA, 22 bp, Homo sapiens
agctgctgtcctaggcactgta

SEQ ID NO: 7929916 - DNA, 22 bp, Homo sapiens
agcttagaatgtgttaggaaag

SEQ ID NO: 7929917 - DNA, 22 bp, Homo sapiens
agctgtgtagggaatcagagaa

SEQ ID NO: 7929918 - DNA, 22 bp, Homo sapiens
agctgtgtaggatcataacacg

SEQ ID NO: 7929919 - DNA, 22 bp, Homo sapiens
agctgtgtaggatcataacacg

SEQ ID NO: 7929920 - DNA, 22 bp, Homo sapiens
agcttagtggttgtatgagtta

SEQ ID NO: 7929921 - DNA, 22 bp, Homo sapiens
agcttaggaggatgatgaacat

SEQ ID NO: 7929922 - DNA, 22 bp, Homo sapiens
agcttattaccactccttgggg

SEQ ID NO: 7929923 - DNA, 22 bp, Homo sapiens
agcttattaatttttctgcatg

SEQ ID NO: 7929924 - DNA, 22 bp, Homo sapiens
agcttatcttgttagtttcatt

SEQ ID NO: 7929925 - DNA, 22 bp, Homo sapiens
agcttagtggttgtatgagtta

SEQ ID NO: 7929926 - DNA, 22 bp, Homo sapiens
agcttataatgtaactaaggac

SEQ ID NO: 7929927 - DNA, 22 bp, Homo sapiens
agcttataatgtaactaaggac

SEQ ID NO: 7929928 - DNA, 22 bp, Homo sapiens
agcttcaacttactaaaagata

SEQ ID NO: 7929929 - DNA, 22 bp, Homo sapiens
agcttcaaggttcaaggatgct

SEQ ID NO: 7929930 - DNA, 22 bp, Homo sapiens
agcttcaaggttcaaggatgct

SEQ ID NO: 7929931 - DNA, 20 bp, Homo sapiens
agcttcagccctaggattgc

SEQ ID NO: 7929932 - DNA, 22 bp, Homo sapiens
agcttattatcttatcaagctt

SEQ ID NO: 7929933 - DNA, 22 bp, Homo sapiens
agcttcaaagctaggaagatct

SEQ ID NO: 7929934 - DNA, 22 bp, Homo sapiens
agcttattcatcttgtgaccta

SEQ ID NO: 7929935 - DNA, 22 bp, Homo sapiens
agcttcaaagctaggaagatct

SEQ ID NO: 7929936 - DNA, 20 bp, Homo sapiens
agcttcaggctcaagagaac

SEQ ID NO: 7929937 - DNA, 22 bp, Homo sapiens
agcttcaggaacaggcagcctg

SEQ ID NO: 7929938 - DNA, 20 bp, Homo sapiens
agcttcaggctcaagagaac

SEQ ID NO: 7929939 - DNA, 22 bp, Homo sapiens
agcttcaggaacaggcagcctg

SEQ ID NO: 7929940 - DNA, 22 bp, Homo sapiens
agctgtggtacttgattcacaa

SEQ ID NO: 7929941 - DNA, 19 bp, Homo sapiens
agctgtggggcctagcacc

SEQ ID NO: 7929942 - DNA, 19 bp, Homo sapiens
agctgtggggcctagcacc

SEQ ID NO: 7929943 - DNA, 22 bp, Homo sapiens
agctgtggggcaggcagcgagg

SEQ ID NO: 7929944 - DNA, 22 bp, Homo sapiens
agctgtggggaggaggctagca

SEQ ID NO: 7929945 - DNA, 22 bp, Homo sapiens
agctgtgggcctgggagagctg

SEQ ID NO: 7929946 - DNA, 22 bp, Homo sapiens
agctgtggggaggaggctagca

SEQ ID NO: 7929947 - DNA, 22 bp, Homo sapiens
agctgtggggaggaggctagca

SEQ ID NO: 7929948 - DNA, 22 bp, Homo sapiens
agctgtggggaggaggctagca

SEQ ID NO: 7929949 - DNA, 22 bp, Homo sapiens
agctgtggtgttttcaagccct

SEQ ID NO: 7929950 - DNA, 22 bp, Homo sapiens
agctgtggtcttcaagttgcct

SEQ ID NO: 7929951 - DNA, 22 bp, Homo sapiens
agctgtggtcttcaagttgcct

SEQ ID NO: 7929952 - DNA, 22 bp, Homo sapiens
agctgtggttagatagagtcct

SEQ ID NO: 7929953 - DNA, 22 bp, Homo sapiens
agctgtggttagatagagtcct

SEQ ID NO: 7929954 - DNA, 22 bp, Homo sapiens
agctgtggttctgggcagcgac

SEQ ID NO: 7929955 - DNA, 22 bp, Homo sapiens
agctgtgtaagtcatgtaggtg

SEQ ID NO: 7929956 - DNA, 22 bp, Homo sapiens
agctgtgtaggatcataacacg

SEQ ID NO: 7929957 - DNA, 22 bp, Homo sapiens
agctgtgggcctgggagagctg

SEQ ID NO: 7929958 - DNA, 22 bp, Homo sapiens
agctgtgggcctgggagagctg

SEQ ID NO: 7929959 - DNA, 22 bp, Homo sapiens
agctgtgggagaatctctgggt

SEQ ID NO: 7929960 - DNA, 22 bp, Homo sapiens
agctgtgggatttgggtgtgcc

SEQ ID NO: 7929961 - DNA, 22 bp, Homo sapiens
agctgtgggagaatctctgggt

SEQ ID NO: 7929962 - DNA, 21 bp, Homo sapiens
agctgtggcgaggggaacatg

SEQ ID NO: 7929963 - DNA, 21 bp, Homo sapiens
agctgtggcgaggggaacatg

SEQ ID NO: 7929964 - DNA, 22 bp, Homo sapiens
agctggttcactaagcataata

SEQ ID NO: 7929965 - DNA, 22 bp, Homo sapiens
agctggttcagaaattagatgg

SEQ ID NO: 7929966 - DNA, 22 bp, Homo sapiens
agctggttcagtttctgggcct

SEQ ID NO: 7929967 - DNA, 22 bp, Homo sapiens
agctgtggccagatgtgagcgg

SEQ ID NO: 7929968 - DNA, 22 bp, Homo sapiens
agctgggatgataacctcagtc

SEQ ID NO: 7929969 - DNA, 22 bp, Homo sapiens
agctgggatgataacctcagtc

SEQ ID NO: 7929970 - DNA, 22 bp, Homo sapiens
agctgggatgataacctcagtc

SEQ ID NO: 7929971 - DNA, 22 bp, Homo sapiens
agctgggatgataacctcagtc

SEQ ID NO: 7929972 - DNA, 22 bp, Homo sapiens
agctgggcaaaatgtgaggttg

SEQ ID NO: 7929973 - DNA, 22 bp, Homo sapiens
agctggttcactaagcataata

SEQ ID NO: 7929974 - DNA, 22 bp, Homo sapiens
agctggttaagggtggagttaa

SEQ ID NO: 7929975 - DNA, 23 bp, Homo sapiens
agctgggcaaggatccgggctcc

SEQ ID NO: 7929976 - DNA, 22 bp, Homo sapiens
agctggtgtggatttttgaatg

SEQ ID NO: 7929977 - DNA, 22 bp, Homo sapiens
agctgggcaaaatgtgaggttg

SEQ ID NO: 7929978 - DNA, 22 bp, Homo sapiens
agctgggcaaaatgtgaggttg

SEQ ID NO: 7929979 - DNA, 22 bp, Homo sapiens
agctgggcaaaatgtgaggttg

SEQ ID NO: 7929980 - DNA, 22 bp, Homo sapiens
agctgggcaaaatgtgaggttg

SEQ ID NO: 7929981 - DNA, 22 bp, Homo sapiens
agctgggagcagagccacagcc

SEQ ID NO: 7929982 - DNA, 22 bp, Homo sapiens
agctgggagcagagccacagcc

SEQ ID NO: 7929983 - DNA, 19 bp, Homo sapiens
agctggctcttctttgtct

SEQ ID NO: 7929984 - DNA, 22 bp, Homo sapiens
agctgggagctgaaggctgatt

SEQ ID NO: 7929985 - DNA, 22 bp, Homo sapiens
agctgggagctgaaggctgatt

SEQ ID NO: 7929986 - DNA, 22 bp, Homo sapiens
agctgggagctgaaggctgatt

SEQ ID NO: 7929987 - DNA, 22 bp, Homo sapiens
agctgggagctgaaggctgatt

SEQ ID NO: 7929988 - DNA, 22 bp, Homo sapiens
agctgggagctgaaggctgatt

SEQ ID NO: 7929989 - DNA, 22 bp, Homo sapiens
agctgggagctgaaggctgatt

SEQ ID NO: 7929990 - DNA, 22 bp, Homo sapiens
agctgggagctgaaggctgatt

SEQ ID NO: 7929991 - DNA, 22 bp, Homo sapiens
agctgggagctgaaggctgatt

SEQ ID NO: 7929992 - DNA, 22 bp, Homo sapiens
agctgggaggtgggcagtgaga

SEQ ID NO: 7929993 - DNA, 22 bp, Homo sapiens
agctgggaggtgggcagtgaga

SEQ ID NO: 7929994 - DNA, 22 bp, Homo sapiens
agctgggaggtgggcagtgaga

SEQ ID NO: 7929995 - DNA, 22 bp, Homo sapiens
agctgggaggctcctctgtgac

SEQ ID NO: 7929996 - DNA, 22 bp, Homo sapiens
agctgggaggctcctctgtgac

SEQ ID NO: 7929997 - DNA, 22 bp, Homo sapiens
agctgggaggctcctctgtgac

SEQ ID NO: 7929998 - DNA, 22 bp, Homo sapiens
agctgggaggctcctctgtgac

SEQ ID NO: 7929999 - DNA, 22 bp, Homo sapiens
agctgggaggctcctctgtgac

SEQ ID NO: 7930000 - DNA, 22 bp, Homo sapiens
agctgggaggctcctctgtgac

SEQ ID NO: 7930001 - DNA, 22 bp, Homo sapiens
agctgggatgaggagcatcctt

SEQ ID NO: 7930002 - DNA, 22 bp, Homo sapiens
agctgggaggtgggcagtgaga

SEQ ID NO: 7930003 - DNA, 22 bp, Homo sapiens
agctgggaggtgggcagtgaga

SEQ ID NO: 7930004 - DNA, 22 bp, Homo sapiens
agctgggaggtgggcagtgaga

SEQ ID NO: 7930005 - DNA, 22 bp, Homo sapiens
agctgggaggtgggcagtgaga

SEQ ID NO: 7930006 - DNA, 22 bp, Homo sapiens
agctgggaggtgggcagtgaga

SEQ ID NO: 7930007 - DNA, 18 bp, Homo sapiens
aggaaagaaaggcaggtg

SEQ ID NO: 7930008 - DNA, 22 bp, Homo sapiens
aggaagagcattcacatggtag

SEQ ID NO: 7930009 - DNA, 22 bp, Homo sapiens
aggaagagcattcacatggtag

SEQ ID NO: 7930010 - DNA, 22 bp, Homo sapiens
aggaagagcattcacatggtag

SEQ ID NO: 7930011 - DNA, 22 bp, Homo sapiens
aggaagagcattcacatggtag

SEQ ID NO: 7930012 - DNA, 22 bp, Homo sapiens
aggaagagcattcacatggtag

SEQ ID NO: 7930013 - DNA, 22 bp, Homo sapiens
aggaaagaaaggaggtgcattt

SEQ ID NO: 7930014 - DNA, 18 bp, Homo sapiens
aggaaagaaaggcaggtg

SEQ ID NO: 7930015 - DNA, 18 bp, Homo sapiens
aggaaagaaaggcaggtg

SEQ ID NO: 7930016 - DNA, 18 bp, Homo sapiens
aggaaagaaaggcaggtg

SEQ ID NO: 7930017 - DNA, 18 bp, Homo sapiens
aggaaagaaaggcaggtg

SEQ ID NO: 7930018 - DNA, 18 bp, Homo sapiens
aggaaagaaaggcaggtg

SEQ ID NO: 7930019 - DNA, 22 bp, Homo sapiens
aggaagccacgagtggcacggg

SEQ ID NO: 7930020 - DNA, 22 bp, Homo sapiens
aggaagccaagcctgacactca

SEQ ID NO: 7930021 - DNA, 22 bp, Homo sapiens
aggaagccaagcctgacactca

SEQ ID NO: 7930022 - DNA, 22 bp, Homo sapiens
aggaagccaggcccttgggtgg

SEQ ID NO: 7930023 - DNA, 22 bp, Homo sapiens
aggaagccaggcccttgggtgg

SEQ ID NO: 7930024 - DNA, 18 bp, Homo sapiens
aggaagcaggaggaaggc

SEQ ID NO: 7930025 - DNA, 22 bp, Homo sapiens
aggaagcatgttggatccactt

SEQ ID NO: 7930026 - DNA, 22 bp, Homo sapiens
aggaagcatgttggatccactt

SEQ ID NO: 7930027 - DNA, 22 bp, Homo sapiens
aggaagcagtttataatgcatt

SEQ ID NO: 7930028 - DNA, 22 bp, Homo sapiens
aggaagcagtttataatgcatt

SEQ ID NO: 7930029 - DNA, 22 bp, Homo sapiens
aggaaactaattagtagaataa

SEQ ID NO: 7930030 - DNA, 22 bp, Homo sapiens
aggaaactaattagtagaataa

SEQ ID NO: 7930031 - DNA, 22 bp, Homo sapiens
aggaaactaaggctcagtgaag

SEQ ID NO: 7930032 - DNA, 22 bp, Homo sapiens
aggaaactgaagcccagagagg

SEQ ID NO: 7930033 - DNA, 22 bp, Homo sapiens
aggaaactctgagcggaccagc

SEQ ID NO: 7930034 - DNA, 22 bp, Homo sapiens
aggaaactgaggttacgggact

SEQ ID NO: 7930035 - DNA, 23 bp, Homo sapiens
aggaaactgaaggggccctctat

SEQ ID NO: 7930036 - DNA, 22 bp, Homo sapiens
aggaaactcccctacatctcaa

SEQ ID NO: 7930037 - DNA, 22 bp, Homo sapiens
aggaaactcccctacatctcaa

SEQ ID NO: 7930038 - DNA, 22 bp, Homo sapiens
aggaaactcccctacatctcaa

SEQ ID NO: 7930039 - DNA, 22 bp, Homo sapiens
aggaaactcaaagtgtcaggta

SEQ ID NO: 7930040 - DNA, 22 bp, Homo sapiens
aggaaagaaaggaggtgcattt

SEQ ID NO: 7930041 - DNA, 22 bp, Homo sapiens
aggaaagaaaggaggtgcattt

SEQ ID NO: 7930042 - DNA, 22 bp, Homo sapiens
aggaaagaaaggaggtgcattt

SEQ ID NO: 7930043 - DNA, 22 bp, Homo sapiens
aggaaactttcttttgcttcat

SEQ ID NO: 7930044 - DNA, 22 bp, Homo sapiens
aggaaactttcttttgcttcat

SEQ ID NO: 7930045 - DNA, 22 bp, Homo sapiens
aggaaacttcagagttttggtc

SEQ ID NO: 7930046 - DNA, 19 bp, Homo sapiens
aggaaactgtcttttccag

SEQ ID NO: 7930047 - DNA, 19 bp, Homo sapiens
aggaaactgtcttttccag

SEQ ID NO: 7930048 - DNA, 22 bp, Homo sapiens
aggaaactgggtatggttatac

SEQ ID NO: 7930049 - DNA, 19 bp, Homo sapiens
aggaaactgtcttttccag

SEQ ID NO: 7930050 - DNA, 22 bp, Homo sapiens
aggaaactgtcccctcatccta

SEQ ID NO: 7930051 - DNA, 22 bp, Homo sapiens
aggaaactgggcctcaggttag

SEQ ID NO: 7930052 - DNA, 22 bp, Homo sapiens
aggaaactgatgttttttacaa

SEQ ID NO: 7930053 - DNA, 22 bp, Homo sapiens
aggaaactgatgttttttacaa

SEQ ID NO: 7930054 - DNA, 22 bp, Homo sapiens
aggaaaaaagtctgtgattata

SEQ ID NO: 7930055 - DNA, 22 bp, Homo sapiens
aggaaaaaagtctgtgattata

SEQ ID NO: 7930056 - DNA, 22 bp, Homo sapiens
aggaaaaacctgttaatggtag

SEQ ID NO: 7930057 - DNA, 22 bp, Homo sapiens
aggaaaaaagtctgtgattata

SEQ ID NO: 7930058 - DNA, 22 bp, Homo sapiens
aggaaaaaagtctgtgattata

SEQ ID NO: 7930059 - DNA, 22 bp, Homo sapiens
aggaaaaaagtctgtgattata

SEQ ID NO: 7930060 - DNA, 22 bp, Homo sapiens
aggaaaaacctgttaatggtag

SEQ ID NO: 7930061 - DNA, 22 bp, Homo sapiens
aggaaaaacctgttaatggtag

SEQ ID NO: 7930062 - DNA, 22 bp, Homo sapiens
aggaaaaacctgttaatggtag

SEQ ID NO: 7930063 - DNA, 22 bp, Homo sapiens
aggaaaaagagttgctgccttc

SEQ ID NO: 7930064 - DNA, 22 bp, Homo sapiens
aggaaaaagagttgctgccttc

SEQ ID NO: 7930065 - DNA, 22 bp, Homo sapiens
aggaaaaagagttgctgccttc

SEQ ID NO: 7930066 - DNA, 22 bp, Homo sapiens
agcttttagtacgttaaaattg

SEQ ID NO: 7930067 - DNA, 22 bp, Homo sapiens
agcttttattggctgtcatttg

SEQ ID NO: 7930068 - DNA, 22 bp, Homo sapiens
aggaaaaaagtctgtgattata

SEQ ID NO: 7930069 - DNA, 19 bp, Homo sapiens
agcttttactaacagcaga

SEQ ID NO: 7930070 - DNA, 22 bp, Homo sapiens
agcttttacataatgatcttga

SEQ ID NO: 7930071 - DNA, 19 bp, Homo sapiens
agcttttactaacagcaga

SEQ ID NO: 7930072 - DNA, 22 bp, Homo sapiens
agcttttacataatgatcttga

SEQ ID NO: 7930073 - DNA, 22 bp, Homo sapiens
agctttgtttgctcacccgccg

SEQ ID NO: 7930074 - DNA, 22 bp, Homo sapiens
agcttttacataatgatcttga

SEQ ID NO: 7930075 - DNA, 22 bp, Homo sapiens
agctttggttgaggggagtgtg

SEQ ID NO: 7930076 - DNA, 20 bp, Homo sapiens
agctttggttaagccagtgg

SEQ ID NO: 7930077 - DNA, 22 bp, Homo sapiens
agctttggttgaggggagtgtg

SEQ ID NO: 7930078 - DNA, 22 bp, Homo sapiens
agctttggttgccatgatctga

SEQ ID NO: 7930079 - DNA, 22 bp, Homo sapiens
agctttggtgctgtcacacaaa

SEQ ID NO: 7930080 - DNA, 22 bp, Homo sapiens
agctttggtgctgtcacacaaa

SEQ ID NO: 7930081 - DNA, 22 bp, Homo sapiens
agctttggtgctgtcacacaaa

SEQ ID NO: 7930082 - DNA, 20 bp, Homo sapiens
agctttggttaagccagtgg

SEQ ID NO: 7930083 - DNA, 22 bp, Homo sapiens
agctttgtttcacatacacctt

SEQ ID NO: 7930084 - DNA, 22 bp, Homo sapiens
agctttgtttcacatacacctt

SEQ ID NO: 7930085 - DNA, 22 bp, Homo sapiens
agctttgtttcacatacacctt

SEQ ID NO: 7930086 - DNA, 22 bp, Homo sapiens
agctttgtttgctcacccgccg

SEQ ID NO: 7930087 - DNA, 22 bp, Homo sapiens
agctttgtcttctcacatatcc

SEQ ID NO: 7930088 - DNA, 22 bp, Homo sapiens
agctttgtcttctcacatatcc

SEQ ID NO: 7930089 - DNA, 22 bp, Homo sapiens
agctttgtatttgagcatacga

SEQ ID NO: 7930090 - DNA, 22 bp, Homo sapiens
agcttcatgcctaaagacagcg

SEQ ID NO: 7930091 - DNA, 22 bp, Homo sapiens
agctttatggtgcctcacttga

SEQ ID NO: 7930092 - DNA, 22 bp, Homo sapiens
agcttccaatttctccaagaga

SEQ ID NO: 7930093 - DNA, 22 bp, Homo sapiens
agcttcatgcctaaagacagcg

SEQ ID NO: 7930094 - DNA, 22 bp, Homo sapiens
agcttcagtgtcaggcccgtgg

SEQ ID NO: 7930095 - DNA, 17 bp, Homo sapiens
agcttcagttgcaaaac

SEQ ID NO: 7930096 - DNA, 17 bp, Homo sapiens
agcttcagttgcaaaac

SEQ ID NO: 7930097 - DNA, 22 bp, Homo sapiens
agcttcagatttatctttctgt

SEQ ID NO: 7930098 - DNA, 22 bp, Homo sapiens
agatattaccagcagtctatgc

SEQ ID NO: 7930099 - DNA, 22 bp, Homo sapiens
agatattaggaggattcataat

SEQ ID NO: 7930100 - DNA, 22 bp, Homo sapiens
agatattaggaggattcataat

SEQ ID NO: 7930101 - DNA, 22 bp, Homo sapiens
agatattaggaggattcataat

SEQ ID NO: 7930102 - DNA, 22 bp, Homo sapiens
agatattaggaggattcataat

SEQ ID NO: 7930103 - DNA, 22 bp, Homo sapiens
agatattaatcgtacataaggt

SEQ ID NO: 7930104 - DNA, 22 bp, Homo sapiens
agatattaatcgtacataaggt

SEQ ID NO: 7930105 - DNA, 22 bp, Homo sapiens
agatattaatcgtacataaggt

SEQ ID NO: 7930106 - DNA, 22 bp, Homo sapiens
agatataataatttacaagtgt

SEQ ID NO: 7930107 - DNA, 22 bp, Homo sapiens
agatataataatttacaagtgt

SEQ ID NO: 7930108 - DNA, 22 bp, Homo sapiens
agatataataatttacaagtgt

SEQ ID NO: 7930109 - DNA, 22 bp, Homo sapiens
agatatttaaatcagacaaaga

SEQ ID NO: 7930110 - DNA, 22 bp, Homo sapiens
agatatttaaatcagacaaaga

SEQ ID NO: 7930111 - DNA, 22 bp, Homo sapiens
agatatttaaatcagacaaaga

SEQ ID NO: 7930112 - DNA, 22 bp, Homo sapiens
agatatttaaatcagacaaaga

SEQ ID NO: 7930113 - DNA, 22 bp, Homo sapiens
agatatttgtatcttgctattg

SEQ ID NO: 7930114 - DNA, 22 bp, Homo sapiens
agatattgtttgtttcaccaat

SEQ ID NO: 7930115 - DNA, 22 bp, Homo sapiens
agatattgtgcatactgctgtt

SEQ ID NO: 7930116 - DNA, 22 bp, Homo sapiens
agatatttaaatcagacaaaga

SEQ ID NO: 7930117 - DNA, 22 bp, Homo sapiens
agatatttaaatcagacaaaga

SEQ ID NO: 7930118 - DNA, 22 bp, Homo sapiens
agatatttgtatcttgctattg

SEQ ID NO: 7930119 - DNA, 22 bp, Homo sapiens
agatatttgtatcttgctattg

SEQ ID NO: 7930120 - DNA, 22 bp, Homo sapiens
agatatttgtatcttgctattg

SEQ ID NO: 7930121 - DNA, 22 bp, Homo sapiens
agatattttgtgtgatgtttca

SEQ ID NO: 7930122 - DNA, 22 bp, Homo sapiens
agatattttgtgtgatgtttca

SEQ ID NO: 7930123 - DNA, 22 bp, Homo sapiens
agatcacagtggcaactccctt

SEQ ID NO: 7930124 - DNA, 22 bp, Homo sapiens
agatcacagtggcaactccctt

SEQ ID NO: 7930125 - DNA, 22 bp, Homo sapiens
agatcacagtggcaactccctt

SEQ ID NO: 7930126 - DNA, 22 bp, Homo sapiens
agatcacagtggcaactccctt

SEQ ID NO: 7930127 - DNA, 22 bp, Homo sapiens
agatcactggttacttaatgaa

SEQ ID NO: 7930128 - DNA, 23 bp, Homo sapiens
agatcacatgctgatggaaaatg

SEQ ID NO: 7930129 - DNA, 22 bp, Homo sapiens
agatattttgtgtgatgtttca

SEQ ID NO: 7930130 - DNA, 22 bp, Homo sapiens
agatcaaagccatgagagattt

SEQ ID NO: 7930131 - DNA, 22 bp, Homo sapiens
agatcacagcccccagatgcca

SEQ ID NO: 7930132 - DNA, 22 bp, Homo sapiens
agatcacagagccaagattcca

SEQ ID NO: 7930133 - DNA, 22 bp, Homo sapiens
agatcacagagccaagattcca

SEQ ID NO: 7930134 - DNA, 22 bp, Homo sapiens
agatcacagcccccagatgcca

SEQ ID NO: 7930135 - DNA, 22 bp, Homo sapiens
agatcaatgtgtcagaagagat

SEQ ID NO: 7930136 - DNA, 22 bp, Homo sapiens
attggtagttttgtatttctct

SEQ ID NO: 7930137 - DNA, 22 bp, Homo sapiens
attggtagttttgtatttctct

SEQ ID NO: 7930138 - DNA, 22 bp, Homo sapiens
attggtatataaaatgtgtact

SEQ ID NO: 7930139 - DNA, 22 bp, Homo sapiens
attggtcaagtcttgcaggtga

SEQ ID NO: 7930140 - DNA, 22 bp, Homo sapiens
attggtatgtattctgaaaact

SEQ ID NO: 7930141 - DNA, 22 bp, Homo sapiens
attggtagttttgtatttctct

SEQ ID NO: 7930142 - DNA, 22 bp, Homo sapiens
attgggatgccggctgataaga

SEQ ID NO: 7930143 - DNA, 22 bp, Homo sapiens
attgggatgccggctgataaga

SEQ ID NO: 7930144 - DNA, 22 bp, Homo sapiens
attgggatgccggctgataaga

SEQ ID NO: 7930145 - DNA, 22 bp, Homo sapiens
attgggatgccggctgataaga

SEQ ID NO: 7930146 - DNA, 22 bp, Homo sapiens
attgggatgccggctgataaga

SEQ ID NO: 7930147 - DNA, 22 bp, Homo sapiens
attgggcggtgtccagaggctc

SEQ ID NO: 7930148 - DNA, 22 bp, Homo sapiens
attgggctctactgaagggagg

SEQ ID NO: 7930149 - DNA, 22 bp, Homo sapiens
attgggctggattaggactgtt

SEQ ID NO: 7930150 - DNA, 22 bp, Homo sapiens
attgggctgcaccccagagttt

SEQ ID NO: 7930151 - DNA, 22 bp, Homo sapiens
attgggctgatgttacacaggc

SEQ ID NO: 7930152 - DNA, 22 bp, Homo sapiens
attgggctggccttctggagag

SEQ ID NO: 7930153 - DNA, 22 bp, Homo sapiens
attgggctttatgtaggggaag

SEQ ID NO: 7930154 - DNA, 22 bp, Homo sapiens
attgggctggccttctggagag

SEQ ID NO: 7930155 - DNA, 22 bp, Homo sapiens
attggtcccctcctatgtgcca

SEQ ID NO: 7930156 - DNA, 22 bp, Homo sapiens
attggtctaaagttaagaagat

SEQ ID NO: 7930157 - DNA, 22 bp, Homo sapiens
attggtcacctccctcagctct

SEQ ID NO: 7930158 - DNA, 22 bp, Homo sapiens
agatataataatttacaagtgt

SEQ ID NO: 7930159 - DNA, 22 bp, Homo sapiens
agatataataatttacaagtgt

SEQ ID NO: 7930160 - DNA, 22 bp, Homo sapiens
attggtctggggaaatgaagag

SEQ ID NO: 7930161 - DNA, 22 bp, Homo sapiens
attggtctaggctttaaaaaga

SEQ ID NO: 7930162 - DNA, 22 bp, Homo sapiens
attggtctggggaaatgaagag

SEQ ID NO: 7930163 - DNA, 22 bp, Homo sapiens
attggtctctgctaaagggagg

SEQ ID NO: 7930164 - DNA, 22 bp, Homo sapiens
attgggaagatttagatccact

SEQ ID NO: 7930165 - DNA, 22 bp, Homo sapiens
attgggaagatttagatccact

SEQ ID NO: 7930166 - DNA, 22 bp, Homo sapiens
attggctttcttttgtgaaaat

SEQ ID NO: 7930167 - DNA, 22 bp, Homo sapiens
attggcttcgaaagttatatta

SEQ ID NO: 7930168 - DNA, 22 bp, Homo sapiens
attggcttccttcttattgtca

SEQ ID NO: 7930169 - DNA, 22 bp, Homo sapiens
attggctccctgtgatctggtg

SEQ ID NO: 7930170 - DNA, 22 bp, Homo sapiens
attggctcctagtcagctgagc

SEQ ID NO: 7930171 - DNA, 22 bp, Homo sapiens
attggctccttctaacatgtct

SEQ ID NO: 7930172 - DNA, 22 bp, Homo sapiens
attggccatttgcatgtattat

SEQ ID NO: 7930173 - DNA, 22 bp, Homo sapiens
attggccatttgcatgtattat

SEQ ID NO: 7930174 - DNA, 22 bp, Homo sapiens
attggcctaaagaaatgacaga

SEQ ID NO: 7930175 - DNA, 21 bp, Homo sapiens
attggcctgtttacagagtga

SEQ ID NO: 7930176 - DNA, 22 bp, Homo sapiens
attggcctattttggaagactt

SEQ ID NO: 7930177 - DNA, 22 bp, Homo sapiens
attggcatttctcacagtcccc

SEQ ID NO: 7930178 - DNA, 22 bp, Homo sapiens
attggccagacttatccttcag

SEQ ID NO: 7930179 - DNA, 22 bp, Homo sapiens
attggcatgacagatttgaggc

SEQ ID NO: 7930180 - DNA, 20 bp, Homo sapiens
attggccaggcataaaacac

SEQ ID NO: 7930181 - DNA, 22 bp, Homo sapiens
agagtggcagcaagtcaggtag

SEQ ID NO: 7930182 - DNA, 22 bp, Homo sapiens
agagtggcagtaaaatagagca

SEQ ID NO: 7930183 - DNA, 22 bp, Homo sapiens
agagtggcccgttggcctgaac

SEQ ID NO: 7930184 - DNA, 22 bp, Homo sapiens
agagtggcccgttggcctgaac

SEQ ID NO: 7930185 - DNA, 22 bp, Homo sapiens
agagtggcagcaagtcaggtag

SEQ ID NO: 7930186 - DNA, 22 bp, Homo sapiens
attggcatactttctatattca

SEQ ID NO: 7930187 - DNA, 22 bp, Homo sapiens
attggcataggttaaacagcgg

SEQ ID NO: 7930188 - DNA, 22 bp, Homo sapiens
attggcatatccacgacaatgc

SEQ ID NO: 7930189 - DNA, 22 bp, Homo sapiens
attggcatagtaggacagatca

SEQ ID NO: 7930190 - DNA, 22 bp, Homo sapiens
agagtggcaccttacctgagac

SEQ ID NO: 7930191 - DNA, 22 bp, Homo sapiens
agagtggcaccttacctgagac

SEQ ID NO: 7930192 - DNA, 21 bp, Homo sapiens
agagtggcaaagtgtccaaga

SEQ ID NO: 7930193 - DNA, 22 bp, Homo sapiens
agagtggcagcaagtcaggtag

SEQ ID NO: 7930194 - DNA, 22 bp, Homo sapiens
agagtggagagaaacaactctg

SEQ ID NO: 7930195 - DNA, 22 bp, Homo sapiens
agagtggagagaaacaactctg

SEQ ID NO: 7930196 - DNA, 22 bp, Homo sapiens
agatcatatgcagtaatgaact

SEQ ID NO: 7930197 - DNA, 22 bp, Homo sapiens
agatcattaaccacctgttctg

SEQ ID NO: 7930198 - DNA, 22 bp, Homo sapiens
agatcatattgtaactttattg

SEQ ID NO: 7930199 - DNA, 22 bp, Homo sapiens
agatccactatggtgctgatga

SEQ ID NO: 7930200 - DNA, 23 bp, Homo sapiens
agatccaacattgtccatttttt

SEQ ID NO: 7930201 - DNA, 21 bp, Homo sapiens
agatcattcttctgagcactt

SEQ ID NO: 7930202 - DNA, 22 bp, Homo sapiens
agatccactatggtgctgatga

SEQ ID NO: 7930203 - DNA, 22 bp, Homo sapiens
agatccagatccttcctggttg

SEQ ID NO: 7930204 - DNA, 22 bp, Homo sapiens
agatccagatccttcctggttg

SEQ ID NO: 7930205 - DNA, 22 bp, Homo sapiens
agatccagatccttcctggttg

SEQ ID NO: 7930206 - DNA, 22 bp, Homo sapiens
agatccactcgaatccaggaat

SEQ ID NO: 7930207 - DNA, 22 bp, Homo sapiens
agatccagatccttcctggttg

SEQ ID NO: 7930208 - DNA, 22 bp, Homo sapiens
agatccaggatgtcccaaaata

SEQ ID NO: 7930209 - DNA, 22 bp, Homo sapiens
agatgcaatgctgaatttgagt

SEQ ID NO: 7930210 - DNA, 22 bp, Homo sapiens
agatgcaatgctgaatttgagt

SEQ ID NO: 7930211 - DNA, 22 bp, Homo sapiens
agatgattatgatagcactgtt

SEQ ID NO: 7930212 - DNA, 22 bp, Homo sapiens
agatccaggatgtcccaaaata

SEQ ID NO: 7930213 - DNA, 22 bp, Homo sapiens
agatcatatgaaaaatttcaag

SEQ ID NO: 7930214 - DNA, 22 bp, Homo sapiens
agatcatagtgcagctctggag

SEQ ID NO: 7930215 - DNA, 22 bp, Homo sapiens
agatcatagcacaaaagtgaca

SEQ ID NO: 7930216 - DNA, 22 bp, Homo sapiens
agatcatactacttgtactaaa

SEQ ID NO: 7930217 - DNA, 22 bp, Homo sapiens
agatcatactacttgtactaaa

SEQ ID NO: 7930218 - DNA, 22 bp, Homo sapiens
agatcagagtggattgtgctgc

SEQ ID NO: 7930219 - DNA, 22 bp, Homo sapiens
agatcagagtggattgtgctgc

SEQ ID NO: 7930220 - DNA, 22 bp, Homo sapiens
agatcagaaatgtaatggcagt

SEQ ID NO: 7930221 - DNA, 22 bp, Homo sapiens
agatcagagatgctaaaagagc

SEQ ID NO: 7930222 - DNA, 22 bp, Homo sapiens
agatcagaaatgtaatggcagt

SEQ ID NO: 7930223 - DNA, 22 bp, Homo sapiens
agatcactttgatgctacctgg

SEQ ID NO: 7930224 - DNA, 22 bp, Homo sapiens
agatggaaaatatagacagaga

SEQ ID NO: 7930225 - DNA, 22 bp, Homo sapiens
agatgctttttaggtattacct

SEQ ID NO: 7930226 - DNA, 22 bp, Homo sapiens
agatgctttcctgatatttatg

SEQ ID NO: 7930227 - DNA, 22 bp, Homo sapiens
agatggaaaatatagacagaga

SEQ ID NO: 7930228 - DNA, 22 bp, Homo sapiens
agatggaaaatatagacagaga

SEQ ID NO: 7930229 - DNA, 22 bp, Homo sapiens
agatggaaaatatagacagaga

SEQ ID NO: 7930230 - DNA, 22 bp, Homo sapiens
agatggaaaatatagacagaga

SEQ ID NO: 7930231 - DNA, 22 bp, Homo sapiens
agatggagaccttggatgaact

SEQ ID NO: 7930232 - DNA, 22 bp, Homo sapiens
agatgctgtgtctgttcccttg

SEQ ID NO: 7930233 - DNA, 21 bp, Homo sapiens
agatgctgtgctccaggagca

SEQ ID NO: 7930234 - DNA, 22 bp, Homo sapiens
agatgctgtgtctgttcccttg

SEQ ID NO: 7930235 - DNA, 21 bp, Homo sapiens
agatgctgtgctccaggagca

SEQ ID NO: 7930236 - DNA, 21 bp, Homo sapiens
agatgctgtgctccaggagca

SEQ ID NO: 7930237 - DNA, 22 bp, Homo sapiens
agatgcttactatggttgtatg

SEQ ID NO: 7930238 - DNA, 22 bp, Homo sapiens
agatgcttcagtgtttaattta

SEQ ID NO: 7930239 - DNA, 22 bp, Homo sapiens
agatgctggggcccctcggatg

SEQ ID NO: 7930240 - DNA, 22 bp, Homo sapiens
agatgctggggcccctcggatg

SEQ ID NO: 7930241 - DNA, 22 bp, Homo sapiens
agatgctgggatgcttggatgg

SEQ ID NO: 7930242 - DNA, 22 bp, Homo sapiens
agatgctgggaggctgagtgca

SEQ ID NO: 7930243 - DNA, 17 bp, Homo sapiens
agatgctggccacatgt

SEQ ID NO: 7930244 - DNA, 22 bp, Homo sapiens
agatgcagaaaaactaagtgat

SEQ ID NO: 7930245 - DNA, 22 bp, Homo sapiens
agatgctggatggaaaatgatc

SEQ ID NO: 7930246 - DNA, 22 bp, Homo sapiens
agatgctggatggaaaatgatc

SEQ ID NO: 7930247 - DNA, 22 bp, Homo sapiens
agatgctgtcacacacactgtt

SEQ ID NO: 7930248 - DNA, 22 bp, Homo sapiens
agatgctgtcacacacactgtt

SEQ ID NO: 7930249 - DNA, 22 bp, Homo sapiens
agatgctgtcacacacactgtt

SEQ ID NO: 7930250 - DNA, 22 bp, Homo sapiens
agatgctgggatgcttggatgg

SEQ ID NO: 7930251 - DNA, 22 bp, Homo sapiens
agatgctgtcacacacactgtt

SEQ ID NO: 7930252 - DNA, 22 bp, Homo sapiens
agatgctggggcccctcggatg

SEQ ID NO: 7930253 - DNA, 22 bp, Homo sapiens
agatgctgtgaggaagctagga

SEQ ID NO: 7930254 - DNA, 22 bp, Homo sapiens
agatgctgtcttgctggctttg

SEQ ID NO: 7930255 - DNA, 22 bp, Homo sapiens
agatggcaggccctgtgggggt

SEQ ID NO: 7930256 - DNA, 22 bp, Homo sapiens
agatggcaggccctgtgggggt

SEQ ID NO: 7930257 - DNA, 22 bp, Homo sapiens
agatggcaggccctgtgggggt

SEQ ID NO: 7930258 - DNA, 22 bp, Homo sapiens
agatggcaggggtacctggaag

SEQ ID NO: 7930259 - DNA, 22 bp, Homo sapiens
agatggcaggggtacctggaag

SEQ ID NO: 7930260 - DNA, 22 bp, Homo sapiens
agatggcaggggtacctggaag

SEQ ID NO: 7930261 - DNA, 22 bp, Homo sapiens
agatggctatagatagcctttc

SEQ ID NO: 7930262 - DNA, 22 bp, Homo sapiens
agatggctatagatagcctttc

SEQ ID NO: 7930263 - DNA, 22 bp, Homo sapiens
agatggctgattaactccatgg

SEQ ID NO: 7930264 - DNA, 22 bp, Homo sapiens
agatggctgatggcaggagcca

SEQ ID NO: 7930265 - DNA, 21 bp, Homo sapiens
agatggctcccaggtctctgg

SEQ ID NO: 7930266 - DNA, 22 bp, Homo sapiens
agatggctctcaagtctgatta

SEQ ID NO: 7930267 - DNA, 22 bp, Homo sapiens
agatgggccttcgagcatgccc

SEQ ID NO: 7930268 - DNA, 22 bp, Homo sapiens
agatgggccttcgagcatgccc

SEQ ID NO: 7930269 - DNA, 22 bp, Homo sapiens
agatggctttgcttttagaagc

SEQ ID NO: 7930270 - DNA, 22 bp, Homo sapiens
agatgggccttcgagcatgccc

SEQ ID NO: 7930271 - DNA, 22 bp, Homo sapiens
agatgggccttcgagcatgccc

SEQ ID NO: 7930272 - DNA, 22 bp, Homo sapiens
agatgggccttcgagcatgccc

SEQ ID NO: 7930273 - DNA, 22 bp, Homo sapiens
attttaaccctcttatatatac

SEQ ID NO: 7930274 - DNA, 22 bp, Homo sapiens
agatggctttgcttttagaagc

SEQ ID NO: 7930275 - DNA, 22 bp, Homo sapiens
agatggctttgcttttagaagc

SEQ ID NO: 7930276 - DNA, 19 bp, Homo sapiens
agatggcttggactgaaaa

SEQ ID NO: 7930277 - DNA, 22 bp, Homo sapiens
agatggctgggagctctgtttg

SEQ ID NO: 7930278 - DNA, 22 bp, Homo sapiens
agatggctgggagctctgtttg

SEQ ID NO: 7930279 - DNA, 22 bp, Homo sapiens
agatggctggaggtagatgctc

SEQ ID NO: 7930280 - DNA, 22 bp, Homo sapiens
agatggctggaggtagatgctc

SEQ ID NO: 7930281 - DNA, 22 bp, Homo sapiens
agatggctgggagctctgtttg

SEQ ID NO: 7930282 - DNA, 20 bp, Homo sapiens
agatggctgtcatttctgtc

SEQ ID NO: 7930283 - DNA, 22 bp, Homo sapiens
agatggcttagcctggctccca

SEQ ID NO: 7930284 - DNA, 22 bp, Homo sapiens
agatggcttccttctcactgtg

SEQ ID NO: 7930285 - DNA, 17 bp, Homo sapiens
agatggcaggaggcaga

SEQ ID NO: 7930286 - DNA, 17 bp, Homo sapiens
agatggcaggaggcaga

SEQ ID NO: 7930287 - DNA, 17 bp, Homo sapiens
agatggcaggaggcaga

SEQ ID NO: 7930288 - DNA, 17 bp, Homo sapiens
agatggcaggaggcaga

SEQ ID NO: 7930289 - DNA, 17 bp, Homo sapiens
agatggcaggaggcaga

SEQ ID NO: 7930290 - DNA, 17 bp, Homo sapiens
agatggcaggaggcaga

SEQ ID NO: 7930291 - DNA, 22 bp, Homo sapiens
agatggcagcagaacaaacagg

SEQ ID NO: 7930292 - DNA, 22 bp, Homo sapiens
agatggcagcagaacaaacagg

SEQ ID NO: 7930293 - DNA, 19 bp, Homo sapiens
agatggcaaaatgcaaaga

SEQ ID NO: 7930294 - DNA, 22 bp, Homo sapiens
agatggagttgtagcagtgact

SEQ ID NO: 7930295 - DNA, 19 bp, Homo sapiens
agatggcaaaatgcaaaga

SEQ ID NO: 7930296 - DNA, 22 bp, Homo sapiens
agatggcagcagaacaaacagg

SEQ ID NO: 7930297 - DNA, 22 bp, Homo sapiens
agatggagttgtagcagtgact

SEQ ID NO: 7930298 - DNA, 22 bp, Homo sapiens
agatggagttgtagcagtgact

SEQ ID NO: 7930299 - DNA, 22 bp, Homo sapiens
agatggagtggagatgagtaaa

SEQ ID NO: 7930300 - DNA, 22 bp, Homo sapiens
agatggagtggagatgagtaaa

SEQ ID NO: 7930301 - DNA, 22 bp, Homo sapiens
agatggagttagtaccagagtc

SEQ ID NO: 7930302 - DNA, 22 bp, Homo sapiens
agatggagttagtaccagagtc

SEQ ID NO: 7930303 - DNA, 22 bp, Homo sapiens
agatggagttagtaccagagtc

SEQ ID NO: 7930304 - DNA, 22 bp, Homo sapiens
agatggagttagtaccagagtc

SEQ ID NO: 7930305 - DNA, 22 bp, Homo sapiens
agatggagtggagatgagtaaa

SEQ ID NO: 7930306 - DNA, 22 bp, Homo sapiens
agatggagaccttggatgaact

SEQ ID NO: 7930307 - DNA, 22 bp, Homo sapiens
agatggagaccttggatgaact

SEQ ID NO: 7930308 - DNA, 22 bp, Homo sapiens
agatggagaccttggatgaact

SEQ ID NO: 7930309 - DNA, 22 bp, Homo sapiens
agatggagaccttggatgaact

SEQ ID NO: 7930310 - DNA, 22 bp, Homo sapiens
agatggaggaaggctgaactca

SEQ ID NO: 7930311 - DNA, 22 bp, Homo sapiens
agatggagtctcactcttgttg

SEQ ID NO: 7930312 - DNA, 22 bp, Homo sapiens
agcaaagctcatgacattacag

SEQ ID NO: 7930313 - DNA, 22 bp, Homo sapiens
agcaaagctatctctatggaga

SEQ ID NO: 7930314 - DNA, 22 bp, Homo sapiens
agatgtttataactcatgagtg

SEQ ID NO: 7930315 - DNA, 22 bp, Homo sapiens
agcaaagctatctctatggaga

SEQ ID NO: 7930316 - DNA, 22 bp, Homo sapiens
agcaaagctatctctatggaga

SEQ ID NO: 7930317 - DNA, 22 bp, Homo sapiens
agcaaagctcatgacattacag

SEQ ID NO: 7930318 - DNA, 22 bp, Homo sapiens
agatgtgtttctagttcctgca

SEQ ID NO: 7930319 - DNA, 22 bp, Homo sapiens
agatgttatcattcagagtagc

SEQ ID NO: 7930320 - DNA, 22 bp, Homo sapiens
agatgttatcattcagagtagc

SEQ ID NO: 7930321 - DNA, 22 bp, Homo sapiens
agatgttatcattcagagtagc

SEQ ID NO: 7930322 - DNA, 22 bp, Homo sapiens
agatgtgtttctagttcctgca

SEQ ID NO: 7930323 - DNA, 22 bp, Homo sapiens
agatgtgtttctagttcctgca

SEQ ID NO: 7930324 - DNA, 22 bp, Homo sapiens
agatgtgtttctagttcctgca

SEQ ID NO: 7930325 - DNA, 22 bp, Homo sapiens
agatgtggtagttgaagggaag

SEQ ID NO: 7930326 - DNA, 22 bp, Homo sapiens
agatgtgggcaaaaggcttagc

SEQ ID NO: 7930327 - DNA, 22 bp, Homo sapiens
agatgtgggagatgcttctgca

SEQ ID NO: 7930328 - DNA, 22 bp, Homo sapiens
agatgtgggagatgcttctgca

SEQ ID NO: 7930329 - DNA, 22 bp, Homo sapiens
agatgtgggcaatggaatggag

SEQ ID NO: 7930330 - DNA, 22 bp, Homo sapiens
agatgtgggcaatggaatggag

SEQ ID NO: 7930331 - DNA, 22 bp, Homo sapiens
agatgtgggcaatggaatggag

SEQ ID NO: 7930332 - DNA, 22 bp, Homo sapiens
agatgtgggtgtcaggcagtga

SEQ ID NO: 7930333 - DNA, 22 bp, Homo sapiens
agatgtgggtgtcaggcagtga

SEQ ID NO: 7930334 - DNA, 22 bp, Homo sapiens
agatgtgggtgtcaggcagtga

SEQ ID NO: 7930335 - DNA, 22 bp, Homo sapiens
agcaaatgggtttatatttgac

SEQ ID NO: 7930336 - DNA, 22 bp, Homo sapiens
agcaaattaggtcaaggagatg

SEQ ID NO: 7930337 - DNA, 22 bp, Homo sapiens
agcaaattaggtcaaggagatg

SEQ ID NO: 7930338 - DNA, 22 bp, Homo sapiens
agcaaattcagaagcagaatgg

SEQ ID NO: 7930339 - DNA, 22 bp, Homo sapiens
agcaaatctatgaatgtatatt

SEQ ID NO: 7930340 - DNA, 22 bp, Homo sapiens
agcaaatcagctgctcaggaaa

SEQ ID NO: 7930341 - DNA, 22 bp, Homo sapiens
agcaaatctatgaatgtatatt

SEQ ID NO: 7930342 - DNA, 22 bp, Homo sapiens
agcaaatggatttctgaaccta

SEQ ID NO: 7930343 - DNA, 22 bp, Homo sapiens
agcaaatgggtttatatttgac

SEQ ID NO: 7930344 - DNA, 22 bp, Homo sapiens
agcaaattcagaagcagaatgg

SEQ ID NO: 7930345 - DNA, 19 bp, Homo sapiens
agcaacaccgtttatttcc

SEQ ID NO: 7930346 - DNA, 19 bp, Homo sapiens
agcaacaccgtttatttcc

SEQ ID NO: 7930347 - DNA, 18 bp, Homo sapiens
agcaacagaaacatatgg

SEQ ID NO: 7930348 - DNA, 22 bp, Homo sapiens
agcaacagccctgtttcattag

SEQ ID NO: 7930349 - DNA, 22 bp, Homo sapiens
agcaacaggaaatagctgatta

SEQ ID NO: 7930350 - DNA, 22 bp, Homo sapiens
agcaacagcaacgacatttctc

SEQ ID NO: 7930351 - DNA, 22 bp, Homo sapiens
agcaacagaagatagagtgaat

SEQ ID NO: 7930352 - DNA, 22 bp, Homo sapiens
agcaacagaagatagagtgaat

SEQ ID NO: 7930353 - DNA, 22 bp, Homo sapiens
agcaacagaagatagagtgaat

SEQ ID NO: 7930354 - DNA, 22 bp, Homo sapiens
agcaacagcaacgacatttctc

SEQ ID NO: 7930355 - DNA, 22 bp, Homo sapiens
agcaacagcaggtttgcactcc

SEQ ID NO: 7930356 - DNA, 22 bp, Homo sapiens
agcaacagccctgaggttcatg

SEQ ID NO: 7930357 - DNA, 22 bp, Homo sapiens
agcaacagcaacgacatttctc

SEQ ID NO: 7930358 - DNA, 22 bp, Homo sapiens
attttcaaaacatctgctgtgt

SEQ ID NO: 7930359 - DNA, 22 bp, Homo sapiens
attttcaaaacatctgctgtgt

SEQ ID NO: 7930360 - DNA, 22 bp, Homo sapiens
attttatgacacgattcttcca

SEQ ID NO: 7930361 - DNA, 22 bp, Homo sapiens
attttatgacacgattcttcca

SEQ ID NO: 7930362 - DNA, 22 bp, Homo sapiens
attttagttttagcatccatgc

SEQ ID NO: 7930363 - DNA, 22 bp, Homo sapiens
attttatccccactggattaca

SEQ ID NO: 7930364 - DNA, 22 bp, Homo sapiens
attttatccccactggattaca

SEQ ID NO: 7930365 - DNA, 22 bp, Homo sapiens
attttatccccactggattaca

SEQ ID NO: 7930366 - DNA, 22 bp, Homo sapiens
attttatccccactggattaca

SEQ ID NO: 7930367 - DNA, 22 bp, Homo sapiens
attttaaccctcttatatatac

SEQ ID NO: 7930368 - DNA, 22 bp, Homo sapiens
agatgggcgccctggactgagg

SEQ ID NO: 7930369 - DNA, 22 bp, Homo sapiens
attttagatttaagaataaggt

SEQ ID NO: 7930370 - DNA, 22 bp, Homo sapiens
attttagatttaagaataaggt

SEQ ID NO: 7930371 - DNA, 22 bp, Homo sapiens
attttagcaaatgcaagatgga

SEQ ID NO: 7930372 - DNA, 22 bp, Homo sapiens
attttagcaaatgcaagatgga

SEQ ID NO: 7930373 - DNA, 22 bp, Homo sapiens
attttaaccctcttatatatac

SEQ ID NO: 7930374 - DNA, 22 bp, Homo sapiens
attttagtacctcaagtatcca

SEQ ID NO: 7930375 - DNA, 22 bp, Homo sapiens
attttagtacctcaagtatcca

SEQ ID NO: 7930376 - DNA, 22 bp, Homo sapiens
attttagctgtccagtggattg

SEQ ID NO: 7930377 - DNA, 22 bp, Homo sapiens
attttagtacctcaagtatcca

SEQ ID NO: 7930378 - DNA, 22 bp, Homo sapiens
attttagctgtccagtggattg

SEQ ID NO: 7930379 - DNA, 23 bp, Homo sapiens
attttagctgaatgacttcttta

SEQ ID NO: 7930380 - DNA, 22 bp, Homo sapiens
attttagcaaatgcaagatgga

SEQ ID NO: 7930381 - DNA, 22 bp, Homo sapiens
attttcaagggagaggcctctg

SEQ ID NO: 7930382 - DNA, 22 bp, Homo sapiens
attttcaccctgaatatattga

SEQ ID NO: 7930383 - DNA, 22 bp, Homo sapiens
attttcaccctgaatatattga

SEQ ID NO: 7930384 - DNA, 22 bp, Homo sapiens
attttcaccctgaatatattga

SEQ ID NO: 7930385 - DNA, 22 bp, Homo sapiens
attttcagagacatctggactt

SEQ ID NO: 7930386 - DNA, 22 bp, Homo sapiens
attttcagcccccactcgtggc

SEQ ID NO: 7930387 - DNA, 22 bp, Homo sapiens
attttcagagacatctggactt

SEQ ID NO: 7930388 - DNA, 22 bp, Homo sapiens
attttcagaacattcattcact

SEQ ID NO: 7930389 - DNA, 22 bp, Homo sapiens
attttcagaacattcattcact

SEQ ID NO: 7930390 - DNA, 22 bp, Homo sapiens
agatgtggccggctagggagag

SEQ ID NO: 7930391 - DNA, 22 bp, Homo sapiens
agatgtggccggctagggagag

SEQ ID NO: 7930392 - DNA, 22 bp, Homo sapiens
agatgtggatcctagggtagaa

SEQ ID NO: 7930393 - DNA, 22 bp, Homo sapiens
attttcagagacatctggactt

SEQ ID NO: 7930394 - DNA, 22 bp, Homo sapiens
agatgtggcctttgggagatta

SEQ ID NO: 7930395 - DNA, 22 bp, Homo sapiens
agatgtggctgcacccaccgct

SEQ ID NO: 7930396 - DNA, 22 bp, Homo sapiens
agatgtggcctttgggagatta

SEQ ID NO: 7930397 - DNA, 22 bp, Homo sapiens
agcaacaggcataatgtgttga

SEQ ID NO: 7930398 - DNA, 22 bp, Homo sapiens
agcaacaggcataatgtgttga

SEQ ID NO: 7930399 - DNA, 22 bp, Homo sapiens
agcaacaggcataatgtgttga

SEQ ID NO: 7930400 - DNA, 22 bp, Homo sapiens
agcaacagggggatggccactg

SEQ ID NO: 7930401 - DNA, 18 bp, Homo sapiens
agcaacaggatcccaggg

SEQ ID NO: 7930402 - DNA, 22 bp, Homo sapiens
agcaacaggaccatggagccca

SEQ ID NO: 7930403 - DNA, 22 bp, Homo sapiens
agcaacagggtggtcttcagaa

SEQ ID NO: 7930404 - DNA, 22 bp, Homo sapiens
agcaacagggtggtcttcagaa

SEQ ID NO: 7930405 - DNA, 22 bp, Homo sapiens
agcaacagggtggtcttcagaa

SEQ ID NO: 7930406 - DNA, 23 bp, Homo sapiens
agcaacagtgggtgagtgttgct

SEQ ID NO: 7930407 - DNA, 22 bp, Homo sapiens
agcaacagtgtatatcataggc

SEQ ID NO: 7930408 - DNA, 22 bp, Homo sapiens
agcaacagtgtatatcataggc

SEQ ID NO: 7930409 - DNA, 22 bp, Homo sapiens
agcaactatattgaaagccacc

SEQ ID NO: 7930410 - DNA, 21 bp, Homo sapiens
agcaactctgactagatgagg

SEQ ID NO: 7930411 - DNA, 19 bp, Homo sapiens
agcaacctgtcagagatgc

SEQ ID NO: 7930412 - DNA, 22 bp, Homo sapiens
agcaacatttttcaattaacat

SEQ ID NO: 7930413 - DNA, 22 bp, Homo sapiens
agcaacatttttcaattaacat

SEQ ID NO: 7930414 - DNA, 22 bp, Homo sapiens
agcaacatttttcaattaacat

SEQ ID NO: 7930415 - DNA, 22 bp, Homo sapiens
agcaacccgtccttgggggact

SEQ ID NO: 7930416 - DNA, 22 bp, Homo sapiens
agcaacattgagactgcagttg

SEQ ID NO: 7930417 - DNA, 22 bp, Homo sapiens
agcaacattgagactgcagttg

SEQ ID NO: 7930418 - DNA, 22 bp, Homo sapiens
agcaacattgagactgcagttg

SEQ ID NO: 7930419 - DNA, 20 bp, Homo sapiens
agcaagaaggttgtgggagc

SEQ ID NO: 7930420 - DNA, 20 bp, Homo sapiens
agcaagagtaaggacagcga

SEQ ID NO: 7930421 - DNA, 20 bp, Homo sapiens
agcaagagtaaggacagcga

SEQ ID NO: 7930422 - DNA, 20 bp, Homo sapiens
agcaagagtaaggacagcga

SEQ ID NO: 7930423 - DNA, 20 bp, Homo sapiens
agcaagagtaaggacagcga

SEQ ID NO: 7930424 - DNA, 22 bp, Homo sapiens
agcaagagatttccctacctcc

SEQ ID NO: 7930425 - DNA, 22 bp, Homo sapiens
agcaagagcatgtcggcctggt

SEQ ID NO: 7930426 - DNA, 22 bp, Homo sapiens
agcaagagcatgtcggcctggt

SEQ ID NO: 7930427 - DNA, 22 bp, Homo sapiens
agcaagagatttccctacctcc

SEQ ID NO: 7930428 - DNA, 22 bp, Homo sapiens
agcaagagatttccctacctcc

SEQ ID NO: 7930429 - DNA, 22 bp, Homo sapiens
agcaagaagggcaaggaagttt

SEQ ID NO: 7930430 - DNA, 22 bp, Homo sapiens
agcaagaagggcaaggaagttt

SEQ ID NO: 7930431 - DNA, 22 bp, Homo sapiens
agcaagaagctttgctgtgata

SEQ ID NO: 7930432 - DNA, 20 bp, Homo sapiens
agcaagaacgttctgaggga

SEQ ID NO: 7930433 - DNA, 20 bp, Homo sapiens
agcaagaacgttctgaggga

SEQ ID NO: 7930434 - DNA, 20 bp, Homo sapiens
agcaagaacgttctgaggga

SEQ ID NO: 7930435 - DNA, 22 bp, Homo sapiens
agcaagaaatcttcagtgttct

SEQ ID NO: 7930436 - DNA, 22 bp, Homo sapiens
agcaagaaatcttcagtgttct

SEQ ID NO: 7930437 - DNA, 22 bp, Homo sapiens
agcaagaaatcttcagtgttct

SEQ ID NO: 7930438 - DNA, 22 bp, Homo sapiens
agcaagaaatcttcagtgttct

SEQ ID NO: 7930439 - DNA, 22 bp, Homo sapiens
agcaagaaatcttcagtgttct

SEQ ID NO: 7930440 - DNA, 22 bp, Homo sapiens
agcaacttttctagacatggtc

SEQ ID NO: 7930441 - DNA, 22 bp, Homo sapiens
agcaacttctacagatatagca

SEQ ID NO: 7930442 - DNA, 22 bp, Homo sapiens
agcaactgttacaagaacaaca

SEQ ID NO: 7930443 - DNA, 22 bp, Homo sapiens
caaagcaaggctcagtttgaac

SEQ ID NO: 7930444 - DNA, 22 bp, Homo sapiens
caaagcaaggctcagtttgaac

SEQ ID NO: 7930445 - DNA, 22 bp, Homo sapiens
caaagcaaggctcagtttgaac

SEQ ID NO: 7930446 - DNA, 22 bp, Homo sapiens
caaagattttagaatttgcaat

SEQ ID NO: 7930447 - DNA, 22 bp, Homo sapiens
caaagcaaggctcagtttgaac

SEQ ID NO: 7930448 - DNA, 22 bp, Homo sapiens
caaagcaaggctcagtttgaac

SEQ ID NO: 7930449 - DNA, 22 bp, Homo sapiens
caaagcaaggctcagtttgaac

SEQ ID NO: 7930450 - DNA, 22 bp, Homo sapiens
caaagcaagggctgaagactcc

SEQ ID NO: 7930451 - DNA, 22 bp, Homo sapiens
caaagcaagggctgaagactcc

SEQ ID NO: 7930452 - DNA, 22 bp, Homo sapiens
caaagcaagggctgaagactcc

SEQ ID NO: 7930453 - DNA, 22 bp, Homo sapiens
caaagcaagggctgaagactcc

SEQ ID NO: 7930454 - DNA, 22 bp, Homo sapiens
caaagcaagggctgaagactcc

SEQ ID NO: 7930455 - DNA, 22 bp, Homo sapiens
caaagcaagggctgaagactcc

SEQ ID NO: 7930456 - DNA, 22 bp, Homo sapiens
caaagcaagggctgaagactcc

SEQ ID NO: 7930457 - DNA, 22 bp, Homo sapiens
caaagcaagggctgaagactcc

SEQ ID NO: 7930458 - DNA, 22 bp, Homo sapiens
caaagcaagggctgaagactcc

SEQ ID NO: 7930459 - DNA, 22 bp, Homo sapiens
caaagcaccacaaaccaggtga

SEQ ID NO: 7930460 - DNA, 22 bp, Homo sapiens
caaagcaccacaaaccaggtga

SEQ ID NO: 7930461 - DNA, 22 bp, Homo sapiens
caaagcagaaggttctgtggta

SEQ ID NO: 7930462 - DNA, 22 bp, Homo sapiens
caaagcagacctttacccttta

SEQ ID NO: 7930463 - DNA, 22 bp, Homo sapiens
caaagcagaaggttctgtggta

SEQ ID NO: 7930464 - DNA, 22 bp, Homo sapiens
caaagcagacctttacccttta

SEQ ID NO: 7930465 - DNA, 22 bp, Homo sapiens
caaaggcaggtgctgaatattc

SEQ ID NO: 7930466 - DNA, 22 bp, Homo sapiens
caaaggcaggtgctgaatattc

SEQ ID NO: 7930467 - DNA, 22 bp, Homo sapiens
caaaggcaggtgctgaatattc

SEQ ID NO: 7930468 - DNA, 22 bp, Homo sapiens
caaaggcaggtcatggccactt

SEQ ID NO: 7930469 - DNA, 22 bp, Homo sapiens
caaaggcaggtcatggccactt

SEQ ID NO: 7930470 - DNA, 22 bp, Homo sapiens
caaaggcaggccccctgtgcag

SEQ ID NO: 7930471 - DNA, 22 bp, Homo sapiens
caaacattttgagtggtttctg

SEQ ID NO: 7930472 - DNA, 20 bp, Homo sapiens
agcaagagtgtacctggcca

SEQ ID NO: 7930473 - DNA, 20 bp, Homo sapiens
agcaagagtaaggacagcga

SEQ ID NO: 7930474 - DNA, 20 bp, Homo sapiens
agcaagagtaaggacagcga

SEQ ID NO: 7930475 - DNA, 22 bp, Homo sapiens
caaaccagtaggaagtctatta

SEQ ID NO: 7930476 - DNA, 17 bp, Homo sapiens
caaaccagtaagactgc

SEQ ID NO: 7930477 - DNA, 20 bp, Homo sapiens
agcaagagtaaggacagcga

SEQ ID NO: 7930478 - DNA, 20 bp, Homo sapiens
agcaagagtgtacctggcca

SEQ ID NO: 7930479 - DNA, 22 bp, Homo sapiens
caaagataatcacagaataccc

SEQ ID NO: 7930480 - DNA, 22 bp, Homo sapiens
caaagataatcacagaataccc

SEQ ID NO: 7930481 - DNA, 22 bp, Homo sapiens
caaagataatcacagaataccc

SEQ ID NO: 7930482 - DNA, 22 bp, Homo sapiens
caaagataatcacagaataccc

SEQ ID NO: 7930483 - DNA, 22 bp, Homo sapiens
caaagataatcacagaataccc

SEQ ID NO: 7930484 - DNA, 22 bp, Homo sapiens
caaaccagtaggaagtctatta

SEQ ID NO: 7930485 - DNA, 17 bp, Homo sapiens
caaaccagtaagactgc

SEQ ID NO: 7930486 - DNA, 22 bp, Homo sapiens
caaagatatgacatggaaaatg

SEQ ID NO: 7930487 - DNA, 22 bp, Homo sapiens
caaagatatgacatggaaaatg

SEQ ID NO: 7930488 - DNA, 22 bp, Homo sapiens
caaagatatgacatggaaaatg

SEQ ID NO: 7930489 - DNA, 23 bp, Homo sapiens
caaagatgattggaacatggctt

SEQ ID NO: 7930490 - DNA, 22 bp, Homo sapiens
caaagatatgacatggaaaatg

SEQ ID NO: 7930491 - DNA, 22 bp, Homo sapiens
caaagattttagaatttgcaat

SEQ ID NO: 7930492 - DNA, 22 bp, Homo sapiens
caaagatgtcattggtaagaca

SEQ ID NO: 7930493 - DNA, 22 bp, Homo sapiens
caaagatgctgatgttggatca

SEQ ID NO: 7930494 - DNA, 22 bp, Homo sapiens
caaagatgtcattggtaagaca

SEQ ID NO: 7930495 - DNA, 22 bp, Homo sapiens
caaagatgtcattggtaagaca

SEQ ID NO: 7930496 - DNA, 22 bp, Homo sapiens
caaagatgtcattggtaagaca

SEQ ID NO: 7930497 - DNA, 22 bp, Homo sapiens
caaagatgccaaaaggaagaca

SEQ ID NO: 7930498 - DNA, 22 bp, Homo sapiens
caaagatgctgatgttggatca

SEQ ID NO: 7930499 - DNA, 22 bp, Homo sapiens
caaagatgctgatgttggatca

SEQ ID NO: 7930500 - DNA, 22 bp, Homo sapiens
attacagaaagcaatattgagt

SEQ ID NO: 7930501 - DNA, 22 bp, Homo sapiens
attacagaaagcaatattgagt

SEQ ID NO: 7930502 - DNA, 22 bp, Homo sapiens
attacagaaagcaatattgagt

SEQ ID NO: 7930503 - DNA, 22 bp, Homo sapiens
attacagaagatatgctcaaca

SEQ ID NO: 7930504 - DNA, 22 bp, Homo sapiens
attacagaagatatgctcaaca

SEQ ID NO: 7930505 - DNA, 22 bp, Homo sapiens
attacagaagatatgctcaaca

SEQ ID NO: 7930506 - DNA, 22 bp, Homo sapiens
attacagaaatatggtcaaaga

SEQ ID NO: 7930507 - DNA, 22 bp, Homo sapiens
attacagatagactttgaagct

SEQ ID NO: 7930508 - DNA, 22 bp, Homo sapiens
attacagatagactttgaagct

SEQ ID NO: 7930509 - DNA, 22 bp, Homo sapiens
attacagatagactttgaagct

SEQ ID NO: 7930510 - DNA, 22 bp, Homo sapiens
attacagattataaatttgagc

SEQ ID NO: 7930511 - DNA, 22 bp, Homo sapiens
attacagatagactttgaagct

SEQ ID NO: 7930512 - DNA, 22 bp, Homo sapiens
attacagtaacagctacaatgc

SEQ ID NO: 7930513 - DNA, 22 bp, Homo sapiens
attacagtaacagctacaatgc

SEQ ID NO: 7930514 - DNA, 22 bp, Homo sapiens
attacagtaacagctacaatgc

SEQ ID NO: 7930515 - DNA, 22 bp, Homo sapiens
attacagtaacagctacaatgc

SEQ ID NO: 7930516 - DNA, 21 bp, Homo sapiens
attacagcagtggccaaatgc

SEQ ID NO: 7930517 - DNA, 23 bp, Homo sapiens
agaggcaggagtggcttgcccgg

SEQ ID NO: 7930518 - DNA, 22 bp, Homo sapiens
attacagtaacagctacaatgc

SEQ ID NO: 7930519 - DNA, 22 bp, Homo sapiens
attacacagcggttactactag

SEQ ID NO: 7930520 - DNA, 22 bp, Homo sapiens
attacacagcggttactactag

SEQ ID NO: 7930521 - DNA, 22 bp, Homo sapiens
attacacagcggttactactag

SEQ ID NO: 7930522 - DNA, 22 bp, Homo sapiens
attacactaatgtgacaacaat

SEQ ID NO: 7930523 - DNA, 22 bp, Homo sapiens
attacactagctattcttatgg

SEQ ID NO: 7930524 - DNA, 22 bp, Homo sapiens
attacacaggctggctctttga

SEQ ID NO: 7930525 - DNA, 22 bp, Homo sapiens
agaggcacggaggctgcatgga

SEQ ID NO: 7930526 - DNA, 22 bp, Homo sapiens
agaggcacggaggctgcatgga

SEQ ID NO: 7930527 - DNA, 22 bp, Homo sapiens
agaggcacggaggctgcatgga

SEQ ID NO: 7930528 - DNA, 22 bp, Homo sapiens
agaggcactaagggaagagcag

SEQ ID NO: 7930529 - DNA, 22 bp, Homo sapiens
agaggcactaagggaagagcag

SEQ ID NO: 7930530 - DNA, 22 bp, Homo sapiens
agaggcactaagggaagagcag

SEQ ID NO: 7930531 - DNA, 22 bp, Homo sapiens
agaggcacggaggctgcatgga

SEQ ID NO: 7930532 - DNA, 23 bp, Homo sapiens
agaggcactaattattcagagat

SEQ ID NO: 7930533 - DNA, 23 bp, Homo sapiens
agaggcactaattattcagagat

SEQ ID NO: 7930534 - DNA, 22 bp, Homo sapiens
attacaatcgagagaaacaaat

SEQ ID NO: 7930535 - DNA, 22 bp, Homo sapiens
agaggcactaagggaagagcag

SEQ ID NO: 7930536 - DNA, 22 bp, Homo sapiens
agaggcactaagggaagagcag

SEQ ID NO: 7930537 - DNA, 22 bp, Homo sapiens
agaggcacccagttaagctgca

SEQ ID NO: 7930538 - DNA, 22 bp, Homo sapiens
agaggcaccatctggaacagcc

SEQ ID NO: 7930539 - DNA, 22 bp, Homo sapiens
agaggcacccgcgcgcggccat

SEQ ID NO: 7930540 - DNA, 22 bp, Homo sapiens
agaggcacccagttaagctgca

SEQ ID NO: 7930541 - DNA, 23 bp, Homo sapiens
agaggcacctaaagtcaagttgt

SEQ ID NO: 7930542 - DNA, 22 bp, Homo sapiens
agaggcacggaggctgcatgga

SEQ ID NO: 7930543 - DNA, 22 bp, Homo sapiens
agaggcaccgtctgcagcgtgc

SEQ ID NO: 7930544 - DNA, 22 bp, Homo sapiens
agaggcacccgcgcgcggccat

SEQ ID NO: 7930545 - DNA, 22 bp, Homo sapiens
agaggcaaggcaggattcttct

SEQ ID NO: 7930546 - DNA, 22 bp, Homo sapiens
agaggcaaggcaggattcttct

SEQ ID NO: 7930547 - DNA, 22 bp, Homo sapiens
agaggcaagattatcagggcat

SEQ ID NO: 7930548 - DNA, 19 bp, Homo sapiens
agaggcaagggctcatgac

SEQ ID NO: 7930549 - DNA, 22 bp, Homo sapiens
agaggcaagggacctttctggg

SEQ ID NO: 7930550 - DNA, 22 bp, Homo sapiens
agaggcaagggacctttctggg

SEQ ID NO: 7930551 - DNA, 19 bp, Homo sapiens
agaggcaagggtggaagta

SEQ ID NO: 7930552 - DNA, 19 bp, Homo sapiens
agaggcaagggtggaagta

SEQ ID NO: 7930553 - DNA, 19 bp, Homo sapiens
agaggcaagggtggaagta

SEQ ID NO: 7930554 - DNA, 19 bp, Homo sapiens
agaggcaagggctcatgac

SEQ ID NO: 7930555 - DNA, 19 bp, Homo sapiens
agaggcaagggctcatgac

SEQ ID NO: 7930556 - DNA, 22 bp, Homo sapiens
agaggcaagttcagagctagga

SEQ ID NO: 7930557 - DNA, 22 bp, Homo sapiens
agaggcaagttcagagctagga

SEQ ID NO: 7930558 - DNA, 22 bp, Homo sapiens
agaggcacagaggcagtcccct

SEQ ID NO: 7930559 - DNA, 23 bp, Homo sapiens
agaggcacagcacttggctggcc

SEQ ID NO: 7930560 - DNA, 22 bp, Homo sapiens
agaggcacatggagggtggaag

SEQ ID NO: 7930561 - DNA, 23 bp, Homo sapiens
agaggcacagcacttggctggcc

SEQ ID NO: 7930562 - DNA, 22 bp, Homo sapiens
agaggcaccatctggaacagcc

SEQ ID NO: 7930563 - DNA, 22 bp, Homo sapiens
agaggcaccatctggaacagcc

SEQ ID NO: 7930564 - DNA, 22 bp, Homo sapiens
agaggcaccatctggaacagcc

SEQ ID NO: 7930565 - DNA, 22 bp, Homo sapiens
agaggcacaacagtcccattgt

SEQ ID NO: 7930566 - DNA, 22 bp, Homo sapiens
agaggcacaaactggaaaggac

SEQ ID NO: 7930567 - DNA, 22 bp, Homo sapiens
agaggcacaaactggaaaggac

SEQ ID NO: 7930568 - DNA, 22 bp, Homo sapiens
agaggcacaaactggaaaggac

SEQ ID NO: 7930569 - DNA, 22 bp, Homo sapiens
agaggcacaaactggaaaggac

SEQ ID NO: 7930570 - DNA, 22 bp, Homo sapiens
agaggcaatgaaagcagtctct

SEQ ID NO: 7930571 - DNA, 22 bp, Homo sapiens
agaggcaatgaaagcagtctct

SEQ ID NO: 7930572 - DNA, 22 bp, Homo sapiens
agaggcaagttcagagctagga

SEQ ID NO: 7930573 - DNA, 22 bp, Homo sapiens
agagctggctgtgggtgacttt

SEQ ID NO: 7930574 - DNA, 22 bp, Homo sapiens
agagctggctgtgggtgacttt

SEQ ID NO: 7930575 - DNA, 22 bp, Homo sapiens
agagctggctgtgggtgacttt

SEQ ID NO: 7930576 - DNA, 22 bp, Homo sapiens
agagctggctgtgggtgacttt

SEQ ID NO: 7930577 - DNA, 22 bp, Homo sapiens
agagctggctgtgggtgacttt

SEQ ID NO: 7930578 - DNA, 20 bp, Homo sapiens
agagctgggaagctccctat

SEQ ID NO: 7930579 - DNA, 20 bp, Homo sapiens
agagctgggaagctccctat

SEQ ID NO: 7930580 - DNA, 20 bp, Homo sapiens
agagctgggaagctccctat

SEQ ID NO: 7930581 - DNA, 20 bp, Homo sapiens
agagctgggaagctccctat

SEQ ID NO: 7930582 - DNA, 22 bp, Homo sapiens
agagctgggaccgtctggaagt

SEQ ID NO: 7930583 - DNA, 22 bp, Homo sapiens
agagctgggaccgtctggaagt

SEQ ID NO: 7930584 - DNA, 22 bp, Homo sapiens
agagctgggaccgtctggaagt

SEQ ID NO: 7930585 - DNA, 20 bp, Homo sapiens
agagctgggaagctccctat

SEQ ID NO: 7930586 - DNA, 22 bp, Homo sapiens
agagctgggaccgtctggaagt

SEQ ID NO: 7930587 - DNA, 22 bp, Homo sapiens
agagctgggaccgtctggaagt

SEQ ID NO: 7930588 - DNA, 22 bp, Homo sapiens
agaggcaagattatcagggcat

SEQ ID NO: 7930589 - DNA, 22 bp, Homo sapiens
agaggaggtccttttctgatgt

SEQ ID NO: 7930590 - DNA, 22 bp, Homo sapiens
agaggcaactgatttctgccag

SEQ ID NO: 7930591 - DNA, 22 bp, Homo sapiens
agagctgggaccgtctggaagt

SEQ ID NO: 7930592 - DNA, 22 bp, Homo sapiens
agagctgggaccgtctggaagt

SEQ ID NO: 7930593 - DNA, 21 bp, Homo sapiens
agagctgggacttgcctgaga

SEQ ID NO: 7930594 - DNA, 21 bp, Homo sapiens
agagctgggacttgcctgaga

SEQ ID NO: 7930595 - DNA, 21 bp, Homo sapiens
agagctgggacttgcctgaga

SEQ ID NO: 7930596 - DNA, 22 bp, Homo sapiens
agagctgggaccgtctggaagt

SEQ ID NO: 7930597 - DNA, 21 bp, Homo sapiens
agagctgggacttgcctgaga

SEQ ID NO: 7930598 - DNA, 21 bp, Homo sapiens
agagctgggacttgcctgaga

SEQ ID NO: 7930599 - DNA, 23 bp, Homo sapiens
agaggccagcctttggagacacc

SEQ ID NO: 7930600 - DNA, 23 bp, Homo sapiens
agaggccagcctttggagacacc

SEQ ID NO: 7930601 - DNA, 23 bp, Homo sapiens
agaggccagcctttggagacacc

SEQ ID NO: 7930602 - DNA, 23 bp, Homo sapiens
agaggccagcctttggagacacc

SEQ ID NO: 7930603 - DNA, 23 bp, Homo sapiens
agaggccagcctttggagacacc

SEQ ID NO: 7930604 - DNA, 23 bp, Homo sapiens
agaggccagcctttggagacacc

SEQ ID NO: 7930605 - DNA, 23 bp, Homo sapiens
agaggccagcctttggagacacc

SEQ ID NO: 7930606 - DNA, 23 bp, Homo sapiens
agaggccagcctttggagacacc

SEQ ID NO: 7930607 - DNA, 22 bp, Homo sapiens
agaggccagcccaggccaccga

SEQ ID NO: 7930608 - DNA, 22 bp, Homo sapiens
agaggccagcccaggccaccga

SEQ ID NO: 7930609 - DNA, 22 bp, Homo sapiens
agaggccagcccaggccaccga

SEQ ID NO: 7930610 - DNA, 22 bp, Homo sapiens
agaggccagcccaggccaccga

SEQ ID NO: 7930611 - DNA, 22 bp, Homo sapiens
agaggccagcccaggccaccga

SEQ ID NO: 7930612 - DNA, 22 bp, Homo sapiens
agaggccagcagtgcctatctg

SEQ ID NO: 7930613 - DNA, 22 bp, Homo sapiens
agaggccagcagtgcctatctg

SEQ ID NO: 7930614 - DNA, 22 bp, Homo sapiens
agaggccagcagtgcctatctg

SEQ ID NO: 7930615 - DNA, 22 bp, Homo sapiens
agaggccagcagtgcctatctg

SEQ ID NO: 7930616 - DNA, 22 bp, Homo sapiens
agaggccagcagtgcctatctg

SEQ ID NO: 7930617 - DNA, 22 bp, Homo sapiens
agaggccagcactgcagggaag

SEQ ID NO: 7930618 - DNA, 22 bp, Homo sapiens
agaggccagcactgcagggaag

SEQ ID NO: 7930619 - DNA, 22 bp, Homo sapiens
agaggccagcactgcagggaag

SEQ ID NO: 7930620 - DNA, 22 bp, Homo sapiens
agaggccagcactgcagggaag

SEQ ID NO: 7930621 - DNA, 22 bp, Homo sapiens
agaggccagcaaccacagtaaa

SEQ ID NO: 7930622 - DNA, 22 bp, Homo sapiens
agaggccagcaaccacagtaaa

SEQ ID NO: 7930623 - DNA, 22 bp, Homo sapiens
agaggccagcactgcagggaag

SEQ ID NO: 7930624 - DNA, 22 bp, Homo sapiens
agaggccagcactgcagggaag

SEQ ID NO: 7930625 - DNA, 22 bp, Homo sapiens
agaggccagatcatcatagatg

SEQ ID NO: 7930626 - DNA, 22 bp, Homo sapiens
agaggccagatcatcatagatg

SEQ ID NO: 7930627 - DNA, 22 bp, Homo sapiens
agaggccagatcatcatagatg

SEQ ID NO: 7930628 - DNA, 22 bp, Homo sapiens
agaggccagcaaccacagtaaa

SEQ ID NO: 7930629 - DNA, 22 bp, Homo sapiens
agaggccagcaaccacagtaaa

SEQ ID NO: 7930630 - DNA, 22 bp, Homo sapiens
agaggccactttgcctgtgatg

SEQ ID NO: 7930631 - DNA, 22 bp, Homo sapiens
agaggccactttgcctgtgatg

SEQ ID NO: 7930632 - DNA, 22 bp, Homo sapiens
agaggccactttgcctgtgatg

SEQ ID NO: 7930633 - DNA, 22 bp, Homo sapiens
agaggccaccttctcttgagaa

SEQ ID NO: 7930634 - DNA, 22 bp, Homo sapiens
agaggccactttgcctgtgatg

SEQ ID NO: 7930635 - DNA, 22 bp, Homo sapiens
agaggccactttgcctgtgatg

SEQ ID NO: 7930636 - DNA, 22 bp, Homo sapiens
agaggccagaaggcgcaccccg

SEQ ID NO: 7930637 - DNA, 22 bp, Homo sapiens
agaggccagaaggcgcaccccg

SEQ ID NO: 7930638 - DNA, 22 bp, Homo sapiens
agaggccagaaggcgcaccccg

SEQ ID NO: 7930639 - DNA, 22 bp, Homo sapiens
agaggccagaaggcgcaccccg

SEQ ID NO: 7930640 - DNA, 22 bp, Homo sapiens
agaggccagaaagtatgccacc

SEQ ID NO: 7930641 - DNA, 22 bp, Homo sapiens
agaggccagaaagtatgccacc

SEQ ID NO: 7930642 - DNA, 22 bp, Homo sapiens
agaggccagaaagtatgccacc

SEQ ID NO: 7930643 - DNA, 22 bp, Homo sapiens
agaggccagaaagtatgccacc

SEQ ID NO: 7930644 - DNA, 22 bp, Homo sapiens
agaggccaccagaggtggtgcc

SEQ ID NO: 7930645 - DNA, 22 bp, Homo sapiens
agaggccaccagaggtggtgcc

SEQ ID NO: 7930646 - DNA, 22 bp, Homo sapiens
agaggccaccactgtcagggac

SEQ ID NO: 7930647 - DNA, 22 bp, Homo sapiens
agaggccaccagaggtggtgcc

SEQ ID NO: 7930648 - DNA, 22 bp, Homo sapiens
agaggccaccagaggtggtgcc

SEQ ID NO: 7930649 - DNA, 22 bp, Homo sapiens
agaggccaccttctcttgagaa

SEQ ID NO: 7930650 - DNA, 22 bp, Homo sapiens
agaggccaccttctcttgagaa

SEQ ID NO: 7930651 - DNA, 22 bp, Homo sapiens
agaggccaccttctcttgagaa

SEQ ID NO: 7930652 - DNA, 22 bp, Homo sapiens
agaggccaccagaggtggtgcc

SEQ ID NO: 7930653 - DNA, 16 bp, Homo sapiens
agaggccacagacaga

SEQ ID NO: 7930654 - DNA, 22 bp, Homo sapiens
agaggccaccactgtcagggac

SEQ ID NO: 7930655 - DNA, 22 bp, Homo sapiens
agaggccaccactgtcagggac

SEQ ID NO: 7930656 - DNA, 23 bp, Homo sapiens
agaggcaggagtggcttgcccgg

SEQ ID NO: 7930657 - DNA, 16 bp, Homo sapiens
agaggccacagacaga

SEQ ID NO: 7930658 - DNA, 18 bp, Homo sapiens
agaggctggacaggggat

SEQ ID NO: 7930659 - DNA, 18 bp, Homo sapiens
agaggctggacaggggat

SEQ ID NO: 7930660 - DNA, 18 bp, Homo sapiens
agaggctggacaggggat

SEQ ID NO: 7930661 - DNA, 18 bp, Homo sapiens
agaggctggacaggggat

SEQ ID NO: 7930662 - DNA, 18 bp, Homo sapiens
agaggctggacaggggat

SEQ ID NO: 7930663 - DNA, 22 bp, Homo sapiens
agaggctggattgagcatagac

SEQ ID NO: 7930664 - DNA, 22 bp, Homo sapiens
agaggctggattgagcatagac

SEQ ID NO: 7930665 - DNA, 22 bp, Homo sapiens
agaggctggattgagcatagac

SEQ ID NO: 7930666 - DNA, 22 bp, Homo sapiens
agaggctggattgagcatagac

SEQ ID NO: 7930667 - DNA, 22 bp, Homo sapiens
agaggctgcaggctggaaatca

SEQ ID NO: 7930668 - DNA, 22 bp, Homo sapiens
agaggctgcaggctggaaatca

SEQ ID NO: 7930669 - DNA, 22 bp, Homo sapiens
agaggctgcaggctggaaatca

SEQ ID NO: 7930670 - DNA, 22 bp, Homo sapiens
agaggctgcaggctggaaatca

SEQ ID NO: 7930671 - DNA, 22 bp, Homo sapiens
agaggctgcaggctggaaatca

SEQ ID NO: 7930672 - DNA, 23 bp, Homo sapiens
agaggctgcagggtattgagaat

SEQ ID NO: 7930673 - DNA, 23 bp, Homo sapiens
agaggctgcagggtattgagaat

SEQ ID NO: 7930674 - DNA, 23 bp, Homo sapiens
agaggctgcagggtattgagaat

SEQ ID NO: 7930675 - DNA, 18 bp, Homo sapiens
agaggctggacaggggat

SEQ ID NO: 7930676 - DNA, 18 bp, Homo sapiens
agaggctggacaggggat

SEQ ID NO: 7930677 - DNA, 18 bp, Homo sapiens
agaggctggacaggggat

SEQ ID NO: 7930678 - DNA, 22 bp, Homo sapiens
agaggctgcacttgctcatgat

SEQ ID NO: 7930679 - DNA, 22 bp, Homo sapiens
agaggctgcacttgctcatgat

SEQ ID NO: 7930680 - DNA, 22 bp, Homo sapiens
agaggctgcacttgctcatgat

SEQ ID NO: 7930681 - DNA, 22 bp, Homo sapiens
agaggctgcacttgctcatgat

SEQ ID NO: 7930682 - DNA, 22 bp, Homo sapiens
agaggctgatggagtagtgtct

SEQ ID NO: 7930683 - DNA, 22 bp, Homo sapiens
agaggctccttcactctggcac

SEQ ID NO: 7930684 - DNA, 22 bp, Homo sapiens
agaggctgcacttgctcatgat

SEQ ID NO: 7930685 - DNA, 22 bp, Homo sapiens
agaggctgcacttgctcatgat

SEQ ID NO: 7930686 - DNA, 22 bp, Homo sapiens
agaggctgcacttgctcatgat

SEQ ID NO: 7930687 - DNA, 22 bp, Homo sapiens
agaggctgcacttgctcatgat

SEQ ID NO: 7930688 - DNA, 22 bp, Homo sapiens
agaggctgcacttgctcatgat

SEQ ID NO: 7930689 - DNA, 22 bp, Homo sapiens
agaggctgcacttgctcatgat

SEQ ID NO: 7930690 - DNA, 22 bp, Homo sapiens
agaggctgcacttgctcatgat

SEQ ID NO: 7930691 - DNA, 22 bp, Homo sapiens
agaggctgcacttgctcatgat

SEQ ID NO: 7930692 - DNA, 22 bp, Homo sapiens
agaggccaggctgcagagggat

SEQ ID NO: 7930693 - DNA, 22 bp, Homo sapiens
agaggccaggctgcagagggat

SEQ ID NO: 7930694 - DNA, 22 bp, Homo sapiens
agaggccaggctgcagagggat

SEQ ID NO: 7930695 - DNA, 22 bp, Homo sapiens
agaggccaggctgcagagggat

SEQ ID NO: 7930696 - DNA, 22 bp, Homo sapiens
agaggctccttcactctggcac

SEQ ID NO: 7930697 - DNA, 22 bp, Homo sapiens
agaggctcctcggtgcctcgtg

SEQ ID NO: 7930698 - DNA, 22 bp, Homo sapiens
agaggccaggcagcccaaggtg

SEQ ID NO: 7930699 - DNA, 22 bp, Homo sapiens
agaggccaggcagcccaaggtg

SEQ ID NO: 7930700 - DNA, 22 bp, Homo sapiens
agaggccaggcagcccaaggtg

SEQ ID NO: 7930701 - DNA, 22 bp, Homo sapiens
agaggccaggcagcccaaggtg

SEQ ID NO: 7930702 - DNA, 22 bp, Homo sapiens
agaggccaggcagcccaaggtg

SEQ ID NO: 7930703 - DNA, 22 bp, Homo sapiens
agaggccagctagcgggccatc

SEQ ID NO: 7930704 - DNA, 22 bp, Homo sapiens
agaggccagctagcgggccatc

SEQ ID NO: 7930705 - DNA, 22 bp, Homo sapiens
agaggccagctagcgggccatc

SEQ ID NO: 7930706 - DNA, 22 bp, Homo sapiens
agaggggagtcctaatctgatt

SEQ ID NO: 7930707 - DNA, 22 bp, Homo sapiens
agaggggagtcctaatctgatt

SEQ ID NO: 7930708 - DNA, 18 bp, Homo sapiens
agaggggaggtaagtctg

SEQ ID NO: 7930709 - DNA, 22 bp, Homo sapiens
agaggggcaagtaaagagtctt

SEQ ID NO: 7930710 - DNA, 22 bp, Homo sapiens
agaggggcaagtaaagagtctt

SEQ ID NO: 7930711 - DNA, 22 bp, Homo sapiens
agaggggcaagtaaagagtctt

SEQ ID NO: 7930712 - DNA, 22 bp, Homo sapiens
agaggggctcaagcagtggtct

SEQ ID NO: 7930713 - DNA, 22 bp, Homo sapiens
agaggggctcaagcagtggtct

SEQ ID NO: 7930714 - DNA, 22 bp, Homo sapiens
agaggggctcaagcagtggtct

SEQ ID NO: 7930715 - DNA, 22 bp, Homo sapiens
agaggggcgggaactcaacctc

SEQ ID NO: 7930716 - DNA, 22 bp, Homo sapiens
agaggggcccggttctccgtct

SEQ ID NO: 7930717 - DNA, 22 bp, Homo sapiens
agaggggcgggaactcaacctc

SEQ ID NO: 7930718 - DNA, 22 bp, Homo sapiens
agaggggcgggaactcaacctc

SEQ ID NO: 7930719 - DNA, 23 bp, Homo sapiens
agaggggagcatctgctggctga

SEQ ID NO: 7930720 - DNA, 23 bp, Homo sapiens
agaggggagcatctgctggctga

SEQ ID NO: 7930721 - DNA, 23 bp, Homo sapiens
agaggggagcatctgctggctga

SEQ ID NO: 7930722 - DNA, 22 bp, Homo sapiens
agaggggaggcgaaccagagtc

SEQ ID NO: 7930723 - DNA, 22 bp, Homo sapiens
agaggggaggcgaaccagagtc

SEQ ID NO: 7930724 - DNA, 22 bp, Homo sapiens
agaggggaggcgaaccagagtc

SEQ ID NO: 7930725 - DNA, 23 bp, Homo sapiens
agaggggagcatctgctggctga

SEQ ID NO: 7930726 - DNA, 22 bp, Homo sapiens
agaggggaggcgaaccagagtc

SEQ ID NO: 7930727 - DNA, 22 bp, Homo sapiens
agaggggaggcgaaccagagtc

SEQ ID NO: 7930728 - DNA, 22 bp, Homo sapiens
agaggggaggcgaaccagagtc

SEQ ID NO: 7930729 - DNA, 23 bp, Homo sapiens
agaggggagcatctgctggctga

SEQ ID NO: 7930730 - DNA, 23 bp, Homo sapiens
agaggggagcatctgctggctga

SEQ ID NO: 7930731 - DNA, 22 bp, Homo sapiens
agaggggagagctaagcaattc

SEQ ID NO: 7930732 - DNA, 22 bp, Homo sapiens
agaggggagagctaagcaattc

SEQ ID NO: 7930733 - DNA, 22 bp, Homo sapiens
agaggggagagctaagcaattc

SEQ ID NO: 7930734 - DNA, 22 bp, Homo sapiens
agaggggagagctaagcaattc

SEQ ID NO: 7930735 - DNA, 22 bp, Homo sapiens
agaggggacagccacctgcccg

SEQ ID NO: 7930736 - DNA, 22 bp, Homo sapiens
agaggggacagccacctgcccg

SEQ ID NO: 7930737 - DNA, 22 bp, Homo sapiens
agaggggacagccacctgcccg

SEQ ID NO: 7930738 - DNA, 22 bp, Homo sapiens
agaggggaagtaatgaatgata

SEQ ID NO: 7930739 - DNA, 22 bp, Homo sapiens
agaggggaagtaatgaatgata

SEQ ID NO: 7930740 - DNA, 22 bp, Homo sapiens
agaggggaaggatgtgatgtga

SEQ ID NO: 7930741 - DNA, 22 bp, Homo sapiens
agaggggaagtaatgaatgata

SEQ ID NO: 7930742 - DNA, 22 bp, Homo sapiens
agaggggaaggatgtgatgtga

SEQ ID NO: 7930743 - DNA, 22 bp, Homo sapiens
agaggggaaggatgtgatgtga

SEQ ID NO: 7930744 - DNA, 22 bp, Homo sapiens
agaggggaaggatgtgatgtga

SEQ ID NO: 7930745 - DNA, 22 bp, Homo sapiens
agagggctttgattctcagttc

SEQ ID NO: 7930746 - DNA, 22 bp, Homo sapiens
agagggctttgattctcagttc

SEQ ID NO: 7930747 - DNA, 22 bp, Homo sapiens
agagggcttccctaggagtgag

SEQ ID NO: 7930748 - DNA, 22 bp, Homo sapiens
agagggcttccctaggagtgag

SEQ ID NO: 7930749 - DNA, 22 bp, Homo sapiens
agagggcttccctaggagtgag

SEQ ID NO: 7930750 - DNA, 22 bp, Homo sapiens
agagggctgggatgtgctgtgt

SEQ ID NO: 7930751 - DNA, 22 bp, Homo sapiens
agagggctgggatgtgctgtgt

SEQ ID NO: 7930752 - DNA, 22 bp, Homo sapiens
agagggcttccctaggagtgag

SEQ ID NO: 7930753 - DNA, 22 bp, Homo sapiens
agagggcagtctcagattggga

SEQ ID NO: 7930754 - DNA, 22 bp, Homo sapiens
agagggcagtctcagattggga

SEQ ID NO: 7930755 - DNA, 22 bp, Homo sapiens
agagggcagtctcagattggga

SEQ ID NO: 7930756 - DNA, 22 bp, Homo sapiens
agagggcagtctcagattggga

SEQ ID NO: 7930757 - DNA, 22 bp, Homo sapiens
agagggcagggcggtaagtcct

SEQ ID NO: 7930758 - DNA, 22 bp, Homo sapiens
agaggctgtcccttgctattcc

SEQ ID NO: 7930759 - DNA, 22 bp, Homo sapiens
agaggctgtcccttgctattcc

SEQ ID NO: 7930760 - DNA, 19 bp, Homo sapiens
agaggctgtcacctgtagc

SEQ ID NO: 7930761 - DNA, 19 bp, Homo sapiens
agaggctgtcacctgtagc

SEQ ID NO: 7930762 - DNA, 19 bp, Homo sapiens
agaggctgtcacctgtagc

SEQ ID NO: 7930763 - DNA, 22 bp, Homo sapiens
agaggctgggtacgggccacct

SEQ ID NO: 7930764 - DNA, 22 bp, Homo sapiens
agaggctgggtacgggccacct

SEQ ID NO: 7930765 - DNA, 16 bp, Homo sapiens
agaggctgtaatggaa

SEQ ID NO: 7930766 - DNA, 16 bp, Homo sapiens
agaggctgtaatggaa

SEQ ID NO: 7930767 - DNA, 22 bp, Homo sapiens
agaggctgggcaggacccacag

SEQ ID NO: 7930768 - DNA, 22 bp, Homo sapiens
agaggctgggcaggacccacag

SEQ ID NO: 7930769 - DNA, 22 bp, Homo sapiens
agaggctgggcaggacccacag

SEQ ID NO: 7930770 - DNA, 22 bp, Homo sapiens
agaggctgggcaggacccacag

SEQ ID NO: 7930771 - DNA, 22 bp, Homo sapiens
agaggctgggtacgggccacct

SEQ ID NO: 7930772 - DNA, 22 bp, Homo sapiens
agaggctgggtacgggccacct

SEQ ID NO: 7930773 - DNA, 22 bp, Homo sapiens
agaggctgggtacgggccacct

SEQ ID NO: 7930774 - DNA, 22 bp, Homo sapiens
agaggctgggtacgggccacct

SEQ ID NO: 7930775 - DNA, 22 bp, Homo sapiens
agaggctgggtacgggccacct

SEQ ID NO: 7930776 - DNA, 22 bp, Homo sapiens
agaggctgggaagggtccccgg

SEQ ID NO: 7930777 - DNA, 22 bp, Homo sapiens
agaggctgggcaggacccacag

SEQ ID NO: 7930778 - DNA, 22 bp, Homo sapiens
agaggctgggaagggtccccgg

SEQ ID NO: 7930779 - DNA, 22 bp, Homo sapiens
agagtgagggggcactgagacg

SEQ ID NO: 7930780 - DNA, 22 bp, Homo sapiens
agagtgagggggcactgagacg

SEQ ID NO: 7930781 - DNA, 22 bp, Homo sapiens
agagtgagggggcactgagacg

SEQ ID NO: 7930782 - DNA, 22 bp, Homo sapiens
agagtgagggggcactgagacg

SEQ ID NO: 7930783 - DNA, 22 bp, Homo sapiens
agagtgagggggcactgagacg

SEQ ID NO: 7930784 - DNA, 22 bp, Homo sapiens
agagtgagggggcactgagacg

SEQ ID NO: 7930785 - DNA, 22 bp, Homo sapiens
agagtctgatatttgtaccaga

SEQ ID NO: 7930786 - DNA, 22 bp, Homo sapiens
agagtctgatatttgtaccaga

SEQ ID NO: 7930787 - DNA, 20 bp, Homo sapiens
agagtgagactccatctcag

SEQ ID NO: 7930788 - DNA, 22 bp, Homo sapiens
agagtgcagaggtcaaagaaca

SEQ ID NO: 7930789 - DNA, 22 bp, Homo sapiens
agagtgcaaccgaaacaagcag

SEQ ID NO: 7930790 - DNA, 22 bp, Homo sapiens
agagtgattcgttcaagaacca

SEQ ID NO: 7930791 - DNA, 23 bp, Homo sapiens
agagtgcagagatatgcttgtgt

SEQ ID NO: 7930792 - DNA, 22 bp, Homo sapiens
agagtgcaaccgaaacaagcag

SEQ ID NO: 7930793 - DNA, 22 bp, Homo sapiens
agagtgagggggcactgagacg

SEQ ID NO: 7930794 - DNA, 22 bp, Homo sapiens
agagtgatcagatatcaggtgt

SEQ ID NO: 7930795 - DNA, 22 bp, Homo sapiens
agagtgcaaccgaaacaagcag

SEQ ID NO: 7930796 - DNA, 22 bp, Homo sapiens
agagtgctcagatgcatgtctt

SEQ ID NO: 7930797 - DNA, 22 bp, Homo sapiens
agagtgctagcctgagggaggt

SEQ ID NO: 7930798 - DNA, 22 bp, Homo sapiens
agagtgcttagtagtgacatgg

SEQ ID NO: 7930799 - DNA, 20 bp, Homo sapiens
agagtgctggactgaggagc

SEQ ID NO: 7930800 - DNA, 22 bp, Homo sapiens
agagtgcatgacatgatcttgg

SEQ ID NO: 7930801 - DNA, 22 bp, Homo sapiens
agagtgcagaggtcaaagaaca

SEQ ID NO: 7930802 - DNA, 22 bp, Homo sapiens
agagtgcatgttttatctttgt

SEQ ID NO: 7930803 - DNA, 22 bp, Homo sapiens
agagtgccactgacaggtccct

SEQ ID NO: 7930804 - DNA, 22 bp, Homo sapiens
agagtctgaatgctcagagttg

SEQ ID NO: 7930805 - DNA, 21 bp, Homo sapiens
agagtctgagctcttaaccac

SEQ ID NO: 7930806 - DNA, 22 bp, Homo sapiens
agagtctgaatgctcagagttg

SEQ ID NO: 7930807 - DNA, 22 bp, Homo sapiens
agagtctgaggcagctgcagcc

SEQ ID NO: 7930808 - DNA, 22 bp, Homo sapiens
agagtctgaggaggaccaacag

SEQ ID NO: 7930809 - DNA, 22 bp, Homo sapiens
agagtctgaggaggaccaacag

SEQ ID NO: 7930810 - DNA, 22 bp, Homo sapiens
agagtctgaggaggaccaacag

SEQ ID NO: 7930811 - DNA, 22 bp, Homo sapiens
agagtctgatatttgtaccaga

SEQ ID NO: 7930812 - DNA, 22 bp, Homo sapiens
agagtctgatatttgtaccaga

SEQ ID NO: 7930813 - DNA, 21 bp, Homo sapiens
agagtctgagtgtgcaagggc

SEQ ID NO: 7930814 - DNA, 21 bp, Homo sapiens
agagtctgagtgtgcaagggc

SEQ ID NO: 7930815 - DNA, 22 bp, Homo sapiens
agagtctgaggcagctgcagcc

SEQ ID NO: 7930816 - DNA, 22 bp, Homo sapiens
agagtccaggggcctggtgtgt

SEQ ID NO: 7930817 - DNA, 18 bp, Homo sapiens
agagtccagggtgaggtg

SEQ ID NO: 7930818 - DNA, 22 bp, Homo sapiens
agagtccagaaaacagtgtgct

SEQ ID NO: 7930819 - DNA, 22 bp, Homo sapiens
agagtccagaaaacagtgtgct

SEQ ID NO: 7930820 - DNA, 22 bp, Homo sapiens
agagtccagaaaacagtgtgct

SEQ ID NO: 7930821 - DNA, 22 bp, Homo sapiens
agagtccaggtgggctggaggc

SEQ ID NO: 7930822 - DNA, 22 bp, Homo sapiens
agagtccaggtgggctggaggc

SEQ ID NO: 7930823 - DNA, 22 bp, Homo sapiens
agagtcccagggacactccaga

SEQ ID NO: 7930824 - DNA, 22 bp, Homo sapiens
agagtccatgaagacagctgag

SEQ ID NO: 7930825 - DNA, 22 bp, Homo sapiens
agagtccctcttcccaggaggc

SEQ ID NO: 7930826 - DNA, 18 bp, Homo sapiens
agagtccagggtgaggtg

SEQ ID NO: 7930827 - DNA, 22 bp, Homo sapiens
agagtattttgattatcctgga

SEQ ID NO: 7930828 - DNA, 22 bp, Homo sapiens
agagtatgcatctattgtacct

SEQ ID NO: 7930829 - DNA, 22 bp, Homo sapiens
agagtatattgaagcagtcagg

SEQ ID NO: 7930830 - DNA, 19 bp, Homo sapiens
agagtattgaatttgccct

SEQ ID NO: 7930831 - DNA, 18 bp, Homo sapiens
agagtatacagacaacaa

SEQ ID NO: 7930832 - DNA, 22 bp, Homo sapiens
agagtcaagtagggcatgggct

SEQ ID NO: 7930833 - DNA, 22 bp, Homo sapiens
agagtcaacatcgagccactgg

SEQ ID NO: 7930834 - DNA, 22 bp, Homo sapiens
agagtcaccttttcctcaggat

SEQ ID NO: 7930835 - DNA, 22 bp, Homo sapiens
agagtcaaggtggcatttagct

SEQ ID NO: 7930836 - DNA, 22 bp, Homo sapiens
agagtcaagggtgcagaggaag

SEQ ID NO: 7930837 - DNA, 22 bp, Homo sapiens
agagtcaagtagggcatgggct

SEQ ID NO: 7930838 - DNA, 22 bp, Homo sapiens
agagtcaagggtgcagaggaag

SEQ ID NO: 7930839 - DNA, 22 bp, Homo sapiens
agagtcaacatcgagccactgg

SEQ ID NO: 7930840 - DNA, 22 bp, Homo sapiens
agaggtggagctcttggcatca

SEQ ID NO: 7930841 - DNA, 22 bp, Homo sapiens
agagtactgcctcagttatgaa

SEQ ID NO: 7930842 - DNA, 22 bp, Homo sapiens
agagtactgcctcagttatgaa

SEQ ID NO: 7930843 - DNA, 22 bp, Homo sapiens
agaggtgacataggagaggctc

SEQ ID NO: 7930844 - DNA, 22 bp, Homo sapiens
agaggtgagtcattacctagtg

SEQ ID NO: 7930845 - DNA, 22 bp, Homo sapiens
agaggtggagctcttggcatca

SEQ ID NO: 7930846 - DNA, 18 bp, Homo sapiens
agagtatacagacaacaa

SEQ ID NO: 7930847 - DNA, 22 bp, Homo sapiens
agagtataggcaggatgccagt

SEQ ID NO: 7930848 - DNA, 22 bp, Homo sapiens
agagtataattagtgtcttcta

SEQ ID NO: 7930849 - DNA, 18 bp, Homo sapiens
agagtatacagacaacaa

SEQ ID NO: 7930850 - DNA, 22 bp, Homo sapiens
agagtagttctttgcagagtgg

SEQ ID NO: 7930851 - DNA, 21 bp, Homo sapiens
agagtataataaaggcatgtc

SEQ ID NO: 7930852 - DNA, 20 bp, Homo sapiens
agagtagaggtagatttatg

SEQ ID NO: 7930853 - DNA, 20 bp, Homo sapiens
agagtagaggtagatttatg

SEQ ID NO: 7930854 - DNA, 20 bp, Homo sapiens
agagtagaggtagatttatg

SEQ ID NO: 7930855 - DNA, 22 bp, Homo sapiens
agagtactgctgctgggtactg

SEQ ID NO: 7930856 - DNA, 22 bp, Homo sapiens
agagtcagtaacatatatggta

SEQ ID NO: 7930857 - DNA, 22 bp, Homo sapiens
agagtcagtcactggcactttg

SEQ ID NO: 7930858 - DNA, 22 bp, Homo sapiens
agagtcagtcactggcactttg

SEQ ID NO: 7930859 - DNA, 22 bp, Homo sapiens
agagtcagtaacatatatggta

SEQ ID NO: 7930860 - DNA, 22 bp, Homo sapiens
agagtcagttagcgaatactta

SEQ ID NO: 7930861 - DNA, 22 bp, Homo sapiens
agagtcagttatgtcaagtgct

SEQ ID NO: 7930862 - DNA, 22 bp, Homo sapiens
agagtccaccctggggtcaggc

SEQ ID NO: 7930863 - DNA, 22 bp, Homo sapiens
agagtccaccctggggtcaggc

SEQ ID NO: 7930864 - DNA, 22 bp, Homo sapiens
agagtccaaatgtgcagttatg

SEQ ID NO: 7930865 - DNA, 22 bp, Homo sapiens
agagtccaaatgtgcagttatg

SEQ ID NO: 7930866 - DNA, 23 bp, Homo sapiens
agagtccacaagattttccagtg

SEQ ID NO: 7930867 - DNA, 22 bp, Homo sapiens
agagtccaaatgtgcagttatg

SEQ ID NO: 7930868 - DNA, 22 bp, Homo sapiens
agagtcagactaagccatggtg

SEQ ID NO: 7930869 - DNA, 22 bp, Homo sapiens
agagtcagactaagccatggtg

SEQ ID NO: 7930870 - DNA, 22 bp, Homo sapiens
agagtcagcttatgacacagtc

SEQ ID NO: 7930871 - DNA, 22 bp, Homo sapiens
agagtcagcttatgacacagtc

SEQ ID NO: 7930872 - DNA, 22 bp, Homo sapiens
agagtcagcttatgacacagtc

SEQ ID NO: 7930873 - DNA, 22 bp, Homo sapiens
agagtcagaaagcagacagggg

SEQ ID NO: 7930874 - DNA, 22 bp, Homo sapiens
agagtcagaaagcagacagggg

SEQ ID NO: 7930875 - DNA, 22 bp, Homo sapiens
agagtcagaaccaagatgaggc

SEQ ID NO: 7930876 - DNA, 22 bp, Homo sapiens
agagtcagaaccaagatgaggc

SEQ ID NO: 7930877 - DNA, 18 bp, Homo sapiens
atgcatattttaagttgt

SEQ ID NO: 7930878 - DNA, 21 bp, Homo sapiens
atgcatattttaagttgtgtc

SEQ ID NO: 7930879 - DNA, 22 bp, Homo sapiens
atgcatattgtcatttagtcct

SEQ ID NO: 7930880 - DNA, 22 bp, Homo sapiens
atgcatatttcatgaatctttg

SEQ ID NO: 7930881 - DNA, 22 bp, Homo sapiens
atgcatattgattatagattca

SEQ ID NO: 7930882 - DNA, 22 bp, Homo sapiens
atgcatatttcttggagcacct

SEQ ID NO: 7930883 - DNA, 22 bp, Homo sapiens
atgcatatttcttgggcttacc

SEQ ID NO: 7930884 - DNA, 22 bp, Homo sapiens
atgcatatgtacccatgttctg

SEQ ID NO: 7930885 - DNA, 22 bp, Homo sapiens
atgcatatgtacttgcatatgt

SEQ ID NO: 7930886 - DNA, 22 bp, Homo sapiens
atgcaggtatattttattaaag

SEQ ID NO: 7930887 - DNA, 22 bp, Homo sapiens
atgcatatgtgtgcacacgtgt

SEQ ID NO: 7930888 - DNA, 22 bp, Homo sapiens
atgcatattgattatagattca

SEQ ID NO: 7930889 - DNA, 22 bp, Homo sapiens
atgcatattcttagcccctcct

SEQ ID NO: 7930890 - DNA, 22 bp, Homo sapiens
atgcatattgattatagattca

SEQ ID NO: 7930891 - DNA, 22 bp, Homo sapiens
atgcatattggattagcagcca

SEQ ID NO: 7930892 - DNA, 22 bp, Homo sapiens
atgcatttgtaaaatataatcg

SEQ ID NO: 7930893 - DNA, 22 bp, Homo sapiens
atgcatattttctactatatcg

SEQ ID NO: 7930894 - DNA, 22 bp, Homo sapiens
atgcatattttctgttggtgac

SEQ ID NO: 7930895 - DNA, 22 bp, Homo sapiens
atgcatttttgagtatgaatga

SEQ ID NO: 7930896 - DNA, 22 bp, Homo sapiens
atgcatttgtaaaatataatcg

SEQ ID NO: 7930897 - DNA, 22 bp, Homo sapiens
atgcatttttgagtatgaatga

SEQ ID NO: 7930898 - DNA, 22 bp, Homo sapiens
atgcatttttgagtatgaatga

SEQ ID NO: 7930899 - DNA, 22 bp, Homo sapiens
atgcatttttgagtatgaatga

SEQ ID NO: 7930900 - DNA, 22 bp, Homo sapiens
atgcatttttgagtatgaatga

SEQ ID NO: 7930901 - DNA, 22 bp, Homo sapiens
atgccaaagggagcactttggg

SEQ ID NO: 7930902 - DNA, 22 bp, Homo sapiens
atgatatacttcctagaacagt

SEQ ID NO: 7930903 - DNA, 22 bp, Homo sapiens
atgatatacttcctagaacagt

SEQ ID NO: 7930904 - DNA, 22 bp, Homo sapiens
atgatatacttcctagaacagt

SEQ ID NO: 7930905 - DNA, 22 bp, Homo sapiens
atgatatacttcctagaacagt

SEQ ID NO: 7930906 - DNA, 22 bp, Homo sapiens
atgatacatttacctatggtct

SEQ ID NO: 7930907 - DNA, 22 bp, Homo sapiens
atgatactctaggtgatttaca

SEQ ID NO: 7930908 - DNA, 22 bp, Homo sapiens
atgatactctaggtgatttaca

SEQ ID NO: 7930909 - DNA, 22 bp, Homo sapiens
atgatactctaggtgatttaca

SEQ ID NO: 7930910 - DNA, 22 bp, Homo sapiens
atgatagaaaggacacttggtg

SEQ ID NO: 7930911 - DNA, 23 bp, Homo sapiens
atgatagaaactcttgtagtctc

SEQ ID NO: 7930912 - DNA, 23 bp, Homo sapiens
atgatagaaactcttgtagtctc

SEQ ID NO: 7930913 - DNA, 22 bp, Homo sapiens
atgcatatggcttgagggaata

SEQ ID NO: 7930914 - DNA, 22 bp, Homo sapiens
atgcaggttggatcctatgccc

SEQ ID NO: 7930915 - DNA, 22 bp, Homo sapiens
atgcaggttaaagtttgagaat

SEQ ID NO: 7930916 - DNA, 22 bp, Homo sapiens
atgcagggttctgggctagaga

SEQ ID NO: 7930917 - DNA, 22 bp, Homo sapiens
atgatatagagagtagattaaa

SEQ ID NO: 7930918 - DNA, 22 bp, Homo sapiens
atgcagggttctgggctagaga

SEQ ID NO: 7930919 - DNA, 22 bp, Homo sapiens
atgatatagagagtagattaaa

SEQ ID NO: 7930920 - DNA, 22 bp, Homo sapiens
atgatatagagagtagattaaa

SEQ ID NO: 7930921 - DNA, 22 bp, Homo sapiens
atgatacatcttgtttatttca

SEQ ID NO: 7930922 - DNA, 22 bp, Homo sapiens
atgatacatcttgtttatttca

SEQ ID NO: 7930923 - DNA, 22 bp, Homo sapiens
atgatacatcttcatgtcagtg

SEQ ID NO: 7930924 - DNA, 22 bp, Homo sapiens
atgatacatcttcatgtcagtg

SEQ ID NO: 7930925 - DNA, 22 bp, Homo sapiens
agacagacatagaaattagtaa

SEQ ID NO: 7930926 - DNA, 22 bp, Homo sapiens
agacagacagagaatttaaata

SEQ ID NO: 7930927 - DNA, 22 bp, Homo sapiens
agacagaatttgtcagataaat

SEQ ID NO: 7930928 - DNA, 22 bp, Homo sapiens
agacagaatttgtcagataaat

SEQ ID NO: 7930929 - DNA, 22 bp, Homo sapiens
agacagacacatggtaacagat

SEQ ID NO: 7930930 - DNA, 20 bp, Homo sapiens
agacagaatcagagataaag

SEQ ID NO: 7930931 - DNA, 20 bp, Homo sapiens
agacagaatcagagataaag

SEQ ID NO: 7930932 - DNA, 22 bp, Homo sapiens
agacagaatttgtcagataaat

SEQ ID NO: 7930933 - DNA, 22 bp, Homo sapiens
agacagaatttgtcagataaat

SEQ ID NO: 7930934 - DNA, 22 bp, Homo sapiens
agacagaatttgtcagataaat

SEQ ID NO: 7930935 - DNA, 22 bp, Homo sapiens
agacagaacagaataattgttg

SEQ ID NO: 7930936 - DNA, 22 bp, Homo sapiens
agacagaacagaataattgttg

SEQ ID NO: 7930937 - DNA, 20 bp, Homo sapiens
agacagaatcagagataaag

SEQ ID NO: 7930938 - DNA, 20 bp, Homo sapiens
agacagaatcagagataaag

SEQ ID NO: 7930939 - DNA, 22 bp, Homo sapiens
atgccaagtacaggcactgctc

SEQ ID NO: 7930940 - DNA, 22 bp, Homo sapiens
atgccacataaccagttcactt

SEQ ID NO: 7930941 - DNA, 22 bp, Homo sapiens
atgccacataattacaaataga

SEQ ID NO: 7930942 - DNA, 22 bp, Homo sapiens
atgccaattgcaggaagaaaac

SEQ ID NO: 7930943 - DNA, 22 bp, Homo sapiens
agacctggaagttcaagagaaa

SEQ ID NO: 7930944 - DNA, 22 bp, Homo sapiens
agaccccatacctcagcaggta

SEQ ID NO: 7930945 - DNA, 22 bp, Homo sapiens
agaccccatacctcagcaggta

SEQ ID NO: 7930946 - DNA, 22 bp, Homo sapiens
agacccaggtttcaaactactc

SEQ ID NO: 7930947 - DNA, 22 bp, Homo sapiens
agacccaggtttcaaactactc

SEQ ID NO: 7930948 - DNA, 22 bp, Homo sapiens
agaccccatacctcagcaggta

SEQ ID NO: 7930949 - DNA, 22 bp, Homo sapiens
agaccccatacctcagcaggta

SEQ ID NO: 7930950 - DNA, 22 bp, Homo sapiens
agacccaggcttcatgtgaatc

SEQ ID NO: 7930951 - DNA, 22 bp, Homo sapiens
agacccaggattggggctgccg

SEQ ID NO: 7930952 - DNA, 22 bp, Homo sapiens
agacccaggattggggctgccg

SEQ ID NO: 7930953 - DNA, 22 bp, Homo sapiens
agacctggagacctgagtggta

SEQ ID NO: 7930954 - DNA, 22 bp, Homo sapiens
agacctggaagttcaagagaaa

SEQ ID NO: 7930955 - DNA, 22 bp, Homo sapiens
agacctggaagttcaagagaaa

SEQ ID NO: 7930956 - DNA, 22 bp, Homo sapiens
agacctggagacctgagtggta

SEQ ID NO: 7930957 - DNA, 22 bp, Homo sapiens
agacctggagtgaagagttccc

SEQ ID NO: 7930958 - DNA, 22 bp, Homo sapiens
agacctggagtggggcctcagg

SEQ ID NO: 7930959 - DNA, 22 bp, Homo sapiens
agacctggagtggggcctcagg

SEQ ID NO: 7930960 - DNA, 22 bp, Homo sapiens
agacctggagtgaagagttccc

SEQ ID NO: 7930961 - DNA, 22 bp, Homo sapiens
agacctggagtgaagagttccc

SEQ ID NO: 7930962 - DNA, 22 bp, Homo sapiens
agacctttatttcatgatagga

SEQ ID NO: 7930963 - DNA, 22 bp, Homo sapiens
agacctttgctgcttcttatag

SEQ ID NO: 7930964 - DNA, 22 bp, Homo sapiens
agacctgtgatcacatggaatg

SEQ ID NO: 7930965 - DNA, 22 bp, Homo sapiens
agacctggtttatcaccagcat

SEQ ID NO: 7930966 - DNA, 22 bp, Homo sapiens
agacctggtttatcaccagcat

SEQ ID NO: 7930967 - DNA, 22 bp, Homo sapiens
agacctgttgggttcattggct

SEQ ID NO: 7930968 - DNA, 22 bp, Homo sapiens
agacctggtgatagctgtccta

SEQ ID NO: 7930969 - DNA, 22 bp, Homo sapiens
agacctggtttatcaccagcat

SEQ ID NO: 7930970 - DNA, 22 bp, Homo sapiens
agacctggtttatcaccagcat

SEQ ID NO: 7930971 - DNA, 22 bp, Homo sapiens
agacctggtgatagctgtccta

SEQ ID NO: 7930972 - DNA, 22 bp, Homo sapiens
agacctggtaagcaggttgggc

SEQ ID NO: 7930973 - DNA, 22 bp, Homo sapiens
agacctggatgtgagggaagta

SEQ ID NO: 7930974 - DNA, 22 bp, Homo sapiens
agacctggatgtgagggaagta

SEQ ID NO: 7930975 - DNA, 22 bp, Homo sapiens
agacctggattccaatcctacc

SEQ ID NO: 7930976 - DNA, 22 bp, Homo sapiens
agacctggattccaatcctacc

SEQ ID NO: 7930977 - DNA, 22 bp, Homo sapiens
agacctggatgtgagggaagta

SEQ ID NO: 7930978 - DNA, 22 bp, Homo sapiens
agacctggatgtgagggaagta

SEQ ID NO: 7930979 - DNA, 22 bp, Homo sapiens
agacctggagtggggcctcagg

SEQ ID NO: 7930980 - DNA, 22 bp, Homo sapiens
agacctggagtgaagagttccc

SEQ ID NO: 7930981 - DNA, 22 bp, Homo sapiens
agacctggagtggggcctcagg

SEQ ID NO: 7930982 - DNA, 22 bp, Homo sapiens
agacctggagtggggcctcagg

SEQ ID NO: 7930983 - DNA, 22 bp, Homo sapiens
agacctggagtggggcctcagg

SEQ ID NO: 7930984 - DNA, 22 bp, Homo sapiens
agacctgggtgccctgtgcttt

SEQ ID NO: 7930985 - DNA, 22 bp, Homo sapiens
agacctgggtgccctgtgcttt

SEQ ID NO: 7930986 - DNA, 22 bp, Homo sapiens
agacctgggtgccctgtgcttt

SEQ ID NO: 7930987 - DNA, 22 bp, Homo sapiens
agacctggattccaatcctacc

SEQ ID NO: 7930988 - DNA, 22 bp, Homo sapiens
agacctgggttcgagtcctaac

SEQ ID NO: 7930989 - DNA, 22 bp, Homo sapiens
agacctgggttcgagtcctaac

SEQ ID NO: 7930990 - DNA, 22 bp, Homo sapiens
agacctgggttcgagtcctaac

SEQ ID NO: 7930991 - DNA, 22 bp, Homo sapiens
agacctgggttcgagtcctaac

SEQ ID NO: 7930992 - DNA, 22 bp, Homo sapiens
agactgtaattgacatgtcagc

SEQ ID NO: 7930993 - DNA, 22 bp, Homo sapiens
agactggtttttaacttcacct

SEQ ID NO: 7930994 - DNA, 22 bp, Homo sapiens
agactggggttctggcaaggag

SEQ ID NO: 7930995 - DNA, 22 bp, Homo sapiens
agactggggttctggcaaggag

SEQ ID NO: 7930996 - DNA, 22 bp, Homo sapiens
agactctgattccctcatgtca

SEQ ID NO: 7930997 - DNA, 22 bp, Homo sapiens
atgcgagtgatgcagagtggct

SEQ ID NO: 7930998 - DNA, 22 bp, Homo sapiens
atgcggagccccaagcttgaag

SEQ ID NO: 7930999 - DNA, 22 bp, Homo sapiens
agactctgataagcaactcttg

SEQ ID NO: 7931000 - DNA, 22 bp, Homo sapiens
agactctgattccctcatgtca

SEQ ID NO: 7931001 - DNA, 22 bp, Homo sapiens
agactctgcatttctaataagc

SEQ ID NO: 7931002 - DNA, 22 bp, Homo sapiens
atgcgagtgatgcagagtggct

SEQ ID NO: 7931003 - DNA, 22 bp, Homo sapiens
atgcgagtgatgcagagtggct

SEQ ID NO: 7931004 - DNA, 22 bp, Homo sapiens
atgcctttttatcatggatgat

SEQ ID NO: 7931005 - DNA, 22 bp, Homo sapiens
atgccttttcgggtacttctct

SEQ ID NO: 7931006 - DNA, 22 bp, Homo sapiens
atgccttttccatctcaggcag

SEQ ID NO: 7931007 - DNA, 22 bp, Homo sapiens
atgcctttgttgaccactataa

SEQ ID NO: 7931008 - DNA, 22 bp, Homo sapiens
atgcctttggcattatttcttg

SEQ ID NO: 7931009 - DNA, 22 bp, Homo sapiens
atgcctttggcattatttcttg

SEQ ID NO: 7931010 - DNA, 22 bp, Homo sapiens
atgcctttggagaatccaacat

SEQ ID NO: 7931011 - DNA, 22 bp, Homo sapiens
atgcctttggagaatccaacat

SEQ ID NO: 7931012 - DNA, 22 bp, Homo sapiens
atgcctttctctgtagaaagaa

SEQ ID NO: 7931013 - DNA, 22 bp, Homo sapiens
atgccttattccaacaatctag

SEQ ID NO: 7931014 - DNA, 22 bp, Homo sapiens
atgcctttatcaggaggtaaat

SEQ ID NO: 7931015 - DNA, 22 bp, Homo sapiens
atgcctttcccaacagggtggg

SEQ ID NO: 7931016 - DNA, 22 bp, Homo sapiens
atgcctttctggtgttcttcct

SEQ ID NO: 7931017 - DNA, 22 bp, Homo sapiens
atgcctttcttagccctgaagg

SEQ ID NO: 7931018 - DNA, 22 bp, Homo sapiens
atgcctttgccacagattagga

SEQ ID NO: 7931019 - DNA, 22 bp, Homo sapiens
atgcctttgccacagattagga

SEQ ID NO: 7931020 - DNA, 20 bp, Homo sapiens
atgcctttgatagtcaggct

SEQ ID NO: 7931021 - DNA, 22 bp, Homo sapiens
atgcctttctttggtgcaggtt

SEQ ID NO: 7931022 - DNA, 22 bp, Homo sapiens
atgcctgtgctatattctcaca

SEQ ID NO: 7931023 - DNA, 22 bp, Homo sapiens
atgcctgtaattccagcatttt

SEQ ID NO: 7931024 - DNA, 22 bp, Homo sapiens
atgccttaaggcgagatactta

SEQ ID NO: 7931025 - DNA, 22 bp, Homo sapiens
atgccttattccaacaatctag

SEQ ID NO: 7931026 - DNA, 22 bp, Homo sapiens
atgccttatagtccacagtgga

SEQ ID NO: 7931027 - DNA, 22 bp, Homo sapiens
atgccttaaggcgagatactta

SEQ ID NO: 7931028 - DNA, 22 bp, Homo sapiens
atgccttaaggcgagatactta

SEQ ID NO: 7931029 - DNA, 22 bp, Homo sapiens
atgccttatagtccacagtgga

SEQ ID NO: 7931030 - DNA, 22 bp, Homo sapiens
atgcctttaagagatactgagg

SEQ ID NO: 7931031 - DNA, 22 bp, Homo sapiens
atgccttattgtaatctttcca

SEQ ID NO: 7931032 - DNA, 22 bp, Homo sapiens
atgccttattgtaatctttcca

SEQ ID NO: 7931033 - DNA, 22 bp, Homo sapiens
atgccttatggtgaattagttc

SEQ ID NO: 7931034 - DNA, 22 bp, Homo sapiens
atgccttattccaacaatctag

SEQ ID NO: 7931035 - DNA, 22 bp, Homo sapiens
atgcctttaagagatactgagg

SEQ ID NO: 7931036 - DNA, 22 bp, Homo sapiens
atgcctttaagagatactgagg

SEQ ID NO: 7931037 - DNA, 22 bp, Homo sapiens
atgcctttaagagatactgagg

SEQ ID NO: 7931038 - DNA, 22 bp, Homo sapiens
atgcctggtcccacctctaggt

SEQ ID NO: 7931039 - DNA, 22 bp, Homo sapiens
atgcctggtcccacctctaggt

SEQ ID NO: 7931040 - DNA, 22 bp, Homo sapiens
atgcctgtaatcccagtgcttt

SEQ ID NO: 7931041 - DNA, 22 bp, Homo sapiens
agacgagggcccccaggacagc

SEQ ID NO: 7931042 - DNA, 22 bp, Homo sapiens
agacgagggcccccaggacagc

SEQ ID NO: 7931043 - DNA, 22 bp, Homo sapiens
atgcctggtatgaagcaaggaa

SEQ ID NO: 7931044 - DNA, 22 bp, Homo sapiens
agacgcagatttatttcagttt

SEQ ID NO: 7931045 - DNA, 22 bp, Homo sapiens
atgcctggtatgaagcaaggaa

SEQ ID NO: 7931046 - DNA, 22 bp, Homo sapiens
agacgcgcagaaggaagcggcc

SEQ ID NO: 7931047 - DNA, 22 bp, Homo sapiens
agacgcagatttatttcagttt

SEQ ID NO: 7931048 - DNA, 22 bp, Homo sapiens
agaatattcatctgtattctta

SEQ ID NO: 7931049 - DNA, 22 bp, Homo sapiens
agaatattcatctgtattctta

SEQ ID NO: 7931050 - DNA, 22 bp, Homo sapiens
agaatattcatctgtattctta

SEQ ID NO: 7931051 - DNA, 22 bp, Homo sapiens
agaatattgaaagttcttgaca

SEQ ID NO: 7931052 - DNA, 22 bp, Homo sapiens
agaatatgatggttggagaatt

SEQ ID NO: 7931053 - DNA, 22 bp, Homo sapiens
agaatatgattcagaccattag

SEQ ID NO: 7931054 - DNA, 22 bp, Homo sapiens
agaatattcatctgtattctta

SEQ ID NO: 7931055 - DNA, 22 bp, Homo sapiens
agaatattcatctgtattctta

SEQ ID NO: 7931056 - DNA, 22 bp, Homo sapiens
agaatatatgactgcaagacta

SEQ ID NO: 7931057 - DNA, 22 bp, Homo sapiens
agaatatatgactgcaagacta

SEQ ID NO: 7931058 - DNA, 22 bp, Homo sapiens
agaatatcgtagcatattatct

SEQ ID NO: 7931059 - DNA, 22 bp, Homo sapiens
agaatatatgactgcaagacta

SEQ ID NO: 7931060 - DNA, 22 bp, Homo sapiens
agaatatgatcggaatacagat

SEQ ID NO: 7931061 - DNA, 22 bp, Homo sapiens
agaatatgaggaaactgtgaat

SEQ ID NO: 7931062 - DNA, 22 bp, Homo sapiens
agaatatgatcggaatacagat

SEQ ID NO: 7931063 - DNA, 22 bp, Homo sapiens
agaatatagttaccaaattctg

SEQ ID NO: 7931064 - DNA, 22 bp, Homo sapiens
agaatatagttaccaaattctg

SEQ ID NO: 7931065 - DNA, 22 bp, Homo sapiens
agaatatagttaccaaattctg

SEQ ID NO: 7931066 - DNA, 22 bp, Homo sapiens
agaatatagttaccaaattctg

SEQ ID NO: 7931067 - DNA, 22 bp, Homo sapiens
agaatatagttaccaaattctg

SEQ ID NO: 7931068 - DNA, 22 bp, Homo sapiens
atgaagttccagtatatgcagt

SEQ ID NO: 7931069 - DNA, 22 bp, Homo sapiens
atgaagttctagtgagaaatgc

SEQ ID NO: 7931070 - DNA, 22 bp, Homo sapiens
atgaagttctagtgagaaatgc

SEQ ID NO: 7931071 - DNA, 22 bp, Homo sapiens
atgaagttctcaataatcatgt

SEQ ID NO: 7931072 - DNA, 22 bp, Homo sapiens
atgaagttctagtgagaaatgc

SEQ ID NO: 7931073 - DNA, 22 bp, Homo sapiens
atgaagctgtttattttagcag

SEQ ID NO: 7931074 - DNA, 22 bp, Homo sapiens
atgaagctgaggttctctttga

SEQ ID NO: 7931075 - DNA, 22 bp, Homo sapiens
atgaagctgaaaaaggcatata

SEQ ID NO: 7931076 - DNA, 22 bp, Homo sapiens
atgaaggatggctggctgccct

SEQ ID NO: 7931077 - DNA, 22 bp, Homo sapiens
atgaaggacaacaggggagcag

SEQ ID NO: 7931078 - DNA, 22 bp, Homo sapiens
atgaaggatggctggctgccct

SEQ ID NO: 7931079 - DNA, 19 bp, Homo sapiens
atgaaggcactgagtggga

SEQ ID NO: 7931080 - DNA, 19 bp, Homo sapiens
atgaaggcactgagtggga

SEQ ID NO: 7931081 - DNA, 22 bp, Homo sapiens
atgaaggcaagactgaggtgtg

SEQ ID NO: 7931082 - DNA, 22 bp, Homo sapiens
atgaaggcagttaaacgtcatc

SEQ ID NO: 7931083 - DNA, 21 bp, Homo sapiens
atgaaggcagtgccaagggct

SEQ ID NO: 7931084 - DNA, 22 bp, Homo sapiens
atgaaggcagttttataagatt

SEQ ID NO: 7931085 - DNA, 21 bp, Homo sapiens
atgaaggcagtgccaagggct

SEQ ID NO: 7931086 - DNA, 22 bp, Homo sapiens
atgaaggccaggcttcagtgtg

SEQ ID NO: 7931087 - DNA, 22 bp, Homo sapiens
atgaaggccaggcttcagtgtg

SEQ ID NO: 7931088 - DNA, 22 bp, Homo sapiens
atgaaggctgtgtagatggatg

SEQ ID NO: 7931089 - DNA, 22 bp, Homo sapiens
atgaaggctgtgtggagccccc

SEQ ID NO: 7931090 - DNA, 21 bp, Homo sapiens
atgaagtctatgcttctgtgt

SEQ ID NO: 7931091 - DNA, 22 bp, Homo sapiens
atgaagtctatttacctaagct

SEQ ID NO: 7931092 - DNA, 20 bp, Homo sapiens
atgaagtccccatctgatgt

SEQ ID NO: 7931093 - DNA, 22 bp, Homo sapiens
atgaagggtgtccctgtgagca

SEQ ID NO: 7931094 - DNA, 17 bp, Homo sapiens
atctgcttcacccagca

SEQ ID NO: 7931095 - DNA, 22 bp, Homo sapiens
atctgcttcctccttagggaaa

SEQ ID NO: 7931096 - DNA, 22 bp, Homo sapiens
atctgcttcctgggctccatga

SEQ ID NO: 7931097 - DNA, 22 bp, Homo sapiens
atctgcttgaaacttcttatac

SEQ ID NO: 7931098 - DNA, 22 bp, Homo sapiens
atctgcttcgcgccaatttcat

SEQ ID NO: 7931099 - DNA, 22 bp, Homo sapiens
atctgcttgaaacttcttatac

SEQ ID NO: 7931100 - DNA, 22 bp, Homo sapiens
atctgcttgagtttgaagtcag

SEQ ID NO: 7931101 - DNA, 22 bp, Homo sapiens
atctgcttgagtttgaagtcag

SEQ ID NO: 7931102 - DNA, 22 bp, Homo sapiens
atctgcttgagtttgaagtcag

SEQ ID NO: 7931103 - DNA, 22 bp, Homo sapiens
atctgcttgaatgagcaacagg

SEQ ID NO: 7931104 - DNA, 22 bp, Homo sapiens
atctgcttgcaggctggccctt

SEQ ID NO: 7931105 - DNA, 22 bp, Homo sapiens
atctgcttgcaggctggccctt

SEQ ID NO: 7931106 - DNA, 22 bp, Homo sapiens
atctgcttgcaggctggccctt

SEQ ID NO: 7931107 - DNA, 22 bp, Homo sapiens
atctgcttgagtttgaagtcag

SEQ ID NO: 7931108 - DNA, 22 bp, Homo sapiens
atgaacaatgactacatattga

SEQ ID NO: 7931109 - DNA, 22 bp, Homo sapiens
atctgcttgccctcttaggacc

SEQ ID NO: 7931110 - DNA, 22 bp, Homo sapiens
atctgcttgccctcttaggacc

SEQ ID NO: 7931111 - DNA, 20 bp, Homo sapiens
atctgcttgcctgtcctcgg

SEQ ID NO: 7931112 - DNA, 22 bp, Homo sapiens
atgaagcgttcgagataggtag

SEQ ID NO: 7931113 - DNA, 22 bp, Homo sapiens
atgaagcgttcgagataggtag

SEQ ID NO: 7931114 - DNA, 22 bp, Homo sapiens
atgaagcgttcgagataggtag

SEQ ID NO: 7931115 - DNA, 22 bp, Homo sapiens
atgaagcattacaggatgacag

SEQ ID NO: 7931116 - DNA, 19 bp, Homo sapiens
atgaagcattgtttttgta

SEQ ID NO: 7931117 - DNA, 22 bp, Homo sapiens
atctgcctgcagtggaggtggg

SEQ ID NO: 7931118 - DNA, 22 bp, Homo sapiens
atctgcctcttcttcattgcga

SEQ ID NO: 7931119 - DNA, 22 bp, Homo sapiens
atctgcctggctccaggtgagc

SEQ ID NO: 7931120 - DNA, 22 bp, Homo sapiens
atctgcctgcttatgatgcctg

SEQ ID NO: 7931121 - DNA, 22 bp, Homo sapiens
atctgcctggtctttgatgcag

SEQ ID NO: 7931122 - DNA, 22 bp, Homo sapiens
atctgcctggtctttgatgcag

SEQ ID NO: 7931123 - DNA, 22 bp, Homo sapiens
atctgcttagaattcattgtcc

SEQ ID NO: 7931124 - DNA, 22 bp, Homo sapiens
atctgctggcatctctagccca

SEQ ID NO: 7931125 - DNA, 19 bp, Homo sapiens
agacaagtttccagaagcc

SEQ ID NO: 7931126 - DNA, 19 bp, Homo sapiens
agacaagtttccagaagcc

SEQ ID NO: 7931127 - DNA, 22 bp, Homo sapiens
agacacattttacattaactgt

SEQ ID NO: 7931128 - DNA, 22 bp, Homo sapiens
agacaagttctgtgggtcacct

SEQ ID NO: 7931129 - DNA, 22 bp, Homo sapiens
agacaaggctggagtttaggca

SEQ ID NO: 7931130 - DNA, 22 bp, Homo sapiens
agacaagtgtggtgagagcagt

SEQ ID NO: 7931131 - DNA, 22 bp, Homo sapiens
agacacattttacattaactgt

SEQ ID NO: 7931132 - DNA, 22 bp, Homo sapiens
agacactgtgtacagaaaaaga

SEQ ID NO: 7931133 - DNA, 22 bp, Homo sapiens
agacactgtgtacagaaaaaga

SEQ ID NO: 7931134 - DNA, 22 bp, Homo sapiens
agacaatacatttattcccttt

SEQ ID NO: 7931135 - DNA, 22 bp, Homo sapiens
agacagaaataggagaaaccag

SEQ ID NO: 7931136 - DNA, 22 bp, Homo sapiens
agacagaaataggagaaaccag

SEQ ID NO: 7931137 - DNA, 22 bp, Homo sapiens
agacagaacagaataattgttg

SEQ ID NO: 7931138 - DNA, 21 bp, Homo sapiens
agacagaacaactgctctcca

SEQ ID NO: 7931139 - DNA, 21 bp, Homo sapiens
agacagaacaactgctctcca

SEQ ID NO: 7931140 - DNA, 21 bp, Homo sapiens
agacagaacaactgctctcca

SEQ ID NO: 7931141 - DNA, 22 bp, Homo sapiens
agacacttcatgtaagtggaat

SEQ ID NO: 7931142 - DNA, 22 bp, Homo sapiens
agacacttggcagagagctgtt

SEQ ID NO: 7931143 - DNA, 22 bp, Homo sapiens
agacactgtgtacagaaaaaga

SEQ ID NO: 7931144 - DNA, 22 bp, Homo sapiens
agacactgttctcacatgcttg

SEQ ID NO: 7931145 - DNA, 22 bp, Homo sapiens
agacactgttctcacatgcttg

SEQ ID NO: 7931146 - DNA, 22 bp, Homo sapiens
agacactgttctcacatgcttg

SEQ ID NO: 7931147 - DNA, 22 bp, Homo sapiens
agacactgttctcacatgcttg

SEQ ID NO: 7931148 - DNA, 22 bp, Homo sapiens
agacaagactaggcagttgttg

SEQ ID NO: 7931149 - DNA, 22 bp, Homo sapiens
agacaagaaactgggagtctct

SEQ ID NO: 7931150 - DNA, 22 bp, Homo sapiens
agacaactgcagagcaaagaat

SEQ ID NO: 7931151 - DNA, 22 bp, Homo sapiens
agacaactgcagagcaaagaat

SEQ ID NO: 7931152 - DNA, 22 bp, Homo sapiens
agacaagagctgaggacatatt

SEQ ID NO: 7931153 - DNA, 22 bp, Homo sapiens
agacaagagctgaggacatatt

SEQ ID NO: 7931154 - DNA, 22 bp, Homo sapiens
agacaaggaatgtagcttactc

SEQ ID NO: 7931155 - DNA, 22 bp, Homo sapiens
agacaaggcaaggcggccagat

SEQ ID NO: 7931156 - DNA, 22 bp, Homo sapiens
agacaaggcaaggcggccagat

SEQ ID NO: 7931157 - DNA, 22 bp, Homo sapiens
agacaaatttcctgcaatgaag

SEQ ID NO: 7931158 - DNA, 22 bp, Homo sapiens
agacaaatttcctgcaatgaag

SEQ ID NO: 7931159 - DNA, 22 bp, Homo sapiens
agacaaatttgttttcctgtct

SEQ ID NO: 7931160 - DNA, 22 bp, Homo sapiens
agacaacaccaaatgctagtgt

SEQ ID NO: 7931161 - DNA, 22 bp, Homo sapiens
agacaacaccaaatgctagtgt

SEQ ID NO: 7931162 - DNA, 22 bp, Homo sapiens
agacaacatgatcagcagtcct

SEQ ID NO: 7931163 - DNA, 22 bp, Homo sapiens
agacaactagaaaactagacag

SEQ ID NO: 7931164 - DNA, 22 bp, Homo sapiens
agacaactagaaaactagacag

SEQ ID NO: 7931165 - DNA, 22 bp, Homo sapiens
agacaacatcactaaagctgag

SEQ ID NO: 7931166 - DNA, 22 bp, Homo sapiens
agacaacatcactaaagctgag

SEQ ID NO: 7931167 - DNA, 22 bp, Homo sapiens
agacaacatcactaaagctgag

SEQ ID NO: 7931168 - DNA, 22 bp, Homo sapiens
agacaacatctagtttggtgga

SEQ ID NO: 7931169 - DNA, 22 bp, Homo sapiens
agacaacatctagtttggtgga

SEQ ID NO: 7931170 - DNA, 22 bp, Homo sapiens
atgaggcacgtgttactggcct

SEQ ID NO: 7931171 - DNA, 22 bp, Homo sapiens
atgaggcacttaaaagtgaaga

SEQ ID NO: 7931172 - DNA, 22 bp, Homo sapiens
atgaggcacttaaaagtgaaga

SEQ ID NO: 7931173 - DNA, 22 bp, Homo sapiens
atgaggcacgtgttactggcct

SEQ ID NO: 7931174 - DNA, 22 bp, Homo sapiens
atgaggcagagggctgtgccag

SEQ ID NO: 7931175 - DNA, 22 bp, Homo sapiens
atgaggccagaccactctgcat

SEQ ID NO: 7931176 - DNA, 22 bp, Homo sapiens
atgaggcagaaaaaagtcggag

SEQ ID NO: 7931177 - DNA, 20 bp, Homo sapiens
atgaggccagcagggctcag

SEQ ID NO: 7931178 - DNA, 22 bp, Homo sapiens
atgaggccagggtgccatgaaa

SEQ ID NO: 7931179 - DNA, 22 bp, Homo sapiens
atgaggccagggtgccatgaaa

SEQ ID NO: 7931180 - DNA, 22 bp, Homo sapiens
agaatattgaaagttcttgaca

SEQ ID NO: 7931181 - DNA, 22 bp, Homo sapiens
agaatattcatctgtattctta

SEQ ID NO: 7931182 - DNA, 22 bp, Homo sapiens
agaatatgatcggaatacagat

SEQ ID NO: 7931183 - DNA, 22 bp, Homo sapiens
agaatattgaaagttcttgaca

SEQ ID NO: 7931184 - DNA, 22 bp, Homo sapiens
agaatcaaagagaaatactttg

SEQ ID NO: 7931185 - DNA, 22 bp, Homo sapiens
agaatcaaagagaaatactttg

SEQ ID NO: 7931186 - DNA, 22 bp, Homo sapiens
agaatattgaaagttcttgaca

SEQ ID NO: 7931187 - DNA, 22 bp, Homo sapiens
agaatcaaagagaaatactttg

SEQ ID NO: 7931188 - DNA, 22 bp, Homo sapiens
agaatcaaggtgaagcccacag

SEQ ID NO: 7931189 - DNA, 22 bp, Homo sapiens
agaatcaactgaaaattggtga

SEQ ID NO: 7931190 - DNA, 22 bp, Homo sapiens
atgaggctctcaggggagctgt

SEQ ID NO: 7931191 - DNA, 22 bp, Homo sapiens
atgaggctctcaggggagctgt

SEQ ID NO: 7931192 - DNA, 22 bp, Homo sapiens
atgaggcttaaactgctgcaac

SEQ ID NO: 7931193 - DNA, 22 bp, Homo sapiens
atgaggctgaaacacagaggct

SEQ ID NO: 7931194 - DNA, 22 bp, Homo sapiens
atgaggctgaaacacagaggct

SEQ ID NO: 7931195 - DNA, 22 bp, Homo sapiens
atgaggcttaaactgctgcaac

SEQ ID NO: 7931196 - DNA, 22 bp, Homo sapiens
atgaggcttaaactgctgcaac

SEQ ID NO: 7931197 - DNA, 22 bp, Homo sapiens
atgaggcttaaactgctgcaac

SEQ ID NO: 7931198 - DNA, 22 bp, Homo sapiens
agacaaatttcctgcaatgaag

SEQ ID NO: 7931199 - DNA, 22 bp, Homo sapiens
agacaaatttcctgcaatgaag

SEQ ID NO: 7931200 - DNA, 22 bp, Homo sapiens
agacaaatttcctgcaatgaag

SEQ ID NO: 7931201 - DNA, 22 bp, Homo sapiens
agacaaatttcctgcaatgaag

SEQ ID NO: 7931202 - DNA, 22 bp, Homo sapiens
atgagggaggggtggtgccgca

SEQ ID NO: 7931203 - DNA, 22 bp, Homo sapiens
atgagggaggcaaggagatgct

SEQ ID NO: 7931204 - DNA, 22 bp, Homo sapiens
atgagggaggcaaggagatgct

SEQ ID NO: 7931205 - DNA, 22 bp, Homo sapiens
atgaggcctttcttcacccttt

SEQ ID NO: 7931206 - DNA, 22 bp, Homo sapiens
atgaggcctatcttggcagagg

SEQ ID NO: 7931207 - DNA, 22 bp, Homo sapiens
atgaggctatgaatggggagat

SEQ ID NO: 7931208 - DNA, 22 bp, Homo sapiens
atgaggctatgaatggggagat

SEQ ID NO: 7931209 - DNA, 22 bp, Homo sapiens
atgaggctctcaacaccttgag

SEQ ID NO: 7931210 - DNA, 22 bp, Homo sapiens
atgaggctatttcatagatttt

SEQ ID NO: 7931211 - DNA, 22 bp, Homo sapiens
atgaggcccaggaatctgtatt

SEQ ID NO: 7931212 - DNA, 22 bp, Homo sapiens
atgaggcccaaacattacaaat

SEQ ID NO: 7931213 - DNA, 22 bp, Homo sapiens
atgaggccatggctgtcactaa

SEQ ID NO: 7931214 - DNA, 22 bp, Homo sapiens
agagcagatggccagggggcct

SEQ ID NO: 7931215 - DNA, 22 bp, Homo sapiens
agagcagatggccagggggcct

SEQ ID NO: 7931216 - DNA, 22 bp, Homo sapiens
agagcagatggccagggggcct

SEQ ID NO: 7931217 - DNA, 22 bp, Homo sapiens
agagcagatggccagggggcct

SEQ ID NO: 7931218 - DNA, 22 bp, Homo sapiens
agagcagatggagctggaagag

SEQ ID NO: 7931219 - DNA, 22 bp, Homo sapiens
agagcagatggagctggaagag

SEQ ID NO: 7931220 - DNA, 22 bp, Homo sapiens
agagcagatggagctggaagag

SEQ ID NO: 7931221 - DNA, 22 bp, Homo sapiens
agagcagatggagctggaagag

SEQ ID NO: 7931222 - DNA, 22 bp, Homo sapiens
agagcagatggagctggaagag

SEQ ID NO: 7931223 - DNA, 22 bp, Homo sapiens
agagcagatggagctggaagag

SEQ ID NO: 7931224 - DNA, 22 bp, Homo sapiens
agagcagatggagctggaagag

SEQ ID NO: 7931225 - DNA, 22 bp, Homo sapiens
agagccaggcaggcaatgttga

SEQ ID NO: 7931226 - DNA, 22 bp, Homo sapiens
agagcagcctcagctccctgtg

SEQ ID NO: 7931227 - DNA, 22 bp, Homo sapiens
agagcagcctcagctccctgtg

SEQ ID NO: 7931228 - DNA, 22 bp, Homo sapiens
agagcagcctcagctccctgtg

SEQ ID NO: 7931229 - DNA, 20 bp, Homo sapiens
agagcagcagttggtgaggt

SEQ ID NO: 7931230 - DNA, 20 bp, Homo sapiens
agagcagcagttggtgaggt

SEQ ID NO: 7931231 - DNA, 22 bp, Homo sapiens
agagcagcacgttgtccccaca

SEQ ID NO: 7931232 - DNA, 22 bp, Homo sapiens
agagcagcacgttgtccccaca

SEQ ID NO: 7931233 - DNA, 20 bp, Homo sapiens
agagcagcagttggtgaggt

SEQ ID NO: 7931234 - DNA, 22 bp, Homo sapiens
agagcagatttcaaatattggc

SEQ ID NO: 7931235 - DNA, 22 bp, Homo sapiens
agagcagatttcaaatattggc

SEQ ID NO: 7931236 - DNA, 22 bp, Homo sapiens
agagcagatttcaaatattggc

SEQ ID NO: 7931237 - DNA, 22 bp, Homo sapiens
agagcagatggccagggggcct

SEQ ID NO: 7931238 - DNA, 22 bp, Homo sapiens
agagcagatggccagggggcct

SEQ ID NO: 7931239 - DNA, 22 bp, Homo sapiens
agagcagatggccagggggcct

SEQ ID NO: 7931240 - DNA, 22 bp, Homo sapiens
agagcagatggccagggggcct

SEQ ID NO: 7931241 - DNA, 22 bp, Homo sapiens
agagccaggccaggccggggca

SEQ ID NO: 7931242 - DNA, 22 bp, Homo sapiens
agagccaggccaggccggggca

SEQ ID NO: 7931243 - DNA, 22 bp, Homo sapiens
agagccaggccaggccggggca

SEQ ID NO: 7931244 - DNA, 22 bp, Homo sapiens
agagccaggccaggccggggca

SEQ ID NO: 7931245 - DNA, 22 bp, Homo sapiens
agagccaggcaggcaatgttga

SEQ ID NO: 7931246 - DNA, 22 bp, Homo sapiens
agagccaggccaggccggggca

SEQ ID NO: 7931247 - DNA, 22 bp, Homo sapiens
agagcccaggtcctggagaggg

SEQ ID NO: 7931248 - DNA, 22 bp, Homo sapiens
agagcccaggcaggcatccagg

SEQ ID NO: 7931249 - DNA, 22 bp, Homo sapiens
agagcccagaaagtatgtcata

SEQ ID NO: 7931250 - DNA, 20 bp, Homo sapiens
agagcccagatgtctgtatt

SEQ ID NO: 7931251 - DNA, 20 bp, Homo sapiens
agagcccagatgtctgtatt

SEQ ID NO: 7931252 - DNA, 22 bp, Homo sapiens
agagcccatcagtggcagtgga

SEQ ID NO: 7931253 - DNA, 22 bp, Homo sapiens
agagcccatcagtggcagtgga

SEQ ID NO: 7931254 - DNA, 22 bp, Homo sapiens
agagcccatcagtggcagtgga

SEQ ID NO: 7931255 - DNA, 22 bp, Homo sapiens
agagcccatcagtggcagtgga

SEQ ID NO: 7931256 - DNA, 22 bp, Homo sapiens
agagcccatcagtggcagtgga

SEQ ID NO: 7931257 - DNA, 22 bp, Homo sapiens
agagcccagtgacatcagcaca

SEQ ID NO: 7931258 - DNA, 22 bp, Homo sapiens
agagcccctggtggagtgagaa

SEQ ID NO: 7931259 - DNA, 22 bp, Homo sapiens
agagcccctggtggagtgagaa

SEQ ID NO: 7931260 - DNA, 22 bp, Homo sapiens
agagcccctggtggagtgagaa

SEQ ID NO: 7931261 - DNA, 22 bp, Homo sapiens
agagcagatggagctggaagag

SEQ ID NO: 7931262 - DNA, 22 bp, Homo sapiens
agagcagatggagctggaagag

SEQ ID NO: 7931263 - DNA, 22 bp, Homo sapiens
agagcagagtggctgtagcttg

SEQ ID NO: 7931264 - DNA, 22 bp, Homo sapiens
agagcagagggctctgggacaa

SEQ ID NO: 7931265 - DNA, 22 bp, Homo sapiens
agagcagagtggctgtagcttg

SEQ ID NO: 7931266 - DNA, 22 bp, Homo sapiens
agagcagagtggctgtagcttg

SEQ ID NO: 7931267 - DNA, 22 bp, Homo sapiens
agagcagagtggctgtagcttg

SEQ ID NO: 7931268 - DNA, 22 bp, Homo sapiens
agagcagagggctctgggacaa

SEQ ID NO: 7931269 - DNA, 22 bp, Homo sapiens
agagcagagggctctgggacaa

SEQ ID NO: 7931270 - DNA, 22 bp, Homo sapiens
agagcagagggctctgggacaa

SEQ ID NO: 7931271 - DNA, 22 bp, Homo sapiens
agagcagagggctctgggacaa

SEQ ID NO: 7931272 - DNA, 22 bp, Homo sapiens
agagcagagggctctgggacaa

SEQ ID NO: 7931273 - DNA, 22 bp, Homo sapiens
agagcagagggctctgggacaa

SEQ ID NO: 7931274 - DNA, 22 bp, Homo sapiens
agagcagaggcatggccgtggg

SEQ ID NO: 7931275 - DNA, 22 bp, Homo sapiens
agagcagaggcatggccgtggg

SEQ ID NO: 7931276 - DNA, 22 bp, Homo sapiens
agagcagaggcatggccgtggg

SEQ ID NO: 7931277 - DNA, 22 bp, Homo sapiens
agagcagaggcatggccgtggg

SEQ ID NO: 7931278 - DNA, 22 bp, Homo sapiens
agagcagacatccttgtcttgt

SEQ ID NO: 7931279 - DNA, 22 bp, Homo sapiens
agagcagaggcatggccgtggg

SEQ ID NO: 7931280 - DNA, 22 bp, Homo sapiens
agagcagacatccttgtcttgt

SEQ ID NO: 7931281 - DNA, 22 bp, Homo sapiens
agagcagacatccttgtcttgt

SEQ ID NO: 7931282 - DNA, 22 bp, Homo sapiens
agagcactttcgagagccggag

SEQ ID NO: 7931283 - DNA, 22 bp, Homo sapiens
agagcactttcgagagccggag

SEQ ID NO: 7931284 - DNA, 22 bp, Homo sapiens
agagcactttcgagagccggag

SEQ ID NO: 7931285 - DNA, 22 bp, Homo sapiens
agagcactgctgatttacagtc

SEQ ID NO: 7931286 - DNA, 22 bp, Homo sapiens
agagcaccccgggaagagcaag

SEQ ID NO: 7931287 - DNA, 22 bp, Homo sapiens
agagcacagtgcaggatccccg

SEQ ID NO: 7931288 - DNA, 22 bp, Homo sapiens
agagcactgagtgagcaaggcc

SEQ ID NO: 7931289 - DNA, 22 bp, Homo sapiens
agagcactgagtgagcaaggcc

SEQ ID NO: 7931290 - DNA, 22 bp, Homo sapiens
agagcactgcgccggctcggaa

SEQ ID NO: 7931291 - DNA, 22 bp, Homo sapiens
agagcactgcgccggctcggaa

SEQ ID NO: 7931292 - DNA, 22 bp, Homo sapiens
agagcacggccaccatttacaa

SEQ ID NO: 7931293 - DNA, 22 bp, Homo sapiens
agagattgctagctggctttaa

SEQ ID NO: 7931294 - DNA, 22 bp, Homo sapiens
agagagttgaggaagcaacact

SEQ ID NO: 7931295 - DNA, 22 bp, Homo sapiens
agagagtctttctcttcctgtt

SEQ ID NO: 7931296 - DNA, 22 bp, Homo sapiens
agagaggtttgctggaagattc

SEQ ID NO: 7931297 - DNA, 22 bp, Homo sapiens
agagatttacacatgccttttc

SEQ ID NO: 7931298 - DNA, 22 bp, Homo sapiens
agagcacaggctcaccattgtt

SEQ ID NO: 7931299 - DNA, 22 bp, Homo sapiens
agagcacaggctcaccattgtt

SEQ ID NO: 7931300 - DNA, 22 bp, Homo sapiens
agagcacaggctctggagtcta

SEQ ID NO: 7931301 - DNA, 22 bp, Homo sapiens
agagcacaggctcaccattgtt

SEQ ID NO: 7931302 - DNA, 22 bp, Homo sapiens
agagcacaggctctggagtcta

SEQ ID NO: 7931303 - DNA, 22 bp, Homo sapiens
agagcacaggctctggagtcta

SEQ ID NO: 7931304 - DNA, 22 bp, Homo sapiens
agagcacagggttttgtgccgg

SEQ ID NO: 7931305 - DNA, 22 bp, Homo sapiens
agagcacagggttttgtgccgg

SEQ ID NO: 7931306 - DNA, 21 bp, Homo sapiens
agagcacaggtggacaatgct

SEQ ID NO: 7931307 - DNA, 21 bp, Homo sapiens
agagcacaggtggacaatgct

SEQ ID NO: 7931308 - DNA, 22 bp, Homo sapiens
agagcacaggtgctggagccca

SEQ ID NO: 7931309 - DNA, 22 bp, Homo sapiens
agagcacaggtgctggagccca

SEQ ID NO: 7931310 - DNA, 21 bp, Homo sapiens
agagcacaggtggacaatgct

SEQ ID NO: 7931311 - DNA, 22 bp, Homo sapiens
agagcacagtatctgcacatca

SEQ ID NO: 7931312 - DNA, 22 bp, Homo sapiens
agagcacagtatctgcacatca

SEQ ID NO: 7931313 - DNA, 22 bp, Homo sapiens
agagcacagtatctgcacatca

SEQ ID NO: 7931314 - DNA, 22 bp, Homo sapiens
agagcacagtatctgcacatca

SEQ ID NO: 7931315 - DNA, 22 bp, Homo sapiens
agagcacagtatctgcacatca

SEQ ID NO: 7931316 - DNA, 22 bp, Homo sapiens
agagcacagtgcaggatccccg

SEQ ID NO: 7931317 - DNA, 22 bp, Homo sapiens
agagcacagtgcaggatccccg

SEQ ID NO: 7931318 - DNA, 21 bp, Homo sapiens
agagcctgagatcttccagca

SEQ ID NO: 7931319 - DNA, 22 bp, Homo sapiens
agagcctgagcctgaaagccct

SEQ ID NO: 7931320 - DNA, 21 bp, Homo sapiens
agagcctgagatcttccagca

SEQ ID NO: 7931321 - DNA, 21 bp, Homo sapiens
agagcctgagatcttccagca

SEQ ID NO: 7931322 - DNA, 22 bp, Homo sapiens
agagcctgagaggataatgggg

SEQ ID NO: 7931323 - DNA, 22 bp, Homo sapiens
agagcctgagaggataatgggg

SEQ ID NO: 7931324 - DNA, 22 bp, Homo sapiens
agagcctgagaggataatgggg

SEQ ID NO: 7931325 - DNA, 22 bp, Homo sapiens
agagcctgagaggataatgggg

SEQ ID NO: 7931326 - DNA, 23 bp, Homo sapiens
agagcctgaaagacttctggcac

SEQ ID NO: 7931327 - DNA, 22 bp, Homo sapiens
agagcctgagcctgatcttgaa

SEQ ID NO: 7931328 - DNA, 22 bp, Homo sapiens
agagcctgagcctgatcttgaa

SEQ ID NO: 7931329 - DNA, 22 bp, Homo sapiens
agagcctgagcctgatcttgaa

SEQ ID NO: 7931330 - DNA, 22 bp, Homo sapiens
agagcctgagcctgaaagccct

SEQ ID NO: 7931331 - DNA, 22 bp, Homo sapiens
agagcctgagcctgaaagccct

SEQ ID NO: 7931332 - DNA, 22 bp, Homo sapiens
agagcctgagcctgaaagccct

SEQ ID NO: 7931333 - DNA, 22 bp, Homo sapiens
agagcctgagcctgaaagccct

SEQ ID NO: 7931334 - DNA, 22 bp, Homo sapiens
agagcctgaggatgtcccagct

SEQ ID NO: 7931335 - DNA, 22 bp, Homo sapiens
agagcctgaggatgtcccagct

SEQ ID NO: 7931336 - DNA, 22 bp, Homo sapiens
agagcctgaggccaggaaaatg

SEQ ID NO: 7931337 - DNA, 22 bp, Homo sapiens
agagcctgaggatgtcccagct

SEQ ID NO: 7931338 - DNA, 22 bp, Homo sapiens
agagctctttgatttgcttctc

SEQ ID NO: 7931339 - DNA, 22 bp, Homo sapiens
agagctctttgatttgcttctc

SEQ ID NO: 7931340 - DNA, 22 bp, Homo sapiens
agagctctttgatttgcttctc

SEQ ID NO: 7931341 - DNA, 22 bp, Homo sapiens
agagcctgcagctgtgaagaaa

SEQ ID NO: 7931342 - DNA, 22 bp, Homo sapiens
agagcctgcagctgtgaagaaa

SEQ ID NO: 7931343 - DNA, 22 bp, Homo sapiens
agagcctgcagctgtgaagaaa

SEQ ID NO: 7931344 - DNA, 22 bp, Homo sapiens
agagcctgaggtctaacagggg

SEQ ID NO: 7931345 - DNA, 22 bp, Homo sapiens
agagcctgaggtctaacagggg

SEQ ID NO: 7931346 - DNA, 22 bp, Homo sapiens
agagcctgaggccctgagaggg

SEQ ID NO: 7931347 - DNA, 22 bp, Homo sapiens
agagcctgaggccctgagaggg

SEQ ID NO: 7931348 - DNA, 22 bp, Homo sapiens
agagcctgaggccctgagaggg

SEQ ID NO: 7931349 - DNA, 22 bp, Homo sapiens
agagcctgaggccctgagaggg

SEQ ID NO: 7931350 - DNA, 22 bp, Homo sapiens
agagcctgaggccctgagaggg

SEQ ID NO: 7931351 - DNA, 22 bp, Homo sapiens
agagcctgaggccctgagaggg

SEQ ID NO: 7931352 - DNA, 22 bp, Homo sapiens
agagcctgaggccaggaaaatg

SEQ ID NO: 7931353 - DNA, 22 bp, Homo sapiens
agagcctgaggccaggaaaatg

SEQ ID NO: 7931354 - DNA, 22 bp, Homo sapiens
agagccctgcagttcttcagga

SEQ ID NO: 7931355 - DNA, 22 bp, Homo sapiens
agagccctgcagttcttcagga

SEQ ID NO: 7931356 - DNA, 22 bp, Homo sapiens
agagccctgagtcagttctgga

SEQ ID NO: 7931357 - DNA, 22 bp, Homo sapiens
agagccctgacggggacagatg

SEQ ID NO: 7931358 - DNA, 22 bp, Homo sapiens
agagccctgacggggacagatg

SEQ ID NO: 7931359 - DNA, 22 bp, Homo sapiens
agagccctgacggggacagatg

SEQ ID NO: 7931360 - DNA, 22 bp, Homo sapiens
agagccctgaagcagagctaaa

SEQ ID NO: 7931361 - DNA, 22 bp, Homo sapiens
agagccctgaagcagagctaaa

SEQ ID NO: 7931362 - DNA, 22 bp, Homo sapiens
agagccctctcattggcttatt

SEQ ID NO: 7931363 - DNA, 22 bp, Homo sapiens
agagccctaaaccctgccttgg

SEQ ID NO: 7931364 - DNA, 22 bp, Homo sapiens
agagcccttgccctcagtcacc

SEQ ID NO: 7931365 - DNA, 22 bp, Homo sapiens
agagccctttctccaggcacct

SEQ ID NO: 7931366 - DNA, 22 bp, Homo sapiens
agagccctttctccaggcacct

SEQ ID NO: 7931367 - DNA, 23 bp, Homo sapiens
agagcctgaaagacttctggcac

SEQ ID NO: 7931368 - DNA, 22 bp, Homo sapiens
agagcctctgtcatggagagaa

SEQ ID NO: 7931369 - DNA, 22 bp, Homo sapiens
agagccctgtggttctggtaag

SEQ ID NO: 7931370 - DNA, 22 bp, Homo sapiens
agagccctgccaatggatgagg

SEQ ID NO: 7931371 - DNA, 22 bp, Homo sapiens
agagccctgcagttcttcagga

SEQ ID NO: 7931372 - DNA, 22 bp, Homo sapiens
agagccctgcagttcttcagga

SEQ ID NO: 7931373 - DNA, 22 bp, Homo sapiens
agagctggctgctgcggtgctt

SEQ ID NO: 7931374 - DNA, 22 bp, Homo sapiens
agagctggctgctgcggtgctt

SEQ ID NO: 7931375 - DNA, 21 bp, Homo sapiens
agagctggcctgccaggccct

SEQ ID NO: 7931376 - DNA, 21 bp, Homo sapiens
agagctggcctgccaggccct

SEQ ID NO: 7931377 - DNA, 21 bp, Homo sapiens
agagctggcctgccaggccct

SEQ ID NO: 7931378 - DNA, 21 bp, Homo sapiens
agagctggcctgccaggccct

SEQ ID NO: 7931379 - DNA, 21 bp, Homo sapiens
agagctggcctgccaggccct

SEQ ID NO: 7931380 - DNA, 21 bp, Homo sapiens
agagctggcctgccaggccct

SEQ ID NO: 7931381 - DNA, 21 bp, Homo sapiens
agagctggcctgccaggccct

SEQ ID NO: 7931382 - DNA, 21 bp, Homo sapiens
agagctggcctgccaggccct

SEQ ID NO: 7931383 - DNA, 22 bp, Homo sapiens
agagctggccagggatcactct

SEQ ID NO: 7931384 - DNA, 22 bp, Homo sapiens
agagctggccagggatcactct

SEQ ID NO: 7931385 - DNA, 22 bp, Homo sapiens
agagctggccagggatcactct

SEQ ID NO: 7931386 - DNA, 21 bp, Homo sapiens
agagctggcctgccaggccct

SEQ ID NO: 7931387 - DNA, 22 bp, Homo sapiens
agagctggccagggatcactct

SEQ ID NO: 7931388 - DNA, 22 bp, Homo sapiens
agagctggccagggatcactct

SEQ ID NO: 7931389 - DNA, 22 bp, Homo sapiens
agagctggccagggatcactct

SEQ ID NO: 7931390 - DNA, 22 bp, Homo sapiens
agagctggctggtagccctgat

SEQ ID NO: 7931391 - DNA, 22 bp, Homo sapiens
agagctggctggtagccctgat

SEQ ID NO: 7931392 - DNA, 22 bp, Homo sapiens
agagctggctggtagccctgat

SEQ ID NO: 7931393 - DNA, 22 bp, Homo sapiens
agagctggctggtagccctgat

SEQ ID NO: 7931394 - DNA, 22 bp, Homo sapiens
agagctggctgctgcggtgctt

SEQ ID NO: 7931395 - DNA, 22 bp, Homo sapiens
agagctggctggtagccctgat

SEQ ID NO: 7931396 - DNA, 22 bp, Homo sapiens
agagctggctgctgcggtgctt

SEQ ID NO: 7931397 - DNA, 22 bp, Homo sapiens
agagctggctggtagccctgat

SEQ ID NO: 7931398 - DNA, 22 bp, Homo sapiens
agagctggctggtagccctgat

SEQ ID NO: 7931399 - DNA, 22 bp, Homo sapiens
agagctggctggtagccctgat

SEQ ID NO: 7931400 - DNA, 22 bp, Homo sapiens
agagctggctgtgggtgacttt

SEQ ID NO: 7931401 - DNA, 22 bp, Homo sapiens
agagctggctgtgggtgacttt

SEQ ID NO: 7931402 - DNA, 22 bp, Homo sapiens
agagctggctgtgggtgacttt

SEQ ID NO: 7931403 - DNA, 22 bp, Homo sapiens
agagctggctgtgggtgacttt

SEQ ID NO: 7931404 - DNA, 22 bp, Homo sapiens
agagctggctgtgggtgacttt

SEQ ID NO: 7931405 - DNA, 22 bp, Homo sapiens
agagctggatggtcaagatggc

SEQ ID NO: 7931406 - DNA, 22 bp, Homo sapiens
agagctggatggtcaagatggc

SEQ ID NO: 7931407 - DNA, 22 bp, Homo sapiens
agagctggatggtcaagatggc

SEQ ID NO: 7931408 - DNA, 22 bp, Homo sapiens
agagctggatggtcaagatggc

SEQ ID NO: 7931409 - DNA, 22 bp, Homo sapiens
agagctggatggtcaagatggc

SEQ ID NO: 7931410 - DNA, 22 bp, Homo sapiens
agagctggatggtcaagatggc

SEQ ID NO: 7931411 - DNA, 22 bp, Homo sapiens
agagctggcactgaccctcacc

SEQ ID NO: 7931412 - DNA, 22 bp, Homo sapiens
agagctggcactgaccctcacc

SEQ ID NO: 7931413 - DNA, 22 bp, Homo sapiens
agagctggcactgaccctcacc

SEQ ID NO: 7931414 - DNA, 22 bp, Homo sapiens
agagctggcagcagcttctcct

SEQ ID NO: 7931415 - DNA, 22 bp, Homo sapiens
agagctggcagcagcttctcct

SEQ ID NO: 7931416 - DNA, 22 bp, Homo sapiens
agagctggcagcagcttctcct

SEQ ID NO: 7931417 - DNA, 22 bp, Homo sapiens
agagctggcagcagcttctcct

SEQ ID NO: 7931418 - DNA, 22 bp, Homo sapiens
agagctggcagcagcttctcct

SEQ ID NO: 7931419 - DNA, 22 bp, Homo sapiens
agagctggcagcagcttctcct

SEQ ID NO: 7931420 - DNA, 22 bp, Homo sapiens
agagctggcagcagcttctcct

SEQ ID NO: 7931421 - DNA, 22 bp, Homo sapiens
agagctggacgtctgagcccta

SEQ ID NO: 7931422 - DNA, 22 bp, Homo sapiens
agagctggaatcagacctcagg

SEQ ID NO: 7931423 - DNA, 22 bp, Homo sapiens
agagctggacgtctgagcccta

SEQ ID NO: 7931424 - DNA, 22 bp, Homo sapiens
agagctggacgtctgagcccta

SEQ ID NO: 7931425 - DNA, 22 bp, Homo sapiens
agagctggacgtctgagcccta

SEQ ID NO: 7931426 - DNA, 22 bp, Homo sapiens
agagctggaatcagacctcagg

SEQ ID NO: 7931427 - DNA, 22 bp, Homo sapiens
agagctgaattcaagtgctggc

SEQ ID NO: 7931428 - DNA, 22 bp, Homo sapiens
agagctggagcagccccactgg

SEQ ID NO: 7931429 - DNA, 22 bp, Homo sapiens
agagctggatggtcaagatggc

SEQ ID NO: 7931430 - DNA, 22 bp, Homo sapiens
agagctggagcagccccactgg

SEQ ID NO: 7931431 - DNA, 22 bp, Homo sapiens
agagctggagcagccccactgg

SEQ ID NO: 7931432 - DNA, 22 bp, Homo sapiens
agagctggagcagccccactgg

SEQ ID NO: 7931433 - DNA, 22 bp, Homo sapiens
agagctggagatgcaggtttcg

SEQ ID NO: 7931434 - DNA, 22 bp, Homo sapiens
agagctggagatgcaggtttcg

SEQ ID NO: 7931435 - DNA, 22 bp, Homo sapiens
agagctggagatgcaggtttcg

SEQ ID NO: 7931436 - DNA, 22 bp, Homo sapiens
agagctggagatgcaggtttcg

SEQ ID NO: 7931437 - DNA, 22 bp, Homo sapiens
agagctggacgtctgagcccta

SEQ ID NO: 7931438 - DNA, 20 bp, Homo sapiens
agacttaggcaatttaggct

SEQ ID NO: 7931439 - DNA, 22 bp, Homo sapiens
agacttagtgagttctaagttt

SEQ ID NO: 7931440 - DNA, 22 bp, Homo sapiens
agacttcacctacagcagtctc

SEQ ID NO: 7931441 - DNA, 21 bp, Homo sapiens
agacttctagaagtgagatag

SEQ ID NO: 7931442 - DNA, 21 bp, Homo sapiens
agacttctagaagtgagatag

SEQ ID NO: 7931443 - DNA, 22 bp, Homo sapiens
agacttctaaatagcagcttct

SEQ ID NO: 7931444 - DNA, 21 bp, Homo sapiens
agacttctagaagtgagatag

SEQ ID NO: 7931445 - DNA, 22 bp, Homo sapiens
agacttctctccttgacttgca

SEQ ID NO: 7931446 - DNA, 22 bp, Homo sapiens
agacttctctccttgacttgca

SEQ ID NO: 7931447 - DNA, 22 bp, Homo sapiens
agacttctctaacttgaggacc

SEQ ID NO: 7931448 - DNA, 22 bp, Homo sapiens
agacttctctaacttgaggacc

SEQ ID NO: 7931449 - DNA, 22 bp, Homo sapiens
agactgtgagaagatggctgcg

SEQ ID NO: 7931450 - DNA, 22 bp, Homo sapiens
agactgtaattgacatgtcagc

SEQ ID NO: 7931451 - DNA, 22 bp, Homo sapiens
agactgtactttctgcagctct

SEQ ID NO: 7931452 - DNA, 22 bp, Homo sapiens
agactgtaattgacatgtcagc

SEQ ID NO: 7931453 - DNA, 22 bp, Homo sapiens
agacttaaggcatttccaagaa

SEQ ID NO: 7931454 - DNA, 22 bp, Homo sapiens
agacttaattctgcaagtgtag

SEQ ID NO: 7931455 - DNA, 22 bp, Homo sapiens
agacttaggagctgacatctct

SEQ ID NO: 7931456 - DNA, 22 bp, Homo sapiens
agactgttgcctgaacttagcc

SEQ ID NO: 7931457 - DNA, 22 bp, Homo sapiens
agactgtgagggagatacaggg

SEQ ID NO: 7931458 - DNA, 22 bp, Homo sapiens
agactgtgccacacatgggagt

SEQ ID NO: 7931459 - DNA, 21 bp, Homo sapiens
agactgtggattttgacatgt

SEQ ID NO: 7931460 - DNA, 22 bp, Homo sapiens
agactttcttgacctagttaat

SEQ ID NO: 7931461 - DNA, 22 bp, Homo sapiens
agactttcttgacctagttaat

SEQ ID NO: 7931462 - DNA, 22 bp, Homo sapiens
agactttcgtgttatgttgcct

SEQ ID NO: 7931463 - DNA, 22 bp, Homo sapiens
agactttctgtagcatctgtaa

SEQ ID NO: 7931464 - DNA, 22 bp, Homo sapiens
agactttagaatcagatagcct

SEQ ID NO: 7931465 - DNA, 22 bp, Homo sapiens
agactttagggccatggtaggt

SEQ ID NO: 7931466 - DNA, 22 bp, Homo sapiens
agactttataaatcttaatttc

SEQ ID NO: 7931467 - DNA, 22 bp, Homo sapiens
agactttaatgtgcaaatgaaa

SEQ ID NO: 7931468 - DNA, 22 bp, Homo sapiens
agactttaatgtgcaaatgaaa

SEQ ID NO: 7931469 - DNA, 22 bp, Homo sapiens
agactttagaatcagatagcct

SEQ ID NO: 7931470 - DNA, 22 bp, Homo sapiens
agactttagaatcagatagcct

SEQ ID NO: 7931471 - DNA, 22 bp, Homo sapiens
agactttaatgtgcaaatgaaa

SEQ ID NO: 7931472 - DNA, 22 bp, Homo sapiens
agactttaatgtgcaaatgaaa

SEQ ID NO: 7931473 - DNA, 22 bp, Homo sapiens
agactttaatgtgcaaatgaaa

SEQ ID NO: 7931474 - DNA, 22 bp, Homo sapiens
agactttaatgtgcaaatgaaa

SEQ ID NO: 7931475 - DNA, 22 bp, Homo sapiens
agacttcttgagctggcacttc

SEQ ID NO: 7931476 - DNA, 22 bp, Homo sapiens
agacttcttgagctggcacttc

SEQ ID NO: 7931477 - DNA, 22 bp, Homo sapiens
agacttcttgagctggcacttc

SEQ ID NO: 7931478 - DNA, 22 bp, Homo sapiens
agacttcttgagctggcacttc

SEQ ID NO: 7931479 - DNA, 22 bp, Homo sapiens
agacttctcttggctatattat

SEQ ID NO: 7931480 - DNA, 22 bp, Homo sapiens
agacttctctccttgacttgca

SEQ ID NO: 7931481 - DNA, 22 bp, Homo sapiens
agagaaggtcactaaggaccca

SEQ ID NO: 7931482 - DNA, 22 bp, Homo sapiens
agagaaggtcactaaggaccca

SEQ ID NO: 7931483 - DNA, 22 bp, Homo sapiens
agagaaggtcactaaggaccca

SEQ ID NO: 7931484 - DNA, 22 bp, Homo sapiens
agagaaggtcactaaggaccca

SEQ ID NO: 7931485 - DNA, 22 bp, Homo sapiens
agagaaggtcactaaggaccca

SEQ ID NO: 7931486 - DNA, 22 bp, Homo sapiens
agagaaggtcactaaggaccca

SEQ ID NO: 7931487 - DNA, 22 bp, Homo sapiens
agagaaggtcactaaggaccca

SEQ ID NO: 7931488 - DNA, 22 bp, Homo sapiens
agagaaggtcactaaggaccca

SEQ ID NO: 7931489 - DNA, 22 bp, Homo sapiens
agagaaggtcactaaggaccca

SEQ ID NO: 7931490 - DNA, 22 bp, Homo sapiens
agagaagggtgtagcctgggcc

SEQ ID NO: 7931491 - DNA, 22 bp, Homo sapiens
agagaagggtgtagcctgggcc

SEQ ID NO: 7931492 - DNA, 22 bp, Homo sapiens
agagaagggtgtagcctgggcc

SEQ ID NO: 7931493 - DNA, 22 bp, Homo sapiens
agagaagggtgtagcctgggcc

SEQ ID NO: 7931494 - DNA, 22 bp, Homo sapiens
agagaagggtgtagcctgggcc

SEQ ID NO: 7931495 - DNA, 22 bp, Homo sapiens
agagaaggtcactaaggaccca

SEQ ID NO: 7931496 - DNA, 22 bp, Homo sapiens
agagaatacagggtaacaggaa

SEQ ID NO: 7931497 - DNA, 22 bp, Homo sapiens
agagaatacagggtaacaggaa

SEQ ID NO: 7931498 - DNA, 22 bp, Homo sapiens
agagaatacagggtaacaggaa

SEQ ID NO: 7931499 - DNA, 23 bp, Homo sapiens
agagaatcatggaaactctttct

SEQ ID NO: 7931500 - DNA, 23 bp, Homo sapiens
agagaatcatggaaactctttct

SEQ ID NO: 7931501 - DNA, 22 bp, Homo sapiens
agagaatccccagacagagtta

SEQ ID NO: 7931502 - DNA, 22 bp, Homo sapiens
agagaatccccagacagagtta

SEQ ID NO: 7931503 - DNA, 22 bp, Homo sapiens
agagaatctagaatgtttatac

SEQ ID NO: 7931504 - DNA, 22 bp, Homo sapiens
agagaatctagaatgtttatac

SEQ ID NO: 7931505 - DNA, 22 bp, Homo sapiens
agagaatcctctacatgttttt

SEQ ID NO: 7931506 - DNA, 22 bp, Homo sapiens
agagaatctgggaagatgttaa

SEQ ID NO: 7931507 - DNA, 22 bp, Homo sapiens
agagaatctgggaagatgttaa

SEQ ID NO: 7931508 - DNA, 22 bp, Homo sapiens
agagaatacaaagaagatatgt

SEQ ID NO: 7931509 - DNA, 22 bp, Homo sapiens
agagaatacaaagaagatatgt

SEQ ID NO: 7931510 - DNA, 22 bp, Homo sapiens
agagaatacaaagaagatatgt

SEQ ID NO: 7931511 - DNA, 22 bp, Homo sapiens
agagaatacaaagaagatatgt

SEQ ID NO: 7931512 - DNA, 22 bp, Homo sapiens
agagaatacaaagaagatatgt

SEQ ID NO: 7931513 - DNA, 22 bp, Homo sapiens
agagaaaactcattgaggtgtc

SEQ ID NO: 7931514 - DNA, 23 bp, Homo sapiens
agagaaaaatatctgggcacatt

SEQ ID NO: 7931515 - DNA, 22 bp, Homo sapiens
agagaaaactcattgaggtgtc

SEQ ID NO: 7931516 - DNA, 22 bp, Homo sapiens
agagaaaagagttcaggctttg

SEQ ID NO: 7931517 - DNA, 23 bp, Homo sapiens
agagaaaaatatctgggcacatt

SEQ ID NO: 7931518 - DNA, 23 bp, Homo sapiens
agagaaaaatatctgggcacatt

SEQ ID NO: 7931519 - DNA, 23 bp, Homo sapiens
agagaaaaatatctgggcacatt

SEQ ID NO: 7931520 - DNA, 23 bp, Homo sapiens
agagaaaaatatctgggcacatt

SEQ ID NO: 7931521 - DNA, 19 bp, Homo sapiens
agacttttgtaagttgaga

SEQ ID NO: 7931522 - DNA, 22 bp, Homo sapiens
agagaaaagagttcaggctttg

SEQ ID NO: 7931523 - DNA, 22 bp, Homo sapiens
agagaaaagagttcaggctttg

SEQ ID NO: 7931524 - DNA, 22 bp, Homo sapiens
agagaaaagagttcaggctttg

SEQ ID NO: 7931525 - DNA, 19 bp, Homo sapiens
agagaaggatcctatggtt

SEQ ID NO: 7931526 - DNA, 19 bp, Homo sapiens
agagaaggatcctatggtt

SEQ ID NO: 7931527 - DNA, 22 bp, Homo sapiens
agagaagggtgtagcctgggcc

SEQ ID NO: 7931528 - DNA, 22 bp, Homo sapiens
agagaagggtgtagcctgggcc

SEQ ID NO: 7931529 - DNA, 22 bp, Homo sapiens
agagaagggtgtagcctgggcc

SEQ ID NO: 7931530 - DNA, 22 bp, Homo sapiens
agagaagggtagcccattctcc

SEQ ID NO: 7931531 - DNA, 22 bp, Homo sapiens
agagaagggtagcccattctcc

SEQ ID NO: 7931532 - DNA, 22 bp, Homo sapiens
agagaagggtagcccattctcc

SEQ ID NO: 7931533 - DNA, 22 bp, Homo sapiens
agagaagggtgtagcctgggcc

SEQ ID NO: 7931534 - DNA, 19 bp, Homo sapiens
agagaaggatcctatggtt

SEQ ID NO: 7931535 - DNA, 19 bp, Homo sapiens
agagaaggatcctatggtt

SEQ ID NO: 7931536 - DNA, 22 bp, Homo sapiens
agagaaaagagttcaggctttg

SEQ ID NO: 7931537 - DNA, 19 bp, Homo sapiens
agagaaggatcctatggtt

SEQ ID NO: 7931538 - DNA, 19 bp, Homo sapiens
agagaaggatcctatggtt

SEQ ID NO: 7931539 - DNA, 22 bp, Homo sapiens
agagaagggtagcccattctcc

SEQ ID NO: 7931540 - DNA, 22 bp, Homo sapiens
agagagcatggcacagaggggt

SEQ ID NO: 7931541 - DNA, 22 bp, Homo sapiens
agagagcatggcacagaggggt

SEQ ID NO: 7931542 - DNA, 22 bp, Homo sapiens
agagagcatggcacagaggggt

SEQ ID NO: 7931543 - DNA, 21 bp, Homo sapiens
agagagaaggccatatggtcc

SEQ ID NO: 7931544 - DNA, 21 bp, Homo sapiens
agagagaaggccatatggtcc

SEQ ID NO: 7931545 - DNA, 22 bp, Homo sapiens
agagagcccgggccagggcaca

SEQ ID NO: 7931546 - DNA, 22 bp, Homo sapiens
agagagcattgaggaaatcttc

SEQ ID NO: 7931547 - DNA, 22 bp, Homo sapiens
agagagcccgggccagggcaca

SEQ ID NO: 7931548 - DNA, 22 bp, Homo sapiens
agagagcattgaggaaatcttc

SEQ ID NO: 7931549 - DNA, 22 bp, Homo sapiens
agagagcattgaggaaatcttc

SEQ ID NO: 7931550 - DNA, 22 bp, Homo sapiens
agagacaccgcgcatcatggct

SEQ ID NO: 7931551 - DNA, 21 bp, Homo sapiens
agagacagagaaagtaacatt

SEQ ID NO: 7931552 - DNA, 21 bp, Homo sapiens
agagacagagaaagtaacatt

SEQ ID NO: 7931553 - DNA, 21 bp, Homo sapiens
agagacagagaaagtaacatt

SEQ ID NO: 7931554 - DNA, 22 bp, Homo sapiens
agagagaagcaatcagtggcca

SEQ ID NO: 7931555 - DNA, 21 bp, Homo sapiens
agagacagagaaagtaacatt

SEQ ID NO: 7931556 - DNA, 21 bp, Homo sapiens
agagacagagaaagtaacatt

SEQ ID NO: 7931557 - DNA, 21 bp, Homo sapiens
agagacagagaaagtaacatt

SEQ ID NO: 7931558 - DNA, 21 bp, Homo sapiens
agagacagagaaagtaacatt

SEQ ID NO: 7931559 - DNA, 22 bp, Homo sapiens
agagaattggagcagtgacagg

SEQ ID NO: 7931560 - DNA, 22 bp, Homo sapiens
agagaattctggtgctaacaag

SEQ ID NO: 7931561 - DNA, 22 bp, Homo sapiens
agagaattctggtgctaacaag

SEQ ID NO: 7931562 - DNA, 22 bp, Homo sapiens
agagaattttaaaagccttgaa

SEQ ID NO: 7931563 - DNA, 22 bp, Homo sapiens
agagaattttaaaagccttgaa

SEQ ID NO: 7931564 - DNA, 22 bp, Homo sapiens
agagaattggagcagtgacagg

SEQ ID NO: 7931565 - DNA, 22 bp, Homo sapiens
agagaattaattaggagcactg

SEQ ID NO: 7931566 - DNA, 22 bp, Homo sapiens
agagaattaacattccatggct

SEQ ID NO: 7931567 - DNA, 22 bp, Homo sapiens
agagaattaacattccatggct

SEQ ID NO: 7931568 - DNA, 20 bp, Homo sapiens
agagaattccctttggagat

SEQ ID NO: 7931569 - DNA, 22 bp, Homo sapiens
agagaattctggtgctaacaag

SEQ ID NO: 7931570 - DNA, 20 bp, Homo sapiens
agagaattccctttggagat

SEQ ID NO: 7931571 - DNA, 22 bp, Homo sapiens
agagacaccgcgcatcatggct

SEQ ID NO: 7931572 - DNA, 22 bp, Homo sapiens
agagacaatgccaatgcacacg

SEQ ID NO: 7931573 - DNA, 22 bp, Homo sapiens
agagacaatgccaatgcacacg

SEQ ID NO: 7931574 - DNA, 22 bp, Homo sapiens
agagacaatgccaatgcacacg

SEQ ID NO: 7931575 - DNA, 22 bp, Homo sapiens
agagacaatgccaatgcacacg

SEQ ID NO: 7931576 - DNA, 22 bp, Homo sapiens
agagacaatgccaatgcacacg

SEQ ID NO: 7931577 - DNA, 22 bp, Homo sapiens
agagacaatgccaatgcacacg

SEQ ID NO: 7931578 - DNA, 22 bp, Homo sapiens
agagacaatgccaatgcacacg

SEQ ID NO: 7931579 - DNA, 22 bp, Homo sapiens
agagacaatgccaatgcacacg

SEQ ID NO: 7931580 - DNA, 22 bp, Homo sapiens
agagacaatgccaatgcacacg

SEQ ID NO: 7931581 - DNA, 22 bp, Homo sapiens
agagacaaacactgcaacttct

SEQ ID NO: 7931582 - DNA, 22 bp, Homo sapiens
agagacaaacactgcaacttct

SEQ ID NO: 7931583 - DNA, 22 bp, Homo sapiens
agagacaagaaatacctgggac

SEQ ID NO: 7931584 - DNA, 22 bp, Homo sapiens
agagagcccgggccagggcaca

SEQ ID NO: 7931585 - DNA, 22 bp, Homo sapiens
agagagcccgggccagggcaca

SEQ ID NO: 7931586 - DNA, 22 bp, Homo sapiens
agagagcctgagtggcagctat

SEQ ID NO: 7931587 - DNA, 22 bp, Homo sapiens
agagagctgtcctgggacaccc

SEQ ID NO: 7931588 - DNA, 22 bp, Homo sapiens
agagagctgactttggagtcag

SEQ ID NO: 7931589 - DNA, 22 bp, Homo sapiens
agagagctgactttggagtcag

SEQ ID NO: 7931590 - DNA, 22 bp, Homo sapiens
agagagctctgctgctgcccag

SEQ ID NO: 7931591 - DNA, 22 bp, Homo sapiens
agagagctctggctgggtgacc

SEQ ID NO: 7931592 - DNA, 22 bp, Homo sapiens
agagagctctggctgggtgacc

SEQ ID NO: 7931593 - DNA, 22 bp, Homo sapiens
agagagctgtcctgggacaccc

SEQ ID NO: 7931594 - DNA, 22 bp, Homo sapiens
agagagcttccattctagtgat

SEQ ID NO: 7931595 - DNA, 22 bp, Homo sapiens
agagaggcattcggtgatccca

SEQ ID NO: 7931596 - DNA, 22 bp, Homo sapiens
agagaggcattcggtgatccca

SEQ ID NO: 7931597 - DNA, 22 bp, Homo sapiens
agagaggcattcggtgatccca

SEQ ID NO: 7931598 - DNA, 22 bp, Homo sapiens
agagaggcattcggtgatccca

SEQ ID NO: 7931599 - DNA, 22 bp, Homo sapiens
agagaggctgctggactatatg

SEQ ID NO: 7931600 - DNA, 22 bp, Homo sapiens
agagaggctgctggactatatg

SEQ ID NO: 7931601 - DNA, 22 bp, Homo sapiens
agagaggcgagttacctgtgct

SEQ ID NO: 7931602 - DNA, 22 bp, Homo sapiens
agagaggcgagttacctgtgct

SEQ ID NO: 7931603 - DNA, 22 bp, Homo sapiens
agagaggcgagttacctgtgct

SEQ ID NO: 7931604 - DNA, 22 bp, Homo sapiens
agagaggcgagttacctgtgct

SEQ ID NO: 7931605 - DNA, 22 bp, Homo sapiens
agagaggcgagttacctgtgct

SEQ ID NO: 7931606 - DNA, 22 bp, Homo sapiens
agagaggcattcggtgatccca

SEQ ID NO: 7931607 - DNA, 22 bp, Homo sapiens
agagaggctgggcgtagggctt

SEQ ID NO: 7931608 - DNA, 22 bp, Homo sapiens
agagaggctgggcgtagggctt

SEQ ID NO: 7931609 - DNA, 22 bp, Homo sapiens
agagaggctgctggactatatg

SEQ ID NO: 7931610 - DNA, 19 bp, Homo sapiens
agagaggctgtgtgaggga

SEQ ID NO: 7931611 - DNA, 22 bp, Homo sapiens
agagaggctgggcgtagggctt

SEQ ID NO: 7931612 - DNA, 22 bp, Homo sapiens
agagaggctgggcgtagggctt

SEQ ID NO: 7931613 - DNA, 19 bp, Homo sapiens
agagaggctgtgtgaggga

SEQ ID NO: 7931614 - DNA, 22 bp, Homo sapiens
agagagggaatatttggggtat

SEQ ID NO: 7931615 - DNA, 22 bp, Homo sapiens
agagagggaatatttggggtat

SEQ ID NO: 7931616 - DNA, 22 bp, Homo sapiens
agagagggaatatttggggtat

SEQ ID NO: 7931617 - DNA, 22 bp, Homo sapiens
agagaggttggctaggatgttt

SEQ ID NO: 7931618 - DNA, 22 bp, Homo sapiens
agagaggttggctaggatgttt

SEQ ID NO: 7931619 - DNA, 22 bp, Homo sapiens
agagaggttaaggagctcttgt

SEQ ID NO: 7931620 - DNA, 22 bp, Homo sapiens
agagaggttaaggagctcttgt

SEQ ID NO: 7931621 - DNA, 22 bp, Homo sapiens
agagaggtctcaggagaaacca

SEQ ID NO: 7931622 - DNA, 21 bp, Homo sapiens
agagagggagatgaaacatcc

SEQ ID NO: 7931623 - DNA, 22 bp, Homo sapiens
agagagggcatagaaaaaggga

SEQ ID NO: 7931624 - DNA, 22 bp, Homo sapiens
agagagggcatagaaaaaggga

SEQ ID NO: 7931625 - DNA, 21 bp, Homo sapiens
agagagggagatgaaacatcc

SEQ ID NO: 7931626 - DNA, 21 bp, Homo sapiens
agagagggagatgaaacatcc

SEQ ID NO: 7931627 - DNA, 22 bp, Homo sapiens
agcagcagaggtcagaaaggta

SEQ ID NO: 7931628 - DNA, 22 bp, Homo sapiens
agcagcagatcaaacaggcttg

SEQ ID NO: 7931629 - DNA, 22 bp, Homo sapiens
agcagcagatcaaacaggcttg

SEQ ID NO: 7931630 - DNA, 22 bp, Homo sapiens
agcagcagaggtcagaaaggta

SEQ ID NO: 7931631 - DNA, 22 bp, Homo sapiens
agcagcagagctctggtctgca

SEQ ID NO: 7931632 - DNA, 22 bp, Homo sapiens
agcagcagagctctggtctgca

SEQ ID NO: 7931633 - DNA, 22 bp, Homo sapiens
agcagcagagctctggtctgca

SEQ ID NO: 7931634 - DNA, 22 bp, Homo sapiens
agcagcagaggtcagaaaggta

SEQ ID NO: 7931635 - DNA, 22 bp, Homo sapiens
agcagcagaggtcagaaaggta

SEQ ID NO: 7931636 - DNA, 22 bp, Homo sapiens
agcagcagagctctggtctgca

SEQ ID NO: 7931637 - DNA, 21 bp, Homo sapiens
agcagcagatctggtgagggc

SEQ ID NO: 7931638 - DNA, 21 bp, Homo sapiens
agcagcagatctggtgagggc

SEQ ID NO: 7931639 - DNA, 21 bp, Homo sapiens
agcagcagatctggtgagggc

SEQ ID NO: 7931640 - DNA, 21 bp, Homo sapiens
agcagcagatctggtgagggc

SEQ ID NO: 7931641 - DNA, 22 bp, Homo sapiens
agcagcagatccaaaaaatgtg

SEQ ID NO: 7931642 - DNA, 21 bp, Homo sapiens
agcagcagatctggtgagggc

SEQ ID NO: 7931643 - DNA, 22 bp, Homo sapiens
agcagcagatcaaacaggcttg

SEQ ID NO: 7931644 - DNA, 22 bp, Homo sapiens
agcagcagatcaaacaggcttg

SEQ ID NO: 7931645 - DNA, 22 bp, Homo sapiens
agcagcagatccaaaaaatgtg

SEQ ID NO: 7931646 - DNA, 22 bp, Homo sapiens
agcagcagatcaaacaggcttg

SEQ ID NO: 7931647 - DNA, 22 bp, Homo sapiens
agcagcagatcaaacaggcttg

SEQ ID NO: 7931648 - DNA, 22 bp, Homo sapiens
agcagcagatcaaacaggcttg

SEQ ID NO: 7931649 - DNA, 22 bp, Homo sapiens
caatacaattaccagttaatca

SEQ ID NO: 7931650 - DNA, 22 bp, Homo sapiens
caatacaattaccagttaatca

SEQ ID NO: 7931651 - DNA, 22 bp, Homo sapiens
caatacaattaccagttaatca

SEQ ID NO: 7931652 - DNA, 22 bp, Homo sapiens
caatacaattaccagttaatca

SEQ ID NO: 7931653 - DNA, 22 bp, Homo sapiens
caatacactaaacttctctgaa

SEQ ID NO: 7931654 - DNA, 22 bp, Homo sapiens
caatacactaaacttctctgaa

SEQ ID NO: 7931655 - DNA, 22 bp, Homo sapiens
caatacaattaccagttaatca

SEQ ID NO: 7931656 - DNA, 22 bp, Homo sapiens
caatacatcaggtcaaaatgtg

SEQ ID NO: 7931657 - DNA, 22 bp, Homo sapiens
caatacatcaggtcaaaatgtg

SEQ ID NO: 7931658 - DNA, 22 bp, Homo sapiens
caatacagcacacctgtatcag

SEQ ID NO: 7931659 - DNA, 19 bp, Homo sapiens
agcagcagaagtgtgcctt

SEQ ID NO: 7931660 - DNA, 19 bp, Homo sapiens
agcagcagaagtgtgcctt

SEQ ID NO: 7931661 - DNA, 19 bp, Homo sapiens
agcagcagaagtgtgcctt

SEQ ID NO: 7931662 - DNA, 19 bp, Homo sapiens
agcagcagaagtgtgcctt

SEQ ID NO: 7931663 - DNA, 22 bp, Homo sapiens
agcagcagagctctggtctgca

SEQ ID NO: 7931664 - DNA, 19 bp, Homo sapiens
agcagcagaagtgtgcctt

SEQ ID NO: 7931665 - DNA, 19 bp, Homo sapiens
agcagcagaagtgtgcctt

SEQ ID NO: 7931666 - DNA, 22 bp, Homo sapiens
caatactattcggaccatctct

SEQ ID NO: 7931667 - DNA, 18 bp, Homo sapiens
caatactgagaggtgggg

SEQ ID NO: 7931668 - DNA, 22 bp, Homo sapiens
caatactgagtttacattcatc

SEQ ID NO: 7931669 - DNA, 22 bp, Homo sapiens
caatactgagtttacattcatc

SEQ ID NO: 7931670 - DNA, 22 bp, Homo sapiens
caatactgagtttacattcatc

SEQ ID NO: 7931671 - DNA, 20 bp, Homo sapiens
agcagcagatgttggaggtg

SEQ ID NO: 7931672 - DNA, 20 bp, Homo sapiens
agcagcagatgttggaggtg

SEQ ID NO: 7931673 - DNA, 22 bp, Homo sapiens
agcagccagaaatccagaggtg

SEQ ID NO: 7931674 - DNA, 22 bp, Homo sapiens
agcagcccagataaagctcagg

SEQ ID NO: 7931675 - DNA, 23 bp, Homo sapiens
agcagcccaatggcaagctctgg

SEQ ID NO: 7931676 - DNA, 23 bp, Homo sapiens
agcagcccaatggcaagctctgg

SEQ ID NO: 7931677 - DNA, 22 bp, Homo sapiens
agcagccagagaatgatgcagt

SEQ ID NO: 7931678 - DNA, 23 bp, Homo sapiens
agcagcccaatggcaagctctgg

SEQ ID NO: 7931679 - DNA, 22 bp, Homo sapiens
agcagccagagaatgatgcagt

SEQ ID NO: 7931680 - DNA, 22 bp, Homo sapiens
agcagccagagaatgatgcagt

SEQ ID NO: 7931681 - DNA, 22 bp, Homo sapiens
agcagccagagaatgatgcagt

SEQ ID NO: 7931682 - DNA, 22 bp, Homo sapiens
agcagccagagaatgatgcagt

SEQ ID NO: 7931683 - DNA, 22 bp, Homo sapiens
agcagccagaaatccagaggtg

SEQ ID NO: 7931684 - DNA, 22 bp, Homo sapiens
agcagccagagaatgatgcagt

SEQ ID NO: 7931685 - DNA, 22 bp, Homo sapiens
agcagcccctcggcgggtgcgc

SEQ ID NO: 7931686 - DNA, 22 bp, Homo sapiens
agcagcccaggcaaagataaaa

SEQ ID NO: 7931687 - DNA, 22 bp, Homo sapiens
agcagcccagttgtactgagtg

SEQ ID NO: 7931688 - DNA, 22 bp, Homo sapiens
agcagcccagttgtactgagtg

SEQ ID NO: 7931689 - DNA, 23 bp, Homo sapiens
agcagcccagatgccttccatcc

SEQ ID NO: 7931690 - DNA, 23 bp, Homo sapiens
agcagcccagatgccttccatcc

SEQ ID NO: 7931691 - DNA, 22 bp, Homo sapiens
agcagcccctcggcgggtgcgc

SEQ ID NO: 7931692 - DNA, 22 bp, Homo sapiens
agcagccctatgtaattggact

SEQ ID NO: 7931693 - DNA, 22 bp, Homo sapiens
agcagccctagggattgctgtt

SEQ ID NO: 7931694 - DNA, 22 bp, Homo sapiens
agcagccctagggattgctgtt

SEQ ID NO: 7931695 - DNA, 22 bp, Homo sapiens
agcagccctagggattgctgtt

SEQ ID NO: 7931696 - DNA, 22 bp, Homo sapiens
agcagccttgcaggggtcgcac

SEQ ID NO: 7931697 - DNA, 22 bp, Homo sapiens
agcagccttaggtattgtgatt

SEQ ID NO: 7931698 - DNA, 22 bp, Homo sapiens
agcagccttaggtattgtgatt

SEQ ID NO: 7931699 - DNA, 22 bp, Homo sapiens
agcagccttaggtattgtgatt

SEQ ID NO: 7931700 - DNA, 21 bp, Homo sapiens
agcagccttgtgtgccaggca

SEQ ID NO: 7931701 - DNA, 22 bp, Homo sapiens
agcagccttgcaggggtcgcac

SEQ ID NO: 7931702 - DNA, 22 bp, Homo sapiens
agcagccttgcaggggtcgcac

SEQ ID NO: 7931703 - DNA, 22 bp, Homo sapiens
agcagccttaggtattgtgatt

SEQ ID NO: 7931704 - DNA, 22 bp, Homo sapiens
agcagcctggacttggatgtgg

SEQ ID NO: 7931705 - DNA, 22 bp, Homo sapiens
agcagcctggtctctcgccaat

SEQ ID NO: 7931706 - DNA, 22 bp, Homo sapiens
agcagcctggacttggatgtgg

SEQ ID NO: 7931707 - DNA, 22 bp, Homo sapiens
agcagcctctgtagaggtctcc

SEQ ID NO: 7931708 - DNA, 22 bp, Homo sapiens
agcagcctctgtagaggtctcc

SEQ ID NO: 7931709 - DNA, 22 bp, Homo sapiens
agcagcctgcagatattggtct

SEQ ID NO: 7931710 - DNA, 22 bp, Homo sapiens
agcagcctgcagatattggtct

SEQ ID NO: 7931711 - DNA, 23 bp, Homo sapiens
agcagccctgggacctggcctgc

SEQ ID NO: 7931712 - DNA, 23 bp, Homo sapiens
agcagccctgggacctggcctgc

SEQ ID NO: 7931713 - DNA, 23 bp, Homo sapiens
agcagccctgggacctggcctgc

SEQ ID NO: 7931714 - DNA, 23 bp, Homo sapiens
agcagccctgggacctggcctgc

SEQ ID NO: 7931715 - DNA, 22 bp, Homo sapiens
agcagccgtattatggtggttt

SEQ ID NO: 7931716 - DNA, 22 bp, Homo sapiens
agcagcctattcttctcttgga

SEQ ID NO: 7931717 - DNA, 22 bp, Homo sapiens
agcagcctattcttctcttgga

SEQ ID NO: 7931718 - DNA, 22 bp, Homo sapiens
agcagcctattcttctcttgga

SEQ ID NO: 7931719 - DNA, 22 bp, Homo sapiens
agcagcctcccagggagcagcc

SEQ ID NO: 7931720 - DNA, 22 bp, Homo sapiens
agcagcctcccagggagcagcc

SEQ ID NO: 7931721 - DNA, 22 bp, Homo sapiens
agcagcctctgtagaggtctcc

SEQ ID NO: 7931722 - DNA, 22 bp, Homo sapiens
agcagcctcccagggagcagcc

SEQ ID NO: 7931723 - DNA, 23 bp, Homo sapiens
agcagccctgggacctggcctgc

SEQ ID NO: 7931724 - DNA, 22 bp, Homo sapiens
agcagcctattcttctcttgga

SEQ ID NO: 7931725 - DNA, 22 bp, Homo sapiens
agcagcctattcttctcttgga

SEQ ID NO: 7931726 - DNA, 22 bp, Homo sapiens
agcagctacttaaccttgtaca

SEQ ID NO: 7931727 - DNA, 22 bp, Homo sapiens
agcagcctttgatcatctggga

SEQ ID NO: 7931728 - DNA, 22 bp, Homo sapiens
agcagctcaaagcctgcaagga

SEQ ID NO: 7931729 - DNA, 22 bp, Homo sapiens
agcagcctttgatcatctggga

SEQ ID NO: 7931730 - DNA, 22 bp, Homo sapiens
agcagcctttgatcatctggga

SEQ ID NO: 7931731 - DNA, 21 bp, Homo sapiens
agcagccttgtgtgccaggca

SEQ ID NO: 7931732 - DNA, 22 bp, Homo sapiens
agcagcctttgatcatctggga

SEQ ID NO: 7931733 - DNA, 21 bp, Homo sapiens
agcagccttgtgtgccaggca

SEQ ID NO: 7931734 - DNA, 21 bp, Homo sapiens
agcagccttgtgtgccaggca

SEQ ID NO: 7931735 - DNA, 22 bp, Homo sapiens
agcagctcaacagtgtctctat

SEQ ID NO: 7931736 - DNA, 22 bp, Homo sapiens
agcagctcaaagcctgcaagga

SEQ ID NO: 7931737 - DNA, 22 bp, Homo sapiens
agcagctcaacagtgtctctat

SEQ ID NO: 7931738 - DNA, 22 bp, Homo sapiens
agcagctcaacagtgtctctat

SEQ ID NO: 7931739 - DNA, 22 bp, Homo sapiens
agcagctcacaggattcctgaa

SEQ ID NO: 7931740 - DNA, 22 bp, Homo sapiens
agcagctcacaggattcctgaa

SEQ ID NO: 7931741 - DNA, 22 bp, Homo sapiens
agcagctcatggagtaggcact

SEQ ID NO: 7931742 - DNA, 22 bp, Homo sapiens
agcagctcatggagtaggcact

SEQ ID NO: 7931743 - DNA, 22 bp, Homo sapiens
agcagctcatggagtaggcact

SEQ ID NO: 7931744 - DNA, 19 bp, Homo sapiens
agcagctcagggaggcacc

SEQ ID NO: 7931745 - DNA, 19 bp, Homo sapiens
agcagctcagggaggcacc

SEQ ID NO: 7931746 - DNA, 19 bp, Homo sapiens
agcagctcagggaggcacc

SEQ ID NO: 7931747 - DNA, 22 bp, Homo sapiens
agcagctcagaggcaccagggc

SEQ ID NO: 7931748 - DNA, 22 bp, Homo sapiens
agcagctcagaggcaccagggc

SEQ ID NO: 7931749 - DNA, 22 bp, Homo sapiens
cacagaacatccttagctcatg

SEQ ID NO: 7931750 - DNA, 22 bp, Homo sapiens
cacagaacatccttagctcatg

SEQ ID NO: 7931751 - DNA, 22 bp, Homo sapiens
agcagctcatggagtaggcact

SEQ ID NO: 7931752 - DNA, 22 bp, Homo sapiens
cacagaacatttttagatgcag

SEQ ID NO: 7931753 - DNA, 22 bp, Homo sapiens
cacagaacatccttagctcatg

SEQ ID NO: 7931754 - DNA, 22 bp, Homo sapiens
cacagaacatccttagctcatg

SEQ ID NO: 7931755 - DNA, 22 bp, Homo sapiens
agcagctcccctcatgctccac

SEQ ID NO: 7931756 - DNA, 22 bp, Homo sapiens
agcagctcccctcatgctccac

SEQ ID NO: 7931757 - DNA, 22 bp, Homo sapiens
agcagctcccctcatgctccac

SEQ ID NO: 7931758 - DNA, 22 bp, Homo sapiens
agcagctcccctcatgctccac

SEQ ID NO: 7931759 - DNA, 22 bp, Homo sapiens
cacagaacatttttagatgcag

SEQ ID NO: 7931760 - DNA, 22 bp, Homo sapiens
cacagaactggttaatagcaga

SEQ ID NO: 7931761 - DNA, 22 bp, Homo sapiens
cacagagaggcttgtctccaag

SEQ ID NO: 7931762 - DNA, 21 bp, Homo sapiens
cacagagatattggtgagcct

SEQ ID NO: 7931763 - DNA, 21 bp, Homo sapiens
cacagagatattggtgagcct

SEQ ID NO: 7931764 - DNA, 22 bp, Homo sapiens
cacagagaggcttgtctccaag

SEQ ID NO: 7931765 - DNA, 22 bp, Homo sapiens
cacagagaggcttgtctccaag

SEQ ID NO: 7931766 - DNA, 22 bp, Homo sapiens
cacagagatcggaacagaagta

SEQ ID NO: 7931767 - DNA, 22 bp, Homo sapiens
cacagagatcggaacagaagta

SEQ ID NO: 7931768 - DNA, 22 bp, Homo sapiens
cacagagatcggaacagaagta

SEQ ID NO: 7931769 - DNA, 22 bp, Homo sapiens
cacagagatcggaacagaagta

SEQ ID NO: 7931770 - DNA, 22 bp, Homo sapiens
cacagagatggccagggcacat

SEQ ID NO: 7931771 - DNA, 22 bp, Homo sapiens
cacagagatggccagggcacat

SEQ ID NO: 7931772 - DNA, 22 bp, Homo sapiens
cacagagatggccagggcacat

SEQ ID NO: 7931773 - DNA, 22 bp, Homo sapiens
cacagagatggccagggcacat

SEQ ID NO: 7931774 - DNA, 22 bp, Homo sapiens
cacagagatcggaacagaagta

SEQ ID NO: 7931775 - DNA, 22 bp, Homo sapiens
cacagagatggccagggcacat

SEQ ID NO: 7931776 - DNA, 21 bp, Homo sapiens
cacagagatattggtgagcct

SEQ ID NO: 7931777 - DNA, 22 bp, Homo sapiens
cacagagatcggaacagaagta

SEQ ID NO: 7931778 - DNA, 22 bp, Homo sapiens
cacagagatcggaacagaagta

SEQ ID NO: 7931779 - DNA, 22 bp, Homo sapiens
cacagagatcggaacagaagta

SEQ ID NO: 7931780 - DNA, 21 bp, Homo sapiens
cacagagatattggtgagcct

SEQ ID NO: 7931781 - DNA, 22 bp, Homo sapiens
cacagagatcggaacagaagta

SEQ ID NO: 7931782 - DNA, 17 bp, Homo sapiens
agcagctggcacaggag

SEQ ID NO: 7931783 - DNA, 17 bp, Homo sapiens
agcagctggcacaggag

SEQ ID NO: 7931784 - DNA, 17 bp, Homo sapiens
agcagctggcacaggag

SEQ ID NO: 7931785 - DNA, 22 bp, Homo sapiens
agcagctggcagcttcttctct

SEQ ID NO: 7931786 - DNA, 22 bp, Homo sapiens
agcagctggcagcttcttctct

SEQ ID NO: 7931787 - DNA, 22 bp, Homo sapiens
agcagctggcagcttcttctct

SEQ ID NO: 7931788 - DNA, 22 bp, Homo sapiens
agcagctggcagcttcttctct

SEQ ID NO: 7931789 - DNA, 21 bp, Homo sapiens
agcagctgggcaacatggagg

SEQ ID NO: 7931790 - DNA, 21 bp, Homo sapiens
agcagctgggcaacatggagg

SEQ ID NO: 7931791 - DNA, 21 bp, Homo sapiens
agcagctgggcaacatggagg

SEQ ID NO: 7931792 - DNA, 22 bp, Homo sapiens
agcagctggcagcttcttctct

SEQ ID NO: 7931793 - DNA, 22 bp, Homo sapiens
agcagctggcagcttcttctct

SEQ ID NO: 7931794 - DNA, 21 bp, Homo sapiens
agcagctgggcaacatggagg

SEQ ID NO: 7931795 - DNA, 21 bp, Homo sapiens
agcagctgggcaacatggagg

SEQ ID NO: 7931796 - DNA, 21 bp, Homo sapiens
agcagctgggcaacatggagg

SEQ ID NO: 7931797 - DNA, 21 bp, Homo sapiens
agcagctgggcaacatggagg

SEQ ID NO: 7931798 - DNA, 19 bp, Homo sapiens
agcagctggaggtggagtg

SEQ ID NO: 7931799 - DNA, 19 bp, Homo sapiens
agcagctggaggtggagtg

SEQ ID NO: 7931800 - DNA, 22 bp, Homo sapiens
agcagctggaacatatgaagaa

SEQ ID NO: 7931801 - DNA, 19 bp, Homo sapiens
agcagctggaggtggagtg

SEQ ID NO: 7931802 - DNA, 19 bp, Homo sapiens
agcagctggaggtggagtg

SEQ ID NO: 7931803 - DNA, 19 bp, Homo sapiens
agcagctggaggtggagtg

SEQ ID NO: 7931804 - DNA, 19 bp, Homo sapiens
agcagctggaggtggagtg

SEQ ID NO: 7931805 - DNA, 19 bp, Homo sapiens
agcagctggaggtggagtg

SEQ ID NO: 7931806 - DNA, 22 bp, Homo sapiens
agcagctggaactaatagtggt

SEQ ID NO: 7931807 - DNA, 19 bp, Homo sapiens
agcagctggaggtggagtg

SEQ ID NO: 7931808 - DNA, 22 bp, Homo sapiens
agcagctggaactaatagtggt

SEQ ID NO: 7931809 - DNA, 22 bp, Homo sapiens
agcagctggaactaatagtggt

SEQ ID NO: 7931810 - DNA, 22 bp, Homo sapiens
agcagctggaactaatagtggt

SEQ ID NO: 7931811 - DNA, 22 bp, Homo sapiens
agcagctggaactaatagtggt

SEQ ID NO: 7931812 - DNA, 17 bp, Homo sapiens
agcagctggcacaggag

SEQ ID NO: 7931813 - DNA, 17 bp, Homo sapiens
agcagctggcacaggag

SEQ ID NO: 7931814 - DNA, 17 bp, Homo sapiens
agcagctggcacaggag

SEQ ID NO: 7931815 - DNA, 17 bp, Homo sapiens
agcagctggcacaggag

SEQ ID NO: 7931816 - DNA, 19 bp, Homo sapiens
agcagctggaggtggagtg

SEQ ID NO: 7931817 - DNA, 17 bp, Homo sapiens
agcagctggcacaggag

SEQ ID NO: 7931818 - DNA, 19 bp, Homo sapiens
agcagctggaggtggagtg

SEQ ID NO: 7931819 - DNA, 19 bp, Homo sapiens
agcagctggaggtggagtg

SEQ ID NO: 7931820 - DNA, 19 bp, Homo sapiens
agcagctggaggtggagtg

SEQ ID NO: 7931821 - DNA, 19 bp, Homo sapiens
agcagctggaggtggagtg

SEQ ID NO: 7931822 - DNA, 19 bp, Homo sapiens
agcagctggaggtggagtg

SEQ ID NO: 7931823 - DNA, 22 bp, Homo sapiens
cacagagattagaattagacta

SEQ ID NO: 7931824 - DNA, 22 bp, Homo sapiens
cacagagattagaattagacta

SEQ ID NO: 7931825 - DNA, 22 bp, Homo sapiens
cacagagatggtctggcaggtg

SEQ ID NO: 7931826 - DNA, 22 bp, Homo sapiens
cacagagattagaattagacta

SEQ ID NO: 7931827 - DNA, 22 bp, Homo sapiens
cacagagatggccagggcacat

SEQ ID NO: 7931828 - DNA, 22 bp, Homo sapiens
cacagagatggccagggcacat

SEQ ID NO: 7931829 - DNA, 22 bp, Homo sapiens
cacagagatggtctggcaggtg

SEQ ID NO: 7931830 - DNA, 22 bp, Homo sapiens
cacagagatggtctggcaggtg

SEQ ID NO: 7931831 - DNA, 22 bp, Homo sapiens
cacagagatggtctggcaggtg

SEQ ID NO: 7931832 - DNA, 22 bp, Homo sapiens
cacagagcaggtgctgggaaga

SEQ ID NO: 7931833 - DNA, 22 bp, Homo sapiens
cacagagcaggtgctgggaaga

SEQ ID NO: 7931834 - DNA, 22 bp, Homo sapiens
cacagagcaggggtctgtgtca

SEQ ID NO: 7931835 - DNA, 22 bp, Homo sapiens
cacagagcaggggtctgtgtca

SEQ ID NO: 7931836 - DNA, 22 bp, Homo sapiens
cacagagcaggggtctgtgtca

SEQ ID NO: 7931837 - DNA, 22 bp, Homo sapiens
cacagagctcaagtcttagaaa

SEQ ID NO: 7931838 - DNA, 22 bp, Homo sapiens
cacagagctcaagtcttagaaa

SEQ ID NO: 7931839 - DNA, 22 bp, Homo sapiens
cacagagcaggtgctgggaaga

SEQ ID NO: 7931840 - DNA, 22 bp, Homo sapiens
agcagctgcttttcttcattgg

SEQ ID NO: 7931841 - DNA, 22 bp, Homo sapiens
agcagctgcttttcttcattgg

SEQ ID NO: 7931842 - DNA, 22 bp, Homo sapiens
agcagctgcttttcttcattgg

SEQ ID NO: 7931843 - DNA, 22 bp, Homo sapiens
agcagctgcttttcttcattgg

SEQ ID NO: 7931844 - DNA, 22 bp, Homo sapiens
agcagctgcttttcttcattgg

SEQ ID NO: 7931845 - DNA, 22 bp, Homo sapiens
agcagctggaactaatagtggt

SEQ ID NO: 7931846 - DNA, 22 bp, Homo sapiens
agcagctggaacatatgaagaa

SEQ ID NO: 7931847 - DNA, 22 bp, Homo sapiens
agcagctggaacatatgaagaa

SEQ ID NO: 7931848 - DNA, 22 bp, Homo sapiens
agcagctggaacatatgaagaa

SEQ ID NO: 7931849 - DNA, 22 bp, Homo sapiens
agcagctggaacatatgaagaa

SEQ ID NO: 7931850 - DNA, 22 bp, Homo sapiens
agcagctgcttttcttcattgg

SEQ ID NO: 7931851 - DNA, 22 bp, Homo sapiens
agcagctggaacatatgaagaa

SEQ ID NO: 7931852 - DNA, 22 bp, Homo sapiens
agcagctggaacatatgaagaa

SEQ ID NO: 7931853 - DNA, 22 bp, Homo sapiens
agcagctggaacatatgaagaa

SEQ ID NO: 7931854 - DNA, 22 bp, Homo sapiens
agcagctggaacatatgaagaa

SEQ ID NO: 7931855 - DNA, 22 bp, Homo sapiens
caaaggcctgagaactgagggg

SEQ ID NO: 7931856 - DNA, 22 bp, Homo sapiens
caaaggctcagtaaatctttgt

SEQ ID NO: 7931857 - DNA, 22 bp, Homo sapiens
caaaggctgccactgtggctgt

SEQ ID NO: 7931858 - DNA, 22 bp, Homo sapiens
caaaggcctgagaactgagggg

SEQ ID NO: 7931859 - DNA, 22 bp, Homo sapiens
caaaggctggtagaatgagcca

SEQ ID NO: 7931860 - DNA, 22 bp, Homo sapiens
caaaggcagttactgaatgaag

SEQ ID NO: 7931861 - DNA, 22 bp, Homo sapiens
caaaggcagttactgaatgaag

SEQ ID NO: 7931862 - DNA, 22 bp, Homo sapiens
caaaggcatcggcaattaggga

SEQ ID NO: 7931863 - DNA, 22 bp, Homo sapiens
caaaggcatcggcaattaggga

SEQ ID NO: 7931864 - DNA, 22 bp, Homo sapiens
caaaggcatcggcaattaggga

SEQ ID NO: 7931865 - DNA, 22 bp, Homo sapiens
caaaggcatgtgagtatatgtg

SEQ ID NO: 7931866 - DNA, 22 bp, Homo sapiens
caaaggcatgtgagtatatgtg

SEQ ID NO: 7931867 - DNA, 22 bp, Homo sapiens
caaagggaaacgcagtgtcaag

SEQ ID NO: 7931868 - DNA, 22 bp, Homo sapiens
caaagggcattttagtgaactg

SEQ ID NO: 7931869 - DNA, 22 bp, Homo sapiens
caaagggaaaagccatgtgggc

SEQ ID NO: 7931870 - DNA, 22 bp, Homo sapiens
caaaggctttgctatgatgcat

SEQ ID NO: 7931871 - DNA, 22 bp, Homo sapiens
caaaggcttcatctcagagcag

SEQ ID NO: 7931872 - DNA, 22 bp, Homo sapiens
caaaggcttccactgcatcctt

SEQ ID NO: 7931873 - DNA, 22 bp, Homo sapiens
agcacctgcttaatgtgcagtg

SEQ ID NO: 7931874 - DNA, 22 bp, Homo sapiens
agcacctgcttaatgtgcagtg

SEQ ID NO: 7931875 - DNA, 22 bp, Homo sapiens
agcacctggagggctgggacct

SEQ ID NO: 7931876 - DNA, 22 bp, Homo sapiens
agcacctggagggctgggacct

SEQ ID NO: 7931877 - DNA, 22 bp, Homo sapiens
agcacctgggaagctattctca

SEQ ID NO: 7931878 - DNA, 22 bp, Homo sapiens
agcacctggagggctgggacct

SEQ ID NO: 7931879 - DNA, 22 bp, Homo sapiens
agcacctggagggctgggacct

SEQ ID NO: 7931880 - DNA, 18 bp, Homo sapiens
agcaccagtcactaacag

SEQ ID NO: 7931881 - DNA, 20 bp, Homo sapiens
agcaccagtgggggcagccc

SEQ ID NO: 7931882 - DNA, 22 bp, Homo sapiens
agcaccaggtcgctggcacgct

SEQ ID NO: 7931883 - DNA, 22 bp, Homo sapiens
caaagggcggctgtcggagggt

SEQ ID NO: 7931884 - DNA, 22 bp, Homo sapiens
agcacctggtctcctggcgctg

SEQ ID NO: 7931885 - DNA, 22 bp, Homo sapiens
agcacctgggctggaagacccc

SEQ ID NO: 7931886 - DNA, 22 bp, Homo sapiens
agcacctgtcaagtccaggctg

SEQ ID NO: 7931887 - DNA, 22 bp, Homo sapiens
agcacctgtcacaagcagaagg

SEQ ID NO: 7931888 - DNA, 22 bp, Homo sapiens
agcacctgtcaagtccaggctg

SEQ ID NO: 7931889 - DNA, 23 bp, Homo sapiens
agcacctgtgatttcctagctct

SEQ ID NO: 7931890 - DNA, 23 bp, Homo sapiens
agcacctgtgatttcctagctct

SEQ ID NO: 7931891 - DNA, 23 bp, Homo sapiens
agcacctgtgatttcctagctct

SEQ ID NO: 7931892 - DNA, 23 bp, Homo sapiens
agcacctgtgatttcctagctct

SEQ ID NO: 7931893 - DNA, 23 bp, Homo sapiens
agcacctgtgatttcctagctct

SEQ ID NO: 7931894 - DNA, 17 bp, Homo sapiens
agcacctgtccagtccc

SEQ ID NO: 7931895 - DNA, 17 bp, Homo sapiens
agcacctgtccagtccc

SEQ ID NO: 7931896 - DNA, 17 bp, Homo sapiens
agcacctgtccagtccc

SEQ ID NO: 7931897 - DNA, 19 bp, Homo sapiens
agcacctgtgagagcctgg

SEQ ID NO: 7931898 - DNA, 22 bp, Homo sapiens
agcactgtccggtaagatgctc

SEQ ID NO: 7931899 - DNA, 22 bp, Homo sapiens
agcactgtccggtaagatgctc

SEQ ID NO: 7931900 - DNA, 20 bp, Homo sapiens
agcactgtctgaccagtggc

SEQ ID NO: 7931901 - DNA, 22 bp, Homo sapiens
agcactgtagttatagctaaca

SEQ ID NO: 7931902 - DNA, 22 bp, Homo sapiens
agcactgtagttatagctaaca

SEQ ID NO: 7931903 - DNA, 22 bp, Homo sapiens
agcactgggaacgcatggggcc

SEQ ID NO: 7931904 - DNA, 22 bp, Homo sapiens
agcactgggaacgcatggggcc

SEQ ID NO: 7931905 - DNA, 22 bp, Homo sapiens
agcactggagtttagtgggatt

SEQ ID NO: 7931906 - DNA, 22 bp, Homo sapiens
agcactggagtttagtgggatt

SEQ ID NO: 7931907 - DNA, 22 bp, Homo sapiens
agcactgggaacgcatggggcc

SEQ ID NO: 7931908 - DNA, 22 bp, Homo sapiens
agcactgggaacgcatggggcc

SEQ ID NO: 7931909 - DNA, 22 bp, Homo sapiens
agcactgggaacgcatggggcc

SEQ ID NO: 7931910 - DNA, 22 bp, Homo sapiens
agcactgcctctgagctccagc

SEQ ID NO: 7931911 - DNA, 22 bp, Homo sapiens
agcactggagtttagtgggatt

SEQ ID NO: 7931912 - DNA, 22 bp, Homo sapiens
agcactggagtttagtgggatt

SEQ ID NO: 7931913 - DNA, 22 bp, Homo sapiens
agcactcctgtctttccccttt

SEQ ID NO: 7931914 - DNA, 19 bp, Homo sapiens
agcactccctgttctgtct

SEQ ID NO: 7931915 - DNA, 22 bp, Homo sapiens
agcactctaagtgcaagacact

SEQ ID NO: 7931916 - DNA, 22 bp, Homo sapiens
agcactctggagtaggagtggg

SEQ ID NO: 7931917 - DNA, 22 bp, Homo sapiens
agcactgatttaaactggattt

SEQ ID NO: 7931918 - DNA, 20 bp, Homo sapiens
agcactaggtgtggcaggtg

SEQ ID NO: 7931919 - DNA, 23 bp, Homo sapiens
agcactcatgctgcagaagtcat

SEQ ID NO: 7931920 - DNA, 22 bp, Homo sapiens
agcactagctttaagcattctg

SEQ ID NO: 7931921 - DNA, 22 bp, Homo sapiens
agcactagctttaagcattctg

SEQ ID NO: 7931922 - DNA, 22 bp, Homo sapiens
agcactagcctgttttgctgtg

SEQ ID NO: 7931923 - DNA, 22 bp, Homo sapiens
agcactagcctgttttgctgtg

SEQ ID NO: 7931924 - DNA, 22 bp, Homo sapiens
agcacctgtgtgagctagatgt

SEQ ID NO: 7931925 - DNA, 20 bp, Homo sapiens
agcacctgtgtagaagcatc

SEQ ID NO: 7931926 - DNA, 22 bp, Homo sapiens
agcacctgtgccctgatggaga

SEQ ID NO: 7931927 - DNA, 22 bp, Homo sapiens
agcacctgtggctcatgctcgt

SEQ ID NO: 7931928 - DNA, 22 bp, Homo sapiens
agcacctgtggctcatgctcgt

SEQ ID NO: 7931929 - DNA, 22 bp, Homo sapiens
agcacctgtgtggtagggaggt

SEQ ID NO: 7931930 - DNA, 22 bp, Homo sapiens
agcacctgtgttcatgcctcat

SEQ ID NO: 7931931 - DNA, 22 bp, Homo sapiens
agcacctgtgttcatgcctcat

SEQ ID NO: 7931932 - DNA, 22 bp, Homo sapiens
agcacctgtgtggtagggaggt

SEQ ID NO: 7931933 - DNA, 22 bp, Homo sapiens
agcacctgttgcacttcataat

SEQ ID NO: 7931934 - DNA, 21 bp, Homo sapiens
agcaccttacagctataatgg

SEQ ID NO: 7931935 - DNA, 22 bp, Homo sapiens
agcacctgttgcacttcataat

SEQ ID NO: 7931936 - DNA, 22 bp, Homo sapiens
agcactagagccaaaatttggg

SEQ ID NO: 7931937 - DNA, 22 bp, Homo sapiens
agcactagacatgtaagtgagc

SEQ ID NO: 7931938 - DNA, 22 bp, Homo sapiens
agcactaagtaatctcacagga

SEQ ID NO: 7931939 - DNA, 17 bp, Homo sapiens
agcactaaaatgcttcc

SEQ ID NO: 7931940 - DNA, 23 bp, Homo sapiens
agcacgggtacagcctggccagg

SEQ ID NO: 7931941 - DNA, 22 bp, Homo sapiens
agcacgagatcgatgtgccttt

SEQ ID NO: 7931942 - DNA, 22 bp, Homo sapiens
agcacgagatcgatgtgccttt

SEQ ID NO: 7931943 - DNA, 22 bp, Homo sapiens
agcaccttgatcttggacttcc

SEQ ID NO: 7931944 - DNA, 22 bp, Homo sapiens
agcaccttgctcttggccttcc

SEQ ID NO: 7931945 - DNA, 22 bp, Homo sapiens
agcaccttgagatcaagcagtg

SEQ ID NO: 7931946 - DNA, 22 bp, Homo sapiens
agcaccttgagatcaagcagtg

SEQ ID NO: 7931947 - DNA, 21 bp, Homo sapiens
agcaccttcaattctattgtc

SEQ ID NO: 7931948 - DNA, 22 bp, Homo sapiens
agcaccttcacaggctctcagg

SEQ ID NO: 7931949 - DNA, 20 bp, Homo sapiens
agcagagtgcccatcccgga

SEQ ID NO: 7931950 - DNA, 20 bp, Homo sapiens
agcagagtgcccatcccgga

SEQ ID NO: 7931951 - DNA, 20 bp, Homo sapiens
agcagagtgcccatcccgga

SEQ ID NO: 7931952 - DNA, 22 bp, Homo sapiens
agcagagtcttcaagggcaggc

SEQ ID NO: 7931953 - DNA, 22 bp, Homo sapiens
agcagagtcttcaagggcaggc

SEQ ID NO: 7931954 - DNA, 22 bp, Homo sapiens
agcagagtcttcaagggcaggc

SEQ ID NO: 7931955 - DNA, 20 bp, Homo sapiens
agcagagtgcccatcccgga

SEQ ID NO: 7931956 - DNA, 22 bp, Homo sapiens
agcagagtctgtgtgcacttta

SEQ ID NO: 7931957 - DNA, 22 bp, Homo sapiens
agcagagtctgtgtgcacttta

SEQ ID NO: 7931958 - DNA, 22 bp, Homo sapiens
agcagaggtttgttggaaacct

SEQ ID NO: 7931959 - DNA, 22 bp, Homo sapiens
agcagaggtttgttggaaacct

SEQ ID NO: 7931960 - DNA, 22 bp, Homo sapiens
agcagaggtttgttggaaacct

SEQ ID NO: 7931961 - DNA, 21 bp, Homo sapiens
agcagaggggacatgtttgat

SEQ ID NO: 7931962 - DNA, 21 bp, Homo sapiens
agcagaggctgcctggtgact

SEQ ID NO: 7931963 - DNA, 21 bp, Homo sapiens
agcagaggggacatgtttgat

SEQ ID NO: 7931964 - DNA, 21 bp, Homo sapiens
agcagaggggacatgtttgat

SEQ ID NO: 7931965 - DNA, 16 bp, Homo sapiens
agcagaggtgagtgaa

SEQ ID NO: 7931966 - DNA, 21 bp, Homo sapiens
agcagaggggacatgtttgat

SEQ ID NO: 7931967 - DNA, 22 bp, Homo sapiens
agcagaggtgtttattatggga

SEQ ID NO: 7931968 - DNA, 16 bp, Homo sapiens
agcagaggtgagtgaa

SEQ ID NO: 7931969 - DNA, 16 bp, Homo sapiens
agcagaggtgagtgaa

SEQ ID NO: 7931970 - DNA, 22 bp, Homo sapiens
agcagaggtttgttggaaacct

SEQ ID NO: 7931971 - DNA, 22 bp, Homo sapiens
agcagaggtgtttattatggga

SEQ ID NO: 7931972 - DNA, 22 bp, Homo sapiens
agcagaggtgtttattatggga

SEQ ID NO: 7931973 - DNA, 22 bp, Homo sapiens
caataatatcctgtgctgtttg

SEQ ID NO: 7931974 - DNA, 22 bp, Homo sapiens
caataatatcctgtgctgtttg

SEQ ID NO: 7931975 - DNA, 22 bp, Homo sapiens
caagtgagtgaccagagttggt

SEQ ID NO: 7931976 - DNA, 22 bp, Homo sapiens
caataatatcctgtgctgtttg

SEQ ID NO: 7931977 - DNA, 22 bp, Homo sapiens
caataatatcctgtgctgtttg

SEQ ID NO: 7931978 - DNA, 22 bp, Homo sapiens
caataatatcctgtgctgtttg

SEQ ID NO: 7931979 - DNA, 22 bp, Homo sapiens
agcagagtgccccatcacaagg

SEQ ID NO: 7931980 - DNA, 20 bp, Homo sapiens
agcagagtgcccatcccgga

SEQ ID NO: 7931981 - DNA, 22 bp, Homo sapiens
caagtgagcctcctctttttaa

SEQ ID NO: 7931982 - DNA, 20 bp, Homo sapiens
caataatttacttccctatt

SEQ ID NO: 7931983 - DNA, 22 bp, Homo sapiens
caatacaattaccagttaatca

SEQ ID NO: 7931984 - DNA, 22 bp, Homo sapiens
caatacaattaccagttaatca

SEQ ID NO: 7931985 - DNA, 22 bp, Homo sapiens
caatacaattaccagttaatca

SEQ ID NO: 7931986 - DNA, 22 bp, Homo sapiens
caatacaattaccagttaatca

SEQ ID NO: 7931987 - DNA, 22 bp, Homo sapiens
caatacaattaccagttaatca

SEQ ID NO: 7931988 - DNA, 20 bp, Homo sapiens
caataatttacttccctatt

SEQ ID NO: 7931989 - DNA, 22 bp, Homo sapiens
caataatttacattggatacca

SEQ ID NO: 7931990 - DNA, 22 bp, Homo sapiens
caataatttacattggatacca

SEQ ID NO: 7931991 - DNA, 22 bp, Homo sapiens
caataattgctttccagagtta

SEQ ID NO: 7931992 - DNA, 21 bp, Homo sapiens
agcagaggctgcctggtgact

SEQ ID NO: 7931993 - DNA, 21 bp, Homo sapiens
agcagaggctgcctggtgact

SEQ ID NO: 7931994 - DNA, 21 bp, Homo sapiens
agcagaggctgcctggtgact

SEQ ID NO: 7931995 - DNA, 21 bp, Homo sapiens
agcagaggctgcctggtgact

SEQ ID NO: 7931996 - DNA, 21 bp, Homo sapiens
agcagaggctgcctggtgact

SEQ ID NO: 7931997 - DNA, 21 bp, Homo sapiens
agcagaggctgcctggtgact

SEQ ID NO: 7931998 - DNA, 21 bp, Homo sapiens
agcagaggcagaatgtatgca

SEQ ID NO: 7931999 - DNA, 21 bp, Homo sapiens
agcagaggcagaatgtatgca

SEQ ID NO: 7932000 - DNA, 21 bp, Homo sapiens
agcagaggcagaatgtatgca

SEQ ID NO: 7932001 - DNA, 21 bp, Homo sapiens
agcagaggcagaatgtatgca

SEQ ID NO: 7932002 - DNA, 21 bp, Homo sapiens
agcagaggcagaatgtatgca

SEQ ID NO: 7932003 - DNA, 22 bp, Homo sapiens
agcagaggaggatttagttagg

SEQ ID NO: 7932004 - DNA, 21 bp, Homo sapiens
agcagaggcagaatgtatgca

SEQ ID NO: 7932005 - DNA, 22 bp, Homo sapiens
agcagagctttttggactcaga

SEQ ID NO: 7932006 - DNA, 22 bp, Homo sapiens
agcagagctttttggactcaga

SEQ ID NO: 7932007 - DNA, 22 bp, Homo sapiens
agcagagctttttggactcaga

SEQ ID NO: 7932008 - DNA, 22 bp, Homo sapiens
agcagagctttttggactcaga

SEQ ID NO: 7932009 - DNA, 22 bp, Homo sapiens
agcagagctgggatcctgggtc

SEQ ID NO: 7932010 - DNA, 22 bp, Homo sapiens
agcagagctgggatcctgggtc

SEQ ID NO: 7932011 - DNA, 22 bp, Homo sapiens
agcagagctgggatcctgggtc

SEQ ID NO: 7932012 - DNA, 22 bp, Homo sapiens
agcagagctgggatcctgggtc

SEQ ID NO: 7932013 - DNA, 22 bp, Homo sapiens
agcagagctttttggactcaga

SEQ ID NO: 7932014 - DNA, 22 bp, Homo sapiens
agcagaggaggatttagttagg

SEQ ID NO: 7932015 - DNA, 22 bp, Homo sapiens
agcagaggaggatttagttagg

SEQ ID NO: 7932016 - DNA, 22 bp, Homo sapiens
agcagaggacagttcttaggaa

SEQ ID NO: 7932017 - DNA, 22 bp, Homo sapiens
agcagaggacagttcttaggaa

SEQ ID NO: 7932018 - DNA, 22 bp, Homo sapiens
agcagaggacagttcttaggaa

SEQ ID NO: 7932019 - DNA, 22 bp, Homo sapiens
agcagaggacagttcttaggaa

SEQ ID NO: 7932020 - DNA, 22 bp, Homo sapiens
agcagagctgcagtggcctgct

SEQ ID NO: 7932021 - DNA, 22 bp, Homo sapiens
agcagagctgcagtggcctgct

SEQ ID NO: 7932022 - DNA, 22 bp, Homo sapiens
agcagagctattcttgtgcaat

SEQ ID NO: 7932023 - DNA, 22 bp, Homo sapiens
agcagagctgcagtggcctgct

SEQ ID NO: 7932024 - DNA, 22 bp, Homo sapiens
agcagagctattcttgtgcaat

SEQ ID NO: 7932025 - DNA, 22 bp, Homo sapiens
agcagagctgcagtggcctgct

SEQ ID NO: 7932026 - DNA, 22 bp, Homo sapiens
agcagagctgcagtggcctgct

SEQ ID NO: 7932027 - DNA, 22 bp, Homo sapiens
agcagagctgcagtggcctgct

SEQ ID NO: 7932028 - DNA, 22 bp, Homo sapiens
agcagagcgcctgctcagaggg

SEQ ID NO: 7932029 - DNA, 22 bp, Homo sapiens
agcagagcgcctgctcagaggg

SEQ ID NO: 7932030 - DNA, 22 bp, Homo sapiens
agcagagctattcttgtgcaat

SEQ ID NO: 7932031 - DNA, 22 bp, Homo sapiens
agcagagctattcttgtgcaat

SEQ ID NO: 7932032 - DNA, 22 bp, Homo sapiens
agcactgtgatttataacattt

SEQ ID NO: 7932033 - DNA, 22 bp, Homo sapiens
agcactgtgatttataacattt

SEQ ID NO: 7932034 - DNA, 22 bp, Homo sapiens
agcactgtgagcaccagcacgc

SEQ ID NO: 7932035 - DNA, 22 bp, Homo sapiens
agcactgtgatttataacattt

SEQ ID NO: 7932036 - DNA, 22 bp, Homo sapiens
agcactgtagttatagctaaca

SEQ ID NO: 7932037 - DNA, 22 bp, Homo sapiens
agcactgtgatttataacattt

SEQ ID NO: 7932038 - DNA, 22 bp, Homo sapiens
agcactgtgatttataacattt

SEQ ID NO: 7932039 - DNA, 22 bp, Homo sapiens
agcactgtggggaactcacaga

SEQ ID NO: 7932040 - DNA, 22 bp, Homo sapiens
agcactgtggggaactcacaga

SEQ ID NO: 7932041 - DNA, 22 bp, Homo sapiens
agcagagcgcctgctcagaggg

SEQ ID NO: 7932042 - DNA, 22 bp, Homo sapiens
agcagagaggaggtggccctgt

SEQ ID NO: 7932043 - DNA, 22 bp, Homo sapiens
agcagagacctggttttgttga

SEQ ID NO: 7932044 - DNA, 22 bp, Homo sapiens
agcagagacctggttttgttga

SEQ ID NO: 7932045 - DNA, 22 bp, Homo sapiens
agcagagacctggttttgttga

SEQ ID NO: 7932046 - DNA, 22 bp, Homo sapiens
cactgtgtaagaagatgggctt

SEQ ID NO: 7932047 - DNA, 22 bp, Homo sapiens
cactgtgtaagaagatgggctt

SEQ ID NO: 7932048 - DNA, 22 bp, Homo sapiens
cactgtgtcagtttggttagac

SEQ ID NO: 7932049 - DNA, 22 bp, Homo sapiens
cactgtggttattatcactgtt

SEQ ID NO: 7932050 - DNA, 22 bp, Homo sapiens
cactgtgggtcccagactggag

SEQ ID NO: 7932051 - DNA, 19 bp, Homo sapiens
cactgtggtccttcactgc

SEQ ID NO: 7932052 - DNA, 22 bp, Homo sapiens
cactgtgggcctgtcgtgggtg

SEQ ID NO: 7932053 - DNA, 22 bp, Homo sapiens
cactggtgagtccagaagtcat

SEQ ID NO: 7932054 - DNA, 22 bp, Homo sapiens
cactggtgagtccagaagtcat

SEQ ID NO: 7932055 - DNA, 22 bp, Homo sapiens
cactggtgacttctgagctgga

SEQ ID NO: 7932056 - DNA, 22 bp, Homo sapiens
agcattagattaaaaatttaga

SEQ ID NO: 7932057 - DNA, 22 bp, Homo sapiens
agcattagaagaaatgattata

SEQ ID NO: 7932058 - DNA, 19 bp, Homo sapiens
agcattaggcaaattttga

SEQ ID NO: 7932059 - DNA, 22 bp, Homo sapiens
cactggtgacttctgagctgga

SEQ ID NO: 7932060 - DNA, 22 bp, Homo sapiens
agcattacagtggtacccaggg

SEQ ID NO: 7932061 - DNA, 22 bp, Homo sapiens
agcattaataagaaatggctcc

SEQ ID NO: 7932062 - DNA, 22 bp, Homo sapiens
agcattaataagaaatggctcc

SEQ ID NO: 7932063 - DNA, 22 bp, Homo sapiens
cactgtgtctggagtgagctgg

SEQ ID NO: 7932064 - DNA, 22 bp, Homo sapiens
cactgtgtctggagtgagctgg

SEQ ID NO: 7932065 - DNA, 23 bp, Homo sapiens
cactgtgttacatgttgaagatg

SEQ ID NO: 7932066 - DNA, 22 bp, Homo sapiens
cactgtgtctggagtgagctgg

SEQ ID NO: 7932067 - DNA, 22 bp, Homo sapiens
cactgttcacattttagtctat

SEQ ID NO: 7932068 - DNA, 22 bp, Homo sapiens
cactgttcacattttagtctat

SEQ ID NO: 7932069 - DNA, 22 bp, Homo sapiens
cactgttattactactatacat

SEQ ID NO: 7932070 - DNA, 22 bp, Homo sapiens
cactgttattactactatacat

SEQ ID NO: 7932071 - DNA, 22 bp, Homo sapiens
cactgttcatcaaaactgctct

SEQ ID NO: 7932072 - DNA, 22 bp, Homo sapiens
cactgttctttttgtagtccaa

SEQ ID NO: 7932073 - DNA, 22 bp, Homo sapiens
cactgttcatcaaaactgctct

SEQ ID NO: 7932074 - DNA, 22 bp, Homo sapiens
cactgttcatcaaaactgctct

SEQ ID NO: 7932075 - DNA, 22 bp, Homo sapiens
cacttaaaactcctggaattgt

SEQ ID NO: 7932076 - DNA, 22 bp, Homo sapiens
cactgtttttatgtaatcagtg

SEQ ID NO: 7932077 - DNA, 22 bp, Homo sapiens
cactgtttttatgtaatcagtg

SEQ ID NO: 7932078 - DNA, 22 bp, Homo sapiens
cactgttttcagtcagttctat

SEQ ID NO: 7932079 - DNA, 22 bp, Homo sapiens
cactgttttattccaacatagg

SEQ ID NO: 7932080 - DNA, 22 bp, Homo sapiens
cactgttttcagtcagttctat

SEQ ID NO: 7932081 - DNA, 22 bp, Homo sapiens
cactgtttggctcctgtactta

SEQ ID NO: 7932082 - DNA, 22 bp, Homo sapiens
cactgtttgaggccctagttga

SEQ ID NO: 7932083 - DNA, 22 bp, Homo sapiens
cactttactatctataaaataa

SEQ ID NO: 7932084 - DNA, 22 bp, Homo sapiens
cactttactatctataaaataa

SEQ ID NO: 7932085 - DNA, 22 bp, Homo sapiens
cacttaaagtcttagcttacag

SEQ ID NO: 7932086 - DNA, 22 bp, Homo sapiens
agcatggggcaatgcatgtgct

SEQ ID NO: 7932087 - DNA, 22 bp, Homo sapiens
agcatgtaaagctcttagcacc

SEQ ID NO: 7932088 - DNA, 22 bp, Homo sapiens
agcatggtctgatcaggtggct

SEQ ID NO: 7932089 - DNA, 22 bp, Homo sapiens
agcatgttcatcttctgttggt

SEQ ID NO: 7932090 - DNA, 22 bp, Homo sapiens
agcatgtgtggagaaatatttt

SEQ ID NO: 7932091 - DNA, 22 bp, Homo sapiens
agcatggggcaatgcatgtgct

SEQ ID NO: 7932092 - DNA, 22 bp, Homo sapiens
agcatggggcaatgcatgtgct

SEQ ID NO: 7932093 - DNA, 22 bp, Homo sapiens
agcatggctttggaggatagca

SEQ ID NO: 7932094 - DNA, 22 bp, Homo sapiens
agcatggctttggaggatagca

SEQ ID NO: 7932095 - DNA, 22 bp, Homo sapiens
agcatggggcaatgcatgtgct

SEQ ID NO: 7932096 - DNA, 19 bp, Homo sapiens
agcatggcctacagtgtgc

SEQ ID NO: 7932097 - DNA, 19 bp, Homo sapiens
agcatggcctacagtgtgc

SEQ ID NO: 7932098 - DNA, 19 bp, Homo sapiens
agcatggcctacagtgtgc

SEQ ID NO: 7932099 - DNA, 22 bp, Homo sapiens
agcatggccatctgggccgtcc

SEQ ID NO: 7932100 - DNA, 22 bp, Homo sapiens
agcatggcctgcagcggccacc

SEQ ID NO: 7932101 - DNA, 22 bp, Homo sapiens
agcatggcctcccgggcctggc

SEQ ID NO: 7932102 - DNA, 22 bp, Homo sapiens
agcatggcctcccgggcctggc

SEQ ID NO: 7932103 - DNA, 22 bp, Homo sapiens
agcatggacagtggcagcagtg

SEQ ID NO: 7932104 - DNA, 22 bp, Homo sapiens
agcatggacagtggcagcagtg

SEQ ID NO: 7932105 - DNA, 18 bp, Homo sapiens
agcatggcacaggctccc

SEQ ID NO: 7932106 - DNA, 22 bp, Homo sapiens
agcatggacagtggcagcagtg

SEQ ID NO: 7932107 - DNA, 22 bp, Homo sapiens
agcatggacagtggcagcagtg

SEQ ID NO: 7932108 - DNA, 23 bp, Homo sapiens
agcatggaataggaaagaggcag

SEQ ID NO: 7932109 - DNA, 23 bp, Homo sapiens
agcatggaataggaaagaggcag

SEQ ID NO: 7932110 - DNA, 23 bp, Homo sapiens
agcatggaagaagctggactcct

SEQ ID NO: 7932111 - DNA, 22 bp, Homo sapiens
agcatggcactcaaggctcctg

SEQ ID NO: 7932112 - DNA, 18 bp, Homo sapiens
agcatggcacaggctccc

SEQ ID NO: 7932113 - DNA, 22 bp, Homo sapiens
agcatggcactcaaggctcctg

SEQ ID NO: 7932114 - DNA, 18 bp, Homo sapiens
agcatggcacaggctccc

SEQ ID NO: 7932115 - DNA, 18 bp, Homo sapiens
agcatggcacaggctccc

SEQ ID NO: 7932116 - DNA, 22 bp, Homo sapiens
agcatggcattattggaaggac

SEQ ID NO: 7932117 - DNA, 22 bp, Homo sapiens
agcatggcattattggaaggac

SEQ ID NO: 7932118 - DNA, 22 bp, Homo sapiens
agcatgctgggtcatttttgcc

SEQ ID NO: 7932119 - DNA, 22 bp, Homo sapiens
agcatgctggtgttcatggcag

SEQ ID NO: 7932120 - DNA, 22 bp, Homo sapiens
agcatgcttattttatctcatt

SEQ ID NO: 7932121 - DNA, 22 bp, Homo sapiens
agcatgcttggcatttgtcaga

SEQ ID NO: 7932122 - DNA, 22 bp, Homo sapiens
agcatgcatgaagattcagcaa

SEQ ID NO: 7932123 - DNA, 22 bp, Homo sapiens
agcatgcgcttgatcagctcca

SEQ ID NO: 7932124 - DNA, 21 bp, Homo sapiens
agcatgcactacttcatctta

SEQ ID NO: 7932125 - DNA, 20 bp, Homo sapiens
agcatgcagccagagccaac

SEQ ID NO: 7932126 - DNA, 22 bp, Homo sapiens
agcatgcaggaaccacatggca

SEQ ID NO: 7932127 - DNA, 22 bp, Homo sapiens
agcatgcagtaaagcccatgtc

SEQ ID NO: 7932128 - DNA, 22 bp, Homo sapiens
agcatgcaggaaccacatggca

SEQ ID NO: 7932129 - DNA, 22 bp, Homo sapiens
agcaggtgtcggcgagggtctt

SEQ ID NO: 7932130 - DNA, 22 bp, Homo sapiens
agcaggtgtcggcgagggtctt

SEQ ID NO: 7932131 - DNA, 18 bp, Homo sapiens
agcaggtgtgcagaatgt

SEQ ID NO: 7932132 - DNA, 18 bp, Homo sapiens
agcaggtgtgcagaatgt

SEQ ID NO: 7932133 - DNA, 22 bp, Homo sapiens
agcaggtgttggctgggccatc

SEQ ID NO: 7932134 - DNA, 22 bp, Homo sapiens
agcaggtgttagggatccaatg

SEQ ID NO: 7932135 - DNA, 22 bp, Homo sapiens
agcaggtgttagggatccaatg

SEQ ID NO: 7932136 - DNA, 22 bp, Homo sapiens
agcagggctggggcacgagcca

SEQ ID NO: 7932137 - DNA, 22 bp, Homo sapiens
agcagggctggggcacgagcca

SEQ ID NO: 7932138 - DNA, 22 bp, Homo sapiens
agcagggctgcggccccaccac

SEQ ID NO: 7932139 - DNA, 22 bp, Homo sapiens
agcagggctggggcacgagcca

SEQ ID NO: 7932140 - DNA, 22 bp, Homo sapiens
agcagggctggggcacgagcca

SEQ ID NO: 7932141 - DNA, 22 bp, Homo sapiens
agcaggtgggcatgaaagctga

SEQ ID NO: 7932142 - DNA, 22 bp, Homo sapiens
agcaggtgggcatgaaagctga

SEQ ID NO: 7932143 - DNA, 22 bp, Homo sapiens
agcaggtgtcggcgagggtctt

SEQ ID NO: 7932144 - DNA, 22 bp, Homo sapiens
agcagggctgcggccccaccac

SEQ ID NO: 7932145 - DNA, 22 bp, Homo sapiens
agcagggctgcggccccaccac

SEQ ID NO: 7932146 - DNA, 22 bp, Homo sapiens
agcagggctggatttggcaaga

SEQ ID NO: 7932147 - DNA, 22 bp, Homo sapiens
agcagggctggatttggcaaga

SEQ ID NO: 7932148 - DNA, 22 bp, Homo sapiens
agcagggctggatttggcaaga

SEQ ID NO: 7932149 - DNA, 22 bp, Homo sapiens
agcagggctggatttggcaaga

SEQ ID NO: 7932150 - DNA, 22 bp, Homo sapiens
agcagggctggatttggcaaga

SEQ ID NO: 7932151 - DNA, 22 bp, Homo sapiens
agcagggctggggcacgagcca

SEQ ID NO: 7932152 - DNA, 22 bp, Homo sapiens
agcagggctggggcacgagcca

SEQ ID NO: 7932153 - DNA, 22 bp, Homo sapiens
agcaggttgtgatacactcaga

SEQ ID NO: 7932154 - DNA, 22 bp, Homo sapiens
agcaggttgttttgtggccagg

SEQ ID NO: 7932155 - DNA, 22 bp, Homo sapiens
agcaggttaccattgatttcct

SEQ ID NO: 7932156 - DNA, 18 bp, Homo sapiens
agcaggttctcacagcca

SEQ ID NO: 7932157 - DNA, 22 bp, Homo sapiens
agcaggttccaggcactgtggc

SEQ ID NO: 7932158 - DNA, 18 bp, Homo sapiens
agcaggttctcacagcca

SEQ ID NO: 7932159 - DNA, 22 bp, Homo sapiens
agcaggttaaaccaaaatataa

SEQ ID NO: 7932160 - DNA, 22 bp, Homo sapiens
agcaggtttaaactctaatgca

SEQ ID NO: 7932161 - DNA, 23 bp, Homo sapiens
agcagtaacttcagaaacatcag

SEQ ID NO: 7932162 - DNA, 23 bp, Homo sapiens
agcagtaacttcagaaacatcag

SEQ ID NO: 7932163 - DNA, 22 bp, Homo sapiens
agcaggtttgttttcttctgag

SEQ ID NO: 7932164 - DNA, 22 bp, Homo sapiens
agcagtaagtgaagactagttt

SEQ ID NO: 7932165 - DNA, 22 bp, Homo sapiens
agcagtaagcaactgagcttgc

SEQ ID NO: 7932166 - DNA, 22 bp, Homo sapiens
agcagtaagacttttttctgtg

SEQ ID NO: 7932167 - DNA, 22 bp, Homo sapiens
agcagtccttctttagagagcc

SEQ ID NO: 7932168 - DNA, 20 bp, Homo sapiens
agcagtccaaaagggcagac

SEQ ID NO: 7932169 - DNA, 20 bp, Homo sapiens
agcagtccaaaagggcagac

SEQ ID NO: 7932170 - DNA, 22 bp, Homo sapiens
agcagtcattttaggtcatgca

SEQ ID NO: 7932171 - DNA, 18 bp, Homo sapiens
agcagtagcgccaggtgc

SEQ ID NO: 7932172 - DNA, 20 bp, Homo sapiens
agcagtaggacctctgggcc

SEQ ID NO: 7932173 - DNA, 18 bp, Homo sapiens
agcagtagcgccaggtgc

SEQ ID NO: 7932174 - DNA, 22 bp, Homo sapiens
agcagtcaggcctcagagccgt

SEQ ID NO: 7932175 - DNA, 23 bp, Homo sapiens
agcagtcagggtggtaagccatc

SEQ ID NO: 7932176 - DNA, 22 bp, Homo sapiens
agcagtagtgatggcccctgag

SEQ ID NO: 7932177 - DNA, 22 bp, Homo sapiens
agcagtagtgatggcccctgag

SEQ ID NO: 7932178 - DNA, 22 bp, Homo sapiens
agcagtattctcctgtggtgga

SEQ ID NO: 7932179 - DNA, 22 bp, Homo sapiens
agcagtcaggacctgtgatttt

SEQ ID NO: 7932180 - DNA, 22 bp, Homo sapiens
agcagtgcctggcacatgtaag

SEQ ID NO: 7932181 - DNA, 22 bp, Homo sapiens
agcagtgctatggccaggctaa

SEQ ID NO: 7932182 - DNA, 22 bp, Homo sapiens
agcagtgatgcatgacagccta

SEQ ID NO: 7932183 - DNA, 22 bp, Homo sapiens
agcagtgatgcatgacagccta

SEQ ID NO: 7932184 - DNA, 22 bp, Homo sapiens
agcagtgattctcttggactca

SEQ ID NO: 7932185 - DNA, 22 bp, Homo sapiens
agcagtgcccattctgccccct

SEQ ID NO: 7932186 - DNA, 22 bp, Homo sapiens
agcagtgcccattctgccccct

SEQ ID NO: 7932187 - DNA, 21 bp, Homo sapiens
agcagtgctcctgggatgagg

SEQ ID NO: 7932188 - DNA, 22 bp, Homo sapiens
agcagtggacctcagtgctatt

SEQ ID NO: 7932189 - DNA, 22 bp, Homo sapiens
agcagtggacctcagtgctatt

SEQ ID NO: 7932190 - DNA, 22 bp, Homo sapiens
agcagtggacctcagtgctatt

SEQ ID NO: 7932191 - DNA, 22 bp, Homo sapiens
agcagtgatgaaatgagcatcc

SEQ ID NO: 7932192 - DNA, 22 bp, Homo sapiens
agcagtgatgaaatgagcatcc

SEQ ID NO: 7932193 - DNA, 22 bp, Homo sapiens
agcagtgagtgggaggaccatg

SEQ ID NO: 7932194 - DNA, 22 bp, Homo sapiens
agcagtgagtgggaggaccatg

SEQ ID NO: 7932195 - DNA, 22 bp, Homo sapiens
agcagtgagtaacacagaccag

SEQ ID NO: 7932196 - DNA, 22 bp, Homo sapiens
agcagtgatgaaatgagcatcc

SEQ ID NO: 7932197 - DNA, 22 bp, Homo sapiens
agcagtgagtgggaggaccatg

SEQ ID NO: 7932198 - DNA, 22 bp, Homo sapiens
agcagtgagtaacacagaccag

SEQ ID NO: 7932199 - DNA, 22 bp, Homo sapiens
agcagtgagtaacacagaccag

SEQ ID NO: 7932200 - DNA, 23 bp, Homo sapiens
agcagtgagtaaacagataggat

SEQ ID NO: 7932201 - DNA, 23 bp, Homo sapiens
agcagtgagtaaacagataggat

SEQ ID NO: 7932202 - DNA, 22 bp, Homo sapiens
agcagtgacttgctttgtttcc

SEQ ID NO: 7932203 - DNA, 22 bp, Homo sapiens
agcagtgagccataagtgctag

SEQ ID NO: 7932204 - DNA, 23 bp, Homo sapiens
agcagtgagtaaacagataggat

SEQ ID NO: 7932205 - DNA, 22 bp, Homo sapiens
agcagtgagccataagtgctag

SEQ ID NO: 7932206 - DNA, 22 bp, Homo sapiens
agcagtgagccataagtgctag

SEQ ID NO: 7932207 - DNA, 22 bp, Homo sapiens
agcagtgagccataagtgctag

SEQ ID NO: 7932208 - DNA, 22 bp, Homo sapiens
agcagtgaaacagctgcatatg

SEQ ID NO: 7932209 - DNA, 22 bp, Homo sapiens
agcagtgaaacagctgcatatg

SEQ ID NO: 7932210 - DNA, 22 bp, Homo sapiens
agcagtgaaacagctgcatatg

SEQ ID NO: 7932211 - DNA, 22 bp, Homo sapiens
agcagtgaaacagctgcatatg

SEQ ID NO: 7932212 - DNA, 22 bp, Homo sapiens
agcatataggaaatgttgaatc

SEQ ID NO: 7932213 - DNA, 22 bp, Homo sapiens
agcatataggaaatgttgaatc

SEQ ID NO: 7932214 - DNA, 22 bp, Homo sapiens
agcatattcatgccagactact

SEQ ID NO: 7932215 - DNA, 22 bp, Homo sapiens
agcatattgtatgtctatatgt

SEQ ID NO: 7932216 - DNA, 22 bp, Homo sapiens
agcatattgtatgtctatatgt

SEQ ID NO: 7932217 - DNA, 22 bp, Homo sapiens
agcatgaaagcataggacagtc

SEQ ID NO: 7932218 - DNA, 22 bp, Homo sapiens
agcagtggcctggggctctgtg

SEQ ID NO: 7932219 - DNA, 22 bp, Homo sapiens
agcagtggcctggggctctgtg

SEQ ID NO: 7932220 - DNA, 22 bp, Homo sapiens
agcagtggcctggggctctgtg

SEQ ID NO: 7932221 - DNA, 19 bp, Homo sapiens
agcagtggagccatgcctg

SEQ ID NO: 7932222 - DNA, 22 bp, Homo sapiens
agcatgaaaggcgtgccaactt

SEQ ID NO: 7932223 - DNA, 22 bp, Homo sapiens
agcatgaaagcataggacagtc

SEQ ID NO: 7932224 - DNA, 22 bp, Homo sapiens
agcatgaagacttcagagctag

SEQ ID NO: 7932225 - DNA, 22 bp, Homo sapiens
agcatgaagacttcagagctag

SEQ ID NO: 7932226 - DNA, 18 bp, Homo sapiens
agcatgagagaggctgtg

SEQ ID NO: 7932227 - DNA, 22 bp, Homo sapiens
agcatgaagacttcagagctag

SEQ ID NO: 7932228 - DNA, 22 bp, Homo sapiens
agcatgatgtagaatcactgga

SEQ ID NO: 7932229 - DNA, 22 bp, Homo sapiens
agcatgatgtagaatcactgga

SEQ ID NO: 7932230 - DNA, 21 bp, Homo sapiens
agcagctgggcaacatggagg

SEQ ID NO: 7932231 - DNA, 22 bp, Homo sapiens
agcagcttctttcactcctgga

SEQ ID NO: 7932232 - DNA, 21 bp, Homo sapiens
agcagctgggcaacatggagg

SEQ ID NO: 7932233 - DNA, 22 bp, Homo sapiens
agcagcttgaggctggattcca

SEQ ID NO: 7932234 - DNA, 22 bp, Homo sapiens
agcagcttgagctggggctggc

SEQ ID NO: 7932235 - DNA, 22 bp, Homo sapiens
agcagcttgagctggggctggc

SEQ ID NO: 7932236 - DNA, 22 bp, Homo sapiens
agcaggaactgacaccaagcca

SEQ ID NO: 7932237 - DNA, 22 bp, Homo sapiens
agcaggaactgacaccaagcca

SEQ ID NO: 7932238 - DNA, 22 bp, Homo sapiens
agcaggaactcagggagttctc

SEQ ID NO: 7932239 - DNA, 22 bp, Homo sapiens
agcaggaactcagggagttctc

SEQ ID NO: 7932240 - DNA, 22 bp, Homo sapiens
agcaggaactgacaccaagcca

SEQ ID NO: 7932241 - DNA, 22 bp, Homo sapiens
agcaggaactgacaccaagcca

SEQ ID NO: 7932242 - DNA, 22 bp, Homo sapiens
agcaggaaggctttgggggttc

SEQ ID NO: 7932243 - DNA, 22 bp, Homo sapiens
agcaggaaggctttgggggttc

SEQ ID NO: 7932244 - DNA, 22 bp, Homo sapiens
agcaggaaggctttgggggttc

SEQ ID NO: 7932245 - DNA, 22 bp, Homo sapiens
agcaggaaggggatgatgggca

SEQ ID NO: 7932246 - DNA, 22 bp, Homo sapiens
agcaggaaggggatgatgggca

SEQ ID NO: 7932247 - DNA, 22 bp, Homo sapiens
agcaggaaggggcctagcctgg

SEQ ID NO: 7932248 - DNA, 22 bp, Homo sapiens
agcaggaaggggcctagcctgg

SEQ ID NO: 7932249 - DNA, 22 bp, Homo sapiens
agcaggaaggtctgtgtgagtc

SEQ ID NO: 7932250 - DNA, 22 bp, Homo sapiens
agcaggaaggtctgtgtgagtc

SEQ ID NO: 7932251 - DNA, 22 bp, Homo sapiens
agcaggaaggtctgttagtcca

SEQ ID NO: 7932252 - DNA, 22 bp, Homo sapiens
agcaggaaggtctgtgtgagtc

SEQ ID NO: 7932253 - DNA, 22 bp, Homo sapiens
agcaggaaggtctgtgtgagtc

SEQ ID NO: 7932254 - DNA, 22 bp, Homo sapiens
agcaggaaggtctgtgtgagtc

SEQ ID NO: 7932255 - DNA, 22 bp, Homo sapiens
cacagcaagagctaaatgacca

SEQ ID NO: 7932256 - DNA, 22 bp, Homo sapiens
cacagcaagagctaaatgacca

SEQ ID NO: 7932257 - DNA, 22 bp, Homo sapiens
cacagcaagagctaaatgacca

SEQ ID NO: 7932258 - DNA, 20 bp, Homo sapiens
agcaggaatgatgctttcat

SEQ ID NO: 7932259 - DNA, 17 bp, Homo sapiens
agcaggaccccagagca

SEQ ID NO: 7932260 - DNA, 17 bp, Homo sapiens
agcaggaccccagagca

SEQ ID NO: 7932261 - DNA, 17 bp, Homo sapiens
agcaggaccccagagca

SEQ ID NO: 7932262 - DNA, 22 bp, Homo sapiens
agcaggaccaagaaggggaaaa

SEQ ID NO: 7932263 - DNA, 17 bp, Homo sapiens
agcaggaccccagagca

SEQ ID NO: 7932264 - DNA, 22 bp, Homo sapiens
cacagcaatagctaactgatac

SEQ ID NO: 7932265 - DNA, 22 bp, Homo sapiens
cacagcaatagctaactgatac

SEQ ID NO: 7932266 - DNA, 22 bp, Homo sapiens
cacagcaagagctaaatgacca

SEQ ID NO: 7932267 - DNA, 22 bp, Homo sapiens
cacagcaatagctaactgatac

SEQ ID NO: 7932268 - DNA, 22 bp, Homo sapiens
agcaggaccaagaaggggaaaa

SEQ ID NO: 7932269 - DNA, 22 bp, Homo sapiens
agcaggacacgatgcggcagga

SEQ ID NO: 7932270 - DNA, 22 bp, Homo sapiens
agcaggacacgatgcggcagga

SEQ ID NO: 7932271 - DNA, 22 bp, Homo sapiens
agcaggacaatatgggatcagg

SEQ ID NO: 7932272 - DNA, 22 bp, Homo sapiens
agcaggaagtagtctgtaagca

SEQ ID NO: 7932273 - DNA, 22 bp, Homo sapiens
agcaggaagtcctctcaggaga

SEQ ID NO: 7932274 - DNA, 22 bp, Homo sapiens
agcaggaagtcctctcaggaga

SEQ ID NO: 7932275 - DNA, 22 bp, Homo sapiens
agcaggaagtagtctgtaagca

SEQ ID NO: 7932276 - DNA, 22 bp, Homo sapiens
agcaggaagtcctctcaggaga

SEQ ID NO: 7932277 - DNA, 22 bp, Homo sapiens
agcaggaatctgttctgtataa

SEQ ID NO: 7932278 - DNA, 20 bp, Homo sapiens
agcaggaatgatgctttcat

SEQ ID NO: 7932279 - DNA, 22 bp, Homo sapiens
agcagggaggcccagggcactg

SEQ ID NO: 7932280 - DNA, 22 bp, Homo sapiens
agcagggaggcccagggcactg

SEQ ID NO: 7932281 - DNA, 22 bp, Homo sapiens
agcagggaggcccagggcactg

SEQ ID NO: 7932282 - DNA, 22 bp, Homo sapiens
agcagggaggcccagggcactg

SEQ ID NO: 7932283 - DNA, 22 bp, Homo sapiens
agcagggaggcccagggcactg

SEQ ID NO: 7932284 - DNA, 22 bp, Homo sapiens
agcagggagaccatctcttcct

SEQ ID NO: 7932285 - DNA, 22 bp, Homo sapiens
cacagcagatccaggggttgtg

SEQ ID NO: 7932286 - DNA, 22 bp, Homo sapiens
agcagggagaccatctcttcct

SEQ ID NO: 7932287 - DNA, 22 bp, Homo sapiens
agcagggaggtctagcacgtgg

SEQ ID NO: 7932288 - DNA, 22 bp, Homo sapiens
agcagggaggtctagcacgtgg

SEQ ID NO: 7932289 - DNA, 17 bp, Homo sapiens
agcagggagtcaaggga

SEQ ID NO: 7932290 - DNA, 17 bp, Homo sapiens
agcagggagtcaaggga

SEQ ID NO: 7932291 - DNA, 17 bp, Homo sapiens
agcagggagtcaaggga

SEQ ID NO: 7932292 - DNA, 22 bp, Homo sapiens
agcagggaggcggtgtgctggc

SEQ ID NO: 7932293 - DNA, 22 bp, Homo sapiens
agcagggaggcggtgtgctggc

SEQ ID NO: 7932294 - DNA, 22 bp, Homo sapiens
agcagggaggtctagcacgtgg

SEQ ID NO: 7932295 - DNA, 22 bp, Homo sapiens
cacagcagaaagtgtaggagga

SEQ ID NO: 7932296 - DNA, 22 bp, Homo sapiens
cacagcagaaatatgaaggcag

SEQ ID NO: 7932297 - DNA, 22 bp, Homo sapiens
cacagcagaaatatgaaggcag

SEQ ID NO: 7932298 - DNA, 22 bp, Homo sapiens
cacagcagaaagtgtaggagga

SEQ ID NO: 7932299 - DNA, 22 bp, Homo sapiens
cacagcagaaagtgtaggagga

SEQ ID NO: 7932300 - DNA, 22 bp, Homo sapiens
cacagcagaaagtgtaggagga

SEQ ID NO: 7932301 - DNA, 22 bp, Homo sapiens
cacagcagaaagtgtaggagga

SEQ ID NO: 7932302 - DNA, 22 bp, Homo sapiens
cacagcagaaagtgtaggagga

SEQ ID NO: 7932303 - DNA, 22 bp, Homo sapiens
cacagcagaaagtgtaggagga

SEQ ID NO: 7932304 - DNA, 22 bp, Homo sapiens
cacagcagaacttaatttcaaa

SEQ ID NO: 7932305 - DNA, 22 bp, Homo sapiens
cacagcagaacttaatttcaaa

SEQ ID NO: 7932306 - DNA, 22 bp, Homo sapiens
cacagcagaacttaatttcaaa

SEQ ID NO: 7932307 - DNA, 22 bp, Homo sapiens
cacagcagaaatatgaaggcag

SEQ ID NO: 7932308 - DNA, 22 bp, Homo sapiens
cacagcagaaatatgaaggcag

SEQ ID NO: 7932309 - DNA, 22 bp, Homo sapiens
cacagcagaaatatgaaggcag

SEQ ID NO: 7932310 - DNA, 22 bp, Homo sapiens
agcaggctgggcaatatgggca

SEQ ID NO: 7932311 - DNA, 23 bp, Homo sapiens
agcaggctgcttctccacagctg

SEQ ID NO: 7932312 - DNA, 22 bp, Homo sapiens
cacagcagagggagccattgaa

SEQ ID NO: 7932313 - DNA, 22 bp, Homo sapiens
cacagcagagggagccattgaa

SEQ ID NO: 7932314 - DNA, 22 bp, Homo sapiens
cacagcagacagggaggcggct

SEQ ID NO: 7932315 - DNA, 22 bp, Homo sapiens
cacagcagagggagccattgaa

SEQ ID NO: 7932316 - DNA, 22 bp, Homo sapiens
cacagcagagggagccattgaa

SEQ ID NO: 7932317 - DNA, 22 bp, Homo sapiens
cacagcagagggagccattgaa

SEQ ID NO: 7932318 - DNA, 22 bp, Homo sapiens
cacagcagacagggaggcggct

SEQ ID NO: 7932319 - DNA, 22 bp, Homo sapiens
cacagcagacagggaggcggct

SEQ ID NO: 7932320 - DNA, 22 bp, Homo sapiens
cacagcagacagggaggcggct

SEQ ID NO: 7932321 - DNA, 22 bp, Homo sapiens
cacagcagacagggaggcggct

SEQ ID NO: 7932322 - DNA, 22 bp, Homo sapiens
caccagccagagtgacagctcc

SEQ ID NO: 7932323 - DNA, 22 bp, Homo sapiens
caccagccagagtgacagctcc

SEQ ID NO: 7932324 - DNA, 22 bp, Homo sapiens
caccagccccctcacgctgtca

SEQ ID NO: 7932325 - DNA, 22 bp, Homo sapiens
caccagcgactgtgaccagcaa

SEQ ID NO: 7932326 - DNA, 22 bp, Homo sapiens
caccagccccctcacgctgtca

SEQ ID NO: 7932327 - DNA, 22 bp, Homo sapiens
agcagggctctgccatgggccc

SEQ ID NO: 7932328 - DNA, 22 bp, Homo sapiens
agcagggctctgtggagggtgg

SEQ ID NO: 7932329 - DNA, 22 bp, Homo sapiens
agcagggctctgccatgggccc

SEQ ID NO: 7932330 - DNA, 22 bp, Homo sapiens
agcagggctctgtggagggtgg

SEQ ID NO: 7932331 - DNA, 22 bp, Homo sapiens
agcagggctctgtggagggtgg

SEQ ID NO: 7932332 - DNA, 22 bp, Homo sapiens
agcagggctctgtggagggtgg

SEQ ID NO: 7932333 - DNA, 22 bp, Homo sapiens
agcagggctctgtggagggtgg

SEQ ID NO: 7932334 - DNA, 22 bp, Homo sapiens
agcagggctgcagtgtgtcttt

SEQ ID NO: 7932335 - DNA, 22 bp, Homo sapiens
agcagggctgcagtgtgtcttt

SEQ ID NO: 7932336 - DNA, 22 bp, Homo sapiens
agcagggctgcagtgtgtcttt

SEQ ID NO: 7932337 - DNA, 22 bp, Homo sapiens
agcagggctgcagtgtgtcttt

SEQ ID NO: 7932338 - DNA, 22 bp, Homo sapiens
agcagggctctgtggagggtgg

SEQ ID NO: 7932339 - DNA, 22 bp, Homo sapiens
caccagagttgtccaaatgatt

SEQ ID NO: 7932340 - DNA, 22 bp, Homo sapiens
caccagagttgtccaaatgatt

SEQ ID NO: 7932341 - DNA, 22 bp, Homo sapiens
caccagagttgtccaaatgatt

SEQ ID NO: 7932342 - DNA, 22 bp, Homo sapiens
caccagagtgagtggactgtcg

SEQ ID NO: 7932343 - DNA, 22 bp, Homo sapiens
caccagagtgagtggactgtcg

SEQ ID NO: 7932344 - DNA, 22 bp, Homo sapiens
caccagagtgagtggactgtcg

SEQ ID NO: 7932345 - DNA, 22 bp, Homo sapiens
caccagagccacttggaggtca

SEQ ID NO: 7932346 - DNA, 22 bp, Homo sapiens
caccagagtgagtggactgtcg

SEQ ID NO: 7932347 - DNA, 22 bp, Homo sapiens
caccagagccacttggaggtca

SEQ ID NO: 7932348 - DNA, 22 bp, Homo sapiens
caccagagtgggtgagggtgat

SEQ ID NO: 7932349 - DNA, 22 bp, Homo sapiens
caccagagtgggtgagggtgat

SEQ ID NO: 7932350 - DNA, 23 bp, Homo sapiens
caccactttctccttctccttgg

SEQ ID NO: 7932351 - DNA, 23 bp, Homo sapiens
caccactttctccttctccttgg

SEQ ID NO: 7932352 - DNA, 23 bp, Homo sapiens
caccactttctccttctccttgg

SEQ ID NO: 7932353 - DNA, 22 bp, Homo sapiens
caccagacaggtgtatgcatat

SEQ ID NO: 7932354 - DNA, 22 bp, Homo sapiens
caccagaacaagacaggagaat

SEQ ID NO: 7932355 - DNA, 22 bp, Homo sapiens
caccagaacaagacaggagaat

SEQ ID NO: 7932356 - DNA, 22 bp, Homo sapiens
caccagaacaagacaggagaat

SEQ ID NO: 7932357 - DNA, 23 bp, Homo sapiens
caccactttctccttctccttgg

SEQ ID NO: 7932358 - DNA, 20 bp, Homo sapiens
caccagcagcagctgccacc

SEQ ID NO: 7932359 - DNA, 20 bp, Homo sapiens
caccagcagcagctgccacc

SEQ ID NO: 7932360 - DNA, 20 bp, Homo sapiens
caccagcagcagctgccacc

SEQ ID NO: 7932361 - DNA, 20 bp, Homo sapiens
caccagcagcagctgccacc

SEQ ID NO: 7932362 - DNA, 20 bp, Homo sapiens
caccagcagcagctgccacc

SEQ ID NO: 7932363 - DNA, 20 bp, Homo sapiens
caccagcagcagctgccacc

SEQ ID NO: 7932364 - DNA, 20 bp, Homo sapiens
caccagcagcagctgccacc

SEQ ID NO: 7932365 - DNA, 22 bp, Homo sapiens
caccagccagagtgacagctcc

SEQ ID NO: 7932366 - DNA, 22 bp, Homo sapiens
caccagcagcggtgtgagggtg

SEQ ID NO: 7932367 - DNA, 22 bp, Homo sapiens
caccagcagcggtgtgagggtg

SEQ ID NO: 7932368 - DNA, 22 bp, Homo sapiens
caccagcagaagactgagggtg

SEQ ID NO: 7932369 - DNA, 20 bp, Homo sapiens
caccagcagcagctgccacc

SEQ ID NO: 7932370 - DNA, 20 bp, Homo sapiens
caccagcagcagctgccacc

SEQ ID NO: 7932371 - DNA, 22 bp, Homo sapiens
caccagcagaagactgagggtg

SEQ ID NO: 7932372 - DNA, 22 bp, Homo sapiens
caccagcaccagctctgtgcct

SEQ ID NO: 7932373 - DNA, 22 bp, Homo sapiens
caccagcagaagactgagggtg

SEQ ID NO: 7932374 - DNA, 22 bp, Homo sapiens
agcagggcaggtaaggatcaga

SEQ ID NO: 7932375 - DNA, 22 bp, Homo sapiens
agcagggcaggtaaggatcaga

SEQ ID NO: 7932376 - DNA, 22 bp, Homo sapiens
agcagggcaggtaaggatcaga

SEQ ID NO: 7932377 - DNA, 22 bp, Homo sapiens
agcagggcaggtaaggatcaga

SEQ ID NO: 7932378 - DNA, 22 bp, Homo sapiens
agcagggcagcttttttcagaa

SEQ ID NO: 7932379 - DNA, 22 bp, Homo sapiens
agcagggcagctgatgcgcacg

SEQ ID NO: 7932380 - DNA, 22 bp, Homo sapiens
agcagggcaggtaaggatcaga

SEQ ID NO: 7932381 - DNA, 22 bp, Homo sapiens
agcagggcagcttttttcagaa

SEQ ID NO: 7932382 - DNA, 22 bp, Homo sapiens
agcagggcaggtaaggatcaga

SEQ ID NO: 7932383 - DNA, 22 bp, Homo sapiens
agcagggcagtgatcagaaagg

SEQ ID NO: 7932384 - DNA, 22 bp, Homo sapiens
agcagggcagtgatcagaaagg

SEQ ID NO: 7932385 - DNA, 22 bp, Homo sapiens
agcagggcagtgatcagaaagg

SEQ ID NO: 7932386 - DNA, 22 bp, Homo sapiens
agcagggcagtgatcagaaagg

SEQ ID NO: 7932387 - DNA, 22 bp, Homo sapiens
agcagggcagtgatcagaaagg

SEQ ID NO: 7932388 - DNA, 23 bp, Homo sapiens
caccactttctccttctccttgg

SEQ ID NO: 7932389 - DNA, 19 bp, Homo sapiens
caccacttctttttgcatc

SEQ ID NO: 7932390 - DNA, 22 bp, Homo sapiens
caccacttcataggctttaagg

SEQ ID NO: 7932391 - DNA, 22 bp, Homo sapiens
caccactgtatccctagcactt

SEQ ID NO: 7932392 - DNA, 22 bp, Homo sapiens
cacatttaatcctttataagta

SEQ ID NO: 7932393 - DNA, 22 bp, Homo sapiens
cacatttaatcctttataagta

SEQ ID NO: 7932394 - DNA, 22 bp, Homo sapiens
cacatttaattggtttagggtg

SEQ ID NO: 7932395 - DNA, 22 bp, Homo sapiens
cacatttaatcctttataagta

SEQ ID NO: 7932396 - DNA, 22 bp, Homo sapiens
agcagggcaaagtcaggctaac

SEQ ID NO: 7932397 - DNA, 22 bp, Homo sapiens
agcagggcaaagtcaggctaac

SEQ ID NO: 7932398 - DNA, 22 bp, Homo sapiens
agcagggcaaagtcaggctaac

SEQ ID NO: 7932399 - DNA, 22 bp, Homo sapiens
agcagggcaaagtcaggctaac

SEQ ID NO: 7932400 - DNA, 22 bp, Homo sapiens
agcagggcaaagtcaggctaac

SEQ ID NO: 7932401 - DNA, 22 bp, Homo sapiens
agcagggcaaagtcaggctaac

SEQ ID NO: 7932402 - DNA, 17 bp, Homo sapiens
agcagggagtcaaggga

SEQ ID NO: 7932403 - DNA, 19 bp, Homo sapiens
agcagggagtggttgtggg

SEQ ID NO: 7932404 - DNA, 22 bp, Homo sapiens
agcagggcactggaaggcactg

SEQ ID NO: 7932405 - DNA, 22 bp, Homo sapiens
agcagggcactggaaggcactg

SEQ ID NO: 7932406 - DNA, 22 bp, Homo sapiens
agcagggcactggaaggcactg

SEQ ID NO: 7932407 - DNA, 22 bp, Homo sapiens
agcagggcaaagtcaggctaac

SEQ ID NO: 7932408 - DNA, 22 bp, Homo sapiens
agcagggcaaagtcaggctaac

SEQ ID NO: 7932409 - DNA, 22 bp, Homo sapiens
agcagggcagctgatgcgcacg

SEQ ID NO: 7932410 - DNA, 22 bp, Homo sapiens
agcagggcagctgatgcgcacg

SEQ ID NO: 7932411 - DNA, 22 bp, Homo sapiens
agcagggcagctgatgcgcacg

SEQ ID NO: 7932412 - DNA, 22 bp, Homo sapiens
agcagggcagctgatgcgcacg

SEQ ID NO: 7932413 - DNA, 22 bp, Homo sapiens
agcagggcagctgatgcgcacg

SEQ ID NO: 7932414 - DNA, 22 bp, Homo sapiens
agcagggcagctgatgcgcacg

SEQ ID NO: 7932415 - DNA, 22 bp, Homo sapiens
agcagggcagctgatgcgcacg

SEQ ID NO: 7932416 - DNA, 22 bp, Homo sapiens
cagatggctgccaagatgggct

SEQ ID NO: 7932417 - DNA, 22 bp, Homo sapiens
cagatggccagaggcagctgca

SEQ ID NO: 7932418 - DNA, 22 bp, Homo sapiens
cagatggctgccttcttgctgt

SEQ ID NO: 7932419 - DNA, 22 bp, Homo sapiens
cagatggcagggcagctctgca

SEQ ID NO: 7932420 - DNA, 22 bp, Homo sapiens
cagatggcagggcagctctgca

SEQ ID NO: 7932421 - DNA, 22 bp, Homo sapiens
cagatggcagggcagctctgca

SEQ ID NO: 7932422 - DNA, 20 bp, Homo sapiens
cagatggcacgtcagggcat

SEQ ID NO: 7932423 - DNA, 19 bp, Homo sapiens
cagatggccacctacttgc

SEQ ID NO: 7932424 - DNA, 22 bp, Homo sapiens
cagatggcatttcctttctggc

SEQ ID NO: 7932425 - DNA, 22 bp, Homo sapiens
cagatgaagatcatagaatagt

SEQ ID NO: 7932426 - DNA, 22 bp, Homo sapiens
agccctgggctgtagataagca

SEQ ID NO: 7932427 - DNA, 22 bp, Homo sapiens
agccctgggcgttactgggatg

SEQ ID NO: 7932428 - DNA, 22 bp, Homo sapiens
cagatgaagatcatagaatagt

SEQ ID NO: 7932429 - DNA, 22 bp, Homo sapiens
agccctgggcgttactgggatg

SEQ ID NO: 7932430 - DNA, 22 bp, Homo sapiens
agccctgggcgttactgggatg

SEQ ID NO: 7932431 - DNA, 22 bp, Homo sapiens
agccctgggcagccaaggaagc

SEQ ID NO: 7932432 - DNA, 22 bp, Homo sapiens
agccctgggcagccaaggaagc

SEQ ID NO: 7932433 - DNA, 22 bp, Homo sapiens
agccctgggcagccaaggaagc

SEQ ID NO: 7932434 - DNA, 22 bp, Homo sapiens
agccctgggcagccaaggaagc

SEQ ID NO: 7932435 - DNA, 22 bp, Homo sapiens
agccctggctcccagcagcgct

SEQ ID NO: 7932436 - DNA, 22 bp, Homo sapiens
agccctggctcccagcagcgct

SEQ ID NO: 7932437 - DNA, 22 bp, Homo sapiens
agccctggctcccagcagcgct

SEQ ID NO: 7932438 - DNA, 22 bp, Homo sapiens
agccctggcccggctgtgcttt

SEQ ID NO: 7932439 - DNA, 22 bp, Homo sapiens
agccctggcccggctgtgcttt

SEQ ID NO: 7932440 - DNA, 22 bp, Homo sapiens
agccctggctcccagcagcgct

SEQ ID NO: 7932441 - DNA, 22 bp, Homo sapiens
agccctggcccggctgtgcttt

SEQ ID NO: 7932442 - DNA, 22 bp, Homo sapiens
agccctggcccggctgtgcttt

SEQ ID NO: 7932443 - DNA, 22 bp, Homo sapiens
agccctggcccggctgtgcttt

SEQ ID NO: 7932444 - DNA, 22 bp, Homo sapiens
agccctggcccggctgtgcttt

SEQ ID NO: 7932445 - DNA, 22 bp, Homo sapiens
agccctggcccggctgtgcttt

SEQ ID NO: 7932446 - DNA, 22 bp, Homo sapiens
agccctggcccggctgtgcttt

SEQ ID NO: 7932447 - DNA, 22 bp, Homo sapiens
agccctgggcacctgtgagggg

SEQ ID NO: 7932448 - DNA, 22 bp, Homo sapiens
agccctgggcacctgtgagggg

SEQ ID NO: 7932449 - DNA, 22 bp, Homo sapiens
agccctgggcacctgtgagggg

SEQ ID NO: 7932450 - DNA, 22 bp, Homo sapiens
agccctgggcacctgtgagggg

SEQ ID NO: 7932451 - DNA, 22 bp, Homo sapiens
agccctgggatacagtaaaagc

SEQ ID NO: 7932452 - DNA, 22 bp, Homo sapiens
agccctgggatacagtaaaagc

SEQ ID NO: 7932453 - DNA, 22 bp, Homo sapiens
agccctgggatacagtaaaagc

SEQ ID NO: 7932454 - DNA, 22 bp, Homo sapiens
agccctgggaggccagcttgta

SEQ ID NO: 7932455 - DNA, 22 bp, Homo sapiens
agccctggctcccagcagcgct

SEQ ID NO: 7932456 - DNA, 22 bp, Homo sapiens
agccctgggaggccagcttgta

SEQ ID NO: 7932457 - DNA, 22 bp, Homo sapiens
agccctgggaggccagcttgta

SEQ ID NO: 7932458 - DNA, 22 bp, Homo sapiens
agccctgggaggccagcttgta

SEQ ID NO: 7932459 - DNA, 22 bp, Homo sapiens
agccctgggaggccagcttgta

SEQ ID NO: 7932460 - DNA, 22 bp, Homo sapiens
agccctgggaggccagcttgta

SEQ ID NO: 7932461 - DNA, 22 bp, Homo sapiens
agccctgattaaccttggcttt

SEQ ID NO: 7932462 - DNA, 22 bp, Homo sapiens
agccctgattaaccttggcttt

SEQ ID NO: 7932463 - DNA, 23 bp, Homo sapiens
agccctgctgagacccagctccc

SEQ ID NO: 7932464 - DNA, 22 bp, Homo sapiens
agccctgctcatctggatcccg

SEQ ID NO: 7932465 - DNA, 22 bp, Homo sapiens
agccctgctgcctgaattagct

SEQ ID NO: 7932466 - DNA, 23 bp, Homo sapiens
agccctgctgagacccagctccc

SEQ ID NO: 7932467 - DNA, 23 bp, Homo sapiens
agccctgctgagacccagctccc

SEQ ID NO: 7932468 - DNA, 23 bp, Homo sapiens
agccctgctgagacccagctccc

SEQ ID NO: 7932469 - DNA, 22 bp, Homo sapiens
agccccagtccgctgcgggcgg

SEQ ID NO: 7932470 - DNA, 22 bp, Homo sapiens
agccccagttccctggaagtct

SEQ ID NO: 7932471 - DNA, 22 bp, Homo sapiens
agccccagttccctggaagtct

SEQ ID NO: 7932472 - DNA, 22 bp, Homo sapiens
agccccagttccctggaagtct

SEQ ID NO: 7932473 - DNA, 22 bp, Homo sapiens
agccccagttccctggaagtct

SEQ ID NO: 7932474 - DNA, 22 bp, Homo sapiens
agcccccacgtttcctgggtcc

SEQ ID NO: 7932475 - DNA, 17 bp, Homo sapiens
agcccccactcccaagt

SEQ ID NO: 7932476 - DNA, 22 bp, Homo sapiens
agccctgagctggcctgggctt

SEQ ID NO: 7932477 - DNA, 22 bp, Homo sapiens
agccctggagcaaaggtgtctt

SEQ ID NO: 7932478 - DNA, 22 bp, Homo sapiens
agccctggagcaaaggtgtctt

SEQ ID NO: 7932479 - DNA, 22 bp, Homo sapiens
agccctggagcaaaggtgtctt

SEQ ID NO: 7932480 - DNA, 22 bp, Homo sapiens
agccctggagcaaaggtgtctt

SEQ ID NO: 7932481 - DNA, 22 bp, Homo sapiens
agccctggaccttagcccccac

SEQ ID NO: 7932482 - DNA, 22 bp, Homo sapiens
agccctggaccttagcccccac

SEQ ID NO: 7932483 - DNA, 22 bp, Homo sapiens
agccctggagcaaaggtgtctt

SEQ ID NO: 7932484 - DNA, 22 bp, Homo sapiens
agccctggaagccacagtccta

SEQ ID NO: 7932485 - DNA, 22 bp, Homo sapiens
agccctggaagccacagtccta

SEQ ID NO: 7932486 - DNA, 22 bp, Homo sapiens
agccctggaagccacagtccta

SEQ ID NO: 7932487 - DNA, 22 bp, Homo sapiens
agccctggaagccacagtccta

SEQ ID NO: 7932488 - DNA, 22 bp, Homo sapiens
agccctgcttcaccatttactt

SEQ ID NO: 7932489 - DNA, 22 bp, Homo sapiens
agccctggattctgaggtccaa

SEQ ID NO: 7932490 - DNA, 22 bp, Homo sapiens
agccctggattctgaggtccaa

SEQ ID NO: 7932491 - DNA, 22 bp, Homo sapiens
agccctggattctgaggtccaa

SEQ ID NO: 7932492 - DNA, 22 bp, Homo sapiens
agccctggatggacagtttccc

SEQ ID NO: 7932493 - DNA, 22 bp, Homo sapiens
agccctggattctgaggtccaa

SEQ ID NO: 7932494 - DNA, 22 bp, Homo sapiens
agccctggagcaaaggtgtctt

SEQ ID NO: 7932495 - DNA, 22 bp, Homo sapiens
agccctggcagagccaggtagt

SEQ ID NO: 7932496 - DNA, 22 bp, Homo sapiens
agccctggcagagccaggtagt

SEQ ID NO: 7932497 - DNA, 22 bp, Homo sapiens
agccctggcagagccaggtagt

SEQ ID NO: 7932498 - DNA, 22 bp, Homo sapiens
agccctggcagagccaggtagt

SEQ ID NO: 7932499 - DNA, 22 bp, Homo sapiens
agccctggcagagccaggtagt

SEQ ID NO: 7932500 - DNA, 22 bp, Homo sapiens
agccctggcagagccaggtagt

SEQ ID NO: 7932501 - DNA, 22 bp, Homo sapiens
agccctggcagagccaggtagt

SEQ ID NO: 7932502 - DNA, 22 bp, Homo sapiens
agccagtggtgtaatgccgtct

SEQ ID NO: 7932503 - DNA, 22 bp, Homo sapiens
agccagtgtcgtgtgacatgag

SEQ ID NO: 7932504 - DNA, 22 bp, Homo sapiens
agccagtgtcgtgtgacatgag

SEQ ID NO: 7932505 - DNA, 22 bp, Homo sapiens
agccagtgggattagagcctct

SEQ ID NO: 7932506 - DNA, 22 bp, Homo sapiens
agccagtggaattcccaggggt

SEQ ID NO: 7932507 - DNA, 22 bp, Homo sapiens
agccagtgttaagtgactggtt

SEQ ID NO: 7932508 - DNA, 22 bp, Homo sapiens
agccagtgttaagtgactggtt

SEQ ID NO: 7932509 - DNA, 22 bp, Homo sapiens
agccagtgttaagtgactggtt

SEQ ID NO: 7932510 - DNA, 22 bp, Homo sapiens
agccagtgttaagtgactggtt

SEQ ID NO: 7932511 - DNA, 19 bp, Homo sapiens
agccagttctagacaatgg

SEQ ID NO: 7932512 - DNA, 22 bp, Homo sapiens
agccagttccagcacaccactg

SEQ ID NO: 7932513 - DNA, 22 bp, Homo sapiens
agccagttcaagttatggcgtt

SEQ ID NO: 7932514 - DNA, 22 bp, Homo sapiens
agccagttccagcacaccactg

SEQ ID NO: 7932515 - DNA, 17 bp, Homo sapiens
agccagttcatagcact

SEQ ID NO: 7932516 - DNA, 22 bp, Homo sapiens
agccagttcaagttatggcgtt

SEQ ID NO: 7932517 - DNA, 22 bp, Homo sapiens
cagagctctgacagctacagcc

SEQ ID NO: 7932518 - DNA, 22 bp, Homo sapiens
cagagctctgacagctacagcc

SEQ ID NO: 7932519 - DNA, 22 bp, Homo sapiens
cagagctctctttgctactaca

SEQ ID NO: 7932520 - DNA, 22 bp, Homo sapiens
cagagctctctttgctactaca

SEQ ID NO: 7932521 - DNA, 22 bp, Homo sapiens
cagagctctatgttcatggagg

SEQ ID NO: 7932522 - DNA, 22 bp, Homo sapiens
cagagctctgacagctacagcc

SEQ ID NO: 7932523 - DNA, 22 bp, Homo sapiens
cagagctctgacagctacagcc

SEQ ID NO: 7932524 - DNA, 22 bp, Homo sapiens
cagagctctgacagctacagcc

SEQ ID NO: 7932525 - DNA, 22 bp, Homo sapiens
agccagtgcagctggaaattca

SEQ ID NO: 7932526 - DNA, 22 bp, Homo sapiens
agccagtgcagctggaaattca

SEQ ID NO: 7932527 - DNA, 22 bp, Homo sapiens
agccagtgccagtcatgcctgc

SEQ ID NO: 7932528 - DNA, 22 bp, Homo sapiens
agccagtgccagtcatgcctgc

SEQ ID NO: 7932529 - DNA, 22 bp, Homo sapiens
agccagtggaattcccaggggt

SEQ ID NO: 7932530 - DNA, 22 bp, Homo sapiens
agccagttctctagtgatattt

SEQ ID NO: 7932531 - DNA, 19 bp, Homo sapiens
agccagttctagacaatgg

SEQ ID NO: 7932532 - DNA, 19 bp, Homo sapiens
agccagttctagacaatgg

SEQ ID NO: 7932533 - DNA, 19 bp, Homo sapiens
agccagttctagacaatgg

SEQ ID NO: 7932534 - DNA, 22 bp, Homo sapiens
agccagttggctatgaggagga

SEQ ID NO: 7932535 - DNA, 22 bp, Homo sapiens
agccagttggctatgaggagga

SEQ ID NO: 7932536 - DNA, 22 bp, Homo sapiens
agccagttgatgggtttccaat

SEQ ID NO: 7932537 - DNA, 23 bp, Homo sapiens
agccagttgtagccacagaactc

SEQ ID NO: 7932538 - DNA, 19 bp, Homo sapiens
agccagttggtaagaggct

SEQ ID NO: 7932539 - DNA, 22 bp, Homo sapiens
agccagttggctatgaggagga

SEQ ID NO: 7932540 - DNA, 22 bp, Homo sapiens
agccagttggctatgaggagga

SEQ ID NO: 7932541 - DNA, 22 bp, Homo sapiens
agccagtttgcttgtaataaca

SEQ ID NO: 7932542 - DNA, 22 bp, Homo sapiens
agccagtttgcttgtaataaca

SEQ ID NO: 7932543 - DNA, 22 bp, Homo sapiens
agcccagggacagggcggatgt

SEQ ID NO: 7932544 - DNA, 22 bp, Homo sapiens
agccagtttaagcaggaggggt

SEQ ID NO: 7932545 - DNA, 22 bp, Homo sapiens
agccagttgtggggctagccct

SEQ ID NO: 7932546 - DNA, 22 bp, Homo sapiens
agccagtttccagatattaact

SEQ ID NO: 7932547 - DNA, 19 bp, Homo sapiens
agccagttggtaagaggct

SEQ ID NO: 7932548 - DNA, 23 bp, Homo sapiens
agccagttgtagccacagaactc

SEQ ID NO: 7932549 - DNA, 22 bp, Homo sapiens
agccagttgtggggctagccct

SEQ ID NO: 7932550 - DNA, 23 bp, Homo sapiens
agccagttgtagccacagaactc

SEQ ID NO: 7932551 - DNA, 22 bp, Homo sapiens
agccagtttaagcaggaggggt

SEQ ID NO: 7932552 - DNA, 22 bp, Homo sapiens
agccagtttaagcaggaggggt

SEQ ID NO: 7932553 - DNA, 22 bp, Homo sapiens
agcccaggttgaggctgcagtg

SEQ ID NO: 7932554 - DNA, 22 bp, Homo sapiens
agcccaggttgaggctgcagtg

SEQ ID NO: 7932555 - DNA, 22 bp, Homo sapiens
agcccaggttgaggctgcagtg

SEQ ID NO: 7932556 - DNA, 22 bp, Homo sapiens
agcccaggttgaggctgcagtg

SEQ ID NO: 7932557 - DNA, 22 bp, Homo sapiens
agcccaggttctaaagccaaac

SEQ ID NO: 7932558 - DNA, 22 bp, Homo sapiens
agcccaggttctaaagccaaac

SEQ ID NO: 7932559 - DNA, 22 bp, Homo sapiens
agcccaggttctaaagccaaac

SEQ ID NO: 7932560 - DNA, 22 bp, Homo sapiens
agcccaggttctaaagccaaac

SEQ ID NO: 7932561 - DNA, 22 bp, Homo sapiens
agcccagggacagggcggatgt

SEQ ID NO: 7932562 - DNA, 22 bp, Homo sapiens
agcccagggagttgattagcat

SEQ ID NO: 7932563 - DNA, 22 bp, Homo sapiens
agcccagggacagggcggatgt

SEQ ID NO: 7932564 - DNA, 22 bp, Homo sapiens
agcccagggacagggcggatgt

SEQ ID NO: 7932565 - DNA, 22 bp, Homo sapiens
agcccagggacagggcggatgt

SEQ ID NO: 7932566 - DNA, 22 bp, Homo sapiens
agcccagggacagggcggatgt

SEQ ID NO: 7932567 - DNA, 22 bp, Homo sapiens
agcccatgcaacaggcctagcg

SEQ ID NO: 7932568 - DNA, 22 bp, Homo sapiens
agcccatgcaaatactcggtga

SEQ ID NO: 7932569 - DNA, 22 bp, Homo sapiens
agcccatgcaacaggcctagcg

SEQ ID NO: 7932570 - DNA, 22 bp, Homo sapiens
agcccatgcaacaggcctagcg

SEQ ID NO: 7932571 - DNA, 22 bp, Homo sapiens
agcccatgcagaccttcccaga

SEQ ID NO: 7932572 - DNA, 22 bp, Homo sapiens
agcccatgcagaccttcccaga

SEQ ID NO: 7932573 - DNA, 22 bp, Homo sapiens
agcccatggtgtactctgtggc

SEQ ID NO: 7932574 - DNA, 22 bp, Homo sapiens
agccccacactctctctgagaa

SEQ ID NO: 7932575 - DNA, 22 bp, Homo sapiens
agcccatgtggctgaggcttct

SEQ ID NO: 7932576 - DNA, 22 bp, Homo sapiens
agcccatggtgtactctgtggc

SEQ ID NO: 7932577 - DNA, 22 bp, Homo sapiens
agcccatgtggctgaggcttct

SEQ ID NO: 7932578 - DNA, 22 bp, Homo sapiens
agcccatggtgtactctgtggc

SEQ ID NO: 7932579 - DNA, 22 bp, Homo sapiens
agcccaggttgaggctgcagtg

SEQ ID NO: 7932580 - DNA, 22 bp, Homo sapiens
agcccaggttgaggctgcagtg

SEQ ID NO: 7932581 - DNA, 22 bp, Homo sapiens
agcccaggttgaggctgcagtg

SEQ ID NO: 7932582 - DNA, 22 bp, Homo sapiens
agcccaggttgaggctgcagtg

SEQ ID NO: 7932583 - DNA, 22 bp, Homo sapiens
agcccaggttgaggctgcagtg

SEQ ID NO: 7932584 - DNA, 22 bp, Homo sapiens
agcccaggttgaggctgcagtg

SEQ ID NO: 7932585 - DNA, 22 bp, Homo sapiens
agcccaggttgaggctgcagtg

SEQ ID NO: 7932586 - DNA, 22 bp, Homo sapiens
agcccaggttgaggctgcagtg

SEQ ID NO: 7932587 - DNA, 22 bp, Homo sapiens
agcccaggttgaggctgcagtg

SEQ ID NO: 7932588 - DNA, 22 bp, Homo sapiens
agcccaggttgaggctgcagtg

SEQ ID NO: 7932589 - DNA, 20 bp, Homo sapiens
agcccatctcccacagctac

SEQ ID NO: 7932590 - DNA, 20 bp, Homo sapiens
agcccatctcccacagctac

SEQ ID NO: 7932591 - DNA, 22 bp, Homo sapiens
agcccagtgggccgaggcgggg

SEQ ID NO: 7932592 - DNA, 22 bp, Homo sapiens
agccccagtaagggagggcctg

SEQ ID NO: 7932593 - DNA, 22 bp, Homo sapiens
agccccagtccgctgcgggcgg

SEQ ID NO: 7932594 - DNA, 22 bp, Homo sapiens
agccccagtccgctgcgggcgg

SEQ ID NO: 7932595 - DNA, 22 bp, Homo sapiens
agccccagtaagggagggcctg

SEQ ID NO: 7932596 - DNA, 22 bp, Homo sapiens
agccccagtaagggagggcctg

SEQ ID NO: 7932597 - DNA, 22 bp, Homo sapiens
agccccagtaagggagggcctg

SEQ ID NO: 7932598 - DNA, 22 bp, Homo sapiens
agccccaggatgggccgcagga

SEQ ID NO: 7932599 - DNA, 22 bp, Homo sapiens
agccccaggatgggccgcagga

SEQ ID NO: 7932600 - DNA, 22 bp, Homo sapiens
agccccaggatgggccgcagga

SEQ ID NO: 7932601 - DNA, 22 bp, Homo sapiens
agccccaggcccggacgcctct

SEQ ID NO: 7932602 - DNA, 22 bp, Homo sapiens
agccccaggcccggacgcctct

SEQ ID NO: 7932603 - DNA, 22 bp, Homo sapiens
agccccaggcccggacgcctct

SEQ ID NO: 7932604 - DNA, 22 bp, Homo sapiens
agccccaggatgggccgcagga

SEQ ID NO: 7932605 - DNA, 22 bp, Homo sapiens
agccccaggatgggccgcagga

SEQ ID NO: 7932606 - DNA, 22 bp, Homo sapiens
agccccaggatgggccgcagga

SEQ ID NO: 7932607 - DNA, 22 bp, Homo sapiens
agccccagcccctctctcacaa

SEQ ID NO: 7932608 - DNA, 22 bp, Homo sapiens
agccccagcccctctctcacaa

SEQ ID NO: 7932609 - DNA, 22 bp, Homo sapiens
agccccaggatgggccgcagga

SEQ ID NO: 7932610 - DNA, 20 bp, Homo sapiens
agccccacccttgtcctggc

SEQ ID NO: 7932611 - DNA, 22 bp, Homo sapiens
agccccagcccctctctcacaa

SEQ ID NO: 7932612 - DNA, 22 bp, Homo sapiens
agccccagcccctctctcacaa

SEQ ID NO: 7932613 - DNA, 22 bp, Homo sapiens
agccccagcccctctctcacaa

SEQ ID NO: 7932614 - DNA, 22 bp, Homo sapiens
agccccagcccctctctcacaa

SEQ ID NO: 7932615 - DNA, 22 bp, Homo sapiens
cagagaaagggtgaattccttc

SEQ ID NO: 7932616 - DNA, 22 bp, Homo sapiens
cagagaacaaagctgagggttt

SEQ ID NO: 7932617 - DNA, 22 bp, Homo sapiens
cagagaacaaagctgagggttt

SEQ ID NO: 7932618 - DNA, 21 bp, Homo sapiens
agccagctatcacacagcatt

SEQ ID NO: 7932619 - DNA, 22 bp, Homo sapiens
agccagctaccggggctcctgg

SEQ ID NO: 7932620 - DNA, 22 bp, Homo sapiens
cagagaactccagtggctggcg

SEQ ID NO: 7932621 - DNA, 22 bp, Homo sapiens
cagagaacaaagctgagggttt

SEQ ID NO: 7932622 - DNA, 22 bp, Homo sapiens
cagagaacattcagagctgtag

SEQ ID NO: 7932623 - DNA, 22 bp, Homo sapiens
cagagaacaaagctgagggttt

SEQ ID NO: 7932624 - DNA, 22 bp, Homo sapiens
cagagacatgtggcctgcacgt

SEQ ID NO: 7932625 - DNA, 22 bp, Homo sapiens
cagagacatgtggcctgcacgt

SEQ ID NO: 7932626 - DNA, 22 bp, Homo sapiens
cagagacatccattttatatgc

SEQ ID NO: 7932627 - DNA, 22 bp, Homo sapiens
cagagacatgtggcctgcacgt

SEQ ID NO: 7932628 - DNA, 22 bp, Homo sapiens
cagagacatgtggcctgcacgt

SEQ ID NO: 7932629 - DNA, 22 bp, Homo sapiens
cagagacatgtggcctgcacgt

SEQ ID NO: 7932630 - DNA, 22 bp, Homo sapiens
cagagacatccattttatatgc

SEQ ID NO: 7932631 - DNA, 22 bp, Homo sapiens
cagagacatccatgttagttgg

SEQ ID NO: 7932632 - DNA, 22 bp, Homo sapiens
cagagacatccatgttagttgg

SEQ ID NO: 7932633 - DNA, 22 bp, Homo sapiens
cagagacattaagtgccatgat

SEQ ID NO: 7932634 - DNA, 22 bp, Homo sapiens
cagagacattaagtgccatgat

SEQ ID NO: 7932635 - DNA, 22 bp, Homo sapiens
cagagacattaagtgccatgat

SEQ ID NO: 7932636 - DNA, 22 bp, Homo sapiens
cagagacattaagtgccatgat

SEQ ID NO: 7932637 - DNA, 22 bp, Homo sapiens
cagagacatgtggcctgcacgt

SEQ ID NO: 7932638 - DNA, 22 bp, Homo sapiens
cagagacattaagtgccatgat

SEQ ID NO: 7932639 - DNA, 22 bp, Homo sapiens
cagagacattaagtgccatgat

SEQ ID NO: 7932640 - DNA, 22 bp, Homo sapiens
cagagacattaagtgccatgat

SEQ ID NO: 7932641 - DNA, 22 bp, Homo sapiens
cagagacattaagtgccatgat

SEQ ID NO: 7932642 - DNA, 22 bp, Homo sapiens
cagagacattctccccattgga

SEQ ID NO: 7932643 - DNA, 22 bp, Homo sapiens
cagagacattctccccattgga

SEQ ID NO: 7932644 - DNA, 22 bp, Homo sapiens
cagagacattcagtaaattatc

SEQ ID NO: 7932645 - DNA, 20 bp, Homo sapiens
cagagaccaggccaggtgtc

SEQ ID NO: 7932646 - DNA, 20 bp, Homo sapiens
cagagaccaggccaggtgtc

SEQ ID NO: 7932647 - DNA, 20 bp, Homo sapiens
cagagacccaggcttcagct

SEQ ID NO: 7932648 - DNA, 22 bp, Homo sapiens
cagagaccccgctgcccttctg

SEQ ID NO: 7932649 - DNA, 20 bp, Homo sapiens
cagagacccaggcttcagct

SEQ ID NO: 7932650 - DNA, 20 bp, Homo sapiens
cagagacccaggcttcagct

SEQ ID NO: 7932651 - DNA, 22 bp, Homo sapiens
cagagaccctaggcaggtgaca

SEQ ID NO: 7932652 - DNA, 22 bp, Homo sapiens
cagagaccctaggcaggtgaca

SEQ ID NO: 7932653 - DNA, 22 bp, Homo sapiens
cagagaccctaggcaggtgaca

SEQ ID NO: 7932654 - DNA, 22 bp, Homo sapiens
cagagaccccgctgcccttctg

SEQ ID NO: 7932655 - DNA, 22 bp, Homo sapiens
cagagacccctggcatggtggt

SEQ ID NO: 7932656 - DNA, 22 bp, Homo sapiens
cagagacccctggcatggtggt

SEQ ID NO: 7932657 - DNA, 22 bp, Homo sapiens
cagagacccttctcagtggcca

SEQ ID NO: 7932658 - DNA, 22 bp, Homo sapiens
cagagacccttctcagtggcca

SEQ ID NO: 7932659 - DNA, 22 bp, Homo sapiens
cagagacctcaaattatttcct

SEQ ID NO: 7932660 - DNA, 22 bp, Homo sapiens
agccaggcagggctctcgctct

SEQ ID NO: 7932661 - DNA, 22 bp, Homo sapiens
cagagacccttctcagtggcca

SEQ ID NO: 7932662 - DNA, 22 bp, Homo sapiens
cagagacccttctcagtggcca

SEQ ID NO: 7932663 - DNA, 22 bp, Homo sapiens
cagagacccttctcagtggcca

SEQ ID NO: 7932664 - DNA, 22 bp, Homo sapiens
agccaggccagactcacaccct

SEQ ID NO: 7932665 - DNA, 22 bp, Homo sapiens
agccaggccagactcacaccct

SEQ ID NO: 7932666 - DNA, 22 bp, Homo sapiens
agccaggccagactcacaccct

SEQ ID NO: 7932667 - DNA, 17 bp, Homo sapiens
agccaggcatatgaagt

SEQ ID NO: 7932668 - DNA, 17 bp, Homo sapiens
agccaggcatatgaagt

SEQ ID NO: 7932669 - DNA, 17 bp, Homo sapiens
agccaggcatatgaagt

SEQ ID NO: 7932670 - DNA, 17 bp, Homo sapiens
agccaggcatatgaagt

SEQ ID NO: 7932671 - DNA, 18 bp, Homo sapiens
cagagctcctggatgcag

SEQ ID NO: 7932672 - DNA, 18 bp, Homo sapiens
cagagctcctggatgcag

SEQ ID NO: 7932673 - DNA, 18 bp, Homo sapiens
cagagctcctggatgcag

SEQ ID NO: 7932674 - DNA, 18 bp, Homo sapiens
cagagctcctggatgcag

SEQ ID NO: 7932675 - DNA, 22 bp, Homo sapiens
cagagctcagagctgccaggca

SEQ ID NO: 7932676 - DNA, 22 bp, Homo sapiens
cagagctcagagctgccaggca

SEQ ID NO: 7932677 - DNA, 22 bp, Homo sapiens
cagagctcagagcagggcactc

SEQ ID NO: 7932678 - DNA, 22 bp, Homo sapiens
cagagctcagagcagggcactc

SEQ ID NO: 7932679 - DNA, 22 bp, Homo sapiens
cagagctcagagctgccaggca

SEQ ID NO: 7932680 - DNA, 22 bp, Homo sapiens
cagagctcagagctgccaggca

SEQ ID NO: 7932681 - DNA, 22 bp, Homo sapiens
cagagctcagagctgccaggca

SEQ ID NO: 7932682 - DNA, 22 bp, Homo sapiens
cagagctcagagcagggcactc

SEQ ID NO: 7932683 - DNA, 22 bp, Homo sapiens
cagagccttcctagcagactct

SEQ ID NO: 7932684 - DNA, 22 bp, Homo sapiens
cagagccttcctagcagactct

SEQ ID NO: 7932685 - DNA, 22 bp, Homo sapiens
cagagccttcctagcagactct

SEQ ID NO: 7932686 - DNA, 22 bp, Homo sapiens
cagagcctttgtgtccacattt

SEQ ID NO: 7932687 - DNA, 22 bp, Homo sapiens
cagagcctttgtgtccacattt

SEQ ID NO: 7932688 - DNA, 22 bp, Homo sapiens
cagagccttagttctcctagaa

SEQ ID NO: 7932689 - DNA, 19 bp, Homo sapiens
cagagccttcagtgactcc

SEQ ID NO: 7932690 - DNA, 19 bp, Homo sapiens
cagagccttcagtgactcc

SEQ ID NO: 7932691 - DNA, 22 bp, Homo sapiens
cagagccttagttctcctagaa

SEQ ID NO: 7932692 - DNA, 22 bp, Homo sapiens
cagagccttagttctcctagaa

SEQ ID NO: 7932693 - DNA, 22 bp, Homo sapiens
cagagccttagttctcctagaa

SEQ ID NO: 7932694 - DNA, 22 bp, Homo sapiens
cagagccttagttctcctagaa

SEQ ID NO: 7932695 - DNA, 22 bp, Homo sapiens
agccaggccttagggagaggca

SEQ ID NO: 7932696 - DNA, 22 bp, Homo sapiens
agccaggccttagggagaggca

SEQ ID NO: 7932697 - DNA, 22 bp, Homo sapiens
agccaggccttagggagaggca

SEQ ID NO: 7932698 - DNA, 22 bp, Homo sapiens
agccaggccttagggagaggca

SEQ ID NO: 7932699 - DNA, 20 bp, Homo sapiens
agccaggcctcaagttaagt

SEQ ID NO: 7932700 - DNA, 22 bp, Homo sapiens
agccaggccttagggagaggca

SEQ ID NO: 7932701 - DNA, 22 bp, Homo sapiens
agccaggccttagggagaggca

SEQ ID NO: 7932702 - DNA, 22 bp, Homo sapiens
agccaggccttagggagaggca

SEQ ID NO: 7932703 - DNA, 22 bp, Homo sapiens
agccaggccagctgtcttgagt

SEQ ID NO: 7932704 - DNA, 22 bp, Homo sapiens
agccaggccagctgtcttgagt

SEQ ID NO: 7932705 - DNA, 22 bp, Homo sapiens
agccaggccagactcacaccct

SEQ ID NO: 7932706 - DNA, 22 bp, Homo sapiens
agccaggccagactcacaccct

SEQ ID NO: 7932707 - DNA, 20 bp, Homo sapiens
agccaggcctcaagttaagt

SEQ ID NO: 7932708 - DNA, 22 bp, Homo sapiens
agccaggccttttctcaaggtt

SEQ ID NO: 7932709 - DNA, 22 bp, Homo sapiens
agccaggccttttctcaaggtt

SEQ ID NO: 7932710 - DNA, 22 bp, Homo sapiens
agccaggccttagggagaggca

SEQ ID NO: 7932711 - DNA, 22 bp, Homo sapiens
agccaggccttttctcaaggtt

SEQ ID NO: 7932712 - DNA, 22 bp, Homo sapiens
cagagcctggcgatgtcatgga

SEQ ID NO: 7932713 - DNA, 21 bp, Homo sapiens
cagagcctgtgttgacagttg

SEQ ID NO: 7932714 - DNA, 22 bp, Homo sapiens
cagagcctggcgatgtcatgga

SEQ ID NO: 7932715 - DNA, 21 bp, Homo sapiens
cagagcctgtgttgacagttg

SEQ ID NO: 7932716 - DNA, 22 bp, Homo sapiens
cagagcccagggcctacgtccc

SEQ ID NO: 7932717 - DNA, 22 bp, Homo sapiens
cactttatatgcattacctcat

SEQ ID NO: 7932718 - DNA, 22 bp, Homo sapiens
cactttatattctaagacggcc

SEQ ID NO: 7932719 - DNA, 22 bp, Homo sapiens
cactttataaaattggtgtgag

SEQ ID NO: 7932720 - DNA, 22 bp, Homo sapiens
cactttataaaattggtgtgag

SEQ ID NO: 7932721 - DNA, 22 bp, Homo sapiens
cactttataaaattggtgtgag

SEQ ID NO: 7932722 - DNA, 22 bp, Homo sapiens
cactttataaaattggtgtgag

SEQ ID NO: 7932723 - DNA, 22 bp, Homo sapiens
cactttatgggaagcaaaaatt

SEQ ID NO: 7932724 - DNA, 22 bp, Homo sapiens
cactttattataaatttgagag

SEQ ID NO: 7932725 - DNA, 22 bp, Homo sapiens
cactttattataaatttgagag

SEQ ID NO: 7932726 - DNA, 22 bp, Homo sapiens
cactttatgggaagcaaaaatt

SEQ ID NO: 7932727 - DNA, 22 bp, Homo sapiens
cactttctcatgaatttggccc

SEQ ID NO: 7932728 - DNA, 22 bp, Homo sapiens
cactttctcatgaatttggccc

SEQ ID NO: 7932729 - DNA, 22 bp, Homo sapiens
cactttcaagtttcagaggata

SEQ ID NO: 7932730 - DNA, 22 bp, Homo sapiens
cactttctcatgaatttggccc

SEQ ID NO: 7932731 - DNA, 22 bp, Homo sapiens
cactttctgtgtatcttccatt

SEQ ID NO: 7932732 - DNA, 22 bp, Homo sapiens
cactttctcatgaatttggccc

SEQ ID NO: 7932733 - DNA, 22 bp, Homo sapiens
cactttctgtgtatcttccatt

SEQ ID NO: 7932734 - DNA, 22 bp, Homo sapiens
cactttctgtgtatcttccatt

SEQ ID NO: 7932735 - DNA, 22 bp, Homo sapiens
cactttctgtgttgtgcaaaaa

SEQ ID NO: 7932736 - DNA, 19 bp, Homo sapiens
cactttatttctgttttgt

SEQ ID NO: 7932737 - DNA, 22 bp, Homo sapiens
cactttcaagtttcagaggata

SEQ ID NO: 7932738 - DNA, 22 bp, Homo sapiens
agccagatgctattgctggaaa

SEQ ID NO: 7932739 - DNA, 21 bp, Homo sapiens
agccagatccattttgcatgg

SEQ ID NO: 7932740 - DNA, 21 bp, Homo sapiens
agccagcaacacagcatctcc

SEQ ID NO: 7932741 - DNA, 22 bp, Homo sapiens
agccagatgtgagaaagaacac

SEQ ID NO: 7932742 - DNA, 23 bp, Homo sapiens
agccagatttctttgcagggcag

SEQ ID NO: 7932743 - DNA, 22 bp, Homo sapiens
agccagcacggatttcccagga

SEQ ID NO: 7932744 - DNA, 21 bp, Homo sapiens
agccagcaacacagcatctcc

SEQ ID NO: 7932745 - DNA, 22 bp, Homo sapiens
agccagcacggatttcccagga

SEQ ID NO: 7932746 - DNA, 22 bp, Homo sapiens
agccagcacggatttcccagga

SEQ ID NO: 7932747 - DNA, 22 bp, Homo sapiens
agccagcacggcgccatggagt

SEQ ID NO: 7932748 - DNA, 22 bp, Homo sapiens
agccagcacggcgccatggagt

SEQ ID NO: 7932749 - DNA, 22 bp, Homo sapiens
agccagcacggcgccatggagt

SEQ ID NO: 7932750 - DNA, 19 bp, Homo sapiens
agccagcagcgtagcatct

SEQ ID NO: 7932751 - DNA, 22 bp, Homo sapiens
agccagcactttttctctgggc

SEQ ID NO: 7932752 - DNA, 22 bp, Homo sapiens
agccagcacggcgccatggagt

SEQ ID NO: 7932753 - DNA, 22 bp, Homo sapiens
agccagcacggcgccatggagt

SEQ ID NO: 7932754 - DNA, 22 bp, Homo sapiens
agccagagagtgttggagatgt

SEQ ID NO: 7932755 - DNA, 22 bp, Homo sapiens
agccagagagtgttggagatgt

SEQ ID NO: 7932756 - DNA, 22 bp, Homo sapiens
cactttctgtgttgtgcaaaaa

SEQ ID NO: 7932757 - DNA, 22 bp, Homo sapiens
cactttctgtgttgtgcaaaaa

SEQ ID NO: 7932758 - DNA, 22 bp, Homo sapiens
agccagagttgaatgtgagtct

SEQ ID NO: 7932759 - DNA, 22 bp, Homo sapiens
agccagatccaggagacagctc

SEQ ID NO: 7932760 - DNA, 22 bp, Homo sapiens
agccagatccaggagacagctc

SEQ ID NO: 7932761 - DNA, 19 bp, Homo sapiens
agccagagtggcccagggg

SEQ ID NO: 7932762 - DNA, 19 bp, Homo sapiens
agccagagtggcccagggg

SEQ ID NO: 7932763 - DNA, 22 bp, Homo sapiens
agccagagttgaatgtgagtct

SEQ ID NO: 7932764 - DNA, 22 bp, Homo sapiens
agccagctaagggaagcatgat

SEQ ID NO: 7932765 - DNA, 22 bp, Homo sapiens
agccagctaagggaagcatgat

SEQ ID NO: 7932766 - DNA, 22 bp, Homo sapiens
agccagctaagggaagcatgat

SEQ ID NO: 7932767 - DNA, 22 bp, Homo sapiens
agccagctaagggaagcatgat

SEQ ID NO: 7932768 - DNA, 22 bp, Homo sapiens
agccagctaccggggctcctgg

SEQ ID NO: 7932769 - DNA, 22 bp, Homo sapiens
agccagctaccggggctcctgg

SEQ ID NO: 7932770 - DNA, 22 bp, Homo sapiens
agccagctaccggggctcctgg

SEQ ID NO: 7932771 - DNA, 22 bp, Homo sapiens
agccagctaccggggctcctgg

SEQ ID NO: 7932772 - DNA, 22 bp, Homo sapiens
agccagccgggggaccacagtg

SEQ ID NO: 7932773 - DNA, 22 bp, Homo sapiens
agccagccgggggaccacagtg

SEQ ID NO: 7932774 - DNA, 22 bp, Homo sapiens
agccagccgggggaccacagtg

SEQ ID NO: 7932775 - DNA, 22 bp, Homo sapiens
agccagccgggggaccacagtg

SEQ ID NO: 7932776 - DNA, 22 bp, Homo sapiens
agccagcctgatctcttcttgc

SEQ ID NO: 7932777 - DNA, 22 bp, Homo sapiens
agccagcccctgactgtgtcct

SEQ ID NO: 7932778 - DNA, 22 bp, Homo sapiens
agccagcccctgactgtgtcct

SEQ ID NO: 7932779 - DNA, 22 bp, Homo sapiens
agccagcccctgactgtgtcct

SEQ ID NO: 7932780 - DNA, 20 bp, Homo sapiens
agccagccacttcctgctcc

SEQ ID NO: 7932781 - DNA, 22 bp, Homo sapiens
agccagccagttcactaggaaa

SEQ ID NO: 7932782 - DNA, 22 bp, Homo sapiens
agccagcatgaagacagaggcc

SEQ ID NO: 7932783 - DNA, 20 bp, Homo sapiens
agccagccacttcctgctcc

SEQ ID NO: 7932784 - DNA, 20 bp, Homo sapiens
agccagccacttcctgctcc

SEQ ID NO: 7932785 - DNA, 22 bp, Homo sapiens
agccagcatcccttcagtctcc

SEQ ID NO: 7932786 - DNA, 22 bp, Homo sapiens
agccagcatcccttcagtctcc

SEQ ID NO: 7932787 - DNA, 22 bp, Homo sapiens
agccagcatcccttcagtctcc

SEQ ID NO: 7932788 - DNA, 22 bp, Homo sapiens
agccagcatcttgcttcttgag

SEQ ID NO: 7932789 - DNA, 22 bp, Homo sapiens
agccagcatgaagacagaggcc

SEQ ID NO: 7932790 - DNA, 22 bp, Homo sapiens
agccagcatgaagacagaggcc

SEQ ID NO: 7932791 - DNA, 22 bp, Homo sapiens
agccagcaggtgagtgcagcct

SEQ ID NO: 7932792 - DNA, 22 bp, Homo sapiens
agccagcaggtgagtgcagcct

SEQ ID NO: 7932793 - DNA, 22 bp, Homo sapiens
agccagcaggtgagtgcagcct

SEQ ID NO: 7932794 - DNA, 22 bp, Homo sapiens
agccagcaggtgcagaattcca

SEQ ID NO: 7932795 - DNA, 22 bp, Homo sapiens
agccagcaggtgcagaattcca

SEQ ID NO: 7932796 - DNA, 17 bp, Homo sapiens
agccagcagtagctggt

SEQ ID NO: 7932797 - DNA, 17 bp, Homo sapiens
agccagcagtagctggt

SEQ ID NO: 7932798 - DNA, 22 bp, Homo sapiens
agccagcatatatatagttgaa

SEQ ID NO: 7932799 - DNA, 22 bp, Homo sapiens
agccagcatatatatagttgaa

SEQ ID NO: 7932800 - DNA, 17 bp, Homo sapiens
agccagcagtagctggt

SEQ ID NO: 7932801 - DNA, 17 bp, Homo sapiens
agccagcagtagctggt

SEQ ID NO: 7932802 - DNA, 22 bp, Homo sapiens
agccagcaggtgggaaactgga

SEQ ID NO: 7932803 - DNA, 19 bp, Homo sapiens
agccagcagcgtagcatct

SEQ ID NO: 7932804 - DNA, 22 bp, Homo sapiens
agccagcactttttctctgggc

SEQ ID NO: 7932805 - DNA, 19 bp, Homo sapiens
agccagcagcgtagcatct

SEQ ID NO: 7932806 - DNA, 19 bp, Homo sapiens
agccagcagcgtagcatct

SEQ ID NO: 7932807 - DNA, 19 bp, Homo sapiens
agccagcagcgtagcatct

SEQ ID NO: 7932808 - DNA, 22 bp, Homo sapiens
agccagcaggaacgtctaggtt

SEQ ID NO: 7932809 - DNA, 22 bp, Homo sapiens
agccagcaggaacgtctaggtt

SEQ ID NO: 7932810 - DNA, 22 bp, Homo sapiens
agccagcaggaacgtctaggtt

SEQ ID NO: 7932811 - DNA, 19 bp, Homo sapiens
agccagcaggcctctgagc

SEQ ID NO: 7932812 - DNA, 22 bp, Homo sapiens
agccagcagggcttagaggaca

SEQ ID NO: 7932813 - DNA, 22 bp, Homo sapiens
agccagcaggtgagtgcagcct

SEQ ID NO: 7932814 - DNA, 19 bp, Homo sapiens
agccagcaggcctctgagc

SEQ ID NO: 7932815 - DNA, 19 bp, Homo sapiens
agccagcaggcctctgagc

SEQ ID NO: 7932816 - DNA, 22 bp, Homo sapiens
agccagcagggcttagaggaca

SEQ ID NO: 7932817 - DNA, 20 bp, Homo sapiens
cagatgggacgtggaggagt

SEQ ID NO: 7932818 - DNA, 20 bp, Homo sapiens
cagatgggacgtggaggagt

SEQ ID NO: 7932819 - DNA, 22 bp, Homo sapiens
cagatggggcaaggccatctgt

SEQ ID NO: 7932820 - DNA, 18 bp, Homo sapiens
cagatggtggagttttta

SEQ ID NO: 7932821 - DNA, 22 bp, Homo sapiens
cagatggtagcagtagcttgct

SEQ ID NO: 7932822 - DNA, 22 bp, Homo sapiens
cagatggtagcagtagcttgct

SEQ ID NO: 7932823 - DNA, 22 bp, Homo sapiens
cagatgtaatctgacagctgga

SEQ ID NO: 7932824 - DNA, 18 bp, Homo sapiens
cagatggtggagttttta

SEQ ID NO: 7932825 - DNA, 22 bp, Homo sapiens
cagatgtacatgaagggcaatg

SEQ ID NO: 7932826 - DNA, 22 bp, Homo sapiens
cagatgtacatgaagggcaatg

SEQ ID NO: 7932827 - DNA, 23 bp, Homo sapiens
cagatgtgcaactctaggcaatg

SEQ ID NO: 7932828 - DNA, 22 bp, Homo sapiens
cagatgtgagctggggagagtg

SEQ ID NO: 7932829 - DNA, 22 bp, Homo sapiens
cagatgtgagctggggagagtg

SEQ ID NO: 7932830 - DNA, 22 bp, Homo sapiens
cagatgtgagctggggagagtg

SEQ ID NO: 7932831 - DNA, 22 bp, Homo sapiens
cagatgtacatgaagggcaatg

SEQ ID NO: 7932832 - DNA, 22 bp, Homo sapiens
cagatgtatatgcataaaaagt

SEQ ID NO: 7932833 - DNA, 22 bp, Homo sapiens
cagatgtcgaaggatgtgaccg

SEQ ID NO: 7932834 - DNA, 22 bp, Homo sapiens
cagatgtgcatgatgggaaggg

SEQ ID NO: 7932835 - DNA, 22 bp, Homo sapiens
cagatgtgattcttccctcagc

SEQ ID NO: 7932836 - DNA, 23 bp, Homo sapiens
cagatgtgcaactctaggcaatg

SEQ ID NO: 7932837 - DNA, 22 bp, Homo sapiens
cagatgtgcatgatgggaaggg

SEQ ID NO: 7932838 - DNA, 23 bp, Homo sapiens
cagatgtgcaactctaggcaatg

SEQ ID NO: 7932839 - DNA, 22 bp, Homo sapiens
cagatgtgcctccagggctttg

SEQ ID NO: 7932840 - DNA, 22 bp, Homo sapiens
cagatgtgcctccagggctttg

SEQ ID NO: 7932841 - DNA, 22 bp, Homo sapiens
cagatgtggaatgcagcaggct

SEQ ID NO: 7932842 - DNA, 22 bp, Homo sapiens
cagcaaatactactagttttta

SEQ ID NO: 7932843 - DNA, 22 bp, Homo sapiens
cagatgtggaatgcagcaggct

SEQ ID NO: 7932844 - DNA, 21 bp, Homo sapiens
cagcaaatcattgggcagact

SEQ ID NO: 7932845 - DNA, 21 bp, Homo sapiens
cagcaaatcattgggcagact

SEQ ID NO: 7932846 - DNA, 22 bp, Homo sapiens
cagcaaatgagtggcagggcag

SEQ ID NO: 7932847 - DNA, 22 bp, Homo sapiens
cagcaaatgagtggcagggcag

SEQ ID NO: 7932848 - DNA, 22 bp, Homo sapiens
cagcaacatatatgaaactgtg

SEQ ID NO: 7932849 - DNA, 22 bp, Homo sapiens
cagcaaattttaatactgcttt

SEQ ID NO: 7932850 - DNA, 22 bp, Homo sapiens
cagcaacatgtggtagtgtagg

SEQ ID NO: 7932851 - DNA, 22 bp, Homo sapiens
cagcaacatgtggtagtgtagg

SEQ ID NO: 7932852 - DNA, 22 bp, Homo sapiens
cagcaactcctatattgaaagc

SEQ ID NO: 7932853 - DNA, 22 bp, Homo sapiens
cagcaacggaaaatacacatag

SEQ ID NO: 7932854 - DNA, 22 bp, Homo sapiens
cagcaacctaaatccactaact

SEQ ID NO: 7932855 - DNA, 22 bp, Homo sapiens
cagcaacatgtggtagtgtagg

SEQ ID NO: 7932856 - DNA, 22 bp, Homo sapiens
cagcaacccgggggacctttct

SEQ ID NO: 7932857 - DNA, 22 bp, Homo sapiens
cagcaactctcctgtgctcaaa

SEQ ID NO: 7932858 - DNA, 22 bp, Homo sapiens
cagcaactctcctgtgctcaaa

SEQ ID NO: 7932859 - DNA, 22 bp, Homo sapiens
cagcaactggtcattgctctcc

SEQ ID NO: 7932860 - DNA, 22 bp, Homo sapiens
cagcaactgtgcctgacacaca

SEQ ID NO: 7932861 - DNA, 22 bp, Homo sapiens
cagcaactgtgcctgacacaca

SEQ ID NO: 7932862 - DNA, 22 bp, Homo sapiens
cagcaactgtgcctgacacaca

SEQ ID NO: 7932863 - DNA, 22 bp, Homo sapiens
cagcaactctcctgtgctcaaa

SEQ ID NO: 7932864 - DNA, 22 bp, Homo sapiens
cagcaactctcctgtgctcaaa

SEQ ID NO: 7932865 - DNA, 22 bp, Homo sapiens
cagcaactctcctgtgctcaaa

SEQ ID NO: 7932866 - DNA, 22 bp, Homo sapiens
cagcaactcctgtagcttatgc

SEQ ID NO: 7932867 - DNA, 22 bp, Homo sapiens
cagcaactcctgtagcttatgc

SEQ ID NO: 7932868 - DNA, 22 bp, Homo sapiens
cagcaactcctatattgaaagc

SEQ ID NO: 7932869 - DNA, 22 bp, Homo sapiens
cagcaactcctgtagcttatgc

SEQ ID NO: 7932870 - DNA, 22 bp, Homo sapiens
cagcaacttaggcagaacatct

SEQ ID NO: 7932871 - DNA, 22 bp, Homo sapiens
cagcaacttaggcagaacatct

SEQ ID NO: 7932872 - DNA, 22 bp, Homo sapiens
cagcaacttaggcagaacatct

SEQ ID NO: 7932873 - DNA, 22 bp, Homo sapiens
cagcaacttggacagcagtctt

SEQ ID NO: 7932874 - DNA, 22 bp, Homo sapiens
cagcaacttggacagcagtctt

SEQ ID NO: 7932875 - DNA, 22 bp, Homo sapiens
cagcaacttggacagcagtctt

SEQ ID NO: 7932876 - DNA, 22 bp, Homo sapiens
cagcaacttggacagcagtctt

SEQ ID NO: 7932877 - DNA, 18 bp, Homo sapiens
cagcaactttagatcctg

SEQ ID NO: 7932878 - DNA, 20 bp, Homo sapiens
cagcaactttggactgagtt

SEQ ID NO: 7932879 - DNA, 20 bp, Homo sapiens
cagcaactttggactgagtt

SEQ ID NO: 7932880 - DNA, 20 bp, Homo sapiens
cagcaactttggactgagtt

SEQ ID NO: 7932881 - DNA, 20 bp, Homo sapiens
cagcaactttggactgagtt

SEQ ID NO: 7932882 - DNA, 19 bp, Homo sapiens
agcctggctttgctctgct

SEQ ID NO: 7932883 - DNA, 19 bp, Homo sapiens
agcctggctttgctctgct

SEQ ID NO: 7932884 - DNA, 22 bp, Homo sapiens
agcctggcttagctctctcact

SEQ ID NO: 7932885 - DNA, 22 bp, Homo sapiens
agcctggcttagctctctcact

SEQ ID NO: 7932886 - DNA, 17 bp, Homo sapiens
agcctgggaaggagtga

SEQ ID NO: 7932887 - DNA, 17 bp, Homo sapiens
agcctgggaaggagtga

SEQ ID NO: 7932888 - DNA, 17 bp, Homo sapiens
agcctgggaaggagtga

SEQ ID NO: 7932889 - DNA, 17 bp, Homo sapiens
agcctgggaaggagtga

SEQ ID NO: 7932890 - DNA, 19 bp, Homo sapiens
agcctggctttgctctgct

SEQ ID NO: 7932891 - DNA, 19 bp, Homo sapiens
agcctggctttgctctgct

SEQ ID NO: 7932892 - DNA, 19 bp, Homo sapiens
agcctggctttgctctgct

SEQ ID NO: 7932893 - DNA, 19 bp, Homo sapiens
agcctggctttgctctgct

SEQ ID NO: 7932894 - DNA, 17 bp, Homo sapiens
agcctgggaaggagtga

SEQ ID NO: 7932895 - DNA, 17 bp, Homo sapiens
agcctgggaaggagtga

SEQ ID NO: 7932896 - DNA, 22 bp, Homo sapiens
agcctggccactcagggcctga

SEQ ID NO: 7932897 - DNA, 22 bp, Homo sapiens
agcctggccactcagggcctga

SEQ ID NO: 7932898 - DNA, 22 bp, Homo sapiens
cagcaagaatcagacaacctca

SEQ ID NO: 7932899 - DNA, 22 bp, Homo sapiens
cagcaagaacagcctgatgtgc

SEQ ID NO: 7932900 - DNA, 22 bp, Homo sapiens
agcctggccactcagggcctga

SEQ ID NO: 7932901 - DNA, 22 bp, Homo sapiens
cagcaagaacagcctgatgtgc

SEQ ID NO: 7932902 - DNA, 22 bp, Homo sapiens
cagcaagaaaattcacatgctc

SEQ ID NO: 7932903 - DNA, 22 bp, Homo sapiens
cagcaagaaaattcacatgctc

SEQ ID NO: 7932904 - DNA, 22 bp, Homo sapiens
cagcaagaaaattcacatgctc

SEQ ID NO: 7932905 - DNA, 22 bp, Homo sapiens
cagcaagaaaattcacatgctc

SEQ ID NO: 7932906 - DNA, 22 bp, Homo sapiens
cagcaagaaaattcacatgctc

SEQ ID NO: 7932907 - DNA, 22 bp, Homo sapiens
cagcaagaaaattcacatgctc

SEQ ID NO: 7932908 - DNA, 22 bp, Homo sapiens
cagcaagaaaattcacatgctc

SEQ ID NO: 7932909 - DNA, 22 bp, Homo sapiens
agcctgggcaacaacacagcga

SEQ ID NO: 7932910 - DNA, 22 bp, Homo sapiens
agcctgggcaacaacacagcga

SEQ ID NO: 7932911 - DNA, 22 bp, Homo sapiens
agcctgggcaacaacacagcga

SEQ ID NO: 7932912 - DNA, 22 bp, Homo sapiens
agcctgggcaacagagcaaaac

SEQ ID NO: 7932913 - DNA, 22 bp, Homo sapiens
agcctgggcaacaacacagcga

SEQ ID NO: 7932914 - DNA, 22 bp, Homo sapiens
agcctgggcaacaacacagcga

SEQ ID NO: 7932915 - DNA, 22 bp, Homo sapiens
agcctgggcaacaacacagcga

SEQ ID NO: 7932916 - DNA, 21 bp, Homo sapiens
agcctgggaggcggaggttgc

SEQ ID NO: 7932917 - DNA, 22 bp, Homo sapiens
agcctgggcaacagagcaaaac

SEQ ID NO: 7932918 - DNA, 22 bp, Homo sapiens
agcctgggcaactccattcact

SEQ ID NO: 7932919 - DNA, 22 bp, Homo sapiens
agcctgggcaactccattcact

SEQ ID NO: 7932920 - DNA, 22 bp, Homo sapiens
agcctgggcatgggacgggagg

SEQ ID NO: 7932921 - DNA, 22 bp, Homo sapiens
agcctgggcatgggacgggagg

SEQ ID NO: 7932922 - DNA, 22 bp, Homo sapiens
agcctgggcatgggacgggagg

SEQ ID NO: 7932923 - DNA, 22 bp, Homo sapiens
agcctgggaatttagagttcgg

SEQ ID NO: 7932924 - DNA, 22 bp, Homo sapiens
agcctgggaatttagagttcgg

SEQ ID NO: 7932925 - DNA, 22 bp, Homo sapiens
agcctgggaatttagagttcgg

SEQ ID NO: 7932926 - DNA, 17 bp, Homo sapiens
agcctgggaaggagtga

SEQ ID NO: 7932927 - DNA, 17 bp, Homo sapiens
agcctgggaaggagtga

SEQ ID NO: 7932928 - DNA, 22 bp, Homo sapiens
agcctgggaatttagagttcgg

SEQ ID NO: 7932929 - DNA, 21 bp, Homo sapiens
agcctgggaggcggaggttgc

SEQ ID NO: 7932930 - DNA, 21 bp, Homo sapiens
agcctgggaggcggaggttgc

SEQ ID NO: 7932931 - DNA, 21 bp, Homo sapiens
agcctgggaggcggaggttgc

SEQ ID NO: 7932932 - DNA, 21 bp, Homo sapiens
agcctgggaggcggaggttgc

SEQ ID NO: 7932933 - DNA, 21 bp, Homo sapiens
agcctgggaggcggaggttgc

SEQ ID NO: 7932934 - DNA, 21 bp, Homo sapiens
agcctgggaggcggaggttgc

SEQ ID NO: 7932935 - DNA, 22 bp, Homo sapiens
agcctgggagacactaagttgt

SEQ ID NO: 7932936 - DNA, 22 bp, Homo sapiens
agcctgggagacactaagttgt

SEQ ID NO: 7932937 - DNA, 22 bp, Homo sapiens
agcctgggagacactaagttgt

SEQ ID NO: 7932938 - DNA, 21 bp, Homo sapiens
agcctgggaggcggaggttgc

SEQ ID NO: 7932939 - DNA, 22 bp, Homo sapiens
agcctgggagacactaagttgt

SEQ ID NO: 7932940 - DNA, 22 bp, Homo sapiens
agctaagatttattaaaggccc

SEQ ID NO: 7932941 - DNA, 20 bp, Homo sapiens
agctaagaggaaaagtgaga

SEQ ID NO: 7932942 - DNA, 20 bp, Homo sapiens
agctaagaggaaaagtgaga

SEQ ID NO: 7932943 - DNA, 20 bp, Homo sapiens
agctaagaggaaaagtgaga

SEQ ID NO: 7932944 - DNA, 19 bp, Homo sapiens
agctaatggaagtttactg

SEQ ID NO: 7932945 - DNA, 22 bp, Homo sapiens
agctaatggaacagagatgtca

SEQ ID NO: 7932946 - DNA, 23 bp, Homo sapiens
agctaatgggacagattccatgg

SEQ ID NO: 7932947 - DNA, 22 bp, Homo sapiens
agctaatgatgagatacagata

SEQ ID NO: 7932948 - DNA, 22 bp, Homo sapiens
agctaaggactggagggtttct

SEQ ID NO: 7932949 - DNA, 22 bp, Homo sapiens
agctacaacttttccatgagca

SEQ ID NO: 7932950 - DNA, 17 bp, Homo sapiens
agctacaaggcagttca

SEQ ID NO: 7932951 - DNA, 22 bp, Homo sapiens
agctacaagtcatcagctatca

SEQ ID NO: 7932952 - DNA, 22 bp, Homo sapiens
agctacaaaattactaagtcct

SEQ ID NO: 7932953 - DNA, 22 bp, Homo sapiens
agctacaacttttccatgagca

SEQ ID NO: 7932954 - DNA, 22 bp, Homo sapiens
agctaattagaaatagattatt

SEQ ID NO: 7932955 - DNA, 22 bp, Homo sapiens
agctaattagaaatagattatt

SEQ ID NO: 7932956 - DNA, 20 bp, Homo sapiens
agctacaatgcgaagctggc

SEQ ID NO: 7932957 - DNA, 20 bp, Homo sapiens
agctacaatgcgaagctggc

SEQ ID NO: 7932958 - DNA, 22 bp, Homo sapiens
agctacacaggaggactcttct

SEQ ID NO: 7932959 - DNA, 22 bp, Homo sapiens
agctacacccctttacagtcct

SEQ ID NO: 7932960 - DNA, 22 bp, Homo sapiens
agctacacttaaccacatagca

SEQ ID NO: 7932961 - DNA, 19 bp, Homo sapiens
agctacagcatggcgaggt

SEQ ID NO: 7932962 - DNA, 22 bp, Homo sapiens
agctacagatgagcccagtatc

SEQ ID NO: 7932963 - DNA, 22 bp, Homo sapiens
agctacagctgtactctgcagg

SEQ ID NO: 7932964 - DNA, 22 bp, Homo sapiens
agctacacccctttacagtcct

SEQ ID NO: 7932965 - DNA, 22 bp, Homo sapiens
agctagaatattgatctgaaat

SEQ ID NO: 7932966 - DNA, 22 bp, Homo sapiens
agctagaatattgatctgaaat

SEQ ID NO: 7932967 - DNA, 22 bp, Homo sapiens
agctagaatattgatctgaaat

SEQ ID NO: 7932968 - DNA, 22 bp, Homo sapiens
agctagaatattgatctgaaat

SEQ ID NO: 7932969 - DNA, 22 bp, Homo sapiens
agctagaatgttccttttcatt

SEQ ID NO: 7932970 - DNA, 22 bp, Homo sapiens
agctagagctgagaagcacttg

SEQ ID NO: 7932971 - DNA, 22 bp, Homo sapiens
agctagaatattgatctgaaat

SEQ ID NO: 7932972 - DNA, 22 bp, Homo sapiens
agctactggagaacacaaaacc

SEQ ID NO: 7932973 - DNA, 22 bp, Homo sapiens
agctagaactacaggcatgtgc

SEQ ID NO: 7932974 - DNA, 22 bp, Homo sapiens
agctacttccctgtaggaaaca

SEQ ID NO: 7932975 - DNA, 22 bp, Homo sapiens
agctagaagtcctagataaagg

SEQ ID NO: 7932976 - DNA, 22 bp, Homo sapiens
agctagaagtcctagataaagg

SEQ ID NO: 7932977 - DNA, 22 bp, Homo sapiens
agctagaagtacagccatatga

SEQ ID NO: 7932978 - DNA, 22 bp, Homo sapiens
agctacttccctgtaggaaaca

SEQ ID NO: 7932979 - DNA, 22 bp, Homo sapiens
agctacctgatccttcttctga

SEQ ID NO: 7932980 - DNA, 22 bp, Homo sapiens
agctacctgatccttcttctga

SEQ ID NO: 7932981 - DNA, 22 bp, Homo sapiens
agctacctggcttatcactgtc

SEQ ID NO: 7932982 - DNA, 22 bp, Homo sapiens
agctacagtggacaagtgaact

SEQ ID NO: 7932983 - DNA, 22 bp, Homo sapiens
agctacagttgccctcagcagg

SEQ ID NO: 7932984 - DNA, 22 bp, Homo sapiens
agctacagttgccctcagcagg

SEQ ID NO: 7932985 - DNA, 22 bp, Homo sapiens
agctacagtcggaaggacagac

SEQ ID NO: 7932986 - DNA, 22 bp, Homo sapiens
agctacagtcggaaggacagac

SEQ ID NO: 7932987 - DNA, 22 bp, Homo sapiens
agctacagggaactaaaagcta

SEQ ID NO: 7932988 - DNA, 22 bp, Homo sapiens
agctacagctgtactctgcagg

SEQ ID NO: 7932989 - DNA, 22 bp, Homo sapiens
agcctgggtttttattaaggag

SEQ ID NO: 7932990 - DNA, 22 bp, Homo sapiens
agcctgggtttttattaaggag

SEQ ID NO: 7932991 - DNA, 22 bp, Homo sapiens
agcctgggtttttattaaggag

SEQ ID NO: 7932992 - DNA, 22 bp, Homo sapiens
agcctggtgatatcagtggttt

SEQ ID NO: 7932993 - DNA, 22 bp, Homo sapiens
agcctggtgtggggctgcagag

SEQ ID NO: 7932994 - DNA, 22 bp, Homo sapiens
agcctggtgatatcagtggttt

SEQ ID NO: 7932995 - DNA, 22 bp, Homo sapiens
agcctggtgatatcagtggttt

SEQ ID NO: 7932996 - DNA, 22 bp, Homo sapiens
agcctgggtgggggttcggaga

SEQ ID NO: 7932997 - DNA, 22 bp, Homo sapiens
agcctgggtgggggttcggaga

SEQ ID NO: 7932998 - DNA, 21 bp, Homo sapiens
agcctgggtatcctttgagga

SEQ ID NO: 7932999 - DNA, 22 bp, Homo sapiens
agcctgggttagggttcttccc

SEQ ID NO: 7933000 - DNA, 22 bp, Homo sapiens
agcctgggttagggttcttccc

SEQ ID NO: 7933001 - DNA, 22 bp, Homo sapiens
agcctgggttagggttcttccc

SEQ ID NO: 7933002 - DNA, 22 bp, Homo sapiens
agctaagaacttgagctctgga

SEQ ID NO: 7933003 - DNA, 22 bp, Homo sapiens
agctaagaacttgagctctgga

SEQ ID NO: 7933004 - DNA, 22 bp, Homo sapiens
agctaacatgactagaagcttc

SEQ ID NO: 7933005 - DNA, 22 bp, Homo sapiens
agctaagacttagtgacttagt

SEQ ID NO: 7933006 - DNA, 19 bp, Homo sapiens
agctaagacaagggacatc

SEQ ID NO: 7933007 - DNA, 22 bp, Homo sapiens
agctaagacttagtgacttagt

SEQ ID NO: 7933008 - DNA, 20 bp, Homo sapiens
agcggcagcttcctgcttcg

SEQ ID NO: 7933009 - DNA, 22 bp, Homo sapiens
agcggcagcagatgtgatcagg

SEQ ID NO: 7933010 - DNA, 22 bp, Homo sapiens
agcctggtttaagcattttata

SEQ ID NO: 7933011 - DNA, 21 bp, Homo sapiens
agcggcagaccctgcatttga

SEQ ID NO: 7933012 - DNA, 21 bp, Homo sapiens
agcggcagaccctgcatttga

SEQ ID NO: 7933013 - DNA, 20 bp, Homo sapiens
agcggaccaggccattgttg

SEQ ID NO: 7933014 - DNA, 21 bp, Homo sapiens
agcggcagaccctgcatttga

SEQ ID NO: 7933015 - DNA, 18 bp, Homo sapiens
agcctgggctctgcctgg

SEQ ID NO: 7933016 - DNA, 18 bp, Homo sapiens
agcctgggctctgcctgg

SEQ ID NO: 7933017 - DNA, 18 bp, Homo sapiens
agcctgggctctgcctgg

SEQ ID NO: 7933018 - DNA, 18 bp, Homo sapiens
agcctgggctctgcctgg

SEQ ID NO: 7933019 - DNA, 18 bp, Homo sapiens
agcctgggctctgcctgg

SEQ ID NO: 7933020 - DNA, 18 bp, Homo sapiens
agcctgggctctgcctgg

SEQ ID NO: 7933021 - DNA, 22 bp, Homo sapiens
agcctgggcctggcttcccgcc

SEQ ID NO: 7933022 - DNA, 22 bp, Homo sapiens
agcctgggcctggcttcccgcc

SEQ ID NO: 7933023 - DNA, 18 bp, Homo sapiens
agcctgggctctgcctgg

SEQ ID NO: 7933024 - DNA, 18 bp, Homo sapiens
agcctgggctctgcctgg

SEQ ID NO: 7933025 - DNA, 22 bp, Homo sapiens
agcctgggccctgcctcttctc

SEQ ID NO: 7933026 - DNA, 22 bp, Homo sapiens
agcctgggccctgcctcttctc

SEQ ID NO: 7933027 - DNA, 22 bp, Homo sapiens
agcctgggccctgcctcttctc

SEQ ID NO: 7933028 - DNA, 22 bp, Homo sapiens
agcctgggcatgggacgggagg

SEQ ID NO: 7933029 - DNA, 22 bp, Homo sapiens
agcctgggcatgggacgggagg

SEQ ID NO: 7933030 - DNA, 22 bp, Homo sapiens
agcctgggcatgggacgggagg

SEQ ID NO: 7933031 - DNA, 21 bp, Homo sapiens
agcctgggtatcctttgagga

SEQ ID NO: 7933032 - DNA, 21 bp, Homo sapiens
agcctgggtatcctttgagga

SEQ ID NO: 7933033 - DNA, 21 bp, Homo sapiens
agcctgggtatcctttgagga

SEQ ID NO: 7933034 - DNA, 23 bp, Homo sapiens
agcctgggtagcctaaataacag

SEQ ID NO: 7933035 - DNA, 21 bp, Homo sapiens
agcctgggtatcctttgagga

SEQ ID NO: 7933036 - DNA, 22 bp, Homo sapiens
agcctgggggcgcagaaaccgg

SEQ ID NO: 7933037 - DNA, 22 bp, Homo sapiens
agcctgggggcgcagaaaccgg

SEQ ID NO: 7933038 - DNA, 22 bp, Homo sapiens
agcctgggggcgcagaaaccgg

SEQ ID NO: 7933039 - DNA, 22 bp, Homo sapiens
agcctggggtttcagtttgcac

SEQ ID NO: 7933040 - DNA, 22 bp, Homo sapiens
agcctggggtttcagtttgcac

SEQ ID NO: 7933041 - DNA, 22 bp, Homo sapiens
agcctggggtttcagtttgcac

SEQ ID NO: 7933042 - DNA, 20 bp, Homo sapiens
agcctggggaattccacccc

SEQ ID NO: 7933043 - DNA, 18 bp, Homo sapiens
agcctgggctctgcctgg

SEQ ID NO: 7933044 - DNA, 20 bp, Homo sapiens
agcctggggaattccacccc

SEQ ID NO: 7933045 - DNA, 22 bp, Homo sapiens
agcctggggcacttctccaaac

SEQ ID NO: 7933046 - DNA, 22 bp, Homo sapiens
agcctggggcacttctccaaac

SEQ ID NO: 7933047 - DNA, 22 bp, Homo sapiens
agcctggggcacttctccaaac

SEQ ID NO: 7933048 - DNA, 22 bp, Homo sapiens
agctaggaaattgaggctgaga

SEQ ID NO: 7933049 - DNA, 22 bp, Homo sapiens
agctaggaaattgaggctgaga

SEQ ID NO: 7933050 - DNA, 22 bp, Homo sapiens
agctaggaaattgaggctgaga

SEQ ID NO: 7933051 - DNA, 20 bp, Homo sapiens
agctaggagaaagcatggag

SEQ ID NO: 7933052 - DNA, 20 bp, Homo sapiens
agctaggagaaagcatggag

SEQ ID NO: 7933053 - DNA, 22 bp, Homo sapiens
agctaggacaggtagagatggg

SEQ ID NO: 7933054 - DNA, 22 bp, Homo sapiens
agctagcttagcctgtgaggta

SEQ ID NO: 7933055 - DNA, 22 bp, Homo sapiens
agctagctttaactcttagaca

SEQ ID NO: 7933056 - DNA, 22 bp, Homo sapiens
agctagcctaggcagagtgcat

SEQ ID NO: 7933057 - DNA, 22 bp, Homo sapiens
agctagccatgtggctcctgtg

SEQ ID NO: 7933058 - DNA, 23 bp, Homo sapiens
agctagcataatgtctggctcct

SEQ ID NO: 7933059 - DNA, 22 bp, Homo sapiens
agctagccatgtggctcctgtg

SEQ ID NO: 7933060 - DNA, 22 bp, Homo sapiens
agctagcaaatagcatgtagga

SEQ ID NO: 7933061 - DNA, 22 bp, Homo sapiens
agctagcaaatagcatgtagga

SEQ ID NO: 7933062 - DNA, 22 bp, Homo sapiens
agctagcaaatagcatgtagga

SEQ ID NO: 7933063 - DNA, 22 bp, Homo sapiens
agctagaggtgaaacatgccaa

SEQ ID NO: 7933064 - DNA, 23 bp, Homo sapiens
agctccagaacatagcacaggaa

SEQ ID NO: 7933065 - DNA, 23 bp, Homo sapiens
agctccagaacatagcacaggaa

SEQ ID NO: 7933066 - DNA, 23 bp, Homo sapiens
agctccagaacatagcacaggaa

SEQ ID NO: 7933067 - DNA, 23 bp, Homo sapiens
agctccagaacatagcacaggaa

SEQ ID NO: 7933068 - DNA, 23 bp, Homo sapiens
agctccagaacatagcacaggaa

SEQ ID NO: 7933069 - DNA, 23 bp, Homo sapiens
agctccagaacatagcacaggaa

SEQ ID NO: 7933070 - DNA, 23 bp, Homo sapiens
agctccagaacatagcacaggaa

SEQ ID NO: 7933071 - DNA, 23 bp, Homo sapiens
agctccagaacatagcacaggaa

SEQ ID NO: 7933072 - DNA, 19 bp, Homo sapiens
agctcaggcccatcgtccc

SEQ ID NO: 7933073 - DNA, 22 bp, Homo sapiens
agctcaggccggagctacaggc

SEQ ID NO: 7933074 - DNA, 20 bp, Homo sapiens
agctaggagaaagcatggag

SEQ ID NO: 7933075 - DNA, 20 bp, Homo sapiens
agctaggagaaagcatggag

SEQ ID NO: 7933076 - DNA, 22 bp, Homo sapiens
agctccagcccatctgctcgtg

SEQ ID NO: 7933077 - DNA, 22 bp, Homo sapiens
agctccagccctagtacagctg

SEQ ID NO: 7933078 - DNA, 22 bp, Homo sapiens
agctccagccctagtacagctg

SEQ ID NO: 7933079 - DNA, 22 bp, Homo sapiens
agctccagccctagtacagctg

SEQ ID NO: 7933080 - DNA, 22 bp, Homo sapiens
agctccagccctagtacagctg

SEQ ID NO: 7933081 - DNA, 22 bp, Homo sapiens
agctccagattaattgtaggag

SEQ ID NO: 7933082 - DNA, 22 bp, Homo sapiens
agctccagcccatctgctcgtg

SEQ ID NO: 7933083 - DNA, 22 bp, Homo sapiens
agctccagcctcttctggaggt

SEQ ID NO: 7933084 - DNA, 22 bp, Homo sapiens
agctccagccgctgatgggttt

SEQ ID NO: 7933085 - DNA, 22 bp, Homo sapiens
agctccagccgctgatgggttt

SEQ ID NO: 7933086 - DNA, 22 bp, Homo sapiens
agctccagccgctgatgggttt

SEQ ID NO: 7933087 - DNA, 22 bp, Homo sapiens
agctccagccgctgatgggttt

SEQ ID NO: 7933088 - DNA, 22 bp, Homo sapiens
agctccagccctagtacagctg

SEQ ID NO: 7933089 - DNA, 22 bp, Homo sapiens
agctccagccgctgatgggttt

SEQ ID NO: 7933090 - DNA, 22 bp, Homo sapiens
agctccagccgctgatgggttt

SEQ ID NO: 7933091 - DNA, 22 bp, Homo sapiens
agctccagagccacatccatca

SEQ ID NO: 7933092 - DNA, 22 bp, Homo sapiens
agctccagaagcctgcaaggta

SEQ ID NO: 7933093 - DNA, 22 bp, Homo sapiens
agctccagaggcagtgatgaag

SEQ ID NO: 7933094 - DNA, 22 bp, Homo sapiens
agctccagaggcagtgatgaag

SEQ ID NO: 7933095 - DNA, 22 bp, Homo sapiens
agctccagagtctgaactattc

SEQ ID NO: 7933096 - DNA, 22 bp, Homo sapiens
agctccagagtctgaactattc

SEQ ID NO: 7933097 - DNA, 22 bp, Homo sapiens
agctccagagtctgaactattc

SEQ ID NO: 7933098 - DNA, 22 bp, Homo sapiens
agctccagaagcctgcaaggta

SEQ ID NO: 7933099 - DNA, 22 bp, Homo sapiens
agctccagaagcctgcaaggta

SEQ ID NO: 7933100 - DNA, 22 bp, Homo sapiens
agctccagaagcctgcaaggta

SEQ ID NO: 7933101 - DNA, 22 bp, Homo sapiens
agctccagaagcctgcaaggta

SEQ ID NO: 7933102 - DNA, 22 bp, Homo sapiens
agctccagaagcctgcaaggta

SEQ ID NO: 7933103 - DNA, 23 bp, Homo sapiens
agctccagaacatagcacaggaa

SEQ ID NO: 7933104 - DNA, 22 bp, Homo sapiens
agctccagaagcctgcaaggta

SEQ ID NO: 7933105 - DNA, 22 bp, Homo sapiens
agctccagaagcctgcaaggta

SEQ ID NO: 7933106 - DNA, 22 bp, Homo sapiens
agctccagaagcctgcaaggta

SEQ ID NO: 7933107 - DNA, 23 bp, Homo sapiens
agctccagaacatagcacaggaa

SEQ ID NO: 7933108 - DNA, 22 bp, Homo sapiens
agctccaggataagacaggtgc

SEQ ID NO: 7933109 - DNA, 22 bp, Homo sapiens
agctccaggataagacaggtgc

SEQ ID NO: 7933110 - DNA, 22 bp, Homo sapiens
agctccaggataagacaggtgc

SEQ ID NO: 7933111 - DNA, 22 bp, Homo sapiens
agctccaggataagacaggtgc

SEQ ID NO: 7933112 - DNA, 19 bp, Homo sapiens
agctccaggcctggatgct

SEQ ID NO: 7933113 - DNA, 19 bp, Homo sapiens
agctccaggcctggatgct

SEQ ID NO: 7933114 - DNA, 19 bp, Homo sapiens
agctccaggcctggatgct

SEQ ID NO: 7933115 - DNA, 22 bp, Homo sapiens
agctccaggccttgggccccgg

SEQ ID NO: 7933116 - DNA, 19 bp, Homo sapiens
agctccaggcctggatgct

SEQ ID NO: 7933117 - DNA, 22 bp, Homo sapiens
agctccaggatctgaaagttcg

SEQ ID NO: 7933118 - DNA, 22 bp, Homo sapiens
agctccaggatctgaaagttcg

SEQ ID NO: 7933119 - DNA, 22 bp, Homo sapiens
agctccaggcagcattaataaa

SEQ ID NO: 7933120 - DNA, 22 bp, Homo sapiens
agctccaggcagcattaataaa

SEQ ID NO: 7933121 - DNA, 23 bp, Homo sapiens
agctccagctgacgtgggcagcc

SEQ ID NO: 7933122 - DNA, 23 bp, Homo sapiens
agctccagctgacgtgggcagcc

SEQ ID NO: 7933123 - DNA, 23 bp, Homo sapiens
agctccagctgacgtgggcagcc

SEQ ID NO: 7933124 - DNA, 23 bp, Homo sapiens
agctccagctgacgtgggcagcc

SEQ ID NO: 7933125 - DNA, 23 bp, Homo sapiens
agctccagctgacgtgggcagcc

SEQ ID NO: 7933126 - DNA, 23 bp, Homo sapiens
agctccagctgacgtgggcagcc

SEQ ID NO: 7933127 - DNA, 23 bp, Homo sapiens
agctccagctgacgtgggcagcc

SEQ ID NO: 7933128 - DNA, 22 bp, Homo sapiens
agctccaggataagacaggtgc

SEQ ID NO: 7933129 - DNA, 23 bp, Homo sapiens
agctccagctgacgtgggcagcc

SEQ ID NO: 7933130 - DNA, 23 bp, Homo sapiens
agctccagctgacgtgggcagcc

SEQ ID NO: 7933131 - DNA, 22 bp, Homo sapiens
agctccagcctcttctggaggt

SEQ ID NO: 7933132 - DNA, 22 bp, Homo sapiens
agctccagcctcttctggaggt

SEQ ID NO: 7933133 - DNA, 22 bp, Homo sapiens
agctccagcctcttctggaggt

SEQ ID NO: 7933134 - DNA, 22 bp, Homo sapiens
agctccagcctcttctggaggt

SEQ ID NO: 7933135 - DNA, 22 bp, Homo sapiens
agctccagcggatggtcttata

SEQ ID NO: 7933136 - DNA, 23 bp, Homo sapiens
agctccagctgacgtgggcagcc

SEQ ID NO: 7933137 - DNA, 22 bp, Homo sapiens
agctccagcctcttctggaggt

SEQ ID NO: 7933138 - DNA, 22 bp, Homo sapiens
agctccagcctcttctggaggt

SEQ ID NO: 7933139 - DNA, 22 bp, Homo sapiens
agctccagcctcttctggaggt

SEQ ID NO: 7933140 - DNA, 22 bp, Homo sapiens
agctcctggaggtgcgcactcg

SEQ ID NO: 7933141 - DNA, 22 bp, Homo sapiens
agctcctggaggtgcgcactcg

SEQ ID NO: 7933142 - DNA, 22 bp, Homo sapiens
agctcctggaggtgcgcactcg

SEQ ID NO: 7933143 - DNA, 22 bp, Homo sapiens
agctcctggaggtgcgcactcg

SEQ ID NO: 7933144 - DNA, 20 bp, Homo sapiens
agctcctggactagagagtg

SEQ ID NO: 7933145 - DNA, 22 bp, Homo sapiens
agctcctggaggtgcgcactcg

SEQ ID NO: 7933146 - DNA, 22 bp, Homo sapiens
agctcctggaggtgcgcactcg

SEQ ID NO: 7933147 - DNA, 22 bp, Homo sapiens
agctcctggatgaggcttatgt

SEQ ID NO: 7933148 - DNA, 22 bp, Homo sapiens
agctcctggcaaggtcatggtg

SEQ ID NO: 7933149 - DNA, 22 bp, Homo sapiens
agctcctgcttgacagaagagg

SEQ ID NO: 7933150 - DNA, 22 bp, Homo sapiens
agctcctggacgaacagggagt

SEQ ID NO: 7933151 - DNA, 22 bp, Homo sapiens
agctcctggacgaacagggagt

SEQ ID NO: 7933152 - DNA, 22 bp, Homo sapiens
agctcctggacgaacagggagt

SEQ ID NO: 7933153 - DNA, 22 bp, Homo sapiens
agctcctggacgaacagggagt

SEQ ID NO: 7933154 - DNA, 22 bp, Homo sapiens
agctcctggacgaacagggagt

SEQ ID NO: 7933155 - DNA, 22 bp, Homo sapiens
agctcctggacgaacagggagt

SEQ ID NO: 7933156 - DNA, 20 bp, Homo sapiens
agctcctggactagagagtg

SEQ ID NO: 7933157 - DNA, 20 bp, Homo sapiens
agctcctggactagagagtg

SEQ ID NO: 7933158 - DNA, 22 bp, Homo sapiens
agctccagggaaagagtggatc

SEQ ID NO: 7933159 - DNA, 22 bp, Homo sapiens
agctccagggaaagagtggatc

SEQ ID NO: 7933160 - DNA, 22 bp, Homo sapiens
agctccagggaaagagtggatc

SEQ ID NO: 7933161 - DNA, 19 bp, Homo sapiens
agctcctgattgtgcctcg

SEQ ID NO: 7933162 - DNA, 19 bp, Homo sapiens
agctcctgattgtgcctcg

SEQ ID NO: 7933163 - DNA, 19 bp, Homo sapiens
agctcctgattgtgcctcg

SEQ ID NO: 7933164 - DNA, 19 bp, Homo sapiens
agctcctgattgtgcctcg

SEQ ID NO: 7933165 - DNA, 19 bp, Homo sapiens
agctcctgattgtgcctcg

SEQ ID NO: 7933166 - DNA, 21 bp, Homo sapiens
agctccaggctcctggggttc

SEQ ID NO: 7933167 - DNA, 21 bp, Homo sapiens
agctccaggctcctggggttc

SEQ ID NO: 7933168 - DNA, 22 bp, Homo sapiens
agctccagggaaagagtggatc

SEQ ID NO: 7933169 - DNA, 21 bp, Homo sapiens
agctccaggctcctggggttc

SEQ ID NO: 7933170 - DNA, 21 bp, Homo sapiens
agctccaggctcctggggttc

SEQ ID NO: 7933171 - DNA, 21 bp, Homo sapiens
agctccaggctcctggggttc

SEQ ID NO: 7933172 - DNA, 21 bp, Homo sapiens
agctccaggctcctggggttc

SEQ ID NO: 7933173 - DNA, 22 bp, Homo sapiens
agctccaggccttgggccccgg

SEQ ID NO: 7933174 - DNA, 22 bp, Homo sapiens
agctccaggccttgggccccgg

SEQ ID NO: 7933175 - DNA, 22 bp, Homo sapiens
agctccaggccttgggccccgg

SEQ ID NO: 7933176 - DNA, 19 bp, Homo sapiens
agctcctgggctctgggcc

SEQ ID NO: 7933177 - DNA, 19 bp, Homo sapiens
agctcctgggctctgggcc

SEQ ID NO: 7933178 - DNA, 19 bp, Homo sapiens
agctcctgggctctgggcc

SEQ ID NO: 7933179 - DNA, 19 bp, Homo sapiens
agctcctgggctctgggcc

SEQ ID NO: 7933180 - DNA, 19 bp, Homo sapiens
agctcctgggctctgggcc

SEQ ID NO: 7933181 - DNA, 19 bp, Homo sapiens
agctcctgggctctgggcc

SEQ ID NO: 7933182 - DNA, 22 bp, Homo sapiens
agctcctgggggttccaagcag

SEQ ID NO: 7933183 - DNA, 22 bp, Homo sapiens
agctcctgggccaagcccatgc

SEQ ID NO: 7933184 - DNA, 22 bp, Homo sapiens
agctcctgggccaagcccatgc

SEQ ID NO: 7933185 - DNA, 22 bp, Homo sapiens
agctcctgggcacctctttcac

SEQ ID NO: 7933186 - DNA, 22 bp, Homo sapiens
agctcctgggcacctctttcac

SEQ ID NO: 7933187 - DNA, 22 bp, Homo sapiens
agctcctgggccaagcccatgc

SEQ ID NO: 7933188 - DNA, 22 bp, Homo sapiens
agctcctgggccaagcccatgc

SEQ ID NO: 7933189 - DNA, 22 bp, Homo sapiens
agctcctgggccatcacaacca

SEQ ID NO: 7933190 - DNA, 22 bp, Homo sapiens
agctcctgggccatcacaacca

SEQ ID NO: 7933191 - DNA, 22 bp, Homo sapiens
agctcctggctttcctctcacc

SEQ ID NO: 7933192 - DNA, 22 bp, Homo sapiens
agctcctggctttcctctcacc

SEQ ID NO: 7933193 - DNA, 22 bp, Homo sapiens
agctcctggctttcctctcacc

SEQ ID NO: 7933194 - DNA, 22 bp, Homo sapiens
agctcctggctttcctctcacc

SEQ ID NO: 7933195 - DNA, 22 bp, Homo sapiens
agctcctggctttcctctcacc

SEQ ID NO: 7933196 - DNA, 22 bp, Homo sapiens
agctcctggctttcctctcacc

SEQ ID NO: 7933197 - DNA, 22 bp, Homo sapiens
agctcctgggagcaggtggtac

SEQ ID NO: 7933198 - DNA, 22 bp, Homo sapiens
agctcctgggagcaggtggtac

SEQ ID NO: 7933199 - DNA, 22 bp, Homo sapiens
agctcctgggagcaggtggtac

SEQ ID NO: 7933200 - DNA, 22 bp, Homo sapiens
agctcctggcaaggtcatggtg

SEQ ID NO: 7933201 - DNA, 22 bp, Homo sapiens
agctcctggcaaggtcatggtg

SEQ ID NO: 7933202 - DNA, 22 bp, Homo sapiens
agctcctggcaaggtcatggtg

SEQ ID NO: 7933203 - DNA, 22 bp, Homo sapiens
agctcctggcaaggtcatggtg

SEQ ID NO: 7933204 - DNA, 22 bp, Homo sapiens
agctcctggcaaggtcatggtg

SEQ ID NO: 7933205 - DNA, 22 bp, Homo sapiens
agctcctggcaaggtcatggtg

SEQ ID NO: 7933206 - DNA, 22 bp, Homo sapiens
agctcctggctttcctctcacc

SEQ ID NO: 7933207 - DNA, 22 bp, Homo sapiens
agctcctggcaaggtcatggtg

SEQ ID NO: 7933208 - DNA, 22 bp, Homo sapiens
agctcctggcaaggtcatggtg

SEQ ID NO: 7933209 - DNA, 22 bp, Homo sapiens
agctccagggaaagagtggatc

SEQ ID NO: 7933210 - DNA, 23 bp, Homo sapiens
agctcctgtaaggtggtcgtcac

SEQ ID NO: 7933211 - DNA, 23 bp, Homo sapiens
agctcctgtaaggtggtcgtcac

SEQ ID NO: 7933212 - DNA, 22 bp, Homo sapiens
agctcctggtgcctcagccgaa

SEQ ID NO: 7933213 - DNA, 22 bp, Homo sapiens
agctcctggtgcctcagccgaa

SEQ ID NO: 7933214 - DNA, 22 bp, Homo sapiens
agctcctggtgcctcagccgaa

SEQ ID NO: 7933215 - DNA, 22 bp, Homo sapiens
agctcctggtctttgtccagag

SEQ ID NO: 7933216 - DNA, 22 bp, Homo sapiens
agctcctggtctttgtccagag

SEQ ID NO: 7933217 - DNA, 22 bp, Homo sapiens
agctcctggtctttgtccagag

SEQ ID NO: 7933218 - DNA, 22 bp, Homo sapiens
agctcctggtgcctcagccgaa

SEQ ID NO: 7933219 - DNA, 22 bp, Homo sapiens
agctcctgtctcaagggagcct

SEQ ID NO: 7933220 - DNA, 22 bp, Homo sapiens
agctcctgtctcaagggagcct

SEQ ID NO: 7933221 - DNA, 22 bp, Homo sapiens
agctcctgtctcaagggagcct

SEQ ID NO: 7933222 - DNA, 23 bp, Homo sapiens
agctcctgtaaggtggtcgtcac

SEQ ID NO: 7933223 - DNA, 22 bp, Homo sapiens
agctcctgtagtacatattatt

SEQ ID NO: 7933224 - DNA, 22 bp, Homo sapiens
agctcctgtctcaagggagcct

SEQ ID NO: 7933225 - DNA, 22 bp, Homo sapiens
agctcctgtctcaagggagcct

SEQ ID NO: 7933226 - DNA, 17 bp, Homo sapiens
agctcctggggtcttta

SEQ ID NO: 7933227 - DNA, 20 bp, Homo sapiens
agctcctggtataggtgcct

SEQ ID NO: 7933228 - DNA, 20 bp, Homo sapiens
agctcctggtataggtgcct

SEQ ID NO: 7933229 - DNA, 22 bp, Homo sapiens
agctcctgggggttccaagcag

SEQ ID NO: 7933230 - DNA, 22 bp, Homo sapiens
agctcctgggggttccaagcag

SEQ ID NO: 7933231 - DNA, 22 bp, Homo sapiens
agctcctgggggttccaagcag

SEQ ID NO: 7933232 - DNA, 18 bp, Homo sapiens
agctcctggtctcaggga

SEQ ID NO: 7933233 - DNA, 18 bp, Homo sapiens
agctcctggtctcaggga

SEQ ID NO: 7933234 - DNA, 22 bp, Homo sapiens
agctcctggtctttgtccagag

SEQ ID NO: 7933235 - DNA, 20 bp, Homo sapiens
agctcctggtataggtgcct

SEQ ID NO: 7933236 - DNA, 18 bp, Homo sapiens
agctcctggtctcaggga

SEQ ID NO: 7933237 - DNA, 18 bp, Homo sapiens
agctcctggtctcaggga

SEQ ID NO: 7933238 - DNA, 18 bp, Homo sapiens
agctcctggtctcaggga

SEQ ID NO: 7933239 - DNA, 22 bp, Homo sapiens
agctcctgtggcagctcttctg

SEQ ID NO: 7933240 - DNA, 22 bp, Homo sapiens
agctcctgtctcaagggagcct

SEQ ID NO: 7933241 - DNA, 22 bp, Homo sapiens
agctcctgtctcaagggagcct

SEQ ID NO: 7933242 - DNA, 22 bp, Homo sapiens
agctcctgtctcaagggagcct

SEQ ID NO: 7933243 - DNA, 22 bp, Homo sapiens
agctcctgtggcagctcttctg

SEQ ID NO: 7933244 - DNA, 22 bp, Homo sapiens
agctcctgtggcagctcttctg

SEQ ID NO: 7933245 - DNA, 22 bp, Homo sapiens
agctcctgtggcagctcttctg

SEQ ID NO: 7933246 - DNA, 22 bp, Homo sapiens
agctcctgtggcagctcttctg

SEQ ID NO: 7933247 - DNA, 22 bp, Homo sapiens
agctcctgtggctgaaagagga

SEQ ID NO: 7933248 - DNA, 22 bp, Homo sapiens
agctcctgtggctgaaagagga

SEQ ID NO: 7933249 - DNA, 22 bp, Homo sapiens
agctcctgtgtgaagcctccct

SEQ ID NO: 7933250 - DNA, 22 bp, Homo sapiens
agctcctgtgtgaagcctccct

SEQ ID NO: 7933251 - DNA, 22 bp, Homo sapiens
agctctgggccaggaaccctaa

SEQ ID NO: 7933252 - DNA, 22 bp, Homo sapiens
agctctgggattctcaggccac

SEQ ID NO: 7933253 - DNA, 22 bp, Homo sapiens
agctctggtttagaaggggaaa

SEQ ID NO: 7933254 - DNA, 22 bp, Homo sapiens
agctctggtttagaaggggaaa

SEQ ID NO: 7933255 - DNA, 22 bp, Homo sapiens
agctctggttattgaagcaggg

SEQ ID NO: 7933256 - DNA, 22 bp, Homo sapiens
agctctggtttagaaggggaaa

SEQ ID NO: 7933257 - DNA, 22 bp, Homo sapiens
agctctgggccaggaaccctaa

SEQ ID NO: 7933258 - DNA, 22 bp, Homo sapiens
agctctgggccaggaaccctaa

SEQ ID NO: 7933259 - DNA, 22 bp, Homo sapiens
agctctggtttagaaggggaaa

SEQ ID NO: 7933260 - DNA, 22 bp, Homo sapiens
agctctgtctttctcttagtaa

SEQ ID NO: 7933261 - DNA, 19 bp, Homo sapiens
agctctgtcaggctacata

SEQ ID NO: 7933262 - DNA, 22 bp, Homo sapiens
agctctgtgaagccagcagttc

SEQ ID NO: 7933263 - DNA, 22 bp, Homo sapiens
agctctgtgaagccagcagttc

SEQ ID NO: 7933264 - DNA, 20 bp, Homo sapiens
agctcttaagaagaagatga

SEQ ID NO: 7933265 - DNA, 22 bp, Homo sapiens
agctctgttactgattttcctg

SEQ ID NO: 7933266 - DNA, 22 bp, Homo sapiens
agctctgtgttcacagcactaa

SEQ ID NO: 7933267 - DNA, 22 bp, Homo sapiens
agctcttacatttaggtctatg

SEQ ID NO: 7933268 - DNA, 22 bp, Homo sapiens
agctcttacatttaggtctatg

SEQ ID NO: 7933269 - DNA, 22 bp, Homo sapiens
agctcttacatttaggtctatg

SEQ ID NO: 7933270 - DNA, 22 bp, Homo sapiens
agctcttcctgcacctgtggct

SEQ ID NO: 7933271 - DNA, 22 bp, Homo sapiens
agctcttccacctcatgatggg

SEQ ID NO: 7933272 - DNA, 20 bp, Homo sapiens
agctcttactttgcagcagc

SEQ ID NO: 7933273 - DNA, 20 bp, Homo sapiens
agctcttactttgcagcagc

SEQ ID NO: 7933274 - DNA, 22 bp, Homo sapiens
agctcttcctgcacctgtggct

SEQ ID NO: 7933275 - DNA, 22 bp, Homo sapiens
agctcttccacctcatgatggg

SEQ ID NO: 7933276 - DNA, 19 bp, Homo sapiens
agctctttgctgcattcca

SEQ ID NO: 7933277 - DNA, 22 bp, Homo sapiens
agctctttggaaggtgtgcact

SEQ ID NO: 7933278 - DNA, 22 bp, Homo sapiens
agctctttggaaggtgtgcact

SEQ ID NO: 7933279 - DNA, 22 bp, Homo sapiens
agctctttagagtctcccttct

SEQ ID NO: 7933280 - DNA, 22 bp, Homo sapiens
acctggctgttctcatttctag

SEQ ID NO: 7933281 - DNA, 18 bp, Homo sapiens
acctggctgtgtgagctg

SEQ ID NO: 7933282 - DNA, 18 bp, Homo sapiens
acctggctgtgtgagctg

SEQ ID NO: 7933283 - DNA, 22 bp, Homo sapiens
acctggctggttgtgattccca

SEQ ID NO: 7933284 - DNA, 18 bp, Homo sapiens
acctgcctgttcttctct

SEQ ID NO: 7933285 - DNA, 22 bp, Homo sapiens
aagtaacagcatcaagtctcaa

SEQ ID NO: 7933286 - DNA, 22 bp, Homo sapiens
acctgcctctaagcagcaggtg

SEQ ID NO: 7933287 - DNA, 22 bp, Homo sapiens
acctggcttcaaccatcatttg

SEQ ID NO: 7933288 - DNA, 22 bp, Homo sapiens
acctggcttcaaccatcatttg

SEQ ID NO: 7933289 - DNA, 22 bp, Homo sapiens
acctggctgttctcatttctag

SEQ ID NO: 7933290 - DNA, 22 bp, Homo sapiens
acctggctgttctcatttctag

SEQ ID NO: 7933291 - DNA, 22 bp, Homo sapiens
acctggcttccaatctaggagc

SEQ ID NO: 7933292 - DNA, 22 bp, Homo sapiens
acctggcttcagagtctggcca

SEQ ID NO: 7933293 - DNA, 22 bp, Homo sapiens
acctggcttccaatctaggagc

SEQ ID NO: 7933294 - DNA, 22 bp, Homo sapiens
acctggcttctaatcatggctc

SEQ ID NO: 7933295 - DNA, 22 bp, Homo sapiens
acctggcttctaatcatggctc

SEQ ID NO: 7933296 - DNA, 20 bp, Homo sapiens
acctggcttcctcttggcat

SEQ ID NO: 7933297 - DNA, 20 bp, Homo sapiens
acctggcttcctcttggcat

SEQ ID NO: 7933298 - DNA, 22 bp, Homo sapiens
aagtaacacatgttacttctgc

SEQ ID NO: 7933299 - DNA, 22 bp, Homo sapiens
aagtaaatgttggagctcaaat

SEQ ID NO: 7933300 - DNA, 22 bp, Homo sapiens
aagtaacacggaacttgaagca

SEQ ID NO: 7933301 - DNA, 18 bp, Homo sapiens
aagtaacagaagagcaca

SEQ ID NO: 7933302 - DNA, 18 bp, Homo sapiens
aagtaacagaagagcaca

SEQ ID NO: 7933303 - DNA, 18 bp, Homo sapiens
aagtaacagaagagcaca

SEQ ID NO: 7933304 - DNA, 22 bp, Homo sapiens
aagtaaaccacagagaagccac

SEQ ID NO: 7933305 - DNA, 22 bp, Homo sapiens
aagtaaacttacacatagtaaa

SEQ ID NO: 7933306 - DNA, 22 bp, Homo sapiens
aagtaaacagataagaaatctg

SEQ ID NO: 7933307 - DNA, 22 bp, Homo sapiens
aagtaaacagataagaaatctg

SEQ ID NO: 7933308 - DNA, 22 bp, Homo sapiens
aagtaaacattgagagacaaga

SEQ ID NO: 7933309 - DNA, 22 bp, Homo sapiens
aagtaaacattgagagacaaga

SEQ ID NO: 7933310 - DNA, 23 bp, Homo sapiens
aagtaaacattagaagttgaggt

SEQ ID NO: 7933311 - DNA, 23 bp, Homo sapiens
aagtaaacattagaagttgaggt

SEQ ID NO: 7933312 - DNA, 22 bp, Homo sapiens
aagtaaatatctgtagtcttta

SEQ ID NO: 7933313 - DNA, 22 bp, Homo sapiens
aagtaaatatctgtagtcttta

SEQ ID NO: 7933314 - DNA, 22 bp, Homo sapiens
aagtaaatatctgtttatagca

SEQ ID NO: 7933315 - DNA, 22 bp, Homo sapiens
aagtaaatatctgtttatagca

SEQ ID NO: 7933316 - DNA, 22 bp, Homo sapiens
aagtaaatgttggagctcaaat

SEQ ID NO: 7933317 - DNA, 22 bp, Homo sapiens
aagtaaatgttggagctcaaat

SEQ ID NO: 7933318 - DNA, 22 bp, Homo sapiens
aagtaaatgttggagctcaaat

SEQ ID NO: 7933319 - DNA, 22 bp, Homo sapiens
aagtaaatcttatgtcagggag

SEQ ID NO: 7933320 - DNA, 21 bp, Homo sapiens
aagtaaatcagagaaataacc

SEQ ID NO: 7933321 - DNA, 21 bp, Homo sapiens
aagtaaatcagagaaataacc

SEQ ID NO: 7933322 - DNA, 21 bp, Homo sapiens
aagtaaatcagagaaataacc

SEQ ID NO: 7933323 - DNA, 21 bp, Homo sapiens
aagtaaatcagagaaataacc

SEQ ID NO: 7933324 - DNA, 21 bp, Homo sapiens
aagtaaatcagagaaataacc

SEQ ID NO: 7933325 - DNA, 21 bp, Homo sapiens
aagtaaatcagagaaataacc

SEQ ID NO: 7933326 - DNA, 19 bp, Homo sapiens
accttctgggaaacattcc

SEQ ID NO: 7933327 - DNA, 22 bp, Homo sapiens
accttctggtctgcctgacagc

SEQ ID NO: 7933328 - DNA, 22 bp, Homo sapiens
accttctgaccagttatcttga

SEQ ID NO: 7933329 - DNA, 22 bp, Homo sapiens
acctgggtctggtgttgggacg

SEQ ID NO: 7933330 - DNA, 22 bp, Homo sapiens
accttgaacccagcttgctgca

SEQ ID NO: 7933331 - DNA, 22 bp, Homo sapiens
acctgggttgctggcgtgaggg

SEQ ID NO: 7933332 - DNA, 22 bp, Homo sapiens
accttctgaccagttatcttga

SEQ ID NO: 7933333 - DNA, 22 bp, Homo sapiens
accttctgaccagttatcttga

SEQ ID NO: 7933334 - DNA, 22 bp, Homo sapiens
acctgggtctggtgttgggacg

SEQ ID NO: 7933335 - DNA, 22 bp, Homo sapiens
acctgggcattttggatgatta

SEQ ID NO: 7933336 - DNA, 22 bp, Homo sapiens
acctgggcattttggatgatta

SEQ ID NO: 7933337 - DNA, 20 bp, Homo sapiens
acctggggttgcctgtgctc

SEQ ID NO: 7933338 - DNA, 19 bp, Homo sapiens
accttgggcaagtgccttc

SEQ ID NO: 7933339 - DNA, 23 bp, Homo sapiens
accttggacttcccagcttccag

SEQ ID NO: 7933340 - DNA, 23 bp, Homo sapiens
accttggacttcccagcttccag

SEQ ID NO: 7933341 - DNA, 22 bp, Homo sapiens
accttgggcaacctgctcctgc

SEQ ID NO: 7933342 - DNA, 22 bp, Homo sapiens
accttgaccttgagcacctgtt

SEQ ID NO: 7933343 - DNA, 18 bp, Homo sapiens
accttgatggcagcttgc

SEQ ID NO: 7933344 - DNA, 22 bp, Homo sapiens
accttgatggggctgttggagt

SEQ ID NO: 7933345 - DNA, 22 bp, Homo sapiens
accttggaactgaagtgttttt

SEQ ID NO: 7933346 - DNA, 22 bp, Homo sapiens
accttggaactgaagtgttttt

SEQ ID NO: 7933347 - DNA, 22 bp, Homo sapiens
accttggaaagtttaattgagg

SEQ ID NO: 7933348 - DNA, 22 bp, Homo sapiens
accttggaaagtttaattgagg

SEQ ID NO: 7933349 - DNA, 22 bp, Homo sapiens
accttggaaagtttaattgagg

SEQ ID NO: 7933350 - DNA, 22 bp, Homo sapiens
accttggaaatgcccattgcct

SEQ ID NO: 7933351 - DNA, 22 bp, Homo sapiens
acctgggaaagccgtggaaagg

SEQ ID NO: 7933352 - DNA, 22 bp, Homo sapiens
acctgggaacgctttgtggagg

SEQ ID NO: 7933353 - DNA, 22 bp, Homo sapiens
acctgggagagaggagccggcg

SEQ ID NO: 7933354 - DNA, 22 bp, Homo sapiens
acctgggaaaaggagtggccat

SEQ ID NO: 7933355 - DNA, 20 bp, Homo sapiens
acctggcttgggggaggagt

SEQ ID NO: 7933356 - DNA, 22 bp, Homo sapiens
acctggcttctaatcatggctc

SEQ ID NO: 7933357 - DNA, 22 bp, Homo sapiens
acctggcttgtttctacctcct

SEQ ID NO: 7933358 - DNA, 22 bp, Homo sapiens
acctggcttgtttctacctcct

SEQ ID NO: 7933359 - DNA, 22 bp, Homo sapiens
acctggctttggggataggctt

SEQ ID NO: 7933360 - DNA, 22 bp, Homo sapiens
acctgggatggggccaggttta

SEQ ID NO: 7933361 - DNA, 22 bp, Homo sapiens
acctgggagtcacacctgagaa

SEQ ID NO: 7933362 - DNA, 22 bp, Homo sapiens
acctgggaggcggaggttgcag

SEQ ID NO: 7933363 - DNA, 22 bp, Homo sapiens
acctgggaggcagaggttgcag

SEQ ID NO: 7933364 - DNA, 22 bp, Homo sapiens
accttgtcttttatagaacaag

SEQ ID NO: 7933365 - DNA, 22 bp, Homo sapiens
accttgtgaggttacataatgt

SEQ ID NO: 7933366 - DNA, 22 bp, Homo sapiens
accttgtcttttatagaacaag

SEQ ID NO: 7933367 - DNA, 22 bp, Homo sapiens
accttgtccatcccaggccctc

SEQ ID NO: 7933368 - DNA, 20 bp, Homo sapiens
accttgggtgagtgacggtc

SEQ ID NO: 7933369 - DNA, 22 bp, Homo sapiens
accttgttgtaggtacaaaaga

SEQ ID NO: 7933370 - DNA, 22 bp, Homo sapiens
accttgttgtaggtacaaaaga

SEQ ID NO: 7933371 - DNA, 21 bp, Homo sapiens
acctttaattcaagcatcagg

SEQ ID NO: 7933372 - DNA, 21 bp, Homo sapiens
acctttaattcaagcatcagg

SEQ ID NO: 7933373 - DNA, 22 bp, Homo sapiens
acctttatagcaacctggtgaa

SEQ ID NO: 7933374 - DNA, 22 bp, Homo sapiens
acctttatagcaacctggtgaa

SEQ ID NO: 7933375 - DNA, 22 bp, Homo sapiens
acctttatagcaacctggtgaa

SEQ ID NO: 7933376 - DNA, 21 bp, Homo sapiens
acctttaattcaagcatcagg

SEQ ID NO: 7933377 - DNA, 22 bp, Homo sapiens
acctttatagcaacctggtgaa

SEQ ID NO: 7933378 - DNA, 22 bp, Homo sapiens
acctttatagctgattatgaca

SEQ ID NO: 7933379 - DNA, 22 bp, Homo sapiens
acctttatagctgattatgaca

SEQ ID NO: 7933380 - DNA, 22 bp, Homo sapiens
acctttatcgccatcattgtgc

SEQ ID NO: 7933381 - DNA, 22 bp, Homo sapiens
acctttatatgaaagatgacat

SEQ ID NO: 7933382 - DNA, 22 bp, Homo sapiens
acctttatatgaaagatgacat

SEQ ID NO: 7933383 - DNA, 22 bp, Homo sapiens
acctttatatatcaacttctcc

SEQ ID NO: 7933384 - DNA, 22 bp, Homo sapiens
aagtgaagaaatacatgagaat

SEQ ID NO: 7933385 - DNA, 22 bp, Homo sapiens
aagtgaagaaatacatgagaat

SEQ ID NO: 7933386 - DNA, 22 bp, Homo sapiens
aagtgaaattgccattcttata

SEQ ID NO: 7933387 - DNA, 22 bp, Homo sapiens
aagtgaaattgccattcttata

SEQ ID NO: 7933388 - DNA, 22 bp, Homo sapiens
aagtgaaattgccattcttata

SEQ ID NO: 7933389 - DNA, 22 bp, Homo sapiens
aagtctcttttcttcctgtatt

SEQ ID NO: 7933390 - DNA, 22 bp, Homo sapiens
aagtctcttttcttcctgtatt

SEQ ID NO: 7933391 - DNA, 22 bp, Homo sapiens
aagtctcttttcttcctgtatt

SEQ ID NO: 7933392 - DNA, 22 bp, Homo sapiens
aagtctctttgggtactttatt

SEQ ID NO: 7933393 - DNA, 22 bp, Homo sapiens
acctttatcgccatcattgtgc

SEQ ID NO: 7933394 - DNA, 22 bp, Homo sapiens
aagtgaatctcctttctttatt

SEQ ID NO: 7933395 - DNA, 22 bp, Homo sapiens
aagtgaatgatgtgaagtgtaa

SEQ ID NO: 7933396 - DNA, 22 bp, Homo sapiens
aagtgaatagcctatttactag

SEQ ID NO: 7933397 - DNA, 22 bp, Homo sapiens
aagtgaatagcctatttactag

SEQ ID NO: 7933398 - DNA, 22 bp, Homo sapiens
aagtgaatctcctttctttatt

SEQ ID NO: 7933399 - DNA, 22 bp, Homo sapiens
aagtgaataaaattgtgttctt

SEQ ID NO: 7933400 - DNA, 22 bp, Homo sapiens
aagtgaataaaattgtgttctt

SEQ ID NO: 7933401 - DNA, 22 bp, Homo sapiens
aagtgaataccatcaagagctt

SEQ ID NO: 7933402 - DNA, 22 bp, Homo sapiens
aagtgaataccatcaagagctt

SEQ ID NO: 7933403 - DNA, 22 bp, Homo sapiens
aagtgaatagcctatttactag

SEQ ID NO: 7933404 - DNA, 22 bp, Homo sapiens
aagtgaatagcctatttactag

SEQ ID NO: 7933405 - DNA, 22 bp, Homo sapiens
aagtgaatagcctatttactag

SEQ ID NO: 7933406 - DNA, 22 bp, Homo sapiens
aagtgaatttcattccaattct

SEQ ID NO: 7933407 - DNA, 22 bp, Homo sapiens
aagtgaatttcattccaattct

SEQ ID NO: 7933408 - DNA, 18 bp, Homo sapiens
aagtgaattgtccttttc

SEQ ID NO: 7933409 - DNA, 22 bp, Homo sapiens
aagtgaatggggcagacttcag

SEQ ID NO: 7933410 - DNA, 22 bp, Homo sapiens
aagtgaatggggcagacttcag

SEQ ID NO: 7933411 - DNA, 22 bp, Homo sapiens
aagtgaatggggcagacttcag

SEQ ID NO: 7933412 - DNA, 22 bp, Homo sapiens
aagtgaatgtagcaaacttgaa

SEQ ID NO: 7933413 - DNA, 22 bp, Homo sapiens
aagtgaatgtagcaaacttgaa

SEQ ID NO: 7933414 - DNA, 22 bp, Homo sapiens
aagtgaatgtttggtagcagtg

SEQ ID NO: 7933415 - DNA, 22 bp, Homo sapiens
aagtgaattcattgtgttatat

SEQ ID NO: 7933416 - DNA, 22 bp, Homo sapiens
aagtgacataccttacatatgt

SEQ ID NO: 7933417 - DNA, 22 bp, Homo sapiens
aagtgacataccttacatatgt

SEQ ID NO: 7933418 - DNA, 22 bp, Homo sapiens
aagtgacataaaatctcccagg

SEQ ID NO: 7933419 - DNA, 22 bp, Homo sapiens
aagtgacataaaatctcccagg

SEQ ID NO: 7933420 - DNA, 22 bp, Homo sapiens
aagtgacctcatggtttctcct

SEQ ID NO: 7933421 - DNA, 22 bp, Homo sapiens
aagtgactatttgagtacatca

SEQ ID NO: 7933422 - DNA, 17 bp, Homo sapiens
aagtgacatcaggctgc

SEQ ID NO: 7933423 - DNA, 22 bp, Homo sapiens
aagtgacctcatggtttctcct

SEQ ID NO: 7933424 - DNA, 22 bp, Homo sapiens
aagtgacaaaagggtatccaaa

SEQ ID NO: 7933425 - DNA, 22 bp, Homo sapiens
aagtgacacatggcacttctat

SEQ ID NO: 7933426 - DNA, 22 bp, Homo sapiens
aagtgacagtttacaattctta

SEQ ID NO: 7933427 - DNA, 22 bp, Homo sapiens
aagtgacagtttacaattctta

SEQ ID NO: 7933428 - DNA, 22 bp, Homo sapiens
aagtgacacatttgtgatgaat

SEQ ID NO: 7933429 - DNA, 22 bp, Homo sapiens
aagtgacacatttgtgatgaat

SEQ ID NO: 7933430 - DNA, 22 bp, Homo sapiens
aagtgagtgaaaatgcagaata

SEQ ID NO: 7933431 - DNA, 22 bp, Homo sapiens
aagtgagttcagcattcactcg

SEQ ID NO: 7933432 - DNA, 22 bp, Homo sapiens
aagtgagttcagcattcactcg

SEQ ID NO: 7933433 - DNA, 22 bp, Homo sapiens
aagtgaggcctaggcactgggt

SEQ ID NO: 7933434 - DNA, 22 bp, Homo sapiens
aagtgaggtttctgctttcaga

SEQ ID NO: 7933435 - DNA, 22 bp, Homo sapiens
aagtgaggcctaggcactgggt

SEQ ID NO: 7933436 - DNA, 22 bp, Homo sapiens
aagtgagattatatgtacggga

SEQ ID NO: 7933437 - DNA, 22 bp, Homo sapiens
aagtgactatttgagtacatca

SEQ ID NO: 7933438 - DNA, 18 bp, Homo sapiens
aagtgactggcaggccaa

SEQ ID NO: 7933439 - DNA, 22 bp, Homo sapiens
aagtgatgctacgactttgaca

SEQ ID NO: 7933440 - DNA, 22 bp, Homo sapiens
aagtgatgctacgactttgaca

SEQ ID NO: 7933441 - DNA, 22 bp, Homo sapiens
aagtgatacctaggaaatcaag

SEQ ID NO: 7933442 - DNA, 22 bp, Homo sapiens
aagtgatacatctagtctataa

SEQ ID NO: 7933443 - DNA, 22 bp, Homo sapiens
aagtgatgctacgactttgaca

SEQ ID NO: 7933444 - DNA, 22 bp, Homo sapiens
aagtgattccttgcagacacac

SEQ ID NO: 7933445 - DNA, 22 bp, Homo sapiens
aagtgattcattgatgatgagg

SEQ ID NO: 7933446 - DNA, 22 bp, Homo sapiens
aagtgattctagtcatgattct

SEQ ID NO: 7933447 - DNA, 22 bp, Homo sapiens
aagtgattctagtcatgattct

SEQ ID NO: 7933448 - DNA, 22 bp, Homo sapiens
aagtgattaagtaacctaatat

SEQ ID NO: 7933449 - DNA, 22 bp, Homo sapiens
aagtgattaacatggagctttt

SEQ ID NO: 7933450 - DNA, 22 bp, Homo sapiens
aagtgattattgttttcaggtt

SEQ ID NO: 7933451 - DNA, 22 bp, Homo sapiens
aagtgattatgtccaggagaac

SEQ ID NO: 7933452 - DNA, 22 bp, Homo sapiens
aagtgatttagtcttataaagg

SEQ ID NO: 7933453 - DNA, 22 bp, Homo sapiens
aagtgatttgcatgcttaattc

SEQ ID NO: 7933454 - DNA, 22 bp, Homo sapiens
aagtgatttgcatgcttaattc

SEQ ID NO: 7933455 - DNA, 22 bp, Homo sapiens
aagtgattgttccgttgagtgt

SEQ ID NO: 7933456 - DNA, 22 bp, Homo sapiens
aagtgattctgatgtgtttctt

SEQ ID NO: 7933457 - DNA, 22 bp, Homo sapiens
aagtgattttcctacttgctaa

SEQ ID NO: 7933458 - DNA, 22 bp, Homo sapiens
aagtgatttgtacaaaatgtcg

SEQ ID NO: 7933459 - DNA, 22 bp, Homo sapiens
aagtgcaaatctgtggctgaaa

SEQ ID NO: 7933460 - DNA, 22 bp, Homo sapiens
aagtgcaaatctgtggctgaaa

SEQ ID NO: 7933461 - DNA, 22 bp, Homo sapiens
aagtgcaaatctgtggctgaaa

SEQ ID NO: 7933462 - DNA, 22 bp, Homo sapiens
aagtgattttcttcttagttat

SEQ ID NO: 7933463 - DNA, 22 bp, Homo sapiens
aagtgattttcttcttagttat

SEQ ID NO: 7933464 - DNA, 22 bp, Homo sapiens
aagtgattttcctacttgctaa

SEQ ID NO: 7933465 - DNA, 22 bp, Homo sapiens
aagtgcaatttgaaattctgca

SEQ ID NO: 7933466 - DNA, 22 bp, Homo sapiens
aagtgcaatttgaaattctgca

SEQ ID NO: 7933467 - DNA, 22 bp, Homo sapiens
aagtgcaatttgaaattctgca

SEQ ID NO: 7933468 - DNA, 22 bp, Homo sapiens
aagtgcagagagctgacgaact

SEQ ID NO: 7933469 - DNA, 22 bp, Homo sapiens
aagtgcaggagtggggaaagta

SEQ ID NO: 7933470 - DNA, 22 bp, Homo sapiens
aagtgcaggagtggggaaagta

SEQ ID NO: 7933471 - DNA, 22 bp, Homo sapiens
aagtgcaggagtggggaaagta

SEQ ID NO: 7933472 - DNA, 22 bp, Homo sapiens
aagtgcaggtctcagctactct

SEQ ID NO: 7933473 - DNA, 22 bp, Homo sapiens
aagtgcaggtctcagctactct

SEQ ID NO: 7933474 - DNA, 22 bp, Homo sapiens
aagtgcaaatttaagaaggcat

SEQ ID NO: 7933475 - DNA, 22 bp, Homo sapiens
aagtgcaagatcaaggtgtcag

SEQ ID NO: 7933476 - DNA, 22 bp, Homo sapiens
aagtgcaaatttaagaaggcat

SEQ ID NO: 7933477 - DNA, 22 bp, Homo sapiens
aagtgcaaatttaagaaggcat

SEQ ID NO: 7933478 - DNA, 22 bp, Homo sapiens
aagtgcaagcaggacttagttt

SEQ ID NO: 7933479 - DNA, 22 bp, Homo sapiens
aagtgcaagcaggacttagttt

SEQ ID NO: 7933480 - DNA, 21 bp, Homo sapiens
aagtgcaagatgcgcgcttgc

SEQ ID NO: 7933481 - DNA, 22 bp, Homo sapiens
aagtgcaagcaggacttagttt

SEQ ID NO: 7933482 - DNA, 22 bp, Homo sapiens
aagtgcaagcaggacttagttt

SEQ ID NO: 7933483 - DNA, 22 bp, Homo sapiens
aagtgcaatgaatagctgcaat

SEQ ID NO: 7933484 - DNA, 23 bp, Homo sapiens
aagtgcaagtgaaaggcacagtt

SEQ ID NO: 7933485 - DNA, 22 bp, Homo sapiens
aagtgcaatgaatagctgcaat

SEQ ID NO: 7933486 - DNA, 22 bp, Homo sapiens
aagtgcaatgaatagctgcaat

SEQ ID NO: 7933487 - DNA, 22 bp, Homo sapiens
aagtgcaatgaatagctgcaat

SEQ ID NO: 7933488 - DNA, 22 bp, Homo sapiens
aagttttaacaagtacttacta

SEQ ID NO: 7933489 - DNA, 22 bp, Homo sapiens
aagttttactgaggacacatgt

SEQ ID NO: 7933490 - DNA, 22 bp, Homo sapiens
aagttttactgaggacacatgt

SEQ ID NO: 7933491 - DNA, 22 bp, Homo sapiens
aagtttgttttagtctaatgat

SEQ ID NO: 7933492 - DNA, 21 bp, Homo sapiens
aagtttgttcttgtatagtct

SEQ ID NO: 7933493 - DNA, 22 bp, Homo sapiens
aagtttgtcgaaattatcagca

SEQ ID NO: 7933494 - DNA, 22 bp, Homo sapiens
aagtttgtcgaaattatcagca

SEQ ID NO: 7933495 - DNA, 22 bp, Homo sapiens
aagtttgtcgaaattatcagca

SEQ ID NO: 7933496 - DNA, 22 bp, Homo sapiens
aagtttgtgaggttaatccctt

SEQ ID NO: 7933497 - DNA, 22 bp, Homo sapiens
aagtttgtggtcatttattata

SEQ ID NO: 7933498 - DNA, 22 bp, Homo sapiens
aagtttgtctcatttgatcttc

SEQ ID NO: 7933499 - DNA, 22 bp, Homo sapiens
aagtttgtctcatttgatcttc

SEQ ID NO: 7933500 - DNA, 22 bp, Homo sapiens
aagtttgttcattcattcatcc

SEQ ID NO: 7933501 - DNA, 22 bp, Homo sapiens
aagtttgtgtcagagctgttac

SEQ ID NO: 7933502 - DNA, 22 bp, Homo sapiens
aagtttgttcagggcttacatt

SEQ ID NO: 7933503 - DNA, 22 bp, Homo sapiens
aagtttgttcagggcttacatt

SEQ ID NO: 7933504 - DNA, 22 bp, Homo sapiens
aagtttgtggtcatttattata

SEQ ID NO: 7933505 - DNA, 22 bp, Homo sapiens
aagtttgtgtagtttagcatcc

SEQ ID NO: 7933506 - DNA, 22 bp, Homo sapiens
aagtggcagaatagtggcagga

SEQ ID NO: 7933507 - DNA, 22 bp, Homo sapiens
aagtggcagaatagtggcagga

SEQ ID NO: 7933508 - DNA, 22 bp, Homo sapiens
aagtggcagaatagtggcagga

SEQ ID NO: 7933509 - DNA, 22 bp, Homo sapiens
aagtggcagccttagaaggaga

SEQ ID NO: 7933510 - DNA, 22 bp, Homo sapiens
aagtggcagccttagaaggaga

SEQ ID NO: 7933511 - DNA, 22 bp, Homo sapiens
aagtggcagttcaggaagcaga

SEQ ID NO: 7933512 - DNA, 22 bp, Homo sapiens
aagtggcagttcaggaagcaga

SEQ ID NO: 7933513 - DNA, 22 bp, Homo sapiens
aagtggcagttcaggaagcaga

SEQ ID NO: 7933514 - DNA, 22 bp, Homo sapiens
aagtggcagttcaggaagcaga

SEQ ID NO: 7933515 - DNA, 22 bp, Homo sapiens
aagtggcagttcaggaagcaga

SEQ ID NO: 7933516 - DNA, 22 bp, Homo sapiens
aagtggctaacagtccttgcct

SEQ ID NO: 7933517 - DNA, 22 bp, Homo sapiens
aagtggctgctatcaactcctt

SEQ ID NO: 7933518 - DNA, 22 bp, Homo sapiens
aagtggctcatgtggcttctgc

SEQ ID NO: 7933519 - DNA, 22 bp, Homo sapiens
aagtggctcatgtggcttctgc

SEQ ID NO: 7933520 - DNA, 22 bp, Homo sapiens
aagtggctaacagtccttgcct

SEQ ID NO: 7933521 - DNA, 22 bp, Homo sapiens
aagtggccctaggccaagggga

SEQ ID NO: 7933522 - DNA, 22 bp, Homo sapiens
aagtggcatgtataagaaagaa

SEQ ID NO: 7933523 - DNA, 22 bp, Homo sapiens
aagtggcagttcaggaagcaga

SEQ ID NO: 7933524 - DNA, 22 bp, Homo sapiens
aagtttctgaatttgaaaggat

SEQ ID NO: 7933525 - DNA, 22 bp, Homo sapiens
aagtttggtccttctaagaaga

SEQ ID NO: 7933526 - DNA, 22 bp, Homo sapiens
aagtttctcagggttgattggg

SEQ ID NO: 7933527 - DNA, 22 bp, Homo sapiens
aagtttctcaatggcaactggg

SEQ ID NO: 7933528 - DNA, 21 bp, Homo sapiens
aagtttctccctaattgttgc

SEQ ID NO: 7933529 - DNA, 21 bp, Homo sapiens
aagtttctccctaattgttgc

SEQ ID NO: 7933530 - DNA, 22 bp, Homo sapiens
aagtggctttgagcttctgcca

SEQ ID NO: 7933531 - DNA, 22 bp, Homo sapiens
aagtggggcctggtggtacagt

SEQ ID NO: 7933532 - DNA, 22 bp, Homo sapiens
aagtgggtaactggcctttgtt

SEQ ID NO: 7933533 - DNA, 22 bp, Homo sapiens
aagtgggtacatgatgcacttt

SEQ ID NO: 7933534 - DNA, 22 bp, Homo sapiens
aagtttctcaatggcaactggg

SEQ ID NO: 7933535 - DNA, 22 bp, Homo sapiens
actcagtggcactttggaattt

SEQ ID NO: 7933536 - DNA, 22 bp, Homo sapiens
actcagtgggcttgatgtcgaa

SEQ ID NO: 7933537 - DNA, 22 bp, Homo sapiens
actcagtggcactttggaattt

SEQ ID NO: 7933538 - DNA, 22 bp, Homo sapiens
actcatcaactgttacaaatgt

SEQ ID NO: 7933539 - DNA, 22 bp, Homo sapiens
actcatcagcctctaggaaaga

SEQ ID NO: 7933540 - DNA, 22 bp, Homo sapiens
actcatatactgttgtttttaa

SEQ ID NO: 7933541 - DNA, 23 bp, Homo sapiens
actcatccttgatttgcagatgt

SEQ ID NO: 7933542 - DNA, 20 bp, Homo sapiens
actcatctactccagaccct

SEQ ID NO: 7933543 - DNA, 22 bp, Homo sapiens
actcatctattagatatctgtt

SEQ ID NO: 7933544 - DNA, 22 bp, Homo sapiens
actcatctgaaaaatgaggaga

SEQ ID NO: 7933545 - DNA, 22 bp, Homo sapiens
actcatctgactggtgggaatg

SEQ ID NO: 7933546 - DNA, 19 bp, Homo sapiens
actcatctgccacctctgt

SEQ ID NO: 7933547 - DNA, 22 bp, Homo sapiens
aagtgcagtggcgtgatcttgg

SEQ ID NO: 7933548 - DNA, 22 bp, Homo sapiens
actcagagatatggtggttgat

SEQ ID NO: 7933549 - DNA, 22 bp, Homo sapiens
actcagagatatggtggttgat

SEQ ID NO: 7933550 - DNA, 22 bp, Homo sapiens
actcagtacatctggagttggc

SEQ ID NO: 7933551 - DNA, 23 bp, Homo sapiens
actcagtgaagcaaacagatagt

SEQ ID NO: 7933552 - DNA, 22 bp, Homo sapiens
actcagtgaattttcatcaaat

SEQ ID NO: 7933553 - DNA, 22 bp, Homo sapiens
actcagtgaattttcatcaaat

SEQ ID NO: 7933554 - DNA, 23 bp, Homo sapiens
actcagtgagggccttgggctgc

SEQ ID NO: 7933555 - DNA, 23 bp, Homo sapiens
actcagtgagggccttgggctgc

SEQ ID NO: 7933556 - DNA, 22 bp, Homo sapiens
actcagtacatctggagttggc

SEQ ID NO: 7933557 - DNA, 22 bp, Homo sapiens
actcagagcagagcagcctgag

SEQ ID NO: 7933558 - DNA, 22 bp, Homo sapiens
actcagtacatctggagttggc

SEQ ID NO: 7933559 - DNA, 22 bp, Homo sapiens
actcagtatacaccagtatagg

SEQ ID NO: 7933560 - DNA, 22 bp, Homo sapiens
actcagtatgagctccgtgaga

SEQ ID NO: 7933561 - DNA, 22 bp, Homo sapiens
actcatgatatgcctataagat

SEQ ID NO: 7933562 - DNA, 22 bp, Homo sapiens
actcatgtaagcggaatgtagt

SEQ ID NO: 7933563 - DNA, 22 bp, Homo sapiens
actcatgtaagcggaatgtagt

SEQ ID NO: 7933564 - DNA, 22 bp, Homo sapiens
actcatgtcctaggagtaaagc

SEQ ID NO: 7933565 - DNA, 22 bp, Homo sapiens
actcatgtaagcggaatgtagt

SEQ ID NO: 7933566 - DNA, 21 bp, Homo sapiens
actcatctttttggagaccag

SEQ ID NO: 7933567 - DNA, 19 bp, Homo sapiens
actcatctttccagaatat

SEQ ID NO: 7933568 - DNA, 22 bp, Homo sapiens
actcatctttgaattttcagta

SEQ ID NO: 7933569 - DNA, 23 bp, Homo sapiens
actcatcttctggtatccacagt

SEQ ID NO: 7933570 - DNA, 23 bp, Homo sapiens
actcatcttctggtatccacagt

SEQ ID NO: 7933571 - DNA, 22 bp, Homo sapiens
actcatctgccattcctgtacc

SEQ ID NO: 7933572 - DNA, 22 bp, Homo sapiens
actcatcttccctcctggaggg

SEQ ID NO: 7933573 - DNA, 22 bp, Homo sapiens
aagtggaggccgagttcacgca

SEQ ID NO: 7933574 - DNA, 22 bp, Homo sapiens
aagtggaggccgagttcacgca

SEQ ID NO: 7933575 - DNA, 22 bp, Homo sapiens
aagtggagtccctacaaccagc

SEQ ID NO: 7933576 - DNA, 22 bp, Homo sapiens
aagtggaggccgagttcacgca

SEQ ID NO: 7933577 - DNA, 22 bp, Homo sapiens
aagtggagctataggctcagat

SEQ ID NO: 7933578 - DNA, 22 bp, Homo sapiens
actcatgtcctaggagtaaagc

SEQ ID NO: 7933579 - DNA, 22 bp, Homo sapiens
aagtggagctataggctcagat

SEQ ID NO: 7933580 - DNA, 22 bp, Homo sapiens
aagtggagctataggctcagat

SEQ ID NO: 7933581 - DNA, 22 bp, Homo sapiens
aagtggcacgctttttggagtt

SEQ ID NO: 7933582 - DNA, 22 bp, Homo sapiens
aagtggcagaatagtggcagga

SEQ ID NO: 7933583 - DNA, 22 bp, Homo sapiens
aagtggcagaatagtggcagga

SEQ ID NO: 7933584 - DNA, 22 bp, Homo sapiens
aagtggcacgctttttggagtt

SEQ ID NO: 7933585 - DNA, 18 bp, Homo sapiens
aagtggcacaggagtgca

SEQ ID NO: 7933586 - DNA, 18 bp, Homo sapiens
aagtggcacaggagtgca

SEQ ID NO: 7933587 - DNA, 18 bp, Homo sapiens
aagtggcacaggagtgca

SEQ ID NO: 7933588 - DNA, 22 bp, Homo sapiens
aagtggagtccctacaaccagc

SEQ ID NO: 7933589 - DNA, 22 bp, Homo sapiens
aagtggaggccgagttcacgca

SEQ ID NO: 7933590 - DNA, 21 bp, Homo sapiens
aagttttatgttgccatttgt

SEQ ID NO: 7933591 - DNA, 22 bp, Homo sapiens
aagttttatgggaagatgtgca

SEQ ID NO: 7933592 - DNA, 22 bp, Homo sapiens
aagttttattggaacatagcca

SEQ ID NO: 7933593 - DNA, 22 bp, Homo sapiens
aagttttattggctatagcact

SEQ ID NO: 7933594 - DNA, 22 bp, Homo sapiens
aagttttattggctatagcact

SEQ ID NO: 7933595 - DNA, 22 bp, Homo sapiens
aagttttattggctatagcact

SEQ ID NO: 7933596 - DNA, 22 bp, Homo sapiens
aagttttattggaacatagcca

SEQ ID NO: 7933597 - DNA, 22 bp, Homo sapiens
actgacactgactaagacagca

SEQ ID NO: 7933598 - DNA, 22 bp, Homo sapiens
actgacactgactaagacagca

SEQ ID NO: 7933599 - DNA, 22 bp, Homo sapiens
aagttttattggctatagcact

SEQ ID NO: 7933600 - DNA, 20 bp, Homo sapiens
actgacagggaactaaggct

SEQ ID NO: 7933601 - DNA, 22 bp, Homo sapiens
actgacatttttccctaagcat

SEQ ID NO: 7933602 - DNA, 22 bp, Homo sapiens
actgaccagatatgtcatacct

SEQ ID NO: 7933603 - DNA, 22 bp, Homo sapiens
actgaccttctcagctaactca

SEQ ID NO: 7933604 - DNA, 22 bp, Homo sapiens
actgactcttgttaacttcagc

SEQ ID NO: 7933605 - DNA, 22 bp, Homo sapiens
actgactttggaatatttctag

SEQ ID NO: 7933606 - DNA, 22 bp, Homo sapiens
actgagaaatttccagacttgc

SEQ ID NO: 7933607 - DNA, 22 bp, Homo sapiens
actgagaaatttccagacttgc

SEQ ID NO: 7933608 - DNA, 22 bp, Homo sapiens
actgactttggaatatttctag

SEQ ID NO: 7933609 - DNA, 22 bp, Homo sapiens
actgactttggaatatttctag

SEQ ID NO: 7933610 - DNA, 22 bp, Homo sapiens
actgagaaagaccacatggaga

SEQ ID NO: 7933611 - DNA, 22 bp, Homo sapiens
actgagaaatagcaagtgtctc

SEQ ID NO: 7933612 - DNA, 22 bp, Homo sapiens
actgagaagctcgcagtgatgc

SEQ ID NO: 7933613 - DNA, 22 bp, Homo sapiens
actgagaagctcgcagtgatgc

SEQ ID NO: 7933614 - DNA, 22 bp, Homo sapiens
actgagaagctcgcagtgatgc

SEQ ID NO: 7933615 - DNA, 22 bp, Homo sapiens
actgagaagtcaggttctcttc

SEQ ID NO: 7933616 - DNA, 22 bp, Homo sapiens
actgagaatacaatgttgcagg

SEQ ID NO: 7933617 - DNA, 22 bp, Homo sapiens
actgagaagctcgcagtgatgc

SEQ ID NO: 7933618 - DNA, 22 bp, Homo sapiens
actgagaagctcgcagtgatgc

SEQ ID NO: 7933619 - DNA, 22 bp, Homo sapiens
actgagaagctcgcagtgatgc

SEQ ID NO: 7933620 - DNA, 22 bp, Homo sapiens
actgagaagattctcactctta

SEQ ID NO: 7933621 - DNA, 22 bp, Homo sapiens
actgagaagattctcactctta

SEQ ID NO: 7933622 - DNA, 22 bp, Homo sapiens
actgagaactcaagagaaaagg

SEQ ID NO: 7933623 - DNA, 22 bp, Homo sapiens
actgagaacttgccaaggactg

SEQ ID NO: 7933624 - DNA, 22 bp, Homo sapiens
actgagaagattctcactctta

SEQ ID NO: 7933625 - DNA, 22 bp, Homo sapiens
actgagaacttggggacagagg

SEQ ID NO: 7933626 - DNA, 22 bp, Homo sapiens
aataaaatggtcagttttctca

SEQ ID NO: 7933627 - DNA, 22 bp, Homo sapiens
aataaaatggtcagttttctca

SEQ ID NO: 7933628 - DNA, 22 bp, Homo sapiens
aataaaatggtcagttttctca

SEQ ID NO: 7933629 - DNA, 22 bp, Homo sapiens
aataaaatggtcagttttctca

SEQ ID NO: 7933630 - DNA, 22 bp, Homo sapiens
aataaaatggtcagttttctca

SEQ ID NO: 7933631 - DNA, 22 bp, Homo sapiens
aataaaatggtcagttttctca

SEQ ID NO: 7933632 - DNA, 22 bp, Homo sapiens
aataaaatggtcagttttctca

SEQ ID NO: 7933633 - DNA, 22 bp, Homo sapiens
aataaaatggtcagttttctca

SEQ ID NO: 7933634 - DNA, 22 bp, Homo sapiens
aataaacttccactgtgttttt

SEQ ID NO: 7933635 - DNA, 22 bp, Homo sapiens
aataaatgtttgttggatgttt

SEQ ID NO: 7933636 - DNA, 22 bp, Homo sapiens
aataaatgttaagattgtctca

SEQ ID NO: 7933637 - DNA, 22 bp, Homo sapiens
aataaatgttaagattgtctca

SEQ ID NO: 7933638 - DNA, 22 bp, Homo sapiens
aataaatgttaagattgtctca

SEQ ID NO: 7933639 - DNA, 22 bp, Homo sapiens
aataaatgttaagattgtctca

SEQ ID NO: 7933640 - DNA, 22 bp, Homo sapiens
aataaatcaatcctattggtag

SEQ ID NO: 7933641 - DNA, 22 bp, Homo sapiens
aataaatcaatcctattggtag

SEQ ID NO: 7933642 - DNA, 22 bp, Homo sapiens
aataaatcaatcctattggtag

SEQ ID NO: 7933643 - DNA, 22 bp, Homo sapiens
aataaatcaatcctattggtag

SEQ ID NO: 7933644 - DNA, 22 bp, Homo sapiens
aataaatgaacaaagcaggttg

SEQ ID NO: 7933645 - DNA, 22 bp, Homo sapiens
aataaatgaacaaagcaggttg

SEQ ID NO: 7933646 - DNA, 22 bp, Homo sapiens
aataaatgaacaaagcaggttg

SEQ ID NO: 7933647 - DNA, 22 bp, Homo sapiens
aataacagagtcttcaagatag

SEQ ID NO: 7933648 - DNA, 22 bp, Homo sapiens
aataacagagtcttcaagatag

SEQ ID NO: 7933649 - DNA, 22 bp, Homo sapiens
aataacagaaacttgagcatca

SEQ ID NO: 7933650 - DNA, 22 bp, Homo sapiens
aataacagagtcttcaagatag

SEQ ID NO: 7933651 - DNA, 22 bp, Homo sapiens
aataacagagtcttcaagatag

SEQ ID NO: 7933652 - DNA, 22 bp, Homo sapiens
aataacagaaacttgagcatca

SEQ ID NO: 7933653 - DNA, 22 bp, Homo sapiens
aataacagaaacttgagcatca

SEQ ID NO: 7933654 - DNA, 22 bp, Homo sapiens
aataaatgtttgttggatgttt

SEQ ID NO: 7933655 - DNA, 22 bp, Homo sapiens
aataaatgtttgttggatgttt

SEQ ID NO: 7933656 - DNA, 22 bp, Homo sapiens
aataaatgtttgttggatgttt

SEQ ID NO: 7933657 - DNA, 22 bp, Homo sapiens
aataaagcagggtccttgcact

SEQ ID NO: 7933658 - DNA, 22 bp, Homo sapiens
aataaagcatgaggcatttatc

SEQ ID NO: 7933659 - DNA, 22 bp, Homo sapiens
aataaagcctgtctctttagag

SEQ ID NO: 7933660 - DNA, 22 bp, Homo sapiens
aataaagcatgaggcatttatc

SEQ ID NO: 7933661 - DNA, 22 bp, Homo sapiens
aataaagaatggatgagatcgt

SEQ ID NO: 7933662 - DNA, 22 bp, Homo sapiens
aataaagacaaacaggggagcc

SEQ ID NO: 7933663 - DNA, 22 bp, Homo sapiens
aataaagacaaacaggggagcc

SEQ ID NO: 7933664 - DNA, 22 bp, Homo sapiens
aataaagactcagaggcccagg

SEQ ID NO: 7933665 - DNA, 22 bp, Homo sapiens
aataaagtagcgtttaaggtgc

SEQ ID NO: 7933666 - DNA, 22 bp, Homo sapiens
aataaagtgtattctttgtcat

SEQ ID NO: 7933667 - DNA, 22 bp, Homo sapiens
aataaagtgtattctttgtcat

SEQ ID NO: 7933668 - DNA, 22 bp, Homo sapiens
aataaagtgtattctttgtcat

SEQ ID NO: 7933669 - DNA, 22 bp, Homo sapiens
aataaatcaatcctattggtag

SEQ ID NO: 7933670 - DNA, 22 bp, Homo sapiens
aataaaggcaccataaggcaaa

SEQ ID NO: 7933671 - DNA, 22 bp, Homo sapiens
aataaagccttattgattttac

SEQ ID NO: 7933672 - DNA, 22 bp, Homo sapiens
aataaagccttattgattttac

SEQ ID NO: 7933673 - DNA, 22 bp, Homo sapiens
aataaagcctgtctctttagag

SEQ ID NO: 7933674 - DNA, 22 bp, Homo sapiens
aataaaggcaccataaggcaaa

SEQ ID NO: 7933675 - DNA, 22 bp, Homo sapiens
aataaaggcaccataaggcaaa

SEQ ID NO: 7933676 - DNA, 22 bp, Homo sapiens
aataaagtagcgtttaaggtgc

SEQ ID NO: 7933677 - DNA, 22 bp, Homo sapiens
aataaagtagcgtttaaggtgc

SEQ ID NO: 7933678 - DNA, 22 bp, Homo sapiens
aatacttgtcagatgaataaga

SEQ ID NO: 7933679 - DNA, 22 bp, Homo sapiens
aatacttgtcagatgaataaga

SEQ ID NO: 7933680 - DNA, 22 bp, Homo sapiens
aatacttgggctgagatttttg

SEQ ID NO: 7933681 - DNA, 22 bp, Homo sapiens
aatactttcctatataaggtgc

SEQ ID NO: 7933682 - DNA, 22 bp, Homo sapiens
aatacttgtgaattcaaagtct

SEQ ID NO: 7933683 - DNA, 22 bp, Homo sapiens
aatacttgaatttcatgtcagg

SEQ ID NO: 7933684 - DNA, 17 bp, Homo sapiens
aatacttccaactagtg

SEQ ID NO: 7933685 - DNA, 22 bp, Homo sapiens
aatacttatgtgacctcatttt

SEQ ID NO: 7933686 - DNA, 22 bp, Homo sapiens
aatactttcctatataaggtgc

SEQ ID NO: 7933687 - DNA, 22 bp, Homo sapiens
aatactttcctatataaggtgc

SEQ ID NO: 7933688 - DNA, 22 bp, Homo sapiens
aatactttcctatataaggtgc

SEQ ID NO: 7933689 - DNA, 22 bp, Homo sapiens
aatactttcctatataaggtgc

SEQ ID NO: 7933690 - DNA, 22 bp, Homo sapiens
aatactttgccaagttcgaaga

SEQ ID NO: 7933691 - DNA, 22 bp, Homo sapiens
aatactttgccaagttcgaaga

SEQ ID NO: 7933692 - DNA, 22 bp, Homo sapiens
aatactttcctatataaggtgc

SEQ ID NO: 7933693 - DNA, 22 bp, Homo sapiens
aatactttgccaagttcgaaga

SEQ ID NO: 7933694 - DNA, 22 bp, Homo sapiens
aatactttgccaagttcgaaga

SEQ ID NO: 7933695 - DNA, 22 bp, Homo sapiens
aatactttgccaagttcgaaga

SEQ ID NO: 7933696 - DNA, 22 bp, Homo sapiens
aatagaaaggaggggctcttgt

SEQ ID NO: 7933697 - DNA, 22 bp, Homo sapiens
aatagaaaggaggggctcttgt

SEQ ID NO: 7933698 - DNA, 22 bp, Homo sapiens
aatagaaaggaggggctcttgt

SEQ ID NO: 7933699 - DNA, 22 bp, Homo sapiens
aatactttgccaagttcgaaga

SEQ ID NO: 7933700 - DNA, 22 bp, Homo sapiens
aatacttttgaactgaaaggca

SEQ ID NO: 7933701 - DNA, 22 bp, Homo sapiens
actgtggggggctttgctcagt

SEQ ID NO: 7933702 - DNA, 22 bp, Homo sapiens
actgtggggtgaggcccaagaa

SEQ ID NO: 7933703 - DNA, 22 bp, Homo sapiens
actgtgggggagccagtcccat

SEQ ID NO: 7933704 - DNA, 22 bp, Homo sapiens
actgtgggcctttcctttgacc

SEQ ID NO: 7933705 - DNA, 22 bp, Homo sapiens
actgtgggccattgggttctgt

SEQ ID NO: 7933706 - DNA, 22 bp, Homo sapiens
actgtgggagcgcagtggcagc

SEQ ID NO: 7933707 - DNA, 22 bp, Homo sapiens
actgtgggagcgcagtggcagc

SEQ ID NO: 7933708 - DNA, 23 bp, Homo sapiens
actgtgggcaccacagagagtgt

SEQ ID NO: 7933709 - DNA, 22 bp, Homo sapiens
actgtgggagcttatcatttca

SEQ ID NO: 7933710 - DNA, 22 bp, Homo sapiens
actgtgggcagcttctgggaac

SEQ ID NO: 7933711 - DNA, 23 bp, Homo sapiens
actgtgggcaccacagagagtgt

SEQ ID NO: 7933712 - DNA, 22 bp, Homo sapiens
aatactgtctttcacagatatt

SEQ ID NO: 7933713 - DNA, 22 bp, Homo sapiens
aatactgtctttcacagatatt

SEQ ID NO: 7933714 - DNA, 22 bp, Homo sapiens
aatactgtctttcacagatatt

SEQ ID NO: 7933715 - DNA, 22 bp, Homo sapiens
aatactgctgcctgcaaattat

SEQ ID NO: 7933716 - DNA, 22 bp, Homo sapiens
aatactgtctttcacagatatt

SEQ ID NO: 7933717 - DNA, 22 bp, Homo sapiens
aatactggctgtcaaagatgga

SEQ ID NO: 7933718 - DNA, 22 bp, Homo sapiens
aatactggactctcactattta

SEQ ID NO: 7933719 - DNA, 22 bp, Homo sapiens
aatactgctgctgctgaaatca

SEQ ID NO: 7933720 - DNA, 21 bp, Homo sapiens
actgtggggttcaactggcag

SEQ ID NO: 7933721 - DNA, 22 bp, Homo sapiens
actgtggggtgcgaggcagtga

SEQ ID NO: 7933722 - DNA, 22 bp, Homo sapiens
aataactggcacatatcacata

SEQ ID NO: 7933723 - DNA, 22 bp, Homo sapiens
aataactggcacatatcacata

SEQ ID NO: 7933724 - DNA, 22 bp, Homo sapiens
aataactggcacatatcacata

SEQ ID NO: 7933725 - DNA, 22 bp, Homo sapiens
actgtctgcaaaactcatactc

SEQ ID NO: 7933726 - DNA, 22 bp, Homo sapiens
actgtgctgctctccgcagccc

SEQ ID NO: 7933727 - DNA, 22 bp, Homo sapiens
actgtgctatctactgaattat

SEQ ID NO: 7933728 - DNA, 18 bp, Homo sapiens
actgtctgccagattggg

SEQ ID NO: 7933729 - DNA, 22 bp, Homo sapiens
actgtctgccctgagatgccag

SEQ ID NO: 7933730 - DNA, 22 bp, Homo sapiens
actgtctgcacccgaggaggcc

SEQ ID NO: 7933731 - DNA, 22 bp, Homo sapiens
aataacagtgccatgaaattga

SEQ ID NO: 7933732 - DNA, 22 bp, Homo sapiens
aataacctttatttcaaagtgt

SEQ ID NO: 7933733 - DNA, 22 bp, Homo sapiens
aataaccttacttattacatgg

SEQ ID NO: 7933734 - DNA, 22 bp, Homo sapiens
aataactgcacttgttgaatgc

SEQ ID NO: 7933735 - DNA, 22 bp, Homo sapiens
aataacctttatttcaaagtgt

SEQ ID NO: 7933736 - DNA, 22 bp, Homo sapiens
aataacagggttgatttgcaat

SEQ ID NO: 7933737 - DNA, 22 bp, Homo sapiens
aataacagggttgatttgcaat

SEQ ID NO: 7933738 - DNA, 22 bp, Homo sapiens
aataacagggttgatttgcaat

SEQ ID NO: 7933739 - DNA, 22 bp, Homo sapiens
aataacaggctcatcagatgct

SEQ ID NO: 7933740 - DNA, 22 bp, Homo sapiens
aataacaggctcatcagatgct

SEQ ID NO: 7933741 - DNA, 22 bp, Homo sapiens
aataacaggctcatcagatgct

SEQ ID NO: 7933742 - DNA, 22 bp, Homo sapiens
actgtgggacatccctccctat

SEQ ID NO: 7933743 - DNA, 22 bp, Homo sapiens
actgtgggaaccactgaatcag

SEQ ID NO: 7933744 - DNA, 22 bp, Homo sapiens
actgtggccaaagcctctggga

SEQ ID NO: 7933745 - DNA, 22 bp, Homo sapiens
actgtggataagtcagagatgt

SEQ ID NO: 7933746 - DNA, 22 bp, Homo sapiens
actgtggagcagtggctaggga

SEQ ID NO: 7933747 - DNA, 22 bp, Homo sapiens
actgtgctggcaatgactcagg

SEQ ID NO: 7933748 - DNA, 22 bp, Homo sapiens
actgtgcttgccaaaccattga

SEQ ID NO: 7933749 - DNA, 22 bp, Homo sapiens
actgtggatcaaagacttgggg

SEQ ID NO: 7933750 - DNA, 22 bp, Homo sapiens
actgtggataagtcagagatgt

SEQ ID NO: 7933751 - DNA, 22 bp, Homo sapiens
actgtggataagtcagagatgt

SEQ ID NO: 7933752 - DNA, 22 bp, Homo sapiens
actgtggatgccaaaggggagg

SEQ ID NO: 7933753 - DNA, 22 bp, Homo sapiens
actgtggcaaagaagcaggctc

SEQ ID NO: 7933754 - DNA, 22 bp, Homo sapiens
actgtggccaaagcctctggga

SEQ ID NO: 7933755 - DNA, 22 bp, Homo sapiens
aatatcttctaaggatagaact

SEQ ID NO: 7933756 - DNA, 22 bp, Homo sapiens
aatatcttctaaggatagaact

SEQ ID NO: 7933757 - DNA, 22 bp, Homo sapiens
aatatcttctaaggatagaact

SEQ ID NO: 7933758 - DNA, 22 bp, Homo sapiens
aatatcagctctgtcacttact

SEQ ID NO: 7933759 - DNA, 22 bp, Homo sapiens
aatatcagctctgtcacttact

SEQ ID NO: 7933760 - DNA, 19 bp, Homo sapiens
acttcctgcccgctccttt

SEQ ID NO: 7933761 - DNA, 22 bp, Homo sapiens
aatatcagcacttttgtggtat

SEQ ID NO: 7933762 - DNA, 22 bp, Homo sapiens
aatatcttctaaggatagaact

SEQ ID NO: 7933763 - DNA, 22 bp, Homo sapiens
aatatcttctaaggatagaact

SEQ ID NO: 7933764 - DNA, 22 bp, Homo sapiens
aatatcttctaaggatagaact

SEQ ID NO: 7933765 - DNA, 22 bp, Homo sapiens
aatatcttctaaggatagaact

SEQ ID NO: 7933766 - DNA, 22 bp, Homo sapiens
aatatcttggcccaactccaga

SEQ ID NO: 7933767 - DNA, 22 bp, Homo sapiens
aatatcttggcccaactccaga

SEQ ID NO: 7933768 - DNA, 22 bp, Homo sapiens
aatatcttggcccaactccaga

SEQ ID NO: 7933769 - DNA, 22 bp, Homo sapiens
aatatgaattattgttacaagt

SEQ ID NO: 7933770 - DNA, 22 bp, Homo sapiens
aatatgaattattgttacaagt

SEQ ID NO: 7933771 - DNA, 22 bp, Homo sapiens
aatatgaattattgttacaagt

SEQ ID NO: 7933772 - DNA, 22 bp, Homo sapiens
aatatgaattattgttacaagt

SEQ ID NO: 7933773 - DNA, 22 bp, Homo sapiens
aatatgagtttgcctttcctgc

SEQ ID NO: 7933774 - DNA, 22 bp, Homo sapiens
acttcccatttctctgctttag

SEQ ID NO: 7933775 - DNA, 22 bp, Homo sapiens
acttcccatttctctgctttag

SEQ ID NO: 7933776 - DNA, 22 bp, Homo sapiens
acttcccatttctctgctttag

SEQ ID NO: 7933777 - DNA, 22 bp, Homo sapiens
acttcccaggtggtgtggagtt

SEQ ID NO: 7933778 - DNA, 22 bp, Homo sapiens
acttcccaggtggtgtggagtt

SEQ ID NO: 7933779 - DNA, 21 bp, Homo sapiens
acttcccaggacctactcaga

SEQ ID NO: 7933780 - DNA, 21 bp, Homo sapiens
acttcccaggacctactcaga

SEQ ID NO: 7933781 - DNA, 18 bp, Homo sapiens
acttcccagatgagggga

SEQ ID NO: 7933782 - DNA, 21 bp, Homo sapiens
acttcccaggacctactcaga

SEQ ID NO: 7933783 - DNA, 22 bp, Homo sapiens
acttcctgaatggggctaatta

SEQ ID NO: 7933784 - DNA, 22 bp, Homo sapiens
acttccctgtgggcaggtagtg

SEQ ID NO: 7933785 - DNA, 22 bp, Homo sapiens
acttcctgaatggggctaatta

SEQ ID NO: 7933786 - DNA, 22 bp, Homo sapiens
acttcccactgcagtgactgag

SEQ ID NO: 7933787 - DNA, 22 bp, Homo sapiens
acttcccactgcagtgactgag

SEQ ID NO: 7933788 - DNA, 17 bp, Homo sapiens
acttcccacccctccag

SEQ ID NO: 7933789 - DNA, 22 bp, Homo sapiens
acttcccacaccctgttttctc

SEQ ID NO: 7933790 - DNA, 22 bp, Homo sapiens
acttcccacaccctgttttctc

SEQ ID NO: 7933791 - DNA, 22 bp, Homo sapiens
acttcccacaccctgttttctc

SEQ ID NO: 7933792 - DNA, 22 bp, Homo sapiens
acttcccaacgtgggcctccca

SEQ ID NO: 7933793 - DNA, 22 bp, Homo sapiens
acttcccaacgtgggcctccca

SEQ ID NO: 7933794 - DNA, 23 bp, Homo sapiens
acttccagttataggaactcttc

SEQ ID NO: 7933795 - DNA, 22 bp, Homo sapiens
acttccagtgtctgctgctagc

SEQ ID NO: 7933796 - DNA, 22 bp, Homo sapiens
acttcccaacacttttgagatg

SEQ ID NO: 7933797 - DNA, 22 bp, Homo sapiens
acttcccaacgtgggcctccca

SEQ ID NO: 7933798 - DNA, 22 bp, Homo sapiens
acttccagttttaattaaattg

SEQ ID NO: 7933799 - DNA, 22 bp, Homo sapiens
acttccagttttaattaaattg

SEQ ID NO: 7933800 - DNA, 23 bp, Homo sapiens
acttccagttgcttcagcatatg

SEQ ID NO: 7933801 - DNA, 23 bp, Homo sapiens
acttccagttgcttcagcatatg

SEQ ID NO: 7933802 - DNA, 23 bp, Homo sapiens
acttccagttataggaactcttc

SEQ ID NO: 7933803 - DNA, 23 bp, Homo sapiens
acttccagttataggaactcttc

SEQ ID NO: 7933804 - DNA, 23 bp, Homo sapiens
acttccagttgcttcagcatatg

SEQ ID NO: 7933805 - DNA, 23 bp, Homo sapiens
acttccagttataggaactcttc

SEQ ID NO: 7933806 - DNA, 20 bp, Homo sapiens
acttattctgaggacagtac

SEQ ID NO: 7933807 - DNA, 22 bp, Homo sapiens
acttattctgagattatgatca

SEQ ID NO: 7933808 - DNA, 18 bp, Homo sapiens
acttattcactaggtgga

SEQ ID NO: 7933809 - DNA, 22 bp, Homo sapiens
acttattctgagattatgatca

SEQ ID NO: 7933810 - DNA, 22 bp, Homo sapiens
acttatgaggagaaaatatata

SEQ ID NO: 7933811 - DNA, 22 bp, Homo sapiens
acttatgaggagaaaatatata

SEQ ID NO: 7933812 - DNA, 22 bp, Homo sapiens
acttatcttagttcatttgtat

SEQ ID NO: 7933813 - DNA, 22 bp, Homo sapiens
acttatatttgctttatgcttc

SEQ ID NO: 7933814 - DNA, 22 bp, Homo sapiens
acttatatttgctttatgcttc

SEQ ID NO: 7933815 - DNA, 22 bp, Homo sapiens
acttatgaatgtcattataatg

SEQ ID NO: 7933816 - DNA, 22 bp, Homo sapiens
acttatccatgtctatatgttg

SEQ ID NO: 7933817 - DNA, 22 bp, Homo sapiens
acttatctgcaattagtacata

SEQ ID NO: 7933818 - DNA, 22 bp, Homo sapiens
acttccaggaggtgtcactgaa

SEQ ID NO: 7933819 - DNA, 22 bp, Homo sapiens
acttccagctttataattcagt

SEQ ID NO: 7933820 - DNA, 22 bp, Homo sapiens
acttccaggaactgccgctaac

SEQ ID NO: 7933821 - DNA, 22 bp, Homo sapiens
acttccaggaactgccgctaac

SEQ ID NO: 7933822 - DNA, 22 bp, Homo sapiens
acttccaggaggtgtcactgaa

SEQ ID NO: 7933823 - DNA, 22 bp, Homo sapiens
acttccagggtagaggggaaga

SEQ ID NO: 7933824 - DNA, 22 bp, Homo sapiens
acttccaggttccacccaagac

SEQ ID NO: 7933825 - DNA, 22 bp, Homo sapiens
acttccagggtagaggggaaga

SEQ ID NO: 7933826 - DNA, 22 bp, Homo sapiens
acttccaggttccacccaagac

SEQ ID NO: 7933827 - DNA, 22 bp, Homo sapiens
acttccaggttccacccaagac

SEQ ID NO: 7933828 - DNA, 22 bp, Homo sapiens
acttccagtgtctgctgctagc

SEQ ID NO: 7933829 - DNA, 16 bp, Homo sapiens
acttccaggggagccc

SEQ ID NO: 7933830 - DNA, 22 bp, Homo sapiens
acttccagggtagaggggaaga

SEQ ID NO: 7933831 - DNA, 22 bp, Homo sapiens
acttccagggtagaggggaaga

SEQ ID NO: 7933832 - DNA, 16 bp, Homo sapiens
acttccaggggagccc

SEQ ID NO: 7933833 - DNA, 16 bp, Homo sapiens
acttccaggggagccc

SEQ ID NO: 7933834 - DNA, 22 bp, Homo sapiens
acttccagctgccctgtgtgct

SEQ ID NO: 7933835 - DNA, 22 bp, Homo sapiens
acttccagctttataattcagt

SEQ ID NO: 7933836 - DNA, 22 bp, Homo sapiens
acttccagctgccctgtgtgct

SEQ ID NO: 7933837 - DNA, 22 bp, Homo sapiens
acttccagctgccctgtgtgct

SEQ ID NO: 7933838 - DNA, 22 bp, Homo sapiens
acttatttcatggatcataatg

SEQ ID NO: 7933839 - DNA, 22 bp, Homo sapiens
acttagtgccctggcccttaca

SEQ ID NO: 7933840 - DNA, 22 bp, Homo sapiens
acttagcagtttagaatatgtc

SEQ ID NO: 7933841 - DNA, 22 bp, Homo sapiens
acttatactaaagtattatttg

SEQ ID NO: 7933842 - DNA, 22 bp, Homo sapiens
acttataagagtgctatgggga

SEQ ID NO: 7933843 - DNA, 22 bp, Homo sapiens
acttataagagtgctatgggga

SEQ ID NO: 7933844 - DNA, 22 bp, Homo sapiens
acttagcaatttgattaaaaga

SEQ ID NO: 7933845 - DNA, 22 bp, Homo sapiens
acttagaattagtgtagaatga

SEQ ID NO: 7933846 - DNA, 22 bp, Homo sapiens
acttagaattagtgtagaatga

SEQ ID NO: 7933847 - DNA, 22 bp, Homo sapiens
acttagaattagtgtagaatga

SEQ ID NO: 7933848 - DNA, 22 bp, Homo sapiens
acttagcagagttgaatgtact

SEQ ID NO: 7933849 - DNA, 22 bp, Homo sapiens
acttagcacgaacatttacttt

SEQ ID NO: 7933850 - DNA, 20 bp, Homo sapiens
actgttggaagtggagaatg

SEQ ID NO: 7933851 - DNA, 22 bp, Homo sapiens
actgttggcttctggtagtgac

SEQ ID NO: 7933852 - DNA, 22 bp, Homo sapiens
aatagaaaggaggggctcttgt

SEQ ID NO: 7933853 - DNA, 22 bp, Homo sapiens
aatagaaaggaggggctcttgt

SEQ ID NO: 7933854 - DNA, 22 bp, Homo sapiens
actgttgaagtgccagcttgat

SEQ ID NO: 7933855 - DNA, 22 bp, Homo sapiens
aatagaacaataattgtaaact

SEQ ID NO: 7933856 - DNA, 22 bp, Homo sapiens
aatagaacaataattgtaaact

SEQ ID NO: 7933857 - DNA, 22 bp, Homo sapiens
aatcttcacagagaaaattagg

SEQ ID NO: 7933858 - DNA, 22 bp, Homo sapiens
aatcttcacagagaaaattagg

SEQ ID NO: 7933859 - DNA, 22 bp, Homo sapiens
aatcttcaacagaatggtagga

SEQ ID NO: 7933860 - DNA, 22 bp, Homo sapiens
aatcttaagctgaattctctcc

SEQ ID NO: 7933861 - DNA, 22 bp, Homo sapiens
aatcttaagctgaattctctcc

SEQ ID NO: 7933862 - DNA, 22 bp, Homo sapiens
aatcttacaccgaatttaaact

SEQ ID NO: 7933863 - DNA, 22 bp, Homo sapiens
aatcttaggtttggcttcatct

SEQ ID NO: 7933864 - DNA, 22 bp, Homo sapiens
aatcttacaccgaatttaaact

SEQ ID NO: 7933865 - DNA, 22 bp, Homo sapiens
aatcttcactcattcagagttg

SEQ ID NO: 7933866 - DNA, 22 bp, Homo sapiens
aatcttcactcattcagagttg

SEQ ID NO: 7933867 - DNA, 22 bp, Homo sapiens
aatcttcactcattcagagttg

SEQ ID NO: 7933868 - DNA, 22 bp, Homo sapiens
aatcttcactcttaactgtgca

SEQ ID NO: 7933869 - DNA, 22 bp, Homo sapiens
aatcttcatgtcctctctaatt

SEQ ID NO: 7933870 - DNA, 22 bp, Homo sapiens
aatcttcataaaaatctagtag

SEQ ID NO: 7933871 - DNA, 22 bp, Homo sapiens
aatcttcagtgtctaaaaagca

SEQ ID NO: 7933872 - DNA, 22 bp, Homo sapiens
aatcttcagtgtctaaaaagca

SEQ ID NO: 7933873 - DNA, 22 bp, Homo sapiens
aatcttcagtgtctaaaaagca

SEQ ID NO: 7933874 - DNA, 22 bp, Homo sapiens
aatcttcagcactccagagact

SEQ ID NO: 7933875 - DNA, 22 bp, Homo sapiens
aatcttcagcactccagagact

SEQ ID NO: 7933876 - DNA, 22 bp, Homo sapiens
aatctttccctattaaatgtgg

SEQ ID NO: 7933877 - DNA, 22 bp, Homo sapiens
aatctttcgtttctcctgtctg

SEQ ID NO: 7933878 - DNA, 22 bp, Homo sapiens
aatcttggttgcagtatatccg

SEQ ID NO: 7933879 - DNA, 22 bp, Homo sapiens
aatctttaaggactcagtctct

SEQ ID NO: 7933880 - DNA, 22 bp, Homo sapiens
aatctttaaggactcagtctct

SEQ ID NO: 7933881 - DNA, 22 bp, Homo sapiens
aatcttggcaaatgtagcttcc

SEQ ID NO: 7933882 - DNA, 22 bp, Homo sapiens
aatcttgagggactcatgaggt

SEQ ID NO: 7933883 - DNA, 22 bp, Homo sapiens
aatcttcattttgacaagattc

SEQ ID NO: 7933884 - DNA, 22 bp, Homo sapiens
aatcttcattttgacaagattc

SEQ ID NO: 7933885 - DNA, 22 bp, Homo sapiens
aatcttcattttgacaagattc

SEQ ID NO: 7933886 - DNA, 22 bp, Homo sapiens
aatcttcattttgacaagattc

SEQ ID NO: 7933887 - DNA, 22 bp, Homo sapiens
aatcttctttcttaacagtaca

SEQ ID NO: 7933888 - DNA, 22 bp, Homo sapiens
aatcttctacttgacagttctc

SEQ ID NO: 7933889 - DNA, 22 bp, Homo sapiens
aatctatatgcttttcacatac

SEQ ID NO: 7933890 - DNA, 22 bp, Homo sapiens
agaaactgaacacaagagtcgg

SEQ ID NO: 7933891 - DNA, 22 bp, Homo sapiens
aatctatatgcttttcacatac

SEQ ID NO: 7933892 - DNA, 22 bp, Homo sapiens
aatctatatgcttttcacatac

SEQ ID NO: 7933893 - DNA, 22 bp, Homo sapiens
aatctatatgcttttcacatac

SEQ ID NO: 7933894 - DNA, 22 bp, Homo sapiens
aatctattccctttctgtaaaa

SEQ ID NO: 7933895 - DNA, 22 bp, Homo sapiens
aatctattccctttctgtaaaa

SEQ ID NO: 7933896 - DNA, 22 bp, Homo sapiens
agaaactcacctttccagccat

SEQ ID NO: 7933897 - DNA, 22 bp, Homo sapiens
agaaactcatcctggagatgac

SEQ ID NO: 7933898 - DNA, 22 bp, Homo sapiens
agaaactctaggtcaattgagg

SEQ ID NO: 7933899 - DNA, 22 bp, Homo sapiens
agaaactctggaagaactttta

SEQ ID NO: 7933900 - DNA, 22 bp, Homo sapiens
agaaactctggaagaactttta

SEQ ID NO: 7933901 - DNA, 22 bp, Homo sapiens
agaaactattatggtaaacaaa

SEQ ID NO: 7933902 - DNA, 22 bp, Homo sapiens
agaaactattatggtaaacaaa

SEQ ID NO: 7933903 - DNA, 22 bp, Homo sapiens
agaaactaacctggtagggttc

SEQ ID NO: 7933904 - DNA, 22 bp, Homo sapiens
agaaactaaagccaagggctct

SEQ ID NO: 7933905 - DNA, 22 bp, Homo sapiens
agaaacgcctgtgaaattatct

SEQ ID NO: 7933906 - DNA, 22 bp, Homo sapiens
agaaacgcctgtgaaattatct

SEQ ID NO: 7933907 - DNA, 22 bp, Homo sapiens
agaaacctcacagcaattctga

SEQ ID NO: 7933908 - DNA, 22 bp, Homo sapiens
agaaacctgggggttgtacata

SEQ ID NO: 7933909 - DNA, 22 bp, Homo sapiens
agaaacgcctgtgaaattatct

SEQ ID NO: 7933910 - DNA, 22 bp, Homo sapiens
agaaacgcctgtgaaattatct

SEQ ID NO: 7933911 - DNA, 22 bp, Homo sapiens
agaaacgcctgtgaaattatct

SEQ ID NO: 7933912 - DNA, 22 bp, Homo sapiens
agaaacctgtgtgctgtgatga

SEQ ID NO: 7933913 - DNA, 22 bp, Homo sapiens
agaaactacttggaggaaagat

SEQ ID NO: 7933914 - DNA, 22 bp, Homo sapiens
agaaactaagtcataactcttt

SEQ ID NO: 7933915 - DNA, 22 bp, Homo sapiens
agaaactaagtcataactcttt

SEQ ID NO: 7933916 - DNA, 22 bp, Homo sapiens
agaaactaagtcataactcttt

SEQ ID NO: 7933917 - DNA, 22 bp, Homo sapiens
agaaactacttggaggaaagat

SEQ ID NO: 7933918 - DNA, 22 bp, Homo sapiens
agaaactatcctgagtagcaaa

SEQ ID NO: 7933919 - DNA, 22 bp, Homo sapiens
agaaactatcctgagtagcaaa

SEQ ID NO: 7933920 - DNA, 22 bp, Homo sapiens
agaaactatcctgagtagcaaa

SEQ ID NO: 7933921 - DNA, 22 bp, Homo sapiens
aatctgtcgtagtaaaaagcag

SEQ ID NO: 7933922 - DNA, 22 bp, Homo sapiens
aatctcaaagatggccagaaga

SEQ ID NO: 7933923 - DNA, 22 bp, Homo sapiens
aatctgtattgttaacaagtaa

SEQ ID NO: 7933924 - DNA, 22 bp, Homo sapiens
aatctgttctactctattcaga

SEQ ID NO: 7933925 - DNA, 22 bp, Homo sapiens
aatctgttaggatgaggatacg

SEQ ID NO: 7933926 - DNA, 22 bp, Homo sapiens
aatctgttcccagagcttgtct

SEQ ID NO: 7933927 - DNA, 22 bp, Homo sapiens
aatctgttaagaacagaaatgt

SEQ ID NO: 7933928 - DNA, 17 bp, Homo sapiens
aatctgtttacagtcag

SEQ ID NO: 7933929 - DNA, 17 bp, Homo sapiens
aatctgtttacagtcag

SEQ ID NO: 7933930 - DNA, 17 bp, Homo sapiens
aatctgtttacagtcag

SEQ ID NO: 7933931 - DNA, 22 bp, Homo sapiens
aatctgtttaacagatttctgt

SEQ ID NO: 7933932 - DNA, 22 bp, Homo sapiens
aatctgtttaacagatttctgt

SEQ ID NO: 7933933 - DNA, 22 bp, Homo sapiens
aatctgtttaacagatttctgt

SEQ ID NO: 7933934 - DNA, 22 bp, Homo sapiens
aatctgtttaacagatttctgt

SEQ ID NO: 7933935 - DNA, 22 bp, Homo sapiens
aatctgtttttgaaactttgta

SEQ ID NO: 7933936 - DNA, 22 bp, Homo sapiens
aatctgttttatcatttgttac

SEQ ID NO: 7933937 - DNA, 22 bp, Homo sapiens
aatctgttttatcatttgttac

SEQ ID NO: 7933938 - DNA, 22 bp, Homo sapiens
aatctgtttttgaaactttgta

SEQ ID NO: 7933939 - DNA, 22 bp, Homo sapiens
aatcttaaagaatattctacca

SEQ ID NO: 7933940 - DNA, 22 bp, Homo sapiens
aatcttaaagaatattctacca

SEQ ID NO: 7933941 - DNA, 22 bp, Homo sapiens
aatcttaaagaatattctacca

SEQ ID NO: 7933942 - DNA, 22 bp, Homo sapiens
aatcttaaagaatattctacca

SEQ ID NO: 7933943 - DNA, 22 bp, Homo sapiens
aatctgtttccaatacttgcta

SEQ ID NO: 7933944 - DNA, 22 bp, Homo sapiens
aatctgtttccatgttttattg

SEQ ID NO: 7933945 - DNA, 22 bp, Homo sapiens
aatctgtttccatgttttattg

SEQ ID NO: 7933946 - DNA, 22 bp, Homo sapiens
aatctgtttagttctgcgtatg

SEQ ID NO: 7933947 - DNA, 17 bp, Homo sapiens
aatctgtttacagtcag

SEQ ID NO: 7933948 - DNA, 22 bp, Homo sapiens
aatctgttttatcatttgttac

SEQ ID NO: 7933949 - DNA, 22 bp, Homo sapiens
aatctgttttaaagtttgtgcc

SEQ ID NO: 7933950 - DNA, 22 bp, Homo sapiens
aatctgtttgatgcttgtgata

SEQ ID NO: 7933951 - DNA, 22 bp, Homo sapiens
aatctgtttgatgcttgtgata

SEQ ID NO: 7933952 - DNA, 22 bp, Homo sapiens
aatctgtttccattagagtcat

SEQ ID NO: 7933953 - DNA, 22 bp, Homo sapiens
aatctgtttccatgttttattg

SEQ ID NO: 7933954 - DNA, 22 bp, Homo sapiens
aatattatcaaaagctttttca

SEQ ID NO: 7933955 - DNA, 22 bp, Homo sapiens
aatattatacagtcaacctctt

SEQ ID NO: 7933956 - DNA, 22 bp, Homo sapiens
aatattatcaaaagctttttca

SEQ ID NO: 7933957 - DNA, 22 bp, Homo sapiens
aatattagtttctcaagagaga

SEQ ID NO: 7933958 - DNA, 22 bp, Homo sapiens
aatattatcaaaagctttttca

SEQ ID NO: 7933959 - DNA, 22 bp, Homo sapiens
aatattatcaaaagctttttca

SEQ ID NO: 7933960 - DNA, 22 bp, Homo sapiens
aatattcaagttattctttctt

SEQ ID NO: 7933961 - DNA, 22 bp, Homo sapiens
aatattcaagttattctttctt

SEQ ID NO: 7933962 - DNA, 22 bp, Homo sapiens
aatattaatagaaggggttcta

SEQ ID NO: 7933963 - DNA, 22 bp, Homo sapiens
aatattagtttctcaagagaga

SEQ ID NO: 7933964 - DNA, 22 bp, Homo sapiens
aatatgttcaaaatagatcact

SEQ ID NO: 7933965 - DNA, 22 bp, Homo sapiens
aatatgttccacttaaagctgg

SEQ ID NO: 7933966 - DNA, 22 bp, Homo sapiens
aatatgttccacttaaagctgg

SEQ ID NO: 7933967 - DNA, 22 bp, Homo sapiens
aatatgttcaaaatagatcact

SEQ ID NO: 7933968 - DNA, 22 bp, Homo sapiens
aatatgttcaaaatagatcact

SEQ ID NO: 7933969 - DNA, 22 bp, Homo sapiens
aatatgttgagtctatctttat

SEQ ID NO: 7933970 - DNA, 22 bp, Homo sapiens
aatatgttgagtctatctttat

SEQ ID NO: 7933971 - DNA, 22 bp, Homo sapiens
aatatgttgagtctatctttat

SEQ ID NO: 7933972 - DNA, 22 bp, Homo sapiens
aatatgtttataagatatcttc

SEQ ID NO: 7933973 - DNA, 22 bp, Homo sapiens
aatatgttgagtctatctttat

SEQ ID NO: 7933974 - DNA, 22 bp, Homo sapiens
aatatgttccacttaaagctgg

SEQ ID NO: 7933975 - DNA, 22 bp, Homo sapiens
aatatgttccacttaaagctgg

SEQ ID NO: 7933976 - DNA, 22 bp, Homo sapiens
aatatgttccacttaaagctgg

SEQ ID NO: 7933977 - DNA, 22 bp, Homo sapiens
aatatgtctctggctagacatt

SEQ ID NO: 7933978 - DNA, 22 bp, Homo sapiens
aatatgcatgtatacatgtgta

SEQ ID NO: 7933979 - DNA, 22 bp, Homo sapiens
aatatgcatgtatacatgtgta

SEQ ID NO: 7933980 - DNA, 22 bp, Homo sapiens
aatatgcagcttatcttctagg

SEQ ID NO: 7933981 - DNA, 22 bp, Homo sapiens
aatatgcagcttatcttctagg

SEQ ID NO: 7933982 - DNA, 22 bp, Homo sapiens
aatatgcagcttatcttctagg

SEQ ID NO: 7933983 - DNA, 22 bp, Homo sapiens
aatatgcattaactgtgtacat

SEQ ID NO: 7933984 - DNA, 22 bp, Homo sapiens
aatatgcattatacagactgat

SEQ ID NO: 7933985 - DNA, 22 bp, Homo sapiens
aatatgcaaataggtgtaatga

SEQ ID NO: 7933986 - DNA, 22 bp, Homo sapiens
aatatgatgccaaattgctaca

SEQ ID NO: 7933987 - DNA, 22 bp, Homo sapiens
aatatgcactctgatttagcag

SEQ ID NO: 7933988 - DNA, 22 bp, Homo sapiens
aatatgcagcatgatgaagtaa

SEQ ID NO: 7933989 - DNA, 22 bp, Homo sapiens
aatatgcagcatgatgaagtaa

SEQ ID NO: 7933990 - DNA, 21 bp, Homo sapiens
agaaaatggcgttttagattt

SEQ ID NO: 7933991 - DNA, 21 bp, Homo sapiens
agaaaatggcgttttagattt

SEQ ID NO: 7933992 - DNA, 21 bp, Homo sapiens
agaaaatggcgttttagattt

SEQ ID NO: 7933993 - DNA, 21 bp, Homo sapiens
agaaaatggcgttttagattt

SEQ ID NO: 7933994 - DNA, 22 bp, Homo sapiens
agaaaatgtgaacttgtgaatt

SEQ ID NO: 7933995 - DNA, 22 bp, Homo sapiens
agaaaatgtgaacttgtgaatt

SEQ ID NO: 7933996 - DNA, 22 bp, Homo sapiens
agaaaatgtgaacttgtgaatt

SEQ ID NO: 7933997 - DNA, 22 bp, Homo sapiens
agaaaatgtgaacttgtgaatt

SEQ ID NO: 7933998 - DNA, 22 bp, Homo sapiens
agaaaatgtgaacttgtgaatt

SEQ ID NO: 7933999 - DNA, 22 bp, Homo sapiens
agaaaattactccagagacaag

SEQ ID NO: 7934000 - DNA, 22 bp, Homo sapiens
agaaaattactccagagacaag

SEQ ID NO: 7934001 - DNA, 22 bp, Homo sapiens
agaaaattactccagagacaag

SEQ ID NO: 7934002 - DNA, 20 bp, Homo sapiens
agaaaatgttttcagctgga

SEQ ID NO: 7934003 - DNA, 22 bp, Homo sapiens
agaaaccagggcttaccagtgc

SEQ ID NO: 7934004 - DNA, 22 bp, Homo sapiens
agaaaccagggcttaccagtgc

SEQ ID NO: 7934005 - DNA, 22 bp, Homo sapiens
agaaaccagggcttaccagtgc

SEQ ID NO: 7934006 - DNA, 22 bp, Homo sapiens
agaaaccagggcttaccagtgc

SEQ ID NO: 7934007 - DNA, 22 bp, Homo sapiens
agaaaccagggcttaccagtgc

SEQ ID NO: 7934008 - DNA, 22 bp, Homo sapiens
agaaaccatctttatatatctg

SEQ ID NO: 7934009 - DNA, 22 bp, Homo sapiens
agaaaccatctttatatatctg

SEQ ID NO: 7934010 - DNA, 22 bp, Homo sapiens
agaaaccatctttatatatctg

SEQ ID NO: 7934011 - DNA, 22 bp, Homo sapiens
agaaaccatctttatatatctg

SEQ ID NO: 7934012 - DNA, 22 bp, Homo sapiens
agaaacctccatttattcactc

SEQ ID NO: 7934013 - DNA, 22 bp, Homo sapiens
agaaacctcacagcaattctga

SEQ ID NO: 7934014 - DNA, 23 bp, Homo sapiens
agaaaccactgaagagatccagt

SEQ ID NO: 7934015 - DNA, 22 bp, Homo sapiens
agaaaccagacttggcccattt

SEQ ID NO: 7934016 - DNA, 22 bp, Homo sapiens
agaaaccagacttggcccattt

SEQ ID NO: 7934017 - DNA, 22 bp, Homo sapiens
agaaaattactccagagacaag

SEQ ID NO: 7934018 - DNA, 22 bp, Homo sapiens
agaaaattactccagagacaag

SEQ ID NO: 7934019 - DNA, 21 bp, Homo sapiens
agaaaatggcgttttagattt

SEQ ID NO: 7934020 - DNA, 21 bp, Homo sapiens
agaaaatggcgttttagattt

SEQ ID NO: 7934021 - DNA, 22 bp, Homo sapiens
agaaaatattcattgagaggct

SEQ ID NO: 7934022 - DNA, 22 bp, Homo sapiens
agaaaatattcattgagaggct

SEQ ID NO: 7934023 - DNA, 22 bp, Homo sapiens
agaaaatattcattgagaggct

SEQ ID NO: 7934024 - DNA, 22 bp, Homo sapiens
agaaaatattcattgagaggct

SEQ ID NO: 7934025 - DNA, 22 bp, Homo sapiens
agaaaatattcattgagaggct

SEQ ID NO: 7934026 - DNA, 22 bp, Homo sapiens
agaaaataatttcttggctggt

SEQ ID NO: 7934027 - DNA, 22 bp, Homo sapiens
agaaaatattcattgagaggct

SEQ ID NO: 7934028 - DNA, 22 bp, Homo sapiens
agaaaatattcattgagaggct

SEQ ID NO: 7934029 - DNA, 22 bp, Homo sapiens
agaaaataatttcttggctggt

SEQ ID NO: 7934030 - DNA, 22 bp, Homo sapiens
aatattcatttgcagaagaagt

SEQ ID NO: 7934031 - DNA, 22 bp, Homo sapiens
aatattcatttgcagaagaagt

SEQ ID NO: 7934032 - DNA, 22 bp, Homo sapiens
aatattcatttgcagaagaagt

SEQ ID NO: 7934033 - DNA, 22 bp, Homo sapiens
aatattcatttgcagaagaagt

SEQ ID NO: 7934034 - DNA, 22 bp, Homo sapiens
agaaaactgggaggagagcttc

SEQ ID NO: 7934035 - DNA, 22 bp, Homo sapiens
agaaaactggagcctggggttg

SEQ ID NO: 7934036 - DNA, 22 bp, Homo sapiens
agaaaataatttcttggctggt

SEQ ID NO: 7934037 - DNA, 22 bp, Homo sapiens
agaaaataatttcttggctggt

SEQ ID NO: 7934038 - DNA, 22 bp, Homo sapiens
agaaaataatttcttggctggt

SEQ ID NO: 7934039 - DNA, 22 bp, Homo sapiens
agaaaactgggaggagagcttc

SEQ ID NO: 7934040 - DNA, 22 bp, Homo sapiens
agaaaactgggaggagagcttc

SEQ ID NO: 7934041 - DNA, 22 bp, Homo sapiens
acaggctgagcgtccatcttca

SEQ ID NO: 7934042 - DNA, 22 bp, Homo sapiens
acaggctgagcgtccatcttca

SEQ ID NO: 7934043 - DNA, 22 bp, Homo sapiens
acaggctgagcgtccatcttca

SEQ ID NO: 7934044 - DNA, 22 bp, Homo sapiens
acaggctgagcgtccatcttca

SEQ ID NO: 7934045 - DNA, 22 bp, Homo sapiens
acaggctgagcgtccatcttca

SEQ ID NO: 7934046 - DNA, 22 bp, Homo sapiens
acaggctgacttcctgccatgt

SEQ ID NO: 7934047 - DNA, 22 bp, Homo sapiens
acaggctgacttcctgccatgt

SEQ ID NO: 7934048 - DNA, 22 bp, Homo sapiens
acaggctgacttcctgccatgt

SEQ ID NO: 7934049 - DNA, 22 bp, Homo sapiens
acaggctgaggatgattgcatc

SEQ ID NO: 7934050 - DNA, 22 bp, Homo sapiens
acaggctgaggatgattgcatc

SEQ ID NO: 7934051 - DNA, 22 bp, Homo sapiens
acaggctgagcgtccatcttca

SEQ ID NO: 7934052 - DNA, 22 bp, Homo sapiens
acaggctgaggatgattgcatc

SEQ ID NO: 7934053 - DNA, 22 bp, Homo sapiens
acaggctgagcgtccatcttca

SEQ ID NO: 7934054 - DNA, 22 bp, Homo sapiens
acaggctgaggatgattgcatc

SEQ ID NO: 7934055 - DNA, 22 bp, Homo sapiens
acaggctgatagaccataaata

SEQ ID NO: 7934056 - DNA, 22 bp, Homo sapiens
acaggctctggggcaggatggc

SEQ ID NO: 7934057 - DNA, 23 bp, Homo sapiens
acaggctcttaatcagtgctcct

SEQ ID NO: 7934058 - DNA, 22 bp, Homo sapiens
acaggctgaaagttaagttctg

SEQ ID NO: 7934059 - DNA, 22 bp, Homo sapiens
acaggctgaaagttaagttctg

SEQ ID NO: 7934060 - DNA, 22 bp, Homo sapiens
acaggctgaaagttaagttctg

SEQ ID NO: 7934061 - DNA, 22 bp, Homo sapiens
acaggctgacttcctgccatgt

SEQ ID NO: 7934062 - DNA, 22 bp, Homo sapiens
acaggctgacttcctgccatgt

SEQ ID NO: 7934063 - DNA, 22 bp, Homo sapiens
acaggctgacttcctgccatgt

SEQ ID NO: 7934064 - DNA, 22 bp, Homo sapiens
acaggctgacttcctgccatgt

SEQ ID NO: 7934065 - DNA, 22 bp, Homo sapiens
acaggctgacttcctgccatgt

SEQ ID NO: 7934066 - DNA, 22 bp, Homo sapiens
acaggctgacttcctgccatgt

SEQ ID NO: 7934067 - DNA, 22 bp, Homo sapiens
acaggctgacttcctgccatgt

SEQ ID NO: 7934068 - DNA, 22 bp, Homo sapiens
acaggctgaaagttaagttctg

SEQ ID NO: 7934069 - DNA, 22 bp, Homo sapiens
acaggctgccacttgcatccaa

SEQ ID NO: 7934070 - DNA, 22 bp, Homo sapiens
acaggctgccacttgcatccaa

SEQ ID NO: 7934071 - DNA, 22 bp, Homo sapiens
acaggctgatagaccataaata

SEQ ID NO: 7934072 - DNA, 22 bp, Homo sapiens
acaggctgccacttgcatccaa

SEQ ID NO: 7934073 - DNA, 22 bp, Homo sapiens
acaggctgatagaccataaata

SEQ ID NO: 7934074 - DNA, 22 bp, Homo sapiens
acaggctgatagaccataaata

SEQ ID NO: 7934075 - DNA, 22 bp, Homo sapiens
acaggctgttggggtccagggt

SEQ ID NO: 7934076 - DNA, 22 bp, Homo sapiens
acaggctgccacttgcatccaa

SEQ ID NO: 7934077 - DNA, 22 bp, Homo sapiens
acaggctgccacttgcatccaa

SEQ ID NO: 7934078 - DNA, 22 bp, Homo sapiens
acaggctgttggggtccagggt

SEQ ID NO: 7934079 - DNA, 22 bp, Homo sapiens
acaggctgttggggtccagggt

SEQ ID NO: 7934080 - DNA, 22 bp, Homo sapiens
acaggcttctcacagaaaaggg

SEQ ID NO: 7934081 - DNA, 22 bp, Homo sapiens
acaggcttgcactagggtggca

SEQ ID NO: 7934082 - DNA, 22 bp, Homo sapiens
acaggcttgcactagggtggca

SEQ ID NO: 7934083 - DNA, 22 bp, Homo sapiens
acaggctttaaatttaaaacca

SEQ ID NO: 7934084 - DNA, 22 bp, Homo sapiens
acaggcttcattacttcagcgt

SEQ ID NO: 7934085 - DNA, 22 bp, Homo sapiens
acaggcttactgtttcataggg

SEQ ID NO: 7934086 - DNA, 22 bp, Homo sapiens
acaggcttactgtttcataggg

SEQ ID NO: 7934087 - DNA, 22 bp, Homo sapiens
acaggtaggttaaaatgtgtca

SEQ ID NO: 7934088 - DNA, 22 bp, Homo sapiens
acaggtagatacatacttctaa

SEQ ID NO: 7934089 - DNA, 22 bp, Homo sapiens
acaggtagcatttttcctcttt

SEQ ID NO: 7934090 - DNA, 22 bp, Homo sapiens
acaggtactttgtaatgaagga

SEQ ID NO: 7934091 - DNA, 22 bp, Homo sapiens
acaggtaccggtcagattacgg

SEQ ID NO: 7934092 - DNA, 21 bp, Homo sapiens
acagggcttcagggagggtta

SEQ ID NO: 7934093 - DNA, 22 bp, Homo sapiens
acagggttttttatgagaacag

SEQ ID NO: 7934094 - DNA, 23 bp, Homo sapiens
acagggcttatctgtcactcatc

SEQ ID NO: 7934095 - DNA, 23 bp, Homo sapiens
acagggaaaagtcatcagtgtga

SEQ ID NO: 7934096 - DNA, 23 bp, Homo sapiens
acagggaaaagtcatcagtgtga

SEQ ID NO: 7934097 - DNA, 23 bp, Homo sapiens
acagggcttatctgtcactcatc

SEQ ID NO: 7934098 - DNA, 22 bp, Homo sapiens
acaggctttaaatttaaaacca

SEQ ID NO: 7934099 - DNA, 21 bp, Homo sapiens
acaggctttagaaaatgactc

SEQ ID NO: 7934100 - DNA, 23 bp, Homo sapiens
acagggaaaagtcatcagtgtga

SEQ ID NO: 7934101 - DNA, 22 bp, Homo sapiens
acaggtgaagtattacactaag

SEQ ID NO: 7934102 - DNA, 22 bp, Homo sapiens
acaggtgacctgctcatatgaa

SEQ ID NO: 7934103 - DNA, 22 bp, Homo sapiens
acaggtgaagtattacactaag

SEQ ID NO: 7934104 - DNA, 22 bp, Homo sapiens
acaggtctggtctgggtgggac

SEQ ID NO: 7934105 - DNA, 22 bp, Homo sapiens
acaggtctgtgtgcacagtgct

SEQ ID NO: 7934106 - DNA, 22 bp, Homo sapiens
acaggtctgtgtgcacagtgct

SEQ ID NO: 7934107 - DNA, 22 bp, Homo sapiens
acaggtgagggagctttgtgcc

SEQ ID NO: 7934108 - DNA, 22 bp, Homo sapiens
acaggtgagggagctttgtgcc

SEQ ID NO: 7934109 - DNA, 22 bp, Homo sapiens
acaggtgaggggttctaggctg

SEQ ID NO: 7934110 - DNA, 22 bp, Homo sapiens
acaggtgaggggttctaggctg

SEQ ID NO: 7934111 - DNA, 22 bp, Homo sapiens
acaggtgacttgcattttcaca

SEQ ID NO: 7934112 - DNA, 22 bp, Homo sapiens
acaggtgaggatctgagcctca

SEQ ID NO: 7934113 - DNA, 22 bp, Homo sapiens
acaggtcctcaagtcagctggg

SEQ ID NO: 7934114 - DNA, 22 bp, Homo sapiens
acaggtcctcaagtcagctggg

SEQ ID NO: 7934115 - DNA, 22 bp, Homo sapiens
acaggtcaacgagagcaggcaa

SEQ ID NO: 7934116 - DNA, 22 bp, Homo sapiens
acaggtagtctgaacactgggt

SEQ ID NO: 7934117 - DNA, 22 bp, Homo sapiens
acaggtctgcagtaactgggaa

SEQ ID NO: 7934118 - DNA, 22 bp, Homo sapiens
acaggtctccagagtgagagga

SEQ ID NO: 7934119 - DNA, 22 bp, Homo sapiens
acaggtctccagagtgagagga

SEQ ID NO: 7934120 - DNA, 22 bp, Homo sapiens
acaggtctactggcaagcagtg

SEQ ID NO: 7934121 - DNA, 22 bp, Homo sapiens
acaggtctactggcaagcagtg

SEQ ID NO: 7934122 - DNA, 22 bp, Homo sapiens
acaggtccttataagagcactc

SEQ ID NO: 7934123 - DNA, 22 bp, Homo sapiens
acaggtccttataagagcactc

SEQ ID NO: 7934124 - DNA, 22 bp, Homo sapiens
acagtgtaattcatggctgaaa

SEQ ID NO: 7934125 - DNA, 22 bp, Homo sapiens
acagtgtactaaatagtaagag

SEQ ID NO: 7934126 - DNA, 22 bp, Homo sapiens
acagtgtactaaatagtaagag

SEQ ID NO: 7934127 - DNA, 22 bp, Homo sapiens
acagtgtactaggtacatgttc

SEQ ID NO: 7934128 - DNA, 22 bp, Homo sapiens
acagtgtagaatcctgtactta

SEQ ID NO: 7934129 - DNA, 22 bp, Homo sapiens
acagtgtagcatggtagcaatg

SEQ ID NO: 7934130 - DNA, 22 bp, Homo sapiens
acagtgtagaatcctgtactta

SEQ ID NO: 7934131 - DNA, 22 bp, Homo sapiens
acagtgtactaggtacatgttc

SEQ ID NO: 7934132 - DNA, 22 bp, Homo sapiens
acagtgtatgatatttcacagt

SEQ ID NO: 7934133 - DNA, 22 bp, Homo sapiens
acagtgtataaaatcttaaaga

SEQ ID NO: 7934134 - DNA, 22 bp, Homo sapiens
acagtgtagtgtgatgtcaaaa

SEQ ID NO: 7934135 - DNA, 22 bp, Homo sapiens
acagtgtagtgtgatgtcaaaa

SEQ ID NO: 7934136 - DNA, 22 bp, Homo sapiens
acagtgtagcatggtagcaatg

SEQ ID NO: 7934137 - DNA, 22 bp, Homo sapiens
acagtgtagcatggtagcaatg

SEQ ID NO: 7934138 - DNA, 22 bp, Homo sapiens
acagtgtagcatggtagcaatg

SEQ ID NO: 7934139 - DNA, 22 bp, Homo sapiens
acagtgtagcatggtagcaatg

SEQ ID NO: 7934140 - DNA, 22 bp, Homo sapiens
acagtttacagggatttgagct

SEQ ID NO: 7934141 - DNA, 22 bp, Homo sapiens
acagtttacagggatttgagct

SEQ ID NO: 7934142 - DNA, 22 bp, Homo sapiens
acagtttactggccttgccgtt

SEQ ID NO: 7934143 - DNA, 22 bp, Homo sapiens
acagtgtccccagctctgtgag

SEQ ID NO: 7934144 - DNA, 22 bp, Homo sapiens
acataacaatcataggacatag

SEQ ID NO: 7934145 - DNA, 22 bp, Homo sapiens
acagtgtcatcagtttctcaac

SEQ ID NO: 7934146 - DNA, 22 bp, Homo sapiens
acagtgtcatgtcgtgttcccc

SEQ ID NO: 7934147 - DNA, 22 bp, Homo sapiens
acagtgtccccagctctgtgag

SEQ ID NO: 7934148 - DNA, 22 bp, Homo sapiens
acagtgtccttgtggtccctgt

SEQ ID NO: 7934149 - DNA, 22 bp, Homo sapiens
acagtgtccccagctctgtgag

SEQ ID NO: 7934150 - DNA, 20 bp, Homo sapiens
acagtgggtggggagcactg

SEQ ID NO: 7934151 - DNA, 20 bp, Homo sapiens
acagtgggtggggagcactg

SEQ ID NO: 7934152 - DNA, 22 bp, Homo sapiens
acagtggtaggataactgtttt

SEQ ID NO: 7934153 - DNA, 20 bp, Homo sapiens
acagtgggtggggagcactg

SEQ ID NO: 7934154 - DNA, 22 bp, Homo sapiens
acagtggtaggataactgtttt

SEQ ID NO: 7934155 - DNA, 22 bp, Homo sapiens
acagtggtgagtgactgatagg

SEQ ID NO: 7934156 - DNA, 22 bp, Homo sapiens
acagtggtgagtgactgatagg

SEQ ID NO: 7934157 - DNA, 22 bp, Homo sapiens
acagtgtaatatgggagtcagt

SEQ ID NO: 7934158 - DNA, 22 bp, Homo sapiens
acagtgtaatatgggagtcagt

SEQ ID NO: 7934159 - DNA, 18 bp, Homo sapiens
acagtggtttgatgtgct

SEQ ID NO: 7934160 - DNA, 22 bp, Homo sapiens
acagtgctatcaatagctagaa

SEQ ID NO: 7934161 - DNA, 22 bp, Homo sapiens
acagtgctgaacgacatggaag

SEQ ID NO: 7934162 - DNA, 22 bp, Homo sapiens
acagtgctgaacgacatggaag

SEQ ID NO: 7934163 - DNA, 22 bp, Homo sapiens
acagtgctcatgtgacatggtg

SEQ ID NO: 7934164 - DNA, 22 bp, Homo sapiens
acagtgctcatgtgacatggtg

SEQ ID NO: 7934165 - DNA, 22 bp, Homo sapiens
acagtgctgaacgacatggaag

SEQ ID NO: 7934166 - DNA, 22 bp, Homo sapiens
acagtgctgatctagactgacc

SEQ ID NO: 7934167 - DNA, 22 bp, Homo sapiens
acagtgctgatctagactgacc

SEQ ID NO: 7934168 - DNA, 22 bp, Homo sapiens
acagtgctggctacaaccctgg

SEQ ID NO: 7934169 - DNA, 22 bp, Homo sapiens
acagtgctaaacacttcttgaa

SEQ ID NO: 7934170 - DNA, 22 bp, Homo sapiens
acagtgctaaacacttcttgaa

SEQ ID NO: 7934171 - DNA, 22 bp, Homo sapiens
acagtgcattattgctgaatgc

SEQ ID NO: 7934172 - DNA, 22 bp, Homo sapiens
acagtgcattattgctgaatgc

SEQ ID NO: 7934173 - DNA, 20 bp, Homo sapiens
acagtgcatggggggacagc

SEQ ID NO: 7934174 - DNA, 22 bp, Homo sapiens
acagtgccctatgaacagctct

SEQ ID NO: 7934175 - DNA, 22 bp, Homo sapiens
acagtgcattattgctgaatgc

SEQ ID NO: 7934176 - DNA, 19 bp, Homo sapiens
acagtgcatgggacctggt

SEQ ID NO: 7934177 - DNA, 22 bp, Homo sapiens
acagtgcattattgctgaatgc

SEQ ID NO: 7934178 - DNA, 19 bp, Homo sapiens
acagtgcatgggacctggt

SEQ ID NO: 7934179 - DNA, 19 bp, Homo sapiens
acagtgcatgggacctggt

SEQ ID NO: 7934180 - DNA, 22 bp, Homo sapiens
acagtgcataaaaacaactttt

SEQ ID NO: 7934181 - DNA, 19 bp, Homo sapiens
acagtgcatgggacctggt

SEQ ID NO: 7934182 - DNA, 19 bp, Homo sapiens
acagtgcatgggacctggt

SEQ ID NO: 7934183 - DNA, 19 bp, Homo sapiens
acagtgcatgggacctggt

SEQ ID NO: 7934184 - DNA, 20 bp, Homo sapiens
acagtgcatggggggacagc

SEQ ID NO: 7934185 - DNA, 20 bp, Homo sapiens
acagtgcatggggggacagc

SEQ ID NO: 7934186 - DNA, 20 bp, Homo sapiens
acagtgcatggggggacagc

SEQ ID NO: 7934187 - DNA, 19 bp, Homo sapiens
acagtgcatgggacctggt

SEQ ID NO: 7934188 - DNA, 20 bp, Homo sapiens
acagtgcatggggggacagc

SEQ ID NO: 7934189 - DNA, 20 bp, Homo sapiens
acagtgcatggggggacagc

SEQ ID NO: 7934190 - DNA, 19 bp, Homo sapiens
acagtgcatgggacctggt

SEQ ID NO: 7934191 - DNA, 20 bp, Homo sapiens
acagtgcatggggggacagc

SEQ ID NO: 7934192 - DNA, 22 bp, Homo sapiens
acagtctttctacattctgtgc

SEQ ID NO: 7934193 - DNA, 22 bp, Homo sapiens
acagtctttgcaaagtcctggt

SEQ ID NO: 7934194 - DNA, 22 bp, Homo sapiens
acagtctttgcaaagtcctggt

SEQ ID NO: 7934195 - DNA, 22 bp, Homo sapiens
acagtctttgcagaagcaatat

SEQ ID NO: 7934196 - DNA, 22 bp, Homo sapiens
acagtgcaggtctcaacaatta

SEQ ID NO: 7934197 - DNA, 22 bp, Homo sapiens
acagtgcaggtctcaacaatta

SEQ ID NO: 7934198 - DNA, 22 bp, Homo sapiens
acagtgcaggtctcaacaatta

SEQ ID NO: 7934199 - DNA, 22 bp, Homo sapiens
acagtgcaggtctcaacaatta

SEQ ID NO: 7934200 - DNA, 22 bp, Homo sapiens
acagtgcaggtctcaacaatta

SEQ ID NO: 7934201 - DNA, 22 bp, Homo sapiens
acagtgcaggtctcaacaatta

SEQ ID NO: 7934202 - DNA, 22 bp, Homo sapiens
acagtgcagtgtgatgagtatt

SEQ ID NO: 7934203 - DNA, 22 bp, Homo sapiens
acagtgcagtgtgatgagtatt

SEQ ID NO: 7934204 - DNA, 22 bp, Homo sapiens
acagtgcataaaaacaactttt

SEQ ID NO: 7934205 - DNA, 22 bp, Homo sapiens
acagtgcataaaaacaactttt

SEQ ID NO: 7934206 - DNA, 22 bp, Homo sapiens
acagtgcataaaaacaactttt

SEQ ID NO: 7934207 - DNA, 22 bp, Homo sapiens
acagtgcagtgtgatgagtatt

SEQ ID NO: 7934208 - DNA, 22 bp, Homo sapiens
acagtgcagtgtgatgagtatt

SEQ ID NO: 7934209 - DNA, 22 bp, Homo sapiens
acagtgcataaaaacaactttt

SEQ ID NO: 7934210 - DNA, 22 bp, Homo sapiens
acaggtgattcaggctctggga

SEQ ID NO: 7934211 - DNA, 22 bp, Homo sapiens
acaggtgattcaggctctggga

SEQ ID NO: 7934212 - DNA, 22 bp, Homo sapiens
acaggtgattcaggctctggga

SEQ ID NO: 7934213 - DNA, 22 bp, Homo sapiens
acaggtgatgacatttgaacca

SEQ ID NO: 7934214 - DNA, 18 bp, Homo sapiens
acaggtgatatcttgaga

SEQ ID NO: 7934215 - DNA, 22 bp, Homo sapiens
acaggtgataagaaaactcgct

SEQ ID NO: 7934216 - DNA, 22 bp, Homo sapiens
acaggtgtatgaatatgttcca

SEQ ID NO: 7934217 - DNA, 22 bp, Homo sapiens
acaggtgtagcaggagcatcaa

SEQ ID NO: 7934218 - DNA, 22 bp, Homo sapiens
acaggtgtaggtacatttgcat

SEQ ID NO: 7934219 - DNA, 22 bp, Homo sapiens
acaggtgtagcaggagcatcaa

SEQ ID NO: 7934220 - DNA, 22 bp, Homo sapiens
acaggtgtagcaggagcatcaa

SEQ ID NO: 7934221 - DNA, 22 bp, Homo sapiens
acaggtgtagaaaacagattat

SEQ ID NO: 7934222 - DNA, 22 bp, Homo sapiens
acaggtgtgagaacatgccttg

SEQ ID NO: 7934223 - DNA, 22 bp, Homo sapiens
acaggtgtctgcaagttactgg

SEQ ID NO: 7934224 - DNA, 22 bp, Homo sapiens
acaggtgtgagaacatgccttg

SEQ ID NO: 7934225 - DNA, 22 bp, Homo sapiens
acaggtgtgggctgggctctga

SEQ ID NO: 7934226 - DNA, 22 bp, Homo sapiens
acaggtgtgcggaaagctgtga

SEQ ID NO: 7934227 - DNA, 22 bp, Homo sapiens
acagtctttctacattctgtgc

SEQ ID NO: 7934228 - DNA, 22 bp, Homo sapiens
acagtctttctacattctgtgc

SEQ ID NO: 7934229 - DNA, 22 bp, Homo sapiens
acaggtgtcctcacagggggtg

SEQ ID NO: 7934230 - DNA, 22 bp, Homo sapiens
acaggtgtctaaggcagacagc

SEQ ID NO: 7934231 - DNA, 22 bp, Homo sapiens
acaggtgtctaaggcagacagc

SEQ ID NO: 7934232 - DNA, 22 bp, Homo sapiens
acaggtgtctaaggcagacagc

SEQ ID NO: 7934233 - DNA, 22 bp, Homo sapiens
acaggtgtccaacatttacctt

SEQ ID NO: 7934234 - DNA, 22 bp, Homo sapiens
acagatttttggtaaataattt

SEQ ID NO: 7934235 - DNA, 22 bp, Homo sapiens
acagctggagtgttggtgaggt

SEQ ID NO: 7934236 - DNA, 22 bp, Homo sapiens
acagctggagtgttggtgaggt

SEQ ID NO: 7934237 - DNA, 22 bp, Homo sapiens
acagctggagtgttggtgaggt

SEQ ID NO: 7934238 - DNA, 22 bp, Homo sapiens
acagcttgcacaagggaactca

SEQ ID NO: 7934239 - DNA, 22 bp, Homo sapiens
acagcttgcatgcagaggcact

SEQ ID NO: 7934240 - DNA, 22 bp, Homo sapiens
acagcttgcatgcagaggcact

SEQ ID NO: 7934241 - DNA, 21 bp, Homo sapiens
acagattttatatctctgctg

SEQ ID NO: 7934242 - DNA, 22 bp, Homo sapiens
acagattttattattcaggtat

SEQ ID NO: 7934243 - DNA, 22 bp, Homo sapiens
acagattttattattcaggtat

SEQ ID NO: 7934244 - DNA, 21 bp, Homo sapiens
acagattttatatctctgctg

SEQ ID NO: 7934245 - DNA, 22 bp, Homo sapiens
acagattttggtatttgcaatg

SEQ ID NO: 7934246 - DNA, 22 bp, Homo sapiens
acagattttattattcaggtat

SEQ ID NO: 7934247 - DNA, 22 bp, Homo sapiens
acagattttggtatttgcaatg

SEQ ID NO: 7934248 - DNA, 22 bp, Homo sapiens
acagatttttggtaaataattt

SEQ ID NO: 7934249 - DNA, 22 bp, Homo sapiens
acagatttttcagctcctgtgt

SEQ ID NO: 7934250 - DNA, 22 bp, Homo sapiens
acagattttaaatgacactccc

SEQ ID NO: 7934251 - DNA, 22 bp, Homo sapiens
acagattttaaatgacactccc

SEQ ID NO: 7934252 - DNA, 22 bp, Homo sapiens
acagattttaaatttgtagttg

SEQ ID NO: 7934253 - DNA, 22 bp, Homo sapiens
acagatttggaggcctcacccc

SEQ ID NO: 7934254 - DNA, 22 bp, Homo sapiens
acagatttggcccagccaatgc

SEQ ID NO: 7934255 - DNA, 22 bp, Homo sapiens
acagatttggcccagccaatgc

SEQ ID NO: 7934256 - DNA, 22 bp, Homo sapiens
acagatttgttcttttgggcta

SEQ ID NO: 7934257 - DNA, 22 bp, Homo sapiens
acagatttgactggtacctggc

SEQ ID NO: 7934258 - DNA, 22 bp, Homo sapiens
acagatttgactggtacctggc

SEQ ID NO: 7934259 - DNA, 22 bp, Homo sapiens
acagatttattgaagctgctgc

SEQ ID NO: 7934260 - DNA, 22 bp, Homo sapiens
acagatttgatctgagaacaaa

SEQ ID NO: 7934261 - DNA, 22 bp, Homo sapiens
acagatttgatctgagaacaaa

SEQ ID NO: 7934262 - DNA, 22 bp, Homo sapiens
acagatttgatctgagaacaaa

SEQ ID NO: 7934263 - DNA, 22 bp, Homo sapiens
acagatttggaggcctcacccc

SEQ ID NO: 7934264 - DNA, 22 bp, Homo sapiens
acagatttggcccagccaatgc

SEQ ID NO: 7934265 - DNA, 22 bp, Homo sapiens
acagatttggaggcctcacccc

SEQ ID NO: 7934266 - DNA, 22 bp, Homo sapiens
acagatgaggaagagtcagcca

SEQ ID NO: 7934267 - DNA, 22 bp, Homo sapiens
acagatgaggaagagtcagcca

SEQ ID NO: 7934268 - DNA, 22 bp, Homo sapiens
acagatgaggaaacagggtcag

SEQ ID NO: 7934269 - DNA, 22 bp, Homo sapiens
acagatgagactccaggacctt

SEQ ID NO: 7934270 - DNA, 22 bp, Homo sapiens
acagatgagagacaatgtgcta

SEQ ID NO: 7934271 - DNA, 20 bp, Homo sapiens
acagatgaggaaaatgaagt

SEQ ID NO: 7934272 - DNA, 22 bp, Homo sapiens
acagatgaggaaacagggtcag

SEQ ID NO: 7934273 - DNA, 20 bp, Homo sapiens
acagatgaggaaaatgaagt

SEQ ID NO: 7934274 - DNA, 20 bp, Homo sapiens
acagatgaggaaaatgaagt

SEQ ID NO: 7934275 - DNA, 22 bp, Homo sapiens
acagcttgtctaccccagaggt

SEQ ID NO: 7934276 - DNA, 22 bp, Homo sapiens
acagcttgtagaggccctggca

SEQ ID NO: 7934277 - DNA, 22 bp, Homo sapiens
acagcttgtatcccaatggagc

SEQ ID NO: 7934278 - DNA, 22 bp, Homo sapiens
acagcttggggaggccctggga

SEQ ID NO: 7934279 - DNA, 22 bp, Homo sapiens
acagcttggggaggccctggga

SEQ ID NO: 7934280 - DNA, 22 bp, Homo sapiens
acagcttgtagaggccctggca

SEQ ID NO: 7934281 - DNA, 23 bp, Homo sapiens
acagcttgccaattagccttccg

SEQ ID NO: 7934282 - DNA, 22 bp, Homo sapiens
acagctttgttttccctgctga

SEQ ID NO: 7934283 - DNA, 22 bp, Homo sapiens
acagctttgtgttaatgggaag

SEQ ID NO: 7934284 - DNA, 22 bp, Homo sapiens
acagcttttatgggaccagcca

SEQ ID NO: 7934285 - DNA, 22 bp, Homo sapiens
acagctttatctcagggatcag

SEQ ID NO: 7934286 - DNA, 22 bp, Homo sapiens
acagctttgggcaatgctatga

SEQ ID NO: 7934287 - DNA, 22 bp, Homo sapiens
acagctttagtgtgggtggtgc

SEQ ID NO: 7934288 - DNA, 22 bp, Homo sapiens
acagctttatctcagggatcag

SEQ ID NO: 7934289 - DNA, 22 bp, Homo sapiens
acagcttttgaaaaattactgg

SEQ ID NO: 7934290 - DNA, 22 bp, Homo sapiens
acagcttttgaaaaattactgg

SEQ ID NO: 7934291 - DNA, 22 bp, Homo sapiens
acagcttttctgatagatcctg

SEQ ID NO: 7934292 - DNA, 22 bp, Homo sapiens
acagcttttgaaaaattactgg

SEQ ID NO: 7934293 - DNA, 22 bp, Homo sapiens
acagcttttcaattctgctgag

SEQ ID NO: 7934294 - DNA, 22 bp, Homo sapiens
acagcttttcaattctgctgag

SEQ ID NO: 7934295 - DNA, 22 bp, Homo sapiens
acagcttttcaattctgctgag

SEQ ID NO: 7934296 - DNA, 22 bp, Homo sapiens
acagcttttatgggaccagcca

SEQ ID NO: 7934297 - DNA, 22 bp, Homo sapiens
acagctttttactaatagattg

SEQ ID NO: 7934298 - DNA, 22 bp, Homo sapiens
acagctttttactaatagattg

SEQ ID NO: 7934299 - DNA, 22 bp, Homo sapiens
acagctttttactaatagattg

SEQ ID NO: 7934300 - DNA, 22 bp, Homo sapiens
acaggaaagagctaggcatagg

SEQ ID NO: 7934301 - DNA, 22 bp, Homo sapiens
acaggaaagagctaggcatagg

SEQ ID NO: 7934302 - DNA, 22 bp, Homo sapiens
acaggaaagagctaggcatagg

SEQ ID NO: 7934303 - DNA, 22 bp, Homo sapiens
acaggaaagagctaggcatagg

SEQ ID NO: 7934304 - DNA, 22 bp, Homo sapiens
acaggaaagagctaggcatagg

SEQ ID NO: 7934305 - DNA, 22 bp, Homo sapiens
acaggaaattggcatatcagtt

SEQ ID NO: 7934306 - DNA, 22 bp, Homo sapiens
acaggaaattggcatatcagtt

SEQ ID NO: 7934307 - DNA, 22 bp, Homo sapiens
acaggaaattggcatatcagtt

SEQ ID NO: 7934308 - DNA, 22 bp, Homo sapiens
acaggaaatgaaatggtatcta

SEQ ID NO: 7934309 - DNA, 22 bp, Homo sapiens
acaggaaatgaaatggtatcta

SEQ ID NO: 7934310 - DNA, 22 bp, Homo sapiens
acaggaaatgaaatggtatcta

SEQ ID NO: 7934311 - DNA, 22 bp, Homo sapiens
acaggaaccaggcaggtcgatt

SEQ ID NO: 7934312 - DNA, 22 bp, Homo sapiens
acaggaacagcttgatggcatc

SEQ ID NO: 7934313 - DNA, 22 bp, Homo sapiens
acaggaacagcttgatggcatc

SEQ ID NO: 7934314 - DNA, 22 bp, Homo sapiens
acaggaaattggcatatcagtt

SEQ ID NO: 7934315 - DNA, 22 bp, Homo sapiens
acaggaaattggcatatcagtt

SEQ ID NO: 7934316 - DNA, 22 bp, Homo sapiens
acaggaacccagaaacatttct

SEQ ID NO: 7934317 - DNA, 22 bp, Homo sapiens
acaggagaccctgctggttctg

SEQ ID NO: 7934318 - DNA, 21 bp, Homo sapiens
acaggagaccgcctggcagtc

SEQ ID NO: 7934319 - DNA, 21 bp, Homo sapiens
acaggagaccgcctggcagtc

SEQ ID NO: 7934320 - DNA, 21 bp, Homo sapiens
acaggagaccgcctggcagtc

SEQ ID NO: 7934321 - DNA, 21 bp, Homo sapiens
acaggagaccgcctggcagtc

SEQ ID NO: 7934322 - DNA, 21 bp, Homo sapiens
acaggagaccgcctggcagtc

SEQ ID NO: 7934323 - DNA, 21 bp, Homo sapiens
acaggagaccgcctggcagtc

SEQ ID NO: 7934324 - DNA, 22 bp, Homo sapiens
acaggagaccctgctggttctg

SEQ ID NO: 7934325 - DNA, 21 bp, Homo sapiens
acaggagaccgcctggcagtc

SEQ ID NO: 7934326 - DNA, 21 bp, Homo sapiens
acaggagaccgcctggcagtc

SEQ ID NO: 7934327 - DNA, 21 bp, Homo sapiens
acaggagaccgcctggcagtc

SEQ ID NO: 7934328 - DNA, 20 bp, Homo sapiens
acaggagatctgaggaaagg

SEQ ID NO: 7934329 - DNA, 22 bp, Homo sapiens
acaggcagagaactcagccaga

SEQ ID NO: 7934330 - DNA, 22 bp, Homo sapiens
acaggcagagaactcagccaga

SEQ ID NO: 7934331 - DNA, 22 bp, Homo sapiens
acaggcagagaactcagccaga

SEQ ID NO: 7934332 - DNA, 22 bp, Homo sapiens
acaggcagagaactcagccaga

SEQ ID NO: 7934333 - DNA, 22 bp, Homo sapiens
acaggcagagaactcagccaga

SEQ ID NO: 7934334 - DNA, 22 bp, Homo sapiens
acaggcagagaactcagccaga

SEQ ID NO: 7934335 - DNA, 22 bp, Homo sapiens
acaggcagagaactcagccaga

SEQ ID NO: 7934336 - DNA, 19 bp, Homo sapiens
acaggcagaattgggtgtg

SEQ ID NO: 7934337 - DNA, 19 bp, Homo sapiens
acaggcagaattgggtgtg

SEQ ID NO: 7934338 - DNA, 19 bp, Homo sapiens
acaggcagaattgggtgtg

SEQ ID NO: 7934339 - DNA, 19 bp, Homo sapiens
acaggcagaattgggtgtg

SEQ ID NO: 7934340 - DNA, 19 bp, Homo sapiens
acaggcagaattgggtgtg

SEQ ID NO: 7934341 - DNA, 22 bp, Homo sapiens
acaggcactttgacatgccatc

SEQ ID NO: 7934342 - DNA, 19 bp, Homo sapiens
acaggcagaattgggtgtg

SEQ ID NO: 7934343 - DNA, 19 bp, Homo sapiens
acaggcagaattgggtgtg

SEQ ID NO: 7934344 - DNA, 22 bp, Homo sapiens
acaggcactttgacatgccatc

SEQ ID NO: 7934345 - DNA, 22 bp, Homo sapiens
acaggcactgtcaagtcatgaa

SEQ ID NO: 7934346 - DNA, 22 bp, Homo sapiens
acaggcactgtcaagtcatgaa

SEQ ID NO: 7934347 - DNA, 22 bp, Homo sapiens
acaggaggagctgtttcaggga

SEQ ID NO: 7934348 - DNA, 22 bp, Homo sapiens
acaggcactgtcaagtcatgaa

SEQ ID NO: 7934349 - DNA, 22 bp, Homo sapiens
acaggcactgtcaagtcatgaa

SEQ ID NO: 7934350 - DNA, 22 bp, Homo sapiens
acaggcactttgacatgccatc

SEQ ID NO: 7934351 - DNA, 22 bp, Homo sapiens
acaggcactttgacatgccatc

SEQ ID NO: 7934352 - DNA, 22 bp, Homo sapiens
acaggcactttgacatgccatc

SEQ ID NO: 7934353 - DNA, 22 bp, Homo sapiens
acaggcacctgccaccacatct

SEQ ID NO: 7934354 - DNA, 22 bp, Homo sapiens
acaggcacctgccaccacatct

SEQ ID NO: 7934355 - DNA, 22 bp, Homo sapiens
acaggaggagctgtttcaggga

SEQ ID NO: 7934356 - DNA, 22 bp, Homo sapiens
acaggcactgtcaagtcatgaa

SEQ ID NO: 7934357 - DNA, 22 bp, Homo sapiens
acaggcactctcattaaaatag

SEQ ID NO: 7934358 - DNA, 22 bp, Homo sapiens
acaggcactgtcaagtcatgaa

SEQ ID NO: 7934359 - DNA, 22 bp, Homo sapiens
acaggcactgtcaagtcatgaa

SEQ ID NO: 7934360 - DNA, 22 bp, Homo sapiens
acaggcactctcattaaaatag

SEQ ID NO: 7934361 - DNA, 22 bp, Homo sapiens
acaggagctctagggacagcac

SEQ ID NO: 7934362 - DNA, 22 bp, Homo sapiens
acaggagctctagggacagcac

SEQ ID NO: 7934363 - DNA, 22 bp, Homo sapiens
acaggagctctagggacagcac

SEQ ID NO: 7934364 - DNA, 22 bp, Homo sapiens
acaggaggagcagctgtgtgcc

SEQ ID NO: 7934365 - DNA, 22 bp, Homo sapiens
acaggaggagcagctgtgtgcc

SEQ ID NO: 7934366 - DNA, 22 bp, Homo sapiens
acaggagctctagggacagcac

SEQ ID NO: 7934367 - DNA, 22 bp, Homo sapiens
acaggaggagcagctgtgtgcc

SEQ ID NO: 7934368 - DNA, 22 bp, Homo sapiens
acaggaggagcagctgtgtgcc

SEQ ID NO: 7934369 - DNA, 22 bp, Homo sapiens
acaggaggagcagctgtgtgcc

SEQ ID NO: 7934370 - DNA, 22 bp, Homo sapiens
acaggaggagcagctgtgtgcc

SEQ ID NO: 7934371 - DNA, 22 bp, Homo sapiens
acaggaggagctgtttcaggga

SEQ ID NO: 7934372 - DNA, 22 bp, Homo sapiens
acaggaggagctgtttcaggga

SEQ ID NO: 7934373 - DNA, 22 bp, Homo sapiens
acaggagcaacagactaagaca

SEQ ID NO: 7934374 - DNA, 22 bp, Homo sapiens
acaggagcaacagactaagaca

SEQ ID NO: 7934375 - DNA, 22 bp, Homo sapiens
acaggagccaaacacatgccag

SEQ ID NO: 7934376 - DNA, 22 bp, Homo sapiens
acaggagccaaacacatgccag

SEQ ID NO: 7934377 - DNA, 22 bp, Homo sapiens
acaggagccaaacacatgccag

SEQ ID NO: 7934378 - DNA, 22 bp, Homo sapiens
acaggagccaaacacatgccag

SEQ ID NO: 7934379 - DNA, 22 bp, Homo sapiens
acaggagcccaggatgggcgga

SEQ ID NO: 7934380 - DNA, 22 bp, Homo sapiens
acaggagccaaacacatgccag

SEQ ID NO: 7934381 - DNA, 20 bp, Homo sapiens
acaggagatctgaggaaagg

SEQ ID NO: 7934382 - DNA, 20 bp, Homo sapiens
acaggagatctgaggaaagg

SEQ ID NO: 7934383 - DNA, 20 bp, Homo sapiens
acaggagatctgaggaaagg

SEQ ID NO: 7934384 - DNA, 20 bp, Homo sapiens
acaggagatctgaggaaagg

SEQ ID NO: 7934385 - DNA, 20 bp, Homo sapiens
acaggagatctgaggaaagg

SEQ ID NO: 7934386 - DNA, 22 bp, Homo sapiens
aagccctggatagagagaactg

SEQ ID NO: 7934387 - DNA, 22 bp, Homo sapiens
aagccctggacggcccttcccc

SEQ ID NO: 7934388 - DNA, 22 bp, Homo sapiens
aagccctggaactttcctagcc

SEQ ID NO: 7934389 - DNA, 22 bp, Homo sapiens
aagccctggaactttcctagcc

SEQ ID NO: 7934390 - DNA, 22 bp, Homo sapiens
aagccctggaactttcctagcc

SEQ ID NO: 7934391 - DNA, 22 bp, Homo sapiens
aagccctgccacccattcactg

SEQ ID NO: 7934392 - DNA, 22 bp, Homo sapiens
aagccctggattaaagatgcca

SEQ ID NO: 7934393 - DNA, 22 bp, Homo sapiens
aagccctggcaatgtcagatga

SEQ ID NO: 7934394 - DNA, 22 bp, Homo sapiens
aagccctggattaaagatgcca

SEQ ID NO: 7934395 - DNA, 22 bp, Homo sapiens
aagccctggattaaagatgcca

SEQ ID NO: 7934396 - DNA, 22 bp, Homo sapiens
aagccctggcccaaccttgatt

SEQ ID NO: 7934397 - DNA, 22 bp, Homo sapiens
aagccctggcaatgtcagatga

SEQ ID NO: 7934398 - DNA, 22 bp, Homo sapiens
aagccctggcccaaccttgatt

SEQ ID NO: 7934399 - DNA, 22 bp, Homo sapiens
aagccctggcgggtggagggcc

SEQ ID NO: 7934400 - DNA, 22 bp, Homo sapiens
aagccctggctcagctcaccag

SEQ ID NO: 7934401 - DNA, 22 bp, Homo sapiens
aagccctggcgggtggagggcc

SEQ ID NO: 7934402 - DNA, 22 bp, Homo sapiens
aagccctggctcagctcaccag

SEQ ID NO: 7934403 - DNA, 22 bp, Homo sapiens
aagccctggcgggtggagggcc

SEQ ID NO: 7934404 - DNA, 22 bp, Homo sapiens
acaggccagaggtggggcagcc

SEQ ID NO: 7934405 - DNA, 22 bp, Homo sapiens
acaggccagaggtggggcagcc

SEQ ID NO: 7934406 - DNA, 22 bp, Homo sapiens
acaggccagaggtggggcagcc

SEQ ID NO: 7934407 - DNA, 22 bp, Homo sapiens
acaggccagcctggggtaaggt

SEQ ID NO: 7934408 - DNA, 22 bp, Homo sapiens
acaggccagcctggggtaaggt

SEQ ID NO: 7934409 - DNA, 22 bp, Homo sapiens
acaggccagcctggggtaaggt

SEQ ID NO: 7934410 - DNA, 22 bp, Homo sapiens
acaggccagcctggggtaaggt

SEQ ID NO: 7934411 - DNA, 22 bp, Homo sapiens
aagccctgccacccattcactg

SEQ ID NO: 7934412 - DNA, 22 bp, Homo sapiens
aagccctgcagtctctgccaca

SEQ ID NO: 7934413 - DNA, 22 bp, Homo sapiens
aagccctgataggaaaatgctg

SEQ ID NO: 7934414 - DNA, 22 bp, Homo sapiens
aagccctgagcactgcagagaa

SEQ ID NO: 7934415 - DNA, 22 bp, Homo sapiens
aagccctgcagtctctgccaca

SEQ ID NO: 7934416 - DNA, 22 bp, Homo sapiens
aagccctgactatgaagacata

SEQ ID NO: 7934417 - DNA, 22 bp, Homo sapiens
aagccctgactatgaagacata

SEQ ID NO: 7934418 - DNA, 22 bp, Homo sapiens
aagccctgagcactgcagagaa

SEQ ID NO: 7934419 - DNA, 22 bp, Homo sapiens
aagccctgagcactgcagagaa

SEQ ID NO: 7934420 - DNA, 22 bp, Homo sapiens
acaggcagagtcaggttgggtt

SEQ ID NO: 7934421 - DNA, 22 bp, Homo sapiens
acaggcagagtcaggttgggtt

SEQ ID NO: 7934422 - DNA, 22 bp, Homo sapiens
acaggcagagtcaggttgggtt

SEQ ID NO: 7934423 - DNA, 22 bp, Homo sapiens
acaggcagagtcaggttgggtt

SEQ ID NO: 7934424 - DNA, 22 bp, Homo sapiens
acaggcagagtcaggttgggtt

SEQ ID NO: 7934425 - DNA, 22 bp, Homo sapiens
acaggcagagagtggcggactc

SEQ ID NO: 7934426 - DNA, 22 bp, Homo sapiens
acaggcagagagtggcggactc

SEQ ID NO: 7934427 - DNA, 22 bp, Homo sapiens
acaggcagagagtggcggactc

SEQ ID NO: 7934428 - DNA, 22 bp, Homo sapiens
acaggcagagagtggcggactc

SEQ ID NO: 7934429 - DNA, 22 bp, Homo sapiens
acaggcagagagtggcggactc

SEQ ID NO: 7934430 - DNA, 22 bp, Homo sapiens
acaggcagagagtggcggactc

SEQ ID NO: 7934431 - DNA, 22 bp, Homo sapiens
acaggcagagagtggcggactc

SEQ ID NO: 7934432 - DNA, 22 bp, Homo sapiens
acaggcagagaactcagccaga

SEQ ID NO: 7934433 - DNA, 22 bp, Homo sapiens
acaggcagagaactcagccaga

SEQ ID NO: 7934434 - DNA, 18 bp, Homo sapiens
acatacattctgtctgca

SEQ ID NO: 7934435 - DNA, 22 bp, Homo sapiens
acatacaaatagagctgtagta

SEQ ID NO: 7934436 - DNA, 18 bp, Homo sapiens
acatacattctgtctgca

SEQ ID NO: 7934437 - DNA, 18 bp, Homo sapiens
acatacattctgtctgca

SEQ ID NO: 7934438 - DNA, 22 bp, Homo sapiens
acatacaaatagagctgtagta

SEQ ID NO: 7934439 - DNA, 18 bp, Homo sapiens
acatacattctgtctgca

SEQ ID NO: 7934440 - DNA, 22 bp, Homo sapiens
acatactatgaatacatgtgtc

SEQ ID NO: 7934441 - DNA, 22 bp, Homo sapiens
acatactatgaatacatgtgtc

SEQ ID NO: 7934442 - DNA, 22 bp, Homo sapiens
acatactatgaatacatgtgtc

SEQ ID NO: 7934443 - DNA, 22 bp, Homo sapiens
acatacttaacattaaagtcat

SEQ ID NO: 7934444 - DNA, 22 bp, Homo sapiens
acatacattgcctcattggtaa

SEQ ID NO: 7934445 - DNA, 22 bp, Homo sapiens
acatacattgcctcattggtaa

SEQ ID NO: 7934446 - DNA, 22 bp, Homo sapiens
acatacattgcctcattggtaa

SEQ ID NO: 7934447 - DNA, 22 bp, Homo sapiens
acataatgagctctttataaat

SEQ ID NO: 7934448 - DNA, 22 bp, Homo sapiens
acataatgaaatgcagaaatca

SEQ ID NO: 7934449 - DNA, 22 bp, Homo sapiens
acataatgagctctttataaat

SEQ ID NO: 7934450 - DNA, 22 bp, Homo sapiens
acataatgagctctttataaat

SEQ ID NO: 7934451 - DNA, 22 bp, Homo sapiens
acataatggacaataatgcatc

SEQ ID NO: 7934452 - DNA, 22 bp, Homo sapiens
acatacaaatagagctgtagta

SEQ ID NO: 7934453 - DNA, 22 bp, Homo sapiens
acataattataaatggtgggct

SEQ ID NO: 7934454 - DNA, 22 bp, Homo sapiens
acataattataaatggtgggct

SEQ ID NO: 7934455 - DNA, 22 bp, Homo sapiens
acataataggtgcctgaatatt

SEQ ID NO: 7934456 - DNA, 22 bp, Homo sapiens
acataataggtgcctgaatatt

SEQ ID NO: 7934457 - DNA, 22 bp, Homo sapiens
acataataggtgcctgaatatt

SEQ ID NO: 7934458 - DNA, 22 bp, Homo sapiens
acataataggtgcctgaatatt

SEQ ID NO: 7934459 - DNA, 22 bp, Homo sapiens
acataataggtgcctgaatatt

SEQ ID NO: 7934460 - DNA, 22 bp, Homo sapiens
acataataggtgcctgaatatt

SEQ ID NO: 7934461 - DNA, 22 bp, Homo sapiens
acataatacctaggacagtttg

SEQ ID NO: 7934462 - DNA, 22 bp, Homo sapiens
acataatacctaggacagtttg

SEQ ID NO: 7934463 - DNA, 22 bp, Homo sapiens
acataataaaaataacagctca

SEQ ID NO: 7934464 - DNA, 22 bp, Homo sapiens
acataataaaaataacagctca

SEQ ID NO: 7934465 - DNA, 22 bp, Homo sapiens
acataagttatggataaaatgt

SEQ ID NO: 7934466 - DNA, 22 bp, Homo sapiens
acataagttatggataaaatgt

SEQ ID NO: 7934467 - DNA, 22 bp, Homo sapiens
acataataggtacctgaataat

SEQ ID NO: 7934468 - DNA, 22 bp, Homo sapiens
acataataggtacctgaataat

SEQ ID NO: 7934469 - DNA, 22 bp, Homo sapiens
acataataggtacctgaataat

SEQ ID NO: 7934470 - DNA, 22 bp, Homo sapiens
acataataggtacctgaataat

SEQ ID NO: 7934471 - DNA, 22 bp, Homo sapiens
acataataggtacctgaataat

SEQ ID NO: 7934472 - DNA, 22 bp, Homo sapiens
acataataggtacctgaataat

SEQ ID NO: 7934473 - DNA, 22 bp, Homo sapiens
acataatagcatttctaatttg

SEQ ID NO: 7934474 - DNA, 22 bp, Homo sapiens
acataatagcatttctaatttg

SEQ ID NO: 7934475 - DNA, 22 bp, Homo sapiens
acataatagcatttctaatttg

SEQ ID NO: 7934476 - DNA, 22 bp, Homo sapiens
acataatagcatttctaatttg

SEQ ID NO: 7934477 - DNA, 22 bp, Homo sapiens
acataatagcatttctaatttg

SEQ ID NO: 7934478 - DNA, 22 bp, Homo sapiens
acataagtgcacaataaatatt

SEQ ID NO: 7934479 - DNA, 22 bp, Homo sapiens
acataagcttctgaagggatgg

SEQ ID NO: 7934480 - DNA, 21 bp, Homo sapiens
acataactgtcaagtaacgtt

SEQ ID NO: 7934481 - DNA, 21 bp, Homo sapiens
acataactgtcaagtaacgtt

SEQ ID NO: 7934482 - DNA, 22 bp, Homo sapiens
acataacatgtcaatcacccga

SEQ ID NO: 7934483 - DNA, 22 bp, Homo sapiens
acataagttatggataaaatgt

SEQ ID NO: 7934484 - DNA, 22 bp, Homo sapiens
acataagtgcacaataaatatt

SEQ ID NO: 7934485 - DNA, 22 bp, Homo sapiens
acataagtgcacaataaatatt

SEQ ID NO: 7934486 - DNA, 22 bp, Homo sapiens
acataacaatcataggacatag

SEQ ID NO: 7934487 - DNA, 22 bp, Homo sapiens
acataacactcttctctagtga

SEQ ID NO: 7934488 - DNA, 22 bp, Homo sapiens
acataacactcttctctagtga

SEQ ID NO: 7934489 - DNA, 22 bp, Homo sapiens
acataacatagttgacattttt

SEQ ID NO: 7934490 - DNA, 19 bp, Homo sapiens
acatggctctccagtctgg

SEQ ID NO: 7934491 - DNA, 23 bp, Homo sapiens
acatgggaaatgcaaagagaagt

SEQ ID NO: 7934492 - DNA, 22 bp, Homo sapiens
acatgggacagagaaagaggcc

SEQ ID NO: 7934493 - DNA, 22 bp, Homo sapiens
acatggctggcaccttaaattt

SEQ ID NO: 7934494 - DNA, 23 bp, Homo sapiens
acatgggaaatgcaaagagaagt

SEQ ID NO: 7934495 - DNA, 23 bp, Homo sapiens
acatgggaaatgcaaagagaagt

SEQ ID NO: 7934496 - DNA, 21 bp, Homo sapiens
acatgggacctgcgaaaggaa

SEQ ID NO: 7934497 - DNA, 21 bp, Homo sapiens
acatgggacctgcgaaaggaa

SEQ ID NO: 7934498 - DNA, 23 bp, Homo sapiens
acatgggagggacatggaggctg

SEQ ID NO: 7934499 - DNA, 23 bp, Homo sapiens
acatgggagggacatggaggctg

SEQ ID NO: 7934500 - DNA, 22 bp, Homo sapiens
acatggggcccaaagagaggtc

SEQ ID NO: 7934501 - DNA, 22 bp, Homo sapiens
acatggggcccaaagagaggtc

SEQ ID NO: 7934502 - DNA, 22 bp, Homo sapiens
acatggggcccaaagagaggtc

SEQ ID NO: 7934503 - DNA, 22 bp, Homo sapiens
acatgggggctgctgccagcga

SEQ ID NO: 7934504 - DNA, 22 bp, Homo sapiens
acatggtatgtattttaagaga

SEQ ID NO: 7934505 - DNA, 22 bp, Homo sapiens
acatggtaaattggtaaaggac

SEQ ID NO: 7934506 - DNA, 22 bp, Homo sapiens
acatggtaaaagttttggcaat

SEQ ID NO: 7934507 - DNA, 22 bp, Homo sapiens
acatgggatcaatgaggcaggc

SEQ ID NO: 7934508 - DNA, 22 bp, Homo sapiens
acatgggatcaatgaggcaggc

SEQ ID NO: 7934509 - DNA, 22 bp, Homo sapiens
acatgggatcaatgaggcaggc

SEQ ID NO: 7934510 - DNA, 22 bp, Homo sapiens
acatgggatcaatgaggcaggc

SEQ ID NO: 7934511 - DNA, 22 bp, Homo sapiens
acatggggcccaaagagaggtc

SEQ ID NO: 7934512 - DNA, 22 bp, Homo sapiens
acatacttatgctaaaaatata

SEQ ID NO: 7934513 - DNA, 22 bp, Homo sapiens
acatacttagagtaaacaagta

SEQ ID NO: 7934514 - DNA, 22 bp, Homo sapiens
acatacttatgctaaaaatata

SEQ ID NO: 7934515 - DNA, 22 bp, Homo sapiens
acatacttatgctaaaaatata

SEQ ID NO: 7934516 - DNA, 22 bp, Homo sapiens
acatacttaacattaaagtcat

SEQ ID NO: 7934517 - DNA, 22 bp, Homo sapiens
acatacttgaagcaagtgatca

SEQ ID NO: 7934518 - DNA, 22 bp, Homo sapiens
acatacttgaagcaagtgatca

SEQ ID NO: 7934519 - DNA, 22 bp, Homo sapiens
acatacttgaagcaagtgatca

SEQ ID NO: 7934520 - DNA, 22 bp, Homo sapiens
acatactttagcactgcattgt

SEQ ID NO: 7934521 - DNA, 22 bp, Homo sapiens
acatactttgtccttaacgtac

SEQ ID NO: 7934522 - DNA, 22 bp, Homo sapiens
acatacttatgtgtatatgtgt

SEQ ID NO: 7934523 - DNA, 22 bp, Homo sapiens
acatacttatgtgtatatgtgt

SEQ ID NO: 7934524 - DNA, 22 bp, Homo sapiens
acatgccaagatcctcgtcttt

SEQ ID NO: 7934525 - DNA, 23 bp, Homo sapiens
acatagaacagaatatatttgtg

SEQ ID NO: 7934526 - DNA, 22 bp, Homo sapiens
acatagaaatttatttcttaca

SEQ ID NO: 7934527 - DNA, 22 bp, Homo sapiens
acatagaaatttatttcttaca

SEQ ID NO: 7934528 - DNA, 22 bp, Homo sapiens
acatagaaatttatttcttaca

SEQ ID NO: 7934529 - DNA, 22 bp, Homo sapiens
acatactttttaaaagattgct

SEQ ID NO: 7934530 - DNA, 22 bp, Homo sapiens
acatactttgtccttaacgtac

SEQ ID NO: 7934531 - DNA, 22 bp, Homo sapiens
acatactttagcactgcattgt

SEQ ID NO: 7934532 - DNA, 23 bp, Homo sapiens
acatagaacagaatatatttgtg

SEQ ID NO: 7934533 - DNA, 23 bp, Homo sapiens
acatagaacagaatatatttgtg

SEQ ID NO: 7934534 - DNA, 22 bp, Homo sapiens
acattctgtatcatctgtctca

SEQ ID NO: 7934535 - DNA, 22 bp, Homo sapiens
acattctgtatcatctgtctca

SEQ ID NO: 7934536 - DNA, 22 bp, Homo sapiens
acattctgggtgatgttcttca

SEQ ID NO: 7934537 - DNA, 22 bp, Homo sapiens
acattctggatgtctgatgaga

SEQ ID NO: 7934538 - DNA, 22 bp, Homo sapiens
acattctgaatgcctgacagta

SEQ ID NO: 7934539 - DNA, 22 bp, Homo sapiens
acattctgaatgcctgacagta

SEQ ID NO: 7934540 - DNA, 22 bp, Homo sapiens
acattctgaaaaacagtgtttt

SEQ ID NO: 7934541 - DNA, 22 bp, Homo sapiens
acattctgaaatccatgtgggt

SEQ ID NO: 7934542 - DNA, 22 bp, Homo sapiens
acattctctccatgtcttcttt

SEQ ID NO: 7934543 - DNA, 22 bp, Homo sapiens
acattctctccatgtcttcttt

SEQ ID NO: 7934544 - DNA, 22 bp, Homo sapiens
acattcaaccaatgtttgctat

SEQ ID NO: 7934545 - DNA, 22 bp, Homo sapiens
acattcaacatggctggtctag

SEQ ID NO: 7934546 - DNA, 22 bp, Homo sapiens
acattcaacatggctggtctag

SEQ ID NO: 7934547 - DNA, 22 bp, Homo sapiens
acattcaaaattgtggtttaga

SEQ ID NO: 7934548 - DNA, 22 bp, Homo sapiens
acattctcaaatatttgtggaa

SEQ ID NO: 7934549 - DNA, 22 bp, Homo sapiens
acattctatttcatcatgtcta

SEQ ID NO: 7934550 - DNA, 22 bp, Homo sapiens
acattctatttcatcatgtcta

SEQ ID NO: 7934551 - DNA, 22 bp, Homo sapiens
acattctattctgcaggacaag

SEQ ID NO: 7934552 - DNA, 22 bp, Homo sapiens
acattctattctgcaggacaag

SEQ ID NO: 7934553 - DNA, 22 bp, Homo sapiens
acattctattctgcaggacaag

SEQ ID NO: 7934554 - DNA, 22 bp, Homo sapiens
acattctattctgcaggacaag

SEQ ID NO: 7934555 - DNA, 22 bp, Homo sapiens
acattcaagatgcattcactta

SEQ ID NO: 7934556 - DNA, 23 bp, Homo sapiens
acattacttagccagagtctcag

SEQ ID NO: 7934557 - DNA, 22 bp, Homo sapiens
acattacctggcatttgatctt

SEQ ID NO: 7934558 - DNA, 22 bp, Homo sapiens
acattacctggcatttgatctt

SEQ ID NO: 7934559 - DNA, 22 bp, Homo sapiens
acattagaacattaatattggg

SEQ ID NO: 7934560 - DNA, 22 bp, Homo sapiens
acattagaacattaatattggg

SEQ ID NO: 7934561 - DNA, 22 bp, Homo sapiens
acattagaacattaatattggg

SEQ ID NO: 7934562 - DNA, 22 bp, Homo sapiens
acattagaacattaatattggg

SEQ ID NO: 7934563 - DNA, 22 bp, Homo sapiens
acattagatgactctttctttc

SEQ ID NO: 7934564 - DNA, 22 bp, Homo sapiens
acattagataactcagaaagga

SEQ ID NO: 7934565 - DNA, 22 bp, Homo sapiens
acattagataactcagaaagga

SEQ ID NO: 7934566 - DNA, 22 bp, Homo sapiens
acattagagaagcttggagatg

SEQ ID NO: 7934567 - DNA, 22 bp, Homo sapiens
acattagagaagcttggagatg

SEQ ID NO: 7934568 - DNA, 22 bp, Homo sapiens
acattagagaagcttggagatg

SEQ ID NO: 7934569 - DNA, 21 bp, Homo sapiens
acattataattcatattccac

SEQ ID NO: 7934570 - DNA, 21 bp, Homo sapiens
acattataattcatattccac

SEQ ID NO: 7934571 - DNA, 21 bp, Homo sapiens
acattataattcatattccac

SEQ ID NO: 7934572 - DNA, 21 bp, Homo sapiens
acattataattcatattccac

SEQ ID NO: 7934573 - DNA, 22 bp, Homo sapiens
acattatagctttgagtttgga

SEQ ID NO: 7934574 - DNA, 22 bp, Homo sapiens
acattatagctttgagtttgga

SEQ ID NO: 7934575 - DNA, 22 bp, Homo sapiens
acattatagttgctacagagta

SEQ ID NO: 7934576 - DNA, 22 bp, Homo sapiens
acattatccctggcacaactgc

SEQ ID NO: 7934577 - DNA, 22 bp, Homo sapiens
acattcaaaaagcatctgtcac

SEQ ID NO: 7934578 - DNA, 22 bp, Homo sapiens
acattatgagcccactggtgaa

SEQ ID NO: 7934579 - DNA, 22 bp, Homo sapiens
acattatagttgctacagagta

SEQ ID NO: 7934580 - DNA, 22 bp, Homo sapiens
acattatagttgctacagagta

SEQ ID NO: 7934581 - DNA, 22 bp, Homo sapiens
acattatccctggcacaactgc

SEQ ID NO: 7934582 - DNA, 22 bp, Homo sapiens
acattatagttgctacagagta

SEQ ID NO: 7934583 - DNA, 22 bp, Homo sapiens
acatggtgagcggcaggcctat

SEQ ID NO: 7934584 - DNA, 22 bp, Homo sapiens
acatggtgtgctgagaatgaca

SEQ ID NO: 7934585 - DNA, 20 bp, Homo sapiens
acatggtggggactcagagc

SEQ ID NO: 7934586 - DNA, 22 bp, Homo sapiens
acatggtatttctattataatt

SEQ ID NO: 7934587 - DNA, 22 bp, Homo sapiens
acatggtatttctattataatt

SEQ ID NO: 7934588 - DNA, 22 bp, Homo sapiens
acatgtaaaaattaaggtaaga

SEQ ID NO: 7934589 - DNA, 22 bp, Homo sapiens
acatgtaaaaattaaggtaaga

SEQ ID NO: 7934590 - DNA, 22 bp, Homo sapiens
aaggccagctggagggatgagg

SEQ ID NO: 7934591 - DNA, 22 bp, Homo sapiens
aaggccagctggagggatgagg

SEQ ID NO: 7934592 - DNA, 22 bp, Homo sapiens
aaggccagctggagggatgagg

SEQ ID NO: 7934593 - DNA, 22 bp, Homo sapiens
acatgtaaaagataaattaaca

SEQ ID NO: 7934594 - DNA, 22 bp, Homo sapiens
acatgtaaaagataaattaaca

SEQ ID NO: 7934595 - DNA, 22 bp, Homo sapiens
aaggccagcgcagaccattgtc

SEQ ID NO: 7934596 - DNA, 22 bp, Homo sapiens
aaggccagcttgtagggctggt

SEQ ID NO: 7934597 - DNA, 22 bp, Homo sapiens
aaggccagcttgtagggctggt

SEQ ID NO: 7934598 - DNA, 22 bp, Homo sapiens
aaggccagcttgtagggctggt

SEQ ID NO: 7934599 - DNA, 22 bp, Homo sapiens
aaggccagcttgtagggctggt

SEQ ID NO: 7934600 - DNA, 22 bp, Homo sapiens
aaggccagctggagggatgagg

SEQ ID NO: 7934601 - DNA, 22 bp, Homo sapiens
aaggccaggaaattatccctat

SEQ ID NO: 7934602 - DNA, 22 bp, Homo sapiens
aaggccagcttgtagggctggt

SEQ ID NO: 7934603 - DNA, 22 bp, Homo sapiens
aaggccaggacaccaggggact

SEQ ID NO: 7934604 - DNA, 22 bp, Homo sapiens
aaggccaggacaccaggggact

SEQ ID NO: 7934605 - DNA, 22 bp, Homo sapiens
aaggccaggcagggagctgtga

SEQ ID NO: 7934606 - DNA, 22 bp, Homo sapiens
aaggccaggcagggagctgtga

SEQ ID NO: 7934607 - DNA, 22 bp, Homo sapiens
aaggccaggagacttggagtca

SEQ ID NO: 7934608 - DNA, 22 bp, Homo sapiens
aaggccaggcagggagctgtga

SEQ ID NO: 7934609 - DNA, 22 bp, Homo sapiens
aaggccaggccagatgacagtc

SEQ ID NO: 7934610 - DNA, 22 bp, Homo sapiens
aaggccaggccagatgacagtc

SEQ ID NO: 7934611 - DNA, 22 bp, Homo sapiens
aaggccaggccagatgacagtc

SEQ ID NO: 7934612 - DNA, 22 bp, Homo sapiens
aaggccaggcctagcacggagg

SEQ ID NO: 7934613 - DNA, 22 bp, Homo sapiens
aaggccaggcctagcacggagg

SEQ ID NO: 7934614 - DNA, 22 bp, Homo sapiens
aaggccaggccagatgacagtc

SEQ ID NO: 7934615 - DNA, 22 bp, Homo sapiens
aaggccagggatgccagctcgg

SEQ ID NO: 7934616 - DNA, 22 bp, Homo sapiens
aaggccaggcctagcacggagg

SEQ ID NO: 7934617 - DNA, 22 bp, Homo sapiens
aaggccaggcctagcacggagg

SEQ ID NO: 7934618 - DNA, 22 bp, Homo sapiens
aaggccagggatgccagctcgg

SEQ ID NO: 7934619 - DNA, 21 bp, Homo sapiens
acattacagggtgatgtgtct

SEQ ID NO: 7934620 - DNA, 21 bp, Homo sapiens
acattacagggtgatgtgtct

SEQ ID NO: 7934621 - DNA, 22 bp, Homo sapiens
acattacagcaagtttacgtta

SEQ ID NO: 7934622 - DNA, 21 bp, Homo sapiens
acattacagggtgatgtgtct

SEQ ID NO: 7934623 - DNA, 22 bp, Homo sapiens
acattacagcaagtttacgtta

SEQ ID NO: 7934624 - DNA, 22 bp, Homo sapiens
acatgtgttaaaattctcacca

SEQ ID NO: 7934625 - DNA, 22 bp, Homo sapiens
acattacctggcatttgatctt

SEQ ID NO: 7934626 - DNA, 22 bp, Homo sapiens
acattacataagattgtaacct

SEQ ID NO: 7934627 - DNA, 21 bp, Homo sapiens
acattacagggtgatgtgtct

SEQ ID NO: 7934628 - DNA, 22 bp, Homo sapiens
aaggtttccagtgatattgtgg

SEQ ID NO: 7934629 - DNA, 22 bp, Homo sapiens
aaggtttattaaatgttgcatg

SEQ ID NO: 7934630 - DNA, 22 bp, Homo sapiens
aaggtttattaaaagttgatgg

SEQ ID NO: 7934631 - DNA, 22 bp, Homo sapiens
aaggtttaaggtctataaatgt

SEQ ID NO: 7934632 - DNA, 22 bp, Homo sapiens
aaggtttaaggtctataaatgt

SEQ ID NO: 7934633 - DNA, 22 bp, Homo sapiens
aaggttgtctctttattatctt

SEQ ID NO: 7934634 - DNA, 22 bp, Homo sapiens
aaggttgttaagatttggtggt

SEQ ID NO: 7934635 - DNA, 22 bp, Homo sapiens
aaggttctaagggaagccatgc

SEQ ID NO: 7934636 - DNA, 23 bp, Homo sapiens
aaggttgaaattggagcttggat

SEQ ID NO: 7934637 - DNA, 22 bp, Homo sapiens
aaggttcctctctccacccagc

SEQ ID NO: 7934638 - DNA, 22 bp, Homo sapiens
aaggttccctctctggaagcct

SEQ ID NO: 7934639 - DNA, 22 bp, Homo sapiens
accaggcatgatgtggagcaca

SEQ ID NO: 7934640 - DNA, 22 bp, Homo sapiens
accaggcatgatgtggagcaca

SEQ ID NO: 7934641 - DNA, 22 bp, Homo sapiens
accaggcatgatgtggagcaca

SEQ ID NO: 7934642 - DNA, 22 bp, Homo sapiens
accaggcatgatgtggagcaca

SEQ ID NO: 7934643 - DNA, 22 bp, Homo sapiens
accaggcatgatgtggagcaca

SEQ ID NO: 7934644 - DNA, 22 bp, Homo sapiens
accaggccaaaatcatatttac

SEQ ID NO: 7934645 - DNA, 22 bp, Homo sapiens
accaggccaaaatcatatttac

SEQ ID NO: 7934646 - DNA, 21 bp, Homo sapiens
accaggccaggaggctggcac

SEQ ID NO: 7934647 - DNA, 21 bp, Homo sapiens
accaggccaggaggctggcac

SEQ ID NO: 7934648 - DNA, 21 bp, Homo sapiens
accaggccaggaggctggcac

SEQ ID NO: 7934649 - DNA, 22 bp, Homo sapiens
accaggccaacagctaagttaa

SEQ ID NO: 7934650 - DNA, 22 bp, Homo sapiens
aagtaaaacacacagtccaccg

SEQ ID NO: 7934651 - DNA, 22 bp, Homo sapiens
aagtaaaacacacagtccaccg

SEQ ID NO: 7934652 - DNA, 22 bp, Homo sapiens
aagtaaaacacacagtccaccg

SEQ ID NO: 7934653 - DNA, 22 bp, Homo sapiens
aagtaaaacacacagtccaccg

SEQ ID NO: 7934654 - DNA, 22 bp, Homo sapiens
aaggtttttttccagtatctct

SEQ ID NO: 7934655 - DNA, 22 bp, Homo sapiens
aagtaaaagcaggtgtgctggg

SEQ ID NO: 7934656 - DNA, 22 bp, Homo sapiens
aagtaaaagcaggtgtgctggg

SEQ ID NO: 7934657 - DNA, 22 bp, Homo sapiens
aagtaaaagcaggtgtgctggg

SEQ ID NO: 7934658 - DNA, 22 bp, Homo sapiens
aagtaaaacacacagtccaccg

SEQ ID NO: 7934659 - DNA, 22 bp, Homo sapiens
aagtaaaacacacagtccaccg

SEQ ID NO: 7934660 - DNA, 22 bp, Homo sapiens
aagtaaaatgtttcctttatta

SEQ ID NO: 7934661 - DNA, 22 bp, Homo sapiens
aagtaaaatgtttcctttatta

SEQ ID NO: 7934662 - DNA, 22 bp, Homo sapiens
aagtaaaagctttaccatgcgc

SEQ ID NO: 7934663 - DNA, 22 bp, Homo sapiens
aagtaaaagctttaccatgcgc

SEQ ID NO: 7934664 - DNA, 22 bp, Homo sapiens
aagtaaaattcaatcttcactg

SEQ ID NO: 7934665 - DNA, 22 bp, Homo sapiens
aagtaaaattcaatcttcactg

SEQ ID NO: 7934666 - DNA, 22 bp, Homo sapiens
aagtaaaattcaatcttcactg

SEQ ID NO: 7934667 - DNA, 22 bp, Homo sapiens
aagtaaaattcaatcttcactg

SEQ ID NO: 7934668 - DNA, 22 bp, Homo sapiens
aagtaaaatgtttcctttatta

SEQ ID NO: 7934669 - DNA, 22 bp, Homo sapiens
aagtaaaatgtttcctttatta

SEQ ID NO: 7934670 - DNA, 22 bp, Homo sapiens
aagtaaaatgtttcctttatta

SEQ ID NO: 7934671 - DNA, 17 bp, Homo sapiens
accaggcaacacgccca

SEQ ID NO: 7934672 - DNA, 17 bp, Homo sapiens
accaggcaacacgccca

SEQ ID NO: 7934673 - DNA, 22 bp, Homo sapiens
accaggcaactgtgaatgggct

SEQ ID NO: 7934674 - DNA, 22 bp, Homo sapiens
accaggcaaaaccacaggagca

SEQ ID NO: 7934675 - DNA, 22 bp, Homo sapiens
accaggcaaaaccacaggagca

SEQ ID NO: 7934676 - DNA, 22 bp, Homo sapiens
accaggcaaaaccacaggagca

SEQ ID NO: 7934677 - DNA, 22 bp, Homo sapiens
accaggcaaaaccacaggagca

SEQ ID NO: 7934678 - DNA, 22 bp, Homo sapiens
accaggcaaaaccacaggagca

SEQ ID NO: 7934679 - DNA, 22 bp, Homo sapiens
accaggcactcttgtggcagtg

SEQ ID NO: 7934680 - DNA, 22 bp, Homo sapiens
accaggcactcctgaggtctga

SEQ ID NO: 7934681 - DNA, 22 bp, Homo sapiens
accaggcactcttgtggcagtg

SEQ ID NO: 7934682 - DNA, 22 bp, Homo sapiens
accaggcactcttgtggcagtg

SEQ ID NO: 7934683 - DNA, 22 bp, Homo sapiens
accaggcaactgtgaatgggct

SEQ ID NO: 7934684 - DNA, 22 bp, Homo sapiens
accaggcaactgtgaatgggct

SEQ ID NO: 7934685 - DNA, 22 bp, Homo sapiens
accaggcactcctgaggtctga

SEQ ID NO: 7934686 - DNA, 22 bp, Homo sapiens
accaggcactcctgaggtctga

SEQ ID NO: 7934687 - DNA, 22 bp, Homo sapiens
accaggcactcctgaggtctga

SEQ ID NO: 7934688 - DNA, 22 bp, Homo sapiens
accaggcactcctgaggtctga

SEQ ID NO: 7934689 - DNA, 22 bp, Homo sapiens
accaggcagtcaccgtccagga

SEQ ID NO: 7934690 - DNA, 22 bp, Homo sapiens
accaggcagtcaccgtccagga

SEQ ID NO: 7934691 - DNA, 22 bp, Homo sapiens
accaggcagtcaccgtccagga

SEQ ID NO: 7934692 - DNA, 22 bp, Homo sapiens
accaggcagtcaccgtccagga

SEQ ID NO: 7934693 - DNA, 22 bp, Homo sapiens
accaggcatgatgtggagcaca

SEQ ID NO: 7934694 - DNA, 22 bp, Homo sapiens
accaggcagctgggggtgatgt

SEQ ID NO: 7934695 - DNA, 22 bp, Homo sapiens
accaggcagtatggtgctgcaa

SEQ ID NO: 7934696 - DNA, 22 bp, Homo sapiens
accaggcagtatggtgctgcaa

SEQ ID NO: 7934697 - DNA, 22 bp, Homo sapiens
accaggcagtatggtgctgcaa

SEQ ID NO: 7934698 - DNA, 22 bp, Homo sapiens
accaggcagtatggtgctgcaa

SEQ ID NO: 7934699 - DNA, 22 bp, Homo sapiens
accaggcagcactttccttgca

SEQ ID NO: 7934700 - DNA, 22 bp, Homo sapiens
accaggcagcaccaaagccggt

SEQ ID NO: 7934701 - DNA, 22 bp, Homo sapiens
accaggcagctgggggtgatgt

SEQ ID NO: 7934702 - DNA, 22 bp, Homo sapiens
accaggcagagctgggccttaa

SEQ ID NO: 7934703 - DNA, 22 bp, Homo sapiens
accaggcagagctgggccttaa

SEQ ID NO: 7934704 - DNA, 22 bp, Homo sapiens
accaggcagagctgggccttaa

SEQ ID NO: 7934705 - DNA, 22 bp, Homo sapiens
accaggcactcttgtggcagtg

SEQ ID NO: 7934706 - DNA, 22 bp, Homo sapiens
accaggcagagctgggccttaa

SEQ ID NO: 7934707 - DNA, 22 bp, Homo sapiens
accaggcactcttgtggcagtg

SEQ ID NO: 7934708 - DNA, 22 bp, Homo sapiens
accagctgttaggcttggtgct

SEQ ID NO: 7934709 - DNA, 22 bp, Homo sapiens
accagctgttaggcttggtgct

SEQ ID NO: 7934710 - DNA, 22 bp, Homo sapiens
accagctgttatctgtagtatc

SEQ ID NO: 7934711 - DNA, 22 bp, Homo sapiens
accaggaaaaacactgtgttgg

SEQ ID NO: 7934712 - DNA, 22 bp, Homo sapiens
accagctgtgtgacctgaggca

SEQ ID NO: 7934713 - DNA, 22 bp, Homo sapiens
accagctgtgtgacctgaggca

SEQ ID NO: 7934714 - DNA, 22 bp, Homo sapiens
accagctgtgtgacctgaggca

SEQ ID NO: 7934715 - DNA, 22 bp, Homo sapiens
accagctgtgtgacttttaatg

SEQ ID NO: 7934716 - DNA, 22 bp, Homo sapiens
accagctgttaggcttggtgct

SEQ ID NO: 7934717 - DNA, 22 bp, Homo sapiens
accaggaaactgtgcccacgac

SEQ ID NO: 7934718 - DNA, 22 bp, Homo sapiens
accaggaaactctcgtctagtt

SEQ ID NO: 7934719 - DNA, 22 bp, Homo sapiens
accaggaaactgtgcccacgac

SEQ ID NO: 7934720 - DNA, 22 bp, Homo sapiens
accaggaaactctcgtctagtt

SEQ ID NO: 7934721 - DNA, 22 bp, Homo sapiens
accaggaaatttggcaacaaag

SEQ ID NO: 7934722 - DNA, 22 bp, Homo sapiens
accaggaaatttggcaacaaag

SEQ ID NO: 7934723 - DNA, 22 bp, Homo sapiens
accaggagttttgaccaggggc

SEQ ID NO: 7934724 - DNA, 22 bp, Homo sapiens
accaggaaatttggcaacaaag

SEQ ID NO: 7934725 - DNA, 22 bp, Homo sapiens
accagctggtcacctgggcact

SEQ ID NO: 7934726 - DNA, 22 bp, Homo sapiens
accagctggcccatgagcacgt

SEQ ID NO: 7934727 - DNA, 22 bp, Homo sapiens
accagctggtcacctgggcact

SEQ ID NO: 7934728 - DNA, 22 bp, Homo sapiens
accagctggtcacctgggcact

SEQ ID NO: 7934729 - DNA, 22 bp, Homo sapiens
accagctggtcacctgggcact

SEQ ID NO: 7934730 - DNA, 22 bp, Homo sapiens
accagctggcccatgagcacgt

SEQ ID NO: 7934731 - DNA, 22 bp, Homo sapiens
accagctggtcacctgggcact

SEQ ID NO: 7934732 - DNA, 22 bp, Homo sapiens
accagctggcccatgagcacgt

SEQ ID NO: 7934733 - DNA, 22 bp, Homo sapiens
accagctgtgtcctggctgcag

SEQ ID NO: 7934734 - DNA, 22 bp, Homo sapiens
accagctgtgtcctggctgcag

SEQ ID NO: 7934735 - DNA, 22 bp, Homo sapiens
accagctgtgtcctggctgcag

SEQ ID NO: 7934736 - DNA, 22 bp, Homo sapiens
accagctggtcagttgaagatt

SEQ ID NO: 7934737 - DNA, 22 bp, Homo sapiens
accagctgtgtcctggctgcag

SEQ ID NO: 7934738 - DNA, 22 bp, Homo sapiens
accagctggtcagggcttttct

SEQ ID NO: 7934739 - DNA, 22 bp, Homo sapiens
accagctggtcacctgggcact

SEQ ID NO: 7934740 - DNA, 22 bp, Homo sapiens
accagctggtcacctgggcact

SEQ ID NO: 7934741 - DNA, 22 bp, Homo sapiens
acattctgtttccccaaagaga

SEQ ID NO: 7934742 - DNA, 22 bp, Homo sapiens
acattctgtttccccaaagaga

SEQ ID NO: 7934743 - DNA, 22 bp, Homo sapiens
acattctgtcaacagtgagcag

SEQ ID NO: 7934744 - DNA, 22 bp, Homo sapiens
acattctgtcaacagtgagcag

SEQ ID NO: 7934745 - DNA, 22 bp, Homo sapiens
acattctgtgagtcatgtttta

SEQ ID NO: 7934746 - DNA, 22 bp, Homo sapiens
acattctgtcaacagtgagcag

SEQ ID NO: 7934747 - DNA, 22 bp, Homo sapiens
acattctgtgagtcatgtttta

SEQ ID NO: 7934748 - DNA, 22 bp, Homo sapiens
acattctgtgatgctgtcccaa

SEQ ID NO: 7934749 - DNA, 22 bp, Homo sapiens
acattctgtttccccaaagaga

SEQ ID NO: 7934750 - DNA, 22 bp, Homo sapiens
acattcttcagctttgtcaggc

SEQ ID NO: 7934751 - DNA, 22 bp, Homo sapiens
acattcttaacagttaaaaact

SEQ ID NO: 7934752 - DNA, 22 bp, Homo sapiens
acattcttataagagtgaggca

SEQ ID NO: 7934753 - DNA, 22 bp, Homo sapiens
acattttgcccttatttgctga

SEQ ID NO: 7934754 - DNA, 22 bp, Homo sapiens
acattttgcccttatttgctga

SEQ ID NO: 7934755 - DNA, 22 bp, Homo sapiens
accacaggaggatggctgctgg

SEQ ID NO: 7934756 - DNA, 22 bp, Homo sapiens
accacaggaggatggctgctgg

SEQ ID NO: 7934757 - DNA, 22 bp, Homo sapiens
accacaggggaggaatgatgcc

SEQ ID NO: 7934758 - DNA, 22 bp, Homo sapiens
accacaggaggatggctgctgg

SEQ ID NO: 7934759 - DNA, 22 bp, Homo sapiens
accacaggaggatggctgctgg

SEQ ID NO: 7934760 - DNA, 20 bp, Homo sapiens
acattttggcatactctcaa

SEQ ID NO: 7934761 - DNA, 22 bp, Homo sapiens
accacaggacccatgagtcagt

SEQ ID NO: 7934762 - DNA, 22 bp, Homo sapiens
accacaggacccatgagtcagt

SEQ ID NO: 7934763 - DNA, 22 bp, Homo sapiens
accacaggggaggaatgatgcc

SEQ ID NO: 7934764 - DNA, 22 bp, Homo sapiens
accacaggggaggaatgatgcc

SEQ ID NO: 7934765 - DNA, 22 bp, Homo sapiens
accacaggggaggaatgatgcc

SEQ ID NO: 7934766 - DNA, 22 bp, Homo sapiens
accacagtatgaaatctgaaat

SEQ ID NO: 7934767 - DNA, 22 bp, Homo sapiens
accacagtctcgaagcactgca

SEQ ID NO: 7934768 - DNA, 22 bp, Homo sapiens
accacagtctcgaagcactgca

SEQ ID NO: 7934769 - DNA, 22 bp, Homo sapiens
accacagtctcgaagcactgca

SEQ ID NO: 7934770 - DNA, 22 bp, Homo sapiens
accacagggtaaagttagatat

SEQ ID NO: 7934771 - DNA, 22 bp, Homo sapiens
accacagtatgaaatctgaaat

SEQ ID NO: 7934772 - DNA, 22 bp, Homo sapiens
accacagtatgaaatctgaaat

SEQ ID NO: 7934773 - DNA, 22 bp, Homo sapiens
accacagtttcattcatgcagg

SEQ ID NO: 7934774 - DNA, 22 bp, Homo sapiens
accacagtttcattcatgcagg

SEQ ID NO: 7934775 - DNA, 22 bp, Homo sapiens
accacagtttagtccaatgaca

SEQ ID NO: 7934776 - DNA, 18 bp, Homo sapiens
accacatgatatcttgcc

SEQ ID NO: 7934777 - DNA, 22 bp, Homo sapiens
accacagtttagtccaatgaca

SEQ ID NO: 7934778 - DNA, 22 bp, Homo sapiens
accacagtctcgaagcactgca

SEQ ID NO: 7934779 - DNA, 18 bp, Homo sapiens
accacagtgcttaatatg

SEQ ID NO: 7934780 - DNA, 18 bp, Homo sapiens
accacagtgcttaatatg

SEQ ID NO: 7934781 - DNA, 22 bp, Homo sapiens
accacagtgggccacaagaagt

SEQ ID NO: 7934782 - DNA, 22 bp, Homo sapiens
accaccccagaatttttcaagg

SEQ ID NO: 7934783 - DNA, 22 bp, Homo sapiens
accaccccaaatgaacctctgt

SEQ ID NO: 7934784 - DNA, 22 bp, Homo sapiens
accaccccagaatttttcaagg

SEQ ID NO: 7934785 - DNA, 22 bp, Homo sapiens
accacccccttgggtgtggaag

SEQ ID NO: 7934786 - DNA, 22 bp, Homo sapiens
accacccccttgggtgtggaag

SEQ ID NO: 7934787 - DNA, 22 bp, Homo sapiens
accaccccagaatttttcaagg

SEQ ID NO: 7934788 - DNA, 22 bp, Homo sapiens
accacccccttgggtgtggaag

SEQ ID NO: 7934789 - DNA, 21 bp, Homo sapiens
accaccctgtttatccagagg

SEQ ID NO: 7934790 - DNA, 22 bp, Homo sapiens
accaccctcagcagagctgaaa

SEQ ID NO: 7934791 - DNA, 22 bp, Homo sapiens
accacccagccagcttctccct

SEQ ID NO: 7934792 - DNA, 22 bp, Homo sapiens
accacccattcagaaacactga

SEQ ID NO: 7934793 - DNA, 22 bp, Homo sapiens
accaccccaaatgaacctctgt

SEQ ID NO: 7934794 - DNA, 22 bp, Homo sapiens
accaccccaaatgaacctctgt

SEQ ID NO: 7934795 - DNA, 22 bp, Homo sapiens
accacccattcagaaacactga

SEQ ID NO: 7934796 - DNA, 22 bp, Homo sapiens
accaccccaaatgaacctctgt

SEQ ID NO: 7934797 - DNA, 22 bp, Homo sapiens
accacccacctcacagcatagt

SEQ ID NO: 7934798 - DNA, 22 bp, Homo sapiens
accacccacctcacagcatagt

SEQ ID NO: 7934799 - DNA, 22 bp, Homo sapiens
accacatttctgaatagcataa

SEQ ID NO: 7934800 - DNA, 22 bp, Homo sapiens
aagggcagctgacagatgctta

SEQ ID NO: 7934801 - DNA, 22 bp, Homo sapiens
aagggcagctgacagatgctta

SEQ ID NO: 7934802 - DNA, 22 bp, Homo sapiens
aagggcagctgacagatgctta

SEQ ID NO: 7934803 - DNA, 22 bp, Homo sapiens
aagggcagctgacagatgctta

SEQ ID NO: 7934804 - DNA, 22 bp, Homo sapiens
aagggcagctattatcgtcatc

SEQ ID NO: 7934805 - DNA, 22 bp, Homo sapiens
aagggcagctattatcgtcatc

SEQ ID NO: 7934806 - DNA, 22 bp, Homo sapiens
aagggcagctattatcgtcatc

SEQ ID NO: 7934807 - DNA, 22 bp, Homo sapiens
aagggcagctgacagatgctta

SEQ ID NO: 7934808 - DNA, 22 bp, Homo sapiens
aagggcagctattatcgtcatc

SEQ ID NO: 7934809 - DNA, 22 bp, Homo sapiens
aagggcagctattatcgtcatc

SEQ ID NO: 7934810 - DNA, 22 bp, Homo sapiens
aagggcagcctgactcacggtc

SEQ ID NO: 7934811 - DNA, 22 bp, Homo sapiens
aagggcagcctgactcacggtc

SEQ ID NO: 7934812 - DNA, 22 bp, Homo sapiens
aagggcagcctgactcacggtc

SEQ ID NO: 7934813 - DNA, 22 bp, Homo sapiens
accactgcccatggtgaaaact

SEQ ID NO: 7934814 - DNA, 22 bp, Homo sapiens
aagggcagagggaatcccacat

SEQ ID NO: 7934815 - DNA, 22 bp, Homo sapiens
aagggcagagggaatcccacat

SEQ ID NO: 7934816 - DNA, 22 bp, Homo sapiens
aagggcagcctgactcacggtc

SEQ ID NO: 7934817 - DNA, 22 bp, Homo sapiens
aagggcagcctgactcacggtc

SEQ ID NO: 7934818 - DNA, 22 bp, Homo sapiens
aagggcagcctgactcacggtc

SEQ ID NO: 7934819 - DNA, 22 bp, Homo sapiens
accacctcatcaagctggattg

SEQ ID NO: 7934820 - DNA, 17 bp, Homo sapiens
accacctctcaccagca

SEQ ID NO: 7934821 - DNA, 17 bp, Homo sapiens
accacctctcaccagca

SEQ ID NO: 7934822 - DNA, 22 bp, Homo sapiens
accaccttcctgcgtgtctctt

SEQ ID NO: 7934823 - DNA, 22 bp, Homo sapiens
accaccttatatgatgggtact

SEQ ID NO: 7934824 - DNA, 22 bp, Homo sapiens
accactataattagtttgttaa

SEQ ID NO: 7934825 - DNA, 22 bp, Homo sapiens
accactgagtgtccttcagggt

SEQ ID NO: 7934826 - DNA, 22 bp, Homo sapiens
aagggcagcttaaattggtagc

SEQ ID NO: 7934827 - DNA, 22 bp, Homo sapiens
aagggcagcttaaattggtagc

SEQ ID NO: 7934828 - DNA, 22 bp, Homo sapiens
aagggcagctgacagatgctta

SEQ ID NO: 7934829 - DNA, 22 bp, Homo sapiens
accagcacggattagaatgctt

SEQ ID NO: 7934830 - DNA, 22 bp, Homo sapiens
accagcacggattagaatgctt

SEQ ID NO: 7934831 - DNA, 22 bp, Homo sapiens
accagcacttccagaggtcagg

SEQ ID NO: 7934832 - DNA, 22 bp, Homo sapiens
accagcacttccagaggtcagg

SEQ ID NO: 7934833 - DNA, 22 bp, Homo sapiens
aagggcagcttaaattggtagc

SEQ ID NO: 7934834 - DNA, 22 bp, Homo sapiens
aagggcaggaaaagatggatgt

SEQ ID NO: 7934835 - DNA, 22 bp, Homo sapiens
aagggcaggaaaagatggatgt

SEQ ID NO: 7934836 - DNA, 22 bp, Homo sapiens
accagcagagttgaggaggaca

SEQ ID NO: 7934837 - DNA, 22 bp, Homo sapiens
accagctgagtaggggagggcc

SEQ ID NO: 7934838 - DNA, 22 bp, Homo sapiens
accagcagagttgaggaggaca

SEQ ID NO: 7934839 - DNA, 22 bp, Homo sapiens
accagctgagttctcggatggt

SEQ ID NO: 7934840 - DNA, 22 bp, Homo sapiens
accagctgagttctcggatggt

SEQ ID NO: 7934841 - DNA, 22 bp, Homo sapiens
accagctgatttaagaataaag

SEQ ID NO: 7934842 - DNA, 22 bp, Homo sapiens
accagctgccaagggctacact

SEQ ID NO: 7934843 - DNA, 22 bp, Homo sapiens
accagctgccaagggctacact

SEQ ID NO: 7934844 - DNA, 22 bp, Homo sapiens
accagctgcctggtctatctgc

SEQ ID NO: 7934845 - DNA, 22 bp, Homo sapiens
accagctgccaagggctacact

SEQ ID NO: 7934846 - DNA, 23 bp, Homo sapiens
accagctgccctgaactttgtgc

SEQ ID NO: 7934847 - DNA, 22 bp, Homo sapiens
accagctgccttttcttagtag

SEQ ID NO: 7934848 - DNA, 23 bp, Homo sapiens
accagctgccctgaactttgtgc

SEQ ID NO: 7934849 - DNA, 22 bp, Homo sapiens
accagctgctgattgctaaatg

SEQ ID NO: 7934850 - DNA, 22 bp, Homo sapiens
agctcaggtctcaggaggtgtc

SEQ ID NO: 7934851 - DNA, 22 bp, Homo sapiens
agctcaggtctcaggaggtgtc

SEQ ID NO: 7934852 - DNA, 22 bp, Homo sapiens
agctcagttggccactctttca

SEQ ID NO: 7934853 - DNA, 22 bp, Homo sapiens
agctcatggtgctatctcaggg

SEQ ID NO: 7934854 - DNA, 22 bp, Homo sapiens
agctcaggtctcaggaggtgtc

SEQ ID NO: 7934855 - DNA, 22 bp, Homo sapiens
agctcaggtctcaggaggtgtc

SEQ ID NO: 7934856 - DNA, 22 bp, Homo sapiens
agctcaggtcattccagggatg

SEQ ID NO: 7934857 - DNA, 22 bp, Homo sapiens
agctcaggtctcaggaggtgtc

SEQ ID NO: 7934858 - DNA, 22 bp, Homo sapiens
agctcaggtcattccagggatg

SEQ ID NO: 7934859 - DNA, 22 bp, Homo sapiens
agctcagggctccaggaccgct

SEQ ID NO: 7934860 - DNA, 22 bp, Homo sapiens
agctcaggtagactcagcatct

SEQ ID NO: 7934861 - DNA, 22 bp, Homo sapiens
agctcaggtagactcagcatct

SEQ ID NO: 7934862 - DNA, 22 bp, Homo sapiens
agctcaggtagactcagcatct

SEQ ID NO: 7934863 - DNA, 22 bp, Homo sapiens
agctcaggtcattccagggatg

SEQ ID NO: 7934864 - DNA, 22 bp, Homo sapiens
agctcaggtcattccagggatg

SEQ ID NO: 7934865 - DNA, 22 bp, Homo sapiens
agctccaaggttgaggagtgag

SEQ ID NO: 7934866 - DNA, 22 bp, Homo sapiens
agctccaaggttgaggagtgag

SEQ ID NO: 7934867 - DNA, 22 bp, Homo sapiens
agctccactccctgcctgtttc

SEQ ID NO: 7934868 - DNA, 22 bp, Homo sapiens
agctccactccctgcctgtttc

SEQ ID NO: 7934869 - DNA, 22 bp, Homo sapiens
agctccactaaacagaatactc

SEQ ID NO: 7934870 - DNA, 22 bp, Homo sapiens
agctccactaaacagaatactc

SEQ ID NO: 7934871 - DNA, 22 bp, Homo sapiens
agctccagaaaggtacacacag

SEQ ID NO: 7934872 - DNA, 22 bp, Homo sapiens
agctccagaaaggtacacacag

SEQ ID NO: 7934873 - DNA, 23 bp, Homo sapiens
agctccaggtgattgtaatgtgt

SEQ ID NO: 7934874 - DNA, 23 bp, Homo sapiens
agctccaggtgattgtaatgtgt

SEQ ID NO: 7934875 - DNA, 23 bp, Homo sapiens
agctccaggtgattgtaatgtgt

SEQ ID NO: 7934876 - DNA, 22 bp, Homo sapiens
agctccaggtcagtgcacccct

SEQ ID NO: 7934877 - DNA, 22 bp, Homo sapiens
agctccaggtcagtgcacccct

SEQ ID NO: 7934878 - DNA, 22 bp, Homo sapiens
agctccaggtcagtgcacccct

SEQ ID NO: 7934879 - DNA, 22 bp, Homo sapiens
agctcagggcgatctgtctcgg

SEQ ID NO: 7934880 - DNA, 22 bp, Homo sapiens
agctcagggcgatctgtctcgg

SEQ ID NO: 7934881 - DNA, 22 bp, Homo sapiens
agctcagggccatcggcccttt

SEQ ID NO: 7934882 - DNA, 22 bp, Homo sapiens
agctcagggctccaggaccgct

SEQ ID NO: 7934883 - DNA, 22 bp, Homo sapiens
agctcagggctccaggaccgct

SEQ ID NO: 7934884 - DNA, 22 bp, Homo sapiens
agctcagggcgatctgtctcgg

SEQ ID NO: 7934885 - DNA, 22 bp, Homo sapiens
agctcagggcgatctgtctcgg

SEQ ID NO: 7934886 - DNA, 22 bp, Homo sapiens
agctcaggctctgcagggacta

SEQ ID NO: 7934887 - DNA, 22 bp, Homo sapiens
agctcaggctctgcagggacta

SEQ ID NO: 7934888 - DNA, 22 bp, Homo sapiens
agctcaggctctgcagggacta

SEQ ID NO: 7934889 - DNA, 22 bp, Homo sapiens
agctcagggcaaagactcaaat

SEQ ID NO: 7934890 - DNA, 22 bp, Homo sapiens
agctcagggcaaagactcaaat

SEQ ID NO: 7934891 - DNA, 22 bp, Homo sapiens
agctcaggctctgcagggacta

SEQ ID NO: 7934892 - DNA, 22 bp, Homo sapiens
agccttagatttgggcaagaac

SEQ ID NO: 7934893 - DNA, 22 bp, Homo sapiens
agctcaagctacacacagagtc

SEQ ID NO: 7934894 - DNA, 23 bp, Homo sapiens
agctcaaggcagtccacatttcc

SEQ ID NO: 7934895 - DNA, 22 bp, Homo sapiens
agccttagatttgggcaagaac

SEQ ID NO: 7934896 - DNA, 22 bp, Homo sapiens
agctcaagctacacacagagtc

SEQ ID NO: 7934897 - DNA, 22 bp, Homo sapiens
agctcaagtgcaagcattctat

SEQ ID NO: 7934898 - DNA, 22 bp, Homo sapiens
agctcaagtgcagttgggggat

SEQ ID NO: 7934899 - DNA, 22 bp, Homo sapiens
agctcaagtatttgggatttgt

SEQ ID NO: 7934900 - DNA, 22 bp, Homo sapiens
agctcaagtgcagttgggggat

SEQ ID NO: 7934901 - DNA, 22 bp, Homo sapiens
agctcaagtatttgggatttgt

SEQ ID NO: 7934902 - DNA, 22 bp, Homo sapiens
agctcaagtgcaagcattctat

SEQ ID NO: 7934903 - DNA, 22 bp, Homo sapiens
agctcaggccggagctacaggc

SEQ ID NO: 7934904 - DNA, 22 bp, Homo sapiens
agctcaagttcttttaccatat

SEQ ID NO: 7934905 - DNA, 22 bp, Homo sapiens
agctcaagttcttttaccatat

SEQ ID NO: 7934906 - DNA, 22 bp, Homo sapiens
agctcaggccggagctacaggc

SEQ ID NO: 7934907 - DNA, 22 bp, Homo sapiens
agctcaggccggagctacaggc

SEQ ID NO: 7934908 - DNA, 22 bp, Homo sapiens
agctcaggctctgcagggacta

SEQ ID NO: 7934909 - DNA, 22 bp, Homo sapiens
agctcaggctctgcagggacta

SEQ ID NO: 7934910 - DNA, 22 bp, Homo sapiens
agccttagagacttaaaacagg

SEQ ID NO: 7934911 - DNA, 22 bp, Homo sapiens
agccttagaggaaaacattagt

SEQ ID NO: 7934912 - DNA, 22 bp, Homo sapiens
agccttagaggaaaacattagt

SEQ ID NO: 7934913 - DNA, 22 bp, Homo sapiens
agccttagataaatgctagctc

SEQ ID NO: 7934914 - DNA, 22 bp, Homo sapiens
agccttaaatgctagattcata

SEQ ID NO: 7934915 - DNA, 21 bp, Homo sapiens
agcctgttggtttactgctca

SEQ ID NO: 7934916 - DNA, 22 bp, Homo sapiens
agcctgttctggtactccaggt

SEQ ID NO: 7934917 - DNA, 22 bp, Homo sapiens
agcctgtgtgctttggacaggg

SEQ ID NO: 7934918 - DNA, 22 bp, Homo sapiens
agcctgtgtgctttggacaggg

SEQ ID NO: 7934919 - DNA, 22 bp, Homo sapiens
agcctgtgttgctctggcgata

SEQ ID NO: 7934920 - DNA, 22 bp, Homo sapiens
agcctgttcagtccactctcca

SEQ ID NO: 7934921 - DNA, 22 bp, Homo sapiens
agcctgttctccctccagacac

SEQ ID NO: 7934922 - DNA, 22 bp, Homo sapiens
agcctgtggatccctgcactgg

SEQ ID NO: 7934923 - DNA, 22 bp, Homo sapiens
agcctgtggatccctgcactgg

SEQ ID NO: 7934924 - DNA, 22 bp, Homo sapiens
agcctgtggaaactgggtgcag

SEQ ID NO: 7934925 - DNA, 22 bp, Homo sapiens
agcctgtgctgtgtttgctcca

SEQ ID NO: 7934926 - DNA, 20 bp, Homo sapiens
agcctgtgtacttgcctgtg

SEQ ID NO: 7934927 - DNA, 20 bp, Homo sapiens
agcctgtgtacttgcctgtg

SEQ ID NO: 7934928 - DNA, 22 bp, Homo sapiens
agcctgtgtcctcatctgcagc

SEQ ID NO: 7934929 - DNA, 22 bp, Homo sapiens
agcctgtgtgaagccctcagag

SEQ ID NO: 7934930 - DNA, 22 bp, Homo sapiens
agcctgtgtgctttggacaggg

SEQ ID NO: 7934931 - DNA, 22 bp, Homo sapiens
agcctggcggtcgtcggtcagg

SEQ ID NO: 7934932 - DNA, 22 bp, Homo sapiens
agcctggcggtcgtcggtcagg

SEQ ID NO: 7934933 - DNA, 22 bp, Homo sapiens
agcctggctaaattctcccatg

SEQ ID NO: 7934934 - DNA, 22 bp, Homo sapiens
agcctggctaaattctcccatg

SEQ ID NO: 7934935 - DNA, 22 bp, Homo sapiens
agcctggctgggaagagcctct

SEQ ID NO: 7934936 - DNA, 22 bp, Homo sapiens
agcctggctgggaagagcctct

SEQ ID NO: 7934937 - DNA, 22 bp, Homo sapiens
agcctggctgtaacctcatggt

SEQ ID NO: 7934938 - DNA, 22 bp, Homo sapiens
agcctggctgtaacctcatggt

SEQ ID NO: 7934939 - DNA, 22 bp, Homo sapiens
agcctggctgtaacctcatggt

SEQ ID NO: 7934940 - DNA, 22 bp, Homo sapiens
agcctggctgtaacctcatggt

SEQ ID NO: 7934941 - DNA, 22 bp, Homo sapiens
agcctggctgtaacctcatggt

SEQ ID NO: 7934942 - DNA, 22 bp, Homo sapiens
agcctggctgtaacctcatggt

SEQ ID NO: 7934943 - DNA, 22 bp, Homo sapiens
agcctggctgtaacctcatggt

SEQ ID NO: 7934944 - DNA, 22 bp, Homo sapiens
agcctggctgggaagagcctct

SEQ ID NO: 7934945 - DNA, 22 bp, Homo sapiens
agcctggcttaatcctcctttt

SEQ ID NO: 7934946 - DNA, 22 bp, Homo sapiens
agcctggcttaatcctcctttt

SEQ ID NO: 7934947 - DNA, 22 bp, Homo sapiens
agcctggcttaatcctcctttt

SEQ ID NO: 7934948 - DNA, 22 bp, Homo sapiens
agcctgtgaaatctctgccact

SEQ ID NO: 7934949 - DNA, 22 bp, Homo sapiens
agcctgtgactctgtgaaacca

SEQ ID NO: 7934950 - DNA, 22 bp, Homo sapiens
agcctgtgagggatgctgcagt

SEQ ID NO: 7934951 - DNA, 22 bp, Homo sapiens
agcctgtgagggatgctgcagt

SEQ ID NO: 7934952 - DNA, 22 bp, Homo sapiens
agcctgtgagggatgctgcagt

SEQ ID NO: 7934953 - DNA, 22 bp, Homo sapiens
agcctgtgactctgtgaaacca

SEQ ID NO: 7934954 - DNA, 22 bp, Homo sapiens
acagacatgggccgctcttgag

SEQ ID NO: 7934955 - DNA, 22 bp, Homo sapiens
acagacatgggccgctcttgag

SEQ ID NO: 7934956 - DNA, 22 bp, Homo sapiens
acagacatgggccgctcttgag

SEQ ID NO: 7934957 - DNA, 22 bp, Homo sapiens
agcccctgtcctctctgatgac

SEQ ID NO: 7934958 - DNA, 22 bp, Homo sapiens
acagacatggaccaagcactgt

SEQ ID NO: 7934959 - DNA, 22 bp, Homo sapiens
acagacatggaccaagcactgt

SEQ ID NO: 7934960 - DNA, 22 bp, Homo sapiens
acagacatgctgtttgggtggt

SEQ ID NO: 7934961 - DNA, 22 bp, Homo sapiens
acagacatggaccaagcactgt

SEQ ID NO: 7934962 - DNA, 22 bp, Homo sapiens
acagacatggaccaagcactgt

SEQ ID NO: 7934963 - DNA, 22 bp, Homo sapiens
agccctgcacaggtctgtggct

SEQ ID NO: 7934964 - DNA, 22 bp, Homo sapiens
agccctgcacaggtctgtggct

SEQ ID NO: 7934965 - DNA, 22 bp, Homo sapiens
agccctgcacaggtctgtggct

SEQ ID NO: 7934966 - DNA, 22 bp, Homo sapiens
agcccctgtttttccagtcaga

SEQ ID NO: 7934967 - DNA, 22 bp, Homo sapiens
agccctgcaggaggtgggagag

SEQ ID NO: 7934968 - DNA, 22 bp, Homo sapiens
agccctgcacagttcgggagga

SEQ ID NO: 7934969 - DNA, 22 bp, Homo sapiens
agccctgcaggatgagggaggt

SEQ ID NO: 7934970 - DNA, 22 bp, Homo sapiens
agccctgcataaatcagttggt

SEQ ID NO: 7934971 - DNA, 22 bp, Homo sapiens
agccctgcaggatgagggaggt

SEQ ID NO: 7934972 - DNA, 22 bp, Homo sapiens
agccctggggctggtcttggaa

SEQ ID NO: 7934973 - DNA, 22 bp, Homo sapiens
agccctggggctggtcttggaa

SEQ ID NO: 7934974 - DNA, 22 bp, Homo sapiens
agccctggggctggtgcttacc

SEQ ID NO: 7934975 - DNA, 22 bp, Homo sapiens
agccctggggctggtcttggaa

SEQ ID NO: 7934976 - DNA, 22 bp, Homo sapiens
agccctggggctggtcttggaa

SEQ ID NO: 7934977 - DNA, 22 bp, Homo sapiens
agccctgcgtgccaggggactg

SEQ ID NO: 7934978 - DNA, 22 bp, Homo sapiens
agccctgcgatcgtgatttctt

SEQ ID NO: 7934979 - DNA, 22 bp, Homo sapiens
agccctgcgctcacgttctgca

SEQ ID NO: 7934980 - DNA, 22 bp, Homo sapiens
agccctgcatagaagggaacac

SEQ ID NO: 7934981 - DNA, 22 bp, Homo sapiens
agccctgccattctctggagct

SEQ ID NO: 7934982 - DNA, 22 bp, Homo sapiens
agccctgcctctccaatgccca

SEQ ID NO: 7934983 - DNA, 22 bp, Homo sapiens
agccctgccctgccatgtggca

SEQ ID NO: 7934984 - DNA, 22 bp, Homo sapiens
agccctgccctgccatgtggca

SEQ ID NO: 7934985 - DNA, 22 bp, Homo sapiens
agccctgccctgccatgtggca

SEQ ID NO: 7934986 - DNA, 22 bp, Homo sapiens
agccctggtagcctgctgccat

SEQ ID NO: 7934987 - DNA, 20 bp, Homo sapiens
agccctgtaaatcccctgga

SEQ ID NO: 7934988 - DNA, 22 bp, Homo sapiens
agccctgggttagggtgggagc

SEQ ID NO: 7934989 - DNA, 22 bp, Homo sapiens
agccctggtagcctgctgccat

SEQ ID NO: 7934990 - DNA, 22 bp, Homo sapiens
agccctggtagcctgctgccat

SEQ ID NO: 7934991 - DNA, 22 bp, Homo sapiens
agccctggtttgcagcatttgc

SEQ ID NO: 7934992 - DNA, 22 bp, Homo sapiens
agccctggtagcctgctgccat

SEQ ID NO: 7934993 - DNA, 22 bp, Homo sapiens
agccctggtagcctgctgccat

SEQ ID NO: 7934994 - DNA, 22 bp, Homo sapiens
agccctgggtcccagtcctggc

SEQ ID NO: 7934995 - DNA, 22 bp, Homo sapiens
agccctgggttagggtgggagc

SEQ ID NO: 7934996 - DNA, 22 bp, Homo sapiens
agccctgggttagggtgggagc

SEQ ID NO: 7934997 - DNA, 22 bp, Homo sapiens
agccctgggttagggtgggagc

SEQ ID NO: 7934998 - DNA, 22 bp, Homo sapiens
agccctgggttagggtgggagc

SEQ ID NO: 7934999 - DNA, 22 bp, Homo sapiens
agccctggggtgcagaaccatg

SEQ ID NO: 7935000 - DNA, 22 bp, Homo sapiens
agccctggggtgcagaaccatg

SEQ ID NO: 7935001 - DNA, 22 bp, Homo sapiens
agccctgggtcccagtcctggc

SEQ ID NO: 7935002 - DNA, 22 bp, Homo sapiens
agccctgggtcccagtcctggc

SEQ ID NO: 7935003 - DNA, 22 bp, Homo sapiens
agcctggccaggcctgcccagg

SEQ ID NO: 7935004 - DNA, 22 bp, Homo sapiens
agcctggccaggcctgcccagg

SEQ ID NO: 7935005 - DNA, 22 bp, Homo sapiens
agcctggccactcagggcctga

SEQ ID NO: 7935006 - DNA, 22 bp, Homo sapiens
agcctggccaggcctgcccagg

SEQ ID NO: 7935007 - DNA, 22 bp, Homo sapiens
agcctggccaggcctgcccagg

SEQ ID NO: 7935008 - DNA, 22 bp, Homo sapiens
agcctgctgggaagggaggctt

SEQ ID NO: 7935009 - DNA, 22 bp, Homo sapiens
agcctgctgggaagggaggctt

SEQ ID NO: 7935010 - DNA, 22 bp, Homo sapiens
agcctgcttcctcagggaacaa

SEQ ID NO: 7935011 - DNA, 22 bp, Homo sapiens
agcctgcttccctttgtgcccc

SEQ ID NO: 7935012 - DNA, 22 bp, Homo sapiens
agcctggcggtcgtcggtcagg

SEQ ID NO: 7935013 - DNA, 22 bp, Homo sapiens
agcctggcctgggcaggcacat

SEQ ID NO: 7935014 - DNA, 22 bp, Homo sapiens
agcctggcctgggcaggcacat

SEQ ID NO: 7935015 - DNA, 22 bp, Homo sapiens
agcctggcctgggcaggcacat

SEQ ID NO: 7935016 - DNA, 22 bp, Homo sapiens
agcctggccctgctgaactctg

SEQ ID NO: 7935017 - DNA, 21 bp, Homo sapiens
agcctggcccagggggaggct

SEQ ID NO: 7935018 - DNA, 21 bp, Homo sapiens
agcctggcccagggggaggct

SEQ ID NO: 7935019 - DNA, 21 bp, Homo sapiens
agcctggcccagggggaggct

SEQ ID NO: 7935020 - DNA, 22 bp, Homo sapiens
agcctggccctgctgaactctg

SEQ ID NO: 7935021 - DNA, 21 bp, Homo sapiens
agcctggcccagggggaggct

SEQ ID NO: 7935022 - DNA, 22 bp, Homo sapiens
agcattccacactgaagtctgc

SEQ ID NO: 7935023 - DNA, 22 bp, Homo sapiens
agcattccacactgaagtctgc

SEQ ID NO: 7935024 - DNA, 22 bp, Homo sapiens
agcattccacactgaagtctgc

SEQ ID NO: 7935025 - DNA, 21 bp, Homo sapiens
agcattcttggccagtccacc

SEQ ID NO: 7935026 - DNA, 22 bp, Homo sapiens
agcattctcagaatgtcatttt

SEQ ID NO: 7935027 - DNA, 22 bp, Homo sapiens
agcattctcagaatgtcatttt

SEQ ID NO: 7935028 - DNA, 23 bp, Homo sapiens
agcattctctccaacatttaaca

SEQ ID NO: 7935029 - DNA, 22 bp, Homo sapiens
agcatctttaggaagagaaaga

SEQ ID NO: 7935030 - DNA, 22 bp, Homo sapiens
agcatcttgaaatataaagtca

SEQ ID NO: 7935031 - DNA, 20 bp, Homo sapiens
agcatcttgcatcttcaagt

SEQ ID NO: 7935032 - DNA, 22 bp, Homo sapiens
agcattcatgatgacaacagga

SEQ ID NO: 7935033 - DNA, 22 bp, Homo sapiens
agcattcaatgattggacttgc

SEQ ID NO: 7935034 - DNA, 22 bp, Homo sapiens
agcattcatgatgacaacagga

SEQ ID NO: 7935035 - DNA, 22 bp, Homo sapiens
agcattcaagtaattcacttgg

SEQ ID NO: 7935036 - DNA, 22 bp, Homo sapiens
agcattccacactgaagtctgc

SEQ ID NO: 7935037 - DNA, 22 bp, Homo sapiens
agcattccacactgaagtctgc

SEQ ID NO: 7935038 - DNA, 22 bp, Homo sapiens
agcattccacactgaagtctgc

SEQ ID NO: 7935039 - DNA, 22 bp, Homo sapiens
agcattcattgctagaatgtaa

SEQ ID NO: 7935040 - DNA, 22 bp, Homo sapiens
agcattcattgctagaatgtaa

SEQ ID NO: 7935041 - DNA, 22 bp, Homo sapiens
agcattcatgatgacaacagga

SEQ ID NO: 7935042 - DNA, 22 bp, Homo sapiens
agcatctgcttaatggcttaac

SEQ ID NO: 7935043 - DNA, 22 bp, Homo sapiens
agcatctggatggaaagcaagg

SEQ ID NO: 7935044 - DNA, 22 bp, Homo sapiens
agcatctggcagaaagtcagaa

SEQ ID NO: 7935045 - DNA, 22 bp, Homo sapiens
agcatctggtcatgagtgagaa

SEQ ID NO: 7935046 - DNA, 22 bp, Homo sapiens
agcatctggtcatgagtgagaa

SEQ ID NO: 7935047 - DNA, 22 bp, Homo sapiens
agcatctggcctggttactttt

SEQ ID NO: 7935048 - DNA, 21 bp, Homo sapiens
agcatctgaggcagtttccta

SEQ ID NO: 7935049 - DNA, 22 bp, Homo sapiens
agcatctgcatattgggagacc

SEQ ID NO: 7935050 - DNA, 22 bp, Homo sapiens
agcatctgcatattgggagacc

SEQ ID NO: 7935051 - DNA, 22 bp, Homo sapiens
agcatcctccttcccagagatg

SEQ ID NO: 7935052 - DNA, 22 bp, Homo sapiens
agcatcctccttcccagagatg

SEQ ID NO: 7935053 - DNA, 22 bp, Homo sapiens
agcatcccatgactctggagga

SEQ ID NO: 7935054 - DNA, 22 bp, Homo sapiens
agcatcccatgactctggagga

SEQ ID NO: 7935055 - DNA, 22 bp, Homo sapiens
agcatcctgcttgctgtctgtg

SEQ ID NO: 7935056 - DNA, 19 bp, Homo sapiens
agcatctccctgatcattc

SEQ ID NO: 7935057 - DNA, 22 bp, Homo sapiens
acagaacagagggttttagaat

SEQ ID NO: 7935058 - DNA, 22 bp, Homo sapiens
agccaggctcaaggcctgctcc

SEQ ID NO: 7935059 - DNA, 22 bp, Homo sapiens
acagaacaagacctgcttattg

SEQ ID NO: 7935060 - DNA, 20 bp, Homo sapiens
agccaggctcaagctccccc

SEQ ID NO: 7935061 - DNA, 20 bp, Homo sapiens
agccaggctcaagctccccc

SEQ ID NO: 7935062 - DNA, 20 bp, Homo sapiens
agccaggctcaagctccccc

SEQ ID NO: 7935063 - DNA, 22 bp, Homo sapiens
agccaggctcaaggcctgctcc

SEQ ID NO: 7935064 - DNA, 22 bp, Homo sapiens
agccaggctactccttgctgac

SEQ ID NO: 7935065 - DNA, 22 bp, Homo sapiens
agccaggctactccttgctgac

SEQ ID NO: 7935066 - DNA, 22 bp, Homo sapiens
agccaggctactccttgctgac

SEQ ID NO: 7935067 - DNA, 20 bp, Homo sapiens
agccaggctcaagctccccc

SEQ ID NO: 7935068 - DNA, 20 bp, Homo sapiens
agccaggctcaagctccccc

SEQ ID NO: 7935069 - DNA, 20 bp, Homo sapiens
agccaggctcaagctccccc

SEQ ID NO: 7935070 - DNA, 22 bp, Homo sapiens
agccaggcgggtctttgctcct

SEQ ID NO: 7935071 - DNA, 22 bp, Homo sapiens
agccaggcgggtctttgctcct

SEQ ID NO: 7935072 - DNA, 22 bp, Homo sapiens
agccaggcgggtctttgctcct

SEQ ID NO: 7935073 - DNA, 22 bp, Homo sapiens
agccaggcgggtctttgctcct

SEQ ID NO: 7935074 - DNA, 22 bp, Homo sapiens
agccaggctaaatgagccatga

SEQ ID NO: 7935075 - DNA, 22 bp, Homo sapiens
agccaggctaaatgagccatga

SEQ ID NO: 7935076 - DNA, 22 bp, Homo sapiens
agccaggctaaatgagccatga

SEQ ID NO: 7935077 - DNA, 22 bp, Homo sapiens
agccaggctaaatgagccatga

SEQ ID NO: 7935078 - DNA, 22 bp, Homo sapiens
agccaggctaaatgagccatga

SEQ ID NO: 7935079 - DNA, 22 bp, Homo sapiens
agccaggctactccttgctgac

SEQ ID NO: 7935080 - DNA, 22 bp, Homo sapiens
agccaggctactccttgctgac

SEQ ID NO: 7935081 - DNA, 22 bp, Homo sapiens
agccaggctaaatgagccatga

SEQ ID NO: 7935082 - DNA, 22 bp, Homo sapiens
agcatttaagggtggatacagg

SEQ ID NO: 7935083 - DNA, 22 bp, Homo sapiens
agcatttaatcctacatagatc

SEQ ID NO: 7935084 - DNA, 22 bp, Homo sapiens
agcatttaatcctacatagatc

SEQ ID NO: 7935085 - DNA, 22 bp, Homo sapiens
agcatttaatcctacatagatc

SEQ ID NO: 7935086 - DNA, 22 bp, Homo sapiens
agcatttaatcctacatagatc

SEQ ID NO: 7935087 - DNA, 22 bp, Homo sapiens
agcatttaatcctacatagatc

SEQ ID NO: 7935088 - DNA, 22 bp, Homo sapiens
agcattggtggccagagtgcct

SEQ ID NO: 7935089 - DNA, 22 bp, Homo sapiens
agcattgtctccaagcaggtct

SEQ ID NO: 7935090 - DNA, 22 bp, Homo sapiens
agcatttaagcttctgcaaagc

SEQ ID NO: 7935091 - DNA, 22 bp, Homo sapiens
agcattgctaaagctaattttt

SEQ ID NO: 7935092 - DNA, 22 bp, Homo sapiens
agccaggcgcagtggcttatgc

SEQ ID NO: 7935093 - DNA, 22 bp, Homo sapiens
agccaggcgcagtggcttatgc

SEQ ID NO: 7935094 - DNA, 22 bp, Homo sapiens
agccaggacagggcagctcgct

SEQ ID NO: 7935095 - DNA, 22 bp, Homo sapiens
agccaggcggggcaggtttcct

SEQ ID NO: 7935096 - DNA, 22 bp, Homo sapiens
agccaggcggggcaggtttcct

SEQ ID NO: 7935097 - DNA, 22 bp, Homo sapiens
agccaggcggggcaggtttcct

SEQ ID NO: 7935098 - DNA, 22 bp, Homo sapiens
agccaggcggggcaggtttcct

SEQ ID NO: 7935099 - DNA, 22 bp, Homo sapiens
agccaggcgcagtggcttatgc

SEQ ID NO: 7935100 - DNA, 22 bp, Homo sapiens
agccaggaattggacaacacat

SEQ ID NO: 7935101 - DNA, 22 bp, Homo sapiens
agccaggaatgcatgctctgct

SEQ ID NO: 7935102 - DNA, 22 bp, Homo sapiens
agcatttaattacagtttaatt

SEQ ID NO: 7935103 - DNA, 22 bp, Homo sapiens
agccaggaatgcatgctctgct

SEQ ID NO: 7935104 - DNA, 22 bp, Homo sapiens
agccaggaattggacaacacat

SEQ ID NO: 7935105 - DNA, 22 bp, Homo sapiens
agccaggacagggcagctcgct

SEQ ID NO: 7935106 - DNA, 22 bp, Homo sapiens
agccaggaattggacaacacat

SEQ ID NO: 7935107 - DNA, 22 bp, Homo sapiens
agccaggacagggcagctcgct

SEQ ID NO: 7935108 - DNA, 22 bp, Homo sapiens
agccaggacagggcagctcgct

SEQ ID NO: 7935109 - DNA, 22 bp, Homo sapiens
agcccaggtgactcatacaccc

SEQ ID NO: 7935110 - DNA, 22 bp, Homo sapiens
agcccaggtgactcatacaccc

SEQ ID NO: 7935111 - DNA, 22 bp, Homo sapiens
agcccaggtgactcatacaccc

SEQ ID NO: 7935112 - DNA, 22 bp, Homo sapiens
agcccaggtgactcatacaccc

SEQ ID NO: 7935113 - DNA, 22 bp, Homo sapiens
agcccaggtgaggggttcgaaa

SEQ ID NO: 7935114 - DNA, 22 bp, Homo sapiens
agcccaggtgaggggttcgaaa

SEQ ID NO: 7935115 - DNA, 22 bp, Homo sapiens
agcccaggtgaggggttcgaaa

SEQ ID NO: 7935116 - DNA, 22 bp, Homo sapiens
agcccaggtggagtgtgtgggg

SEQ ID NO: 7935117 - DNA, 22 bp, Homo sapiens
agcccaggtgaggggttcgaaa

SEQ ID NO: 7935118 - DNA, 22 bp, Homo sapiens
agcccaggtggagtgtgtgggg

SEQ ID NO: 7935119 - DNA, 22 bp, Homo sapiens
agcccaggtggagtgtgtgggg

SEQ ID NO: 7935120 - DNA, 22 bp, Homo sapiens
agcccaggtggagtgtgtgggg

SEQ ID NO: 7935121 - DNA, 22 bp, Homo sapiens
agcccaggtggagtgtgtgggg

SEQ ID NO: 7935122 - DNA, 22 bp, Homo sapiens
agcccaggtggagtgtgtgggg

SEQ ID NO: 7935123 - DNA, 22 bp, Homo sapiens
agcccaggtggagtgtgtgggg

SEQ ID NO: 7935124 - DNA, 22 bp, Homo sapiens
agcccaggtctcaaagtacagg

SEQ ID NO: 7935125 - DNA, 22 bp, Homo sapiens
agcccaggtctcaaagtacagg

SEQ ID NO: 7935126 - DNA, 22 bp, Homo sapiens
agcccaggtctcaaagtacagg

SEQ ID NO: 7935127 - DNA, 22 bp, Homo sapiens
agcccaggtctcaaagtacagg

SEQ ID NO: 7935128 - DNA, 22 bp, Homo sapiens
agcccaggtctcaaagtacagg

SEQ ID NO: 7935129 - DNA, 22 bp, Homo sapiens
agcccaggtctcaaagtacagg

SEQ ID NO: 7935130 - DNA, 22 bp, Homo sapiens
agcccaggtctggcccagcctg

SEQ ID NO: 7935131 - DNA, 22 bp, Homo sapiens
agcccaggtctggcccagcctg

SEQ ID NO: 7935132 - DNA, 22 bp, Homo sapiens
agcccaggtctggcccagcctg

SEQ ID NO: 7935133 - DNA, 22 bp, Homo sapiens
agcccaggtctggcccagcctg

SEQ ID NO: 7935134 - DNA, 22 bp, Homo sapiens
agcccaggtgactcatacaccc

SEQ ID NO: 7935135 - DNA, 22 bp, Homo sapiens
agcccaggtctggcccagcctg

SEQ ID NO: 7935136 - DNA, 22 bp, Homo sapiens
agcccaggtctggcccagcctg

SEQ ID NO: 7935137 - DNA, 22 bp, Homo sapiens
acagacatcatcaacatcttcc

SEQ ID NO: 7935138 - DNA, 22 bp, Homo sapiens
acagacatcatcaacatcttcc

SEQ ID NO: 7935139 - DNA, 22 bp, Homo sapiens
acagacatctatccatttaatt

SEQ ID NO: 7935140 - DNA, 22 bp, Homo sapiens
acagacatctatccatttaatt

SEQ ID NO: 7935141 - DNA, 22 bp, Homo sapiens
acagacatatttggcccatagc

SEQ ID NO: 7935142 - DNA, 22 bp, Homo sapiens
acagacatatttggcccatagc

SEQ ID NO: 7935143 - DNA, 22 bp, Homo sapiens
acagacatcatcaacatcttcc

SEQ ID NO: 7935144 - DNA, 21 bp, Homo sapiens
acagacagtccagagaaaaga

SEQ ID NO: 7935145 - DNA, 21 bp, Homo sapiens
acagacagtccagagaaaaga

SEQ ID NO: 7935146 - DNA, 22 bp, Homo sapiens
acagacagtaaatagtgtggct

SEQ ID NO: 7935147 - DNA, 22 bp, Homo sapiens
acagacagtaaatagtgtggct

SEQ ID NO: 7935148 - DNA, 22 bp, Homo sapiens
acagacagtaaatagtgtggct

SEQ ID NO: 7935149 - DNA, 21 bp, Homo sapiens
acagacagggccagtgtcccc

SEQ ID NO: 7935150 - DNA, 22 bp, Homo sapiens
acagacagtaaatagtgtggct

SEQ ID NO: 7935151 - DNA, 22 bp, Homo sapiens
acagacagtaaatagtgtggct

SEQ ID NO: 7935152 - DNA, 22 bp, Homo sapiens
acagacagtatggtggggctga

SEQ ID NO: 7935153 - DNA, 22 bp, Homo sapiens
acagacagtatggtggggctga

SEQ ID NO: 7935154 - DNA, 22 bp, Homo sapiens
acagacagtatggtggggctga

SEQ ID NO: 7935155 - DNA, 22 bp, Homo sapiens
acagaacatattgcttctctca

SEQ ID NO: 7935156 - DNA, 22 bp, Homo sapiens
acagaacatattgcttctctca

SEQ ID NO: 7935157 - DNA, 22 bp, Homo sapiens
acagaacaggctgagaaaaaca

SEQ ID NO: 7935158 - DNA, 22 bp, Homo sapiens
acagaacatattgcttctctca

SEQ ID NO: 7935159 - DNA, 22 bp, Homo sapiens
acagaacatattgcttctctca

SEQ ID NO: 7935160 - DNA, 22 bp, Homo sapiens
acagaacatattgcttctctca

SEQ ID NO: 7935161 - DNA, 22 bp, Homo sapiens
acagaacatattgcttctctca

SEQ ID NO: 7935162 - DNA, 22 bp, Homo sapiens
acagaacaggctgagaaaaaca

SEQ ID NO: 7935163 - DNA, 22 bp, Homo sapiens
acagaacaggctgagaaaaaca

SEQ ID NO: 7935164 - DNA, 22 bp, Homo sapiens
acagaacagagggttttagaat

SEQ ID NO: 7935165 - DNA, 22 bp, Homo sapiens
acagaacaggctgagaaaaaca

SEQ ID NO: 7935166 - DNA, 22 bp, Homo sapiens
acagaacaggctgagaaaaaca

SEQ ID NO: 7935167 - DNA, 22 bp, Homo sapiens
acagaacaggctgagaaaaaca

SEQ ID NO: 7935168 - DNA, 22 bp, Homo sapiens
acagaacaggctgagaaaaaca

SEQ ID NO: 7935169 - DNA, 22 bp, Homo sapiens
acagaactgggaaatgcacata

SEQ ID NO: 7935170 - DNA, 22 bp, Homo sapiens
acagaactgcagacagtgccaa

SEQ ID NO: 7935171 - DNA, 22 bp, Homo sapiens
acagaactggaattggaactca

SEQ ID NO: 7935172 - DNA, 22 bp, Homo sapiens
acagaactgcaggaggaaaagc

SEQ ID NO: 7935173 - DNA, 22 bp, Homo sapiens
acagaactgcaggaggaaaagc

SEQ ID NO: 7935174 - DNA, 22 bp, Homo sapiens
acagaactgcaggaggaaaagc

SEQ ID NO: 7935175 - DNA, 22 bp, Homo sapiens
acagaacatggatttttgaagt

SEQ ID NO: 7935176 - DNA, 22 bp, Homo sapiens
acagaacatggatttttgaagt

SEQ ID NO: 7935177 - DNA, 18 bp, Homo sapiens
acagaactcaggggcacc

SEQ ID NO: 7935178 - DNA, 18 bp, Homo sapiens
acagaactcaggggcacc

SEQ ID NO: 7935179 - DNA, 21 bp, Homo sapiens
acagaactgtatagtgataaa

SEQ ID NO: 7935180 - DNA, 21 bp, Homo sapiens
acagaactgtatagtgataaa

SEQ ID NO: 7935181 - DNA, 22 bp, Homo sapiens
acagaactgggaaatgcacata

SEQ ID NO: 7935182 - DNA, 22 bp, Homo sapiens
acagaactgggggcacagatag

SEQ ID NO: 7935183 - DNA, 22 bp, Homo sapiens
acagaactgggggcacagatag

SEQ ID NO: 7935184 - DNA, 22 bp, Homo sapiens
acagaactgtgtgatgattaag

SEQ ID NO: 7935185 - DNA, 22 bp, Homo sapiens
acagaacttcagtagtattccc

SEQ ID NO: 7935186 - DNA, 22 bp, Homo sapiens
acagaactgggggcacagatag

SEQ ID NO: 7935187 - DNA, 22 bp, Homo sapiens
agcccagctttcacccctctgg

SEQ ID NO: 7935188 - DNA, 22 bp, Homo sapiens
agcccaggtccagttcactgca

SEQ ID NO: 7935189 - DNA, 22 bp, Homo sapiens
agcccaggtctcaaagtacagg

SEQ ID NO: 7935190 - DNA, 22 bp, Homo sapiens
agcccaggtccagttcactgca

SEQ ID NO: 7935191 - DNA, 22 bp, Homo sapiens
agcccagggctaataggaacca

SEQ ID NO: 7935192 - DNA, 22 bp, Homo sapiens
agcccagggctaataggaacca

SEQ ID NO: 7935193 - DNA, 22 bp, Homo sapiens
agcccaggtccagttcactgca

SEQ ID NO: 7935194 - DNA, 22 bp, Homo sapiens
agcccaggtccagttcactgca

SEQ ID NO: 7935195 - DNA, 22 bp, Homo sapiens
agcccagggctaataggaacca

SEQ ID NO: 7935196 - DNA, 22 bp, Homo sapiens
agcccagggctaataggaacca

SEQ ID NO: 7935197 - DNA, 22 bp, Homo sapiens
agcccagggctaataggaacca

SEQ ID NO: 7935198 - DNA, 22 bp, Homo sapiens
agcccagggctaataggaacca

SEQ ID NO: 7935199 - DNA, 22 bp, Homo sapiens
agcccagggctaataggaacca

SEQ ID NO: 7935200 - DNA, 22 bp, Homo sapiens
agcccagctttgaaccatatca

SEQ ID NO: 7935201 - DNA, 22 bp, Homo sapiens
agcccagctttgaaccatatca

SEQ ID NO: 7935202 - DNA, 22 bp, Homo sapiens
agcccagggctaataggaacca

SEQ ID NO: 7935203 - DNA, 22 bp, Homo sapiens
agcagcagattcagcaggaatg

SEQ ID NO: 7935204 - DNA, 23 bp, Homo sapiens
agcagcagcaattaagtggatat

SEQ ID NO: 7935205 - DNA, 23 bp, Homo sapiens
agcagcagcaattaagtggatat

SEQ ID NO: 7935206 - DNA, 23 bp, Homo sapiens
agcagcagcaattaagtggatat

SEQ ID NO: 7935207 - DNA, 22 bp, Homo sapiens
agcagcagattcagcaggaatg

SEQ ID NO: 7935208 - DNA, 22 bp, Homo sapiens
agcagcagattcagcaggaatg

SEQ ID NO: 7935209 - DNA, 22 bp, Homo sapiens
agcagcagattcagcaggaatg

SEQ ID NO: 7935210 - DNA, 22 bp, Homo sapiens
agcagcagattatggtctacat

SEQ ID NO: 7935211 - DNA, 22 bp, Homo sapiens
agcagcagattatggtctacat

SEQ ID NO: 7935212 - DNA, 22 bp, Homo sapiens
agcagcagattcagcaggaatg

SEQ ID NO: 7935213 - DNA, 22 bp, Homo sapiens
agcagcagattatggtctacat

SEQ ID NO: 7935214 - DNA, 22 bp, Homo sapiens
agcagcagattatggtctacat

SEQ ID NO: 7935215 - DNA, 21 bp, Homo sapiens
agcagaacagtcgagcactgc

SEQ ID NO: 7935216 - DNA, 22 bp, Homo sapiens
agcagaacagtcttctagttct

SEQ ID NO: 7935217 - DNA, 22 bp, Homo sapiens
agcagaacagtcttctagttct

SEQ ID NO: 7935218 - DNA, 22 bp, Homo sapiens
agcagaacattttcagggctgt

SEQ ID NO: 7935219 - DNA, 22 bp, Homo sapiens
agcagaacattttcagggctgt

SEQ ID NO: 7935220 - DNA, 22 bp, Homo sapiens
agcagaaccacagcactgttga

SEQ ID NO: 7935221 - DNA, 22 bp, Homo sapiens
agcagaacattatctaggtctt

SEQ ID NO: 7935222 - DNA, 22 bp, Homo sapiens
agcagaacattatctaggtctt

SEQ ID NO: 7935223 - DNA, 22 bp, Homo sapiens
agcagcaactgctagagtggca

SEQ ID NO: 7935224 - DNA, 22 bp, Homo sapiens
agcagcaactgctagagtggca

SEQ ID NO: 7935225 - DNA, 22 bp, Homo sapiens
agcagaaccacagcactgttga

SEQ ID NO: 7935226 - DNA, 22 bp, Homo sapiens
agcagaaccacagcactgttga

SEQ ID NO: 7935227 - DNA, 22 bp, Homo sapiens
agcagcaaagtattgggcaaga

SEQ ID NO: 7935228 - DNA, 22 bp, Homo sapiens
agcagcaaagtattgggcaaga

SEQ ID NO: 7935229 - DNA, 21 bp, Homo sapiens
agcagcaaccacatagttttt

SEQ ID NO: 7935230 - DNA, 22 bp, Homo sapiens
agcagcaaagtattgggcaaga

SEQ ID NO: 7935231 - DNA, 19 bp, Homo sapiens
agcagcagcaccagggatt

SEQ ID NO: 7935232 - DNA, 21 bp, Homo sapiens
agcagcagcagtggggcttct

SEQ ID NO: 7935233 - DNA, 21 bp, Homo sapiens
agcagcagcagtggggcttct

SEQ ID NO: 7935234 - DNA, 19 bp, Homo sapiens
agcagcagcaccagggatt

SEQ ID NO: 7935235 - DNA, 19 bp, Homo sapiens
agcagcagcaccagggatt

SEQ ID NO: 7935236 - DNA, 19 bp, Homo sapiens
agcagcagcaccagggatt

SEQ ID NO: 7935237 - DNA, 19 bp, Homo sapiens
agcagcagcaccagggatt

SEQ ID NO: 7935238 - DNA, 19 bp, Homo sapiens
agcagcagcaccagggatt

SEQ ID NO: 7935239 - DNA, 23 bp, Homo sapiens
agcagcagcaattaagtggatat

SEQ ID NO: 7935240 - DNA, 23 bp, Homo sapiens
agcagcagcaattaagtggatat

SEQ ID NO: 7935241 - DNA, 23 bp, Homo sapiens
agcagcagcaattaagtggatat

SEQ ID NO: 7935242 - DNA, 19 bp, Homo sapiens
agcagcagctaccacttgt

SEQ ID NO: 7935243 - DNA, 19 bp, Homo sapiens
agcagcagctaccacttgt

SEQ ID NO: 7935244 - DNA, 19 bp, Homo sapiens
agcagcagctaccacttgt

SEQ ID NO: 7935245 - DNA, 19 bp, Homo sapiens
agcagcagctaccacttgt

SEQ ID NO: 7935246 - DNA, 22 bp, Homo sapiens
agcagcagctcagttctcagct

SEQ ID NO: 7935247 - DNA, 22 bp, Homo sapiens
agcagcagctcagttctcagct

SEQ ID NO: 7935248 - DNA, 22 bp, Homo sapiens
agcagcagctcagttctcagct

SEQ ID NO: 7935249 - DNA, 22 bp, Homo sapiens
agcagcagctcagttctcagct

SEQ ID NO: 7935250 - DNA, 22 bp, Homo sapiens
agcagcagccgtagccttatta

SEQ ID NO: 7935251 - DNA, 22 bp, Homo sapiens
agcagcagccgtagccttatta

SEQ ID NO: 7935252 - DNA, 22 bp, Homo sapiens
agcagcagcattgagcgcttgt

SEQ ID NO: 7935253 - DNA, 22 bp, Homo sapiens
agcagcagcattgagcgcttgt

SEQ ID NO: 7935254 - DNA, 22 bp, Homo sapiens
agcagcagcattgagcgcttgt

SEQ ID NO: 7935255 - DNA, 22 bp, Homo sapiens
agcagcagcattgagcgcttgt

SEQ ID NO: 7935256 - DNA, 22 bp, Homo sapiens
acacacttttgctaaaaattgt

SEQ ID NO: 7935257 - DNA, 20 bp, Homo sapiens
acacactttgatcttgagcc

SEQ ID NO: 7935258 - DNA, 20 bp, Homo sapiens
acacactttgatcttgagcc

SEQ ID NO: 7935259 - DNA, 22 bp, Homo sapiens
acacactttaaattaaacctct

SEQ ID NO: 7935260 - DNA, 22 bp, Homo sapiens
acacactgtaaggactatcact

SEQ ID NO: 7935261 - DNA, 22 bp, Homo sapiens
acacactgtaaggactatcact

SEQ ID NO: 7935262 - DNA, 22 bp, Homo sapiens
acacactgtaaggactatcact

SEQ ID NO: 7935263 - DNA, 22 bp, Homo sapiens
acacactgtaaggactatcact

SEQ ID NO: 7935264 - DNA, 22 bp, Homo sapiens
acacactgttgctcatccaggc

SEQ ID NO: 7935265 - DNA, 22 bp, Homo sapiens
acacactgttgctcatccaggc

SEQ ID NO: 7935266 - DNA, 22 bp, Homo sapiens
acacactggcccccagtactga

SEQ ID NO: 7935267 - DNA, 22 bp, Homo sapiens
acacactggcccccagtactga

SEQ ID NO: 7935268 - DNA, 22 bp, Homo sapiens
acacactggcccccagtactga

SEQ ID NO: 7935269 - DNA, 22 bp, Homo sapiens
acacactggcccccagtactga

SEQ ID NO: 7935270 - DNA, 22 bp, Homo sapiens
acacactgtaaggactatcact

SEQ ID NO: 7935271 - DNA, 22 bp, Homo sapiens
acacactggcccccagtactga

SEQ ID NO: 7935272 - DNA, 22 bp, Homo sapiens
acacactgtaaggactatcact

SEQ ID NO: 7935273 - DNA, 22 bp, Homo sapiens
agcagcagctcattcttcctgt

SEQ ID NO: 7935274 - DNA, 22 bp, Homo sapiens
agcagcagctcattcttcctgt

SEQ ID NO: 7935275 - DNA, 22 bp, Homo sapiens
agcagcagctcattcttcctgt

SEQ ID NO: 7935276 - DNA, 22 bp, Homo sapiens
agcagcagctcattcttcctgt

SEQ ID NO: 7935277 - DNA, 22 bp, Homo sapiens
agcagcagctcattcttcctgt

SEQ ID NO: 7935278 - DNA, 22 bp, Homo sapiens
acacactggcaggagctataaa

SEQ ID NO: 7935279 - DNA, 22 bp, Homo sapiens
acacactggcaggagctataaa

SEQ ID NO: 7935280 - DNA, 22 bp, Homo sapiens
agcagccaggaatctgcagagc

SEQ ID NO: 7935281 - DNA, 22 bp, Homo sapiens
agcagccaggaatctgcagagc

SEQ ID NO: 7935282 - DNA, 16 bp, Homo sapiens
agcagccagcactgga

SEQ ID NO: 7935283 - DNA, 22 bp, Homo sapiens
agcagccaggaatctgcagagc

SEQ ID NO: 7935284 - DNA, 22 bp, Homo sapiens
agcagccaggaatctgcagagc

SEQ ID NO: 7935285 - DNA, 22 bp, Homo sapiens
agcagccagtgggagtgataca

SEQ ID NO: 7935286 - DNA, 22 bp, Homo sapiens
agcagccaggaatctgcagagc

SEQ ID NO: 7935287 - DNA, 23 bp, Homo sapiens
agcagccagagatcctcggccct

SEQ ID NO: 7935288 - DNA, 22 bp, Homo sapiens
agcagccagagtctgaacatta

SEQ ID NO: 7935289 - DNA, 23 bp, Homo sapiens
agcagccagagatcctcggccct

SEQ ID NO: 7935290 - DNA, 23 bp, Homo sapiens
agcagccagagatcctcggccct

SEQ ID NO: 7935291 - DNA, 22 bp, Homo sapiens
agcagccagagtctgaacatta

SEQ ID NO: 7935292 - DNA, 23 bp, Homo sapiens
agcagccagagatcctcggccct

SEQ ID NO: 7935293 - DNA, 22 bp, Homo sapiens
agcagccagagtctgaacatta

SEQ ID NO: 7935294 - DNA, 22 bp, Homo sapiens
agcagccagagtctgaacatta

SEQ ID NO: 7935295 - DNA, 23 bp, Homo sapiens
acacagaagaagacccaaggaag

SEQ ID NO: 7935296 - DNA, 23 bp, Homo sapiens
acacagaagaagacccaaggaag

SEQ ID NO: 7935297 - DNA, 23 bp, Homo sapiens
acacagaagaagacccaaggaag

SEQ ID NO: 7935298 - DNA, 22 bp, Homo sapiens
agcagcagttgctgacgttcta

SEQ ID NO: 7935299 - DNA, 22 bp, Homo sapiens
agcagcatacacatcatgttga

SEQ ID NO: 7935300 - DNA, 22 bp, Homo sapiens
agcagcatacacatcatgttga

SEQ ID NO: 7935301 - DNA, 22 bp, Homo sapiens
agcagcatacacatcatgttga

SEQ ID NO: 7935302 - DNA, 22 bp, Homo sapiens
agcagcatacacatcatgttga

SEQ ID NO: 7935303 - DNA, 22 bp, Homo sapiens
agcagcatagaagctgggagga

SEQ ID NO: 7935304 - DNA, 22 bp, Homo sapiens
agcactttattcaggaactcca

SEQ ID NO: 7935305 - DNA, 22 bp, Homo sapiens
agcactttaagcaacagatcaa

SEQ ID NO: 7935306 - DNA, 22 bp, Homo sapiens
agcacttgtcaggcagctctat

SEQ ID NO: 7935307 - DNA, 22 bp, Homo sapiens
agcactttgggagataaagctg

SEQ ID NO: 7935308 - DNA, 22 bp, Homo sapiens
agcactttgtgcatttctgaag

SEQ ID NO: 7935309 - DNA, 22 bp, Homo sapiens
agcagaaaactttcatgctctg

SEQ ID NO: 7935310 - DNA, 22 bp, Homo sapiens
agcagaaaactttcatgctctg

SEQ ID NO: 7935311 - DNA, 22 bp, Homo sapiens
agcagaaaactttcatgctctg

SEQ ID NO: 7935312 - DNA, 22 bp, Homo sapiens
agcagaaaattggaaatgacaa

SEQ ID NO: 7935313 - DNA, 22 bp, Homo sapiens
agcagaaaattggaaatgacaa

SEQ ID NO: 7935314 - DNA, 22 bp, Homo sapiens
agcagaaaattggaaatgacaa

SEQ ID NO: 7935315 - DNA, 22 bp, Homo sapiens
agcagaaaattggaaatgacaa

SEQ ID NO: 7935316 - DNA, 22 bp, Homo sapiens
agcagaaaattggaaatgacaa

SEQ ID NO: 7935317 - DNA, 22 bp, Homo sapiens
agcagaaaattggaaatgacaa

SEQ ID NO: 7935318 - DNA, 22 bp, Homo sapiens
agcagaaacagccagtctggac

SEQ ID NO: 7935319 - DNA, 22 bp, Homo sapiens
agcagaaacagccagtctggac

SEQ ID NO: 7935320 - DNA, 22 bp, Homo sapiens
agcagaaatagaagtcaatgat

SEQ ID NO: 7935321 - DNA, 22 bp, Homo sapiens
agcagaaatagaagtcaatgat

SEQ ID NO: 7935322 - DNA, 22 bp, Homo sapiens
agcagaaatgatggtatgggac

SEQ ID NO: 7935323 - DNA, 22 bp, Homo sapiens
agcagaaatgatggtatgggac

SEQ ID NO: 7935324 - DNA, 22 bp, Homo sapiens
agcagaaatgatggtatgggac

SEQ ID NO: 7935325 - DNA, 22 bp, Homo sapiens
agcagaaatagaagtcaatgat

SEQ ID NO: 7935326 - DNA, 22 bp, Homo sapiens
agcagaaagcttattttgactg

SEQ ID NO: 7935327 - DNA, 22 bp, Homo sapiens
agcagaaatagaagtcaatgat

SEQ ID NO: 7935328 - DNA, 22 bp, Homo sapiens
agcagaaatagaagtcaatgat

SEQ ID NO: 7935329 - DNA, 22 bp, Homo sapiens
agcagaaatagaagtcaatgat

SEQ ID NO: 7935330 - DNA, 22 bp, Homo sapiens
agcagaaacagccagtctggac

SEQ ID NO: 7935331 - DNA, 22 bp, Homo sapiens
acacacatggtattgttcagaa

SEQ ID NO: 7935332 - DNA, 22 bp, Homo sapiens
acacaccatgatttatttaccc

SEQ ID NO: 7935333 - DNA, 22 bp, Homo sapiens
acacaccatgatttatttaccc

SEQ ID NO: 7935334 - DNA, 22 bp, Homo sapiens
acacaccatgatttatttaccc

SEQ ID NO: 7935335 - DNA, 22 bp, Homo sapiens
acacactcaattgcataagcac

SEQ ID NO: 7935336 - DNA, 21 bp, Homo sapiens
acacactctgagtcttctatt

SEQ ID NO: 7935337 - DNA, 22 bp, Homo sapiens
acacactgagtgccataggacc

SEQ ID NO: 7935338 - DNA, 22 bp, Homo sapiens
acacactcaattgcataagcac

SEQ ID NO: 7935339 - DNA, 22 bp, Homo sapiens
acacactcaattgcataagcac

SEQ ID NO: 7935340 - DNA, 21 bp, Homo sapiens
acacactgagttttccactgt

SEQ ID NO: 7935341 - DNA, 22 bp, Homo sapiens
acacactgctcgctcagattaa

SEQ ID NO: 7935342 - DNA, 21 bp, Homo sapiens
acacactgagttttccactgt

SEQ ID NO: 7935343 - DNA, 22 bp, Homo sapiens
acacactgagtgccataggacc

SEQ ID NO: 7935344 - DNA, 22 bp, Homo sapiens
acacactgagtgccataggacc

SEQ ID NO: 7935345 - DNA, 20 bp, Homo sapiens
agcacttgctgtgtgccata

SEQ ID NO: 7935346 - DNA, 22 bp, Homo sapiens
agcacttctcatgggatcaggt

SEQ ID NO: 7935347 - DNA, 22 bp, Homo sapiens
agcacttatgtgattaggacag

SEQ ID NO: 7935348 - DNA, 22 bp, Homo sapiens
acacactggcaggagctataaa

SEQ ID NO: 7935349 - DNA, 22 bp, Homo sapiens
acacactggcaggagctataaa

SEQ ID NO: 7935350 - DNA, 22 bp, Homo sapiens
acacactgctcgctcagattaa

SEQ ID NO: 7935351 - DNA, 18 bp, Homo sapiens
agattttgagaaatacaa

SEQ ID NO: 7935352 - DNA, 22 bp, Homo sapiens
agattttatagataatttccca

SEQ ID NO: 7935353 - DNA, 22 bp, Homo sapiens
agattttatagataatttccca

SEQ ID NO: 7935354 - DNA, 22 bp, Homo sapiens
agattttagtttggggaggtgc

SEQ ID NO: 7935355 - DNA, 22 bp, Homo sapiens
agattttagtttggggaggtgc

SEQ ID NO: 7935356 - DNA, 22 bp, Homo sapiens
agattttagtgtagaggacttg

SEQ ID NO: 7935357 - DNA, 22 bp, Homo sapiens
agattttagtgtagaggacttg

SEQ ID NO: 7935358 - DNA, 22 bp, Homo sapiens
acacacatgcctttcctaagta

SEQ ID NO: 7935359 - DNA, 22 bp, Homo sapiens
acacacatgcctttcctaagta

SEQ ID NO: 7935360 - DNA, 22 bp, Homo sapiens
acacacagaaggaagccccact

SEQ ID NO: 7935361 - DNA, 22 bp, Homo sapiens
acacacagaaggaagccccact

SEQ ID NO: 7935362 - DNA, 22 bp, Homo sapiens
acacacagaaggaagccccact

SEQ ID NO: 7935363 - DNA, 22 bp, Homo sapiens
acacacagaaggaagccccact

SEQ ID NO: 7935364 - DNA, 22 bp, Homo sapiens
agattttatagataatttccca

SEQ ID NO: 7935365 - DNA, 22 bp, Homo sapiens
acacacatggtattgttcagaa

SEQ ID NO: 7935366 - DNA, 22 bp, Homo sapiens
acacacatggtattgttcagaa

SEQ ID NO: 7935367 - DNA, 22 bp, Homo sapiens
acacacatggtattgttcagaa

SEQ ID NO: 7935368 - DNA, 22 bp, Homo sapiens
acacacatggtattgttcagaa

SEQ ID NO: 7935369 - DNA, 22 bp, Homo sapiens
agatttgagttttctatccttg

SEQ ID NO: 7935370 - DNA, 22 bp, Homo sapiens
agatttgaaacttgcttcataa

SEQ ID NO: 7935371 - DNA, 22 bp, Homo sapiens
agatttgccatggatgttcttt

SEQ ID NO: 7935372 - DNA, 22 bp, Homo sapiens
agatttgatatcatgcaacaaa

SEQ ID NO: 7935373 - DNA, 22 bp, Homo sapiens
agatttgatatcatgcaacaaa

SEQ ID NO: 7935374 - DNA, 22 bp, Homo sapiens
agatttgatatcatgcaacaaa

SEQ ID NO: 7935375 - DNA, 22 bp, Homo sapiens
agatttgataaaagtagcagtt

SEQ ID NO: 7935376 - DNA, 22 bp, Homo sapiens
agatttggtgtctggttgatat

SEQ ID NO: 7935377 - DNA, 23 bp, Homo sapiens
agatttggaaagctgagtggcgt

SEQ ID NO: 7935378 - DNA, 22 bp, Homo sapiens
agatttggtgtctggttgatat

SEQ ID NO: 7935379 - DNA, 22 bp, Homo sapiens
agatttggtgtctggttgatat

SEQ ID NO: 7935380 - DNA, 22 bp, Homo sapiens
agatttctgtcaccttctatgc

SEQ ID NO: 7935381 - DNA, 22 bp, Homo sapiens
agatttctgtcaccttctatgc

SEQ ID NO: 7935382 - DNA, 22 bp, Homo sapiens
agatttctgtggtcatgtaatg

SEQ ID NO: 7935383 - DNA, 22 bp, Homo sapiens
agatttctgtggtcatgtaatg

SEQ ID NO: 7935384 - DNA, 22 bp, Homo sapiens
agatttccgttctctcttcagt

SEQ ID NO: 7935385 - DNA, 22 bp, Homo sapiens
agatttccgttctctcttcagt

SEQ ID NO: 7935386 - DNA, 22 bp, Homo sapiens
agatttcctcttttgtaaagtg

SEQ ID NO: 7935387 - DNA, 22 bp, Homo sapiens
agcaggtgaattcctggatgtg

SEQ ID NO: 7935388 - DNA, 22 bp, Homo sapiens
agcaggtgaattcctggatgtg

SEQ ID NO: 7935389 - DNA, 21 bp, Homo sapiens
agcaggtgaacctccagtaca

SEQ ID NO: 7935390 - DNA, 22 bp, Homo sapiens
agcagggctttgtctctgtgaa

SEQ ID NO: 7935391 - DNA, 22 bp, Homo sapiens
agcagggctttgtctctgtgaa

SEQ ID NO: 7935392 - DNA, 22 bp, Homo sapiens
agcagggctttgtctctgtgaa

SEQ ID NO: 7935393 - DNA, 22 bp, Homo sapiens
agcagggctttggctggctttc

SEQ ID NO: 7935394 - DNA, 22 bp, Homo sapiens
agcagggctttggctggctttc

SEQ ID NO: 7935395 - DNA, 22 bp, Homo sapiens
agcagggctttgtctctgtgaa

SEQ ID NO: 7935396 - DNA, 22 bp, Homo sapiens
agcagggctttggctggctttc

SEQ ID NO: 7935397 - DNA, 22 bp, Homo sapiens
agcagggctttggctggctttc

SEQ ID NO: 7935398 - DNA, 22 bp, Homo sapiens
agcaggtgacagggctgtggtg

SEQ ID NO: 7935399 - DNA, 22 bp, Homo sapiens
agcaggtgacagggctgtggtg

SEQ ID NO: 7935400 - DNA, 22 bp, Homo sapiens
agcaggtgacagggctgtggtg

SEQ ID NO: 7935401 - DNA, 22 bp, Homo sapiens
agcaggtgacccaagcaggctg

SEQ ID NO: 7935402 - DNA, 22 bp, Homo sapiens
agcaggtgacccaagcaggctg

SEQ ID NO: 7935403 - DNA, 22 bp, Homo sapiens
agcaggtgacccaagcaggctg

SEQ ID NO: 7935404 - DNA, 19 bp, Homo sapiens
agcagttatatgcatggga

SEQ ID NO: 7935405 - DNA, 23 bp, Homo sapiens
agcagttagggatacaagttatc

SEQ ID NO: 7935406 - DNA, 22 bp, Homo sapiens
agcagttactagttaaatgcat

SEQ ID NO: 7935407 - DNA, 19 bp, Homo sapiens
agcagttatatgcatggga

SEQ ID NO: 7935408 - DNA, 22 bp, Homo sapiens
agcagttatattgaaataaaaa

SEQ ID NO: 7935409 - DNA, 22 bp, Homo sapiens
agcagttatcgaagaatcaggt

SEQ ID NO: 7935410 - DNA, 22 bp, Homo sapiens
agcagttatattgaaataaaaa

SEQ ID NO: 7935411 - DNA, 22 bp, Homo sapiens
agcagttatattgaaataaaaa

SEQ ID NO: 7935412 - DNA, 22 bp, Homo sapiens
agcagttatgtgtctcttgact

SEQ ID NO: 7935413 - DNA, 22 bp, Homo sapiens
agcagttactagttaaatgcat

SEQ ID NO: 7935414 - DNA, 22 bp, Homo sapiens
agcaggtgagcacagccaggct

SEQ ID NO: 7935415 - DNA, 20 bp, Homo sapiens
agcaggtgacggggcctgct

SEQ ID NO: 7935416 - DNA, 20 bp, Homo sapiens
agcaggtgacggggcctgct

SEQ ID NO: 7935417 - DNA, 20 bp, Homo sapiens
agcaggtgacggggcctgct

SEQ ID NO: 7935418 - DNA, 22 bp, Homo sapiens
agcatcagcctctgtcctggag

SEQ ID NO: 7935419 - DNA, 22 bp, Homo sapiens
agcatcagtactaatctggcca

SEQ ID NO: 7935420 - DNA, 22 bp, Homo sapiens
agcatccagaaaactctcagaa

SEQ ID NO: 7935421 - DNA, 22 bp, Homo sapiens
agcatccagaaaactctcagaa

SEQ ID NO: 7935422 - DNA, 22 bp, Homo sapiens
agcatccactcactgggagagg

SEQ ID NO: 7935423 - DNA, 22 bp, Homo sapiens
agcatccaactttgattagaga

SEQ ID NO: 7935424 - DNA, 22 bp, Homo sapiens
agcatccagatgcctgatgtca

SEQ ID NO: 7935425 - DNA, 22 bp, Homo sapiens
agcatccagcatcctatagaaa

SEQ ID NO: 7935426 - DNA, 22 bp, Homo sapiens
agcatccagcatcctatagaaa

SEQ ID NO: 7935427 - DNA, 22 bp, Homo sapiens
agcatccaggccaggttgggca

SEQ ID NO: 7935428 - DNA, 19 bp, Homo sapiens
agcatccagtcatgggatc

SEQ ID NO: 7935429 - DNA, 22 bp, Homo sapiens
agcatcccatgactctggagga

SEQ ID NO: 7935430 - DNA, 22 bp, Homo sapiens
agcatcccatgactctggagga

SEQ ID NO: 7935431 - DNA, 22 bp, Homo sapiens
agcagggctttgcagacttggg

SEQ ID NO: 7935432 - DNA, 22 bp, Homo sapiens
agcagggctttgcagacttggg

SEQ ID NO: 7935433 - DNA, 22 bp, Homo sapiens
agcagggctttgcagacttggg

SEQ ID NO: 7935434 - DNA, 22 bp, Homo sapiens
agcagggctttgcagacttggg

SEQ ID NO: 7935435 - DNA, 22 bp, Homo sapiens
agcagggcttgccgcttgtcct

SEQ ID NO: 7935436 - DNA, 22 bp, Homo sapiens
agcagggcttgccgcttgtcct

SEQ ID NO: 7935437 - DNA, 22 bp, Homo sapiens
agcagggcttgccgcttgtcct

SEQ ID NO: 7935438 - DNA, 22 bp, Homo sapiens
agcagggcttgccgcttgtcct

SEQ ID NO: 7935439 - DNA, 22 bp, Homo sapiens
agcagggcttctgtgcctgtgc

SEQ ID NO: 7935440 - DNA, 22 bp, Homo sapiens
agcagggcttctgtgcctgtgc

SEQ ID NO: 7935441 - DNA, 22 bp, Homo sapiens
agcagggcttctgtgcctgtgc

SEQ ID NO: 7935442 - DNA, 22 bp, Homo sapiens
agcagggctgtgtaggtaatga

SEQ ID NO: 7935443 - DNA, 22 bp, Homo sapiens
agcagggcttctgtgcctgtgc

SEQ ID NO: 7935444 - DNA, 22 bp, Homo sapiens
agcagggctgtgtaggtaatga

SEQ ID NO: 7935445 - DNA, 22 bp, Homo sapiens
agcaggcatttgatatatattt

SEQ ID NO: 7935446 - DNA, 22 bp, Homo sapiens
agcagggctgtgtaggtaatga

SEQ ID NO: 7935447 - DNA, 22 bp, Homo sapiens
agcagggcttctgtgcctgtgc

SEQ ID NO: 7935448 - DNA, 22 bp, Homo sapiens
agcagggcttctgtgcctgtgc

SEQ ID NO: 7935449 - DNA, 22 bp, Homo sapiens
agcagggctgtgtaggtaatga

SEQ ID NO: 7935450 - DNA, 22 bp, Homo sapiens
agcagggctgtgctccttccga

SEQ ID NO: 7935451 - DNA, 22 bp, Homo sapiens
agcagggctgtgctccttccga

SEQ ID NO: 7935452 - DNA, 22 bp, Homo sapiens
agcagggcctctggcactggtc

SEQ ID NO: 7935453 - DNA, 23 bp, Homo sapiens
agcaggcatctgtggcacaaggc

SEQ ID NO: 7935454 - DNA, 23 bp, Homo sapiens
agcaggcatctgtggcacaaggc

SEQ ID NO: 7935455 - DNA, 23 bp, Homo sapiens
agcaggcatctgtggcacaaggc

SEQ ID NO: 7935456 - DNA, 23 bp, Homo sapiens
agcaggcatctgtggcacaaggc

SEQ ID NO: 7935457 - DNA, 23 bp, Homo sapiens
agcaggcatctgtggcacaaggc

SEQ ID NO: 7935458 - DNA, 23 bp, Homo sapiens
agcaggcatctgtggcacaaggc

SEQ ID NO: 7935459 - DNA, 22 bp, Homo sapiens
agcagggcctctggcactggtc

SEQ ID NO: 7935460 - DNA, 19 bp, Homo sapiens
agcaggccacagggccagc

SEQ ID NO: 7935461 - DNA, 19 bp, Homo sapiens
agcaggccacagggccagc

SEQ ID NO: 7935462 - DNA, 19 bp, Homo sapiens
agcaggccacagggccagc

SEQ ID NO: 7935463 - DNA, 19 bp, Homo sapiens
agcaggccacagggccagc

SEQ ID NO: 7935464 - DNA, 22 bp, Homo sapiens
agcaggcatttgatatatattt

SEQ ID NO: 7935465 - DNA, 19 bp, Homo sapiens
agcaggcaggtggcccagg

SEQ ID NO: 7935466 - DNA, 19 bp, Homo sapiens
agcaggcaggtggcccagg

SEQ ID NO: 7935467 - DNA, 21 bp, Homo sapiens
agcaggcagtgggctggattt

SEQ ID NO: 7935468 - DNA, 19 bp, Homo sapiens
agcaggcaggtggcccagg

SEQ ID NO: 7935469 - DNA, 21 bp, Homo sapiens
agcaggcagtgggctggattt

SEQ ID NO: 7935470 - DNA, 22 bp, Homo sapiens
agcaggcagtgtagagccttca

SEQ ID NO: 7935471 - DNA, 21 bp, Homo sapiens
agcaggcagtgggctggattt

SEQ ID NO: 7935472 - DNA, 21 bp, Homo sapiens
agcaggcagtgggctggattt

SEQ ID NO: 7935473 - DNA, 21 bp, Homo sapiens
agcaggcagtgggctggattt

SEQ ID NO: 7935474 - DNA, 22 bp, Homo sapiens
agcaggcagtgtagagccttca

SEQ ID NO: 7935475 - DNA, 22 bp, Homo sapiens
agcaggcagtgtagagccttca

SEQ ID NO: 7935476 - DNA, 22 bp, Homo sapiens
agcaggcatagagtagcactca

SEQ ID NO: 7935477 - DNA, 23 bp, Homo sapiens
agcaggcatctgtggcacaaggc

SEQ ID NO: 7935478 - DNA, 22 bp, Homo sapiens
agcaggcatagagtagcactca

SEQ ID NO: 7935479 - DNA, 22 bp, Homo sapiens
agcaggcatagagtagcactca

SEQ ID NO: 7935480 - DNA, 22 bp, Homo sapiens
agcaggcatagagtagcactca

SEQ ID NO: 7935481 - DNA, 22 bp, Homo sapiens
agcaggagggttttgtagagtc

SEQ ID NO: 7935482 - DNA, 22 bp, Homo sapiens
agcaggagggttttgtagagtc

SEQ ID NO: 7935483 - DNA, 21 bp, Homo sapiens
agcaggaggcagtcacagctc

SEQ ID NO: 7935484 - DNA, 21 bp, Homo sapiens
agcaggaggcagtcacagctc

SEQ ID NO: 7935485 - DNA, 21 bp, Homo sapiens
agcaggaggcagtcacagctc

SEQ ID NO: 7935486 - DNA, 22 bp, Homo sapiens
agcaggagggttttgtagagtc

SEQ ID NO: 7935487 - DNA, 22 bp, Homo sapiens
agcaggagggttttgtagagtc

SEQ ID NO: 7935488 - DNA, 22 bp, Homo sapiens
agcaggagggttttgtagagtc

SEQ ID NO: 7935489 - DNA, 22 bp, Homo sapiens
agcaggagggttttgtagagtc

SEQ ID NO: 7935490 - DNA, 22 bp, Homo sapiens
agcaggagtgtcccctggctgt

SEQ ID NO: 7935491 - DNA, 22 bp, Homo sapiens
agcaggagtgtcccctggctgt

SEQ ID NO: 7935492 - DNA, 22 bp, Homo sapiens
agcaggagggttttgtagagtc

SEQ ID NO: 7935493 - DNA, 22 bp, Homo sapiens
agcaggagggttttgtagagtc

SEQ ID NO: 7935494 - DNA, 22 bp, Homo sapiens
agcaggagggttttgtagagtc

SEQ ID NO: 7935495 - DNA, 22 bp, Homo sapiens
agcaggagggttttgtagagtc

SEQ ID NO: 7935496 - DNA, 22 bp, Homo sapiens
agcaggcaggctgccagtgaat

SEQ ID NO: 7935497 - DNA, 22 bp, Homo sapiens
agcaggcaggctgccagtgaat

SEQ ID NO: 7935498 - DNA, 22 bp, Homo sapiens
agcaggcaggctgccagtgaat

SEQ ID NO: 7935499 - DNA, 22 bp, Homo sapiens
agcaggagtgtcccctggctgt

SEQ ID NO: 7935500 - DNA, 22 bp, Homo sapiens
agcaggagtgtcccctggctgt

SEQ ID NO: 7935501 - DNA, 19 bp, Homo sapiens
agcaggcaggtggcccagg

SEQ ID NO: 7935502 - DNA, 22 bp, Homo sapiens
agcaggcaggctgccagtgaat

SEQ ID NO: 7935503 - DNA, 22 bp, Homo sapiens
agcaggcaggctgccagtgaat

SEQ ID NO: 7935504 - DNA, 21 bp, Homo sapiens
agcaggaggcagtcacagctc

SEQ ID NO: 7935505 - DNA, 21 bp, Homo sapiens
agcaggaggcagtcacagctc

SEQ ID NO: 7935506 - DNA, 21 bp, Homo sapiens
agcaggaggcagtcacagctc

SEQ ID NO: 7935507 - DNA, 22 bp, Homo sapiens
agcaggaggagagcctggcggt

SEQ ID NO: 7935508 - DNA, 22 bp, Homo sapiens
agcaggaggagagcctggcggt

SEQ ID NO: 7935509 - DNA, 22 bp, Homo sapiens
agcaggaggagagcctggcggt

SEQ ID NO: 7935510 - DNA, 22 bp, Homo sapiens
agcaggaggagagcctggcggt

SEQ ID NO: 7935511 - DNA, 22 bp, Homo sapiens
agcaggaggagagcctggcggt

SEQ ID NO: 7935512 - DNA, 22 bp, Homo sapiens
agcaggaggagagcctggcggt

SEQ ID NO: 7935513 - DNA, 22 bp, Homo sapiens
agcaggagctgtgggaagatgg

SEQ ID NO: 7935514 - DNA, 22 bp, Homo sapiens
agcaggagctgtgggaagatgg

SEQ ID NO: 7935515 - DNA, 22 bp, Homo sapiens
agcaggagctgtgggaagatgg

SEQ ID NO: 7935516 - DNA, 22 bp, Homo sapiens
agcaggagctgtgggaagatgg

SEQ ID NO: 7935517 - DNA, 22 bp, Homo sapiens
agcagctgagccccagctgtga

SEQ ID NO: 7935518 - DNA, 22 bp, Homo sapiens
agcaggaacgagttcatgggga

SEQ ID NO: 7935519 - DNA, 22 bp, Homo sapiens
agcaggaacgagttcatgggga

SEQ ID NO: 7935520 - DNA, 22 bp, Homo sapiens
agcaggagcccttatcaccagg

SEQ ID NO: 7935521 - DNA, 22 bp, Homo sapiens
agcaggagcccttatcaccagg

SEQ ID NO: 7935522 - DNA, 22 bp, Homo sapiens
agcaggaacgagttcatgggga

SEQ ID NO: 7935523 - DNA, 22 bp, Homo sapiens
agcagctgagccccagctgtga

SEQ ID NO: 7935524 - DNA, 22 bp, Homo sapiens
agcaggagcccttatcaccagg

SEQ ID NO: 7935525 - DNA, 22 bp, Homo sapiens
agcaggagcccttatcaccagg

SEQ ID NO: 7935526 - DNA, 22 bp, Homo sapiens
agcagctgagccccagctgtga

SEQ ID NO: 7935527 - DNA, 22 bp, Homo sapiens
agcagctgagccccagctgtga

SEQ ID NO: 7935528 - DNA, 22 bp, Homo sapiens
agcagctgagccccagctgtga

SEQ ID NO: 7935529 - DNA, 22 bp, Homo sapiens
agcagctgagatggtaagattc

SEQ ID NO: 7935530 - DNA, 22 bp, Homo sapiens
agcagctgagccccagctgtga

SEQ ID NO: 7935531 - DNA, 22 bp, Homo sapiens
agcagctgagatggtaagattc

SEQ ID NO: 7935532 - DNA, 22 bp, Homo sapiens
agcagctgagatggtaagattc

SEQ ID NO: 7935533 - DNA, 22 bp, Homo sapiens
agcagctgagatggtaagattc

SEQ ID NO: 7935534 - DNA, 22 bp, Homo sapiens
agcagctgagatggtaagattc

SEQ ID NO: 7935535 - DNA, 22 bp, Homo sapiens
agcagctgagatggtaagattc

SEQ ID NO: 7935536 - DNA, 22 bp, Homo sapiens
agcagctctggcactgtagcat

SEQ ID NO: 7935537 - DNA, 22 bp, Homo sapiens
agcagctctggcactgtagcat

SEQ ID NO: 7935538 - DNA, 22 bp, Homo sapiens
agcagctctggcactgtagcat

SEQ ID NO: 7935539 - DNA, 22 bp, Homo sapiens
agcagctctggcactgtagcat

SEQ ID NO: 7935540 - DNA, 22 bp, Homo sapiens
agcagctctggcactgtagcat

SEQ ID NO: 7935541 - DNA, 22 bp, Homo sapiens
agcagctctgtttacctggagg

SEQ ID NO: 7935542 - DNA, 22 bp, Homo sapiens
agcagctctgagaggccagcac

SEQ ID NO: 7935543 - DNA, 22 bp, Homo sapiens
agcagctctgagaggccagcac

SEQ ID NO: 7935544 - DNA, 22 bp, Homo sapiens
agcagctctgagaggccagcac

SEQ ID NO: 7935545 - DNA, 22 bp, Homo sapiens
agcagctcgggctacagagggg

SEQ ID NO: 7935546 - DNA, 22 bp, Homo sapiens
agcagctcctgccatgagtgct

SEQ ID NO: 7935547 - DNA, 17 bp, Homo sapiens
agcagctgaagcagcca

SEQ ID NO: 7935548 - DNA, 17 bp, Homo sapiens
agcagctgaagcagcca

SEQ ID NO: 7935549 - DNA, 17 bp, Homo sapiens
agcagctgaagcagcca

SEQ ID NO: 7935550 - DNA, 22 bp, Homo sapiens
agcagctgaaaggcaaacttct

SEQ ID NO: 7935551 - DNA, 17 bp, Homo sapiens
agcagctgaagcagcca

SEQ ID NO: 7935552 - DNA, 17 bp, Homo sapiens
agcagctgaagcagcca

SEQ ID NO: 7935553 - DNA, 22 bp, Homo sapiens
agcagctgaaaggcaaacttct

SEQ ID NO: 7935554 - DNA, 22 bp, Homo sapiens
agcagctgaaaggcaaacttct

SEQ ID NO: 7935555 - DNA, 22 bp, Homo sapiens
agcagctgaaaggcaaacttct

SEQ ID NO: 7935556 - DNA, 22 bp, Homo sapiens
agcagctgaccagtgagtcctg

SEQ ID NO: 7935557 - DNA, 22 bp, Homo sapiens
agcagctgaccagtgagtcctg

SEQ ID NO: 7935558 - DNA, 22 bp, Homo sapiens
agcagctgaccagtgagtcctg

SEQ ID NO: 7935559 - DNA, 22 bp, Homo sapiens
agcagctgaccagtgagtcctg

SEQ ID NO: 7935560 - DNA, 22 bp, Homo sapiens
agcagctgaccagtgagtcctg

SEQ ID NO: 7935561 - DNA, 22 bp, Homo sapiens
agcagctgaccagtgagtcctg

SEQ ID NO: 7935562 - DNA, 22 bp, Homo sapiens
agcagctgaccagtgagtcctg

SEQ ID NO: 7935563 - DNA, 22 bp, Homo sapiens
agcagctgaccagtgagtcctg

SEQ ID NO: 7935564 - DNA, 17 bp, Homo sapiens
agcagctgaagcagcca

SEQ ID NO: 7935565 - DNA, 17 bp, Homo sapiens
agcagctgaagcagcca

SEQ ID NO: 7935566 - DNA, 23 bp, Homo sapiens
agcagccatagggaagcaataca

SEQ ID NO: 7935567 - DNA, 22 bp, Homo sapiens
agcagccatccttagagaaaga

SEQ ID NO: 7935568 - DNA, 23 bp, Homo sapiens
agcagccatagggaagcaataca

SEQ ID NO: 7935569 - DNA, 23 bp, Homo sapiens
agcagccatagggaagcaataca

SEQ ID NO: 7935570 - DNA, 23 bp, Homo sapiens
agcagccatagggaagcaataca

SEQ ID NO: 7935571 - DNA, 22 bp, Homo sapiens
agcagccatagatagcatgcaa

SEQ ID NO: 7935572 - DNA, 23 bp, Homo sapiens
agcagccatagggaagcaataca

SEQ ID NO: 7935573 - DNA, 22 bp, Homo sapiens
agcagccagttctctgtggtag

SEQ ID NO: 7935574 - DNA, 22 bp, Homo sapiens
agcagccagttctctgtggtag

SEQ ID NO: 7935575 - DNA, 22 bp, Homo sapiens
agcagccagtgggagtgataca

SEQ ID NO: 7935576 - DNA, 22 bp, Homo sapiens
agcagccagtgggagtgataca

SEQ ID NO: 7935577 - DNA, 22 bp, Homo sapiens
agcagccagtgggagtgataca

SEQ ID NO: 7935578 - DNA, 22 bp, Homo sapiens
agcagccatagatagcatgcaa

SEQ ID NO: 7935579 - DNA, 22 bp, Homo sapiens
agcagccatagatagcatgcaa

SEQ ID NO: 7935580 - DNA, 19 bp, Homo sapiens
agcagccatagacaatatg

SEQ ID NO: 7935581 - DNA, 19 bp, Homo sapiens
agcagccatagacaatatg

SEQ ID NO: 7935582 - DNA, 19 bp, Homo sapiens
agcagccatagacaatatg

SEQ ID NO: 7935583 - DNA, 21 bp, Homo sapiens
agcagccatttcacagagact

SEQ ID NO: 7935584 - DNA, 22 bp, Homo sapiens
agcagccatttaaaatgaattg

SEQ ID NO: 7935585 - DNA, 21 bp, Homo sapiens
agcagccatttcacagagact

SEQ ID NO: 7935586 - DNA, 21 bp, Homo sapiens
agcagccatttcacagagact

SEQ ID NO: 7935587 - DNA, 21 bp, Homo sapiens
agcagccatggatggtatgta

SEQ ID NO: 7935588 - DNA, 21 bp, Homo sapiens
agcagccatggatggtatgta

SEQ ID NO: 7935589 - DNA, 21 bp, Homo sapiens
agcagccatggatggtatgta

SEQ ID NO: 7935590 - DNA, 22 bp, Homo sapiens
agcagccatttaaaatgaattg

SEQ ID NO: 7935591 - DNA, 19 bp, Homo sapiens
agcagccatcgaccatgga

SEQ ID NO: 7935592 - DNA, 19 bp, Homo sapiens
agcagccatcgaccatgga

SEQ ID NO: 7935593 - DNA, 19 bp, Homo sapiens
agcagccatcgaccatgga

SEQ ID NO: 7935594 - DNA, 22 bp, Homo sapiens
agaatcagtgagcagttgtgat

SEQ ID NO: 7935595 - DNA, 22 bp, Homo sapiens
agaatcagtgctggctattagc

SEQ ID NO: 7935596 - DNA, 19 bp, Homo sapiens
agaatcaggtcaggtgaca

SEQ ID NO: 7935597 - DNA, 19 bp, Homo sapiens
agaatcaggtcaggtgaca

SEQ ID NO: 7935598 - DNA, 22 bp, Homo sapiens
agaatcagtgagcagttgtgat

SEQ ID NO: 7935599 - DNA, 21 bp, Homo sapiens
agaataatggtatcatttgct

SEQ ID NO: 7935600 - DNA, 22 bp, Homo sapiens
agaatcaggacctgtggctgtc

SEQ ID NO: 7935601 - DNA, 22 bp, Homo sapiens
agaatcattagagagaaaactt

SEQ ID NO: 7935602 - DNA, 22 bp, Homo sapiens
agaatcattagagagaaaactt

SEQ ID NO: 7935603 - DNA, 19 bp, Homo sapiens
agaatcatcttgaagtgat

SEQ ID NO: 7935604 - DNA, 22 bp, Homo sapiens
agaatcagtgctggctattagc

SEQ ID NO: 7935605 - DNA, 21 bp, Homo sapiens
agaatccaagatgccattggc

SEQ ID NO: 7935606 - DNA, 21 bp, Homo sapiens
agaatccattcagaccttctc

SEQ ID NO: 7935607 - DNA, 22 bp, Homo sapiens
agaatcattatatttattaagc

SEQ ID NO: 7935608 - DNA, 22 bp, Homo sapiens
agaatcattatatttattaagc

SEQ ID NO: 7935609 - DNA, 22 bp, Homo sapiens
agaatcattatatttattaagc

SEQ ID NO: 7935610 - DNA, 22 bp, Homo sapiens
agaatcattatatttattaagc

SEQ ID NO: 7935611 - DNA, 22 bp, Homo sapiens
agaataatcactgaagttcaaa

SEQ ID NO: 7935612 - DNA, 22 bp, Homo sapiens
agaataatcactgaagttcaaa

SEQ ID NO: 7935613 - DNA, 22 bp, Homo sapiens
agaataatcactgaagttcaaa

SEQ ID NO: 7935614 - DNA, 22 bp, Homo sapiens
agaataatactgaaatgctgaa

SEQ ID NO: 7935615 - DNA, 22 bp, Homo sapiens
agaataatcactgaagttcaaa

SEQ ID NO: 7935616 - DNA, 22 bp, Homo sapiens
agaataatcactgaagttcaaa

SEQ ID NO: 7935617 - DNA, 22 bp, Homo sapiens
agaataaccagtgtttcacagt

SEQ ID NO: 7935618 - DNA, 22 bp, Homo sapiens
agaataaatgttggacttagga

SEQ ID NO: 7935619 - DNA, 22 bp, Homo sapiens
agaataaatgttggacttagga

SEQ ID NO: 7935620 - DNA, 22 bp, Homo sapiens
agaataaatgttggacttagga

SEQ ID NO: 7935621 - DNA, 22 bp, Homo sapiens
agaataaaatagtctgaagatg

SEQ ID NO: 7935622 - DNA, 22 bp, Homo sapiens
agaataaactgctttagggcag

SEQ ID NO: 7935623 - DNA, 22 bp, Homo sapiens
agaataaaatagtctgaagatg

SEQ ID NO: 7935624 - DNA, 22 bp, Homo sapiens
agaataaaatagtctgaagatg

SEQ ID NO: 7935625 - DNA, 22 bp, Homo sapiens
agaataaaatagtctgaagatg

SEQ ID NO: 7935626 - DNA, 22 bp, Homo sapiens
agaagttttgggaaatactgat

SEQ ID NO: 7935627 - DNA, 22 bp, Homo sapiens
aatggagaccctaaggaagagg

SEQ ID NO: 7935628 - DNA, 22 bp, Homo sapiens
agaataaatgctacctatcaca

SEQ ID NO: 7935629 - DNA, 22 bp, Homo sapiens
agaataaatgctacctatcaca

SEQ ID NO: 7935630 - DNA, 22 bp, Homo sapiens
agaataaatgctacctatcaca

SEQ ID NO: 7935631 - DNA, 22 bp, Homo sapiens
agaataaatgctacctatcaca

SEQ ID NO: 7935632 - DNA, 22 bp, Homo sapiens
agaataaactgctttagggcag

SEQ ID NO: 7935633 - DNA, 22 bp, Homo sapiens
agaataaatcaaatgtcctgag

SEQ ID NO: 7935634 - DNA, 22 bp, Homo sapiens
agaataaatcaaatgtcctgag

SEQ ID NO: 7935635 - DNA, 22 bp, Homo sapiens
agaataaatcaaatgtcctgag

SEQ ID NO: 7935636 - DNA, 22 bp, Homo sapiens
agaataaatgctacctatcaca

SEQ ID NO: 7935637 - DNA, 22 bp, Homo sapiens
aatgctgtatatcttagctaat

SEQ ID NO: 7935638 - DNA, 22 bp, Homo sapiens
aatgctgtatatcttagctaat

SEQ ID NO: 7935639 - DNA, 22 bp, Homo sapiens
aatgctgtaatgaacgtgagag

SEQ ID NO: 7935640 - DNA, 22 bp, Homo sapiens
aatgctgtaaagatgctatctg

SEQ ID NO: 7935641 - DNA, 22 bp, Homo sapiens
aatgctggaagcctcagtagat

SEQ ID NO: 7935642 - DNA, 22 bp, Homo sapiens
aatgctggaagcctcagtagat

SEQ ID NO: 7935643 - DNA, 22 bp, Homo sapiens
aatgaaactagtagaatctttg

SEQ ID NO: 7935644 - DNA, 23 bp, Homo sapiens
aatgctggaaattcaggcatgat

SEQ ID NO: 7935645 - DNA, 23 bp, Homo sapiens
aatgctggaaattcaggcatgat

SEQ ID NO: 7935646 - DNA, 22 bp, Homo sapiens
aatgaaaattggaccctagaac

SEQ ID NO: 7935647 - DNA, 22 bp, Homo sapiens
aatgaaacatatttaggaataa

SEQ ID NO: 7935648 - DNA, 22 bp, Homo sapiens
aatgaaacaattagctgtaata

SEQ ID NO: 7935649 - DNA, 22 bp, Homo sapiens
aatgaaacatatttaggaataa

SEQ ID NO: 7935650 - DNA, 22 bp, Homo sapiens
aatgaaaattggaccctagaac

SEQ ID NO: 7935651 - DNA, 22 bp, Homo sapiens
aatgctttgactatatctataa

SEQ ID NO: 7935652 - DNA, 22 bp, Homo sapiens
aatgctttgactatatctataa

SEQ ID NO: 7935653 - DNA, 22 bp, Homo sapiens
aatgctttgactatatctataa

SEQ ID NO: 7935654 - DNA, 22 bp, Homo sapiens
aatgctttgagggaagatgaaa

SEQ ID NO: 7935655 - DNA, 22 bp, Homo sapiens
aatgctttgagggaagatgaaa

SEQ ID NO: 7935656 - DNA, 22 bp, Homo sapiens
aatgctttgactatatctataa

SEQ ID NO: 7935657 - DNA, 22 bp, Homo sapiens
aatgctttgtctgctccagact

SEQ ID NO: 7935658 - DNA, 22 bp, Homo sapiens
aatgctttggggttggtactgt

SEQ ID NO: 7935659 - DNA, 22 bp, Homo sapiens
aatgctttgccaacagctattg

SEQ ID NO: 7935660 - DNA, 22 bp, Homo sapiens
aatgctttgccaacagctattg

SEQ ID NO: 7935661 - DNA, 22 bp, Homo sapiens
aatgctttgattgattaaaaca

SEQ ID NO: 7935662 - DNA, 22 bp, Homo sapiens
aatgctttgattgattaaaaca

SEQ ID NO: 7935663 - DNA, 22 bp, Homo sapiens
aatgctttgattgattaaaaca

SEQ ID NO: 7935664 - DNA, 22 bp, Homo sapiens
aatgctttgattgattaaaaca

SEQ ID NO: 7935665 - DNA, 19 bp, Homo sapiens
aatggacaggcaatagtct

SEQ ID NO: 7935666 - DNA, 19 bp, Homo sapiens
aatggacaggcaatagtct

SEQ ID NO: 7935667 - DNA, 22 bp, Homo sapiens
aatggaattctccattagatgt

SEQ ID NO: 7935668 - DNA, 22 bp, Homo sapiens
aatggaatgcctcacatgtatt

SEQ ID NO: 7935669 - DNA, 22 bp, Homo sapiens
aatggaatgcctcacatgtatt

SEQ ID NO: 7935670 - DNA, 22 bp, Homo sapiens
aatggaatgcctcacatgtatt

SEQ ID NO: 7935671 - DNA, 22 bp, Homo sapiens
aatggaatacctaggtggccca

SEQ ID NO: 7935672 - DNA, 21 bp, Homo sapiens
aatggaagtttaaaggtatcc

SEQ ID NO: 7935673 - DNA, 22 bp, Homo sapiens
aatggaatacctaggtggccca

SEQ ID NO: 7935674 - DNA, 22 bp, Homo sapiens
aatggaatacctaggtggccca

SEQ ID NO: 7935675 - DNA, 22 bp, Homo sapiens
aatggaatacctaggtggccca

SEQ ID NO: 7935676 - DNA, 22 bp, Homo sapiens
aatggaatacctaggtggccca

SEQ ID NO: 7935677 - DNA, 22 bp, Homo sapiens
aatgcttttacgacatgtacct

SEQ ID NO: 7935678 - DNA, 22 bp, Homo sapiens
aatgcttttacgacatgtacct

SEQ ID NO: 7935679 - DNA, 22 bp, Homo sapiens
aatgcttttacgacatgtacct

SEQ ID NO: 7935680 - DNA, 22 bp, Homo sapiens
aatgcttttacgacatgtacct

SEQ ID NO: 7935681 - DNA, 22 bp, Homo sapiens
aatgctttgtctgctccagact

SEQ ID NO: 7935682 - DNA, 22 bp, Homo sapiens
aatgcttttgctgtcattgctt

SEQ ID NO: 7935683 - DNA, 22 bp, Homo sapiens
aatgctttttgcgaaatgtgca

SEQ ID NO: 7935684 - DNA, 22 bp, Homo sapiens
aatgcttttgctgtcattgctt

SEQ ID NO: 7935685 - DNA, 22 bp, Homo sapiens
aatgctttttgcgaaatgtgca

SEQ ID NO: 7935686 - DNA, 22 bp, Homo sapiens
aatgctttttgcgaaatgtgca

SEQ ID NO: 7935687 - DNA, 22 bp, Homo sapiens
aatgctttttgcgaaatgtgca

SEQ ID NO: 7935688 - DNA, 22 bp, Homo sapiens
aatggaacctagttatccacat

SEQ ID NO: 7935689 - DNA, 18 bp, Homo sapiens
aatggaaggggtgctgtt

SEQ ID NO: 7935690 - DNA, 21 bp, Homo sapiens
aatggaagtttaaaggtatcc

SEQ ID NO: 7935691 - DNA, 18 bp, Homo sapiens
aatggaaggggtgctgtt

SEQ ID NO: 7935692 - DNA, 22 bp, Homo sapiens
aatggaacttgtaattatgtcc

SEQ ID NO: 7935693 - DNA, 22 bp, Homo sapiens
agaatctgaaggcacctctggt

SEQ ID NO: 7935694 - DNA, 20 bp, Homo sapiens
agaatctgacccagagagac

SEQ ID NO: 7935695 - DNA, 22 bp, Homo sapiens
agaatctctactcaagtacttg

SEQ ID NO: 7935696 - DNA, 22 bp, Homo sapiens
agaatctctactcaagtacttg

SEQ ID NO: 7935697 - DNA, 22 bp, Homo sapiens
agaatctctactcaagtacttg

SEQ ID NO: 7935698 - DNA, 22 bp, Homo sapiens
agaatctctactcaagtacttg

SEQ ID NO: 7935699 - DNA, 22 bp, Homo sapiens
agaatctacattttaacaagat

SEQ ID NO: 7935700 - DNA, 22 bp, Homo sapiens
agaatctaagtacacagacaga

SEQ ID NO: 7935701 - DNA, 22 bp, Homo sapiens
agaatctacattttaacaagat

SEQ ID NO: 7935702 - DNA, 22 bp, Homo sapiens
agaatctacattttaacaagat

SEQ ID NO: 7935703 - DNA, 22 bp, Homo sapiens
agaatcttcagatgatttgtca

SEQ ID NO: 7935704 - DNA, 22 bp, Homo sapiens
agaatctgctttttaacaagat

SEQ ID NO: 7935705 - DNA, 22 bp, Homo sapiens
agaatctgcatttttaataaca

SEQ ID NO: 7935706 - DNA, 22 bp, Homo sapiens
agaatctgcatttttaataaca

SEQ ID NO: 7935707 - DNA, 22 bp, Homo sapiens
agaatctgcattttaacaagat

SEQ ID NO: 7935708 - DNA, 22 bp, Homo sapiens
agaatctgcatttctaataagc

SEQ ID NO: 7935709 - DNA, 22 bp, Homo sapiens
agaatctgcattttaacaagcc

SEQ ID NO: 7935710 - DNA, 22 bp, Homo sapiens
agaatctgcattttaacaagct

SEQ ID NO: 7935711 - DNA, 22 bp, Homo sapiens
agaatctaagtacacagacaga

SEQ ID NO: 7935712 - DNA, 22 bp, Homo sapiens
agaatctaagtacacagacaga

SEQ ID NO: 7935713 - DNA, 22 bp, Homo sapiens
agaatctaaatatgcaatttga

SEQ ID NO: 7935714 - DNA, 19 bp, Homo sapiens
agaatctaaattatttctg

SEQ ID NO: 7935715 - DNA, 22 bp, Homo sapiens
agaatccttgactcaggctgag

SEQ ID NO: 7935716 - DNA, 22 bp, Homo sapiens
agaatctaaatatgcaatttga

SEQ ID NO: 7935717 - DNA, 22 bp, Homo sapiens
agaatcctcttcagtaaattct

SEQ ID NO: 7935718 - DNA, 22 bp, Homo sapiens
agaatcctgttttacttcatca

SEQ ID NO: 7935719 - DNA, 22 bp, Homo sapiens
agaatcctgttttacttcatca

SEQ ID NO: 7935720 - DNA, 22 bp, Homo sapiens
agaatccttgactcaggctgag

SEQ ID NO: 7935721 - DNA, 22 bp, Homo sapiens
agaatcctattgtcagattctt

SEQ ID NO: 7935722 - DNA, 22 bp, Homo sapiens
agaatcctcttcagtaaattct

SEQ ID NO: 7935723 - DNA, 22 bp, Homo sapiens
agaatcctgatgaaaaggagag

SEQ ID NO: 7935724 - DNA, 22 bp, Homo sapiens
agaatcctggagaagctgtacc

SEQ ID NO: 7935725 - DNA, 22 bp, Homo sapiens
agaatcctggccaggtcagagc

SEQ ID NO: 7935726 - DNA, 21 bp, Homo sapiens
agaatccattcagaccttctc

SEQ ID NO: 7935727 - DNA, 21 bp, Homo sapiens
agaatccattcagaccttctc

SEQ ID NO: 7935728 - DNA, 21 bp, Homo sapiens
agaatccattcagaccttctc

SEQ ID NO: 7935729 - DNA, 19 bp, Homo sapiens
agaatcccaggccccactg

SEQ ID NO: 7935730 - DNA, 22 bp, Homo sapiens
agaatccctggggagctgcagc

SEQ ID NO: 7935731 - DNA, 22 bp, Homo sapiens
agaatccctggggagctgcagc

SEQ ID NO: 7935732 - DNA, 22 bp, Homo sapiens
agaatccctgcttgtcttcaaa

SEQ ID NO: 7935733 - DNA, 22 bp, Homo sapiens
agaattgttctgtagcttggct

SEQ ID NO: 7935734 - DNA, 22 bp, Homo sapiens
agaattgttctgtagcttggct

SEQ ID NO: 7935735 - DNA, 22 bp, Homo sapiens
agaatcttgggcaaattcatct

SEQ ID NO: 7935736 - DNA, 22 bp, Homo sapiens
agaatcttggaactcagatcac

SEQ ID NO: 7935737 - DNA, 22 bp, Homo sapiens
agaatcttggaactcagatcac

SEQ ID NO: 7935738 - DNA, 22 bp, Homo sapiens
agaatcttcggtaactggaaga

SEQ ID NO: 7935739 - DNA, 22 bp, Homo sapiens
agaatcttcagtctaattccta

SEQ ID NO: 7935740 - DNA, 22 bp, Homo sapiens
agaattgtaagcaatttgatta

SEQ ID NO: 7935741 - DNA, 22 bp, Homo sapiens
agaattgtaagcaatttgatta

SEQ ID NO: 7935742 - DNA, 22 bp, Homo sapiens
agaatttcaaaaggaagccagc

SEQ ID NO: 7935743 - DNA, 22 bp, Homo sapiens
agaatttcaaaaggaagccagc

SEQ ID NO: 7935744 - DNA, 22 bp, Homo sapiens
agaatttatgacaacgatagcc

SEQ ID NO: 7935745 - DNA, 23 bp, Homo sapiens
agaatttcaaagtccagcacatt

SEQ ID NO: 7935746 - DNA, 23 bp, Homo sapiens
agaatttcaaagtccagcacatt

SEQ ID NO: 7935747 - DNA, 22 bp, Homo sapiens
agaatttaggatgcatgtgaat

SEQ ID NO: 7935748 - DNA, 22 bp, Homo sapiens
agaatttaggatgcatgtgaat

SEQ ID NO: 7935749 - DNA, 22 bp, Homo sapiens
agaatttagctccttggtcata

SEQ ID NO: 7935750 - DNA, 22 bp, Homo sapiens
agaatttaggatgcatgtgaat

SEQ ID NO: 7935751 - DNA, 22 bp, Homo sapiens
agaatttagctccttggtcata

SEQ ID NO: 7935752 - DNA, 22 bp, Homo sapiens
aatgtataaagtgttaataact

SEQ ID NO: 7935753 - DNA, 22 bp, Homo sapiens
aatgtataaagtgttaataact

SEQ ID NO: 7935754 - DNA, 22 bp, Homo sapiens
aatgtataaagtgttaataact

SEQ ID NO: 7935755 - DNA, 22 bp, Homo sapiens
aatgtataaagtgttaataact

SEQ ID NO: 7935756 - DNA, 22 bp, Homo sapiens
aatgtataaagtgttaataact

SEQ ID NO: 7935757 - DNA, 22 bp, Homo sapiens
aatgtataaagtgttaataact

SEQ ID NO: 7935758 - DNA, 22 bp, Homo sapiens
aatgtataaagtgttaataact

SEQ ID NO: 7935759 - DNA, 22 bp, Homo sapiens
aatgtagttcacaattggtact

SEQ ID NO: 7935760 - DNA, 22 bp, Homo sapiens
aatgtagatgagatattttttg

SEQ ID NO: 7935761 - DNA, 22 bp, Homo sapiens
aatgtagaatgatccttaggat

SEQ ID NO: 7935762 - DNA, 22 bp, Homo sapiens
aatgtaccagcctaagaagtgg

SEQ ID NO: 7935763 - DNA, 22 bp, Homo sapiens
aatgtacagctgtctttcctcc

SEQ ID NO: 7935764 - DNA, 22 bp, Homo sapiens
aatgtacagctgtctttcctcc

SEQ ID NO: 7935765 - DNA, 22 bp, Homo sapiens
aatgtacagctgtctttcctcc

SEQ ID NO: 7935766 - DNA, 22 bp, Homo sapiens
aatgtacagctgctgctgaagg

SEQ ID NO: 7935767 - DNA, 22 bp, Homo sapiens
aatgtacagctgctgctgaagg

SEQ ID NO: 7935768 - DNA, 22 bp, Homo sapiens
aatgtacagctgctgctgaagg

SEQ ID NO: 7935769 - DNA, 22 bp, Homo sapiens
aatgtacagctgctgctgaagg

SEQ ID NO: 7935770 - DNA, 22 bp, Homo sapiens
aatgtacatctcagtgtagtac

SEQ ID NO: 7935771 - DNA, 22 bp, Homo sapiens
aatgtacatctcagtgtagtac

SEQ ID NO: 7935772 - DNA, 22 bp, Homo sapiens
aatgtacatctcagtgtagtac

SEQ ID NO: 7935773 - DNA, 22 bp, Homo sapiens
aatgtacaggctggctatgggg

SEQ ID NO: 7935774 - DNA, 22 bp, Homo sapiens
aatgtacaggctggctatgggg

SEQ ID NO: 7935775 - DNA, 22 bp, Homo sapiens
aatgtacaggctggctatgggg

SEQ ID NO: 7935776 - DNA, 22 bp, Homo sapiens
aatgtaaacagcaagagaaggg

SEQ ID NO: 7935777 - DNA, 22 bp, Homo sapiens
aatgtaaacagcaagagaaggg

SEQ ID NO: 7935778 - DNA, 22 bp, Homo sapiens
aatgtaaacagcaagagaaggg

SEQ ID NO: 7935779 - DNA, 23 bp, Homo sapiens
agacaaaagcctcagtcttaggc

SEQ ID NO: 7935780 - DNA, 23 bp, Homo sapiens
agacaaaagcctcagtcttaggc

SEQ ID NO: 7935781 - DNA, 23 bp, Homo sapiens
agacaaaagcctcagtcttaggc

SEQ ID NO: 7935782 - DNA, 23 bp, Homo sapiens
agacaaaagcctcagtcttaggc

SEQ ID NO: 7935783 - DNA, 22 bp, Homo sapiens
aatgtacaccgtgggtttttta

SEQ ID NO: 7935784 - DNA, 22 bp, Homo sapiens
aatgtacactgaaagcctatca

SEQ ID NO: 7935785 - DNA, 22 bp, Homo sapiens
aatgtacactgaaagcctatca

SEQ ID NO: 7935786 - DNA, 22 bp, Homo sapiens
aatgtacactgaaagcctatca

SEQ ID NO: 7935787 - DNA, 22 bp, Homo sapiens
agaatttttgattatctactcg

SEQ ID NO: 7935788 - DNA, 22 bp, Homo sapiens
agaattttatctaaagggagta

SEQ ID NO: 7935789 - DNA, 22 bp, Homo sapiens
agaatttttgattatctactcg

SEQ ID NO: 7935790 - DNA, 22 bp, Homo sapiens
agaatttttgcagtttagccat

SEQ ID NO: 7935791 - DNA, 23 bp, Homo sapiens
agacaaaagcctcagtcttaggc

SEQ ID NO: 7935792 - DNA, 23 bp, Homo sapiens
agacaaaagcctcagtcttaggc

SEQ ID NO: 7935793 - DNA, 22 bp, Homo sapiens
agaatttctggaagattgcaag

SEQ ID NO: 7935794 - DNA, 23 bp, Homo sapiens
agaatttctaactctagctctgt

SEQ ID NO: 7935795 - DNA, 22 bp, Homo sapiens
agaatttcctatgagagattcc

SEQ ID NO: 7935796 - DNA, 23 bp, Homo sapiens
agaatttctaactctagctctgt

SEQ ID NO: 7935797 - DNA, 22 bp, Homo sapiens
agaatttgtaaaagataagaca

SEQ ID NO: 7935798 - DNA, 22 bp, Homo sapiens
agaatttgagtgctttctgtgt

SEQ ID NO: 7935799 - DNA, 22 bp, Homo sapiens
agactctggaggggctggtcct

SEQ ID NO: 7935800 - DNA, 22 bp, Homo sapiens
agactctggcatgctaactagt

SEQ ID NO: 7935801 - DNA, 22 bp, Homo sapiens
agactctgggattttgaaagca

SEQ ID NO: 7935802 - DNA, 21 bp, Homo sapiens
agacactggtttagcattcat

SEQ ID NO: 7935803 - DNA, 22 bp, Homo sapiens
agacactggtgaagaaatcagg

SEQ ID NO: 7935804 - DNA, 22 bp, Homo sapiens
agacactggtgaagaaatcagg

SEQ ID NO: 7935805 - DNA, 22 bp, Homo sapiens
agacactggtgaagaaatcagg

SEQ ID NO: 7935806 - DNA, 22 bp, Homo sapiens
agacactggtgaagaaatcagg

SEQ ID NO: 7935807 - DNA, 22 bp, Homo sapiens
agacactggtgaagaaatcagg

SEQ ID NO: 7935808 - DNA, 22 bp, Homo sapiens
agacactggcactggggaagcc

SEQ ID NO: 7935809 - DNA, 22 bp, Homo sapiens
agacactggcactggggaagcc

SEQ ID NO: 7935810 - DNA, 22 bp, Homo sapiens
agacctgaagagtatcttcaga

SEQ ID NO: 7935811 - DNA, 22 bp, Homo sapiens
agacctgaagagtatcttcaga

SEQ ID NO: 7935812 - DNA, 19 bp, Homo sapiens
agactctgccactcttctc

SEQ ID NO: 7935813 - DNA, 22 bp, Homo sapiens
agacctctggatagatgtgagg

SEQ ID NO: 7935814 - DNA, 22 bp, Homo sapiens
agacctctacgtgcgtctcatc

SEQ ID NO: 7935815 - DNA, 21 bp, Homo sapiens
agacactggtttagcattcat

SEQ ID NO: 7935816 - DNA, 22 bp, Homo sapiens
agacctctgctcccttcatggt

SEQ ID NO: 7935817 - DNA, 22 bp, Homo sapiens
agacactgatgttcagctcaat

SEQ ID NO: 7935818 - DNA, 17 bp, Homo sapiens
agacactgagccaagta

SEQ ID NO: 7935819 - DNA, 22 bp, Homo sapiens
agacactgagcattttcctagc

SEQ ID NO: 7935820 - DNA, 22 bp, Homo sapiens
agacactgagcattttcctagc

SEQ ID NO: 7935821 - DNA, 22 bp, Homo sapiens
agacactgccacttctgttccc

SEQ ID NO: 7935822 - DNA, 22 bp, Homo sapiens
agacactgatgttcagctcaat

SEQ ID NO: 7935823 - DNA, 17 bp, Homo sapiens
agacactgagccaagta

SEQ ID NO: 7935824 - DNA, 22 bp, Homo sapiens
agacactgcggaggtcgggtgg

SEQ ID NO: 7935825 - DNA, 19 bp, Homo sapiens
agacactggatggaaaatg

SEQ ID NO: 7935826 - DNA, 19 bp, Homo sapiens
agacactggatggaaaatg

SEQ ID NO: 7935827 - DNA, 22 bp, Homo sapiens
agacacctaatagatgaattca

SEQ ID NO: 7935828 - DNA, 22 bp, Homo sapiens
aatgtataaccataggaaattt

SEQ ID NO: 7935829 - DNA, 22 bp, Homo sapiens
aatgtataaccataggaaattt

SEQ ID NO: 7935830 - DNA, 22 bp, Homo sapiens
aatgtataaccataggaaattt

SEQ ID NO: 7935831 - DNA, 22 bp, Homo sapiens
aatgtataaccataggaaattt

SEQ ID NO: 7935832 - DNA, 21 bp, Homo sapiens
aatgtataacagagcccatca

SEQ ID NO: 7935833 - DNA, 22 bp, Homo sapiens
agacactgaaatgtattgaaga

SEQ ID NO: 7935834 - DNA, 22 bp, Homo sapiens
agacactgaaatgtattgaaga

SEQ ID NO: 7935835 - DNA, 22 bp, Homo sapiens
agacacctgccacccagagctc

SEQ ID NO: 7935836 - DNA, 22 bp, Homo sapiens
agacactgaaatgtattgaaga

SEQ ID NO: 7935837 - DNA, 22 bp, Homo sapiens
agacactgaatcagagggacat

SEQ ID NO: 7935838 - DNA, 22 bp, Homo sapiens
agacactgaatcagagggacat

SEQ ID NO: 7935839 - DNA, 22 bp, Homo sapiens
agacactgaatcagagggacat

SEQ ID NO: 7935840 - DNA, 22 bp, Homo sapiens
agacactgaatgtttggtggtc

SEQ ID NO: 7935841 - DNA, 22 bp, Homo sapiens
agactgaaatagtgcacaccaa

SEQ ID NO: 7935842 - DNA, 22 bp, Homo sapiens
agactcttggtcattggcatta

SEQ ID NO: 7935843 - DNA, 19 bp, Homo sapiens
agactctgtgtgagacttt

SEQ ID NO: 7935844 - DNA, 22 bp, Homo sapiens
agactcttggagaagagctata

SEQ ID NO: 7935845 - DNA, 19 bp, Homo sapiens
agactctgtgtgagacttt

SEQ ID NO: 7935846 - DNA, 22 bp, Homo sapiens
agactgaagtaagaatgcagct

SEQ ID NO: 7935847 - DNA, 22 bp, Homo sapiens
agactgaagctccttgaggaca

SEQ ID NO: 7935848 - DNA, 22 bp, Homo sapiens
agactgaagcaattcaaccagt

SEQ ID NO: 7935849 - DNA, 22 bp, Homo sapiens
agactgaataacaagcaaataa

SEQ ID NO: 7935850 - DNA, 22 bp, Homo sapiens
agactgaagtaagaatgcagct

SEQ ID NO: 7935851 - DNA, 22 bp, Homo sapiens
agactgaagtaagaatgcagct

SEQ ID NO: 7935852 - DNA, 22 bp, Homo sapiens
agactgaataacaagcaaataa

SEQ ID NO: 7935853 - DNA, 22 bp, Homo sapiens
agactgcatattgtcctttaga

SEQ ID NO: 7935854 - DNA, 22 bp, Homo sapiens
agactgcagcaaccccttcagc

SEQ ID NO: 7935855 - DNA, 22 bp, Homo sapiens
agactgatattaactttagtgt

SEQ ID NO: 7935856 - DNA, 23 bp, Homo sapiens
agactgaggctgccagggtcaga

SEQ ID NO: 7935857 - DNA, 23 bp, Homo sapiens
agactgaggctgccagggtcaga

SEQ ID NO: 7935858 - DNA, 22 bp, Homo sapiens
agactgggattctccctgatca

SEQ ID NO: 7935859 - DNA, 22 bp, Homo sapiens
agactgggccatttccccagct

SEQ ID NO: 7935860 - DNA, 22 bp, Homo sapiens
agactgggccatttccccagct

SEQ ID NO: 7935861 - DNA, 22 bp, Homo sapiens
agactggaagcctgccaagcaa

SEQ ID NO: 7935862 - DNA, 21 bp, Homo sapiens
agactgccattgttcttttgg

SEQ ID NO: 7935863 - DNA, 21 bp, Homo sapiens
agactgccatctttgggccac

SEQ ID NO: 7935864 - DNA, 22 bp, Homo sapiens
agagaaactgatgtcctttgaa

SEQ ID NO: 7935865 - DNA, 22 bp, Homo sapiens
agagaaactgatgtcctttgaa

SEQ ID NO: 7935866 - DNA, 22 bp, Homo sapiens
agagaaacccttcagtgttttg

SEQ ID NO: 7935867 - DNA, 22 bp, Homo sapiens
agagaaacaggtcagctgggag

SEQ ID NO: 7935868 - DNA, 22 bp, Homo sapiens
agagaaacaggtcagctgggag

SEQ ID NO: 7935869 - DNA, 23 bp, Homo sapiens
agactggggcataagaagatggc

SEQ ID NO: 7935870 - DNA, 22 bp, Homo sapiens
agactggggttctggcaaggag

SEQ ID NO: 7935871 - DNA, 22 bp, Homo sapiens
agagaaacaggtcagctgggag

SEQ ID NO: 7935872 - DNA, 23 bp, Homo sapiens
agactggggcataagaagatggc

SEQ ID NO: 7935873 - DNA, 22 bp, Homo sapiens
agactgggccatttccccagct

SEQ ID NO: 7935874 - DNA, 19 bp, Homo sapiens
agagaaagaattgagtcta

SEQ ID NO: 7935875 - DNA, 19 bp, Homo sapiens
agagaaagaattgagtcta

SEQ ID NO: 7935876 - DNA, 19 bp, Homo sapiens
agagaaagaattgagtcta

SEQ ID NO: 7935877 - DNA, 19 bp, Homo sapiens
agagaaagaattgagtcta

SEQ ID NO: 7935878 - DNA, 18 bp, Homo sapiens
agagaaagaccaaagcat

SEQ ID NO: 7935879 - DNA, 18 bp, Homo sapiens
agagaaagaccaaagcat

SEQ ID NO: 7935880 - DNA, 18 bp, Homo sapiens
agagaaagaccaaagcat

SEQ ID NO: 7935881 - DNA, 18 bp, Homo sapiens
agagaaagaccaaagcat

SEQ ID NO: 7935882 - DNA, 23 bp, Homo sapiens
agagaaagggataacacgttgaa

SEQ ID NO: 7935883 - DNA, 22 bp, Homo sapiens
agagaaagtaaagattctacct

SEQ ID NO: 7935884 - DNA, 23 bp, Homo sapiens
agagaaagggataacacgttgaa

SEQ ID NO: 7935885 - DNA, 23 bp, Homo sapiens
agagaaagggataacacgttgaa

SEQ ID NO: 7935886 - DNA, 23 bp, Homo sapiens
agagaaagggataacacgttgaa

SEQ ID NO: 7935887 - DNA, 23 bp, Homo sapiens
agagaaagggataacacgttgaa

SEQ ID NO: 7935888 - DNA, 18 bp, Homo sapiens
agagaaagaccaaagcat

SEQ ID NO: 7935889 - DNA, 22 bp, Homo sapiens
agagatcaaagcttgccaagta

SEQ ID NO: 7935890 - DNA, 22 bp, Homo sapiens
agagatcaaagcttgccaagta

SEQ ID NO: 7935891 - DNA, 22 bp, Homo sapiens
agagatattatttaccaagtta

SEQ ID NO: 7935892 - DNA, 19 bp, Homo sapiens
agagatccagcttctagct

SEQ ID NO: 7935893 - DNA, 22 bp, Homo sapiens
agagatcccttctgcctgggga

SEQ ID NO: 7935894 - DNA, 22 bp, Homo sapiens
agagatccttcaatctagtttt

SEQ ID NO: 7935895 - DNA, 22 bp, Homo sapiens
agagatctagcacctgctggtc

SEQ ID NO: 7935896 - DNA, 22 bp, Homo sapiens
agagatcagttaaaatcttttt

SEQ ID NO: 7935897 - DNA, 22 bp, Homo sapiens
agagatctctgaagctgctgct

SEQ ID NO: 7935898 - DNA, 22 bp, Homo sapiens
agagatctctgaagctgctgct

SEQ ID NO: 7935899 - DNA, 22 bp, Homo sapiens
aattatgtagccatatgaaaca

SEQ ID NO: 7935900 - DNA, 22 bp, Homo sapiens
aattatgtgcttgcttgtttcc

SEQ ID NO: 7935901 - DNA, 22 bp, Homo sapiens
aattatgtagccatatgaaaca

SEQ ID NO: 7935902 - DNA, 21 bp, Homo sapiens
agagatctgaagaaccattag

SEQ ID NO: 7935903 - DNA, 21 bp, Homo sapiens
agagatctgaagaaccattag

SEQ ID NO: 7935904 - DNA, 22 bp, Homo sapiens
agagatctgtgcttactacaag

SEQ ID NO: 7935905 - DNA, 22 bp, Homo sapiens
agagatctgtctactatttaag

SEQ ID NO: 7935906 - DNA, 22 bp, Homo sapiens
aattcacagaaccatggtgctc

SEQ ID NO: 7935907 - DNA, 22 bp, Homo sapiens
aattcacacctccggtttttct

SEQ ID NO: 7935908 - DNA, 22 bp, Homo sapiens
aattcacagaaccatggtgctc

SEQ ID NO: 7935909 - DNA, 22 bp, Homo sapiens
aattcacacctccggtttttct

SEQ ID NO: 7935910 - DNA, 22 bp, Homo sapiens
aattcacagaaccatggtgctc

SEQ ID NO: 7935911 - DNA, 22 bp, Homo sapiens
aattatgtttgctttagatgga

SEQ ID NO: 7935912 - DNA, 22 bp, Homo sapiens
agagataattaggttaaatgag

SEQ ID NO: 7935913 - DNA, 22 bp, Homo sapiens
agagataattaggttaaatgag

SEQ ID NO: 7935914 - DNA, 22 bp, Homo sapiens
agagataccaaataggcagtta

SEQ ID NO: 7935915 - DNA, 22 bp, Homo sapiens
agagataccaaataggcagtta

SEQ ID NO: 7935916 - DNA, 22 bp, Homo sapiens
agagatacttttctttggatgc

SEQ ID NO: 7935917 - DNA, 17 bp, Homo sapiens
agagataaggcggagaa

SEQ ID NO: 7935918 - DNA, 22 bp, Homo sapiens
agagataaagctatgatttatg

SEQ ID NO: 7935919 - DNA, 22 bp, Homo sapiens
agagataaagctatgatttatg

SEQ ID NO: 7935920 - DNA, 22 bp, Homo sapiens
agagatataagtataaataggg

SEQ ID NO: 7935921 - DNA, 22 bp, Homo sapiens
agagatatatatttgtttacca

SEQ ID NO: 7935922 - DNA, 22 bp, Homo sapiens
agagatataagtataaataggg

SEQ ID NO: 7935923 - DNA, 21 bp, Homo sapiens
agagatagactagaattgatg

SEQ ID NO: 7935924 - DNA, 22 bp, Homo sapiens
agagatatgctgcctaaattta

SEQ ID NO: 7935925 - DNA, 22 bp, Homo sapiens
agagatatgagtagttgtgaca

SEQ ID NO: 7935926 - DNA, 22 bp, Homo sapiens
agagatattatttaccaagtta

SEQ ID NO: 7935927 - DNA, 20 bp, Homo sapiens
agagagcacaggcaggaaag

SEQ ID NO: 7935928 - DNA, 20 bp, Homo sapiens
agagagcacaggcaggaaag

SEQ ID NO: 7935929 - DNA, 20 bp, Homo sapiens
agagagcacaggcaggaaag

SEQ ID NO: 7935930 - DNA, 23 bp, Homo sapiens
agagagagtttgtgtcaggtacc

SEQ ID NO: 7935931 - DNA, 23 bp, Homo sapiens
agagagagtttgtgtcaggtacc

SEQ ID NO: 7935932 - DNA, 22 bp, Homo sapiens
agagagcagtggatcacctagc

SEQ ID NO: 7935933 - DNA, 22 bp, Homo sapiens
agagagcagtctggaagaaaca

SEQ ID NO: 7935934 - DNA, 22 bp, Homo sapiens
agagagcagtctggaagaaaca

SEQ ID NO: 7935935 - DNA, 22 bp, Homo sapiens
agagagcagtctggaagaaaca

SEQ ID NO: 7935936 - DNA, 22 bp, Homo sapiens
agagagcaggacttcactgagc

SEQ ID NO: 7935937 - DNA, 22 bp, Homo sapiens
agagagcaggacttcactgagc

SEQ ID NO: 7935938 - DNA, 22 bp, Homo sapiens
agagagcaggacttcactgagc

SEQ ID NO: 7935939 - DNA, 20 bp, Homo sapiens
agagagaggtaaattgagca

SEQ ID NO: 7935940 - DNA, 22 bp, Homo sapiens
agagagagggaaactgctaaac

SEQ ID NO: 7935941 - DNA, 22 bp, Homo sapiens
agagagaggggcgagcaaacac

SEQ ID NO: 7935942 - DNA, 22 bp, Homo sapiens
agagagaggcagcagtgctcac

SEQ ID NO: 7935943 - DNA, 22 bp, Homo sapiens
agagagaggcagcagtgctcac

SEQ ID NO: 7935944 - DNA, 22 bp, Homo sapiens
agagagaggcagcagtgctcac

SEQ ID NO: 7935945 - DNA, 17 bp, Homo sapiens
agagagagcatgccacc

SEQ ID NO: 7935946 - DNA, 22 bp, Homo sapiens
agagagagaaatgaaatgtgct

SEQ ID NO: 7935947 - DNA, 17 bp, Homo sapiens
agagagagcatgccacc

SEQ ID NO: 7935948 - DNA, 22 bp, Homo sapiens
agagaaatatttaggaaaggag

SEQ ID NO: 7935949 - DNA, 22 bp, Homo sapiens
agagaaatagattggtccagaa

SEQ ID NO: 7935950 - DNA, 22 bp, Homo sapiens
agagaaatatttaggaaaggag

SEQ ID NO: 7935951 - DNA, 22 bp, Homo sapiens
agagaaatgattcctgggcaga

SEQ ID NO: 7935952 - DNA, 22 bp, Homo sapiens
agagacagggttttgccatgtt

SEQ ID NO: 7935953 - DNA, 22 bp, Homo sapiens
agagacagggttttgccatgtt

SEQ ID NO: 7935954 - DNA, 21 bp, Homo sapiens
agagagaaggccatatggtcc

SEQ ID NO: 7935955 - DNA, 18 bp, Homo sapiens
agagagaattccagtagg

SEQ ID NO: 7935956 - DNA, 22 bp, Homo sapiens
agagagaattggataaattggt

SEQ ID NO: 7935957 - DNA, 22 bp, Homo sapiens
agagagaattggataaattggt

SEQ ID NO: 7935958 - DNA, 22 bp, Homo sapiens
agagagacgggggctgctgctt

SEQ ID NO: 7935959 - DNA, 22 bp, Homo sapiens
agagaaagtaaagattctacct

SEQ ID NO: 7935960 - DNA, 22 bp, Homo sapiens
agagaaagtaaagattctacct

SEQ ID NO: 7935961 - DNA, 21 bp, Homo sapiens
agagaaagtcatggctgtggc

SEQ ID NO: 7935962 - DNA, 21 bp, Homo sapiens
agagaaagtcatggctgtggc

SEQ ID NO: 7935963 - DNA, 21 bp, Homo sapiens
agagaaagtcatggctgtggc

SEQ ID NO: 7935964 - DNA, 21 bp, Homo sapiens
agagaaagtcatggctgtggc

SEQ ID NO: 7935965 - DNA, 21 bp, Homo sapiens
agagaaagtcatggctgtggc

SEQ ID NO: 7935966 - DNA, 21 bp, Homo sapiens
agagaaagtcatggctgtggc

SEQ ID NO: 7935967 - DNA, 21 bp, Homo sapiens
agagaaagtcatggctgtggc

SEQ ID NO: 7935968 - DNA, 22 bp, Homo sapiens
agagaaagtcctgatctctcta

SEQ ID NO: 7935969 - DNA, 22 bp, Homo sapiens
agagaaagtcctgatctctcta

SEQ ID NO: 7935970 - DNA, 22 bp, Homo sapiens
agagaaagtcctgatctctcta

SEQ ID NO: 7935971 - DNA, 22 bp, Homo sapiens
agagaaagtcctgatctctcta

SEQ ID NO: 7935972 - DNA, 22 bp, Homo sapiens
agagcagcgtttgtggaacact

SEQ ID NO: 7935973 - DNA, 22 bp, Homo sapiens
agagcagcgtttgtggaacact

SEQ ID NO: 7935974 - DNA, 22 bp, Homo sapiens
agagcagcgtttgtggaacact

SEQ ID NO: 7935975 - DNA, 22 bp, Homo sapiens
agagcagctcgctacctctcta

SEQ ID NO: 7935976 - DNA, 22 bp, Homo sapiens
agagcagcgtttgtggaacact

SEQ ID NO: 7935977 - DNA, 22 bp, Homo sapiens
agagcagcgtttgtggaacact

SEQ ID NO: 7935978 - DNA, 22 bp, Homo sapiens
agagcagcgtttgtggaacact

SEQ ID NO: 7935979 - DNA, 22 bp, Homo sapiens
aattcatactctatattgcttt

SEQ ID NO: 7935980 - DNA, 22 bp, Homo sapiens
agagcagctgcattcagcacct

SEQ ID NO: 7935981 - DNA, 22 bp, Homo sapiens
agagcagctgcattcagcacct

SEQ ID NO: 7935982 - DNA, 22 bp, Homo sapiens
agagcagctgcattcagcacct

SEQ ID NO: 7935983 - DNA, 22 bp, Homo sapiens
agagcagctgacagcctgccat

SEQ ID NO: 7935984 - DNA, 22 bp, Homo sapiens
agagcagctgacagcctgccat

SEQ ID NO: 7935985 - DNA, 22 bp, Homo sapiens
agagcagctgacagcctgccat

SEQ ID NO: 7935986 - DNA, 22 bp, Homo sapiens
agagcagctgacagcctgccat

SEQ ID NO: 7935987 - DNA, 22 bp, Homo sapiens
aattcagttatatgtccacttc

SEQ ID NO: 7935988 - DNA, 22 bp, Homo sapiens
aattcagttgacagctaatgcc

SEQ ID NO: 7935989 - DNA, 22 bp, Homo sapiens
aattcagttgacagctaatgcc

SEQ ID NO: 7935990 - DNA, 22 bp, Homo sapiens
aattcagttatatgtccacttc

SEQ ID NO: 7935991 - DNA, 22 bp, Homo sapiens
aattcagtgtctggcactgctg

SEQ ID NO: 7935992 - DNA, 22 bp, Homo sapiens
aattcagtgtctggcactgctg

SEQ ID NO: 7935993 - DNA, 22 bp, Homo sapiens
aattcatactctatattgcttt

SEQ ID NO: 7935994 - DNA, 22 bp, Homo sapiens
aattcatactctatattgcttt

SEQ ID NO: 7935995 - DNA, 22 bp, Homo sapiens
aattcatactctatattgcttt

SEQ ID NO: 7935996 - DNA, 22 bp, Homo sapiens
aattcagttgtgtctgacctcg

SEQ ID NO: 7935997 - DNA, 22 bp, Homo sapiens
aattcagttggcaaacatgctg

SEQ ID NO: 7935998 - DNA, 22 bp, Homo sapiens
aattcagttggcaaacatgctg

SEQ ID NO: 7935999 - DNA, 22 bp, Homo sapiens
aattcagttggcaaacatgctg

SEQ ID NO: 7936000 - DNA, 22 bp, Homo sapiens
aattcagagacatgaagtgaca

SEQ ID NO: 7936001 - DNA, 22 bp, Homo sapiens
aattcagatggaagattctggc

SEQ ID NO: 7936002 - DNA, 22 bp, Homo sapiens
aattcagagactcattctggag

SEQ ID NO: 7936003 - DNA, 22 bp, Homo sapiens
aattcagagtcctggccccacg

SEQ ID NO: 7936004 - DNA, 22 bp, Homo sapiens
aattcagagacatgaagtgaca

SEQ ID NO: 7936005 - DNA, 22 bp, Homo sapiens
aattcagcaaaaagatacagga

SEQ ID NO: 7936006 - DNA, 20 bp, Homo sapiens
aattcagctgccttcatgct

SEQ ID NO: 7936007 - DNA, 20 bp, Homo sapiens
aattcagctgccttcatgct

SEQ ID NO: 7936008 - DNA, 22 bp, Homo sapiens
aattcagcacagaggaaccagt

SEQ ID NO: 7936009 - DNA, 22 bp, Homo sapiens
aattcagtggtttctgcaacaa

SEQ ID NO: 7936010 - DNA, 22 bp, Homo sapiens
aattcaggttatatttgcaact

SEQ ID NO: 7936011 - DNA, 22 bp, Homo sapiens
aattcagtaatcattaatgatg

SEQ ID NO: 7936012 - DNA, 22 bp, Homo sapiens
aattcagtaatcattaatgatg

SEQ ID NO: 7936013 - DNA, 22 bp, Homo sapiens
aattcacaggatcacaggagag

SEQ ID NO: 7936014 - DNA, 22 bp, Homo sapiens
aattcacaggatcacaggagag

SEQ ID NO: 7936015 - DNA, 22 bp, Homo sapiens
aattcacaggaggtatttgtcc

SEQ ID NO: 7936016 - DNA, 22 bp, Homo sapiens
aattcacagcatttgcccatct

SEQ ID NO: 7936017 - DNA, 22 bp, Homo sapiens
aattcacagttctgcaccttac

SEQ ID NO: 7936018 - DNA, 22 bp, Homo sapiens
aattcacagttctgcaccttac

SEQ ID NO: 7936019 - DNA, 22 bp, Homo sapiens
aattcacatatacattattcct

SEQ ID NO: 7936020 - DNA, 22 bp, Homo sapiens
aattcacatatacattattcct

SEQ ID NO: 7936021 - DNA, 22 bp, Homo sapiens
aattcacagttctgcaccttac

SEQ ID NO: 7936022 - DNA, 22 bp, Homo sapiens
aattcacagttctgcaccttac

SEQ ID NO: 7936023 - DNA, 22 bp, Homo sapiens
aattcacatgcatgtctgtgca

SEQ ID NO: 7936024 - DNA, 22 bp, Homo sapiens
aattcacatccgaccaggtcaa

SEQ ID NO: 7936025 - DNA, 22 bp, Homo sapiens
aattcacatatacattattcct

SEQ ID NO: 7936026 - DNA, 22 bp, Homo sapiens
aattcacatgttgaagtcctaa

SEQ ID NO: 7936027 - DNA, 22 bp, Homo sapiens
aattcacatgcatgtctgtgca

SEQ ID NO: 7936028 - DNA, 22 bp, Homo sapiens
aattcactgttccttctgcttt

SEQ ID NO: 7936029 - DNA, 22 bp, Homo sapiens
aattcagaagcacaaaacctag

SEQ ID NO: 7936030 - DNA, 22 bp, Homo sapiens
aattcagaaaaattcactccta

SEQ ID NO: 7936031 - DNA, 22 bp, Homo sapiens
aattcactgaacttctctgaga

SEQ ID NO: 7936032 - DNA, 22 bp, Homo sapiens
aattcactgaacttctctgaga

SEQ ID NO: 7936033 - DNA, 22 bp, Homo sapiens
aattcactgaacttctctgaga

SEQ ID NO: 7936034 - DNA, 22 bp, Homo sapiens
aattcacatgttgaagtcctaa

SEQ ID NO: 7936035 - DNA, 22 bp, Homo sapiens
agaggccaagccagactgtgca

SEQ ID NO: 7936036 - DNA, 22 bp, Homo sapiens
agaggccaagccagactgtgca

SEQ ID NO: 7936037 - DNA, 23 bp, Homo sapiens
agaggccaacttcttgcccctcc

SEQ ID NO: 7936038 - DNA, 22 bp, Homo sapiens
agaggccaagccagactgtgca

SEQ ID NO: 7936039 - DNA, 22 bp, Homo sapiens
agaggccaagccagactgtgca

SEQ ID NO: 7936040 - DNA, 22 bp, Homo sapiens
agaggccaagccagactgtgca

SEQ ID NO: 7936041 - DNA, 23 bp, Homo sapiens
agaggccaacttcttgcccctcc

SEQ ID NO: 7936042 - DNA, 23 bp, Homo sapiens
agaggccaacttcttgcccctcc

SEQ ID NO: 7936043 - DNA, 23 bp, Homo sapiens
agaggccaacttcttgcccctcc

SEQ ID NO: 7936044 - DNA, 23 bp, Homo sapiens
agaggccaacttcttgcccctcc

SEQ ID NO: 7936045 - DNA, 22 bp, Homo sapiens
agaggccaaagaatctacaaga

SEQ ID NO: 7936046 - DNA, 22 bp, Homo sapiens
agaggccaaagaatctacaaga

SEQ ID NO: 7936047 - DNA, 22 bp, Homo sapiens
agaggccaaagaatctacaaga

SEQ ID NO: 7936048 - DNA, 22 bp, Homo sapiens
agaggcatgatcttataattta

SEQ ID NO: 7936049 - DNA, 21 bp, Homo sapiens
agaggcaggcattaagtacac

SEQ ID NO: 7936050 - DNA, 21 bp, Homo sapiens
agaggcaggcattaagtacac

SEQ ID NO: 7936051 - DNA, 21 bp, Homo sapiens
agaggcaggcattaagtacac

SEQ ID NO: 7936052 - DNA, 19 bp, Homo sapiens
agaggcagtctccaacagg

SEQ ID NO: 7936053 - DNA, 19 bp, Homo sapiens
agaggcagtctccaacagg

SEQ ID NO: 7936054 - DNA, 19 bp, Homo sapiens
agaggcagtctccaacagg

SEQ ID NO: 7936055 - DNA, 19 bp, Homo sapiens
agaggcagtctccaacagg

SEQ ID NO: 7936056 - DNA, 19 bp, Homo sapiens
agaggcagtctccaacagg

SEQ ID NO: 7936057 - DNA, 19 bp, Homo sapiens
agaggcagtctccaacagg

SEQ ID NO: 7936058 - DNA, 22 bp, Homo sapiens
agaggcagtatacaatccgagc

SEQ ID NO: 7936059 - DNA, 19 bp, Homo sapiens
agaggcagtctccaacagg

SEQ ID NO: 7936060 - DNA, 22 bp, Homo sapiens
agagcaggcataaagctttgaa

SEQ ID NO: 7936061 - DNA, 22 bp, Homo sapiens
agagcaggggcaatgtgttgca

SEQ ID NO: 7936062 - DNA, 22 bp, Homo sapiens
agagcaggcataaagctttgaa

SEQ ID NO: 7936063 - DNA, 22 bp, Homo sapiens
agagcaggcataaagctttgaa

SEQ ID NO: 7936064 - DNA, 22 bp, Homo sapiens
agagcaggcataaagctttgaa

SEQ ID NO: 7936065 - DNA, 22 bp, Homo sapiens
agagcaggcataaagctttgaa

SEQ ID NO: 7936066 - DNA, 22 bp, Homo sapiens
agagcaggcataaagctttgaa

SEQ ID NO: 7936067 - DNA, 22 bp, Homo sapiens
agaggcaacatggggaacagat

SEQ ID NO: 7936068 - DNA, 22 bp, Homo sapiens
agaggcaacatggggaacagat

SEQ ID NO: 7936069 - DNA, 22 bp, Homo sapiens
agaggcaactgatttctgccag

SEQ ID NO: 7936070 - DNA, 22 bp, Homo sapiens
agaggcaacatggggaacagat

SEQ ID NO: 7936071 - DNA, 22 bp, Homo sapiens
agagcagctggctgcatctaga

SEQ ID NO: 7936072 - DNA, 22 bp, Homo sapiens
agagcagctggctgcatctaga

SEQ ID NO: 7936073 - DNA, 22 bp, Homo sapiens
agagcagctggggcagagacca

SEQ ID NO: 7936074 - DNA, 22 bp, Homo sapiens
agagcagctggggcagagacca

SEQ ID NO: 7936075 - DNA, 22 bp, Homo sapiens
agagcagctggggcagagacca

SEQ ID NO: 7936076 - DNA, 22 bp, Homo sapiens
agagcagctgtgacatggacag

SEQ ID NO: 7936077 - DNA, 22 bp, Homo sapiens
agagcagcttttcggaaccact

SEQ ID NO: 7936078 - DNA, 22 bp, Homo sapiens
agagcagcttttcggaaccact

SEQ ID NO: 7936079 - DNA, 22 bp, Homo sapiens
agagcagctgtgacatggacag

SEQ ID NO: 7936080 - DNA, 22 bp, Homo sapiens
agagcagctgtgacatggacag

SEQ ID NO: 7936081 - DNA, 22 bp, Homo sapiens
agagcagctgtgacatggacag

SEQ ID NO: 7936082 - DNA, 22 bp, Homo sapiens
agagcagctgtgacatggacag

SEQ ID NO: 7936083 - DNA, 21 bp, Homo sapiens
aattttgaaggaagattaagg

SEQ ID NO: 7936084 - DNA, 21 bp, Homo sapiens
aattttgaaggaagattaagg

SEQ ID NO: 7936085 - DNA, 22 bp, Homo sapiens
aattttctggtgtgtaatgaag

SEQ ID NO: 7936086 - DNA, 21 bp, Homo sapiens
aattttgaaggaagattaagg

SEQ ID NO: 7936087 - DNA, 21 bp, Homo sapiens
aattttgaaggaagattaagg

SEQ ID NO: 7936088 - DNA, 22 bp, Homo sapiens
aattttgttcttggaaatcagg

SEQ ID NO: 7936089 - DNA, 22 bp, Homo sapiens
aattttgttcttggaaatcagg

SEQ ID NO: 7936090 - DNA, 22 bp, Homo sapiens
aattttgttcttggaaatcagg

SEQ ID NO: 7936091 - DNA, 22 bp, Homo sapiens
aattttgtgtgggatcaaagga

SEQ ID NO: 7936092 - DNA, 22 bp, Homo sapiens
aattttgtgtgggatcaaagga

SEQ ID NO: 7936093 - DNA, 22 bp, Homo sapiens
aattttgtgtgggatcaaagga

SEQ ID NO: 7936094 - DNA, 22 bp, Homo sapiens
aattttgtgtgggatcaaagga

SEQ ID NO: 7936095 - DNA, 22 bp, Homo sapiens
agagggctgcctcagtcagcta

SEQ ID NO: 7936096 - DNA, 22 bp, Homo sapiens
agagggctgcctcagtcagcta

SEQ ID NO: 7936097 - DNA, 17 bp, Homo sapiens
agagggctcaaggcatc

SEQ ID NO: 7936098 - DNA, 22 bp, Homo sapiens
agagggctaaggtttgggagat

SEQ ID NO: 7936099 - DNA, 22 bp, Homo sapiens
agagggctgctgcacagtgctc

SEQ ID NO: 7936100 - DNA, 22 bp, Homo sapiens
agagggctggacgcaggttgga

SEQ ID NO: 7936101 - DNA, 22 bp, Homo sapiens
agagggcatgcttggtggcctg

SEQ ID NO: 7936102 - DNA, 22 bp, Homo sapiens
agagggcataaaatagagcacg

SEQ ID NO: 7936103 - DNA, 22 bp, Homo sapiens
agagggcataaaatagagcacg

SEQ ID NO: 7936104 - DNA, 22 bp, Homo sapiens
agagggcataaaatagagcacg

SEQ ID NO: 7936105 - DNA, 22 bp, Homo sapiens
agagggccataggtgcatagtt

SEQ ID NO: 7936106 - DNA, 22 bp, Homo sapiens
agagggccataggtgcatagtt

SEQ ID NO: 7936107 - DNA, 22 bp, Homo sapiens
agagggcattaactctgtcttg

SEQ ID NO: 7936108 - DNA, 22 bp, Homo sapiens
agagggcccatgttgggctgct

SEQ ID NO: 7936109 - DNA, 22 bp, Homo sapiens
agagggccccagctgatctgag

SEQ ID NO: 7936110 - DNA, 22 bp, Homo sapiens
agagggctaactgggaagcagg

SEQ ID NO: 7936111 - DNA, 22 bp, Homo sapiens
agagggccccagctgatctgag

SEQ ID NO: 7936112 - DNA, 22 bp, Homo sapiens
agagggctaaggtttgggagat

SEQ ID NO: 7936113 - DNA, 22 bp, Homo sapiens
agagggctaaggtttgggagat

SEQ ID NO: 7936114 - DNA, 22 bp, Homo sapiens
agagggctaaggtttgggagat

SEQ ID NO: 7936115 - DNA, 22 bp, Homo sapiens
agagggctaactgggaagcagg

SEQ ID NO: 7936116 - DNA, 22 bp, Homo sapiens
agagggctaactgggaagcagg

SEQ ID NO: 7936117 - DNA, 22 bp, Homo sapiens
aatttcaatgcactcatggttg

SEQ ID NO: 7936118 - DNA, 22 bp, Homo sapiens
aatttcaatgcactcatggttg

SEQ ID NO: 7936119 - DNA, 22 bp, Homo sapiens
aatttcaagtggcatctttgat

SEQ ID NO: 7936120 - DNA, 22 bp, Homo sapiens
aatttcaagtggcatctttgat

SEQ ID NO: 7936121 - DNA, 20 bp, Homo sapiens
agaggctttcttgtagtcag

SEQ ID NO: 7936122 - DNA, 20 bp, Homo sapiens
agaggctttcttgtagtcag

SEQ ID NO: 7936123 - DNA, 22 bp, Homo sapiens
agaggctttctctgcttaggca

SEQ ID NO: 7936124 - DNA, 22 bp, Homo sapiens
agaggcttggcctcagttctgt

SEQ ID NO: 7936125 - DNA, 22 bp, Homo sapiens
agagggcataaaatagagcacg

SEQ ID NO: 7936126 - DNA, 22 bp, Homo sapiens
agagggcataaaatagagcacg

SEQ ID NO: 7936127 - DNA, 22 bp, Homo sapiens
agagggcataaaatagagcacg

SEQ ID NO: 7936128 - DNA, 22 bp, Homo sapiens
agagggaaaaactcatgtcatt

SEQ ID NO: 7936129 - DNA, 22 bp, Homo sapiens
agagggaaaaactcatgtcatt

SEQ ID NO: 7936130 - DNA, 22 bp, Homo sapiens
agaggcttttctggtctttggc

SEQ ID NO: 7936131 - DNA, 20 bp, Homo sapiens
agaggctttcttgtagtcag

SEQ ID NO: 7936132 - DNA, 22 bp, Homo sapiens
aatttcaagtcttgaagaagta

SEQ ID NO: 7936133 - DNA, 22 bp, Homo sapiens
aatttcaagtcttgaagaagta

SEQ ID NO: 7936134 - DNA, 22 bp, Homo sapiens
aatttcaaagctcactggcata

SEQ ID NO: 7936135 - DNA, 22 bp, Homo sapiens
aatttcaagtggcatctttgat

SEQ ID NO: 7936136 - DNA, 22 bp, Homo sapiens
aatttcaaagctcactggcata

SEQ ID NO: 7936137 - DNA, 22 bp, Homo sapiens
aatttcaaagctcactggcata

SEQ ID NO: 7936138 - DNA, 22 bp, Homo sapiens
aatttcaaactcttgccctcag

SEQ ID NO: 7936139 - DNA, 22 bp, Homo sapiens
aatttcaaactaataggaacca

SEQ ID NO: 7936140 - DNA, 22 bp, Homo sapiens
aatttcaaactaataggaacca

SEQ ID NO: 7936141 - DNA, 22 bp, Homo sapiens
aatttatggtggggtaagggga

SEQ ID NO: 7936142 - DNA, 22 bp, Homo sapiens
aatttatatgtaattaggcaca

SEQ ID NO: 7936143 - DNA, 22 bp, Homo sapiens
agaggccacaccagcctcccgt

SEQ ID NO: 7936144 - DNA, 22 bp, Homo sapiens
agaggccacaccagcctcccgt

SEQ ID NO: 7936145 - DNA, 22 bp, Homo sapiens
agaggccacaccagcctcccgt

SEQ ID NO: 7936146 - DNA, 22 bp, Homo sapiens
agaggccaatagtaggtggcat

SEQ ID NO: 7936147 - DNA, 22 bp, Homo sapiens
agaggccaatagtaggtggcat

SEQ ID NO: 7936148 - DNA, 22 bp, Homo sapiens
agaggccaatagtaggtggcat

SEQ ID NO: 7936149 - DNA, 22 bp, Homo sapiens
agaggccaagccagactgtgca

SEQ ID NO: 7936150 - DNA, 21 bp, Homo sapiens
agaggccaagtcatcatttcc

SEQ ID NO: 7936151 - DNA, 21 bp, Homo sapiens
agaggccaagtcatcatttcc

SEQ ID NO: 7936152 - DNA, 22 bp, Homo sapiens
agaggccaatagtaggtggcat

SEQ ID NO: 7936153 - DNA, 22 bp, Homo sapiens
aatttattcccgtctctgggct

SEQ ID NO: 7936154 - DNA, 22 bp, Homo sapiens
aatttattcccgtctctgggct

SEQ ID NO: 7936155 - DNA, 22 bp, Homo sapiens
aatttattcccgtctctgggct

SEQ ID NO: 7936156 - DNA, 22 bp, Homo sapiens
aatttattatatcctaggggaa

SEQ ID NO: 7936157 - DNA, 22 bp, Homo sapiens
aatttattatatcctaggggaa

SEQ ID NO: 7936158 - DNA, 22 bp, Homo sapiens
aatttattatatcctaggggaa

SEQ ID NO: 7936159 - DNA, 22 bp, Homo sapiens
aatttatggccttcgtcttgat

SEQ ID NO: 7936160 - DNA, 22 bp, Homo sapiens
aatttatttcctgccagtacac

SEQ ID NO: 7936161 - DNA, 22 bp, Homo sapiens
aatttatttcctgccagtacac

SEQ ID NO: 7936162 - DNA, 22 bp, Homo sapiens
aatttatgacaaacaggtaggt

SEQ ID NO: 7936163 - DNA, 22 bp, Homo sapiens
aatttatttcctgccagtacac

SEQ ID NO: 7936164 - DNA, 22 bp, Homo sapiens
aatttatttcctgccagtacac

SEQ ID NO: 7936165 - DNA, 22 bp, Homo sapiens
aatttatttcctgccagtacac

SEQ ID NO: 7936166 - DNA, 22 bp, Homo sapiens
aatttatttcctgccagtacac

SEQ ID NO: 7936167 - DNA, 22 bp, Homo sapiens
acaaaaaccgtggattcagcat

SEQ ID NO: 7936168 - DNA, 22 bp, Homo sapiens
acaaaaaccgtggattcagcat

SEQ ID NO: 7936169 - DNA, 22 bp, Homo sapiens
acaaaaaccgtggattcagcat

SEQ ID NO: 7936170 - DNA, 22 bp, Homo sapiens
acaaaaaccgtggattcagcat

SEQ ID NO: 7936171 - DNA, 22 bp, Homo sapiens
acaaaaaccgtggattcagcat

SEQ ID NO: 7936172 - DNA, 22 bp, Homo sapiens
aattttgtttaagtgatctgct

SEQ ID NO: 7936173 - DNA, 22 bp, Homo sapiens
aattttgttttagtggaggctg

SEQ ID NO: 7936174 - DNA, 22 bp, Homo sapiens
agaggtggccatgggcgctgga

SEQ ID NO: 7936175 - DNA, 22 bp, Homo sapiens
agaggtggccatgggcgctgga

SEQ ID NO: 7936176 - DNA, 22 bp, Homo sapiens
agaggtggagctcttggcatca

SEQ ID NO: 7936177 - DNA, 22 bp, Homo sapiens
agaggtggagctcttggcatca

SEQ ID NO: 7936178 - DNA, 22 bp, Homo sapiens
agaggtggccatgggcgctgga

SEQ ID NO: 7936179 - DNA, 22 bp, Homo sapiens
agagggtaacaagaggcctgga

SEQ ID NO: 7936180 - DNA, 22 bp, Homo sapiens
agagggtaacaagaggcctgga

SEQ ID NO: 7936181 - DNA, 22 bp, Homo sapiens
agagggtaacaagaggcctgga

SEQ ID NO: 7936182 - DNA, 22 bp, Homo sapiens
acaaaaaccgtggattcagcat

SEQ ID NO: 7936183 - DNA, 22 bp, Homo sapiens
acaaaaagctccattactgtcc

SEQ ID NO: 7936184 - DNA, 22 bp, Homo sapiens
agaggggttaagtgctagtccg

SEQ ID NO: 7936185 - DNA, 22 bp, Homo sapiens
acaaaaagctccattactgtcc

SEQ ID NO: 7936186 - DNA, 22 bp, Homo sapiens
acaaaaagctccattactgtcc

SEQ ID NO: 7936187 - DNA, 20 bp, Homo sapiens
agaggttcagtctggagaag

SEQ ID NO: 7936188 - DNA, 22 bp, Homo sapiens
agaggttgggtctgaggtgaga

SEQ ID NO: 7936189 - DNA, 22 bp, Homo sapiens
agaggtgtggccaggactcaag

SEQ ID NO: 7936190 - DNA, 22 bp, Homo sapiens
agaggttcagagaaggcgatct

SEQ ID NO: 7936191 - DNA, 22 bp, Homo sapiens
agagtaaagtacttggaatacc

SEQ ID NO: 7936192 - DNA, 22 bp, Homo sapiens
agaggtttcttaggggcttcct

SEQ ID NO: 7936193 - DNA, 22 bp, Homo sapiens
agaggtttcttaggggcttcct

SEQ ID NO: 7936194 - DNA, 22 bp, Homo sapiens
agaggttgttagaatagtggag

SEQ ID NO: 7936195 - DNA, 20 bp, Homo sapiens
agagtaactggcacataggg

SEQ ID NO: 7936196 - DNA, 22 bp, Homo sapiens
agagtaaataggagatgacagc

SEQ ID NO: 7936197 - DNA, 22 bp, Homo sapiens
agagtaaataggagatgacagc

SEQ ID NO: 7936198 - DNA, 22 bp, Homo sapiens
agaggtgtggccaggactcaag

SEQ ID NO: 7936199 - DNA, 22 bp, Homo sapiens
agaggtgtggccaggactcaag

SEQ ID NO: 7936200 - DNA, 22 bp, Homo sapiens
agaggtgtcttgcttattgtta

SEQ ID NO: 7936201 - DNA, 22 bp, Homo sapiens
agaggtgtcttgcttattgtta

SEQ ID NO: 7936202 - DNA, 23 bp, Homo sapiens
agaggtgtagtgtctcatctact

SEQ ID NO: 7936203 - DNA, 22 bp, Homo sapiens
agaggtgggagcctggtcacat

SEQ ID NO: 7936204 - DNA, 22 bp, Homo sapiens
agaggtgggagcctggtcacat

SEQ ID NO: 7936205 - DNA, 22 bp, Homo sapiens
agaggtggccatgggcgctgga

SEQ ID NO: 7936206 - DNA, 22 bp, Homo sapiens
agaggtggagctcttggcatca

SEQ ID NO: 7936207 - DNA, 22 bp, Homo sapiens
agaggtggccatgggcgctgga

SEQ ID NO: 7936208 - DNA, 22 bp, Homo sapiens
agaggtggccatgggcgctgga

SEQ ID NO: 7936209 - DNA, 22 bp, Homo sapiens
agaggtggccatgggcgctgga

SEQ ID NO: 7936210 - DNA, 22 bp, Homo sapiens
agataatgtcaaattctgtctg

SEQ ID NO: 7936211 - DNA, 22 bp, Homo sapiens
agataatgttctgatccatttc

SEQ ID NO: 7936212 - DNA, 22 bp, Homo sapiens
agagtgaaggccaggttacagt

SEQ ID NO: 7936213 - DNA, 22 bp, Homo sapiens
agagtgaaggccaggttacagt

SEQ ID NO: 7936214 - DNA, 22 bp, Homo sapiens
agagtgaaggttgacacttcac

SEQ ID NO: 7936215 - DNA, 22 bp, Homo sapiens
agagtgaaggttgacacttcac

SEQ ID NO: 7936216 - DNA, 22 bp, Homo sapiens
agagtgaaggttgacacttcac

SEQ ID NO: 7936217 - DNA, 22 bp, Homo sapiens
agatataataatttacaagtgt

SEQ ID NO: 7936218 - DNA, 22 bp, Homo sapiens
agatataataatttacaagtgt

SEQ ID NO: 7936219 - DNA, 22 bp, Homo sapiens
agatataataatttacaagtgt

SEQ ID NO: 7936220 - DNA, 22 bp, Homo sapiens
agatataataatttacaagtgt

SEQ ID NO: 7936221 - DNA, 22 bp, Homo sapiens
agataattatgtcaatttcttg

SEQ ID NO: 7936222 - DNA, 22 bp, Homo sapiens
agatatacacccatatcacata

SEQ ID NO: 7936223 - DNA, 22 bp, Homo sapiens
agagtctgttacttgtccccta

SEQ ID NO: 7936224 - DNA, 22 bp, Homo sapiens
agagtctgtgctttcatcagga

SEQ ID NO: 7936225 - DNA, 22 bp, Homo sapiens
agagtctgtgctggggccagct

SEQ ID NO: 7936226 - DNA, 22 bp, Homo sapiens
agagtctgtgctggggccagct

SEQ ID NO: 7936227 - DNA, 22 bp, Homo sapiens
agagtctgtgctttcatcagga

SEQ ID NO: 7936228 - DNA, 22 bp, Homo sapiens
agagtcttggctgagaacaaga

SEQ ID NO: 7936229 - DNA, 22 bp, Homo sapiens
agagtcttccaggcagcctgag

SEQ ID NO: 7936230 - DNA, 22 bp, Homo sapiens
agagtcttttgtcagtaatgtt

SEQ ID NO: 7936231 - DNA, 22 bp, Homo sapiens
agagtgaaaagctagagcagta

SEQ ID NO: 7936232 - DNA, 22 bp, Homo sapiens
agagtgaaaagctagagcagta

SEQ ID NO: 7936233 - DNA, 22 bp, Homo sapiens
agagtgaaaagctagagcagta

SEQ ID NO: 7936234 - DNA, 22 bp, Homo sapiens
agagtgaaaagctagagcagta

SEQ ID NO: 7936235 - DNA, 19 bp, Homo sapiens
agagtctgtgctcttccta

SEQ ID NO: 7936236 - DNA, 22 bp, Homo sapiens
agagtctggtgcatgataagca

SEQ ID NO: 7936237 - DNA, 22 bp, Homo sapiens
agagtctgggcactgggaatgc

SEQ ID NO: 7936238 - DNA, 22 bp, Homo sapiens
agagtctgggcactgggaatgc

SEQ ID NO: 7936239 - DNA, 21 bp, Homo sapiens
agagtctgcatttctgacaag

SEQ ID NO: 7936240 - DNA, 21 bp, Homo sapiens
agagtctgcatttctgacaag

SEQ ID NO: 7936241 - DNA, 22 bp, Homo sapiens
agagtctggaagcgcttctaaa

SEQ ID NO: 7936242 - DNA, 22 bp, Homo sapiens
agagtacactgtacacacaatt

SEQ ID NO: 7936243 - DNA, 23 bp, Homo sapiens
agagtacagtggcgccatctcag

SEQ ID NO: 7936244 - DNA, 22 bp, Homo sapiens
agagtactgcctcagttatgaa

SEQ ID NO: 7936245 - DNA, 22 bp, Homo sapiens
agagtacattcagagctaccta

SEQ ID NO: 7936246 - DNA, 22 bp, Homo sapiens
agagtactgcctcagttatgaa

SEQ ID NO: 7936247 - DNA, 23 bp, Homo sapiens
agagtaatgtttttactgtattc

SEQ ID NO: 7936248 - DNA, 23 bp, Homo sapiens
agagtaatgtttttactgtattc

SEQ ID NO: 7936249 - DNA, 22 bp, Homo sapiens
agagtaatgaacacattccaca

SEQ ID NO: 7936250 - DNA, 22 bp, Homo sapiens
agagtacactgtacacacaatt

SEQ ID NO: 7936251 - DNA, 22 bp, Homo sapiens
agagtaatttttggacaatgcc

SEQ ID NO: 7936252 - DNA, 22 bp, Homo sapiens
agagtaatttctgctgaaaagg

SEQ ID NO: 7936253 - DNA, 21 bp, Homo sapiens
agagtctgcatttctgacaag

SEQ ID NO: 7936254 - DNA, 22 bp, Homo sapiens
agagtctgatttggtaagacca

SEQ ID NO: 7936255 - DNA, 22 bp, Homo sapiens
agagtctgatgtcaacagttct

SEQ ID NO: 7936256 - DNA, 22 bp, Homo sapiens
agagtctgatgtcaacagttct

SEQ ID NO: 7936257 - DNA, 22 bp, Homo sapiens
agagtctgatgtcaacagttct

SEQ ID NO: 7936258 - DNA, 22 bp, Homo sapiens
agagtactgcctcagttatgaa

SEQ ID NO: 7936259 - DNA, 22 bp, Homo sapiens
agagtctgcattgtaacaagat

SEQ ID NO: 7936260 - DNA, 22 bp, Homo sapiens
agagtctgcattgtaacaagat

SEQ ID NO: 7936261 - DNA, 22 bp, Homo sapiens
agatctggttggagtcctgaca

SEQ ID NO: 7936262 - DNA, 22 bp, Homo sapiens
agatctttaaaagttattatta

SEQ ID NO: 7936263 - DNA, 22 bp, Homo sapiens
agatctttaaaagttattatta

SEQ ID NO: 7936264 - DNA, 22 bp, Homo sapiens
agatctttaaaagttattatta

SEQ ID NO: 7936265 - DNA, 22 bp, Homo sapiens
agatctttaaaagttattatta

SEQ ID NO: 7936266 - DNA, 20 bp, Homo sapiens
agatgggttaaagctatggg

SEQ ID NO: 7936267 - DNA, 22 bp, Homo sapiens
agatgggttgagaacacatgct

SEQ ID NO: 7936268 - DNA, 20 bp, Homo sapiens
agatgggttaaagctatggg

SEQ ID NO: 7936269 - DNA, 16 bp, Homo sapiens
agatgggtgggtcact

SEQ ID NO: 7936270 - DNA, 22 bp, Homo sapiens
agatgggtctcccttagcacct

SEQ ID NO: 7936271 - DNA, 22 bp, Homo sapiens
agatgggtctcccttagcacct

SEQ ID NO: 7936272 - DNA, 22 bp, Homo sapiens
agatgggtgccttctttcttta

SEQ ID NO: 7936273 - DNA, 22 bp, Homo sapiens
agatgggtgccttctttcttta

SEQ ID NO: 7936274 - DNA, 22 bp, Homo sapiens
agatctggaactgaggtttatt

SEQ ID NO: 7936275 - DNA, 22 bp, Homo sapiens
agatctggaaaatcacaggtgc

SEQ ID NO: 7936276 - DNA, 23 bp, Homo sapiens
agatctgatgttaccaagaattg

SEQ ID NO: 7936277 - DNA, 22 bp, Homo sapiens
agatctgcccagggtacaaagg

SEQ ID NO: 7936278 - DNA, 22 bp, Homo sapiens
agatctggccctcagcttgatt

SEQ ID NO: 7936279 - DNA, 22 bp, Homo sapiens
agatctggttggagtcctgaca

SEQ ID NO: 7936280 - DNA, 22 bp, Homo sapiens
agatctggaactgaggtttatt

SEQ ID NO: 7936281 - DNA, 22 bp, Homo sapiens
agatctggaaaatcacaggtgc

SEQ ID NO: 7936282 - DNA, 22 bp, Homo sapiens
agatggtaatcacatttatctg

SEQ ID NO: 7936283 - DNA, 22 bp, Homo sapiens
agatgttttctaattctatatt

SEQ ID NO: 7936284 - DNA, 22 bp, Homo sapiens
agatgttttggagacactaacc

SEQ ID NO: 7936285 - DNA, 22 bp, Homo sapiens
agatgttttagagtttgacttg

SEQ ID NO: 7936286 - DNA, 22 bp, Homo sapiens
agatgttttctaattctatatt

SEQ ID NO: 7936287 - DNA, 22 bp, Homo sapiens
agatgttttgtgtatttcatca

SEQ ID NO: 7936288 - DNA, 21 bp, Homo sapiens
agattaaaatctgtgagaagg

SEQ ID NO: 7936289 - DNA, 22 bp, Homo sapiens
agatgttttgtgtatttcatca

SEQ ID NO: 7936290 - DNA, 22 bp, Homo sapiens
agattacaaatcctctgtgttt

SEQ ID NO: 7936291 - DNA, 22 bp, Homo sapiens
agattaactctcagaaaagagg

SEQ ID NO: 7936292 - DNA, 22 bp, Homo sapiens
agattacagaagaataagtaga

SEQ ID NO: 7936293 - DNA, 22 bp, Homo sapiens
agattacagaagaataagtaga

SEQ ID NO: 7936294 - DNA, 22 bp, Homo sapiens
agattacagaagaataagtaga

SEQ ID NO: 7936295 - DNA, 22 bp, Homo sapiens
agattacagcatgggaatggga

SEQ ID NO: 7936296 - DNA, 22 bp, Homo sapiens
agattacagcatgggaatggga

SEQ ID NO: 7936297 - DNA, 20 bp, Homo sapiens
agattaggggctttcttctt

SEQ ID NO: 7936298 - DNA, 22 bp, Homo sapiens
agattagcttgtgtacaaaggt

SEQ ID NO: 7936299 - DNA, 22 bp, Homo sapiens
agattaggtatggtttaagtag

SEQ ID NO: 7936300 - DNA, 22 bp, Homo sapiens
agattaggtatggtttaagtag

SEQ ID NO: 7936301 - DNA, 21 bp, Homo sapiens
agattacaggtgtgatccacc

SEQ ID NO: 7936302 - DNA, 21 bp, Homo sapiens
agattacaggtgtgatccacc

SEQ ID NO: 7936303 - DNA, 22 bp, Homo sapiens
agattagcctaaaaatgtatag

SEQ ID NO: 7936304 - DNA, 22 bp, Homo sapiens
agattagcctaaaaatgtatag

SEQ ID NO: 7936305 - DNA, 19 bp, Homo sapiens
agattattgcacattcatg

SEQ ID NO: 7936306 - DNA, 22 bp, Homo sapiens
agattcaaagtgaagaacttaa

SEQ ID NO: 7936307 - DNA, 22 bp, Homo sapiens
agattcaaagtgaagaacttaa

SEQ ID NO: 7936308 - DNA, 22 bp, Homo sapiens
agattatttccagactaatgaa

SEQ ID NO: 7936309 - DNA, 22 bp, Homo sapiens
agattatttccagactaatgaa

SEQ ID NO: 7936310 - DNA, 21 bp, Homo sapiens
agattcaggacagcagtcact

SEQ ID NO: 7936311 - DNA, 22 bp, Homo sapiens
agattcagaaatgaggagggcc

SEQ ID NO: 7936312 - DNA, 22 bp, Homo sapiens
agattcagaaatgaggagggcc

SEQ ID NO: 7936313 - DNA, 22 bp, Homo sapiens
agattcagaaaattctctgttc

SEQ ID NO: 7936314 - DNA, 22 bp, Homo sapiens
agattatttaagacaggaacca

SEQ ID NO: 7936315 - DNA, 20 bp, Homo sapiens
agattattcctaagatttct

SEQ ID NO: 7936316 - DNA, 19 bp, Homo sapiens
agattattgcacattcatg

SEQ ID NO: 7936317 - DNA, 20 bp, Homo sapiens
agattattcctaagatttct

SEQ ID NO: 7936318 - DNA, 22 bp, Homo sapiens
agattatgctggctgctacaag

SEQ ID NO: 7936319 - DNA, 22 bp, Homo sapiens
agattaggtatggtttaagtag

SEQ ID NO: 7936320 - DNA, 22 bp, Homo sapiens
agatatatttaaggtaataagt

SEQ ID NO: 7936321 - DNA, 22 bp, Homo sapiens
agatatatttaaggtaataagt

SEQ ID NO: 7936322 - DNA, 22 bp, Homo sapiens
agatatagttgttgagaagaac

SEQ ID NO: 7936323 - DNA, 22 bp, Homo sapiens
agatatatttaaggtaataagt

SEQ ID NO: 7936324 - DNA, 22 bp, Homo sapiens
agatatatttaaggtaataagt

SEQ ID NO: 7936325 - DNA, 22 bp, Homo sapiens
agatatatttaaggtaataagt

SEQ ID NO: 7936326 - DNA, 22 bp, Homo sapiens
agatatatttaaggtaataagt

SEQ ID NO: 7936327 - DNA, 22 bp, Homo sapiens
agatatacagagaattattcac

SEQ ID NO: 7936328 - DNA, 22 bp, Homo sapiens
agatatacagagaattattcac

SEQ ID NO: 7936329 - DNA, 22 bp, Homo sapiens
agatatacagagaattattcac

SEQ ID NO: 7936330 - DNA, 22 bp, Homo sapiens
agatatagttgttgagaagaac

SEQ ID NO: 7936331 - DNA, 22 bp, Homo sapiens
agatatctccagtgatgctcgt

SEQ ID NO: 7936332 - DNA, 22 bp, Homo sapiens
agatatatttcctgcccaaggc

SEQ ID NO: 7936333 - DNA, 22 bp, Homo sapiens
agatatatttaaggtaataagt

SEQ ID NO: 7936334 - DNA, 22 bp, Homo sapiens
agatatatttcctgcccaaggc

SEQ ID NO: 7936335 - DNA, 22 bp, Homo sapiens
agatatctgcaatataatttaa

SEQ ID NO: 7936336 - DNA, 22 bp, Homo sapiens
agatatctggaaaaaatgtatg

SEQ ID NO: 7936337 - DNA, 22 bp, Homo sapiens
agatatctgcaatataatttaa

SEQ ID NO: 7936338 - DNA, 22 bp, Homo sapiens
agatatctgcaatataatttaa

SEQ ID NO: 7936339 - DNA, 22 bp, Homo sapiens
agatatgactagaagctcattt

SEQ ID NO: 7936340 - DNA, 22 bp, Homo sapiens
agatatgactagaagctcattt

SEQ ID NO: 7936341 - DNA, 22 bp, Homo sapiens
agatatgagaatatagaggccc

SEQ ID NO: 7936342 - DNA, 22 bp, Homo sapiens
agatatgtccctgtctaatatt

SEQ ID NO: 7936343 - DNA, 22 bp, Homo sapiens
agatatgtccctgtctaatatt

SEQ ID NO: 7936344 - DNA, 22 bp, Homo sapiens
agatatggttttctcttctcct

SEQ ID NO: 7936345 - DNA, 22 bp, Homo sapiens
agatatgatgcatgtaaacatt

SEQ ID NO: 7936346 - DNA, 22 bp, Homo sapiens
agatatgtgcgtcttagattga

SEQ ID NO: 7936347 - DNA, 22 bp, Homo sapiens
agatatgtttgtatatatttgt

SEQ ID NO: 7936348 - DNA, 22 bp, Homo sapiens
agatccagtggtgaacaaaaga

SEQ ID NO: 7936349 - DNA, 22 bp, Homo sapiens
agatccagtggtgaacaaaaga

SEQ ID NO: 7936350 - DNA, 22 bp, Homo sapiens
agatccagttaatagcttcatt

SEQ ID NO: 7936351 - DNA, 21 bp, Homo sapiens
agatccagtgccataaggccc

SEQ ID NO: 7936352 - DNA, 22 bp, Homo sapiens
agatccagttaatagcttcatt

SEQ ID NO: 7936353 - DNA, 22 bp, Homo sapiens
agatccagttaatagcttcatt

SEQ ID NO: 7936354 - DNA, 22 bp, Homo sapiens
agatccagttaatagcttcatt

SEQ ID NO: 7936355 - DNA, 22 bp, Homo sapiens
agatccagttaatagcttcatt

SEQ ID NO: 7936356 - DNA, 22 bp, Homo sapiens
agatccatgtgatttggagttc

SEQ ID NO: 7936357 - DNA, 22 bp, Homo sapiens
agatccatccagcactcttgcc

SEQ ID NO: 7936358 - DNA, 22 bp, Homo sapiens
agatccatcatcatattttcta

SEQ ID NO: 7936359 - DNA, 22 bp, Homo sapiens
agatcccaggatactggcctat

SEQ ID NO: 7936360 - DNA, 22 bp, Homo sapiens
agatcccaggatactggcctat

SEQ ID NO: 7936361 - DNA, 22 bp, Homo sapiens
agatcccaaatcacctgcttat

SEQ ID NO: 7936362 - DNA, 22 bp, Homo sapiens
agatcccaaatcacctgcttat

SEQ ID NO: 7936363 - DNA, 22 bp, Homo sapiens
agatccattttggtgtcaactc

SEQ ID NO: 7936364 - DNA, 22 bp, Homo sapiens
agatcggctttgcagacctcat

SEQ ID NO: 7936365 - DNA, 22 bp, Homo sapiens
agatcggctttgcagacctcat

SEQ ID NO: 7936366 - DNA, 22 bp, Homo sapiens
agatctgacctaaccccaccac

SEQ ID NO: 7936367 - DNA, 22 bp, Homo sapiens
agatctgagtggctgcatgtaa

SEQ ID NO: 7936368 - DNA, 21 bp, Homo sapiens
agatcctgtggctgagaagta

SEQ ID NO: 7936369 - DNA, 20 bp, Homo sapiens
agatcctgtctccaccttgg

SEQ ID NO: 7936370 - DNA, 21 bp, Homo sapiens
agatcctggggtctggggagg

SEQ ID NO: 7936371 - DNA, 21 bp, Homo sapiens
agatcctggggtctggggagg

SEQ ID NO: 7936372 - DNA, 22 bp, Homo sapiens
agatcctgccaatggaagcagg

SEQ ID NO: 7936373 - DNA, 22 bp, Homo sapiens
agatcctgccaatggaagcagg

SEQ ID NO: 7936374 - DNA, 21 bp, Homo sapiens
agatccctgaggagagcatcc

SEQ ID NO: 7936375 - DNA, 21 bp, Homo sapiens
agatccctgaggagagcatcc

SEQ ID NO: 7936376 - DNA, 21 bp, Homo sapiens
agatccctgaggagagcatcc

SEQ ID NO: 7936377 - DNA, 22 bp, Homo sapiens
aaatatcttaggagtatatgag

SEQ ID NO: 7936378 - DNA, 22 bp, Homo sapiens
aaatatcttaggagtatatgag

SEQ ID NO: 7936379 - DNA, 22 bp, Homo sapiens
aaatatccataagcacatctat

SEQ ID NO: 7936380 - DNA, 22 bp, Homo sapiens
aaatatccataagcacatctat

SEQ ID NO: 7936381 - DNA, 22 bp, Homo sapiens
aaatatcctcagggcagaggtg

SEQ ID NO: 7936382 - DNA, 22 bp, Homo sapiens
aaatatccataagcacatctat

SEQ ID NO: 7936383 - DNA, 22 bp, Homo sapiens
aaatatccataagcacatctat

SEQ ID NO: 7936384 - DNA, 22 bp, Homo sapiens
aaatatgaatgataagagttat

SEQ ID NO: 7936385 - DNA, 22 bp, Homo sapiens
aaatatcttaggagtatatgag

SEQ ID NO: 7936386 - DNA, 22 bp, Homo sapiens
aaatatgaatgataagagttat

SEQ ID NO: 7936387 - DNA, 17 bp, Homo sapiens
aaatatgacctcaaagt

SEQ ID NO: 7936388 - DNA, 17 bp, Homo sapiens
aaatatgacctcaaagt

SEQ ID NO: 7936389 - DNA, 22 bp, Homo sapiens
aaatatgaatgataagagttat

SEQ ID NO: 7936390 - DNA, 22 bp, Homo sapiens
aagcacctgcaccggtcgcctt

SEQ ID NO: 7936391 - DNA, 22 bp, Homo sapiens
aagcacagctggaacagcagga

SEQ ID NO: 7936392 - DNA, 22 bp, Homo sapiens
aagcacctgggttatatcttag

SEQ ID NO: 7936393 - DNA, 22 bp, Homo sapiens
aagcacctgggttatatcttag

SEQ ID NO: 7936394 - DNA, 22 bp, Homo sapiens
aagcacctgcagttgacaaaaa

SEQ ID NO: 7936395 - DNA, 22 bp, Homo sapiens
aagcacagctggaacagcagga

SEQ ID NO: 7936396 - DNA, 22 bp, Homo sapiens
aagcacagctggaacagcagga

SEQ ID NO: 7936397 - DNA, 22 bp, Homo sapiens
aaatatgactagaatgccaggt

SEQ ID NO: 7936398 - DNA, 22 bp, Homo sapiens
aaatatcattctggtgcacaga

SEQ ID NO: 7936399 - DNA, 22 bp, Homo sapiens
aaatatcattctggtgcacaga

SEQ ID NO: 7936400 - DNA, 22 bp, Homo sapiens
aaatatcattctggtgcacaga

SEQ ID NO: 7936401 - DNA, 22 bp, Homo sapiens
aaatatcattctggtgcacaga

SEQ ID NO: 7936402 - DNA, 22 bp, Homo sapiens
aaatatcattctggtgcacaga

SEQ ID NO: 7936403 - DNA, 22 bp, Homo sapiens
aaatatcattctggtgcacaga

SEQ ID NO: 7936404 - DNA, 22 bp, Homo sapiens
aaatatcattctggtgcacaga

SEQ ID NO: 7936405 - DNA, 22 bp, Homo sapiens
aaatatcatttataacttttaa

SEQ ID NO: 7936406 - DNA, 22 bp, Homo sapiens
aaatatcatttataacttttaa

SEQ ID NO: 7936407 - DNA, 22 bp, Homo sapiens
aaatatcatttataacttttaa

SEQ ID NO: 7936408 - DNA, 22 bp, Homo sapiens
aaatatcatttataacttttaa

SEQ ID NO: 7936409 - DNA, 22 bp, Homo sapiens
aaatatcatttataacttttaa

SEQ ID NO: 7936410 - DNA, 22 bp, Homo sapiens
aaatatcatttataacttttaa

SEQ ID NO: 7936411 - DNA, 22 bp, Homo sapiens
aaatatcatttataacttttaa

SEQ ID NO: 7936412 - DNA, 22 bp, Homo sapiens
aaatatcatttataacttttaa

SEQ ID NO: 7936413 - DNA, 22 bp, Homo sapiens
aagcaactccctcctcattttt

SEQ ID NO: 7936414 - DNA, 22 bp, Homo sapiens
aagcaactccctcctcattttt

SEQ ID NO: 7936415 - DNA, 22 bp, Homo sapiens
aagcaactccctcctcattttt

SEQ ID NO: 7936416 - DNA, 21 bp, Homo sapiens
aagcaacgtaaatctggcttg

SEQ ID NO: 7936417 - DNA, 22 bp, Homo sapiens
aagcaactcctaggaggaaagg

SEQ ID NO: 7936418 - DNA, 22 bp, Homo sapiens
aagcaactcctaggaggaaagg

SEQ ID NO: 7936419 - DNA, 22 bp, Homo sapiens
aagcaactgccttcaatattta

SEQ ID NO: 7936420 - DNA, 22 bp, Homo sapiens
aagcaactaaggcaaggaaatg

SEQ ID NO: 7936421 - DNA, 22 bp, Homo sapiens
aagcaacattctctgtggcatt

SEQ ID NO: 7936422 - DNA, 22 bp, Homo sapiens
aagcaacattctctgtggcatt

SEQ ID NO: 7936423 - DNA, 22 bp, Homo sapiens
aagcaactggctcattgtctca

SEQ ID NO: 7936424 - DNA, 22 bp, Homo sapiens
aagcaactggctcattgtctca

SEQ ID NO: 7936425 - DNA, 22 bp, Homo sapiens
aagcaactggctcattgtctca

SEQ ID NO: 7936426 - DNA, 22 bp, Homo sapiens
aagcaactgccttcaatattta

SEQ ID NO: 7936427 - DNA, 22 bp, Homo sapiens
aagcaactgccttcaatattta

SEQ ID NO: 7936428 - DNA, 22 bp, Homo sapiens
aagcaactgttgaattggacta

SEQ ID NO: 7936429 - DNA, 22 bp, Homo sapiens
aagcaactgttgaattggacta

SEQ ID NO: 7936430 - DNA, 19 bp, Homo sapiens
aaatatcagagagatgata

SEQ ID NO: 7936431 - DNA, 22 bp, Homo sapiens
aagcaactgttgaattggacta

SEQ ID NO: 7936432 - DNA, 19 bp, Homo sapiens
aaatatcagagagatgata

SEQ ID NO: 7936433 - DNA, 22 bp, Homo sapiens
aagcaaattggatgtctgtgag

SEQ ID NO: 7936434 - DNA, 22 bp, Homo sapiens
aagcaacagaaacattctaata

SEQ ID NO: 7936435 - DNA, 22 bp, Homo sapiens
aagcaacagaaacattctaata

SEQ ID NO: 7936436 - DNA, 22 bp, Homo sapiens
aagcaaatgtgggtgcagaatt

SEQ ID NO: 7936437 - DNA, 22 bp, Homo sapiens
aagcaaattctggaggtgaggt

SEQ ID NO: 7936438 - DNA, 22 bp, Homo sapiens
aagcaaatatttctagagactg

SEQ ID NO: 7936439 - DNA, 22 bp, Homo sapiens
aagcaaatgtgggtgcagaatt

SEQ ID NO: 7936440 - DNA, 22 bp, Homo sapiens
aagcaaatgaaccagaggtaat

SEQ ID NO: 7936441 - DNA, 22 bp, Homo sapiens
aagcaaatgtgggtgcagaatt

SEQ ID NO: 7936442 - DNA, 22 bp, Homo sapiens
aagcaaatgtgggtgcagaatt

SEQ ID NO: 7936443 - DNA, 22 bp, Homo sapiens
aagcaaagtgaattttgccaag

SEQ ID NO: 7936444 - DNA, 22 bp, Homo sapiens
aagcaaagtgaattttgccaag

SEQ ID NO: 7936445 - DNA, 22 bp, Homo sapiens
aagcaaagtgaattttgccaag

SEQ ID NO: 7936446 - DNA, 22 bp, Homo sapiens
aagcaaagtgaattttgccaag

SEQ ID NO: 7936447 - DNA, 22 bp, Homo sapiens
aagcaaagtgctttgcctccag

SEQ ID NO: 7936448 - DNA, 22 bp, Homo sapiens
aagcaaagtgctttgcctccag

SEQ ID NO: 7936449 - DNA, 22 bp, Homo sapiens
aagcaaagtgctttgcctccag

SEQ ID NO: 7936450 - DNA, 22 bp, Homo sapiens
aagcaaaggcaggagcttgtga

SEQ ID NO: 7936451 - DNA, 22 bp, Homo sapiens
aagcaaaggaaagctgactttt

SEQ ID NO: 7936452 - DNA, 22 bp, Homo sapiens
aagcaaaggcaggagcttgtga

SEQ ID NO: 7936453 - DNA, 22 bp, Homo sapiens
aagcaaagagtttagtgggtga

SEQ ID NO: 7936454 - DNA, 22 bp, Homo sapiens
aagcaaaggcaggagcttgtga

SEQ ID NO: 7936455 - DNA, 22 bp, Homo sapiens
aagcaaaggcaggagcttgtga

SEQ ID NO: 7936456 - DNA, 22 bp, Homo sapiens
aagcaaaggcaggagcttgtga

SEQ ID NO: 7936457 - DNA, 22 bp, Homo sapiens
aagcaaaggaaagctgactttt

SEQ ID NO: 7936458 - DNA, 22 bp, Homo sapiens
aagcaaaggaaagctgactttt

SEQ ID NO: 7936459 - DNA, 22 bp, Homo sapiens
aagcaaaggaaagctgactttt

SEQ ID NO: 7936460 - DNA, 22 bp, Homo sapiens
aagcaaaggcaggagcttgtga

SEQ ID NO: 7936461 - DNA, 22 bp, Homo sapiens
aagcaaagagtttagtgggtga

SEQ ID NO: 7936462 - DNA, 22 bp, Homo sapiens
aagcaaagagataaccttttgg

SEQ ID NO: 7936463 - DNA, 22 bp, Homo sapiens
aagcaaagagtttagtgggtga

SEQ ID NO: 7936464 - DNA, 22 bp, Homo sapiens
aagcaaagagtttagtgggtga

SEQ ID NO: 7936465 - DNA, 22 bp, Homo sapiens
aagcaaagagtttagtgggtga

SEQ ID NO: 7936466 - DNA, 18 bp, Homo sapiens
aagaggaggaaacccagg

SEQ ID NO: 7936467 - DNA, 18 bp, Homo sapiens
aagaggaggaaacccagg

SEQ ID NO: 7936468 - DNA, 22 bp, Homo sapiens
aagaggaggacggttcccagaa

SEQ ID NO: 7936469 - DNA, 22 bp, Homo sapiens
aagaggagacttcagcaacttg

SEQ ID NO: 7936470 - DNA, 22 bp, Homo sapiens
aagaggagacttcagcaacttg

SEQ ID NO: 7936471 - DNA, 22 bp, Homo sapiens
aagaggagacttcagcaacttg

SEQ ID NO: 7936472 - DNA, 22 bp, Homo sapiens
aagaggagacttcagcaacttg

SEQ ID NO: 7936473 - DNA, 22 bp, Homo sapiens
aagaggagacttcagcaacttg

SEQ ID NO: 7936474 - DNA, 18 bp, Homo sapiens
aagaggaggagcaggttg

SEQ ID NO: 7936475 - DNA, 18 bp, Homo sapiens
aagaggaggagcaggttg

SEQ ID NO: 7936476 - DNA, 18 bp, Homo sapiens
aagaggaggagcaggttg

SEQ ID NO: 7936477 - DNA, 18 bp, Homo sapiens
aagaggaggagcaggttg

SEQ ID NO: 7936478 - DNA, 18 bp, Homo sapiens
aagaggaggagcaggttg

SEQ ID NO: 7936479 - DNA, 22 bp, Homo sapiens
aagattctgaaaggggtggggc

SEQ ID NO: 7936480 - DNA, 20 bp, Homo sapiens
aagattctgatttgtagcgt

SEQ ID NO: 7936481 - DNA, 20 bp, Homo sapiens
aagattctgatttgtagcgt

SEQ ID NO: 7936482 - DNA, 22 bp, Homo sapiens
aagcaaagagataaccttttgg

SEQ ID NO: 7936483 - DNA, 22 bp, Homo sapiens
aagcaaagagataaccttttgg

SEQ ID NO: 7936484 - DNA, 22 bp, Homo sapiens
aagattctccctgagatattta

SEQ ID NO: 7936485 - DNA, 22 bp, Homo sapiens
aagattctccctgagatattta

SEQ ID NO: 7936486 - DNA, 22 bp, Homo sapiens
aagattctccctgagatattta

SEQ ID NO: 7936487 - DNA, 22 bp, Homo sapiens
aagattctccctgagatattta

SEQ ID NO: 7936488 - DNA, 22 bp, Homo sapiens
aagattctcagagtgaaagaat

SEQ ID NO: 7936489 - DNA, 22 bp, Homo sapiens
aagattctcagaaaaaggctat

SEQ ID NO: 7936490 - DNA, 22 bp, Homo sapiens
aagattctcagagtgaaagaat

SEQ ID NO: 7936491 - DNA, 22 bp, Homo sapiens
aagcagatattgtgggagtggg

SEQ ID NO: 7936492 - DNA, 22 bp, Homo sapiens
aagcagagttagcttgtcacct

SEQ ID NO: 7936493 - DNA, 22 bp, Homo sapiens
aagcagagttagcttgtcacct

SEQ ID NO: 7936494 - DNA, 22 bp, Homo sapiens
aagcagaaagaacaactgagtg

SEQ ID NO: 7936495 - DNA, 22 bp, Homo sapiens
aagcagaactgggaagtagtgg

SEQ ID NO: 7936496 - DNA, 22 bp, Homo sapiens
aagcagaactgggaagtagtgg

SEQ ID NO: 7936497 - DNA, 22 bp, Homo sapiens
aagcagaaaaactgagctccaa

SEQ ID NO: 7936498 - DNA, 22 bp, Homo sapiens
aagcagaaagaacaactgagtg

SEQ ID NO: 7936499 - DNA, 22 bp, Homo sapiens
aagcagaaagaacaactgagtg

SEQ ID NO: 7936500 - DNA, 22 bp, Homo sapiens
aagcagaaagaacaactgagtg

SEQ ID NO: 7936501 - DNA, 22 bp, Homo sapiens
aagcagaaagaacaactgagtg

SEQ ID NO: 7936502 - DNA, 22 bp, Homo sapiens
aagcagaaagaacaactgagtg

SEQ ID NO: 7936503 - DNA, 22 bp, Homo sapiens
aagcagaaagaacaactgagtg

SEQ ID NO: 7936504 - DNA, 22 bp, Homo sapiens
aagcactttatgtcaatgtcct

SEQ ID NO: 7936505 - DNA, 22 bp, Homo sapiens
aagcactttatgtcaatgtcct

SEQ ID NO: 7936506 - DNA, 22 bp, Homo sapiens
aagcagaaaaactgagctccaa

SEQ ID NO: 7936507 - DNA, 22 bp, Homo sapiens
aagcagaaaaactgagctccaa

SEQ ID NO: 7936508 - DNA, 22 bp, Homo sapiens
aagcagaaaaactgagctccaa

SEQ ID NO: 7936509 - DNA, 22 bp, Homo sapiens
aagcagaaaaactgagctccaa

SEQ ID NO: 7936510 - DNA, 22 bp, Homo sapiens
aagcagatgcgttggagcagtt

SEQ ID NO: 7936511 - DNA, 22 bp, Homo sapiens
aagcagatgggactccaaggca

SEQ ID NO: 7936512 - DNA, 22 bp, Homo sapiens
aagcagatctgatagggccctg

SEQ ID NO: 7936513 - DNA, 22 bp, Homo sapiens
aagcagatattgtgggagtggg

SEQ ID NO: 7936514 - DNA, 22 bp, Homo sapiens
aagcagatattgtgggagtggg

SEQ ID NO: 7936515 - DNA, 22 bp, Homo sapiens
aagcagatctgatagggccctg

SEQ ID NO: 7936516 - DNA, 22 bp, Homo sapiens
aagcagatgggactccaaggca

SEQ ID NO: 7936517 - DNA, 22 bp, Homo sapiens
aagcagcaagtttatttctatc

SEQ ID NO: 7936518 - DNA, 22 bp, Homo sapiens
aagcagcaagtttatttctatc

SEQ ID NO: 7936519 - DNA, 22 bp, Homo sapiens
aagcagcaacaaactggataaa

SEQ ID NO: 7936520 - DNA, 22 bp, Homo sapiens
aagcagcaagtttatttctatc

SEQ ID NO: 7936521 - DNA, 22 bp, Homo sapiens
aagcagcaagtttatttctatc

SEQ ID NO: 7936522 - DNA, 22 bp, Homo sapiens
aagcagcaacaaactggataaa

SEQ ID NO: 7936523 - DNA, 22 bp, Homo sapiens
aagcagcaacaaactggataaa

SEQ ID NO: 7936524 - DNA, 22 bp, Homo sapiens
aagcagattggggatttccatg

SEQ ID NO: 7936525 - DNA, 22 bp, Homo sapiens
aagcactggagatgccagagtg

SEQ ID NO: 7936526 - DNA, 22 bp, Homo sapiens
aagcactgaggaaaaatttgat

SEQ ID NO: 7936527 - DNA, 22 bp, Homo sapiens
aagcactggagatgccagagtg

SEQ ID NO: 7936528 - DNA, 22 bp, Homo sapiens
aagcactggagatgccagagtg

SEQ ID NO: 7936529 - DNA, 22 bp, Homo sapiens
aagcactggagatgccagagtg

SEQ ID NO: 7936530 - DNA, 22 bp, Homo sapiens
aagcactggggccacagacacg

SEQ ID NO: 7936531 - DNA, 22 bp, Homo sapiens
aagcactggggccacagacacg

SEQ ID NO: 7936532 - DNA, 22 bp, Homo sapiens
aagcactgggaggaggctgaga

SEQ ID NO: 7936533 - DNA, 22 bp, Homo sapiens
aagcactgggaggaggctgaga

SEQ ID NO: 7936534 - DNA, 22 bp, Homo sapiens
aagcactgggaggaggctgaga

SEQ ID NO: 7936535 - DNA, 22 bp, Homo sapiens
aagcactaggtcacacaagtta

SEQ ID NO: 7936536 - DNA, 22 bp, Homo sapiens
aagcactgagcacagtggctga

SEQ ID NO: 7936537 - DNA, 22 bp, Homo sapiens
aagcactaggtcacacaagtta

SEQ ID NO: 7936538 - DNA, 22 bp, Homo sapiens
aagcactaggacttcagtctct

SEQ ID NO: 7936539 - DNA, 22 bp, Homo sapiens
aagcactaatattttggcacct

SEQ ID NO: 7936540 - DNA, 22 bp, Homo sapiens
aagcactgagcacagtggctga

SEQ ID NO: 7936541 - DNA, 22 bp, Homo sapiens
aagcactttagtgagaataagg

SEQ ID NO: 7936542 - DNA, 22 bp, Homo sapiens
aagcacttggttttggaaagtt

SEQ ID NO: 7936543 - DNA, 20 bp, Homo sapiens
aagcactgtggtggcatgga

SEQ ID NO: 7936544 - DNA, 20 bp, Homo sapiens
aagcactgtggtggcatgga

SEQ ID NO: 7936545 - DNA, 20 bp, Homo sapiens
aagcactgtggtggcatgga

SEQ ID NO: 7936546 - DNA, 22 bp, Homo sapiens
aagcactgtgcctcatatctga

SEQ ID NO: 7936547 - DNA, 22 bp, Homo sapiens
aagcactgggtatagcaatgat

SEQ ID NO: 7936548 - DNA, 22 bp, Homo sapiens
aagccaatgctagcccacatgc

SEQ ID NO: 7936549 - DNA, 22 bp, Homo sapiens
aagccaatgctagcccacatgc

SEQ ID NO: 7936550 - DNA, 22 bp, Homo sapiens
aagccaatgatacgggtgatct

SEQ ID NO: 7936551 - DNA, 22 bp, Homo sapiens
aagccaatgatacgggtgatct

SEQ ID NO: 7936552 - DNA, 22 bp, Homo sapiens
aagccaatgagagaggcctcag

SEQ ID NO: 7936553 - DNA, 23 bp, Homo sapiens
aagcatggttcacagttagtact

SEQ ID NO: 7936554 - DNA, 22 bp, Homo sapiens
aagcagcagcctgaagtacgtc

SEQ ID NO: 7936555 - DNA, 22 bp, Homo sapiens
aagcagcagcctgaagtacgtc

SEQ ID NO: 7936556 - DNA, 22 bp, Homo sapiens
aagcagcagcctgaagtacgtc

SEQ ID NO: 7936557 - DNA, 22 bp, Homo sapiens
aagcagcagccatcccccaagg

SEQ ID NO: 7936558 - DNA, 22 bp, Homo sapiens
aagcagcataattgctatttta

SEQ ID NO: 7936559 - DNA, 22 bp, Homo sapiens
aagcagcataattgctatttta

SEQ ID NO: 7936560 - DNA, 22 bp, Homo sapiens
aagcagcataattgctatttta

SEQ ID NO: 7936561 - DNA, 22 bp, Homo sapiens
aagcagcagacctgattttgaa

SEQ ID NO: 7936562 - DNA, 22 bp, Homo sapiens
aagcagcacgctttgccaacaa

SEQ ID NO: 7936563 - DNA, 22 bp, Homo sapiens
aagcagcagacctgattttgaa

SEQ ID NO: 7936564 - DNA, 22 bp, Homo sapiens
aagcagcacgctttgccaacaa

SEQ ID NO: 7936565 - DNA, 22 bp, Homo sapiens
aagcagcagcaggattaaagag

SEQ ID NO: 7936566 - DNA, 22 bp, Homo sapiens
aagcagcagacctgattttgaa

SEQ ID NO: 7936567 - DNA, 22 bp, Homo sapiens
aagcagcagacctgattttgaa

SEQ ID NO: 7936568 - DNA, 22 bp, Homo sapiens
aagcagcagcaggattaaagag

SEQ ID NO: 7936569 - DNA, 22 bp, Homo sapiens
aagcagcagcaggattaaagag

SEQ ID NO: 7936570 - DNA, 15 bp, Homo sapiens
aagcagcaatatata

SEQ ID NO: 7936571 - DNA, 22 bp, Homo sapiens
aagcagcacagcaatgactcta

SEQ ID NO: 7936572 - DNA, 22 bp, Homo sapiens
aagcagcacagcaatgactcta

SEQ ID NO: 7936573 - DNA, 22 bp, Homo sapiens
aagcagcacagtaatattggtg

SEQ ID NO: 7936574 - DNA, 22 bp, Homo sapiens
aagcagcacagtaatattggtg

SEQ ID NO: 7936575 - DNA, 22 bp, Homo sapiens
aagcagcacagtaatattggtg

SEQ ID NO: 7936576 - DNA, 22 bp, Homo sapiens
aagcagcacgctttgccaacaa

SEQ ID NO: 7936577 - DNA, 22 bp, Homo sapiens
aagcagcacgctttgccaacaa

SEQ ID NO: 7936578 - DNA, 22 bp, Homo sapiens
aagcagcacgctttgccaacaa

SEQ ID NO: 7936579 - DNA, 22 bp, Homo sapiens
aagcagcacagtaatattggtg

SEQ ID NO: 7936580 - DNA, 22 bp, Homo sapiens
aagcagcacgctttgccaacaa

SEQ ID NO: 7936581 - DNA, 22 bp, Homo sapiens
aagccactatggtgattctcaa

SEQ ID NO: 7936582 - DNA, 22 bp, Homo sapiens
aagccacagatcgttctgtcac

SEQ ID NO: 7936583 - DNA, 22 bp, Homo sapiens
aagccaatggattggttgcttt

SEQ ID NO: 7936584 - DNA, 22 bp, Homo sapiens
aagccaatgttgcctgggtttc

SEQ ID NO: 7936585 - DNA, 22 bp, Homo sapiens
aagccaatgttgcctgggtttc

SEQ ID NO: 7936586 - DNA, 22 bp, Homo sapiens
aagccaatggattggttgcttt

SEQ ID NO: 7936587 - DNA, 22 bp, Homo sapiens
aagccactcacaataactgtcc

SEQ ID NO: 7936588 - DNA, 22 bp, Homo sapiens
aagccactcacaataactgtcc

SEQ ID NO: 7936589 - DNA, 22 bp, Homo sapiens
aagccactgagatttcactgca

SEQ ID NO: 7936590 - DNA, 22 bp, Homo sapiens
aagccactatggtgattctcaa

SEQ ID NO: 7936591 - DNA, 22 bp, Homo sapiens
aagccactatggtgattctcaa

SEQ ID NO: 7936592 - DNA, 22 bp, Homo sapiens
aagccactatggtgattctcaa

SEQ ID NO: 7936593 - DNA, 22 bp, Homo sapiens
aagccactattaaataatgatt

SEQ ID NO: 7936594 - DNA, 22 bp, Homo sapiens
aagccactgcggtttcccatcc

SEQ ID NO: 7936595 - DNA, 22 bp, Homo sapiens
aagccactgcggtttcccatcc

SEQ ID NO: 7936596 - DNA, 22 bp, Homo sapiens
aagccactgttttggagtgctt

SEQ ID NO: 7936597 - DNA, 22 bp, Homo sapiens
aagccactgcagcaggagctgc

SEQ ID NO: 7936598 - DNA, 22 bp, Homo sapiens
aagccactgagatttcactgca

SEQ ID NO: 7936599 - DNA, 22 bp, Homo sapiens
aagccactgagatttcactgca

SEQ ID NO: 7936600 - DNA, 22 bp, Homo sapiens
aagccactgcagcaggagctgc

SEQ ID NO: 7936601 - DNA, 22 bp, Homo sapiens
aagccagagtttttgagaactt

SEQ ID NO: 7936602 - DNA, 22 bp, Homo sapiens
aagccacttggggaaagatgga

SEQ ID NO: 7936603 - DNA, 18 bp, Homo sapiens
aagccagagaccactgcc

SEQ ID NO: 7936604 - DNA, 22 bp, Homo sapiens
aagccactttcagctgtctcag

SEQ ID NO: 7936605 - DNA, 22 bp, Homo sapiens
aagccactttcagctgtctcag

SEQ ID NO: 7936606 - DNA, 22 bp, Homo sapiens
aagccagattccttaagcacag

SEQ ID NO: 7936607 - DNA, 22 bp, Homo sapiens
aagccagagtttttgagaactt

SEQ ID NO: 7936608 - DNA, 22 bp, Homo sapiens
aactttgtcttttatgcttaca

SEQ ID NO: 7936609 - DNA, 22 bp, Homo sapiens
aactttgttttattcactgctg

SEQ ID NO: 7936610 - DNA, 22 bp, Homo sapiens
aactttggtattcgacagctct

SEQ ID NO: 7936611 - DNA, 22 bp, Homo sapiens
aactttgggtaatgcttcaatt

SEQ ID NO: 7936612 - DNA, 22 bp, Homo sapiens
aactttgggtaatgcttcaatt

SEQ ID NO: 7936613 - DNA, 22 bp, Homo sapiens
aactttggtattcgacagctct

SEQ ID NO: 7936614 - DNA, 22 bp, Homo sapiens
aactttggtcagagaaattgtg

SEQ ID NO: 7936615 - DNA, 21 bp, Homo sapiens
aactttggaaggcagcttggc

SEQ ID NO: 7936616 - DNA, 22 bp, Homo sapiens
aactttggcaagtcagacttct

SEQ ID NO: 7936617 - DNA, 22 bp, Homo sapiens
aactttggcaagtcagacttct

SEQ ID NO: 7936618 - DNA, 22 bp, Homo sapiens
aactttggcaagtcagacttct

SEQ ID NO: 7936619 - DNA, 22 bp, Homo sapiens
aactttggcaagtcagacttct

SEQ ID NO: 7936620 - DNA, 22 bp, Homo sapiens
aactttggggtggtttgttagt

SEQ ID NO: 7936621 - DNA, 22 bp, Homo sapiens
aactttgggcctaagtactgtt

SEQ ID NO: 7936622 - DNA, 22 bp, Homo sapiens
aactttctttgcatctaagttt

SEQ ID NO: 7936623 - DNA, 22 bp, Homo sapiens
aactttctttgcatctaagttt

SEQ ID NO: 7936624 - DNA, 22 bp, Homo sapiens
aactttctttgcatctaagttt

SEQ ID NO: 7936625 - DNA, 22 bp, Homo sapiens
aactttgcaagggggccctgcg

SEQ ID NO: 7936626 - DNA, 22 bp, Homo sapiens
aactttgagtcattgcctcttt

SEQ ID NO: 7936627 - DNA, 22 bp, Homo sapiens
aactttctttcacagaagtatc

SEQ ID NO: 7936628 - DNA, 22 bp, Homo sapiens
aactttcttgtgacatttgggg

SEQ ID NO: 7936629 - DNA, 22 bp, Homo sapiens
aactttcttgtgacatttgggg

SEQ ID NO: 7936630 - DNA, 22 bp, Homo sapiens
aacttttcacaggctagctctt

SEQ ID NO: 7936631 - DNA, 22 bp, Homo sapiens
aacttttcattccaaaggtgct

SEQ ID NO: 7936632 - DNA, 22 bp, Homo sapiens
aacttttcataagggcaaattt

SEQ ID NO: 7936633 - DNA, 22 bp, Homo sapiens
aacttttcattgaatcatgtca

SEQ ID NO: 7936634 - DNA, 22 bp, Homo sapiens
aacttttcattgaatcatgtca

SEQ ID NO: 7936635 - DNA, 22 bp, Homo sapiens
aacttttcattccaaaggtgct

SEQ ID NO: 7936636 - DNA, 22 bp, Homo sapiens
aacttttcattccaaaggtgct

SEQ ID NO: 7936637 - DNA, 22 bp, Homo sapiens
aacttttacaaattgtcatcat

SEQ ID NO: 7936638 - DNA, 22 bp, Homo sapiens
aacttttacaaattgtcatcat

SEQ ID NO: 7936639 - DNA, 22 bp, Homo sapiens
aacttttaaaatacacagacaa

SEQ ID NO: 7936640 - DNA, 22 bp, Homo sapiens
aacttttaaaatacacagacaa

SEQ ID NO: 7936641 - DNA, 23 bp, Homo sapiens
aacttttagagtttaacagtgtt

SEQ ID NO: 7936642 - DNA, 22 bp, Homo sapiens
aacttttagacttgggtataaa

SEQ ID NO: 7936643 - DNA, 23 bp, Homo sapiens
aacttttagagtttaacagtgtt

SEQ ID NO: 7936644 - DNA, 22 bp, Homo sapiens
aacttttctgtgttgtccggga

SEQ ID NO: 7936645 - DNA, 22 bp, Homo sapiens
aagaaagccaaagttcatacct

SEQ ID NO: 7936646 - DNA, 22 bp, Homo sapiens
aagaaagccaaagttcatacct

SEQ ID NO: 7936647 - DNA, 22 bp, Homo sapiens
aactttttctgggatggagggt

SEQ ID NO: 7936648 - DNA, 22 bp, Homo sapiens
aagaaagccaaagttcatacct

SEQ ID NO: 7936649 - DNA, 22 bp, Homo sapiens
aagaaagctgaatattctgtgt

SEQ ID NO: 7936650 - DNA, 22 bp, Homo sapiens
aagaaagggagaaggatggtgt

SEQ ID NO: 7936651 - DNA, 22 bp, Homo sapiens
aagaaagggctattgttctcca

SEQ ID NO: 7936652 - DNA, 22 bp, Homo sapiens
aagaaagggagaaggatggtgt

SEQ ID NO: 7936653 - DNA, 22 bp, Homo sapiens
aagaaagggagaaggatggtgt

SEQ ID NO: 7936654 - DNA, 22 bp, Homo sapiens
aagaaaggatatatgggaggta

SEQ ID NO: 7936655 - DNA, 22 bp, Homo sapiens
aagaaagggagaaggatggtgt

SEQ ID NO: 7936656 - DNA, 22 bp, Homo sapiens
aagaaaggatatatgggaggta

SEQ ID NO: 7936657 - DNA, 22 bp, Homo sapiens
aagaaaggatatatgggaggta

SEQ ID NO: 7936658 - DNA, 22 bp, Homo sapiens
aagaaaggatatatgggaggta

SEQ ID NO: 7936659 - DNA, 22 bp, Homo sapiens
aagaatgtggcatttatttata

SEQ ID NO: 7936660 - DNA, 22 bp, Homo sapiens
aagaatgtggcatttatttata

SEQ ID NO: 7936661 - DNA, 22 bp, Homo sapiens
aagaatgtgggtggatatgatg

SEQ ID NO: 7936662 - DNA, 22 bp, Homo sapiens
aagaatgtggcatttatttata

SEQ ID NO: 7936663 - DNA, 22 bp, Homo sapiens
aagaatgtgggtggatatgatg

SEQ ID NO: 7936664 - DNA, 22 bp, Homo sapiens
aagaatgtcgttggtattttaa

SEQ ID NO: 7936665 - DNA, 22 bp, Homo sapiens
aagaatgtcgttggtattttaa

SEQ ID NO: 7936666 - DNA, 22 bp, Homo sapiens
aagaatgtcgttggtattttaa

SEQ ID NO: 7936667 - DNA, 22 bp, Homo sapiens
aagaatgtctctggtgaggcgc

SEQ ID NO: 7936668 - DNA, 22 bp, Homo sapiens
aagaatgtcaagcagaaggtct

SEQ ID NO: 7936669 - DNA, 22 bp, Homo sapiens
aagaatgcatcaaaagtcagag

SEQ ID NO: 7936670 - DNA, 22 bp, Homo sapiens
aagaatgcatcaaaagtcagag

SEQ ID NO: 7936671 - DNA, 22 bp, Homo sapiens
aagaatgagctcaaagatctta

SEQ ID NO: 7936672 - DNA, 22 bp, Homo sapiens
aagaatgagctcaaagatctta

SEQ ID NO: 7936673 - DNA, 22 bp, Homo sapiens
aagaatgagctcaaagatctta

SEQ ID NO: 7936674 - DNA, 22 bp, Homo sapiens
aagaatgagctcaaagatctta

SEQ ID NO: 7936675 - DNA, 22 bp, Homo sapiens
aagaatgagctcaaagatctta

SEQ ID NO: 7936676 - DNA, 22 bp, Homo sapiens
aagaagttggaaatgattgaga

SEQ ID NO: 7936677 - DNA, 22 bp, Homo sapiens
aagaatgagctcaaagatctta

SEQ ID NO: 7936678 - DNA, 22 bp, Homo sapiens
aagaatgagctcaaagatctta

SEQ ID NO: 7936679 - DNA, 22 bp, Homo sapiens
aagaatgattacaaagcaacga

SEQ ID NO: 7936680 - DNA, 22 bp, Homo sapiens
aagaatgattacaaagcaacga

SEQ ID NO: 7936681 - DNA, 22 bp, Homo sapiens
aagaatgattacaaagcaacga

SEQ ID NO: 7936682 - DNA, 22 bp, Homo sapiens
aagaatgattacaaagcaacga

SEQ ID NO: 7936683 - DNA, 22 bp, Homo sapiens
aagaatgattacaaagcaacga

SEQ ID NO: 7936684 - DNA, 22 bp, Homo sapiens
aagaatgattacaaagcaacga

SEQ ID NO: 7936685 - DNA, 22 bp, Homo sapiens
aagaatgagctcaaagatctta

SEQ ID NO: 7936686 - DNA, 22 bp, Homo sapiens
aagaatgattacaaagcaacga

SEQ ID NO: 7936687 - DNA, 22 bp, Homo sapiens
aagaaagtgatgagctacagat

SEQ ID NO: 7936688 - DNA, 22 bp, Homo sapiens
aagaaagtgatgagctacagat

SEQ ID NO: 7936689 - DNA, 22 bp, Homo sapiens
aagaaagggctattgttctcca

SEQ ID NO: 7936690 - DNA, 22 bp, Homo sapiens
aagaaaggtctctgcccgctat

SEQ ID NO: 7936691 - DNA, 22 bp, Homo sapiens
aagaaaggtctctgcccgctat

SEQ ID NO: 7936692 - DNA, 22 bp, Homo sapiens
aagaaagggctattgttctcca

SEQ ID NO: 7936693 - DNA, 22 bp, Homo sapiens
aagaaagggctattgttctcca

SEQ ID NO: 7936694 - DNA, 22 bp, Homo sapiens
aagaaaggtgtgtttgcagatg

SEQ ID NO: 7936695 - DNA, 22 bp, Homo sapiens
aagaaaggtgtgtttgcagatg

SEQ ID NO: 7936696 - DNA, 22 bp, Homo sapiens
aagaaaggtgtgtttgcagatg

SEQ ID NO: 7936697 - DNA, 22 bp, Homo sapiens
aagaaaggtgtgtttgcagatg

SEQ ID NO: 7936698 - DNA, 22 bp, Homo sapiens
aagaagttaggtgtaacaatat

SEQ ID NO: 7936699 - DNA, 22 bp, Homo sapiens
aagaagttctgcctaagggaca

SEQ ID NO: 7936700 - DNA, 22 bp, Homo sapiens
aagaaataagacttctctgtcc

SEQ ID NO: 7936701 - DNA, 23 bp, Homo sapiens
aagaagttacctaaagttgtact

SEQ ID NO: 7936702 - DNA, 22 bp, Homo sapiens
aagaaataagacttctctgtcc

SEQ ID NO: 7936703 - DNA, 22 bp, Homo sapiens
aagaaagtgggtaatatgattt

SEQ ID NO: 7936704 - DNA, 22 bp, Homo sapiens
aagaaagtgggtaatatgattt

SEQ ID NO: 7936705 - DNA, 22 bp, Homo sapiens
aagaaagtgggtaatatgattt

SEQ ID NO: 7936706 - DNA, 22 bp, Homo sapiens
aagaatgttagtttctgataca

SEQ ID NO: 7936707 - DNA, 22 bp, Homo sapiens
aagaatgttagtttctgataca

SEQ ID NO: 7936708 - DNA, 22 bp, Homo sapiens
aagaatgttcaacgcttttttg

SEQ ID NO: 7936709 - DNA, 22 bp, Homo sapiens
aagaatgttcattaaactgttg

SEQ ID NO: 7936710 - DNA, 22 bp, Homo sapiens
aagaatgttcaacgcttttttg

SEQ ID NO: 7936711 - DNA, 22 bp, Homo sapiens
aagaatgttcttgtagtcatga

SEQ ID NO: 7936712 - DNA, 22 bp, Homo sapiens
aagaatgttcttgtagtcatga

SEQ ID NO: 7936713 - DNA, 21 bp, Homo sapiens
aagaatgttccaggtcttgcc

SEQ ID NO: 7936714 - DNA, 22 bp, Homo sapiens
aagacactaagctttcaggata

SEQ ID NO: 7936715 - DNA, 22 bp, Homo sapiens
aagacactaagctttcaggata

SEQ ID NO: 7936716 - DNA, 22 bp, Homo sapiens
aagaattatctgaaagctgtgt

SEQ ID NO: 7936717 - DNA, 17 bp, Homo sapiens
aagacagaagccatgag

SEQ ID NO: 7936718 - DNA, 17 bp, Homo sapiens
aagacagaagccatgag

SEQ ID NO: 7936719 - DNA, 22 bp, Homo sapiens
aagacactttctaaatagaagt

SEQ ID NO: 7936720 - DNA, 22 bp, Homo sapiens
aagacactttctaaatagaagt

SEQ ID NO: 7936721 - DNA, 21 bp, Homo sapiens
aagacagaaaagcctattttc

SEQ ID NO: 7936722 - DNA, 22 bp, Homo sapiens
aagacactgggttaggcacgtg

SEQ ID NO: 7936723 - DNA, 22 bp, Homo sapiens
aagacactgggttaggcacgtg

SEQ ID NO: 7936724 - DNA, 22 bp, Homo sapiens
aagacactttctaaatagaagt

SEQ ID NO: 7936725 - DNA, 22 bp, Homo sapiens
aagacactttctaaatagaagt

SEQ ID NO: 7936726 - DNA, 22 bp, Homo sapiens
aagacactcattatcactggtt

SEQ ID NO: 7936727 - DNA, 22 bp, Homo sapiens
aagacactcattatcactggtt

SEQ ID NO: 7936728 - DNA, 22 bp, Homo sapiens
aagacactgatactctgtgatt

SEQ ID NO: 7936729 - DNA, 22 bp, Homo sapiens
aagacactgatactctgtgatt

SEQ ID NO: 7936730 - DNA, 22 bp, Homo sapiens
aagacactgatactctgtgatt

SEQ ID NO: 7936731 - DNA, 22 bp, Homo sapiens
aagacactgatactctgtgatt

SEQ ID NO: 7936732 - DNA, 22 bp, Homo sapiens
aagacactgggggctgcagcca

SEQ ID NO: 7936733 - DNA, 22 bp, Homo sapiens
aagacactgggggctgcagcca

SEQ ID NO: 7936734 - DNA, 22 bp, Homo sapiens
aagacactgggggctgcagcca

SEQ ID NO: 7936735 - DNA, 22 bp, Homo sapiens
aagacagaagtgatttgatgtg

SEQ ID NO: 7936736 - DNA, 22 bp, Homo sapiens
aagacagaccacgtgacagggc

SEQ ID NO: 7936737 - DNA, 22 bp, Homo sapiens
aagacagaccacgtgacagggc

SEQ ID NO: 7936738 - DNA, 17 bp, Homo sapiens
aagacagaagccatgag

SEQ ID NO: 7936739 - DNA, 17 bp, Homo sapiens
aagacagaagccatgag

SEQ ID NO: 7936740 - DNA, 17 bp, Homo sapiens
aagacagaagccatgag

SEQ ID NO: 7936741 - DNA, 17 bp, Homo sapiens
aagacagaagccatgag

SEQ ID NO: 7936742 - DNA, 22 bp, Homo sapiens
aagacagagactctgcaacagg

SEQ ID NO: 7936743 - DNA, 22 bp, Homo sapiens
aagacagagactctgcaacagg

SEQ ID NO: 7936744 - DNA, 22 bp, Homo sapiens
aagacagagactctgcaacagg

SEQ ID NO: 7936745 - DNA, 22 bp, Homo sapiens
aagacagagactctgcaacagg

SEQ ID NO: 7936746 - DNA, 22 bp, Homo sapiens
aagacagagactctgcaacagg

SEQ ID NO: 7936747 - DNA, 22 bp, Homo sapiens
aagacagaccacgtgacagggc

SEQ ID NO: 7936748 - DNA, 22 bp, Homo sapiens
aagacagaccacgtgacagggc

SEQ ID NO: 7936749 - DNA, 22 bp, Homo sapiens
aagacagaccacgtgacagggc

SEQ ID NO: 7936750 - DNA, 22 bp, Homo sapiens
aagacagagactctgcaacagg

SEQ ID NO: 7936751 - DNA, 22 bp, Homo sapiens
aagacagagactctgcaacagg

SEQ ID NO: 7936752 - DNA, 22 bp, Homo sapiens
aagacagagggaagcaatgatg

SEQ ID NO: 7936753 - DNA, 22 bp, Homo sapiens
aagacagagggaagcaatgatg

SEQ ID NO: 7936754 - DNA, 20 bp, Homo sapiens
aagagaggaagttatactag

SEQ ID NO: 7936755 - DNA, 20 bp, Homo sapiens
aagagaggaagttatactag

SEQ ID NO: 7936756 - DNA, 20 bp, Homo sapiens
aagagcatagtacaggaaga

SEQ ID NO: 7936757 - DNA, 22 bp, Homo sapiens
aagagcatatatgtatgtttgt

SEQ ID NO: 7936758 - DNA, 22 bp, Homo sapiens
aagaggaagtctccatggagag

SEQ ID NO: 7936759 - DNA, 22 bp, Homo sapiens
aagagcctctgtgtttcagcct

SEQ ID NO: 7936760 - DNA, 22 bp, Homo sapiens
aagagcctggctgctaggctca

SEQ ID NO: 7936761 - DNA, 22 bp, Homo sapiens
aagagcccttgttcataattat

SEQ ID NO: 7936762 - DNA, 22 bp, Homo sapiens
aagagcctccctagaggtgaag

SEQ ID NO: 7936763 - DNA, 22 bp, Homo sapiens
aagagcctccctagaggtgaag

SEQ ID NO: 7936764 - DNA, 22 bp, Homo sapiens
aagagccgctccggccagggag

SEQ ID NO: 7936765 - DNA, 20 bp, Homo sapiens
aagagcccgcagggcagtgc

SEQ ID NO: 7936766 - DNA, 22 bp, Homo sapiens
aagagccatatatgcagctaga

SEQ ID NO: 7936767 - DNA, 22 bp, Homo sapiens
aagaggagaaaggctggctttg

SEQ ID NO: 7936768 - DNA, 22 bp, Homo sapiens
aagaggacttgtgaagatgtac

SEQ ID NO: 7936769 - DNA, 22 bp, Homo sapiens
aagaggacttgtgaagatgtac

SEQ ID NO: 7936770 - DNA, 22 bp, Homo sapiens
aagaggacttgtgaagatgtac

SEQ ID NO: 7936771 - DNA, 22 bp, Homo sapiens
aagaggaccagtagataaattt

SEQ ID NO: 7936772 - DNA, 22 bp, Homo sapiens
aagaggacagtattcaatatga

SEQ ID NO: 7936773 - DNA, 22 bp, Homo sapiens
aagaggaagtctccatggagag

SEQ ID NO: 7936774 - DNA, 22 bp, Homo sapiens
aagaggaagtctccatggagag

SEQ ID NO: 7936775 - DNA, 22 bp, Homo sapiens
aagagcatctatttcacagtgg

SEQ ID NO: 7936776 - DNA, 22 bp, Homo sapiens
aagagcatcggtggagccccca

SEQ ID NO: 7936777 - DNA, 22 bp, Homo sapiens
aagagcatctatttcacagtgg

SEQ ID NO: 7936778 - DNA, 22 bp, Homo sapiens
aagagcatattaatagtggaga

SEQ ID NO: 7936779 - DNA, 22 bp, Homo sapiens
aagagcatggagttcccctaaa

SEQ ID NO: 7936780 - DNA, 22 bp, Homo sapiens
aagagcatctatttcacagtgg

SEQ ID NO: 7936781 - DNA, 22 bp, Homo sapiens
aagagcatggaatggagatcca

SEQ ID NO: 7936782 - DNA, 22 bp, Homo sapiens
aagagcatgtaattggatttct

SEQ ID NO: 7936783 - DNA, 22 bp, Homo sapiens
aagagcatgttaattctaggac

SEQ ID NO: 7936784 - DNA, 22 bp, Homo sapiens
aagagcattccgttctgattct

SEQ ID NO: 7936785 - DNA, 22 bp, Homo sapiens
aagagccagctagtgaagaggc

SEQ ID NO: 7936786 - DNA, 22 bp, Homo sapiens
aagagccagtgggaaagtcttg

SEQ ID NO: 7936787 - DNA, 22 bp, Homo sapiens
aagagccagtgggaaagtcttg

SEQ ID NO: 7936788 - DNA, 22 bp, Homo sapiens
aagagcatttccactggcactg

SEQ ID NO: 7936789 - DNA, 22 bp, Homo sapiens
aagagcatttaattaggagagt

SEQ ID NO: 7936790 - DNA, 22 bp, Homo sapiens
aagagcattttagtctcccttt

SEQ ID NO: 7936791 - DNA, 22 bp, Homo sapiens
aagagcatttggtgagatttga

SEQ ID NO: 7936792 - DNA, 22 bp, Homo sapiens
aagagcattttgtaaaatcctt

SEQ ID NO: 7936793 - DNA, 20 bp, Homo sapiens
aacagtgaatgaggccagag

SEQ ID NO: 7936794 - DNA, 20 bp, Homo sapiens
aacagtgaatgaggccagag

SEQ ID NO: 7936795 - DNA, 22 bp, Homo sapiens
aacagtcttggaagtcttgtta

SEQ ID NO: 7936796 - DNA, 22 bp, Homo sapiens
aacagtcttggaagtcttgtta

SEQ ID NO: 7936797 - DNA, 22 bp, Homo sapiens
aacagtcttacagaagtagcca

SEQ ID NO: 7936798 - DNA, 22 bp, Homo sapiens
aacagtcttacagaagtagcca

SEQ ID NO: 7936799 - DNA, 19 bp, Homo sapiens
aacagtctgggaagcacag

SEQ ID NO: 7936800 - DNA, 19 bp, Homo sapiens
aacagtctgggaagcacag

SEQ ID NO: 7936801 - DNA, 22 bp, Homo sapiens
aacagtcctgtgctctttcatt

SEQ ID NO: 7936802 - DNA, 22 bp, Homo sapiens
aacagtcctgtgctctttcatt

SEQ ID NO: 7936803 - DNA, 22 bp, Homo sapiens
aacagtcctgtgctctttcatt

SEQ ID NO: 7936804 - DNA, 22 bp, Homo sapiens
aacagtcacattgttcaacttt

SEQ ID NO: 7936805 - DNA, 22 bp, Homo sapiens
aacagtcacattgttcaacttt

SEQ ID NO: 7936806 - DNA, 22 bp, Homo sapiens
aacagtcacattgttcaacttt

SEQ ID NO: 7936807 - DNA, 22 bp, Homo sapiens
aacagtatcttttatcagaaat

SEQ ID NO: 7936808 - DNA, 22 bp, Homo sapiens
aacagtatctacgggaactatt

SEQ ID NO: 7936809 - DNA, 22 bp, Homo sapiens
aacagtatctacgggaactatt

SEQ ID NO: 7936810 - DNA, 22 bp, Homo sapiens
aacagtatcttttatcagaaat

SEQ ID NO: 7936811 - DNA, 22 bp, Homo sapiens
aacagtatgtgagatttacaca

SEQ ID NO: 7936812 - DNA, 22 bp, Homo sapiens
aacagtatgtgagatttacaca

SEQ ID NO: 7936813 - DNA, 22 bp, Homo sapiens
aacagtattggttgaactcaag

SEQ ID NO: 7936814 - DNA, 22 bp, Homo sapiens
aacagtattggttgaactcaag

SEQ ID NO: 7936815 - DNA, 20 bp, Homo sapiens
aacagtcaaatgttgattgc

SEQ ID NO: 7936816 - DNA, 22 bp, Homo sapiens
aacagtaatttgcggtttttgc

SEQ ID NO: 7936817 - DNA, 22 bp, Homo sapiens
aacagtacaactccacaagact

SEQ ID NO: 7936818 - DNA, 22 bp, Homo sapiens
aacagtaatttgcggtttttgc

SEQ ID NO: 7936819 - DNA, 20 bp, Homo sapiens
aacagtaccatttatctcag

SEQ ID NO: 7936820 - DNA, 20 bp, Homo sapiens
aacagtaccccccttgttct

SEQ ID NO: 7936821 - DNA, 22 bp, Homo sapiens
aacagtagtggtcaatatgcca

SEQ ID NO: 7936822 - DNA, 22 bp, Homo sapiens
aacagtagtggtcaatatgcca

SEQ ID NO: 7936823 - DNA, 22 bp, Homo sapiens
aacagtagtggtcaatatgcca

SEQ ID NO: 7936824 - DNA, 22 bp, Homo sapiens
aacagtaatggcattgccatga

SEQ ID NO: 7936825 - DNA, 22 bp, Homo sapiens
aacagtaatggcattgccatga

SEQ ID NO: 7936826 - DNA, 22 bp, Homo sapiens
aacagtaatggcattgccatga

SEQ ID NO: 7936827 - DNA, 22 bp, Homo sapiens
aacagtaatgtggtgttgggtt

SEQ ID NO: 7936828 - DNA, 22 bp, Homo sapiens
aacagtaatgtggtgttgggtt

SEQ ID NO: 7936829 - DNA, 22 bp, Homo sapiens
aacaggaactatttgtattcca

SEQ ID NO: 7936830 - DNA, 22 bp, Homo sapiens
aacaggaactatttgtattcca

SEQ ID NO: 7936831 - DNA, 22 bp, Homo sapiens
aacaggaatgaggagaaaaggt

SEQ ID NO: 7936832 - DNA, 22 bp, Homo sapiens
aacaggaatgaggagaaaaggt

SEQ ID NO: 7936833 - DNA, 22 bp, Homo sapiens
aacaggaaaacagcacaatagc

SEQ ID NO: 7936834 - DNA, 22 bp, Homo sapiens
aacaggaaaacagcacaatagc

SEQ ID NO: 7936835 - DNA, 22 bp, Homo sapiens
aacaggaaaacagcacaatagc

SEQ ID NO: 7936836 - DNA, 22 bp, Homo sapiens
aacaggaaaacagcacaatagc

SEQ ID NO: 7936837 - DNA, 22 bp, Homo sapiens
aacaggaaacaagttgttagga

SEQ ID NO: 7936838 - DNA, 22 bp, Homo sapiens
aacaggaaacaagttgttagga

SEQ ID NO: 7936839 - DNA, 22 bp, Homo sapiens
aacaggaaatacttatgaggta

SEQ ID NO: 7936840 - DNA, 22 bp, Homo sapiens
aacaggaaacaagttgttagga

SEQ ID NO: 7936841 - DNA, 22 bp, Homo sapiens
aacaggaaatacttatgaggta

SEQ ID NO: 7936842 - DNA, 22 bp, Homo sapiens
aacaggaaatacttatgaggta

SEQ ID NO: 7936843 - DNA, 22 bp, Homo sapiens
aacatgcaatgtctgaaaatcc

SEQ ID NO: 7936844 - DNA, 22 bp, Homo sapiens
aacatgcacaattttaggcctg

SEQ ID NO: 7936845 - DNA, 22 bp, Homo sapiens
aacatgcaatgtctgaaaatcc

SEQ ID NO: 7936846 - DNA, 22 bp, Homo sapiens
aacatgcaaagctatgatgtat

SEQ ID NO: 7936847 - DNA, 22 bp, Homo sapiens
aacatgcaaagctatgatgtat

SEQ ID NO: 7936848 - DNA, 22 bp, Homo sapiens
aacattaagatggcggaacagt

SEQ ID NO: 7936849 - DNA, 22 bp, Homo sapiens
aacattaattacagtcaaacat

SEQ ID NO: 7936850 - DNA, 22 bp, Homo sapiens
aacattaattacagtcaaacat

SEQ ID NO: 7936851 - DNA, 22 bp, Homo sapiens
aacattaattacagtcaaacat

SEQ ID NO: 7936852 - DNA, 22 bp, Homo sapiens
aacattaattacagtcaaacat

SEQ ID NO: 7936853 - DNA, 22 bp, Homo sapiens
aacattagatttgtttttctag

SEQ ID NO: 7936854 - DNA, 22 bp, Homo sapiens
aacattcacctctacctccttc

SEQ ID NO: 7936855 - DNA, 22 bp, Homo sapiens
aacattcacctctacctccttc

SEQ ID NO: 7936856 - DNA, 22 bp, Homo sapiens
aacattcaagttctggtttatg

SEQ ID NO: 7936857 - DNA, 22 bp, Homo sapiens
aacattcaattgaggaagttaa

SEQ ID NO: 7936858 - DNA, 22 bp, Homo sapiens
aacattcaaaacccagttcagt

SEQ ID NO: 7936859 - DNA, 22 bp, Homo sapiens
aacattcaaaacccagttcagt

SEQ ID NO: 7936860 - DNA, 22 bp, Homo sapiens
aacattcaaaacccagttcagt

SEQ ID NO: 7936861 - DNA, 21 bp, Homo sapiens
aacattagtaatttgactttt

SEQ ID NO: 7936862 - DNA, 22 bp, Homo sapiens
aacatttctgagaatatcagtt

SEQ ID NO: 7936863 - DNA, 22 bp, Homo sapiens
aacatttctgagaatatcagtt

SEQ ID NO: 7936864 - DNA, 22 bp, Homo sapiens
aacatttccggccttttgttct

SEQ ID NO: 7936865 - DNA, 21 bp, Homo sapiens
aacatttctgggagaactcac

SEQ ID NO: 7936866 - DNA, 21 bp, Homo sapiens
aacatttctgggagaactcac

SEQ ID NO: 7936867 - DNA, 22 bp, Homo sapiens
aacatttcataacttgactttt

SEQ ID NO: 7936868 - DNA, 22 bp, Homo sapiens
aacatttcataacttgactttt

SEQ ID NO: 7936869 - DNA, 22 bp, Homo sapiens
aacattctcattgggatatgtg

SEQ ID NO: 7936870 - DNA, 22 bp, Homo sapiens
aacatttcattggaagctatgt

SEQ ID NO: 7936871 - DNA, 22 bp, Homo sapiens
aacatttcattggaagctatgt

SEQ ID NO: 7936872 - DNA, 22 bp, Homo sapiens
aacatttcattggaagctatgt

SEQ ID NO: 7936873 - DNA, 22 bp, Homo sapiens
aacatttccggccttttgttct

SEQ ID NO: 7936874 - DNA, 22 bp, Homo sapiens
aacatttcattggaagctatgt

SEQ ID NO: 7936875 - DNA, 22 bp, Homo sapiens
aacattctactgtactgcattg

SEQ ID NO: 7936876 - DNA, 22 bp, Homo sapiens
aacattctactgtactgcattg

SEQ ID NO: 7936877 - DNA, 22 bp, Homo sapiens
aacattctactgtactgcattg

SEQ ID NO: 7936878 - DNA, 22 bp, Homo sapiens
aacattcagctgggtggagcag

SEQ ID NO: 7936879 - DNA, 22 bp, Homo sapiens
aacattcagctgggtggagcag

SEQ ID NO: 7936880 - DNA, 22 bp, Homo sapiens
aacattctatgtgcattcagaa

SEQ ID NO: 7936881 - DNA, 22 bp, Homo sapiens
aacattctatgtgcattcagaa

SEQ ID NO: 7936882 - DNA, 22 bp, Homo sapiens
aacattctatgtgcattcagaa

SEQ ID NO: 7936883 - DNA, 22 bp, Homo sapiens
aacattctcattgggatatgtg

SEQ ID NO: 7936884 - DNA, 22 bp, Homo sapiens
aacattctattttgctaaaaca

SEQ ID NO: 7936885 - DNA, 22 bp, Homo sapiens
aacattctattttgctaaaaca

SEQ ID NO: 7936886 - DNA, 22 bp, Homo sapiens
aacattctcattgggatatgtg

SEQ ID NO: 7936887 - DNA, 22 bp, Homo sapiens
aactcagatatgatagcaggag

SEQ ID NO: 7936888 - DNA, 20 bp, Homo sapiens
aactcagagatgaaaaagac

SEQ ID NO: 7936889 - DNA, 22 bp, Homo sapiens
aactcagacatgtataaagact

SEQ ID NO: 7936890 - DNA, 22 bp, Homo sapiens
aactcagaatagggtgcagggc

SEQ ID NO: 7936891 - DNA, 22 bp, Homo sapiens
aactcagaatagggtgcagggc

SEQ ID NO: 7936892 - DNA, 22 bp, Homo sapiens
aactcagaatagggtgcagggc

SEQ ID NO: 7936893 - DNA, 22 bp, Homo sapiens
aactcactttgtggcttctgaa

SEQ ID NO: 7936894 - DNA, 22 bp, Homo sapiens
aactcaggagtttaaggctgca

SEQ ID NO: 7936895 - DNA, 22 bp, Homo sapiens
aactcaggagaatggagggtat

SEQ ID NO: 7936896 - DNA, 22 bp, Homo sapiens
aactcagatgtttggctacctt

SEQ ID NO: 7936897 - DNA, 22 bp, Homo sapiens
aactcagatatgatagcaggag

SEQ ID NO: 7936898 - DNA, 22 bp, Homo sapiens
aactcagatgtttggctacctt

SEQ ID NO: 7936899 - DNA, 22 bp, Homo sapiens
aactcagcatcagtgtccagaa

SEQ ID NO: 7936900 - DNA, 22 bp, Homo sapiens
aactcagtcataaagcgaatgc

SEQ ID NO: 7936901 - DNA, 22 bp, Homo sapiens
aactgaaagtttcacctgaggt

SEQ ID NO: 7936902 - DNA, 22 bp, Homo sapiens
aactgaaatcaatcagtgattc

SEQ ID NO: 7936903 - DNA, 21 bp, Homo sapiens
aactgagaccagctaaagtgg

SEQ ID NO: 7936904 - DNA, 22 bp, Homo sapiens
aactgagacacgaactatgatt

SEQ ID NO: 7936905 - DNA, 22 bp, Homo sapiens
aactgagacacgaactatgatt

SEQ ID NO: 7936906 - DNA, 22 bp, Homo sapiens
aactgacagcaggaaccattcc

SEQ ID NO: 7936907 - DNA, 22 bp, Homo sapiens
aactgaacagaactcagagatt

SEQ ID NO: 7936908 - DNA, 22 bp, Homo sapiens
aactgaactgataacatacacg

SEQ ID NO: 7936909 - DNA, 23 bp, Homo sapiens
aactgagataatgtatgtaaagc

SEQ ID NO: 7936910 - DNA, 22 bp, Homo sapiens
aactgagattacaagagacatt

SEQ ID NO: 7936911 - DNA, 22 bp, Homo sapiens
aactgagattacaagagacatt

SEQ ID NO: 7936912 - DNA, 23 bp, Homo sapiens
aactgagataatgtatgtaaagc

SEQ ID NO: 7936913 - DNA, 20 bp, Homo sapiens
aactgagagttcaggaggag

SEQ ID NO: 7936914 - DNA, 22 bp, Homo sapiens
aactgagcccctgcacttgtga

SEQ ID NO: 7936915 - DNA, 22 bp, Homo sapiens
aactgaggaataactgagttgc

SEQ ID NO: 7936916 - DNA, 22 bp, Homo sapiens
aactgaggtatctgctgtgttt

SEQ ID NO: 7936917 - DNA, 22 bp, Homo sapiens
aactgagggccctgctgaagca

SEQ ID NO: 7936918 - DNA, 22 bp, Homo sapiens
aactgaggccaagtgaggaaag

SEQ ID NO: 7936919 - DNA, 22 bp, Homo sapiens
aactgaggccaagtgaggaaag

SEQ ID NO: 7936920 - DNA, 22 bp, Homo sapiens
aactgattgttggatgatagtg

SEQ ID NO: 7936921 - DNA, 22 bp, Homo sapiens
aactgatttcaagttcagtttc

SEQ ID NO: 7936922 - DNA, 22 bp, Homo sapiens
aactgattgttggatgatagtg

SEQ ID NO: 7936923 - DNA, 22 bp, Homo sapiens
aactgaggtctccagtgcagaa

SEQ ID NO: 7936924 - DNA, 22 bp, Homo sapiens
aactgagttataactagaggta

SEQ ID NO: 7936925 - DNA, 22 bp, Homo sapiens
aactgataatggacacataaaa

SEQ ID NO: 7936926 - DNA, 22 bp, Homo sapiens
aactgatttcaagttcagtttc

SEQ ID NO: 7936927 - DNA, 22 bp, Homo sapiens
aacttgaattctgccattcaga

SEQ ID NO: 7936928 - DNA, 22 bp, Homo sapiens
aacttgcagacacctgtctcaa

SEQ ID NO: 7936929 - DNA, 22 bp, Homo sapiens
aacttgcttatattattacatt

SEQ ID NO: 7936930 - DNA, 22 bp, Homo sapiens
aacttgccaagagctttgctag

SEQ ID NO: 7936931 - DNA, 22 bp, Homo sapiens
aactatgttaataagtttcatt

SEQ ID NO: 7936932 - DNA, 22 bp, Homo sapiens
aactatgttaataagtttcatt

SEQ ID NO: 7936933 - DNA, 22 bp, Homo sapiens
aactatgttaataagtttcatt

SEQ ID NO: 7936934 - DNA, 22 bp, Homo sapiens
aactatgttaataagtttcatt

SEQ ID NO: 7936935 - DNA, 22 bp, Homo sapiens
aactatttttggagctaactct

SEQ ID NO: 7936936 - DNA, 22 bp, Homo sapiens
aactatttttggagctaactct

SEQ ID NO: 7936937 - DNA, 22 bp, Homo sapiens
aactatttttggagctaactct

SEQ ID NO: 7936938 - DNA, 22 bp, Homo sapiens
aactatgttaataagtttcatt

SEQ ID NO: 7936939 - DNA, 22 bp, Homo sapiens
aactatactctgtaaatgtgct

SEQ ID NO: 7936940 - DNA, 22 bp, Homo sapiens
aactatataatctgaaagtgaa

SEQ ID NO: 7936941 - DNA, 22 bp, Homo sapiens
aactatataatctgaaagtgaa

SEQ ID NO: 7936942 - DNA, 20 bp, Homo sapiens
aactatgaatagaagagatt

SEQ ID NO: 7936943 - DNA, 20 bp, Homo sapiens
aactatagccgatctgctgg

SEQ ID NO: 7936944 - DNA, 22 bp, Homo sapiens
aactatcacaaacagagtgtct

SEQ ID NO: 7936945 - DNA, 22 bp, Homo sapiens
aactatggtattctgatgtttc

SEQ ID NO: 7936946 - DNA, 22 bp, Homo sapiens
aactatgttaataagtttcatt

SEQ ID NO: 7936947 - DNA, 22 bp, Homo sapiens
aactcaaagatgcatgacgctt

SEQ ID NO: 7936948 - DNA, 22 bp, Homo sapiens
aactatttttggagctaactct

SEQ ID NO: 7936949 - DNA, 22 bp, Homo sapiens
aactcaaagatgcatgacgctt

SEQ ID NO: 7936950 - DNA, 22 bp, Homo sapiens
aactcaaagatgcatgacgctt

SEQ ID NO: 7936951 - DNA, 22 bp, Homo sapiens
aactcaaagatgcatgacgctt

SEQ ID NO: 7936952 - DNA, 22 bp, Homo sapiens
aactcacagctgtttggattag

SEQ ID NO: 7936953 - DNA, 22 bp, Homo sapiens
aactcacagctgtttggattag

SEQ ID NO: 7936954 - DNA, 22 bp, Homo sapiens
aactcacacaagtattgcctgc

SEQ ID NO: 7936955 - DNA, 22 bp, Homo sapiens
aactcacacaagtattgcctgc

SEQ ID NO: 7936956 - DNA, 22 bp, Homo sapiens
aactcactttgtggcttctgaa

SEQ ID NO: 7936957 - DNA, 22 bp, Homo sapiens
aactcactttgtggcttctgaa

SEQ ID NO: 7936958 - DNA, 22 bp, Homo sapiens
aacatttcttctgaaactgagt

SEQ ID NO: 7936959 - DNA, 22 bp, Homo sapiens
aacatttgagaaaaatactctt

SEQ ID NO: 7936960 - DNA, 22 bp, Homo sapiens
aacatttgagaaaaatactctt

SEQ ID NO: 7936961 - DNA, 22 bp, Homo sapiens
aacatttgaaaatcaagaatct

SEQ ID NO: 7936962 - DNA, 22 bp, Homo sapiens
aacatttgaaaatcaagaatct

SEQ ID NO: 7936963 - DNA, 22 bp, Homo sapiens
aacatttgcatgctttattaga

SEQ ID NO: 7936964 - DNA, 22 bp, Homo sapiens
aacatttgcagaggaaagctat

SEQ ID NO: 7936965 - DNA, 22 bp, Homo sapiens
aacatttgcatgctttattaga

SEQ ID NO: 7936966 - DNA, 22 bp, Homo sapiens
aacatttgcatgctttattaga

SEQ ID NO: 7936967 - DNA, 22 bp, Homo sapiens
aacatttgcagaggaaagctat

SEQ ID NO: 7936968 - DNA, 22 bp, Homo sapiens
aacatttgcagaggaaagctat

SEQ ID NO: 7936969 - DNA, 22 bp, Homo sapiens
aacatttgtgaagtacttagat

SEQ ID NO: 7936970 - DNA, 22 bp, Homo sapiens
aacatttgtgtttgctaaaaat

SEQ ID NO: 7936971 - DNA, 22 bp, Homo sapiens
aactaagttgcccagtccctgg

SEQ ID NO: 7936972 - DNA, 22 bp, Homo sapiens
aactacaatatgtatgtatgta

SEQ ID NO: 7936973 - DNA, 22 bp, Homo sapiens
aactacaatatgtatgtatgta

SEQ ID NO: 7936974 - DNA, 22 bp, Homo sapiens
aactaatacattaatacatgtg

SEQ ID NO: 7936975 - DNA, 22 bp, Homo sapiens
aacaaatgtgttttgtaattaa

SEQ ID NO: 7936976 - DNA, 22 bp, Homo sapiens
aacaaatgtgttttgtaattaa

SEQ ID NO: 7936977 - DNA, 22 bp, Homo sapiens
aacaaattagttgcaagactgg

SEQ ID NO: 7936978 - DNA, 22 bp, Homo sapiens
aacaaattagttgcaagactgg

SEQ ID NO: 7936979 - DNA, 22 bp, Homo sapiens
aacaaatttagctctgagtgct

SEQ ID NO: 7936980 - DNA, 22 bp, Homo sapiens
aacaaatttagctctgagtgct

SEQ ID NO: 7936981 - DNA, 22 bp, Homo sapiens
aacaacaacggagaaagggttg

SEQ ID NO: 7936982 - DNA, 22 bp, Homo sapiens
aacaaatttagctctgagtgct

SEQ ID NO: 7936983 - DNA, 22 bp, Homo sapiens
aacaaattagttgcaagactgg

SEQ ID NO: 7936984 - DNA, 22 bp, Homo sapiens
aacaaattagttgcaagactgg

SEQ ID NO: 7936985 - DNA, 22 bp, Homo sapiens
aaagcacatgagtagtgtagta

SEQ ID NO: 7936986 - DNA, 22 bp, Homo sapiens
aacaaccaaaaagatgaatgta

SEQ ID NO: 7936987 - DNA, 22 bp, Homo sapiens
aacaactgaaaagctttttctg

SEQ ID NO: 7936988 - DNA, 22 bp, Homo sapiens
aacaactgagcaggagtgacag

SEQ ID NO: 7936989 - DNA, 22 bp, Homo sapiens
aacaactgaaaagctttttctg

SEQ ID NO: 7936990 - DNA, 22 bp, Homo sapiens
aacaactgcttattgagtgact

SEQ ID NO: 7936991 - DNA, 22 bp, Homo sapiens
aacaacttgcgttcagagatgt

SEQ ID NO: 7936992 - DNA, 22 bp, Homo sapiens
aacaacaacggagaaagggttg

SEQ ID NO: 7936993 - DNA, 22 bp, Homo sapiens
aacaacaacggagaaagggttg

SEQ ID NO: 7936994 - DNA, 22 bp, Homo sapiens
aacaacagctgctaaagagttg

SEQ ID NO: 7936995 - DNA, 22 bp, Homo sapiens
aacaacagctgctaaagagttg

SEQ ID NO: 7936996 - DNA, 22 bp, Homo sapiens
aaagcacagggtgctagagagt

SEQ ID NO: 7936997 - DNA, 22 bp, Homo sapiens
aaagcacagggtgctagagagt

SEQ ID NO: 7936998 - DNA, 22 bp, Homo sapiens
aaagcacatagtagaaggattt

SEQ ID NO: 7936999 - DNA, 22 bp, Homo sapiens
aaagcacatagtagaaggattt

SEQ ID NO: 7937000 - DNA, 22 bp, Homo sapiens
aaagcacaggagagttcagtaa

SEQ ID NO: 7937001 - DNA, 22 bp, Homo sapiens
aaagcacaggagagttcagtaa

SEQ ID NO: 7937002 - DNA, 22 bp, Homo sapiens
aaagcacagggtgctagagagt

SEQ ID NO: 7937003 - DNA, 22 bp, Homo sapiens
aaagcacaggagagttcagtaa

SEQ ID NO: 7937004 - DNA, 22 bp, Homo sapiens
aaagcacagagctcccacagga

SEQ ID NO: 7937005 - DNA, 22 bp, Homo sapiens
aaagcacagagctcccacagga

SEQ ID NO: 7937006 - DNA, 22 bp, Homo sapiens
aaagcaatttaatggaccatga

SEQ ID NO: 7937007 - DNA, 22 bp, Homo sapiens
aaagcactatagccaaatagcc

SEQ ID NO: 7937008 - DNA, 22 bp, Homo sapiens
aaagcactatagccaaatagcc

SEQ ID NO: 7937009 - DNA, 22 bp, Homo sapiens
aaagcacattacaagctcagtc

SEQ ID NO: 7937010 - DNA, 22 bp, Homo sapiens
aaagcacattacaagctcagtc

SEQ ID NO: 7937011 - DNA, 22 bp, Homo sapiens
aaagcacattacaagctcagtc

SEQ ID NO: 7937012 - DNA, 22 bp, Homo sapiens
aaagcacattacaagctcagtc

SEQ ID NO: 7937013 - DNA, 22 bp, Homo sapiens
aaagcacatgagtagtgtagta

SEQ ID NO: 7937014 - DNA, 22 bp, Homo sapiens
aaagcacatgagtagtgtagta

SEQ ID NO: 7937015 - DNA, 22 bp, Homo sapiens
aaagcacatgagtagtgtagta

SEQ ID NO: 7937016 - DNA, 22 bp, Homo sapiens
aaagcacatgagtagtgtagta

SEQ ID NO: 7937017 - DNA, 22 bp, Homo sapiens
aaatggtatgaaaagagatttc

SEQ ID NO: 7937018 - DNA, 22 bp, Homo sapiens
aaatggtataatgtcatgtatt

SEQ ID NO: 7937019 - DNA, 22 bp, Homo sapiens
aaatggtcactggtgagtgtca

SEQ ID NO: 7937020 - DNA, 22 bp, Homo sapiens
aaatggtatgaaaagagatttc

SEQ ID NO: 7937021 - DNA, 22 bp, Homo sapiens
aaatggtccatcctaaagaagt

SEQ ID NO: 7937022 - DNA, 22 bp, Homo sapiens
aaatggtccatcctaaagaagt

SEQ ID NO: 7937023 - DNA, 22 bp, Homo sapiens
aaatggtcactggtgagtgtca

SEQ ID NO: 7937024 - DNA, 22 bp, Homo sapiens
aaatgggcctggaaagaggatg

SEQ ID NO: 7937025 - DNA, 19 bp, Homo sapiens
aaatggctttctacttaat

SEQ ID NO: 7937026 - DNA, 22 bp, Homo sapiens
aaatggctgacttttcatggga

SEQ ID NO: 7937027 - DNA, 22 bp, Homo sapiens
aaatggctgactaaattaaatt

SEQ ID NO: 7937028 - DNA, 22 bp, Homo sapiens
aaagcaatgggtctaaggtaaa

SEQ ID NO: 7937029 - DNA, 22 bp, Homo sapiens
aaagcaatgggtctaaggtaaa

SEQ ID NO: 7937030 - DNA, 22 bp, Homo sapiens
aaagcaatgtctctgcctggtt

SEQ ID NO: 7937031 - DNA, 22 bp, Homo sapiens
aaagcaatgtctctgcctggtt

SEQ ID NO: 7937032 - DNA, 22 bp, Homo sapiens
aaagcaatgtctctgcctggtt

SEQ ID NO: 7937033 - DNA, 22 bp, Homo sapiens
aaagcaatgtctctgcctggtt

SEQ ID NO: 7937034 - DNA, 22 bp, Homo sapiens
aaagcaattacaaaagggataa

SEQ ID NO: 7937035 - DNA, 22 bp, Homo sapiens
aaagcaattgtggtttttgcca

SEQ ID NO: 7937036 - DNA, 22 bp, Homo sapiens
aaagcaattgtggtttttgcca

SEQ ID NO: 7937037 - DNA, 22 bp, Homo sapiens
aaagcaattgtggtttttgtca

SEQ ID NO: 7937038 - DNA, 22 bp, Homo sapiens
aaagcaagtctctacaaagtac

SEQ ID NO: 7937039 - DNA, 22 bp, Homo sapiens
aaatggtgaagtgtaatttagc

SEQ ID NO: 7937040 - DNA, 21 bp, Homo sapiens
aaatggtctcaagtgtttcat

SEQ ID NO: 7937041 - DNA, 22 bp, Homo sapiens
aaagcaatgggtctaaggtaaa

SEQ ID NO: 7937042 - DNA, 22 bp, Homo sapiens
aaagcaatgggtctaaggtaaa

SEQ ID NO: 7937043 - DNA, 22 bp, Homo sapiens
aaagcaatagagggtaagactg

SEQ ID NO: 7937044 - DNA, 22 bp, Homo sapiens
aaagcaatagagggtaagactg

SEQ ID NO: 7937045 - DNA, 22 bp, Homo sapiens
aaagcaatagagggtaagactg

SEQ ID NO: 7937046 - DNA, 22 bp, Homo sapiens
aacacaaagaagctgcaggatc

SEQ ID NO: 7937047 - DNA, 22 bp, Homo sapiens
aacacaaagaagctgcaggatc

SEQ ID NO: 7937048 - DNA, 22 bp, Homo sapiens
aacacaaagaagctgcaggatc

SEQ ID NO: 7937049 - DNA, 22 bp, Homo sapiens
aacacaaagaagctgcaggatc

SEQ ID NO: 7937050 - DNA, 23 bp, Homo sapiens
aacacaaagctgattccagtggc

SEQ ID NO: 7937051 - DNA, 23 bp, Homo sapiens
aacacaaagctgattccagtggc

SEQ ID NO: 7937052 - DNA, 23 bp, Homo sapiens
aacacaaagctgattccagtggc

SEQ ID NO: 7937053 - DNA, 23 bp, Homo sapiens
aacacaaagctgattccagtggc

SEQ ID NO: 7937054 - DNA, 22 bp, Homo sapiens
aacacataggcagagcatgaca

SEQ ID NO: 7937055 - DNA, 22 bp, Homo sapiens
aacacataggcagagcatgaca

SEQ ID NO: 7937056 - DNA, 22 bp, Homo sapiens
aacaattatcatatacattgca

SEQ ID NO: 7937057 - DNA, 22 bp, Homo sapiens
aacaattatcatatacattgca

SEQ ID NO: 7937058 - DNA, 22 bp, Homo sapiens
aacaattatcatatacattgca

SEQ ID NO: 7937059 - DNA, 22 bp, Homo sapiens
aacaattatcatatacattgca

SEQ ID NO: 7937060 - DNA, 22 bp, Homo sapiens
aacaattatcatatacattgca

SEQ ID NO: 7937061 - DNA, 22 bp, Homo sapiens
aacacaaaaattctcaggggca

SEQ ID NO: 7937062 - DNA, 22 bp, Homo sapiens
aacacaaagaagctgcaggatc

SEQ ID NO: 7937063 - DNA, 22 bp, Homo sapiens
aacacaaagaagctgcaggatc

SEQ ID NO: 7937064 - DNA, 22 bp, Homo sapiens
aacacaaagaagctgcaggatc

SEQ ID NO: 7937065 - DNA, 22 bp, Homo sapiens
aacacaaaaattctcaggggca

SEQ ID NO: 7937066 - DNA, 22 bp, Homo sapiens
aacacaaaaattctcaggggca

SEQ ID NO: 7937067 - DNA, 22 bp, Homo sapiens
aacacaaaaattctcaggggca

SEQ ID NO: 7937068 - DNA, 22 bp, Homo sapiens
aacaagaagggaaggcatgatt

SEQ ID NO: 7937069 - DNA, 22 bp, Homo sapiens
aacaagaagggaaggcatgatt

SEQ ID NO: 7937070 - DNA, 22 bp, Homo sapiens
aacaagaagggaaggcatgatt

SEQ ID NO: 7937071 - DNA, 22 bp, Homo sapiens
aacaagaagagagggacgtaat

SEQ ID NO: 7937072 - DNA, 22 bp, Homo sapiens
aacaagaagggaaggcatgatt

SEQ ID NO: 7937073 - DNA, 22 bp, Homo sapiens
aacaagaagggaaggcatgatt

SEQ ID NO: 7937074 - DNA, 22 bp, Homo sapiens
aacaagaataagtggtttctgg

SEQ ID NO: 7937075 - DNA, 22 bp, Homo sapiens
aacaagaataagtggtttctgg

SEQ ID NO: 7937076 - DNA, 22 bp, Homo sapiens
aacaagaataagtggtttctgg

SEQ ID NO: 7937077 - DNA, 22 bp, Homo sapiens
aacaagaacacctacagttcta

SEQ ID NO: 7937078 - DNA, 22 bp, Homo sapiens
aacaagaacacctacagttcta

SEQ ID NO: 7937079 - DNA, 22 bp, Homo sapiens
aacaagaacacctacagttcta

SEQ ID NO: 7937080 - DNA, 22 bp, Homo sapiens
aacaacttgcgttcagagatgt

SEQ ID NO: 7937081 - DNA, 22 bp, Homo sapiens
aacaacttgcgttcagagatgt

SEQ ID NO: 7937082 - DNA, 22 bp, Homo sapiens
aacaagaacacctacagttcta

SEQ ID NO: 7937083 - DNA, 22 bp, Homo sapiens
aacaagaacacctacagttcta

SEQ ID NO: 7937084 - DNA, 22 bp, Homo sapiens
aacaattagactgacggtatta

SEQ ID NO: 7937085 - DNA, 22 bp, Homo sapiens
aacaattactaccaaggcctgt

SEQ ID NO: 7937086 - DNA, 22 bp, Homo sapiens
aacaatgttcttttagcttgaa

SEQ ID NO: 7937087 - DNA, 22 bp, Homo sapiens
aacaattactaccaaggcctgt

SEQ ID NO: 7937088 - DNA, 22 bp, Homo sapiens
aacaattactaccaaggcctgt

SEQ ID NO: 7937089 - DNA, 22 bp, Homo sapiens
aacaatgttcttttagcttgaa

SEQ ID NO: 7937090 - DNA, 22 bp, Homo sapiens
aacaatgttcttttagcttgaa

SEQ ID NO: 7937091 - DNA, 22 bp, Homo sapiens
aacaagagactctgttccagaa

SEQ ID NO: 7937092 - DNA, 22 bp, Homo sapiens
aacaatgtgattgaagctagaa

SEQ ID NO: 7937093 - DNA, 22 bp, Homo sapiens
aacaatgtgattgaagctagaa

SEQ ID NO: 7937094 - DNA, 22 bp, Homo sapiens
aacaatgtgttcagcactgtgg

SEQ ID NO: 7937095 - DNA, 22 bp, Homo sapiens
aacaatgttcttttagcttgaa

SEQ ID NO: 7937096 - DNA, 22 bp, Homo sapiens
aacacatatttatatatgcaca

SEQ ID NO: 7937097 - DNA, 22 bp, Homo sapiens
aacacatatttatatatgcaca

SEQ ID NO: 7937098 - DNA, 22 bp, Homo sapiens
aacacatatttatatatgcaca

SEQ ID NO: 7937099 - DNA, 22 bp, Homo sapiens
aacacatatttatatatgcaca

SEQ ID NO: 7937100 - DNA, 22 bp, Homo sapiens
aacacatatttatatatgcaca

SEQ ID NO: 7937101 - DNA, 22 bp, Homo sapiens
aacacataggcagagcatgaca

SEQ ID NO: 7937102 - DNA, 22 bp, Homo sapiens
aacacatatttatatatgcaca

SEQ ID NO: 7937103 - DNA, 21 bp, Homo sapiens
aacacatccagagtatttgac

SEQ ID NO: 7937104 - DNA, 22 bp, Homo sapiens
aacacatgaaagttggtgagta

SEQ ID NO: 7937105 - DNA, 22 bp, Homo sapiens
aacacatatttatatatgcaca

SEQ ID NO: 7937106 - DNA, 22 bp, Homo sapiens
aacacatatttttgctgagcat

SEQ ID NO: 7937107 - DNA, 22 bp, Homo sapiens
aacacattgccagagatcagca

SEQ ID NO: 7937108 - DNA, 22 bp, Homo sapiens
aacacattgccagagatcagca

SEQ ID NO: 7937109 - DNA, 22 bp, Homo sapiens
aacacatgggtgtttattgtac

SEQ ID NO: 7937110 - DNA, 22 bp, Homo sapiens
aacacatgggtgtttattgtac

SEQ ID NO: 7937111 - DNA, 23 bp, Homo sapiens
aacacattgctaattacattcaa

SEQ ID NO: 7937112 - DNA, 23 bp, Homo sapiens
aacacattgctaattacattcaa

SEQ ID NO: 7937113 - DNA, 22 bp, Homo sapiens
aacacatgccttaagaataagt

SEQ ID NO: 7937114 - DNA, 22 bp, Homo sapiens
aacacatgccttaagaataagt

SEQ ID NO: 7937115 - DNA, 22 bp, Homo sapiens
aacacatgccttaagaataagt

SEQ ID NO: 7937116 - DNA, 22 bp, Homo sapiens
aacagctttgagcagttctgta

SEQ ID NO: 7937117 - DNA, 22 bp, Homo sapiens
aacagctttgcttctggagaca

SEQ ID NO: 7937118 - DNA, 22 bp, Homo sapiens
aacagctttgtatacagtaact

SEQ ID NO: 7937119 - DNA, 22 bp, Homo sapiens
aacagctttgcttctggagaca

SEQ ID NO: 7937120 - DNA, 22 bp, Homo sapiens
aacagctttgcttctggagaca

SEQ ID NO: 7937121 - DNA, 22 bp, Homo sapiens
aacagctttgtatacagtaact

SEQ ID NO: 7937122 - DNA, 22 bp, Homo sapiens
aacagctttgtatacagtaact

SEQ ID NO: 7937123 - DNA, 22 bp, Homo sapiens
aacagctttgtgctcagatttg

SEQ ID NO: 7937124 - DNA, 22 bp, Homo sapiens
aacagctttgtatacagtaact

SEQ ID NO: 7937125 - DNA, 22 bp, Homo sapiens
aacagcttttttggtcagcatt

SEQ ID NO: 7937126 - DNA, 22 bp, Homo sapiens
aacagctttgtgctcagatttg

SEQ ID NO: 7937127 - DNA, 22 bp, Homo sapiens
aacagcttttttggtcagcatt

SEQ ID NO: 7937128 - DNA, 22 bp, Homo sapiens
aacagcttttttggtcagcatt

SEQ ID NO: 7937129 - DNA, 22 bp, Homo sapiens
aacagcttttttggtcagcatt

SEQ ID NO: 7937130 - DNA, 22 bp, Homo sapiens
aacagctttgagcagttctgta

SEQ ID NO: 7937131 - DNA, 22 bp, Homo sapiens
aacagcttgctgcaccttaata

SEQ ID NO: 7937132 - DNA, 22 bp, Homo sapiens
aacagctttagaggataatagt

SEQ ID NO: 7937133 - DNA, 22 bp, Homo sapiens
aacagctttgagcagttctgta

SEQ ID NO: 7937134 - DNA, 22 bp, Homo sapiens
aacagcttgctgcaccttaata

SEQ ID NO: 7937135 - DNA, 22 bp, Homo sapiens
aacagctttagaggataatagt

SEQ ID NO: 7937136 - DNA, 22 bp, Homo sapiens
aacagcagcatgacagctgggt

SEQ ID NO: 7937137 - DNA, 22 bp, Homo sapiens
aacagcagctgaggagctgggc

SEQ ID NO: 7937138 - DNA, 22 bp, Homo sapiens
aacagcagcatgacagctgggt

SEQ ID NO: 7937139 - DNA, 22 bp, Homo sapiens
aacacattggaagccaagaatg

SEQ ID NO: 7937140 - DNA, 22 bp, Homo sapiens
aaaaagacagaggatgaggcag

SEQ ID NO: 7937141 - DNA, 22 bp, Homo sapiens
aaaaagacagaggatgaggcag

SEQ ID NO: 7937142 - DNA, 22 bp, Homo sapiens
aaaaagacagaggatgaggcag

SEQ ID NO: 7937143 - DNA, 20 bp, Homo sapiens
aaaaagacaaaacgagttgg

SEQ ID NO: 7937144 - DNA, 22 bp, Homo sapiens
aaaaagactagtcgagtgcagt

SEQ ID NO: 7937145 - DNA, 22 bp, Homo sapiens
aaaaagactagtcgagtgcagt

SEQ ID NO: 7937146 - DNA, 22 bp, Homo sapiens
aaaaagactagtcgagtgcagt

SEQ ID NO: 7937147 - DNA, 22 bp, Homo sapiens
aaaaagacagaggatgaggcag

SEQ ID NO: 7937148 - DNA, 22 bp, Homo sapiens
aaaaagacagaggatgaggcag

SEQ ID NO: 7937149 - DNA, 22 bp, Homo sapiens
aaaaagacagaggatgaggcag

SEQ ID NO: 7937150 - DNA, 22 bp, Homo sapiens
aaaaagacttccaactcaggag

SEQ ID NO: 7937151 - DNA, 22 bp, Homo sapiens
aaaaagacttccaactcaggag

SEQ ID NO: 7937152 - DNA, 22 bp, Homo sapiens
aaaaagactagtcgagtgcagt

SEQ ID NO: 7937153 - DNA, 22 bp, Homo sapiens
aaaaagacttccaactcaggag

SEQ ID NO: 7937154 - DNA, 22 bp, Homo sapiens
aaaaagacttccaactcaggag

SEQ ID NO: 7937155 - DNA, 22 bp, Homo sapiens
aaaaagacttccaactcaggag

SEQ ID NO: 7937156 - DNA, 20 bp, Homo sapiens
aaaaagacaaaacgagttgg

SEQ ID NO: 7937157 - DNA, 20 bp, Homo sapiens
aaaaagacaaaacgagttgg

SEQ ID NO: 7937158 - DNA, 20 bp, Homo sapiens
aaaaagacaaaacgagttgg

SEQ ID NO: 7937159 - DNA, 20 bp, Homo sapiens
aaaaagacaaaacgagttgg

SEQ ID NO: 7937160 - DNA, 19 bp, Homo sapiens
aaaaacttagtccagaaag

SEQ ID NO: 7937161 - DNA, 19 bp, Homo sapiens
aaaaacttagtccagaaag

SEQ ID NO: 7937162 - DNA, 19 bp, Homo sapiens
aaaaacttagtccagaaag

SEQ ID NO: 7937163 - DNA, 22 bp, Homo sapiens
aaaaactgtaattacttttgca

SEQ ID NO: 7937164 - DNA, 22 bp, Homo sapiens
aaaaactgtaattacttttgca

SEQ ID NO: 7937165 - DNA, 22 bp, Homo sapiens
aaaaactgtaattacttttgca

SEQ ID NO: 7937166 - DNA, 22 bp, Homo sapiens
aaaaactggtaactattcccca

SEQ ID NO: 7937167 - DNA, 22 bp, Homo sapiens
aaaaactgtaattacttttgca

SEQ ID NO: 7937168 - DNA, 21 bp, Homo sapiens
aaaaatgaagttgttcaggaa

SEQ ID NO: 7937169 - DNA, 21 bp, Homo sapiens
aaaaatgaagttgttcaggaa

SEQ ID NO: 7937170 - DNA, 21 bp, Homo sapiens
aaaaatgaagttgttcaggaa

SEQ ID NO: 7937171 - DNA, 21 bp, Homo sapiens
aaaaatgaagttgttcaggaa

SEQ ID NO: 7937172 - DNA, 22 bp, Homo sapiens
aaaaatgaattcttcagtggca

SEQ ID NO: 7937173 - DNA, 21 bp, Homo sapiens
aaaaatgaagttgttcaggaa

SEQ ID NO: 7937174 - DNA, 22 bp, Homo sapiens
aaaaatgaattcttcagtggca

SEQ ID NO: 7937175 - DNA, 22 bp, Homo sapiens
aaaaagatagcattgtgctcct

SEQ ID NO: 7937176 - DNA, 22 bp, Homo sapiens
aaaaagatagcattgtgctcct

SEQ ID NO: 7937177 - DNA, 19 bp, Homo sapiens
aaaaagaggctataatatt

SEQ ID NO: 7937178 - DNA, 19 bp, Homo sapiens
aaaaagaggctataatatt

SEQ ID NO: 7937179 - DNA, 22 bp, Homo sapiens
aaaaagagaaatgctctagtcc

SEQ ID NO: 7937180 - DNA, 22 bp, Homo sapiens
aaaaagatgtcctgaagtttag

SEQ ID NO: 7937181 - DNA, 22 bp, Homo sapiens
aaaaagatgtcctgaagtttag

SEQ ID NO: 7937182 - DNA, 22 bp, Homo sapiens
aaaaagatagcattgtgctcct

SEQ ID NO: 7937183 - DNA, 22 bp, Homo sapiens
aaaaagatagcattgtgctcct

SEQ ID NO: 7937184 - DNA, 22 bp, Homo sapiens
aaaaagatagcattgtgctcct

SEQ ID NO: 7937185 - DNA, 22 bp, Homo sapiens
aaaaagatagcattgtgctcct

SEQ ID NO: 7937186 - DNA, 22 bp, Homo sapiens
aaaaatgcttggacttaataaa

SEQ ID NO: 7937187 - DNA, 22 bp, Homo sapiens
aaaaatgcttggacttaataaa

SEQ ID NO: 7937188 - DNA, 22 bp, Homo sapiens
aaaaatgcttggacttaataaa

SEQ ID NO: 7937189 - DNA, 22 bp, Homo sapiens
aaaaatgcttggacttaataaa

SEQ ID NO: 7937190 - DNA, 22 bp, Homo sapiens
aaaaatgcttggacttaataaa

SEQ ID NO: 7937191 - DNA, 22 bp, Homo sapiens
aaaaatgtcattatggaactga

SEQ ID NO: 7937192 - DNA, 22 bp, Homo sapiens
aaaaatgctgtggtagctgtgt

SEQ ID NO: 7937193 - DNA, 22 bp, Homo sapiens
aaaaatgctgtggtagctgtgt

SEQ ID NO: 7937194 - DNA, 22 bp, Homo sapiens
aaaaatgaattcttcagtggca

SEQ ID NO: 7937195 - DNA, 22 bp, Homo sapiens
aaaaatgaattcttcagtggca

SEQ ID NO: 7937196 - DNA, 22 bp, Homo sapiens
aaaaatgcttggacttaataaa

SEQ ID NO: 7937197 - DNA, 22 bp, Homo sapiens
aaaaatgcttggacttaataaa

SEQ ID NO: 7937198 - DNA, 22 bp, Homo sapiens
aaaaatgtcattatggaactga

SEQ ID NO: 7937199 - DNA, 22 bp, Homo sapiens
aaaaatgtcattatggaactga

SEQ ID NO: 7937200 - DNA, 22 bp, Homo sapiens
aaaaatgtcattatggaactga

SEQ ID NO: 7937201 - DNA, 22 bp, Homo sapiens
aaaaatgtcattatggaactga

SEQ ID NO: 7937202 - DNA, 22 bp, Homo sapiens
aaaaatgtcattatggaactga

SEQ ID NO: 7937203 - DNA, 22 bp, Homo sapiens
aaaaatgtcattatggaactga

SEQ ID NO: 7937204 - DNA, 22 bp, Homo sapiens
aaaaatgtcattatggaactga

SEQ ID NO: 7937205 - DNA, 22 bp, Homo sapiens
aaaaatgtgaccacagggtgtt

SEQ ID NO: 7937206 - DNA, 22 bp, Homo sapiens
aaaaatgtgaccacagggtgtt

SEQ ID NO: 7937207 - DNA, 22 bp, Homo sapiens
aaaaatgtgaccacagggtgtt

SEQ ID NO: 7937208 - DNA, 22 bp, Homo sapiens
aaaaggcttggaacctttccct

SEQ ID NO: 7937209 - DNA, 22 bp, Homo sapiens
aaaagtattttgagcactttat

SEQ ID NO: 7937210 - DNA, 22 bp, Homo sapiens
aaaagggactactctcagctcc

SEQ ID NO: 7937211 - DNA, 22 bp, Homo sapiens
aaaagtattttggatctcagat

SEQ ID NO: 7937212 - DNA, 22 bp, Homo sapiens
aaaagtattttggatctcagat

SEQ ID NO: 7937213 - DNA, 22 bp, Homo sapiens
aaaagtattttggatctcagat

SEQ ID NO: 7937214 - DNA, 22 bp, Homo sapiens
aaaagtattttggatctcagat

SEQ ID NO: 7937215 - DNA, 22 bp, Homo sapiens
aaaagtattttggatctcagat

SEQ ID NO: 7937216 - DNA, 22 bp, Homo sapiens
aaaagtattttggatctcagat

SEQ ID NO: 7937217 - DNA, 22 bp, Homo sapiens
aaaagtattttggatctcagat

SEQ ID NO: 7937218 - DNA, 22 bp, Homo sapiens
aaaagtcagtctctcctagctc

SEQ ID NO: 7937219 - DNA, 22 bp, Homo sapiens
aaaagtcagtctctcctagctc

SEQ ID NO: 7937220 - DNA, 22 bp, Homo sapiens
aaaagtctgctctcatttcaga

SEQ ID NO: 7937221 - DNA, 22 bp, Homo sapiens
aaaagtctgctctcatttcaga

SEQ ID NO: 7937222 - DNA, 22 bp, Homo sapiens
aaaagtctctctgagtaaaagt

SEQ ID NO: 7937223 - DNA, 22 bp, Homo sapiens
aaaagtctctctgagtaaaagt

SEQ ID NO: 7937224 - DNA, 19 bp, Homo sapiens
aaaagtctattcaattaca

SEQ ID NO: 7937225 - DNA, 19 bp, Homo sapiens
aaaagtctattcaattaca

SEQ ID NO: 7937226 - DNA, 22 bp, Homo sapiens
aaaagtctctctgagtaaaagt

SEQ ID NO: 7937227 - DNA, 19 bp, Homo sapiens
aaaagtctattcaattaca

SEQ ID NO: 7937228 - DNA, 22 bp, Homo sapiens
aaacaagagcttacatggctgc

SEQ ID NO: 7937229 - DNA, 22 bp, Homo sapiens
aaacacaagatggcctcttctg

SEQ ID NO: 7937230 - DNA, 22 bp, Homo sapiens
aaacaagagcttacatggctgc

SEQ ID NO: 7937231 - DNA, 22 bp, Homo sapiens
aaacaactcggcaactgctttt

SEQ ID NO: 7937232 - DNA, 22 bp, Homo sapiens
aaacaagagcttacatggctgc

SEQ ID NO: 7937233 - DNA, 22 bp, Homo sapiens
aaacaacttctgcactatgggt

SEQ ID NO: 7937234 - DNA, 22 bp, Homo sapiens
aaacaacttctgcactatgggt

SEQ ID NO: 7937235 - DNA, 22 bp, Homo sapiens
aaacaactcggcaactgctttt

SEQ ID NO: 7937236 - DNA, 22 bp, Homo sapiens
aaacaactcggcaactgctttt

SEQ ID NO: 7937237 - DNA, 22 bp, Homo sapiens
aaacaactcggcaactgctttt

SEQ ID NO: 7937238 - DNA, 22 bp, Homo sapiens
aaacaactcggcaactgctttt

SEQ ID NO: 7937239 - DNA, 22 bp, Homo sapiens
aaacacacagaaatgaatgagg

SEQ ID NO: 7937240 - DNA, 22 bp, Homo sapiens
aaacacacagaaatgaatgagg

SEQ ID NO: 7937241 - DNA, 22 bp, Homo sapiens
aaacacacagaaatgaatgagg

SEQ ID NO: 7937242 - DNA, 22 bp, Homo sapiens
aaacacacagaaatgaatgagg

SEQ ID NO: 7937243 - DNA, 22 bp, Homo sapiens
aaacacaatgtttctttgttct

SEQ ID NO: 7937244 - DNA, 22 bp, Homo sapiens
aaacacaatgtttctttgttct

SEQ ID NO: 7937245 - DNA, 22 bp, Homo sapiens
aaacacaatgtttctttgttct

SEQ ID NO: 7937246 - DNA, 22 bp, Homo sapiens
aaacacacctttggaactgtga

SEQ ID NO: 7937247 - DNA, 22 bp, Homo sapiens
aaacaaagcatcttgctatgca

SEQ ID NO: 7937248 - DNA, 22 bp, Homo sapiens
aaacaaagcatcttgctatgca

SEQ ID NO: 7937249 - DNA, 22 bp, Homo sapiens
aaacaaacataggtttgaaagt

SEQ ID NO: 7937250 - DNA, 22 bp, Homo sapiens
aaacaaagccagggaagttatg

SEQ ID NO: 7937251 - DNA, 22 bp, Homo sapiens
aaacaaagcatcttgctatgca

SEQ ID NO: 7937252 - DNA, 22 bp, Homo sapiens
aaacaaacaattagttgtgtgg

SEQ ID NO: 7937253 - DNA, 22 bp, Homo sapiens
aaacaaacataggtttgaaagt

SEQ ID NO: 7937254 - DNA, 22 bp, Homo sapiens
aaacaaacataggtttgaaagt

SEQ ID NO: 7937255 - DNA, 22 bp, Homo sapiens
aaacaaacataggtttgaaagt

SEQ ID NO: 7937256 - DNA, 22 bp, Homo sapiens
aaacaaacataggtttgaaagt

SEQ ID NO: 7937257 - DNA, 22 bp, Homo sapiens
aaacaaacataggtttgaaagt

SEQ ID NO: 7937258 - DNA, 22 bp, Homo sapiens
aaacaaatagtgcatgggaatt

SEQ ID NO: 7937259 - DNA, 22 bp, Homo sapiens
aaacaaatagtgcatgggaatt

SEQ ID NO: 7937260 - DNA, 22 bp, Homo sapiens
aaacaaatagtgcatgggaatt

SEQ ID NO: 7937261 - DNA, 22 bp, Homo sapiens
aaacaaatagtgcatgggaatt

SEQ ID NO: 7937262 - DNA, 22 bp, Homo sapiens
aaacaaagccagggaagttatg

SEQ ID NO: 7937263 - DNA, 22 bp, Homo sapiens
aaacaaagccagggaagttatg

SEQ ID NO: 7937264 - DNA, 22 bp, Homo sapiens
aaacaaagccagggaagttatg

SEQ ID NO: 7937265 - DNA, 22 bp, Homo sapiens
aaacaaagccagggaagttatg

SEQ ID NO: 7937266 - DNA, 22 bp, Homo sapiens
aaacaaatttcaagctgtgaca

SEQ ID NO: 7937267 - DNA, 22 bp, Homo sapiens
aaacaaatttcaagctgtgaca

SEQ ID NO: 7937268 - DNA, 22 bp, Homo sapiens
aaacaaatttcaagctgtgaca

SEQ ID NO: 7937269 - DNA, 22 bp, Homo sapiens
aaacaaatttcaagctgtgaca

SEQ ID NO: 7937270 - DNA, 22 bp, Homo sapiens
aaacaaatttcaagctgtgaca

SEQ ID NO: 7937271 - DNA, 22 bp, Homo sapiens
aaacaaatttcaagctgtgaca

SEQ ID NO: 7937272 - DNA, 22 bp, Homo sapiens
aaacaaatttcaagctgtgaca

SEQ ID NO: 7937273 - DNA, 22 bp, Homo sapiens
aaacaaatttcaagctgtgaca

SEQ ID NO: 7937274 - DNA, 22 bp, Homo sapiens
aaacaaatttcaagctgtgaca

SEQ ID NO: 7937275 - DNA, 22 bp, Homo sapiens
aaacaacaatccaatgggagct

SEQ ID NO: 7937276 - DNA, 22 bp, Homo sapiens
aaaagtctgctttctattatca

SEQ ID NO: 7937277 - DNA, 22 bp, Homo sapiens
aaaagtctgctttctattatca

SEQ ID NO: 7937278 - DNA, 22 bp, Homo sapiens
aaaagtcttggggaaggccagg

SEQ ID NO: 7937279 - DNA, 22 bp, Homo sapiens
aaaagtcttggggaaggccagg

SEQ ID NO: 7937280 - DNA, 22 bp, Homo sapiens
aaaagtcttgtcaaggttccca

SEQ ID NO: 7937281 - DNA, 22 bp, Homo sapiens
aaaagtgaggcagcccaaggga

SEQ ID NO: 7937282 - DNA, 22 bp, Homo sapiens
aaaagtgatgggatggcacttc

SEQ ID NO: 7937283 - DNA, 22 bp, Homo sapiens
aaaagtgtccagattatgaaga

SEQ ID NO: 7937284 - DNA, 22 bp, Homo sapiens
aaaagtgatgggatggcacttc

SEQ ID NO: 7937285 - DNA, 22 bp, Homo sapiens
aaaagtgatgggatggcacttc

SEQ ID NO: 7937286 - DNA, 22 bp, Homo sapiens
aaaagtgtccagattatgaaga

SEQ ID NO: 7937287 - DNA, 22 bp, Homo sapiens
aaaagtgtccagattatgaaga

SEQ ID NO: 7937288 - DNA, 22 bp, Homo sapiens
aaaatagataatgccagggtca

SEQ ID NO: 7937289 - DNA, 22 bp, Homo sapiens
aaaagtgtccagattatgaaga

SEQ ID NO: 7937290 - DNA, 22 bp, Homo sapiens
aaaatagatgaaaggaagtctg

SEQ ID NO: 7937291 - DNA, 22 bp, Homo sapiens
aaaatagatgaaaggaagtctg

SEQ ID NO: 7937292 - DNA, 22 bp, Homo sapiens
aaaatagataatgccagggtca

SEQ ID NO: 7937293 - DNA, 22 bp, Homo sapiens
aaaatagatgaaaggaagtctg

SEQ ID NO: 7937294 - DNA, 22 bp, Homo sapiens
aaaatagatgaaaggaagtctg

SEQ ID NO: 7937295 - DNA, 22 bp, Homo sapiens
aaaatagatgaaaggaagtctg

SEQ ID NO: 7937296 - DNA, 22 bp, Homo sapiens
aaaatagatgaaaggaagtctg

SEQ ID NO: 7937297 - DNA, 22 bp, Homo sapiens
aaaatagattctaggatgtctt

SEQ ID NO: 7937298 - DNA, 22 bp, Homo sapiens
aaaatagattctaggatgtctt

SEQ ID NO: 7937299 - DNA, 22 bp, Homo sapiens
aaaatagattctaggatgtctt

SEQ ID NO: 7937300 - DNA, 22 bp, Homo sapiens
aaaatagattctaggatgtctt

SEQ ID NO: 7937301 - DNA, 22 bp, Homo sapiens
aaaatagattctaggatgtctt

SEQ ID NO: 7937302 - DNA, 22 bp, Homo sapiens
aaaatagattctaggatgtctt

SEQ ID NO: 7937303 - DNA, 22 bp, Homo sapiens
aaaatagattctaggatgtctt

SEQ ID NO: 7937304 - DNA, 22 bp, Homo sapiens
aaaatagcatgaaaggcctttg

SEQ ID NO: 7937305 - DNA, 20 bp, Homo sapiens
aaaatagccccaggctcatt

SEQ ID NO: 7937306 - DNA, 22 bp, Homo sapiens
aaaatagcatgaaaggcctttg

SEQ ID NO: 7937307 - DNA, 22 bp, Homo sapiens
aaaatagcagggatgtgggaaa

SEQ ID NO: 7937308 - DNA, 22 bp, Homo sapiens
aaaatagcaatcagggactctc

SEQ ID NO: 7937309 - DNA, 22 bp, Homo sapiens
aaaatagattctaggatgtctt

SEQ ID NO: 7937310 - DNA, 22 bp, Homo sapiens
aaaatagcatattgctttcttt

SEQ ID NO: 7937311 - DNA, 22 bp, Homo sapiens
aaaatagcatattgctttcttt

SEQ ID NO: 7937312 - DNA, 22 bp, Homo sapiens
aaaatagcatattgctttcttt

SEQ ID NO: 7937313 - DNA, 20 bp, Homo sapiens
aaaatagccccaggctcatt

SEQ ID NO: 7937314 - DNA, 22 bp, Homo sapiens
aaaatagcctcacataattgct

SEQ ID NO: 7937315 - DNA, 22 bp, Homo sapiens
aaaatagcctcacataattgct

SEQ ID NO: 7937316 - DNA, 22 bp, Homo sapiens
aaaatagcctcacataattgct

SEQ ID NO: 7937317 - DNA, 22 bp, Homo sapiens
aaaatagcctcacataattgct

SEQ ID NO: 7937318 - DNA, 22 bp, Homo sapiens
aaaatagctatggaatgtcact

SEQ ID NO: 7937319 - DNA, 22 bp, Homo sapiens
aaaatagctatggaatgtcact

SEQ ID NO: 7937320 - DNA, 22 bp, Homo sapiens
aaaatagctatggaatgtcact

SEQ ID NO: 7937321 - DNA, 22 bp, Homo sapiens
aaaatagctatggaatgtcact

SEQ ID NO: 7937322 - DNA, 22 bp, Homo sapiens
aaaatagcctcacataattgct

SEQ ID NO: 7937323 - DNA, 22 bp, Homo sapiens
aaaatagcctcacataattgct

SEQ ID NO: 7937324 - DNA, 22 bp, Homo sapiens
aaaatagcctcacataattgct

SEQ ID NO: 7937325 - DNA, 22 bp, Homo sapiens
aaaatagctatggaatgtcact

SEQ ID NO: 7937326 - DNA, 22 bp, Homo sapiens
aaaatagctatggaatgtcact

SEQ ID NO: 7937327 - DNA, 22 bp, Homo sapiens
aaaataggtacggattagaatg

SEQ ID NO: 7937328 - DNA, 22 bp, Homo sapiens
aaaattcatggcttgggaaaag

SEQ ID NO: 7937329 - DNA, 22 bp, Homo sapiens
aaaattcattcctcagactgcc

SEQ ID NO: 7937330 - DNA, 22 bp, Homo sapiens
aaaattcattcctcagactgcc

SEQ ID NO: 7937331 - DNA, 22 bp, Homo sapiens
aaaattcattcctcagactgcc

SEQ ID NO: 7937332 - DNA, 22 bp, Homo sapiens
aaacttgtgagctaaataaatg

SEQ ID NO: 7937333 - DNA, 22 bp, Homo sapiens
aaacttgggtgaccctgagcaa

SEQ ID NO: 7937334 - DNA, 22 bp, Homo sapiens
aaactttaaatttgtacctctg

SEQ ID NO: 7937335 - DNA, 20 bp, Homo sapiens
aaacttgttggtggatgagg

SEQ ID NO: 7937336 - DNA, 22 bp, Homo sapiens
aaagaactacctgtatgatatt

SEQ ID NO: 7937337 - DNA, 22 bp, Homo sapiens
aaagaactacctgtatgatatt

SEQ ID NO: 7937338 - DNA, 22 bp, Homo sapiens
aaactttaggaaggaatttaca

SEQ ID NO: 7937339 - DNA, 22 bp, Homo sapiens
aaagaacttatcctagaatttg

SEQ ID NO: 7937340 - DNA, 22 bp, Homo sapiens
aaagaacttaagaaattaggct

SEQ ID NO: 7937341 - DNA, 22 bp, Homo sapiens
aaagaacttaagaaattaggct

SEQ ID NO: 7937342 - DNA, 22 bp, Homo sapiens
aaagaactcagagaggatttta

SEQ ID NO: 7937343 - DNA, 22 bp, Homo sapiens
aaacttgacagtagacagatta

SEQ ID NO: 7937344 - DNA, 22 bp, Homo sapiens
aaacttgacagtgagacagttt

SEQ ID NO: 7937345 - DNA, 22 bp, Homo sapiens
aaacttgagccaagggcttggg

SEQ ID NO: 7937346 - DNA, 22 bp, Homo sapiens
aaacttctggctacaagcaata

SEQ ID NO: 7937347 - DNA, 20 bp, Homo sapiens
aaacttgatggcatagaata

SEQ ID NO: 7937348 - DNA, 20 bp, Homo sapiens
aaacttgatggcatagaata

SEQ ID NO: 7937349 - DNA, 22 bp, Homo sapiens
aaacttgaggcaatgaaggtgt

SEQ ID NO: 7937350 - DNA, 22 bp, Homo sapiens
aaacttgatctgtgaccttgct

SEQ ID NO: 7937351 - DNA, 23 bp, Homo sapiens
aaacttgctatggctgaaatcat

SEQ ID NO: 7937352 - DNA, 23 bp, Homo sapiens
aaacttgctatggctgaaatcat

SEQ ID NO: 7937353 - DNA, 23 bp, Homo sapiens
aaacttgctatggctgaaatcat

SEQ ID NO: 7937354 - DNA, 23 bp, Homo sapiens
aaacttgctatggctgaaatcat

SEQ ID NO: 7937355 - DNA, 23 bp, Homo sapiens
aaacttgctatggctgaaatcat

SEQ ID NO: 7937356 - DNA, 23 bp, Homo sapiens
aaacttgctatggctgaaatcat

SEQ ID NO: 7937357 - DNA, 23 bp, Homo sapiens
aaacttgctatggctgaaatcat

SEQ ID NO: 7937358 - DNA, 22 bp, Homo sapiens
aaagagctttagaaatctcaga

SEQ ID NO: 7937359 - DNA, 22 bp, Homo sapiens
aaagagctttagaaatctcaga

SEQ ID NO: 7937360 - DNA, 22 bp, Homo sapiens
aaagagctttccacactagtca

SEQ ID NO: 7937361 - DNA, 22 bp, Homo sapiens
aaagagctttagaaatctcaga

SEQ ID NO: 7937362 - DNA, 22 bp, Homo sapiens
aaagagctttagaaatctcaga

SEQ ID NO: 7937363 - DNA, 22 bp, Homo sapiens
aaagatctatgggcatttagct

SEQ ID NO: 7937364 - DNA, 22 bp, Homo sapiens
aaagagctttccacactagtca

SEQ ID NO: 7937365 - DNA, 22 bp, Homo sapiens
aaagatctatgggcatttagct

SEQ ID NO: 7937366 - DNA, 22 bp, Homo sapiens
aaagatcattctctggtccaga

SEQ ID NO: 7937367 - DNA, 22 bp, Homo sapiens
aaagatcattctctggtccaga

SEQ ID NO: 7937368 - DNA, 22 bp, Homo sapiens
aaagatcattctctggtccaga

SEQ ID NO: 7937369 - DNA, 22 bp, Homo sapiens
aaagatctccccttcaaagagt

SEQ ID NO: 7937370 - DNA, 22 bp, Homo sapiens
aaagatctccccttcaaagagt

SEQ ID NO: 7937371 - DNA, 22 bp, Homo sapiens
aaagatctccccttcaaagagt

SEQ ID NO: 7937372 - DNA, 22 bp, Homo sapiens
aaagatctccccttcaaagagt

SEQ ID NO: 7937373 - DNA, 22 bp, Homo sapiens
aaagatctgacttagacacaga

SEQ ID NO: 7937374 - DNA, 22 bp, Homo sapiens
aaagatctgacttagacacaga

SEQ ID NO: 7937375 - DNA, 22 bp, Homo sapiens
aaagatctgtgttaactcaagg

SEQ ID NO: 7937376 - DNA, 19 bp, Homo sapiens
aaagatctgggattgagac

SEQ ID NO: 7937377 - DNA, 22 bp, Homo sapiens
aaagatggcccatgatctcttg

SEQ ID NO: 7937378 - DNA, 22 bp, Homo sapiens
aaagatgatctacaagttcatt

SEQ ID NO: 7937379 - DNA, 22 bp, Homo sapiens
aaagatgatctacaagttcatt

SEQ ID NO: 7937380 - DNA, 22 bp, Homo sapiens
aaagatgtcacaagatgtgatg

SEQ ID NO: 7937381 - DNA, 22 bp, Homo sapiens
aaagatgtcagtcagataggat

SEQ ID NO: 7937382 - DNA, 22 bp, Homo sapiens
aaagatgtcacaagatgtgatg

SEQ ID NO: 7937383 - DNA, 22 bp, Homo sapiens
aaagatgtcacaagatgtgatg

SEQ ID NO: 7937384 - DNA, 22 bp, Homo sapiens
aaagatgagtccggcagacata

SEQ ID NO: 7937385 - DNA, 22 bp, Homo sapiens
aaagatgagtccggcagacata

SEQ ID NO: 7937386 - DNA, 22 bp, Homo sapiens
aaagatgagtccggcagacata

SEQ ID NO: 7937387 - DNA, 22 bp, Homo sapiens
aaagatgatctacaagttcatt

SEQ ID NO: 7937388 - DNA, 22 bp, Homo sapiens
aaagatgaccgtatgtcagagc

SEQ ID NO: 7937389 - DNA, 22 bp, Homo sapiens
aaagatctgtgttaactcaagg

SEQ ID NO: 7937390 - DNA, 22 bp, Homo sapiens
aaagatgaccgtatgtcagagc

SEQ ID NO: 7937391 - DNA, 21 bp, Homo sapiens
aaagatgagaactggatggct

SEQ ID NO: 7937392 - DNA, 22 bp, Homo sapiens
aaagatgagtccggcagacata

SEQ ID NO: 7937393 - DNA, 22 bp, Homo sapiens
aaagatgagtccggcagacata

SEQ ID NO: 7937394 - DNA, 22 bp, Homo sapiens
aaagaagatggagacctgacta

SEQ ID NO: 7937395 - DNA, 22 bp, Homo sapiens
aaagaagatggagacctgacta

SEQ ID NO: 7937396 - DNA, 22 bp, Homo sapiens
aaagaagcataggctagacttc

SEQ ID NO: 7937397 - DNA, 22 bp, Homo sapiens
aaagaagatggagacctgacta

SEQ ID NO: 7937398 - DNA, 22 bp, Homo sapiens
aaagaagatggagacctgacta

SEQ ID NO: 7937399 - DNA, 22 bp, Homo sapiens
aaagaagagctggaaggagtct

SEQ ID NO: 7937400 - DNA, 22 bp, Homo sapiens
aaagaagagctggaaggagtct

SEQ ID NO: 7937401 - DNA, 22 bp, Homo sapiens
aaagaagagctggaaggagtct

SEQ ID NO: 7937402 - DNA, 22 bp, Homo sapiens
aaagaagagctggaaggagtct

SEQ ID NO: 7937403 - DNA, 22 bp, Homo sapiens
aaagaagagctggaaggagtct

SEQ ID NO: 7937404 - DNA, 22 bp, Homo sapiens
aaagaagacagacatttctttc

SEQ ID NO: 7937405 - DNA, 22 bp, Homo sapiens
aaagaaggacctggaggaggat

SEQ ID NO: 7937406 - DNA, 22 bp, Homo sapiens
aaagaagcataggctagacttc

SEQ ID NO: 7937407 - DNA, 22 bp, Homo sapiens
aaagaagcataggctagacttc

SEQ ID NO: 7937408 - DNA, 22 bp, Homo sapiens
aaagaagctgtggctctgggag

SEQ ID NO: 7937409 - DNA, 22 bp, Homo sapiens
aaagaaggatgggagaaatcct

SEQ ID NO: 7937410 - DNA, 22 bp, Homo sapiens
aaagaaggatgggagaaatcct

SEQ ID NO: 7937411 - DNA, 22 bp, Homo sapiens
aaagaaggatgggagaaatcct

SEQ ID NO: 7937412 - DNA, 22 bp, Homo sapiens
aaagaaggatgggagaaatcct

SEQ ID NO: 7937413 - DNA, 22 bp, Homo sapiens
aaagaaggacctggaggaggat

SEQ ID NO: 7937414 - DNA, 22 bp, Homo sapiens
aaagaaggacctggaggaggat

SEQ ID NO: 7937415 - DNA, 22 bp, Homo sapiens
aaagaaggatgggagaaatcct

SEQ ID NO: 7937416 - DNA, 18 bp, Homo sapiens
aaagaaggattggagagc

SEQ ID NO: 7937417 - DNA, 18 bp, Homo sapiens
aaagaaggattggagagc

SEQ ID NO: 7937418 - DNA, 18 bp, Homo sapiens
aaagaaggattggagagc

SEQ ID NO: 7937419 - DNA, 17 bp, Homo sapiens
aaagagcttggagtgtt

SEQ ID NO: 7937420 - DNA, 22 bp, Homo sapiens
aaaccacttatatcgtgatttg

SEQ ID NO: 7937421 - DNA, 22 bp, Homo sapiens
aaaccactcctgattcacttca

SEQ ID NO: 7937422 - DNA, 22 bp, Homo sapiens
aaaccacagttcagtgcttttg

SEQ ID NO: 7937423 - DNA, 22 bp, Homo sapiens
aaaccacagttcagtgcttttg

SEQ ID NO: 7937424 - DNA, 22 bp, Homo sapiens
aaaccacacttagcagtttcgt

SEQ ID NO: 7937425 - DNA, 22 bp, Homo sapiens
aaaccaaccctggctggcctag

SEQ ID NO: 7937426 - DNA, 22 bp, Homo sapiens
aaaccaaccctggctggcctag

SEQ ID NO: 7937427 - DNA, 22 bp, Homo sapiens
aaaccacacttagcagtttcgt

SEQ ID NO: 7937428 - DNA, 22 bp, Homo sapiens
aaacatttttcttcatcatcct

SEQ ID NO: 7937429 - DNA, 22 bp, Homo sapiens
aaaccaaacatttgcggtggtg

SEQ ID NO: 7937430 - DNA, 22 bp, Homo sapiens
aaaccaaacatttgcggtggtg

SEQ ID NO: 7937431 - DNA, 22 bp, Homo sapiens
aaaccaaccctggctggcctag

SEQ ID NO: 7937432 - DNA, 22 bp, Homo sapiens
aaaccatggctcattggagatg

SEQ ID NO: 7937433 - DNA, 22 bp, Homo sapiens
aaaccattaggttttatctact

SEQ ID NO: 7937434 - DNA, 22 bp, Homo sapiens
aaaccatggagtaagttcacat

SEQ ID NO: 7937435 - DNA, 22 bp, Homo sapiens
aaaccatgctttgatgatttta

SEQ ID NO: 7937436 - DNA, 22 bp, Homo sapiens
aaaccatcagataattcatact

SEQ ID NO: 7937437 - DNA, 22 bp, Homo sapiens
aaaccatcagataattcatact

SEQ ID NO: 7937438 - DNA, 22 bp, Homo sapiens
aaaccagtgatagactagacac

SEQ ID NO: 7937439 - DNA, 22 bp, Homo sapiens
aaaccagtgatagactagacac

SEQ ID NO: 7937440 - DNA, 22 bp, Homo sapiens
aaactggtgtcactgagggctg

SEQ ID NO: 7937441 - DNA, 22 bp, Homo sapiens
aaactggtgtcactgagggctg

SEQ ID NO: 7937442 - DNA, 22 bp, Homo sapiens
aaactggtttctgagatggaac

SEQ ID NO: 7937443 - DNA, 22 bp, Homo sapiens
aaactgtaaacacagcagtaca

SEQ ID NO: 7937444 - DNA, 22 bp, Homo sapiens
aaaccatttgaattattactga

SEQ ID NO: 7937445 - DNA, 22 bp, Homo sapiens
aaaccattgcatctttcttaat

SEQ ID NO: 7937446 - DNA, 22 bp, Homo sapiens
aaaccatttgaattattactga

SEQ ID NO: 7937447 - DNA, 22 bp, Homo sapiens
aaaccattgcatctttcttaat

SEQ ID NO: 7937448 - DNA, 22 bp, Homo sapiens
aaaccattaggttttatctact

SEQ ID NO: 7937449 - DNA, 22 bp, Homo sapiens
aaacatttttcttcatcatcct

SEQ ID NO: 7937450 - DNA, 22 bp, Homo sapiens
aaacatttttcttcatcatcct

SEQ ID NO: 7937451 - DNA, 22 bp, Homo sapiens
aaacatttttctaggtcttggt

SEQ ID NO: 7937452 - DNA, 22 bp, Homo sapiens
aaacatttttctaggtcttggt

SEQ ID NO: 7937453 - DNA, 22 bp, Homo sapiens
aaacatttttctaggtcttggt

SEQ ID NO: 7937454 - DNA, 22 bp, Homo sapiens
aaacatttgcaactcggtttgg

SEQ ID NO: 7937455 - DNA, 22 bp, Homo sapiens
aaacatttgcaactcggtttgg

SEQ ID NO: 7937456 - DNA, 23 bp, Homo sapiens
aaacatttctcttttcctgcctc

SEQ ID NO: 7937457 - DNA, 22 bp, Homo sapiens
aaacatttgcaactcggtttgg

SEQ ID NO: 7937458 - DNA, 23 bp, Homo sapiens
aaacatttctcttttcctgcctc

SEQ ID NO: 7937459 - DNA, 23 bp, Homo sapiens
aaacatttctcttttcctgcctc

SEQ ID NO: 7937460 - DNA, 23 bp, Homo sapiens
aaacatttctcttttcctgcctc

SEQ ID NO: 7937461 - DNA, 22 bp, Homo sapiens
aaacatgagcatctcttcaagc

SEQ ID NO: 7937462 - DNA, 22 bp, Homo sapiens
aaacatgagcatctcttcaagc

SEQ ID NO: 7937463 - DNA, 22 bp, Homo sapiens
aaacatgagcatctcttcaagc

SEQ ID NO: 7937464 - DNA, 22 bp, Homo sapiens
aaacatgagttaaaagtaactg

SEQ ID NO: 7937465 - DNA, 22 bp, Homo sapiens
aaacatgagttaaaagtaactg

SEQ ID NO: 7937466 - DNA, 22 bp, Homo sapiens
aaacatgagttaaaagtaactg

SEQ ID NO: 7937467 - DNA, 22 bp, Homo sapiens
aaacatgatgcctgtactaaga

SEQ ID NO: 7937468 - DNA, 22 bp, Homo sapiens
aaacattgttatgataaattac

SEQ ID NO: 7937469 - DNA, 22 bp, Homo sapiens
aaacattgttatgataaattac

SEQ ID NO: 7937470 - DNA, 22 bp, Homo sapiens
aaacatctgacttgctttttca

SEQ ID NO: 7937471 - DNA, 22 bp, Homo sapiens
aaacatctgacttgctttttca

SEQ ID NO: 7937472 - DNA, 22 bp, Homo sapiens
aaacatctgacttgctttttca

SEQ ID NO: 7937473 - DNA, 22 bp, Homo sapiens
aaacagtcttgtgggcttggag

SEQ ID NO: 7937474 - DNA, 22 bp, Homo sapiens
aaacagtctgatgccatctgcc

SEQ ID NO: 7937475 - DNA, 22 bp, Homo sapiens
aaacagtcgtcttaatagtatt

SEQ ID NO: 7937476 - DNA, 22 bp, Homo sapiens
aaacagtctgatgccatctgcc

SEQ ID NO: 7937477 - DNA, 22 bp, Homo sapiens
aaacacagggatatatattcca

SEQ ID NO: 7937478 - DNA, 22 bp, Homo sapiens
aaacacagggatatatattcca

SEQ ID NO: 7937479 - DNA, 22 bp, Homo sapiens
aaacacagggatatatattcca

SEQ ID NO: 7937480 - DNA, 22 bp, Homo sapiens
aaacagtcctctttatttagtc

SEQ ID NO: 7937481 - DNA, 22 bp, Homo sapiens
aaacagtcctctttatttagtc

SEQ ID NO: 7937482 - DNA, 22 bp, Homo sapiens
aaacacaggtactgcagaagtg

SEQ ID NO: 7937483 - DNA, 20 bp, Homo sapiens
aaacacagcctctctttaca

SEQ ID NO: 7937484 - DNA, 20 bp, Homo sapiens
aaacacagcctctctttaca

SEQ ID NO: 7937485 - DNA, 20 bp, Homo sapiens
aaacacagcctctctttaca

SEQ ID NO: 7937486 - DNA, 20 bp, Homo sapiens
aaacacagcctctctttaca

SEQ ID NO: 7937487 - DNA, 22 bp, Homo sapiens
aaacacagatttctttgtccca

SEQ ID NO: 7937488 - DNA, 22 bp, Homo sapiens
aaacacagggatatatattcca

SEQ ID NO: 7937489 - DNA, 22 bp, Homo sapiens
aaacacagatttctttgtccca

SEQ ID NO: 7937490 - DNA, 19 bp, Homo sapiens
aaacacagatttcttacca

SEQ ID NO: 7937491 - DNA, 22 bp, Homo sapiens
aaacacagatttctttgtccca

SEQ ID NO: 7937492 - DNA, 22 bp, Homo sapiens
aaacacagatttctttgtccca

SEQ ID NO: 7937493 - DNA, 19 bp, Homo sapiens
aaacacagatttcttacca

SEQ ID NO: 7937494 - DNA, 19 bp, Homo sapiens
aaacacagatttcttacca

SEQ ID NO: 7937495 - DNA, 19 bp, Homo sapiens
aaacacagatttcttacca

SEQ ID NO: 7937496 - DNA, 22 bp, Homo sapiens
aaacatgagcatctcttcaagc

SEQ ID NO: 7937497 - DNA, 22 bp, Homo sapiens
aaacatgagcacttgcttcata

SEQ ID NO: 7937498 - DNA, 22 bp, Homo sapiens
aaacatgagcacttgcttcata

SEQ ID NO: 7937499 - DNA, 22 bp, Homo sapiens
aaacatgaatagatattaaaca

SEQ ID NO: 7937500 - DNA, 22 bp, Homo sapiens
aaacatgaatagatattaaaca

SEQ ID NO: 7937501 - DNA, 22 bp, Homo sapiens
aaacatgaatagatattaaaca

SEQ ID NO: 7937502 - DNA, 22 bp, Homo sapiens
aaacatgaatagatattaaaca

SEQ ID NO: 7937503 - DNA, 22 bp, Homo sapiens
aaacatgaatagatattaaaca

SEQ ID NO: 7937504 - DNA, 22 bp, Homo sapiens
aaacatcttgctctgattggta

SEQ ID NO: 7937505 - DNA, 22 bp, Homo sapiens
aaacatcttgctctgattggta

SEQ ID NO: 7937506 - DNA, 22 bp, Homo sapiens
aaacatcttgctctgattggta

SEQ ID NO: 7937507 - DNA, 22 bp, Homo sapiens
aaacatctttctattgcaagtt

SEQ ID NO: 7937508 - DNA, 22 bp, Homo sapiens
aaacatctttctattgcaagtt

SEQ ID NO: 7937509 - DNA, 22 bp, Homo sapiens
aaacatctttctattgcaagtt

SEQ ID NO: 7937510 - DNA, 22 bp, Homo sapiens
aaacatcttctcttgattcttt

SEQ ID NO: 7937511 - DNA, 22 bp, Homo sapiens
aaacatcttctcttgattcttt

SEQ ID NO: 7937512 - DNA, 22 bp, Homo sapiens
aaacatcttctcttgattcttt

SEQ ID NO: 7937513 - DNA, 22 bp, Homo sapiens
aaacatcttctcttgattcttt

SEQ ID NO: 7937514 - DNA, 22 bp, Homo sapiens
aaacatcttctcttgattcttt

SEQ ID NO: 7937515 - DNA, 22 bp, Homo sapiens
aaatatgtatggagttcatgaa

SEQ ID NO: 7937516 - DNA, 22 bp, Homo sapiens
aaatatgtatggagttcatgaa

SEQ ID NO: 7937517 - DNA, 22 bp, Homo sapiens
aaatatgtatggagttcatgaa

SEQ ID NO: 7937518 - DNA, 22 bp, Homo sapiens
aaatatgtaagattagcactag

SEQ ID NO: 7937519 - DNA, 22 bp, Homo sapiens
aaatatgtaagattagcactag

SEQ ID NO: 7937520 - DNA, 23 bp, Homo sapiens
aaatatgtctgagggcaaagaat

SEQ ID NO: 7937521 - DNA, 23 bp, Homo sapiens
aaatatgtctgagggcaaagaat

SEQ ID NO: 7937522 - DNA, 23 bp, Homo sapiens
aaatatgtctgagggcaaagaat

SEQ ID NO: 7937523 - DNA, 22 bp, Homo sapiens
aaatatgtgatcagtgaataaa

SEQ ID NO: 7937524 - DNA, 22 bp, Homo sapiens
aaatatgtgatcagtgaataaa

SEQ ID NO: 7937525 - DNA, 22 bp, Homo sapiens
aaatatgtaagattagcactag

SEQ ID NO: 7937526 - DNA, 22 bp, Homo sapiens
aaatatgtaaccaaggtgaagt

SEQ ID NO: 7937527 - DNA, 22 bp, Homo sapiens
aaatatgtaagattagcactag

SEQ ID NO: 7937528 - DNA, 22 bp, Homo sapiens
aaatatgtaagattagcactag

SEQ ID NO: 7937529 - DNA, 22 bp, Homo sapiens
aaatatgtaaccaaggtgaagt

SEQ ID NO: 7937530 - DNA, 22 bp, Homo sapiens
aaatatgagggtgatgcccaga

SEQ ID NO: 7937531 - DNA, 22 bp, Homo sapiens
aaatatgagggtgatgcccaga

SEQ ID NO: 7937532 - DNA, 22 bp, Homo sapiens
aaatataatttctgcctcaata

SEQ ID NO: 7937533 - DNA, 22 bp, Homo sapiens
aaatataatttctgcctcaata

SEQ ID NO: 7937534 - DNA, 22 bp, Homo sapiens
aaatataatttctgcctcaata

SEQ ID NO: 7937535 - DNA, 22 bp, Homo sapiens
aaatatgatactcccttttagt

SEQ ID NO: 7937536 - DNA, 22 bp, Homo sapiens
aaatatgatactcccttttagt

SEQ ID NO: 7937537 - DNA, 22 bp, Homo sapiens
aaactacatctcatggatgagg

SEQ ID NO: 7937538 - DNA, 22 bp, Homo sapiens
aaactacatctcatggatgagg

SEQ ID NO: 7937539 - DNA, 22 bp, Homo sapiens
aaactacatctcatggatgagg

SEQ ID NO: 7937540 - DNA, 22 bp, Homo sapiens
aaactactatgggaatgtactt

SEQ ID NO: 7937541 - DNA, 23 bp, Homo sapiens
aaactacatttatagtttttctc

SEQ ID NO: 7937542 - DNA, 22 bp, Homo sapiens
aaactactggattagtaactta

SEQ ID NO: 7937543 - DNA, 22 bp, Homo sapiens
aaactactatgggaatgtactt

SEQ ID NO: 7937544 - DNA, 22 bp, Homo sapiens
aaactactatgggaatgtactt

SEQ ID NO: 7937545 - DNA, 22 bp, Homo sapiens
aaactactgatttgtgaattga

SEQ ID NO: 7937546 - DNA, 22 bp, Homo sapiens
aaatataatttctgcctcaata

SEQ ID NO: 7937547 - DNA, 22 bp, Homo sapiens
aaactagaaatcagcaagatag

SEQ ID NO: 7937548 - DNA, 22 bp, Homo sapiens
aaactaatgaagtgaagacgct

SEQ ID NO: 7937549 - DNA, 23 bp, Homo sapiens
aaactacaacgccaggcactgag

SEQ ID NO: 7937550 - DNA, 23 bp, Homo sapiens
aaactacaacgccaggcactgag

SEQ ID NO: 7937551 - DNA, 19 bp, Homo sapiens
aaactaaggggaaatgttt

SEQ ID NO: 7937552 - DNA, 22 bp, Homo sapiens
aaactaaggtgctgtggactga

SEQ ID NO: 7937553 - DNA, 19 bp, Homo sapiens
aaactaaggggaaatgttt

SEQ ID NO: 7937554 - DNA, 20 bp, Homo sapiens
aaactaaaggtgtttggttt

SEQ ID NO: 7937555 - DNA, 22 bp, Homo sapiens
aaactaaacctggcttagtaag

SEQ ID NO: 7937556 - DNA, 22 bp, Homo sapiens
aaatagaattggaagcagagtt

SEQ ID NO: 7937557 - DNA, 22 bp, Homo sapiens
aaatagaattggaagcagagtt

SEQ ID NO: 7937558 - DNA, 22 bp, Homo sapiens
aaatagaattggaagcagagtt

SEQ ID NO: 7937559 - DNA, 22 bp, Homo sapiens
aaatagaattggaagcagagtt

SEQ ID NO: 7937560 - DNA, 22 bp, Homo sapiens
aaatagaattggaagcagagtt

SEQ ID NO: 7937561 - DNA, 22 bp, Homo sapiens
aaatagaattggaagcagagtt

SEQ ID NO: 7937562 - DNA, 22 bp, Homo sapiens
aaatagaattaactagctactg

SEQ ID NO: 7937563 - DNA, 22 bp, Homo sapiens
aaatagaattaactagctactg

SEQ ID NO: 7937564 - DNA, 22 bp, Homo sapiens
aaatagaattaactagctactg

SEQ ID NO: 7937565 - DNA, 22 bp, Homo sapiens
aaatagaattaactagctactg

SEQ ID NO: 7937566 - DNA, 22 bp, Homo sapiens
aaatagaaaccaacaaggtcag

SEQ ID NO: 7937567 - DNA, 22 bp, Homo sapiens
aaatagaaaccaacaaggtcag

SEQ ID NO: 7937568 - DNA, 22 bp, Homo sapiens
aaatagaaaccaacaaggtcag

SEQ ID NO: 7937569 - DNA, 22 bp, Homo sapiens
aaatagaattaactagctactg

SEQ ID NO: 7937570 - DNA, 22 bp, Homo sapiens
aaatagaattaactagctactg

SEQ ID NO: 7937571 - DNA, 22 bp, Homo sapiens
aaatagaattaactagctactg

SEQ ID NO: 7937572 - DNA, 22 bp, Homo sapiens
aaactaaacctggcttagtaag

SEQ ID NO: 7937573 - DNA, 22 bp, Homo sapiens
aaacggaatgagtaagagtatc

SEQ ID NO: 7937574 - DNA, 20 bp, Homo sapiens
aaacgagccatcattctggt

SEQ ID NO: 7937575 - DNA, 20 bp, Homo sapiens
aaacgagccatcattctggt

SEQ ID NO: 7937576 - DNA, 22 bp, Homo sapiens
aaatagaattggaagcagagtt

SEQ ID NO: 7937577 - DNA, 22 bp, Homo sapiens
aaatagaattggaagcagagtt

SEQ ID NO: 7937578 - DNA, 22 bp, Homo sapiens
aaatagaattggaagcagagtt

SEQ ID NO: 7937579 - DNA, 22 bp, Homo sapiens
aaatagaattggaagcagagtt

SEQ ID NO: 7937580 - DNA, 20 bp, Homo sapiens
aaacgagccatcattctggt

SEQ ID NO: 7937581 - DNA, 20 bp, Homo sapiens
aaacgagccatcattctggt

SEQ ID NO: 7937582 - DNA, 23 bp, Homo sapiens
aaaccttttgtagaacaattgct

SEQ ID NO: 7937583 - DNA, 20 bp, Homo sapiens
aaacgagccatcattctggt

SEQ ID NO: 7937584 - DNA, 22 bp, Homo sapiens
aaatactgtccaccatggagca

SEQ ID NO: 7937585 - DNA, 22 bp, Homo sapiens
aaatactgtccaccatggagca

SEQ ID NO: 7937586 - DNA, 21 bp, Homo sapiens
aaatactgtcaaatggtgggt

SEQ ID NO: 7937587 - DNA, 22 bp, Homo sapiens
aaatacagattctgactcagag

SEQ ID NO: 7937588 - DNA, 22 bp, Homo sapiens
aaatacagattccagggtctta

SEQ ID NO: 7937589 - DNA, 22 bp, Homo sapiens
aaatacagattctgactcagag

SEQ ID NO: 7937590 - DNA, 22 bp, Homo sapiens
aaatacagattctgactcagag

SEQ ID NO: 7937591 - DNA, 22 bp, Homo sapiens
aaatactgtctctgagagagcc

SEQ ID NO: 7937592 - DNA, 22 bp, Homo sapiens
aaatactgtgaataaaggtttt

SEQ ID NO: 7937593 - DNA, 22 bp, Homo sapiens
aaatactgtctctgagagagcc

SEQ ID NO: 7937594 - DNA, 22 bp, Homo sapiens
aaatactgtccaccatggagca

SEQ ID NO: 7937595 - DNA, 22 bp, Homo sapiens
aaatactgttgaatgaagtaag

SEQ ID NO: 7937596 - DNA, 22 bp, Homo sapiens
aaatactgttgaatgaagtaag

SEQ ID NO: 7937597 - DNA, 22 bp, Homo sapiens
aaatactgttgaatgaagtaag

SEQ ID NO: 7937598 - DNA, 22 bp, Homo sapiens
aaatactgttgaatgaagtaag

SEQ ID NO: 7937599 - DNA, 22 bp, Homo sapiens
aaatactgttgaatgaagtaag

SEQ ID NO: 7937600 - DNA, 22 bp, Homo sapiens
aaatactgttgaatgaagtaag

SEQ ID NO: 7937601 - DNA, 22 bp, Homo sapiens
aaatactgttgaatgaagtaag

SEQ ID NO: 7937602 - DNA, 22 bp, Homo sapiens
aaatactgttttattccatgat

SEQ ID NO: 7937603 - DNA, 22 bp, Homo sapiens
aaatagaaaccaacaaggtcag

SEQ ID NO: 7937604 - DNA, 22 bp, Homo sapiens
aaatagaaaccaacaaggtcag

SEQ ID NO: 7937605 - DNA, 22 bp, Homo sapiens
aaatagaaaccaacaaggtcag

SEQ ID NO: 7937606 - DNA, 22 bp, Homo sapiens
aaatagaaaccaacaaggtcag

SEQ ID NO: 7937607 - DNA, 22 bp, Homo sapiens
aaatactgttttattccatgat

SEQ ID NO: 7937608 - DNA, 22 bp, Homo sapiens
aaatagaaaccaacaaggtcag

SEQ ID NO: 7937609 - DNA, 22 bp, Homo sapiens
aaatagaaaccaacaaggtcag

SEQ ID NO: 7937610 - DNA, 23 bp, Homo sapiens
aaatgctgaatctttactgttta

SEQ ID NO: 7937611 - DNA, 22 bp, Homo sapiens
aaatgctctggggataagactg

SEQ ID NO: 7937612 - DNA, 22 bp, Homo sapiens
aaatgctgagtgtttagagatc

SEQ ID NO: 7937613 - DNA, 22 bp, Homo sapiens
aaatggcaggctctttgctagt

SEQ ID NO: 7937614 - DNA, 22 bp, Homo sapiens
aaatggcagtagaaaagaatcc

SEQ ID NO: 7937615 - DNA, 22 bp, Homo sapiens
aaatggcatagaggtgaaggta

SEQ ID NO: 7937616 - DNA, 22 bp, Homo sapiens
aaatggcagtagaaaagaatcc

SEQ ID NO: 7937617 - DNA, 22 bp, Homo sapiens
aaatgctagaacattttaaagg

SEQ ID NO: 7937618 - DNA, 18 bp, Homo sapiens
aaatgctaggctacatga

SEQ ID NO: 7937619 - DNA, 22 bp, Homo sapiens
aaatgctagggagaaactctcc

SEQ ID NO: 7937620 - DNA, 22 bp, Homo sapiens
aaatgctatttgggaacaacat

SEQ ID NO: 7937621 - DNA, 22 bp, Homo sapiens
aaatgctatttgggaacaacat

SEQ ID NO: 7937622 - DNA, 22 bp, Homo sapiens
aaatgctatttgggaacaacat

SEQ ID NO: 7937623 - DNA, 22 bp, Homo sapiens
aaatgctctggggataagactg

SEQ ID NO: 7937624 - DNA, 22 bp, Homo sapiens
aaatgctctccaaaatgaaagt

SEQ ID NO: 7937625 - DNA, 22 bp, Homo sapiens
aaatgctctccaaaatgaaagt

SEQ ID NO: 7937626 - DNA, 22 bp, Homo sapiens
aaatgctcaccacagggatgtg

SEQ ID NO: 7937627 - DNA, 22 bp, Homo sapiens
aaatgctacacaggaattctca

SEQ ID NO: 7937628 - DNA, 22 bp, Homo sapiens
aaatgctacacaggaattctca

SEQ ID NO: 7937629 - DNA, 22 bp, Homo sapiens
aaatgctacatacacatcaggg

SEQ ID NO: 7937630 - DNA, 22 bp, Homo sapiens
aaatgctagaacattttaaagg

SEQ ID NO: 7937631 - DNA, 22 bp, Homo sapiens
aaatgctagaacattttaaagg

SEQ ID NO: 7937632 - DNA, 18 bp, Homo sapiens
aaatgctaggctacatga

SEQ ID NO: 7937633 - DNA, 22 bp, Homo sapiens
aaatgcctgtgtaaattctagc

SEQ ID NO: 7937634 - DNA, 22 bp, Homo sapiens
aaatgcctgtgtaaattctagc

SEQ ID NO: 7937635 - DNA, 22 bp, Homo sapiens
aaatgcctgtgtaaattctagc

SEQ ID NO: 7937636 - DNA, 22 bp, Homo sapiens
aaatgctaaatgcagcaagtag

SEQ ID NO: 7937637 - DNA, 22 bp, Homo sapiens
aaatgctaaatgcagcaagtag

SEQ ID NO: 7937638 - DNA, 22 bp, Homo sapiens
aaatgctaaatgcagcaagtag

SEQ ID NO: 7937639 - DNA, 22 bp, Homo sapiens
aaatgccttcaaacacttaagg

SEQ ID NO: 7937640 - DNA, 22 bp, Homo sapiens
aaatgcagctgggcatgagagg

SEQ ID NO: 7937641 - DNA, 22 bp, Homo sapiens
aaatgcagctgggcatgagagg

SEQ ID NO: 7937642 - DNA, 22 bp, Homo sapiens
aaatccagtgggtcctcatgag

SEQ ID NO: 7937643 - DNA, 22 bp, Homo sapiens
aaatgcctcattttctctcact

SEQ ID NO: 7937644 - DNA, 22 bp, Homo sapiens
aaatgcctatttgttccttcag

SEQ ID NO: 7937645 - DNA, 22 bp, Homo sapiens
aaatgcctctgctgtacacaat

SEQ ID NO: 7937646 - DNA, 22 bp, Homo sapiens
aaatgcctcccaaacagcacaa

SEQ ID NO: 7937647 - DNA, 22 bp, Homo sapiens
aaatgcctcccattctactgac

SEQ ID NO: 7937648 - DNA, 22 bp, Homo sapiens
aaatgcctctgggttattctag

SEQ ID NO: 7937649 - DNA, 22 bp, Homo sapiens
aaatgcctctgggttattctag

SEQ ID NO: 7937650 - DNA, 22 bp, Homo sapiens
aaatgcctgaatggtatttggt

SEQ ID NO: 7937651 - DNA, 22 bp, Homo sapiens
aaatcagttctccctttcttca

SEQ ID NO: 7937652 - DNA, 22 bp, Homo sapiens
aaatcagttggaacacaagcag

SEQ ID NO: 7937653 - DNA, 22 bp, Homo sapiens
aaatcagttggaacacaagcag

SEQ ID NO: 7937654 - DNA, 22 bp, Homo sapiens
aaatcagttggaacacaagcag

SEQ ID NO: 7937655 - DNA, 22 bp, Homo sapiens
aaatcagttgttatattaaaga

SEQ ID NO: 7937656 - DNA, 22 bp, Homo sapiens
aaatcagtccctcttggaattt

SEQ ID NO: 7937657 - DNA, 22 bp, Homo sapiens
aaatcagtgctcatttgaaagg

SEQ ID NO: 7937658 - DNA, 22 bp, Homo sapiens
aaatcagttagtggtaggattg

SEQ ID NO: 7937659 - DNA, 22 bp, Homo sapiens
aaatcagttagtggtaggattg

SEQ ID NO: 7937660 - DNA, 22 bp, Homo sapiens
aaatcagttaagatgaggccat

SEQ ID NO: 7937661 - DNA, 22 bp, Homo sapiens
aaatcagttcacgttctgaggt

SEQ ID NO: 7937662 - DNA, 22 bp, Homo sapiens
aaatcagttcacgttctgaggt

SEQ ID NO: 7937663 - DNA, 22 bp, Homo sapiens
aaatatgttttccagttgtcat

SEQ ID NO: 7937664 - DNA, 22 bp, Homo sapiens
aaatatgttttccagttgtcat

SEQ ID NO: 7937665 - DNA, 22 bp, Homo sapiens
aaatatgttttccagttgtcat

SEQ ID NO: 7937666 - DNA, 22 bp, Homo sapiens
aaatatgtgatcagtgaataaa

SEQ ID NO: 7937667 - DNA, 22 bp, Homo sapiens
aaatatgtgatcagtgaataaa

SEQ ID NO: 7937668 - DNA, 22 bp, Homo sapiens
aaatattattgcttaaggggag

SEQ ID NO: 7937669 - DNA, 22 bp, Homo sapiens
aaatattattgcttaaggggag

SEQ ID NO: 7937670 - DNA, 22 bp, Homo sapiens
aaatattattgcttaaggggag

SEQ ID NO: 7937671 - DNA, 22 bp, Homo sapiens
aaatattagggagaacagggac

SEQ ID NO: 7937672 - DNA, 22 bp, Homo sapiens
aaatcatctctgcatccttagc

SEQ ID NO: 7937673 - DNA, 22 bp, Homo sapiens
aaatcatctctgcatccttagc

SEQ ID NO: 7937674 - DNA, 22 bp, Homo sapiens
aaatcatggtggaagaaacaga

SEQ ID NO: 7937675 - DNA, 22 bp, Homo sapiens
aaatcatggtggaagaaacaga

SEQ ID NO: 7937676 - DNA, 22 bp, Homo sapiens
aaatcatggtggaagaaacaga

SEQ ID NO: 7937677 - DNA, 22 bp, Homo sapiens
aaatcatggtggaagaaacaga

SEQ ID NO: 7937678 - DNA, 22 bp, Homo sapiens
aaatcatgtgcagagatcagga

SEQ ID NO: 7937679 - DNA, 22 bp, Homo sapiens
aaatcatgtgcagagatcagga

SEQ ID NO: 7937680 - DNA, 22 bp, Homo sapiens
aaatcattatttacagttctga

SEQ ID NO: 7937681 - DNA, 22 bp, Homo sapiens
aaatcattatttacagttctga

SEQ ID NO: 7937682 - DNA, 22 bp, Homo sapiens
aaatcattatttacagttctga

SEQ ID NO: 7937683 - DNA, 22 bp, Homo sapiens
aaatccagctacggggcaacat

SEQ ID NO: 7937684 - DNA, 22 bp, Homo sapiens
aaatccagctacggggcaacat

SEQ ID NO: 7937685 - DNA, 22 bp, Homo sapiens
aaatccagatgagggtaccaga

SEQ ID NO: 7937686 - DNA, 22 bp, Homo sapiens
aaatccaggtccatgtggggta

SEQ ID NO: 7937687 - DNA, 22 bp, Homo sapiens
aaatccagtgggtcctcatgag

SEQ ID NO: 7937688 - DNA, 22 bp, Homo sapiens
aaatgcagctgggcatgagagg

SEQ ID NO: 7937689 - DNA, 22 bp, Homo sapiens
aaatccaggtagtttggtttga

SEQ ID NO: 7937690 - DNA, 22 bp, Homo sapiens
aaatccaggagaatttccactt

SEQ ID NO: 7937691 - DNA, 22 bp, Homo sapiens
aaatccaggtagtttggtttga

SEQ ID NO: 7937692 - DNA, 22 bp, Homo sapiens
aaatccagatgagggtaccaga

SEQ ID NO: 7937693 - DNA, 22 bp, Homo sapiens
aaatccaggaagcagtggtgta

SEQ ID NO: 7937694 - DNA, 22 bp, Homo sapiens
aaatccaggaagcagtggtgta

SEQ ID NO: 7937695 - DNA, 22 bp, Homo sapiens
aaaggaggaatggagagatgct

SEQ ID NO: 7937696 - DNA, 22 bp, Homo sapiens
aaagcaatggatgagaatctgt

SEQ ID NO: 7937697 - DNA, 22 bp, Homo sapiens
aaagcaatggatgagaatctgt

SEQ ID NO: 7937698 - DNA, 22 bp, Homo sapiens
aaaggaggaatggagagatgct

SEQ ID NO: 7937699 - DNA, 22 bp, Homo sapiens
aaaggaggaatggagagatgct

SEQ ID NO: 7937700 - DNA, 22 bp, Homo sapiens
aaagcaatggatgagaatctgt

SEQ ID NO: 7937701 - DNA, 22 bp, Homo sapiens
aaagcaatgcttgtggaatgta

SEQ ID NO: 7937702 - DNA, 22 bp, Homo sapiens
aaagcaatgcttgtggaatgta

SEQ ID NO: 7937703 - DNA, 22 bp, Homo sapiens
aaaggcattggagaccctggct

SEQ ID NO: 7937704 - DNA, 22 bp, Homo sapiens
aaaggcatgtgggctggttgta

SEQ ID NO: 7937705 - DNA, 22 bp, Homo sapiens
aaaggcatgggtgcctgcatgt

SEQ ID NO: 7937706 - DNA, 22 bp, Homo sapiens
aaaggcatgtgcaactacaaat

SEQ ID NO: 7937707 - DNA, 22 bp, Homo sapiens
aaaggccaataaagacaagctg

SEQ ID NO: 7937708 - DNA, 22 bp, Homo sapiens
aaaggccaataaagacaagctg

SEQ ID NO: 7937709 - DNA, 22 bp, Homo sapiens
aaaggccaagcatgaggtggac

SEQ ID NO: 7937710 - DNA, 22 bp, Homo sapiens
aaaggccacacagagcagggag

SEQ ID NO: 7937711 - DNA, 22 bp, Homo sapiens
aaaggccttgagctgggtgcca

SEQ ID NO: 7937712 - DNA, 22 bp, Homo sapiens
aaaggccttaaagagcatgcct

SEQ ID NO: 7937713 - DNA, 22 bp, Homo sapiens
aaaggcccacagtcagtctacc

SEQ ID NO: 7937714 - DNA, 22 bp, Homo sapiens
aaaggccattacttgcttttag

SEQ ID NO: 7937715 - DNA, 22 bp, Homo sapiens
aaaggccttttccccacttctt

SEQ ID NO: 7937716 - DNA, 22 bp, Homo sapiens
aaaggccttttccccacttctt

SEQ ID NO: 7937717 - DNA, 22 bp, Homo sapiens
aaaggccttttccccacttctt

SEQ ID NO: 7937718 - DNA, 22 bp, Homo sapiens
aaaggctaattaaccacctggt

SEQ ID NO: 7937719 - DNA, 22 bp, Homo sapiens
aaaggctacgggggccgtgtgc

SEQ ID NO: 7937720 - DNA, 23 bp, Homo sapiens
aaaggctatcaaagttttgctga

SEQ ID NO: 7937721 - DNA, 22 bp, Homo sapiens
aaaggctagtggattcattgat

SEQ ID NO: 7937722 - DNA, 22 bp, Homo sapiens
aaacactgatggatatttttcc

SEQ ID NO: 7937723 - DNA, 22 bp, Homo sapiens
aaaggccaccaacatgaagcat

SEQ ID NO: 7937724 - DNA, 22 bp, Homo sapiens
aaaggccacactgctctttctc

SEQ ID NO: 7937725 - DNA, 22 bp, Homo sapiens
aaaggccacactgctctttctc

SEQ ID NO: 7937726 - DNA, 22 bp, Homo sapiens
aaaggccactgcaagggaaggt

SEQ ID NO: 7937727 - DNA, 22 bp, Homo sapiens
aaagatgtcagtttgaaataac

SEQ ID NO: 7937728 - DNA, 22 bp, Homo sapiens
aaagatgtcagtcagataggat

SEQ ID NO: 7937729 - DNA, 22 bp, Homo sapiens
aaagatgtcagtcagataggat

SEQ ID NO: 7937730 - DNA, 22 bp, Homo sapiens
aaagatgtcagtttgaaataac

SEQ ID NO: 7937731 - DNA, 22 bp, Homo sapiens
aaagatgtcatacacattaaga

SEQ ID NO: 7937732 - DNA, 22 bp, Homo sapiens
aaagatgtcatacacattaaga

SEQ ID NO: 7937733 - DNA, 22 bp, Homo sapiens
aaagatgtcatacacattaaga

SEQ ID NO: 7937734 - DNA, 22 bp, Homo sapiens
aaagatgtccaagtaaagttaa

SEQ ID NO: 7937735 - DNA, 22 bp, Homo sapiens
aaagatgtgcctgtttcatagt

SEQ ID NO: 7937736 - DNA, 22 bp, Homo sapiens
aaagatgtgcctgtttcatagt

SEQ ID NO: 7937737 - DNA, 23 bp, Homo sapiens
aaagatgtgagtattcatatggc

SEQ ID NO: 7937738 - DNA, 22 bp, Homo sapiens
aaagatgtgcctgtttcatagt

SEQ ID NO: 7937739 - DNA, 23 bp, Homo sapiens
aaagatgtgagtattcatatggc

SEQ ID NO: 7937740 - DNA, 23 bp, Homo sapiens
aaagatgtgagtattcatatggc

SEQ ID NO: 7937741 - DNA, 19 bp, Homo sapiens
aaagatgtccttttgggct

SEQ ID NO: 7937742 - DNA, 23 bp, Homo sapiens
aaagatgtgagtattcatatggc

SEQ ID NO: 7937743 - DNA, 23 bp, Homo sapiens
aaagatgtgagtattcatatggc

SEQ ID NO: 7937744 - DNA, 23 bp, Homo sapiens
aaagatgtgagtattcatatggc

SEQ ID NO: 7937745 - DNA, 22 bp, Homo sapiens
aaagatgtccaagtaaagttaa

SEQ ID NO: 7937746 - DNA, 22 bp, Homo sapiens
aaagcaataggttaggtcaaga

SEQ ID NO: 7937747 - DNA, 22 bp, Homo sapiens
aaagcaataggttaggtcaaga

SEQ ID NO: 7937748 - DNA, 22 bp, Homo sapiens
aaagcaataggttaggtcaaga

SEQ ID NO: 7937749 - DNA, 22 bp, Homo sapiens
aaagatgtgtaagaaataaaca

SEQ ID NO: 7937750 - DNA, 22 bp, Homo sapiens
aaagatgtgtaagaaataaaca

SEQ ID NO: 7937751 - DNA, 22 bp, Homo sapiens
aaagatgtgtaagaaataaaca

SEQ ID NO: 7937752 - DNA, 22 bp, Homo sapiens
aaagcaatgcccgttcattatc

SEQ ID NO: 7937753 - DNA, 22 bp, Homo sapiens
aaagcaatgcttgtggaatgta

SEQ ID NO: 7937754 - DNA, 22 bp, Homo sapiens
aaagcaatgcttgtggaatgta

SEQ ID NO: 7937755 - DNA, 22 bp, Homo sapiens
aaagcaatgcttgtggaatgta

SEQ ID NO: 7937756 - DNA, 22 bp, Homo sapiens
aaagcaatgcttgtggaatgta

SEQ ID NO: 7937757 - DNA, 22 bp, Homo sapiens
aaagcaatgcccgttcattatc

SEQ ID NO: 7937758 - DNA, 22 bp, Homo sapiens
aaagcaatgcccgttcattatc

SEQ ID NO: 7937759 - DNA, 22 bp, Homo sapiens
aaagcaatgcccgttcattatc

SEQ ID NO: 7937760 - DNA, 22 bp, Homo sapiens
aaagcaatgcccgttcattatc

SEQ ID NO: 7937761 - DNA, 22 bp, Homo sapiens
aaagcaatgatggtagacacgt

SEQ ID NO: 7937762 - DNA, 22 bp, Homo sapiens
aaagcaatgatggtagacacgt

SEQ ID NO: 7937763 - DNA, 22 bp, Homo sapiens
aaagcaatgatggtagacacgt

SEQ ID NO: 7937764 - DNA, 22 bp, Homo sapiens
aaagcaatcagattcagatgtc

SEQ ID NO: 7937765 - DNA, 22 bp, Homo sapiens
aaagcaatcagattcagatgtc

SEQ ID NO: 7937766 - DNA, 22 bp, Homo sapiens
aaagcaatctagttccaattct

SEQ ID NO: 7937767 - DNA, 22 bp, Homo sapiens
aaagcaatctagttccaattct

SEQ ID NO: 7937768 - DNA, 22 bp, Homo sapiens
aaagcaatctagttccaattct

SEQ ID NO: 7937769 - DNA, 22 bp, Homo sapiens
aaagcaatagtaatggtaatag

SEQ ID NO: 7937770 - DNA, 22 bp, Homo sapiens
aaagcaatagtaatggtaatag

SEQ ID NO: 7937771 - DNA, 22 bp, Homo sapiens
aaagcaatagtaatggtaatag

SEQ ID NO: 7937772 - DNA, 22 bp, Homo sapiens
aaagcaatagtaatggtaatag

SEQ ID NO: 7937773 - DNA, 22 bp, Homo sapiens
aaagcaatagtaatggtaatag

SEQ ID NO: 7937774 - DNA, 22 bp, Homo sapiens
aaagcaatcagattcagatgtc

SEQ ID NO: 7937775 - DNA, 22 bp, Homo sapiens
aaagcaatcagattcagatgtc

SEQ ID NO: 7937776 - DNA, 22 bp, Homo sapiens
aaagcaatcagattcagatgtc

SEQ ID NO: 7937777 - DNA, 22 bp, Homo sapiens
aaagcaatcagattcagatgtc

SEQ ID NO: 7937778 - DNA, 22 bp, Homo sapiens
aaacatctatcagcatttttta

SEQ ID NO: 7937779 - DNA, 22 bp, Homo sapiens
aaacatctatcagcatttttta

SEQ ID NO: 7937780 - DNA, 22 bp, Homo sapiens
aaacatctactgtaggctggag

SEQ ID NO: 7937781 - DNA, 22 bp, Homo sapiens
aaacatctactgtaggctggag

SEQ ID NO: 7937782 - DNA, 22 bp, Homo sapiens
aaacatctatcagcatttttta

SEQ ID NO: 7937783 - DNA, 22 bp, Homo sapiens
aaacatctatcagcatttttta

SEQ ID NO: 7937784 - DNA, 22 bp, Homo sapiens
aaacatctatcagcatttttta

SEQ ID NO: 7937785 - DNA, 22 bp, Homo sapiens
aaacatcataggcatgcatgat

SEQ ID NO: 7937786 - DNA, 22 bp, Homo sapiens
aaacatcataggcatgcatgat

SEQ ID NO: 7937787 - DNA, 22 bp, Homo sapiens
aaacatcataggcatgcatgat

SEQ ID NO: 7937788 - DNA, 22 bp, Homo sapiens
aaacatcataggcatgcatgat

SEQ ID NO: 7937789 - DNA, 20 bp, Homo sapiens
aaacatagtggataccacag

SEQ ID NO: 7937790 - DNA, 22 bp, Homo sapiens
aaacatagcacacacagctctt

SEQ ID NO: 7937791 - DNA, 22 bp, Homo sapiens
aaacatagataatagatagatg

SEQ ID NO: 7937792 - DNA, 22 bp, Homo sapiens
aaacatagcacacacagctctt

SEQ ID NO: 7937793 - DNA, 22 bp, Homo sapiens
aaacatagataatagatagatg

SEQ ID NO: 7937794 - DNA, 22 bp, Homo sapiens
aaacatagataatagatagatg

SEQ ID NO: 7937795 - DNA, 22 bp, Homo sapiens
aaacatagataatagatagatg

SEQ ID NO: 7937796 - DNA, 22 bp, Homo sapiens
aaacagttttttaagtctctag

SEQ ID NO: 7937797 - DNA, 22 bp, Homo sapiens
aaacatagataatagatagatg

SEQ ID NO: 7937798 - DNA, 20 bp, Homo sapiens
aaacatagtggataccacag

SEQ ID NO: 7937799 - DNA, 20 bp, Homo sapiens
aaacatagtggataccacag

SEQ ID NO: 7937800 - DNA, 22 bp, Homo sapiens
aaacatcaattgcatctcccaa

SEQ ID NO: 7937801 - DNA, 22 bp, Homo sapiens
aaacatcaccattttacctaat

SEQ ID NO: 7937802 - DNA, 22 bp, Homo sapiens
aaacatcaccattttacctaat

SEQ ID NO: 7937803 - DNA, 22 bp, Homo sapiens
aaacatcaccattttacctaat

SEQ ID NO: 7937804 - DNA, 22 bp, Homo sapiens
aaacatcaccattttacctaat

SEQ ID NO: 7937805 - DNA, 22 bp, Homo sapiens
aaacatcaccattttacctaat

SEQ ID NO: 7937806 - DNA, 22 bp, Homo sapiens
aaacatcaccattttacctaat

SEQ ID NO: 7937807 - DNA, 22 bp, Homo sapiens
aaacatcaccattttacctaat

SEQ ID NO: 7937808 - DNA, 22 bp, Homo sapiens
aaacagttttctcatttagtgt

SEQ ID NO: 7937809 - DNA, 22 bp, Homo sapiens
aaacagttttctcatttagtgt

SEQ ID NO: 7937810 - DNA, 22 bp, Homo sapiens
aaacagttttctcatttagtgt

SEQ ID NO: 7937811 - DNA, 22 bp, Homo sapiens
aaacagttttctcatttagtgt

SEQ ID NO: 7937812 - DNA, 22 bp, Homo sapiens
aaacagttttgccaaaaggaca

SEQ ID NO: 7937813 - DNA, 22 bp, Homo sapiens
aaacagttttttaagtctctag

SEQ ID NO: 7937814 - DNA, 22 bp, Homo sapiens
aaagtgctgggattataggcat

SEQ ID NO: 7937815 - DNA, 22 bp, Homo sapiens
aaagtgctgggattccaggcgt

SEQ ID NO: 7937816 - DNA, 22 bp, Homo sapiens
aaagtgctgggattataggcat

SEQ ID NO: 7937817 - DNA, 22 bp, Homo sapiens
aaagtgctgggattacaggcat

SEQ ID NO: 7937818 - DNA, 22 bp, Homo sapiens
aaagtgctgggattacaggcct

SEQ ID NO: 7937819 - DNA, 22 bp, Homo sapiens
aaagtgctgggattacaggcgt

SEQ ID NO: 7937820 - DNA, 22 bp, Homo sapiens
aaagtgctgggattacaggctt

SEQ ID NO: 7937821 - DNA, 22 bp, Homo sapiens
aaagtgctcggcgctggtccca

SEQ ID NO: 7937822 - DNA, 22 bp, Homo sapiens
aaagtgctaggattacaagcgt

SEQ ID NO: 7937823 - DNA, 22 bp, Homo sapiens
aaagtgctaagtcacccagcta

SEQ ID NO: 7937824 - DNA, 22 bp, Homo sapiens
aaagtgctaagtcacccagcta

SEQ ID NO: 7937825 - DNA, 22 bp, Homo sapiens
aaagtgctaggattacaagcgt

SEQ ID NO: 7937826 - DNA, 22 bp, Homo sapiens
aaagtgctgaagacctagctgt

SEQ ID NO: 7937827 - DNA, 22 bp, Homo sapiens
aaagtgctgaagacctagctgt

SEQ ID NO: 7937828 - DNA, 22 bp, Homo sapiens
aaagtgctgaagacctagctgt

SEQ ID NO: 7937829 - DNA, 22 bp, Homo sapiens
aaagtgctgagattacaagcgt

SEQ ID NO: 7937830 - DNA, 22 bp, Homo sapiens
aaagtgctgagattacaagcgt

SEQ ID NO: 7937831 - DNA, 22 bp, Homo sapiens
aaagtgctgggattacaagcgt

SEQ ID NO: 7937832 - DNA, 22 bp, Homo sapiens
aaagtgctgggattacaagtgt

SEQ ID NO: 7937833 - DNA, 22 bp, Homo sapiens
aaagtgctgggattacaagtgt

SEQ ID NO: 7937834 - DNA, 22 bp, Homo sapiens
aaagtgctgggattacaagcgt

SEQ ID NO: 7937835 - DNA, 22 bp, Homo sapiens
aaagtgcatcaaatgacttccc

SEQ ID NO: 7937836 - DNA, 22 bp, Homo sapiens
aaagtgcattcgaaagtccatc

SEQ ID NO: 7937837 - DNA, 22 bp, Homo sapiens
aaagtgcatagagtagtgccta

SEQ ID NO: 7937838 - DNA, 23 bp, Homo sapiens
aaagtgcagttgaggaatcatag

SEQ ID NO: 7937839 - DNA, 23 bp, Homo sapiens
aaagtgcagttgaggaatcatag

SEQ ID NO: 7937840 - DNA, 22 bp, Homo sapiens
aaagtgcattgtttgtgttcct

SEQ ID NO: 7937841 - DNA, 22 bp, Homo sapiens
aaagtgccacaactggacaacc

SEQ ID NO: 7937842 - DNA, 22 bp, Homo sapiens
aaagtgctaaataagccctgaa

SEQ ID NO: 7937843 - DNA, 22 bp, Homo sapiens
aaagtgctaaataagccctgaa

SEQ ID NO: 7937844 - DNA, 22 bp, Homo sapiens
aaagtgctaaataagccctgaa

SEQ ID NO: 7937845 - DNA, 22 bp, Homo sapiens
aaagtgccccagacaagacccc

SEQ ID NO: 7937846 - DNA, 22 bp, Homo sapiens
aaagtgcctgactcatagttag

SEQ ID NO: 7937847 - DNA, 22 bp, Homo sapiens
aaagtcatttagccttatctcc

SEQ ID NO: 7937848 - DNA, 22 bp, Homo sapiens
aaacactgtctctggtattgaa

SEQ ID NO: 7937849 - DNA, 22 bp, Homo sapiens
aaacactgtctctggtattgaa

SEQ ID NO: 7937850 - DNA, 22 bp, Homo sapiens
aaagtcatttgtatataccctt

SEQ ID NO: 7937851 - DNA, 22 bp, Homo sapiens
aaagtcattttccagaccagta

SEQ ID NO: 7937852 - DNA, 23 bp, Homo sapiens
aaagtgcagttgaggaatcatag

SEQ ID NO: 7937853 - DNA, 23 bp, Homo sapiens
aaagtgcagttgaggaatcatag

SEQ ID NO: 7937854 - DNA, 22 bp, Homo sapiens
aaagtgcagtccatgaaattaa

SEQ ID NO: 7937855 - DNA, 22 bp, Homo sapiens
aaagtgcagtccatgaaattaa

SEQ ID NO: 7937856 - DNA, 22 bp, Homo sapiens
aaagtgcagtccatgaaattaa

SEQ ID NO: 7937857 - DNA, 22 bp, Homo sapiens
aaagtcattttccagaccagta

SEQ ID NO: 7937858 - DNA, 22 bp, Homo sapiens
aaacactggcaatttcatgcac

SEQ ID NO: 7937859 - DNA, 22 bp, Homo sapiens
aaacactggcaatttcatgcac

SEQ ID NO: 7937860 - DNA, 22 bp, Homo sapiens
aaacactgatggatatttttcc

SEQ ID NO: 7937861 - DNA, 22 bp, Homo sapiens
aaacactggcaatttcatgcac

SEQ ID NO: 7937862 - DNA, 22 bp, Homo sapiens
aaacactgcgtggtggcaactc

SEQ ID NO: 7937863 - DNA, 22 bp, Homo sapiens
aaacactgcgtggtggcaactc

SEQ ID NO: 7937864 - DNA, 22 bp, Homo sapiens
aaacactgcagggtttacttga

SEQ ID NO: 7937865 - DNA, 22 bp, Homo sapiens
aaacactgcagggtttacttga

SEQ ID NO: 7937866 - DNA, 22 bp, Homo sapiens
aaacactggtatgatgtatagt

SEQ ID NO: 7937867 - DNA, 22 bp, Homo sapiens
aaacactggtatgatgtatagt

SEQ ID NO: 7937868 - DNA, 22 bp, Homo sapiens
aaacactggtatgatgtatagt

SEQ ID NO: 7937869 - DNA, 22 bp, Homo sapiens
aaacactggtatgatgtatagt

SEQ ID NO: 7937870 - DNA, 22 bp, Homo sapiens
aaacactggtatgatgtatagt

SEQ ID NO: 7937871 - DNA, 20 bp, Homo sapiens
aaacactggctggggcacag

SEQ ID NO: 7937872 - DNA, 22 bp, Homo sapiens
aaacactggtatgatgtatagt

SEQ ID NO: 7937873 - DNA, 22 bp, Homo sapiens
aaacactgtacaatctgcaggg

SEQ ID NO: 7937874 - DNA, 22 bp, Homo sapiens
aaacactgtacaatctgcaggg

SEQ ID NO: 7937875 - DNA, 22 bp, Homo sapiens
aagacaatttgatactagttgc

SEQ ID NO: 7937876 - DNA, 22 bp, Homo sapiens
aagacaatttgatactagttgc

SEQ ID NO: 7937877 - DNA, 22 bp, Homo sapiens
aagacaatttgatactagttgc

SEQ ID NO: 7937878 - DNA, 22 bp, Homo sapiens
aagacaatttgatactagttgc

SEQ ID NO: 7937879 - DNA, 22 bp, Homo sapiens
aagacaattttgagtatgcaca

SEQ ID NO: 7937880 - DNA, 22 bp, Homo sapiens
aagacaattttgagtatgcaca

SEQ ID NO: 7937881 - DNA, 22 bp, Homo sapiens
aagacaattttgagtatgcaca

SEQ ID NO: 7937882 - DNA, 22 bp, Homo sapiens
aagacaattttgagtatgcaca

SEQ ID NO: 7937883 - DNA, 22 bp, Homo sapiens
aagacaattttgagtatgcaca

SEQ ID NO: 7937884 - DNA, 22 bp, Homo sapiens
aagacacaaagcttcccttttc

SEQ ID NO: 7937885 - DNA, 22 bp, Homo sapiens
aagacacaatgtagcccagcac

SEQ ID NO: 7937886 - DNA, 22 bp, Homo sapiens
aagacacaaagcttcccttttc

SEQ ID NO: 7937887 - DNA, 22 bp, Homo sapiens
aagacaatgcattactaagaag

SEQ ID NO: 7937888 - DNA, 22 bp, Homo sapiens
aagacaatgtttctgatagata

SEQ ID NO: 7937889 - DNA, 22 bp, Homo sapiens
aagacaatgtttctgatagata

SEQ ID NO: 7937890 - DNA, 22 bp, Homo sapiens
aagacaatgcattactaagaag

SEQ ID NO: 7937891 - DNA, 22 bp, Homo sapiens
aagacaatgtttctgatagata

SEQ ID NO: 7937892 - DNA, 22 bp, Homo sapiens
aagacaatgtttctgatagata

SEQ ID NO: 7937893 - DNA, 22 bp, Homo sapiens
aagacaatcctggacagtcagc

SEQ ID NO: 7937894 - DNA, 22 bp, Homo sapiens
aagacaatctaaggggaatggt

SEQ ID NO: 7937895 - DNA, 22 bp, Homo sapiens
aagacaatgcattactaagaag

SEQ ID NO: 7937896 - DNA, 22 bp, Homo sapiens
aagacaatgcattactaagaag

SEQ ID NO: 7937897 - DNA, 22 bp, Homo sapiens
aagacaatgcattactaagaag

SEQ ID NO: 7937898 - DNA, 22 bp, Homo sapiens
aagacaatgcattactaagaag

SEQ ID NO: 7937899 - DNA, 22 bp, Homo sapiens
aagacaatgcattactaagaag

SEQ ID NO: 7937900 - DNA, 22 bp, Homo sapiens
acaacaaaatcactagtcttcc

SEQ ID NO: 7937901 - DNA, 22 bp, Homo sapiens
aagacacagcgaaatgttcctg

SEQ ID NO: 7937902 - DNA, 22 bp, Homo sapiens
aagacacacacatatgctgagt

SEQ ID NO: 7937903 - DNA, 22 bp, Homo sapiens
aagacacagcgaaatgttcctg

SEQ ID NO: 7937904 - DNA, 22 bp, Homo sapiens
acaacaaaatgaggaagtggtc

SEQ ID NO: 7937905 - DNA, 22 bp, Homo sapiens
acaacaaaatgaggaagtggtc

SEQ ID NO: 7937906 - DNA, 22 bp, Homo sapiens
aagacacacacatatgctgagt

SEQ ID NO: 7937907 - DNA, 22 bp, Homo sapiens
aagacacacacatatgctgagt

SEQ ID NO: 7937908 - DNA, 22 bp, Homo sapiens
aagacacacacatatgctgagt

SEQ ID NO: 7937909 - DNA, 22 bp, Homo sapiens
acaactctcagttaaataaaga

SEQ ID NO: 7937910 - DNA, 22 bp, Homo sapiens
acaactccttcttgggtcctgg

SEQ ID NO: 7937911 - DNA, 22 bp, Homo sapiens
acaactgtcagtaaagaatatt

SEQ ID NO: 7937912 - DNA, 22 bp, Homo sapiens
acaactgatgggtcatgtggga

SEQ ID NO: 7937913 - DNA, 22 bp, Homo sapiens
acaactctcagttaaataaaga

SEQ ID NO: 7937914 - DNA, 22 bp, Homo sapiens
acaactgtcttcttcatgctcc

SEQ ID NO: 7937915 - DNA, 22 bp, Homo sapiens
acaactgtcttcttcatgctcc

SEQ ID NO: 7937916 - DNA, 22 bp, Homo sapiens
acaagaaaggtaggattcaggt

SEQ ID NO: 7937917 - DNA, 22 bp, Homo sapiens
acaagaaaggtaggattcaggt

SEQ ID NO: 7937918 - DNA, 22 bp, Homo sapiens
acaagaaaggtaggattcaggt

SEQ ID NO: 7937919 - DNA, 22 bp, Homo sapiens
acaactttgtagcaattccacg

SEQ ID NO: 7937920 - DNA, 22 bp, Homo sapiens
acaactttgtagcaattccacg

SEQ ID NO: 7937921 - DNA, 22 bp, Homo sapiens
acaagaagtcacatctaggagt

SEQ ID NO: 7937922 - DNA, 22 bp, Homo sapiens
acaagaagtcacatctaggagt

SEQ ID NO: 7937923 - DNA, 22 bp, Homo sapiens
acaagaagtcacatctaggagt

SEQ ID NO: 7937924 - DNA, 22 bp, Homo sapiens
acaagaagagcatttgcagggt

SEQ ID NO: 7937925 - DNA, 22 bp, Homo sapiens
acaagaaccaaagaaggatatt

SEQ ID NO: 7937926 - DNA, 22 bp, Homo sapiens
acaagaaccaaagaaggatatt

SEQ ID NO: 7937927 - DNA, 22 bp, Homo sapiens
acaactttgacccttgttctta

SEQ ID NO: 7937928 - DNA, 22 bp, Homo sapiens
acaactttgacccttgttctta

SEQ ID NO: 7937929 - DNA, 22 bp, Homo sapiens
acaactttctgggttatctgat

SEQ ID NO: 7937930 - DNA, 22 bp, Homo sapiens
acaacttctcacagataaattt

SEQ ID NO: 7937931 - DNA, 22 bp, Homo sapiens
acaacttcaattgggattctcc

SEQ ID NO: 7937932 - DNA, 22 bp, Homo sapiens
aagacattgtcattttataatt

SEQ ID NO: 7937933 - DNA, 22 bp, Homo sapiens
aagacattgtcattttataatt

SEQ ID NO: 7937934 - DNA, 22 bp, Homo sapiens
aagacattgctgcttttaattg

SEQ ID NO: 7937935 - DNA, 22 bp, Homo sapiens
acaagaataaggataagagatt

SEQ ID NO: 7937936 - DNA, 22 bp, Homo sapiens
aagacattcacaaatgttcact

SEQ ID NO: 7937937 - DNA, 22 bp, Homo sapiens
aagacattcacaaatgttcact

SEQ ID NO: 7937938 - DNA, 22 bp, Homo sapiens
aagacattccaaagtggctaat

SEQ ID NO: 7937939 - DNA, 22 bp, Homo sapiens
acaagaatgtagattagttaag

SEQ ID NO: 7937940 - DNA, 22 bp, Homo sapiens
aagacattgcatgataatgctg

SEQ ID NO: 7937941 - DNA, 22 bp, Homo sapiens
aagacaagccttgtttttctgc

SEQ ID NO: 7937942 - DNA, 22 bp, Homo sapiens
aagacaatattgctgtgaacgt

SEQ ID NO: 7937943 - DNA, 22 bp, Homo sapiens
aagacaatattgctgtgaacgt

SEQ ID NO: 7937944 - DNA, 22 bp, Homo sapiens
aagacaatattgctgtgaacgt

SEQ ID NO: 7937945 - DNA, 22 bp, Homo sapiens
aagacaatcctggacagtcagc

SEQ ID NO: 7937946 - DNA, 22 bp, Homo sapiens
aagacaatcctggacagtcagc

SEQ ID NO: 7937947 - DNA, 22 bp, Homo sapiens
aagacaatcctggacagtcagc

SEQ ID NO: 7937948 - DNA, 22 bp, Homo sapiens
aagacaatcctggacagtcagc

SEQ ID NO: 7937949 - DNA, 22 bp, Homo sapiens
aagacaatattgctgtgaacgt

SEQ ID NO: 7937950 - DNA, 17 bp, Homo sapiens
aagacaagacaaatgca

SEQ ID NO: 7937951 - DNA, 17 bp, Homo sapiens
aagacaagacaaatgca

SEQ ID NO: 7937952 - DNA, 22 bp, Homo sapiens
aagacaacagagatgacagact

SEQ ID NO: 7937953 - DNA, 17 bp, Homo sapiens
aagacaagacaaatgca

SEQ ID NO: 7937954 - DNA, 22 bp, Homo sapiens
aagaatttaaactaaccatatg

SEQ ID NO: 7937955 - DNA, 22 bp, Homo sapiens
aagaattttccagcatgtcagt

SEQ ID NO: 7937956 - DNA, 22 bp, Homo sapiens
aagaattttccagcatgtcagt

SEQ ID NO: 7937957 - DNA, 22 bp, Homo sapiens
aagacaaaggggtccttggatg

SEQ ID NO: 7937958 - DNA, 22 bp, Homo sapiens
aagaattttccagcatgtcagt

SEQ ID NO: 7937959 - DNA, 17 bp, Homo sapiens
aagacaagacaaatgca

SEQ ID NO: 7937960 - DNA, 17 bp, Homo sapiens
aagacaagacaaatgca

SEQ ID NO: 7937961 - DNA, 17 bp, Homo sapiens
aagacaagacaaatgca

SEQ ID NO: 7937962 - DNA, 22 bp, Homo sapiens
aagacaacagagatgacagact

SEQ ID NO: 7937963 - DNA, 22 bp, Homo sapiens
aagacaacagagatgacagact

SEQ ID NO: 7937964 - DNA, 22 bp, Homo sapiens
aagacaaaggggtccttggatg

SEQ ID NO: 7937965 - DNA, 22 bp, Homo sapiens
aattcacaaaaccagattgctt

SEQ ID NO: 7937966 - DNA, 22 bp, Homo sapiens
aattcacaaaaccagattgctt

SEQ ID NO: 7937967 - DNA, 22 bp, Homo sapiens
aattcacaaaagttagatccat

SEQ ID NO: 7937968 - DNA, 22 bp, Homo sapiens
aagaatcttaatccagaaacct

SEQ ID NO: 7937969 - DNA, 22 bp, Homo sapiens
aagaatcttaatccagaaacct

SEQ ID NO: 7937970 - DNA, 22 bp, Homo sapiens
aagaatcttaatccagaaacct

SEQ ID NO: 7937971 - DNA, 22 bp, Homo sapiens
aagaatctttccagttttgatg

SEQ ID NO: 7937972 - DNA, 22 bp, Homo sapiens
aattcacaaaagttagatccat

SEQ ID NO: 7937973 - DNA, 22 bp, Homo sapiens
aattcacaaaagttagatccat

SEQ ID NO: 7937974 - DNA, 22 bp, Homo sapiens
aagaatctgttgattccccact

SEQ ID NO: 7937975 - DNA, 22 bp, Homo sapiens
aagaatctgttgattccccact

SEQ ID NO: 7937976 - DNA, 22 bp, Homo sapiens
aagaatttaaactaaccatatg

SEQ ID NO: 7937977 - DNA, 22 bp, Homo sapiens
aagaattattgcaatactagat

SEQ ID NO: 7937978 - DNA, 22 bp, Homo sapiens
aagaatgaaggatttagctgtt

SEQ ID NO: 7937979 - DNA, 22 bp, Homo sapiens
aagaattattgcaatactagat

SEQ ID NO: 7937980 - DNA, 22 bp, Homo sapiens
aagaattattgcaatactagat

SEQ ID NO: 7937981 - DNA, 22 bp, Homo sapiens
aagaattattgcaatactagat

SEQ ID NO: 7937982 - DNA, 22 bp, Homo sapiens
aagaattattgcaatactagat

SEQ ID NO: 7937983 - DNA, 22 bp, Homo sapiens
aagaattcactggtagagtcaa

SEQ ID NO: 7937984 - DNA, 22 bp, Homo sapiens
aattagactaattttacaaggg

SEQ ID NO: 7937985 - DNA, 22 bp, Homo sapiens
aattagactaattttacaaggg

SEQ ID NO: 7937986 - DNA, 22 bp, Homo sapiens
aattagaagggagttattgata

SEQ ID NO: 7937987 - DNA, 22 bp, Homo sapiens
aattagaagggagttattgata

SEQ ID NO: 7937988 - DNA, 22 bp, Homo sapiens
aattagaatcttatttggggaa

SEQ ID NO: 7937989 - DNA, 22 bp, Homo sapiens
aattagaagctgttagcaaaat

SEQ ID NO: 7937990 - DNA, 22 bp, Homo sapiens
aattagaagctgttagcaaaat

SEQ ID NO: 7937991 - DNA, 22 bp, Homo sapiens
aattagaagctgttagcaaaat

SEQ ID NO: 7937992 - DNA, 22 bp, Homo sapiens
aattagaagctgttagcaaaat

SEQ ID NO: 7937993 - DNA, 20 bp, Homo sapiens
aattagatgtttaatcaata

SEQ ID NO: 7937994 - DNA, 20 bp, Homo sapiens
aattagatgtttaatcaata

SEQ ID NO: 7937995 - DNA, 20 bp, Homo sapiens
aattagatgtttaatcaata

SEQ ID NO: 7937996 - DNA, 20 bp, Homo sapiens
aattagatgtttaatcaata

SEQ ID NO: 7937997 - DNA, 22 bp, Homo sapiens
aattagcatttcccatataaat

SEQ ID NO: 7937998 - DNA, 22 bp, Homo sapiens
aattattgagcatctactgtgt

SEQ ID NO: 7937999 - DNA, 22 bp, Homo sapiens
aattcaaattacaatagttgtt

SEQ ID NO: 7938000 - DNA, 22 bp, Homo sapiens
aattcaaattacaatagttgtt

SEQ ID NO: 7938001 - DNA, 23 bp, Homo sapiens
aattcaaattcagtgtgactagg

SEQ ID NO: 7938002 - DNA, 22 bp, Homo sapiens
aattcaaattacaatagttgtt

SEQ ID NO: 7938003 - DNA, 22 bp, Homo sapiens
aattcaaattacaatagttgtt

SEQ ID NO: 7938004 - DNA, 22 bp, Homo sapiens
aattcaaattacaatagttgtt

SEQ ID NO: 7938005 - DNA, 22 bp, Homo sapiens
aattcaaagactagaattttgc

SEQ ID NO: 7938006 - DNA, 22 bp, Homo sapiens
aattcaacagtcagttatctca

SEQ ID NO: 7938007 - DNA, 22 bp, Homo sapiens
aattcaatctaagaaatgatca

SEQ ID NO: 7938008 - DNA, 23 bp, Homo sapiens
aattcaaattcagtgtgactagg

SEQ ID NO: 7938009 - DNA, 22 bp, Homo sapiens
aattcaatctaagaaatgatca

SEQ ID NO: 7938010 - DNA, 22 bp, Homo sapiens
aattcaatctaagaaatgatca

SEQ ID NO: 7938011 - DNA, 22 bp, Homo sapiens
aattcaatggtttttaggatat

SEQ ID NO: 7938012 - DNA, 22 bp, Homo sapiens
aattcaatctgtagattgtgat

SEQ ID NO: 7938013 - DNA, 22 bp, Homo sapiens
aattcaatctgtagattgtgat

SEQ ID NO: 7938014 - DNA, 22 bp, Homo sapiens
aattcaatctaagaaatgatca

SEQ ID NO: 7938015 - DNA, 22 bp, Homo sapiens
aactttctagagatgagttcgg

SEQ ID NO: 7938016 - DNA, 22 bp, Homo sapiens
aactttctaattttggctgagc

SEQ ID NO: 7938017 - DNA, 22 bp, Homo sapiens
aactttctataggttgggattt

SEQ ID NO: 7938018 - DNA, 22 bp, Homo sapiens
aactttctagagatgagttcgg

SEQ ID NO: 7938019 - DNA, 22 bp, Homo sapiens
aactttctagagatgagttcgg

SEQ ID NO: 7938020 - DNA, 22 bp, Homo sapiens
aactttctaattttggctgagc

SEQ ID NO: 7938021 - DNA, 22 bp, Homo sapiens
aactttccatctttatcgtctt

SEQ ID NO: 7938022 - DNA, 22 bp, Homo sapiens
aactttccatcatttgaagccc

SEQ ID NO: 7938023 - DNA, 22 bp, Homo sapiens
aactttccatctttatcgtctt

SEQ ID NO: 7938024 - DNA, 22 bp, Homo sapiens
aactttctaaagtcaaattggt

SEQ ID NO: 7938025 - DNA, 22 bp, Homo sapiens
aactttcaggcaatgaatattt

SEQ ID NO: 7938026 - DNA, 22 bp, Homo sapiens
aactttcagcaagtaattctgg

SEQ ID NO: 7938027 - DNA, 22 bp, Homo sapiens
aactttcaggcaatgaatattt

SEQ ID NO: 7938028 - DNA, 22 bp, Homo sapiens
aatgttattacacttgtgaaat

SEQ ID NO: 7938029 - DNA, 22 bp, Homo sapiens
aatgttattacacttgtgaaat

SEQ ID NO: 7938030 - DNA, 20 bp, Homo sapiens
aactttagacataatctctt

SEQ ID NO: 7938031 - DNA, 22 bp, Homo sapiens
aactttattgttaggggctaaa

SEQ ID NO: 7938032 - DNA, 22 bp, Homo sapiens
aactttattgttaggggctaaa

SEQ ID NO: 7938033 - DNA, 22 bp, Homo sapiens
aactttatcggaacaggtactc

SEQ ID NO: 7938034 - DNA, 22 bp, Homo sapiens
aactttatcggaacaggtactc

SEQ ID NO: 7938035 - DNA, 22 bp, Homo sapiens
aactttagctatttaatctgat

SEQ ID NO: 7938036 - DNA, 22 bp, Homo sapiens
aactttagctatttaatctgat

SEQ ID NO: 7938037 - DNA, 20 bp, Homo sapiens
aactttctcccattggactg

SEQ ID NO: 7938038 - DNA, 22 bp, Homo sapiens
aactttctctacggcatttgtt

SEQ ID NO: 7938039 - DNA, 22 bp, Homo sapiens
aactttctctacggcatttgtt

SEQ ID NO: 7938040 - DNA, 22 bp, Homo sapiens
aactttctataggttgggattt

SEQ ID NO: 7938041 - DNA, 22 bp, Homo sapiens
aactttctccagtgccaactat

SEQ ID NO: 7938042 - DNA, 22 bp, Homo sapiens
aactttctgaaaagcttgatca

SEQ ID NO: 7938043 - DNA, 22 bp, Homo sapiens
aactttctgaaaagcttgatca

SEQ ID NO: 7938044 - DNA, 22 bp, Homo sapiens
aactttctgaaaagcttgatca

SEQ ID NO: 7938045 - DNA, 22 bp, Homo sapiens
aactttctggctttggggagag

SEQ ID NO: 7938046 - DNA, 22 bp, Homo sapiens
aatgttttgtatgcctctgagc

SEQ ID NO: 7938047 - DNA, 22 bp, Homo sapiens
aatgttttgtatgcctctgagc

SEQ ID NO: 7938048 - DNA, 22 bp, Homo sapiens
aattacttaagagaaactttga

SEQ ID NO: 7938049 - DNA, 22 bp, Homo sapiens
aattacttaagagaaactttga

SEQ ID NO: 7938050 - DNA, 22 bp, Homo sapiens
aattagaaccagaagccatatt

SEQ ID NO: 7938051 - DNA, 22 bp, Homo sapiens
aattagaaccagaagccatatt

SEQ ID NO: 7938052 - DNA, 22 bp, Homo sapiens
aattagaaccagaagccatatt

SEQ ID NO: 7938053 - DNA, 22 bp, Homo sapiens
aattagaagctgttagcaaaat

SEQ ID NO: 7938054 - DNA, 22 bp, Homo sapiens
aattagaagctgttagcaaaat

SEQ ID NO: 7938055 - DNA, 22 bp, Homo sapiens
aattagaagctgttagcaaaat

SEQ ID NO: 7938056 - DNA, 22 bp, Homo sapiens
aattagaaccagaagccatatt

SEQ ID NO: 7938057 - DNA, 22 bp, Homo sapiens
aattagaaccagaagccatatt

SEQ ID NO: 7938058 - DNA, 22 bp, Homo sapiens
aattagaaccagaagccatatt

SEQ ID NO: 7938059 - DNA, 22 bp, Homo sapiens
aattacttaagagaaactttga

SEQ ID NO: 7938060 - DNA, 22 bp, Homo sapiens
aatgttttttggtctgatgaat

SEQ ID NO: 7938061 - DNA, 22 bp, Homo sapiens
aattactgtaattttctacagc

SEQ ID NO: 7938062 - DNA, 22 bp, Homo sapiens
aattactgtaattttctacagc

SEQ ID NO: 7938063 - DNA, 22 bp, Homo sapiens
aattactgtaattttctacagc

SEQ ID NO: 7938064 - DNA, 22 bp, Homo sapiens
aattactgtaattttctacagc

SEQ ID NO: 7938065 - DNA, 22 bp, Homo sapiens
aattactgtaattttctacagc

SEQ ID NO: 7938066 - DNA, 22 bp, Homo sapiens
aatgtcttttaaatgttgaggt

SEQ ID NO: 7938067 - DNA, 21 bp, Homo sapiens
aatgtctttgtccatgctctg

SEQ ID NO: 7938068 - DNA, 22 bp, Homo sapiens
aatgtcttttaaatgttgaggt

SEQ ID NO: 7938069 - DNA, 22 bp, Homo sapiens
aatgtcttttaacctctggact

SEQ ID NO: 7938070 - DNA, 22 bp, Homo sapiens
aatgtcttttaacctctggact

SEQ ID NO: 7938071 - DNA, 21 bp, Homo sapiens
aatgtctttgtccatgctctg

SEQ ID NO: 7938072 - DNA, 22 bp, Homo sapiens
aatgtctttgccagggtcgggc

SEQ ID NO: 7938073 - DNA, 22 bp, Homo sapiens
aatgtctttcttggttctggtt

SEQ ID NO: 7938074 - DNA, 22 bp, Homo sapiens
aatgtctttgcaggagggattg

SEQ ID NO: 7938075 - DNA, 22 bp, Homo sapiens
aatgtcttttcccttactttcc

SEQ ID NO: 7938076 - DNA, 22 bp, Homo sapiens
aatgtcttttaacctctggact

SEQ ID NO: 7938077 - DNA, 22 bp, Homo sapiens
aatgtcttttgatacaagttac

SEQ ID NO: 7938078 - DNA, 22 bp, Homo sapiens
aatgtcttttgatacaagttac

SEQ ID NO: 7938079 - DNA, 22 bp, Homo sapiens
aatgtcttttgatacaagttac

SEQ ID NO: 7938080 - DNA, 22 bp, Homo sapiens
aatgtcttttgatacaagttac

SEQ ID NO: 7938081 - DNA, 22 bp, Homo sapiens
aatgtcttttgatacaagttac

SEQ ID NO: 7938082 - DNA, 22 bp, Homo sapiens
aatgtgtttatttagtgattta

SEQ ID NO: 7938083 - DNA, 22 bp, Homo sapiens
aatgtgttttatgagagaatat

SEQ ID NO: 7938084 - DNA, 22 bp, Homo sapiens
aatgtgttttcactgaagattc

SEQ ID NO: 7938085 - DNA, 22 bp, Homo sapiens
aatgttaaaaccttcagtgctt

SEQ ID NO: 7938086 - DNA, 22 bp, Homo sapiens
aatgttaaaaccttcagtgctt

SEQ ID NO: 7938087 - DNA, 22 bp, Homo sapiens
aatgttaaaaccttcagtgctt

SEQ ID NO: 7938088 - DNA, 22 bp, Homo sapiens
aatgtgaaaccgcacagaataa

SEQ ID NO: 7938089 - DNA, 22 bp, Homo sapiens
aatgtgaaaccgcacagaataa

SEQ ID NO: 7938090 - DNA, 22 bp, Homo sapiens
aatgtcttttgcagttcaagat

SEQ ID NO: 7938091 - DNA, 22 bp, Homo sapiens
aatgtcttttgcagttcaagat

SEQ ID NO: 7938092 - DNA, 22 bp, Homo sapiens
aatgtgaaaccgcacagaataa

SEQ ID NO: 7938093 - DNA, 22 bp, Homo sapiens
aatgtgaactttgtcatgtaac

SEQ ID NO: 7938094 - DNA, 22 bp, Homo sapiens
aatgtgaactttgtcatgtaac

SEQ ID NO: 7938095 - DNA, 22 bp, Homo sapiens
aatgttaatgtgtttgcttatg

SEQ ID NO: 7938096 - DNA, 22 bp, Homo sapiens
aatgttaagtttagattataac

SEQ ID NO: 7938097 - DNA, 22 bp, Homo sapiens
aatgttaatgtgtttgcttatg

SEQ ID NO: 7938098 - DNA, 22 bp, Homo sapiens
aatgttaatgtgtttgcttatg

SEQ ID NO: 7938099 - DNA, 22 bp, Homo sapiens
aatgttaagtttagattataac

SEQ ID NO: 7938100 - DNA, 22 bp, Homo sapiens
aatgttaattcacagccaaata

SEQ ID NO: 7938101 - DNA, 22 bp, Homo sapiens
aatgttaattcacagccaaata

SEQ ID NO: 7938102 - DNA, 22 bp, Homo sapiens
aatgttaattcacagccaaata

SEQ ID NO: 7938103 - DNA, 22 bp, Homo sapiens
aatgttaattcacagccaaata

SEQ ID NO: 7938104 - DNA, 22 bp, Homo sapiens
aatgttaatttactgtcttcat

SEQ ID NO: 7938105 - DNA, 22 bp, Homo sapiens
aatgttaatttactgtcttcat

SEQ ID NO: 7938106 - DNA, 22 bp, Homo sapiens
aatgttaatttactgtcttcat

SEQ ID NO: 7938107 - DNA, 22 bp, Homo sapiens
aatgttacgatcaacaacacat

SEQ ID NO: 7938108 - DNA, 22 bp, Homo sapiens
aatgttacgatcaacaacacat

SEQ ID NO: 7938109 - DNA, 22 bp, Homo sapiens
aatgttacgatcaacaacacat

SEQ ID NO: 7938110 - DNA, 22 bp, Homo sapiens
aatgttacaggacaaagatgga

SEQ ID NO: 7938111 - DNA, 22 bp, Homo sapiens
aatgttacataacccattgtcc

SEQ ID NO: 7938112 - DNA, 22 bp, Homo sapiens
aatgttacataacccattgtcc

SEQ ID NO: 7938113 - DNA, 22 bp, Homo sapiens
aatgttacaggacaaagatgga

SEQ ID NO: 7938114 - DNA, 22 bp, Homo sapiens
aatgttagattcctccacctag

SEQ ID NO: 7938115 - DNA, 22 bp, Homo sapiens
aatgttagtaacttgagtattt

SEQ ID NO: 7938116 - DNA, 22 bp, Homo sapiens
aatgttatgtggttcaacttaa

SEQ ID NO: 7938117 - DNA, 22 bp, Homo sapiens
aatgtattctgggaaaatgtta

SEQ ID NO: 7938118 - DNA, 22 bp, Homo sapiens
aatgtattcttcaaccttgcta

SEQ ID NO: 7938119 - DNA, 22 bp, Homo sapiens
aatgtattctgggaaaatgtta

SEQ ID NO: 7938120 - DNA, 22 bp, Homo sapiens
aatgtattctgggaaaatgtta

SEQ ID NO: 7938121 - DNA, 22 bp, Homo sapiens
aatgtattctgggaaaatgtta

SEQ ID NO: 7938122 - DNA, 22 bp, Homo sapiens
aatgtattctgggaaaatgtta

SEQ ID NO: 7938123 - DNA, 22 bp, Homo sapiens
aatgtattctgggaaaatgtta

SEQ ID NO: 7938124 - DNA, 22 bp, Homo sapiens
aatgtacaataagacaaagagg

SEQ ID NO: 7938125 - DNA, 22 bp, Homo sapiens
aactgaaacggtgatcttttaa

SEQ ID NO: 7938126 - DNA, 22 bp, Homo sapiens
aatgtattctctttataagata

SEQ ID NO: 7938127 - DNA, 22 bp, Homo sapiens
aatgtattctgggaaaatgtta

SEQ ID NO: 7938128 - DNA, 22 bp, Homo sapiens
aatgtacaataagacaaagagg

SEQ ID NO: 7938129 - DNA, 22 bp, Homo sapiens
aactctttctgaggattgggag

SEQ ID NO: 7938130 - DNA, 22 bp, Homo sapiens
aactctttctgaggattgggag

SEQ ID NO: 7938131 - DNA, 22 bp, Homo sapiens
aactctttggtctcaggaaagg

SEQ ID NO: 7938132 - DNA, 22 bp, Homo sapiens
aactctttgtggacattaaatt

SEQ ID NO: 7938133 - DNA, 22 bp, Homo sapiens
aactctttgtggacattaaatt

SEQ ID NO: 7938134 - DNA, 22 bp, Homo sapiens
aactctttttttaagtgtagcc

SEQ ID NO: 7938135 - DNA, 22 bp, Homo sapiens
aactctttacatgtttgattca

SEQ ID NO: 7938136 - DNA, 22 bp, Homo sapiens
aactcttcttataatgcgtgat

SEQ ID NO: 7938137 - DNA, 22 bp, Homo sapiens
aactcttcttataatgcgtgat

SEQ ID NO: 7938138 - DNA, 22 bp, Homo sapiens
aactctgtgtaggaaccaggtc

SEQ ID NO: 7938139 - DNA, 22 bp, Homo sapiens
aactcttaattttcatgaaatg

SEQ ID NO: 7938140 - DNA, 22 bp, Homo sapiens
aactctatttaccctactaaac

SEQ ID NO: 7938141 - DNA, 22 bp, Homo sapiens
aactctcttgggagtacctgga

SEQ ID NO: 7938142 - DNA, 22 bp, Homo sapiens
aactcctctctggtggttcgtc

SEQ ID NO: 7938143 - DNA, 23 bp, Homo sapiens
aactcctgaatcgtgagccatct

SEQ ID NO: 7938144 - DNA, 20 bp, Homo sapiens
aactcctagcctcaagtgat

SEQ ID NO: 7938145 - DNA, 20 bp, Homo sapiens
aactcctagcctcaagtgat

SEQ ID NO: 7938146 - DNA, 20 bp, Homo sapiens
aactcctagcctcaagtgat

SEQ ID NO: 7938147 - DNA, 22 bp, Homo sapiens
aactcctatgacccactgaact

SEQ ID NO: 7938148 - DNA, 22 bp, Homo sapiens
aactctatttaccctactaaac

SEQ ID NO: 7938149 - DNA, 22 bp, Homo sapiens
aactctatttaccctactaaac

SEQ ID NO: 7938150 - DNA, 22 bp, Homo sapiens
aactctatttaccctactaaac

SEQ ID NO: 7938151 - DNA, 22 bp, Homo sapiens
aactctagtgctccttggagga

SEQ ID NO: 7938152 - DNA, 22 bp, Homo sapiens
aactctagggaggcaggaagca

SEQ ID NO: 7938153 - DNA, 22 bp, Homo sapiens
aactccttaatgaagtccagtt

SEQ ID NO: 7938154 - DNA, 22 bp, Homo sapiens
aatgtcaacacaagagaaatgc

SEQ ID NO: 7938155 - DNA, 22 bp, Homo sapiens
aatgtcaacacaagagaaatgc

SEQ ID NO: 7938156 - DNA, 22 bp, Homo sapiens
aatgtcaacacaagagaaatgc

SEQ ID NO: 7938157 - DNA, 22 bp, Homo sapiens
aatgtcaaatgagaggggagaa

SEQ ID NO: 7938158 - DNA, 22 bp, Homo sapiens
aatgtcaacacaagagaaatgc

SEQ ID NO: 7938159 - DNA, 22 bp, Homo sapiens
aatgtcaaaggctatacattca

SEQ ID NO: 7938160 - DNA, 22 bp, Homo sapiens
aatgtcaaagtgctttgcaaac

SEQ ID NO: 7938161 - DNA, 22 bp, Homo sapiens
aatgtcaaacagagcagagcta

SEQ ID NO: 7938162 - DNA, 22 bp, Homo sapiens
aatgtcaaaatggaatgagact

SEQ ID NO: 7938163 - DNA, 22 bp, Homo sapiens
aatgtcaaaatggaatgagact

SEQ ID NO: 7938164 - DNA, 22 bp, Homo sapiens
aatgtcaaaggctatacattca

SEQ ID NO: 7938165 - DNA, 22 bp, Homo sapiens
aatgtcaaaggctatacattca

SEQ ID NO: 7938166 - DNA, 22 bp, Homo sapiens
aatgtattttgggagtttcttt

SEQ ID NO: 7938167 - DNA, 22 bp, Homo sapiens
aatgtattttgggagtttcttt

SEQ ID NO: 7938168 - DNA, 22 bp, Homo sapiens
aatgtcaaaatggaatgagact

SEQ ID NO: 7938169 - DNA, 22 bp, Homo sapiens
aatgtcaaaataattgatttgt

SEQ ID NO: 7938170 - DNA, 22 bp, Homo sapiens
aatgtcaaaataattgatttgt

SEQ ID NO: 7938171 - DNA, 20 bp, Homo sapiens
aatgtattgttttgtttcag

SEQ ID NO: 7938172 - DNA, 20 bp, Homo sapiens
aatgtattgttttgtttcag

SEQ ID NO: 7938173 - DNA, 20 bp, Homo sapiens
aatgtattgttttgtttcag

SEQ ID NO: 7938174 - DNA, 22 bp, Homo sapiens
aatgtatttgatgtattagcct

SEQ ID NO: 7938175 - DNA, 20 bp, Homo sapiens
aatgtattgttttgtttcag

SEQ ID NO: 7938176 - DNA, 22 bp, Homo sapiens
aatgtatttgatgtattagcct

SEQ ID NO: 7938177 - DNA, 22 bp, Homo sapiens
aatgtattttgggagtttcttt

SEQ ID NO: 7938178 - DNA, 22 bp, Homo sapiens
aatgtattcttcaaccttgcta

SEQ ID NO: 7938179 - DNA, 22 bp, Homo sapiens
aatgtatttgatgtattagcct

SEQ ID NO: 7938180 - DNA, 22 bp, Homo sapiens
aatgtctttaaagtgcaataga

SEQ ID NO: 7938181 - DNA, 22 bp, Homo sapiens
aatgtctttacttttgtgggca

SEQ ID NO: 7938182 - DNA, 22 bp, Homo sapiens
aatgtcttggatacagaggttg

SEQ ID NO: 7938183 - DNA, 22 bp, Homo sapiens
aatgtcttggatacagaggttg

SEQ ID NO: 7938184 - DNA, 22 bp, Homo sapiens
aatgtctttaaagtgcaataga

SEQ ID NO: 7938185 - DNA, 22 bp, Homo sapiens
aatgtctttaaagtgcaataga

SEQ ID NO: 7938186 - DNA, 22 bp, Homo sapiens
aatgtctttctcataacagata

SEQ ID NO: 7938187 - DNA, 22 bp, Homo sapiens
aatgtctttctcataacagata

SEQ ID NO: 7938188 - DNA, 22 bp, Homo sapiens
aatgtctttctcataacagata

SEQ ID NO: 7938189 - DNA, 22 bp, Homo sapiens
aatgtctttatttcaggtttac

SEQ ID NO: 7938190 - DNA, 22 bp, Homo sapiens
aatgtctttctcataacagata

SEQ ID NO: 7938191 - DNA, 22 bp, Homo sapiens
aatgtctttctgttctatgaga

SEQ ID NO: 7938192 - DNA, 22 bp, Homo sapiens
aatgtctttctgttctatgaga

SEQ ID NO: 7938193 - DNA, 20 bp, Homo sapiens
aatgtcttgagacatttcag

SEQ ID NO: 7938194 - DNA, 20 bp, Homo sapiens
aatgtcttgagacatttcag

SEQ ID NO: 7938195 - DNA, 22 bp, Homo sapiens
aatgtcaatctcagagaacaca

SEQ ID NO: 7938196 - DNA, 22 bp, Homo sapiens
aatgtcaatctcagagaacaca

SEQ ID NO: 7938197 - DNA, 22 bp, Homo sapiens
aatgtcttcttcagctgaataa

SEQ ID NO: 7938198 - DNA, 22 bp, Homo sapiens
aatgtcttctcttgttgaattt

SEQ ID NO: 7938199 - DNA, 22 bp, Homo sapiens
aatgtcttgagaagagaaatct

SEQ ID NO: 7938200 - DNA, 22 bp, Homo sapiens
aatgtcaagggaagcaggaaat

SEQ ID NO: 7938201 - DNA, 22 bp, Homo sapiens
aatgtcaagggaagcaggaaat

SEQ ID NO: 7938202 - DNA, 22 bp, Homo sapiens
aatgtcaagggaagcaggaaat

SEQ ID NO: 7938203 - DNA, 22 bp, Homo sapiens
aatgtcaacacttggtatgtca

SEQ ID NO: 7938204 - DNA, 22 bp, Homo sapiens
aatgtcaacacttggtatgtca

SEQ ID NO: 7938205 - DNA, 22 bp, Homo sapiens
aatgtcaacacaagagaaatgc

SEQ ID NO: 7938206 - DNA, 22 bp, Homo sapiens
aatgtcaacacttggtatgtca

SEQ ID NO: 7938207 - DNA, 22 bp, Homo sapiens
aatgtcaataactttatccctc

SEQ ID NO: 7938208 - DNA, 22 bp, Homo sapiens
aatgtcaagtagccaatgcttc

SEQ ID NO: 7938209 - DNA, 22 bp, Homo sapiens
aagagtggagctggaaagtggg

SEQ ID NO: 7938210 - DNA, 22 bp, Homo sapiens
aagagtggagctggaaagtggg

SEQ ID NO: 7938211 - DNA, 22 bp, Homo sapiens
aagagttaaatgaatgagtggg

SEQ ID NO: 7938212 - DNA, 22 bp, Homo sapiens
aagagtgtgaggttgtgctttt

SEQ ID NO: 7938213 - DNA, 21 bp, Homo sapiens
aagagtggctgaggaggtgat

SEQ ID NO: 7938214 - DNA, 22 bp, Homo sapiens
aagagtgagtatttcctgatta

SEQ ID NO: 7938215 - DNA, 22 bp, Homo sapiens
aagagtggagctggaaagtggg

SEQ ID NO: 7938216 - DNA, 22 bp, Homo sapiens
aagagtggagctggaaagtggg

SEQ ID NO: 7938217 - DNA, 20 bp, Homo sapiens
aagagtctttactgagctaa

SEQ ID NO: 7938218 - DNA, 20 bp, Homo sapiens
aagagtctttactgagctaa

SEQ ID NO: 7938219 - DNA, 20 bp, Homo sapiens
aagagtctttactgagctaa

SEQ ID NO: 7938220 - DNA, 22 bp, Homo sapiens
aagagtctattggaactagaca

SEQ ID NO: 7938221 - DNA, 22 bp, Homo sapiens
aagagtctattggaactagaca

SEQ ID NO: 7938222 - DNA, 22 bp, Homo sapiens
aagagtttaattttgtctagac

SEQ ID NO: 7938223 - DNA, 22 bp, Homo sapiens
aagagtttaattttgtctagac

SEQ ID NO: 7938224 - DNA, 22 bp, Homo sapiens
aagagtttaccagtgctgcttc

SEQ ID NO: 7938225 - DNA, 22 bp, Homo sapiens
aagagttatacctatttctaac

SEQ ID NO: 7938226 - DNA, 22 bp, Homo sapiens
aagagttagctcaataacttga

SEQ ID NO: 7938227 - DNA, 22 bp, Homo sapiens
aagagttatacctatttctaac

SEQ ID NO: 7938228 - DNA, 22 bp, Homo sapiens
aagagttagctcaataacttga

SEQ ID NO: 7938229 - DNA, 22 bp, Homo sapiens
aagagttagctcaataacttga

SEQ ID NO: 7938230 - DNA, 22 bp, Homo sapiens
aagagttaagcaacagatacca

SEQ ID NO: 7938231 - DNA, 22 bp, Homo sapiens
aagagtaaattcaggactttaa

SEQ ID NO: 7938232 - DNA, 22 bp, Homo sapiens
aagagtaaattcaggactttaa

SEQ ID NO: 7938233 - DNA, 22 bp, Homo sapiens
aagagtatagctttaggattga

SEQ ID NO: 7938234 - DNA, 19 bp, Homo sapiens
aagagtcacaggcagccct

SEQ ID NO: 7938235 - DNA, 19 bp, Homo sapiens
aagagtcacaggcagccct

SEQ ID NO: 7938236 - DNA, 22 bp, Homo sapiens
aagagtatttggtatagaacac

SEQ ID NO: 7938237 - DNA, 22 bp, Homo sapiens
aagagtcatagagacattgatt

SEQ ID NO: 7938238 - DNA, 22 bp, Homo sapiens
aagagtcatagagacattgatt

SEQ ID NO: 7938239 - DNA, 22 bp, Homo sapiens
aagagtcatagagacattgatt

SEQ ID NO: 7938240 - DNA, 22 bp, Homo sapiens
aagagtcagcttctgtatgggt

SEQ ID NO: 7938241 - DNA, 22 bp, Homo sapiens
aagagtcagcttctgtatgggt

SEQ ID NO: 7938242 - DNA, 22 bp, Homo sapiens
aagagtctattggaactagaca

SEQ ID NO: 7938243 - DNA, 22 bp, Homo sapiens
aagagtcccaaaatgattctta

SEQ ID NO: 7938244 - DNA, 22 bp, Homo sapiens
aagagtaaatgtctaattagga

SEQ ID NO: 7938245 - DNA, 22 bp, Homo sapiens
aagagtaaagcaaagcacttgt

SEQ ID NO: 7938246 - DNA, 22 bp, Homo sapiens
aagaggtttcatgattttctta

SEQ ID NO: 7938247 - DNA, 22 bp, Homo sapiens
aagagtaaagcaaagcacttgt

SEQ ID NO: 7938248 - DNA, 22 bp, Homo sapiens
aagaggttgtctgtgatgagtt

SEQ ID NO: 7938249 - DNA, 22 bp, Homo sapiens
aagaggttgtctgtgatgagtt

SEQ ID NO: 7938250 - DNA, 22 bp, Homo sapiens
aagaggttgtctgtgatgagtt

SEQ ID NO: 7938251 - DNA, 22 bp, Homo sapiens
aagaggttgtctgtgatgagtt

SEQ ID NO: 7938252 - DNA, 22 bp, Homo sapiens
aagaggttgtacctaaagtgtt

SEQ ID NO: 7938253 - DNA, 22 bp, Homo sapiens
aagaggttgtctgtgatgagtt

SEQ ID NO: 7938254 - DNA, 22 bp, Homo sapiens
acactaaatgagtctacagtac

SEQ ID NO: 7938255 - DNA, 22 bp, Homo sapiens
acactaatcttttatttggttt

SEQ ID NO: 7938256 - DNA, 22 bp, Homo sapiens
acactaaggttggagtcacagt

SEQ ID NO: 7938257 - DNA, 23 bp, Homo sapiens
acactaaatgtgaaggagcaaag

SEQ ID NO: 7938258 - DNA, 22 bp, Homo sapiens
acactaaggttggagtcacagt

SEQ ID NO: 7938259 - DNA, 23 bp, Homo sapiens
acactaaatgtgaaggagcaaag

SEQ ID NO: 7938260 - DNA, 22 bp, Homo sapiens
acacggcactttaggaaggggc

SEQ ID NO: 7938261 - DNA, 22 bp, Homo sapiens
acacggcactttaggaaggggc

SEQ ID NO: 7938262 - DNA, 22 bp, Homo sapiens
acacggcactttaggaaggggc

SEQ ID NO: 7938263 - DNA, 22 bp, Homo sapiens
acacggcactttaggaaggggc

SEQ ID NO: 7938264 - DNA, 22 bp, Homo sapiens
acacggaaaaggagacagaggg

SEQ ID NO: 7938265 - DNA, 22 bp, Homo sapiens
acacggcactttaggaaggggc

SEQ ID NO: 7938266 - DNA, 22 bp, Homo sapiens
acacggcactttaggaaggggc

SEQ ID NO: 7938267 - DNA, 22 bp, Homo sapiens
acactagagagcaggcattccc

SEQ ID NO: 7938268 - DNA, 22 bp, Homo sapiens
acactacagggagaagactcac

SEQ ID NO: 7938269 - DNA, 22 bp, Homo sapiens
acactacagggccgggatggaa

SEQ ID NO: 7938270 - DNA, 22 bp, Homo sapiens
acactagatgccaatagcaccc

SEQ ID NO: 7938271 - DNA, 22 bp, Homo sapiens
acactacagggagaagactcac

SEQ ID NO: 7938272 - DNA, 22 bp, Homo sapiens
acactacaacagcagaggtgag

SEQ ID NO: 7938273 - DNA, 22 bp, Homo sapiens
acactaatgagaaaggaattaa

SEQ ID NO: 7938274 - DNA, 22 bp, Homo sapiens
acactaattaagctgctttact

SEQ ID NO: 7938275 - DNA, 22 bp, Homo sapiens
acactaattaagctgctttact

SEQ ID NO: 7938276 - DNA, 22 bp, Homo sapiens
acactacaatctcagaactata

SEQ ID NO: 7938277 - DNA, 22 bp, Homo sapiens
acactacaatctcagaactata

SEQ ID NO: 7938278 - DNA, 22 bp, Homo sapiens
acactacaatctcagaactata

SEQ ID NO: 7938279 - DNA, 22 bp, Homo sapiens
acactacaatctcagaactata

SEQ ID NO: 7938280 - DNA, 22 bp, Homo sapiens
acacctttgccccaagtcatag

SEQ ID NO: 7938281 - DNA, 22 bp, Homo sapiens
acacctttgccccaagtcatag

SEQ ID NO: 7938282 - DNA, 22 bp, Homo sapiens
acacctttgtgaagtgatgatg

SEQ ID NO: 7938283 - DNA, 22 bp, Homo sapiens
acacgcataaatacacagtcta

SEQ ID NO: 7938284 - DNA, 23 bp, Homo sapiens
acacctgtgctgtagtcactaca

SEQ ID NO: 7938285 - DNA, 23 bp, Homo sapiens
acacctgtgctgtagtcactaca

SEQ ID NO: 7938286 - DNA, 22 bp, Homo sapiens
acacctggtctttgcatgagca

SEQ ID NO: 7938287 - DNA, 22 bp, Homo sapiens
acacccttgtccatagcagatg

SEQ ID NO: 7938288 - DNA, 22 bp, Homo sapiens
acacccttgtccatagcagatg

SEQ ID NO: 7938289 - DNA, 23 bp, Homo sapiens
aagagtttagagtcttgcagagt

SEQ ID NO: 7938290 - DNA, 22 bp, Homo sapiens
acacccaggctggcgtgcagtg

SEQ ID NO: 7938291 - DNA, 22 bp, Homo sapiens
acacatttctctttttgtaagt

SEQ ID NO: 7938292 - DNA, 22 bp, Homo sapiens
aagaggtggaacagcaattcgt

SEQ ID NO: 7938293 - DNA, 20 bp, Homo sapiens
aagaggtgataacaggtgag

SEQ ID NO: 7938294 - DNA, 22 bp, Homo sapiens
aagaggtcacactaggtcctag

SEQ ID NO: 7938295 - DNA, 19 bp, Homo sapiens
aagagggaaagtgctatgc

SEQ ID NO: 7938296 - DNA, 22 bp, Homo sapiens
aagaggctttcagtgaacttgt

SEQ ID NO: 7938297 - DNA, 19 bp, Homo sapiens
aagagggaaagtgctatgc

SEQ ID NO: 7938298 - DNA, 22 bp, Homo sapiens
acacacaggtaaaggagcctgg

SEQ ID NO: 7938299 - DNA, 22 bp, Homo sapiens
acacacaggtaaaggagcctgg

SEQ ID NO: 7938300 - DNA, 22 bp, Homo sapiens
acacacatgcatgcttgccatt

SEQ ID NO: 7938301 - DNA, 22 bp, Homo sapiens
acacacatgcatgcttgccatt

SEQ ID NO: 7938302 - DNA, 22 bp, Homo sapiens
acacacatgcatgcttgccatt

SEQ ID NO: 7938303 - DNA, 22 bp, Homo sapiens
acacacatgcatgcttgccatt

SEQ ID NO: 7938304 - DNA, 22 bp, Homo sapiens
acacacaggtaaaggagcctgg

SEQ ID NO: 7938305 - DNA, 22 bp, Homo sapiens
acacacaggtaaaggagcctgg

SEQ ID NO: 7938306 - DNA, 22 bp, Homo sapiens
acacacagcgcctaccatgtgc

SEQ ID NO: 7938307 - DNA, 22 bp, Homo sapiens
acacacaggtaaaggagcctgg

SEQ ID NO: 7938308 - DNA, 22 bp, Homo sapiens
acacacagcgcctaccatgtgc

SEQ ID NO: 7938309 - DNA, 22 bp, Homo sapiens
acacacagcgcctaccatgtgc

SEQ ID NO: 7938310 - DNA, 22 bp, Homo sapiens
acacacagcgcctaccatgtgc

SEQ ID NO: 7938311 - DNA, 22 bp, Homo sapiens
acacacagcgcctaccatgtgc

SEQ ID NO: 7938312 - DNA, 22 bp, Homo sapiens
acacacagcgcctaccatgtgc

SEQ ID NO: 7938313 - DNA, 22 bp, Homo sapiens
acacacagagtttatacaggca

SEQ ID NO: 7938314 - DNA, 22 bp, Homo sapiens
acacacagcgcctaccatgtgc

SEQ ID NO: 7938315 - DNA, 22 bp, Homo sapiens
acacacagcgcctaccatgtgc

SEQ ID NO: 7938316 - DNA, 22 bp, Homo sapiens
acacacagagtttatacaggca

SEQ ID NO: 7938317 - DNA, 22 bp, Homo sapiens
acacacagagtttatacaggca

SEQ ID NO: 7938318 - DNA, 22 bp, Homo sapiens
acacacagagtttatacaggca

SEQ ID NO: 7938319 - DNA, 22 bp, Homo sapiens
acacacagagtttatacaggca

SEQ ID NO: 7938320 - DNA, 20 bp, Homo sapiens
acacacagagacatgcgcat

SEQ ID NO: 7938321 - DNA, 20 bp, Homo sapiens
acacacagagacatgcgcat

SEQ ID NO: 7938322 - DNA, 22 bp, Homo sapiens
acacacagaaggaagccccact

SEQ ID NO: 7938323 - DNA, 20 bp, Homo sapiens
acacacagagacatgcgcat

SEQ ID NO: 7938324 - DNA, 22 bp, Homo sapiens
aagaggcatctcagcttcctct

SEQ ID NO: 7938325 - DNA, 21 bp, Homo sapiens
aagaggcatcactatttgtgt

SEQ ID NO: 7938326 - DNA, 21 bp, Homo sapiens
aagaggcatcactatttgtgt

SEQ ID NO: 7938327 - DNA, 22 bp, Homo sapiens
aagaggcatctcagcttcctct

SEQ ID NO: 7938328 - DNA, 21 bp, Homo sapiens
aagaggcatcactatttgtgt

SEQ ID NO: 7938329 - DNA, 22 bp, Homo sapiens
aagaggcatctcagcttcctct

SEQ ID NO: 7938330 - DNA, 22 bp, Homo sapiens
aagacatttatttgaatcaatt

SEQ ID NO: 7938331 - DNA, 22 bp, Homo sapiens
aagaccagggtgggtacgttcc

SEQ ID NO: 7938332 - DNA, 22 bp, Homo sapiens
aagaccagaggatataaccaga

SEQ ID NO: 7938333 - DNA, 22 bp, Homo sapiens
aagacatttatttgaatcaatt

SEQ ID NO: 7938334 - DNA, 22 bp, Homo sapiens
aagacatttatgaaaagtgctg

SEQ ID NO: 7938335 - DNA, 22 bp, Homo sapiens
aagacatttatgaaaagtgctg

SEQ ID NO: 7938336 - DNA, 22 bp, Homo sapiens
aagaggaggattgatgtgggag

SEQ ID NO: 7938337 - DNA, 22 bp, Homo sapiens
aagaggaggattgatgtgggag

SEQ ID NO: 7938338 - DNA, 22 bp, Homo sapiens
aagaggaagtctccatggagag

SEQ ID NO: 7938339 - DNA, 22 bp, Homo sapiens
aagaggaagtctccatggagag

SEQ ID NO: 7938340 - DNA, 22 bp, Homo sapiens
aagaggaagtctccatggagag

SEQ ID NO: 7938341 - DNA, 21 bp, Homo sapiens
aagaggaagcattatggcata

SEQ ID NO: 7938342 - DNA, 21 bp, Homo sapiens
aagaggaagcattatggcata

SEQ ID NO: 7938343 - DNA, 22 bp, Homo sapiens
aagaggaagtctccatggagag

SEQ ID NO: 7938344 - DNA, 23 bp, Homo sapiens
aagaggaggccctgctcccgtcc

SEQ ID NO: 7938345 - DNA, 19 bp, Homo sapiens
aagaggcaaccctcgagcc

SEQ ID NO: 7938346 - DNA, 22 bp, Homo sapiens
aagaggagtagatgtggttggt

SEQ ID NO: 7938347 - DNA, 19 bp, Homo sapiens
aagaggcaaccctcgagcc

SEQ ID NO: 7938348 - DNA, 19 bp, Homo sapiens
aagaggcaaccctcgagcc

SEQ ID NO: 7938349 - DNA, 19 bp, Homo sapiens
aagaggcaaccctcgagcc

SEQ ID NO: 7938350 - DNA, 22 bp, Homo sapiens
aagaggagtagatgtggttggt

SEQ ID NO: 7938351 - DNA, 22 bp, Homo sapiens
aagaggagggcagattcaaggc

SEQ ID NO: 7938352 - DNA, 22 bp, Homo sapiens
aagaggagggcagattcaaggc

SEQ ID NO: 7938353 - DNA, 22 bp, Homo sapiens
aagaggagggcagattcaaggc

SEQ ID NO: 7938354 - DNA, 22 bp, Homo sapiens
aagaggagtagatgtggttggt

SEQ ID NO: 7938355 - DNA, 22 bp, Homo sapiens
aagaggagggcagattcaaggc

SEQ ID NO: 7938356 - DNA, 22 bp, Homo sapiens
aagaggcataaaatttatatgg

SEQ ID NO: 7938357 - DNA, 22 bp, Homo sapiens
aagaggcataaaatttatatgg

SEQ ID NO: 7938358 - DNA, 21 bp, Homo sapiens
aagaggcatcactatttgtgt

SEQ ID NO: 7938359 - DNA, 21 bp, Homo sapiens
aagaggcatcactatttgtgt

SEQ ID NO: 7938360 - DNA, 22 bp, Homo sapiens
aagaggcataaaatttatatgg

SEQ ID NO: 7938361 - DNA, 22 bp, Homo sapiens
aagaggcataaaatttatatgg

SEQ ID NO: 7938362 - DNA, 22 bp, Homo sapiens
aagaggcagtggtgatgaatgg

SEQ ID NO: 7938363 - DNA, 22 bp, Homo sapiens
aagaggcagtggtgatgaatgg

SEQ ID NO: 7938364 - DNA, 22 bp, Homo sapiens
aagaggcagtggtgatgaatgg

SEQ ID NO: 7938365 - DNA, 22 bp, Homo sapiens
aagaggcagaaatatcgctgaa

SEQ ID NO: 7938366 - DNA, 22 bp, Homo sapiens
aagaggcagaaatatcgctgaa

SEQ ID NO: 7938367 - DNA, 22 bp, Homo sapiens
aagaggcagaaatatcgctgaa

SEQ ID NO: 7938368 - DNA, 22 bp, Homo sapiens
aagaggcagaaatatcgctgaa

SEQ ID NO: 7938369 - DNA, 19 bp, Homo sapiens
aagaggcaaccctcgagcc

SEQ ID NO: 7938370 - DNA, 22 bp, Homo sapiens
aagaggcagcccgctgaggctg

SEQ ID NO: 7938371 - DNA, 22 bp, Homo sapiens
aagaggcagcccgctgaggctg

SEQ ID NO: 7938372 - DNA, 22 bp, Homo sapiens
aagaggcagcccgctgaggctg

SEQ ID NO: 7938373 - DNA, 22 bp, Homo sapiens
aagaggcagcccgctgaggctg

SEQ ID NO: 7938374 - DNA, 22 bp, Homo sapiens
aagaggcagcccgctgaggctg

SEQ ID NO: 7938375 - DNA, 22 bp, Homo sapiens
aagaggcagcccgctgaggctg

SEQ ID NO: 7938376 - DNA, 19 bp, Homo sapiens
aagatttggtcattgataa

SEQ ID NO: 7938377 - DNA, 19 bp, Homo sapiens
aagatttggtcattgataa

SEQ ID NO: 7938378 - DNA, 19 bp, Homo sapiens
aagatttggtcattgataa

SEQ ID NO: 7938379 - DNA, 22 bp, Homo sapiens
aagatttggtatcagaagacct

SEQ ID NO: 7938380 - DNA, 22 bp, Homo sapiens
aagattttcagctaatggtgca

SEQ ID NO: 7938381 - DNA, 22 bp, Homo sapiens
aagattttcagctaatggtgca

SEQ ID NO: 7938382 - DNA, 22 bp, Homo sapiens
aagattttcagtgcctaaaaca

SEQ ID NO: 7938383 - DNA, 22 bp, Homo sapiens
aagattttcagtgcctaaaaca

SEQ ID NO: 7938384 - DNA, 22 bp, Homo sapiens
aagattttcagtgcctaaaaca

SEQ ID NO: 7938385 - DNA, 22 bp, Homo sapiens
aagattttctcaactgtatttg

SEQ ID NO: 7938386 - DNA, 22 bp, Homo sapiens
aagattttctcaactgtatttg

SEQ ID NO: 7938387 - DNA, 22 bp, Homo sapiens
aagcaaaaggttacacttctgg

SEQ ID NO: 7938388 - DNA, 22 bp, Homo sapiens
aagcaaaaggttacacttctgg

SEQ ID NO: 7938389 - DNA, 22 bp, Homo sapiens
aagcaaaaggttacacttctgg

SEQ ID NO: 7938390 - DNA, 22 bp, Homo sapiens
aagcaaaaggttacacttctgg

SEQ ID NO: 7938391 - DNA, 22 bp, Homo sapiens
aagcaaaaggttacacttctgg

SEQ ID NO: 7938392 - DNA, 22 bp, Homo sapiens
aagcaaaacgtgctctaggagg

SEQ ID NO: 7938393 - DNA, 22 bp, Homo sapiens
aagcaaaacgtgctctaggagg

SEQ ID NO: 7938394 - DNA, 22 bp, Homo sapiens
aagcaaaacgtgctctaggagg

SEQ ID NO: 7938395 - DNA, 22 bp, Homo sapiens
aagcaaaacgtgctctaggagg

SEQ ID NO: 7938396 - DNA, 22 bp, Homo sapiens
aagcaaaacgtgctctaggagg

SEQ ID NO: 7938397 - DNA, 22 bp, Homo sapiens
aagatttttttccacagactca

SEQ ID NO: 7938398 - DNA, 22 bp, Homo sapiens
aagatttttttccacagactca

SEQ ID NO: 7938399 - DNA, 22 bp, Homo sapiens
aagatttttttccacagactca

SEQ ID NO: 7938400 - DNA, 22 bp, Homo sapiens
aagatttttttccacagactca

SEQ ID NO: 7938401 - DNA, 22 bp, Homo sapiens
aagatttttttccacagactca

SEQ ID NO: 7938402 - DNA, 22 bp, Homo sapiens
acagaagaccagagagctaact

SEQ ID NO: 7938403 - DNA, 22 bp, Homo sapiens
acagaagaccagagagctaact

SEQ ID NO: 7938404 - DNA, 22 bp, Homo sapiens
acagaagagcacatttagtatg

SEQ ID NO: 7938405 - DNA, 22 bp, Homo sapiens
acagaagagcacatttagtatg

SEQ ID NO: 7938406 - DNA, 22 bp, Homo sapiens
acagaagaccagagagctaact

SEQ ID NO: 7938407 - DNA, 22 bp, Homo sapiens
acagaagagcacatttagtatg

SEQ ID NO: 7938408 - DNA, 22 bp, Homo sapiens
acagaagagctggctctgtgct

SEQ ID NO: 7938409 - DNA, 22 bp, Homo sapiens
acagaagagctggctctgtgct

SEQ ID NO: 7938410 - DNA, 22 bp, Homo sapiens
acagaagataactgggaccaga

SEQ ID NO: 7938411 - DNA, 22 bp, Homo sapiens
acagaagagctggctctgtgct

SEQ ID NO: 7938412 - DNA, 22 bp, Homo sapiens
acagaagataactgggaccaga

SEQ ID NO: 7938413 - DNA, 22 bp, Homo sapiens
acagaagataatgctgccttgg

SEQ ID NO: 7938414 - DNA, 22 bp, Homo sapiens
acagaagcagccgtcacagata

SEQ ID NO: 7938415 - DNA, 22 bp, Homo sapiens
acagaagcagcgcggctcttct

SEQ ID NO: 7938416 - DNA, 22 bp, Homo sapiens
aagatttcttacttattgatgc

SEQ ID NO: 7938417 - DNA, 22 bp, Homo sapiens
acagaagcagccgtcacagata

SEQ ID NO: 7938418 - DNA, 22 bp, Homo sapiens
acagaagcaaaagcaggatctt

SEQ ID NO: 7938419 - DNA, 22 bp, Homo sapiens
acagaagcaaaagcaggatctt

SEQ ID NO: 7938420 - DNA, 22 bp, Homo sapiens
acagaagataatgctgccttgg

SEQ ID NO: 7938421 - DNA, 22 bp, Homo sapiens
aagatagatgtcatcagcatat

SEQ ID NO: 7938422 - DNA, 22 bp, Homo sapiens
aagatagatgtcatcagcatat

SEQ ID NO: 7938423 - DNA, 22 bp, Homo sapiens
aagatacttcacttgccgaaat

SEQ ID NO: 7938424 - DNA, 22 bp, Homo sapiens
aagatactttgcatgcatgaag

SEQ ID NO: 7938425 - DNA, 20 bp, Homo sapiens
aagatagaatcctaactttg

SEQ ID NO: 7938426 - DNA, 22 bp, Homo sapiens
aagatactgatgatgtaggcta

SEQ ID NO: 7938427 - DNA, 22 bp, Homo sapiens
aagatactgatgatgtaggcta

SEQ ID NO: 7938428 - DNA, 20 bp, Homo sapiens
aagatactccagaaattaaa

SEQ ID NO: 7938429 - DNA, 20 bp, Homo sapiens
aagatactccagaaattaaa

SEQ ID NO: 7938430 - DNA, 22 bp, Homo sapiens
aagatacattttcttcagagaa

SEQ ID NO: 7938431 - DNA, 22 bp, Homo sapiens
aagatacattttcttcagagaa

SEQ ID NO: 7938432 - DNA, 22 bp, Homo sapiens
aagatacatcattcaggagtga

SEQ ID NO: 7938433 - DNA, 22 bp, Homo sapiens
aagatacatgttaggagcaacc

SEQ ID NO: 7938434 - DNA, 22 bp, Homo sapiens
aagatacatcattcaggagtga

SEQ ID NO: 7938435 - DNA, 22 bp, Homo sapiens
aagatacatcaaagcaaattgg

SEQ ID NO: 7938436 - DNA, 22 bp, Homo sapiens
aagatacattttcttcagagaa

SEQ ID NO: 7938437 - DNA, 22 bp, Homo sapiens
aagatacattgtttttggtagt

SEQ ID NO: 7938438 - DNA, 22 bp, Homo sapiens
acagaagaagttcaaggtgaag

SEQ ID NO: 7938439 - DNA, 22 bp, Homo sapiens
acagaagaagttcaaggtgaag

SEQ ID NO: 7938440 - DNA, 22 bp, Homo sapiens
acagaagaagttcaaggtgaag

SEQ ID NO: 7938441 - DNA, 22 bp, Homo sapiens
acagaagaagttcaaggtgaag

SEQ ID NO: 7938442 - DNA, 22 bp, Homo sapiens
acagaagaaagggaggttttgc

SEQ ID NO: 7938443 - DNA, 22 bp, Homo sapiens
acagaagaagttcaaggtgaag

SEQ ID NO: 7938444 - DNA, 22 bp, Homo sapiens
acagaagaagttcaaggtgaag

SEQ ID NO: 7938445 - DNA, 22 bp, Homo sapiens
acagaagaagttcaaggtgaag

SEQ ID NO: 7938446 - DNA, 22 bp, Homo sapiens
acagaagacagagtgttcatct

SEQ ID NO: 7938447 - DNA, 22 bp, Homo sapiens
acagaagacagagtgttcatct

SEQ ID NO: 7938448 - DNA, 22 bp, Homo sapiens
acagaagacagagtgttcatct

SEQ ID NO: 7938449 - DNA, 22 bp, Homo sapiens
acagaagaccaagaaagcttcc

SEQ ID NO: 7938450 - DNA, 22 bp, Homo sapiens
acagaagacagagtgttcatct

SEQ ID NO: 7938451 - DNA, 22 bp, Homo sapiens
acagaagaccaagaaagcttcc

SEQ ID NO: 7938452 - DNA, 22 bp, Homo sapiens
acagaagaccaagaaagcttcc

SEQ ID NO: 7938453 - DNA, 22 bp, Homo sapiens
acagaagaccaagaaagcttcc

SEQ ID NO: 7938454 - DNA, 22 bp, Homo sapiens
acagaagaccaagaaagcttcc

SEQ ID NO: 7938455 - DNA, 22 bp, Homo sapiens
acagaagaccaagaaagcttcc

SEQ ID NO: 7938456 - DNA, 19 bp, Homo sapiens
acagaaatgtaagtgagac

SEQ ID NO: 7938457 - DNA, 19 bp, Homo sapiens
acagaaatgtaagtgagac

SEQ ID NO: 7938458 - DNA, 19 bp, Homo sapiens
acagaaatgtaagtgagac

SEQ ID NO: 7938459 - DNA, 19 bp, Homo sapiens
acagaaatgtaagtgagac

SEQ ID NO: 7938460 - DNA, 19 bp, Homo sapiens
acagaaatgtaagtgagac

SEQ ID NO: 7938461 - DNA, 19 bp, Homo sapiens
acagaaatgtaagtgagac

SEQ ID NO: 7938462 - DNA, 22 bp, Homo sapiens
aagatatagataaaactatgca

SEQ ID NO: 7938463 - DNA, 22 bp, Homo sapiens
aagatatactattaagtaccat

SEQ ID NO: 7938464 - DNA, 22 bp, Homo sapiens
aagatatactattaagtaccat

SEQ ID NO: 7938465 - DNA, 22 bp, Homo sapiens
aagatatactattaagtaccat

SEQ ID NO: 7938466 - DNA, 22 bp, Homo sapiens
aagatataataactgttgtcat

SEQ ID NO: 7938467 - DNA, 22 bp, Homo sapiens
aagatatagataaaactatgca

SEQ ID NO: 7938468 - DNA, 22 bp, Homo sapiens
aagatatactattaagtaccat

SEQ ID NO: 7938469 - DNA, 22 bp, Homo sapiens
aagatatagataaaactatgca

SEQ ID NO: 7938470 - DNA, 22 bp, Homo sapiens
aagatatagaaagagctgggag

SEQ ID NO: 7938471 - DNA, 22 bp, Homo sapiens
aagcaaagacagtttgagtgga

SEQ ID NO: 7938472 - DNA, 22 bp, Homo sapiens
aagcaaagacagtttgagtgga

SEQ ID NO: 7938473 - DNA, 22 bp, Homo sapiens
aagcaaagacagtttgagtgga

SEQ ID NO: 7938474 - DNA, 22 bp, Homo sapiens
aagcaaagacagtttgagtgga

SEQ ID NO: 7938475 - DNA, 22 bp, Homo sapiens
aagcaaagacagtttgagtgga

SEQ ID NO: 7938476 - DNA, 22 bp, Homo sapiens
aagcaaaaggttacacttctgg

SEQ ID NO: 7938477 - DNA, 22 bp, Homo sapiens
aagcaaacaggagaagagctgt

SEQ ID NO: 7938478 - DNA, 22 bp, Homo sapiens
aagcaaacaggagaagagctgt

SEQ ID NO: 7938479 - DNA, 22 bp, Homo sapiens
aagcaaacaggagaagagctgt

SEQ ID NO: 7938480 - DNA, 22 bp, Homo sapiens
acagagcacatagattggagtt

SEQ ID NO: 7938481 - DNA, 22 bp, Homo sapiens
acagagcacatagattggagtt

SEQ ID NO: 7938482 - DNA, 17 bp, Homo sapiens
acagagcacatcaagat

SEQ ID NO: 7938483 - DNA, 22 bp, Homo sapiens
acagagctgtacatgtgccatg

SEQ ID NO: 7938484 - DNA, 17 bp, Homo sapiens
acagagcacatcaagat

SEQ ID NO: 7938485 - DNA, 22 bp, Homo sapiens
acagagctgtacatgtgccatg

SEQ ID NO: 7938486 - DNA, 17 bp, Homo sapiens
acagagcacatcaagat

SEQ ID NO: 7938487 - DNA, 17 bp, Homo sapiens
acagagcacatcaagat

SEQ ID NO: 7938488 - DNA, 17 bp, Homo sapiens
acagagcacatcaagat

SEQ ID NO: 7938489 - DNA, 22 bp, Homo sapiens
acagagcttcccagcctgagca

SEQ ID NO: 7938490 - DNA, 22 bp, Homo sapiens
acagagcttcccagcctgagca

SEQ ID NO: 7938491 - DNA, 22 bp, Homo sapiens
acagaggaagcatatagcacaa

SEQ ID NO: 7938492 - DNA, 22 bp, Homo sapiens
acagagcttcccagcctgagca

SEQ ID NO: 7938493 - DNA, 22 bp, Homo sapiens
acagagcttaggatgactccca

SEQ ID NO: 7938494 - DNA, 22 bp, Homo sapiens
acagagcttaggatgactccca

SEQ ID NO: 7938495 - DNA, 22 bp, Homo sapiens
acagagcttaattcaggagctt

SEQ ID NO: 7938496 - DNA, 22 bp, Homo sapiens
acagagctgtactacttactga

SEQ ID NO: 7938497 - DNA, 22 bp, Homo sapiens
acagagcttaattcaggagctt

SEQ ID NO: 7938498 - DNA, 22 bp, Homo sapiens
acagagcttaattcaggagctt

SEQ ID NO: 7938499 - DNA, 22 bp, Homo sapiens
acagagctgtactacttactga

SEQ ID NO: 7938500 - DNA, 22 bp, Homo sapiens
acagagcttaattcaggagctt

SEQ ID NO: 7938501 - DNA, 22 bp, Homo sapiens
acagaggacaactaggcgctca

SEQ ID NO: 7938502 - DNA, 22 bp, Homo sapiens
acagaggacaactaggcgctca

SEQ ID NO: 7938503 - DNA, 22 bp, Homo sapiens
acagaggacaactaggcgctca

SEQ ID NO: 7938504 - DNA, 22 bp, Homo sapiens
acagaggacaactaggcgctca

SEQ ID NO: 7938505 - DNA, 22 bp, Homo sapiens
acagaggaaggctgagctgccc

SEQ ID NO: 7938506 - DNA, 22 bp, Homo sapiens
acagaggaaggctgagctgccc

SEQ ID NO: 7938507 - DNA, 22 bp, Homo sapiens
acagaggaaggctgagctgccc

SEQ ID NO: 7938508 - DNA, 22 bp, Homo sapiens
acagaggaaggctgagctgccc

SEQ ID NO: 7938509 - DNA, 22 bp, Homo sapiens
acagaggaaggctgagctgccc

SEQ ID NO: 7938510 - DNA, 22 bp, Homo sapiens
acagaggaagcatatagcacaa

SEQ ID NO: 7938511 - DNA, 22 bp, Homo sapiens
acagaggaaggctgagctgccc

SEQ ID NO: 7938512 - DNA, 22 bp, Homo sapiens
acagaggaaggctgagctgccc

SEQ ID NO: 7938513 - DNA, 22 bp, Homo sapiens
aagcacagttcttagagttaca

SEQ ID NO: 7938514 - DNA, 22 bp, Homo sapiens
aagcacagttcttagagttaca

SEQ ID NO: 7938515 - DNA, 22 bp, Homo sapiens
aagcacagttcttagagttaca

SEQ ID NO: 7938516 - DNA, 22 bp, Homo sapiens
aagcacatacataataaagtcc

SEQ ID NO: 7938517 - DNA, 22 bp, Homo sapiens
aagcacatacataataaagtcc

SEQ ID NO: 7938518 - DNA, 22 bp, Homo sapiens
aagcacatcatgttgttcagac

SEQ ID NO: 7938519 - DNA, 22 bp, Homo sapiens
aagcacatcatgttgttcagac

SEQ ID NO: 7938520 - DNA, 18 bp, Homo sapiens
acagaggcagacatgtat

SEQ ID NO: 7938521 - DNA, 17 bp, Homo sapiens
acagaggcaggagtgga

SEQ ID NO: 7938522 - DNA, 18 bp, Homo sapiens
acagaggcagacatgtat

SEQ ID NO: 7938523 - DNA, 18 bp, Homo sapiens
acagaggcagacatgtat

SEQ ID NO: 7938524 - DNA, 22 bp, Homo sapiens
acagaggacaactaggcgctca

SEQ ID NO: 7938525 - DNA, 22 bp, Homo sapiens
acagatgaaacccagctagttg

SEQ ID NO: 7938526 - DNA, 22 bp, Homo sapiens
acagatgaaaaagcttgtggat

SEQ ID NO: 7938527 - DNA, 22 bp, Homo sapiens
acagatctacattgtctgaccc

SEQ ID NO: 7938528 - DNA, 22 bp, Homo sapiens
acagatcacttgactaaaatga

SEQ ID NO: 7938529 - DNA, 23 bp, Homo sapiens
acagatcatctcgaaacaactat

SEQ ID NO: 7938530 - DNA, 22 bp, Homo sapiens
acagagtcattcactgatgaag

SEQ ID NO: 7938531 - DNA, 22 bp, Homo sapiens
acagagtcatggtagtcaaagg

SEQ ID NO: 7938532 - DNA, 22 bp, Homo sapiens
acagagtcattcactgatgaag

SEQ ID NO: 7938533 - DNA, 23 bp, Homo sapiens
acagatgaaagtgtggctcagag

SEQ ID NO: 7938534 - DNA, 23 bp, Homo sapiens
acagatgaaagtgtggctcagag

SEQ ID NO: 7938535 - DNA, 22 bp, Homo sapiens
acagatgaatttatggatggaa

SEQ ID NO: 7938536 - DNA, 22 bp, Homo sapiens
acagatgaatttatggatggaa

SEQ ID NO: 7938537 - DNA, 22 bp, Homo sapiens
acagatgaattttaattgtgtt

SEQ ID NO: 7938538 - DNA, 22 bp, Homo sapiens
acagatgaattttaattgtgtt

SEQ ID NO: 7938539 - DNA, 22 bp, Homo sapiens
acagatgagactccaggacctt

SEQ ID NO: 7938540 - DNA, 22 bp, Homo sapiens
acagatgagaaggctgaccagt

SEQ ID NO: 7938541 - DNA, 22 bp, Homo sapiens
acagatgagactccaggacctt

SEQ ID NO: 7938542 - DNA, 22 bp, Homo sapiens
aagcacattaaggaacattgaa

SEQ ID NO: 7938543 - DNA, 22 bp, Homo sapiens
aagcacattaaggaacattgaa

SEQ ID NO: 7938544 - DNA, 22 bp, Homo sapiens
aagcacatgagctattcatgct

SEQ ID NO: 7938545 - DNA, 22 bp, Homo sapiens
aagcacatgagctattcatgct

SEQ ID NO: 7938546 - DNA, 22 bp, Homo sapiens
aagcacatgaaaatgtgaagct

SEQ ID NO: 7938547 - DNA, 22 bp, Homo sapiens
aagcacatctcaaacttcatct

SEQ ID NO: 7938548 - DNA, 22 bp, Homo sapiens
aagcacatctcctgtgcagaac

SEQ ID NO: 7938549 - DNA, 22 bp, Homo sapiens
aagcacatctcctgtgcagaac

SEQ ID NO: 7938550 - DNA, 20 bp, Homo sapiens
aagcacatttctacaataat

SEQ ID NO: 7938551 - DNA, 20 bp, Homo sapiens
aagcacatttctacaataat

SEQ ID NO: 7938552 - DNA, 20 bp, Homo sapiens
aagcacatttctacaataat

SEQ ID NO: 7938553 - DNA, 20 bp, Homo sapiens
aagcacatttctacaataat

SEQ ID NO: 7938554 - DNA, 22 bp, Homo sapiens
aagcacatttggaaaacatgga

SEQ ID NO: 7938555 - DNA, 22 bp, Homo sapiens
aagcacatttggaaaacatgga

SEQ ID NO: 7938556 - DNA, 22 bp, Homo sapiens
aagcacatttggaaaacatgga

SEQ ID NO: 7938557 - DNA, 22 bp, Homo sapiens
aagcacatttggaaaacatgga

SEQ ID NO: 7938558 - DNA, 22 bp, Homo sapiens
aagcacattatagctatctagg

SEQ ID NO: 7938559 - DNA, 22 bp, Homo sapiens
aagcacattatagctatctagg

SEQ ID NO: 7938560 - DNA, 22 bp, Homo sapiens
aagcacattgcctggcacatag

SEQ ID NO: 7938561 - DNA, 22 bp, Homo sapiens
aagcacattgcctggcacatag

SEQ ID NO: 7938562 - DNA, 22 bp, Homo sapiens
aagcacattgtacatttgtgct

SEQ ID NO: 7938563 - DNA, 22 bp, Homo sapiens
aagcacattgtacatttgtgct

SEQ ID NO: 7938564 - DNA, 22 bp, Homo sapiens
aagcacattgtacatttgtgct

SEQ ID NO: 7938565 - DNA, 22 bp, Homo sapiens
aatcacattacagcatatctgt

SEQ ID NO: 7938566 - DNA, 22 bp, Homo sapiens
aatcacattacagcatatctgt

SEQ ID NO: 7938567 - DNA, 22 bp, Homo sapiens
aatcacattagtgaaacactga

SEQ ID NO: 7938568 - DNA, 22 bp, Homo sapiens
aatcacattagtgaaacactga

SEQ ID NO: 7938569 - DNA, 22 bp, Homo sapiens
aatcacatttacattgctaatt

SEQ ID NO: 7938570 - DNA, 22 bp, Homo sapiens
aatcacattgaatctgctacct

SEQ ID NO: 7938571 - DNA, 22 bp, Homo sapiens
aatcacatttacattgctaatt

SEQ ID NO: 7938572 - DNA, 22 bp, Homo sapiens
aatcacattagtgaaacactga

SEQ ID NO: 7938573 - DNA, 22 bp, Homo sapiens
aatcacattgaatctgctacct

SEQ ID NO: 7938574 - DNA, 23 bp, Homo sapiens
aatcacttccctccaaatggatt

SEQ ID NO: 7938575 - DNA, 22 bp, Homo sapiens
aatcacttcagtttttggacag

SEQ ID NO: 7938576 - DNA, 22 bp, Homo sapiens
aatcacttgtaaggaattcaat

SEQ ID NO: 7938577 - DNA, 23 bp, Homo sapiens
aatcacttccctccaaatggatt

SEQ ID NO: 7938578 - DNA, 22 bp, Homo sapiens
aatcacttgtaaggaattcaat

SEQ ID NO: 7938579 - DNA, 22 bp, Homo sapiens
aatcacttgtaaggaattcaat

SEQ ID NO: 7938580 - DNA, 22 bp, Homo sapiens
aatcacttgtgccatgggtacc

SEQ ID NO: 7938581 - DNA, 22 bp, Homo sapiens
aatcacatttgcccccatattc

SEQ ID NO: 7938582 - DNA, 22 bp, Homo sapiens
aatcacttaatagctacactgg

SEQ ID NO: 7938583 - DNA, 22 bp, Homo sapiens
aatcacttaatagctacactgg

SEQ ID NO: 7938584 - DNA, 22 bp, Homo sapiens
aatcacttaatagctacactgg

SEQ ID NO: 7938585 - DNA, 22 bp, Homo sapiens
aatcacttagaacccaggaagt

SEQ ID NO: 7938586 - DNA, 22 bp, Homo sapiens
aaccagatcgactgttaacagc

SEQ ID NO: 7938587 - DNA, 22 bp, Homo sapiens
aaccagagtgacactctacaga

SEQ ID NO: 7938588 - DNA, 22 bp, Homo sapiens
aaccagagtgacactctacaga

SEQ ID NO: 7938589 - DNA, 22 bp, Homo sapiens
aaccagaggggccctgcctggg

SEQ ID NO: 7938590 - DNA, 22 bp, Homo sapiens
aatcagaaaattcagtggaatt

SEQ ID NO: 7938591 - DNA, 22 bp, Homo sapiens
aatcactttgcactcttatttg

SEQ ID NO: 7938592 - DNA, 20 bp, Homo sapiens
aatcactttgtacaggaagc

SEQ ID NO: 7938593 - DNA, 22 bp, Homo sapiens
aatcacttttctctaatgtagc

SEQ ID NO: 7938594 - DNA, 22 bp, Homo sapiens
aaccaggaattgcagggctgca

SEQ ID NO: 7938595 - DNA, 22 bp, Homo sapiens
aaccaggaattgcagggctgca

SEQ ID NO: 7938596 - DNA, 22 bp, Homo sapiens
aaccaggaattgcagggctgca

SEQ ID NO: 7938597 - DNA, 22 bp, Homo sapiens
aaccaggaattgcagggctgca

SEQ ID NO: 7938598 - DNA, 22 bp, Homo sapiens
aaccaggaaaagttatgaatag

SEQ ID NO: 7938599 - DNA, 19 bp, Homo sapiens
aaccaggaactaaagcaga

SEQ ID NO: 7938600 - DNA, 22 bp, Homo sapiens
aaccaggaagggcgcaaattat

SEQ ID NO: 7938601 - DNA, 22 bp, Homo sapiens
aaccaggaacttttgtgagagc

SEQ ID NO: 7938602 - DNA, 22 bp, Homo sapiens
aaccagctccagcctccattca

SEQ ID NO: 7938603 - DNA, 22 bp, Homo sapiens
aaccagctttgatacgcattat

SEQ ID NO: 7938604 - DNA, 22 bp, Homo sapiens
aactcatttgcatttttcctgt

SEQ ID NO: 7938605 - DNA, 22 bp, Homo sapiens
aactcatcttcgagtgaggctg

SEQ ID NO: 7938606 - DNA, 22 bp, Homo sapiens
aactcagttctttccacaatgc

SEQ ID NO: 7938607 - DNA, 22 bp, Homo sapiens
aactcatcccagtttgaccgga

SEQ ID NO: 7938608 - DNA, 22 bp, Homo sapiens
aactcatctgggtgagtttgtc

SEQ ID NO: 7938609 - DNA, 22 bp, Homo sapiens
aactcatcttcgagtgaggctg

SEQ ID NO: 7938610 - DNA, 22 bp, Homo sapiens
aactcatctgggtgagtttgtc

SEQ ID NO: 7938611 - DNA, 22 bp, Homo sapiens
aactccagctcacacagtgacc

SEQ ID NO: 7938612 - DNA, 22 bp, Homo sapiens
aactccaggcagggaggccact

SEQ ID NO: 7938613 - DNA, 22 bp, Homo sapiens
aactccaggcagggaggccact

SEQ ID NO: 7938614 - DNA, 22 bp, Homo sapiens
aactccagctcacacagtgacc

SEQ ID NO: 7938615 - DNA, 22 bp, Homo sapiens
aactccaggcagggaggccact

SEQ ID NO: 7938616 - DNA, 22 bp, Homo sapiens
aactccaggcagggaggccact

SEQ ID NO: 7938617 - DNA, 22 bp, Homo sapiens
aactccatttccctgcctcctg

SEQ ID NO: 7938618 - DNA, 22 bp, Homo sapiens
aactccatggttctcagattct

SEQ ID NO: 7938619 - DNA, 22 bp, Homo sapiens
aactccatttccctgcctcctg

SEQ ID NO: 7938620 - DNA, 21 bp, Homo sapiens
aactcccagtgccttcccagc

SEQ ID NO: 7938621 - DNA, 21 bp, Homo sapiens
aactcccagtgccttcccagc

SEQ ID NO: 7938622 - DNA, 20 bp, Homo sapiens
aactcctagcctcaagtgat

SEQ ID NO: 7938623 - DNA, 20 bp, Homo sapiens
aactcctagcctcaagtgat

SEQ ID NO: 7938624 - DNA, 20 bp, Homo sapiens
aactcctagcctcaagtgat

SEQ ID NO: 7938625 - DNA, 22 bp, Homo sapiens
aactcagttacatattagaata

SEQ ID NO: 7938626 - DNA, 22 bp, Homo sapiens
aactcagttacatattagaata

SEQ ID NO: 7938627 - DNA, 22 bp, Homo sapiens
aactcagttacatattagaata

SEQ ID NO: 7938628 - DNA, 22 bp, Homo sapiens
aactatacatatttacatagac

SEQ ID NO: 7938629 - DNA, 22 bp, Homo sapiens
aactatacatatttacatagac

SEQ ID NO: 7938630 - DNA, 22 bp, Homo sapiens
aaccattagtcaatcagcaaga

SEQ ID NO: 7938631 - DNA, 22 bp, Homo sapiens
aaccattagtcaatcagcaaga

SEQ ID NO: 7938632 - DNA, 22 bp, Homo sapiens
aaccatgtactttattctgttt

SEQ ID NO: 7938633 - DNA, 22 bp, Homo sapiens
aaccatgtactttattctgttt

SEQ ID NO: 7938634 - DNA, 22 bp, Homo sapiens
aaccatggatttcagttcacct

SEQ ID NO: 7938635 - DNA, 22 bp, Homo sapiens
aaccattcacagtgtagccaaa

SEQ ID NO: 7938636 - DNA, 22 bp, Homo sapiens
aaccagtactttacacagctct

SEQ ID NO: 7938637 - DNA, 22 bp, Homo sapiens
aaccaggtgactcatggtgagc

SEQ ID NO: 7938638 - DNA, 20 bp, Homo sapiens
aaccaggatagaccagggaa

SEQ ID NO: 7938639 - DNA, 22 bp, Homo sapiens
aaccaggagattaaagaaaggt

SEQ ID NO: 7938640 - DNA, 22 bp, Homo sapiens
aaccaggatttaagattctaga

SEQ ID NO: 7938641 - DNA, 20 bp, Homo sapiens
aaccaggatagaccagggaa

SEQ ID NO: 7938642 - DNA, 22 bp, Homo sapiens
aaccagtttaagcaaataactg

SEQ ID NO: 7938643 - DNA, 22 bp, Homo sapiens
aaccagtgaaacaccaggcaag

SEQ ID NO: 7938644 - DNA, 22 bp, Homo sapiens
aaccagtcccagtgagatgaac

SEQ ID NO: 7938645 - DNA, 22 bp, Homo sapiens
aaccagtttcaaagaaaattgc

SEQ ID NO: 7938646 - DNA, 22 bp, Homo sapiens
aaccagtttagtcatgctgtaa

SEQ ID NO: 7938647 - DNA, 22 bp, Homo sapiens
aaccagtttaagcaaataactg

SEQ ID NO: 7938648 - DNA, 22 bp, Homo sapiens
aacattctttagctcttcctgc

SEQ ID NO: 7938649 - DNA, 22 bp, Homo sapiens
aacattctttagctcttcctgc

SEQ ID NO: 7938650 - DNA, 22 bp, Homo sapiens
aacattcttcaaatatcactct

SEQ ID NO: 7938651 - DNA, 22 bp, Homo sapiens
aacattcttcaaatatcactct

SEQ ID NO: 7938652 - DNA, 22 bp, Homo sapiens
aacattcttcaaatatcactct

SEQ ID NO: 7938653 - DNA, 22 bp, Homo sapiens
aacattcttcaaatatcactct

SEQ ID NO: 7938654 - DNA, 22 bp, Homo sapiens
aacattcttcaaatatcactct

SEQ ID NO: 7938655 - DNA, 22 bp, Homo sapiens
aacattcttaagatttgtgtct

SEQ ID NO: 7938656 - DNA, 22 bp, Homo sapiens
aacattctgtcaattgatgacc

SEQ ID NO: 7938657 - DNA, 22 bp, Homo sapiens
aacattctgtcaattgatgacc

SEQ ID NO: 7938658 - DNA, 22 bp, Homo sapiens
aacattctgtcaattgatgacc

SEQ ID NO: 7938659 - DNA, 22 bp, Homo sapiens
aacattctggttctaaaaacct

SEQ ID NO: 7938660 - DNA, 22 bp, Homo sapiens
aacattctggttctaaaaacct

SEQ ID NO: 7938661 - DNA, 22 bp, Homo sapiens
aacattaagatggcggaacagt

SEQ ID NO: 7938662 - DNA, 22 bp, Homo sapiens
aacattaagatggcggaacagt

SEQ ID NO: 7938663 - DNA, 22 bp, Homo sapiens
aacattaagatggcggaacagt

SEQ ID NO: 7938664 - DNA, 22 bp, Homo sapiens
aacattctggttctaaaaacct

SEQ ID NO: 7938665 - DNA, 22 bp, Homo sapiens
aacatgtttccagtgtaaggcc

SEQ ID NO: 7938666 - DNA, 22 bp, Homo sapiens
aacatgtttccagtgtaaggcc

SEQ ID NO: 7938667 - DNA, 22 bp, Homo sapiens
aacataaatttgaagtggcaaa

SEQ ID NO: 7938668 - DNA, 22 bp, Homo sapiens
aacataaatttgaagtggcaaa

SEQ ID NO: 7938669 - DNA, 22 bp, Homo sapiens
aacagtttgggtaggtatgtag

SEQ ID NO: 7938670 - DNA, 22 bp, Homo sapiens
aacagtttgggtaggtatgtag

SEQ ID NO: 7938671 - DNA, 22 bp, Homo sapiens
aacagtttgtggatagcttgta

SEQ ID NO: 7938672 - DNA, 22 bp, Homo sapiens
aacattgccatggttaatttta

SEQ ID NO: 7938673 - DNA, 14 bp, Homo sapiens
aacattgcatttga

SEQ ID NO: 7938674 - DNA, 22 bp, Homo sapiens
aacattgccatggttaatttta

SEQ ID NO: 7938675 - DNA, 20 bp, Homo sapiens
aacattgcttcaatgtaacc

SEQ ID NO: 7938676 - DNA, 22 bp, Homo sapiens
aacattgctgaaagctgggaca

SEQ ID NO: 7938677 - DNA, 22 bp, Homo sapiens
aacattgcattctctatgagat

SEQ ID NO: 7938678 - DNA, 22 bp, Homo sapiens
aacattgcagatggcacagaag

SEQ ID NO: 7938679 - DNA, 22 bp, Homo sapiens
aacattgcagcttaattgcagg

SEQ ID NO: 7938680 - DNA, 22 bp, Homo sapiens
aacattgcaaataagcttgcag

SEQ ID NO: 7938681 - DNA, 22 bp, Homo sapiens
aacattgttttgcacaactctt

SEQ ID NO: 7938682 - DNA, 22 bp, Homo sapiens
aacattgttttgcacaactctt

SEQ ID NO: 7938683 - DNA, 22 bp, Homo sapiens
aacattgttttgcacaactctt

SEQ ID NO: 7938684 - DNA, 20 bp, Homo sapiens
aacattgtttgtaaaagcag

SEQ ID NO: 7938685 - DNA, 22 bp, Homo sapiens
aacatttacaaatccttctgca

SEQ ID NO: 7938686 - DNA, 22 bp, Homo sapiens
aacattgttttgcacaactctt

SEQ ID NO: 7938687 - DNA, 22 bp, Homo sapiens
aacatttacaaatccttctgca

SEQ ID NO: 7938688 - DNA, 22 bp, Homo sapiens
aacatttacaaatccttctgca

SEQ ID NO: 7938689 - DNA, 22 bp, Homo sapiens
aacattctttggaggattattc

SEQ ID NO: 7938690 - DNA, 22 bp, Homo sapiens
aacattctttggaggattattc

SEQ ID NO: 7938691 - DNA, 22 bp, Homo sapiens
aacattctttggaggattattc

SEQ ID NO: 7938692 - DNA, 20 bp, Homo sapiens
aacattgaaagtctagaaga

SEQ ID NO: 7938693 - DNA, 22 bp, Homo sapiens
aacattgagttctacttccatt

SEQ ID NO: 7938694 - DNA, 22 bp, Homo sapiens
aacattgaatttaaaatacagt

SEQ ID NO: 7938695 - DNA, 22 bp, Homo sapiens
aatcacatgtgctcaattttaa

SEQ ID NO: 7938696 - DNA, 22 bp, Homo sapiens
aatcacattaagccctgttcag

SEQ ID NO: 7938697 - DNA, 22 bp, Homo sapiens
aatatttgcatcattagctatt

SEQ ID NO: 7938698 - DNA, 22 bp, Homo sapiens
aatatttcttctaaagcccttt

SEQ ID NO: 7938699 - DNA, 22 bp, Homo sapiens
aatatttgaacagtcactgagt

SEQ ID NO: 7938700 - DNA, 22 bp, Homo sapiens
aatcacatgcagggcctccacc

SEQ ID NO: 7938701 - DNA, 22 bp, Homo sapiens
aatcacatgcagggcctccacc

SEQ ID NO: 7938702 - DNA, 22 bp, Homo sapiens
aatcacatgcagggcctccacc

SEQ ID NO: 7938703 - DNA, 22 bp, Homo sapiens
aacatttcagcacctgattcct

SEQ ID NO: 7938704 - DNA, 21 bp, Homo sapiens
aacatttcaggatccaaattg

SEQ ID NO: 7938705 - DNA, 22 bp, Homo sapiens
aatatttctgtagctatgttct

SEQ ID NO: 7938706 - DNA, 22 bp, Homo sapiens
aacatttcagcacctgattcct

SEQ ID NO: 7938707 - DNA, 22 bp, Homo sapiens
aacatttcagcaaataagaaca

SEQ ID NO: 7938708 - DNA, 22 bp, Homo sapiens
aacatttattgagcacctactg

SEQ ID NO: 7938709 - DNA, 22 bp, Homo sapiens
aacatttatggtagtcattgca

SEQ ID NO: 7938710 - DNA, 22 bp, Homo sapiens
aacatttatggtagtcattgca

SEQ ID NO: 7938711 - DNA, 22 bp, Homo sapiens
aacatttattgagcacctactg

SEQ ID NO: 7938712 - DNA, 22 bp, Homo sapiens
aacatttattgagcacctactg

SEQ ID NO: 7938713 - DNA, 22 bp, Homo sapiens
aacatttattgagcacctactg

SEQ ID NO: 7938714 - DNA, 22 bp, Homo sapiens
aacatttattctaattctggga

SEQ ID NO: 7938715 - DNA, 22 bp, Homo sapiens
aacatttattctaattctggga

SEQ ID NO: 7938716 - DNA, 22 bp, Homo sapiens
aacatttattctaattctggga

SEQ ID NO: 7938717 - DNA, 22 bp, Homo sapiens
aacatttacaaatccttctgca

SEQ ID NO: 7938718 - DNA, 22 bp, Homo sapiens
aacatttaggaaggacctcctc

SEQ ID NO: 7938719 - DNA, 22 bp, Homo sapiens
aacatttaggaaggacctcctc

SEQ ID NO: 7938720 - DNA, 22 bp, Homo sapiens
aacatttatatgggttcatgaa

SEQ ID NO: 7938721 - DNA, 22 bp, Homo sapiens
aacatttatgattgaggtaaat

SEQ ID NO: 7938722 - DNA, 22 bp, Homo sapiens
aacatttatgattgaggtaaat

SEQ ID NO: 7938723 - DNA, 22 bp, Homo sapiens
aacatttatgattgaggtaaat

SEQ ID NO: 7938724 - DNA, 22 bp, Homo sapiens
aacatttatatgggttcatgaa

SEQ ID NO: 7938725 - DNA, 21 bp, Homo sapiens
aagtcaatacagataagtctt

SEQ ID NO: 7938726 - DNA, 22 bp, Homo sapiens
aagtcaagataaaggtgctggc

SEQ ID NO: 7938727 - DNA, 22 bp, Homo sapiens
aagtcaaagctttcagaggaaa

SEQ ID NO: 7938728 - DNA, 22 bp, Homo sapiens
aagtcaaagctttcagaggaaa

SEQ ID NO: 7938729 - DNA, 22 bp, Homo sapiens
aacactgagggaaaagagatag

SEQ ID NO: 7938730 - DNA, 22 bp, Homo sapiens
aacactgagggaaaagagatag

SEQ ID NO: 7938731 - DNA, 22 bp, Homo sapiens
aacactgagggaaaagagatag

SEQ ID NO: 7938732 - DNA, 20 bp, Homo sapiens
aacactgagggctactcttc

SEQ ID NO: 7938733 - DNA, 22 bp, Homo sapiens
aacactgctccaaaaaaggctt

SEQ ID NO: 7938734 - DNA, 22 bp, Homo sapiens
aacactgatggaaagtatgttt

SEQ ID NO: 7938735 - DNA, 22 bp, Homo sapiens
aacactgctgctgggttctgtg

SEQ ID NO: 7938736 - DNA, 22 bp, Homo sapiens
aacactgctgctgggttctgtg

SEQ ID NO: 7938737 - DNA, 22 bp, Homo sapiens
aacactgagtatcagagttggg

SEQ ID NO: 7938738 - DNA, 22 bp, Homo sapiens
aacactgatggaaagtatgttt

SEQ ID NO: 7938739 - DNA, 22 bp, Homo sapiens
aacactgagtatcagagttggg

SEQ ID NO: 7938740 - DNA, 22 bp, Homo sapiens
aacactgctgctgggttctgtg

SEQ ID NO: 7938741 - DNA, 20 bp, Homo sapiens
aacactgcttctatattttc

SEQ ID NO: 7938742 - DNA, 22 bp, Homo sapiens
aacactggaagggacatcaagt

SEQ ID NO: 7938743 - DNA, 22 bp, Homo sapiens
aacactggaagggacatcaagt

SEQ ID NO: 7938744 - DNA, 22 bp, Homo sapiens
aacactggacaggaggctaggt

SEQ ID NO: 7938745 - DNA, 22 bp, Homo sapiens
aacactggacaggaggctaggt

SEQ ID NO: 7938746 - DNA, 22 bp, Homo sapiens
aagtatttcgttctgaaaaagt

SEQ ID NO: 7938747 - DNA, 22 bp, Homo sapiens
aagtatttcgttctgaaaaagt

SEQ ID NO: 7938748 - DNA, 22 bp, Homo sapiens
aagtatttctggcctgtgaaag

SEQ ID NO: 7938749 - DNA, 22 bp, Homo sapiens
aagtatttcgttctgaaaaagt

SEQ ID NO: 7938750 - DNA, 22 bp, Homo sapiens
aagtcaaagctttcagaggaaa

SEQ ID NO: 7938751 - DNA, 22 bp, Homo sapiens
aagtatttggaatggcattttt

SEQ ID NO: 7938752 - DNA, 22 bp, Homo sapiens
aagtatttggaatggcattttt

SEQ ID NO: 7938753 - DNA, 22 bp, Homo sapiens
aagtatttctggcctgtgaaag

SEQ ID NO: 7938754 - DNA, 22 bp, Homo sapiens
aagtatttctggcctgtgaaag

SEQ ID NO: 7938755 - DNA, 22 bp, Homo sapiens
aagtatttcgttctgaaaaagt

SEQ ID NO: 7938756 - DNA, 22 bp, Homo sapiens
aagtatttcagcggttctttgt

SEQ ID NO: 7938757 - DNA, 22 bp, Homo sapiens
aagtatttcagcggttctttgt

SEQ ID NO: 7938758 - DNA, 22 bp, Homo sapiens
aagttcttagacaagcttgtgg

SEQ ID NO: 7938759 - DNA, 22 bp, Homo sapiens
aagttcttgataagtccactgt

SEQ ID NO: 7938760 - DNA, 22 bp, Homo sapiens
aagttcttgctgtgtgtcagat

SEQ ID NO: 7938761 - DNA, 22 bp, Homo sapiens
aagttcttgataagtccactgt

SEQ ID NO: 7938762 - DNA, 22 bp, Homo sapiens
aagttcttgagccctattctag

SEQ ID NO: 7938763 - DNA, 22 bp, Homo sapiens
aagttcttgagccctattctag

SEQ ID NO: 7938764 - DNA, 22 bp, Homo sapiens
aagttctttctggaaggtctgc

SEQ ID NO: 7938765 - DNA, 22 bp, Homo sapiens
aagttctttctggaaggtctgc

SEQ ID NO: 7938766 - DNA, 22 bp, Homo sapiens
aagttcttgctgtgtgtcagat

SEQ ID NO: 7938767 - DNA, 22 bp, Homo sapiens
aagttcttggaggatgaagagt

SEQ ID NO: 7938768 - DNA, 22 bp, Homo sapiens
aagttgagatgtcataggagac

SEQ ID NO: 7938769 - DNA, 22 bp, Homo sapiens
aagttgaatcagtaacacagtt

SEQ ID NO: 7938770 - DNA, 23 bp, Homo sapiens
aagttcttttagatgtcttcgtg

SEQ ID NO: 7938771 - DNA, 22 bp, Homo sapiens
aagttgaagcatgaaccaaggt

SEQ ID NO: 7938772 - DNA, 22 bp, Homo sapiens
aagttgaatcagtaacacagtt

SEQ ID NO: 7938773 - DNA, 22 bp, Homo sapiens
aagttgaatcagtaacacagtt

SEQ ID NO: 7938774 - DNA, 19 bp, Homo sapiens
aagttgatcattttgacag

SEQ ID NO: 7938775 - DNA, 22 bp, Homo sapiens
aagttgattgcttcaaatttct

SEQ ID NO: 7938776 - DNA, 22 bp, Homo sapiens
aagttgattgcttcaaatttct

SEQ ID NO: 7938777 - DNA, 22 bp, Homo sapiens
aagttctggggtaatgagaatt

SEQ ID NO: 7938778 - DNA, 22 bp, Homo sapiens
aagttcttagacaagcttgtgg

SEQ ID NO: 7938779 - DNA, 22 bp, Homo sapiens
aagttctgccaggctgtggcag

SEQ ID NO: 7938780 - DNA, 23 bp, Homo sapiens
aagttctgattgtttttccatag

SEQ ID NO: 7938781 - DNA, 19 bp, Homo sapiens
aagttctcagagttcaaag

SEQ ID NO: 7938782 - DNA, 22 bp, Homo sapiens
aagttctatatctgcctcacca

SEQ ID NO: 7938783 - DNA, 20 bp, Homo sapiens
aagttacattgtattgtacc

SEQ ID NO: 7938784 - DNA, 20 bp, Homo sapiens
aagttacattgtattgtacc

SEQ ID NO: 7938785 - DNA, 22 bp, Homo sapiens
aacactgtactggaagatggac

SEQ ID NO: 7938786 - DNA, 22 bp, Homo sapiens
aacactgtactggaagatggac

SEQ ID NO: 7938787 - DNA, 22 bp, Homo sapiens
aacactgtaacagcatcatttt

SEQ ID NO: 7938788 - DNA, 22 bp, Homo sapiens
aacactgtaacagcatcatttt

SEQ ID NO: 7938789 - DNA, 22 bp, Homo sapiens
aacactgtaacagcatcatttt

SEQ ID NO: 7938790 - DNA, 22 bp, Homo sapiens
aacactgtaacagcatcatttt

SEQ ID NO: 7938791 - DNA, 22 bp, Homo sapiens
aacactgtactggaagatggac

SEQ ID NO: 7938792 - DNA, 22 bp, Homo sapiens
aacactgtaacagcatcatttt

SEQ ID NO: 7938793 - DNA, 22 bp, Homo sapiens
aacactggttctgactacacag

SEQ ID NO: 7938794 - DNA, 22 bp, Homo sapiens
aacactggtttggcattagatg

SEQ ID NO: 7938795 - DNA, 22 bp, Homo sapiens
aacactggtttggcattagatg

SEQ ID NO: 7938796 - DNA, 17 bp, Homo sapiens
aacactgggtgagcctc

SEQ ID NO: 7938797 - DNA, 22 bp, Homo sapiens
aacactggttctgactacacag

SEQ ID NO: 7938798 - DNA, 22 bp, Homo sapiens
aacactgggataggtgatagac

SEQ ID NO: 7938799 - DNA, 22 bp, Homo sapiens
aacactgggataggtgatagac

SEQ ID NO: 7938800 - DNA, 22 bp, Homo sapiens
aacagtttgcctgaaatgtatt

SEQ ID NO: 7938801 - DNA, 22 bp, Homo sapiens
aacagtttgcctgaaatgtatt

SEQ ID NO: 7938802 - DNA, 22 bp, Homo sapiens
aacagtttgctttaagaggcac

SEQ ID NO: 7938803 - DNA, 22 bp, Homo sapiens
aacagtttgcctgaaatgtatt

SEQ ID NO: 7938804 - DNA, 22 bp, Homo sapiens
aacagtttgagctttgaatttc

SEQ ID NO: 7938805 - DNA, 22 bp, Homo sapiens
aacagtttatgtaaatgtccag

SEQ ID NO: 7938806 - DNA, 22 bp, Homo sapiens
aacagtttatgataaattctta

SEQ ID NO: 7938807 - DNA, 22 bp, Homo sapiens
aataaacttccactgtgttttt

SEQ ID NO: 7938808 - DNA, 22 bp, Homo sapiens
aacagtttcagttactgatgag

SEQ ID NO: 7938809 - DNA, 22 bp, Homo sapiens
aacagtttcagttactgatgag

SEQ ID NO: 7938810 - DNA, 22 bp, Homo sapiens
aataaacaaatccttccttccc

SEQ ID NO: 7938811 - DNA, 22 bp, Homo sapiens
aataaacaaatccttccttccc

SEQ ID NO: 7938812 - DNA, 22 bp, Homo sapiens
aataaacaaatccttccttccc

SEQ ID NO: 7938813 - DNA, 22 bp, Homo sapiens
aataaacaaatccttccttccc

SEQ ID NO: 7938814 - DNA, 22 bp, Homo sapiens
aataaacaaaggacaaggaggt

SEQ ID NO: 7938815 - DNA, 22 bp, Homo sapiens
aataaacaaatctttcctgtgg

SEQ ID NO: 7938816 - DNA, 22 bp, Homo sapiens
aataaacaaatctttcctgtgg

SEQ ID NO: 7938817 - DNA, 22 bp, Homo sapiens
aataaacaaatctttcctgtgg

SEQ ID NO: 7938818 - DNA, 22 bp, Homo sapiens
aataaacaaatctttcctgtgg

SEQ ID NO: 7938819 - DNA, 22 bp, Homo sapiens
aataaacaaatctttcctgtgg

SEQ ID NO: 7938820 - DNA, 22 bp, Homo sapiens
aataaacaaatctttcctgtgg

SEQ ID NO: 7938821 - DNA, 22 bp, Homo sapiens
aataaactgctcaattgcatca

SEQ ID NO: 7938822 - DNA, 22 bp, Homo sapiens
aataaactgctcaattgcatca

SEQ ID NO: 7938823 - DNA, 20 bp, Homo sapiens
aataaactactgagagatgt

SEQ ID NO: 7938824 - DNA, 20 bp, Homo sapiens
aataaactactgagagatgt

SEQ ID NO: 7938825 - DNA, 22 bp, Homo sapiens
aataaactgctcaattgcatca

SEQ ID NO: 7938826 - DNA, 22 bp, Homo sapiens
aataaactgctcaattgcatca

SEQ ID NO: 7938827 - DNA, 22 bp, Homo sapiens
aataaactgctcaattgcatca

SEQ ID NO: 7938828 - DNA, 22 bp, Homo sapiens
aagtttctgatattgttaaagc

SEQ ID NO: 7938829 - DNA, 22 bp, Homo sapiens
aagttgctagtgcttttctgag

SEQ ID NO: 7938830 - DNA, 22 bp, Homo sapiens
aagttggaatctggaactgatc

SEQ ID NO: 7938831 - DNA, 22 bp, Homo sapiens
aagttgctaaaggagttctttg

SEQ ID NO: 7938832 - DNA, 20 bp, Homo sapiens
aagttgcagagagttgtctt

SEQ ID NO: 7938833 - DNA, 20 bp, Homo sapiens
aagttgcagagagttgtctt

SEQ ID NO: 7938834 - DNA, 22 bp, Homo sapiens
aagttgctaatgatgtgtttgc

SEQ ID NO: 7938835 - DNA, 22 bp, Homo sapiens
aagtttctgccatactgtggtg

SEQ ID NO: 7938836 - DNA, 22 bp, Homo sapiens
aagtttctgccatactgtggtg

SEQ ID NO: 7938837 - DNA, 22 bp, Homo sapiens
aagtttctgatattgttaaagc

SEQ ID NO: 7938838 - DNA, 22 bp, Homo sapiens
aagtttctggaccttacctgct

SEQ ID NO: 7938839 - DNA, 22 bp, Homo sapiens
aagtttctgggcaagacaaggc

SEQ ID NO: 7938840 - DNA, 22 bp, Homo sapiens
aagtttctgggcaagacaaggc

SEQ ID NO: 7938841 - DNA, 20 bp, Homo sapiens
aagtttctggtttatatctt

SEQ ID NO: 7938842 - DNA, 20 bp, Homo sapiens
aagtttctggtttatatctt

SEQ ID NO: 7938843 - DNA, 22 bp, Homo sapiens
aagtttctttattagcttgtcc

SEQ ID NO: 7938844 - DNA, 22 bp, Homo sapiens
aagtttctttattagcttgtcc

SEQ ID NO: 7938845 - DNA, 22 bp, Homo sapiens
aagtttctgttcgctttaataa

SEQ ID NO: 7938846 - DNA, 22 bp, Homo sapiens
aagtttctgttcatatctctga

SEQ ID NO: 7938847 - DNA, 20 bp, Homo sapiens
aagtttctggtttatatctt

SEQ ID NO: 7938848 - DNA, 20 bp, Homo sapiens
aagtttctggtttatatctt

SEQ ID NO: 7938849 - DNA, 22 bp, Homo sapiens
aagtttctgtatgctcttctgt

SEQ ID NO: 7938850 - DNA, 22 bp, Homo sapiens
aagtttctgttcatatctctga

SEQ ID NO: 7938851 - DNA, 22 bp, Homo sapiens
aataaaatggtcagttttctca

SEQ ID NO: 7938852 - DNA, 22 bp, Homo sapiens
aataaaatggtcagttttctca

SEQ ID NO: 7938853 - DNA, 22 bp, Homo sapiens
aataaaatggtcagttttctca

SEQ ID NO: 7938854 - DNA, 22 bp, Homo sapiens
aataaacaaaggacaaggaggt

SEQ ID NO: 7938855 - DNA, 22 bp, Homo sapiens
aataaacaaaggacaaggaggt

SEQ ID NO: 7938856 - DNA, 22 bp, Homo sapiens
aataaaatggtcagttttctca

SEQ ID NO: 7938857 - DNA, 22 bp, Homo sapiens
aataaacaaaggacaaggaggt

SEQ ID NO: 7938858 - DNA, 22 bp, Homo sapiens
aataaaatggtcagttttctca

SEQ ID NO: 7938859 - DNA, 22 bp, Homo sapiens
aataaaatggtcagttttctca

SEQ ID NO: 7938860 - DNA, 21 bp, Homo sapiens
aagtttggaagaaagcaaggg

SEQ ID NO: 7938861 - DNA, 21 bp, Homo sapiens
aaggggcaaacccaggacacc

SEQ ID NO: 7938862 - DNA, 21 bp, Homo sapiens
aaggggcaaacccaggacacc

SEQ ID NO: 7938863 - DNA, 21 bp, Homo sapiens
aaggggcaaacccaggacacc

SEQ ID NO: 7938864 - DNA, 21 bp, Homo sapiens
aaggggcaaacccaggacacc

SEQ ID NO: 7938865 - DNA, 22 bp, Homo sapiens
aaggggatttaaggtaagaaga

SEQ ID NO: 7938866 - DNA, 21 bp, Homo sapiens
aaggggcaaacccaggacacc

SEQ ID NO: 7938867 - DNA, 22 bp, Homo sapiens
aaggggcctcacagatgggctt

SEQ ID NO: 7938868 - DNA, 22 bp, Homo sapiens
aaggggcctcacagatgggctt

SEQ ID NO: 7938869 - DNA, 22 bp, Homo sapiens
aaggggcatgcttttgccagga

SEQ ID NO: 7938870 - DNA, 22 bp, Homo sapiens
aaggggcatgcttttgccagga

SEQ ID NO: 7938871 - DNA, 22 bp, Homo sapiens
aaggggcatgcttttgccagga

SEQ ID NO: 7938872 - DNA, 22 bp, Homo sapiens
aaggggaagagaccgcagagtc

SEQ ID NO: 7938873 - DNA, 22 bp, Homo sapiens
aaggggaagtagcaccagaggt

SEQ ID NO: 7938874 - DNA, 22 bp, Homo sapiens
aaggggaagtagcaccagaggt

SEQ ID NO: 7938875 - DNA, 22 bp, Homo sapiens
aaggggaagtagcaccagaggt

SEQ ID NO: 7938876 - DNA, 22 bp, Homo sapiens
aaggggaagtagcaccagaggt

SEQ ID NO: 7938877 - DNA, 22 bp, Homo sapiens
aaggggaatagagtgggttgtg

SEQ ID NO: 7938878 - DNA, 22 bp, Homo sapiens
aaggggaatagagtgggttgtg

SEQ ID NO: 7938879 - DNA, 22 bp, Homo sapiens
aaggggaatagagtgggttgtg

SEQ ID NO: 7938880 - DNA, 22 bp, Homo sapiens
aaggggagatgtcatgggccct

SEQ ID NO: 7938881 - DNA, 22 bp, Homo sapiens
aaggggagatgtcatgggccct

SEQ ID NO: 7938882 - DNA, 22 bp, Homo sapiens
aaggggaatagagtgggttgtg

SEQ ID NO: 7938883 - DNA, 22 bp, Homo sapiens
aaggggagttagtgataaaacc

SEQ ID NO: 7938884 - DNA, 22 bp, Homo sapiens
aaggggagttagtgataaaacc

SEQ ID NO: 7938885 - DNA, 22 bp, Homo sapiens
aaggggagttagtgataaaacc

SEQ ID NO: 7938886 - DNA, 22 bp, Homo sapiens
aagggagcaaatggacagacgg

SEQ ID NO: 7938887 - DNA, 22 bp, Homo sapiens
aagggagcaaatggacagacgg

SEQ ID NO: 7938888 - DNA, 22 bp, Homo sapiens
aagggagcaaatggacagacgg

SEQ ID NO: 7938889 - DNA, 22 bp, Homo sapiens
aagggagccaagaaagcagggc

SEQ ID NO: 7938890 - DNA, 22 bp, Homo sapiens
aagggagccaagaaagcagggc

SEQ ID NO: 7938891 - DNA, 22 bp, Homo sapiens
aagggagccaagaaagcagggc

SEQ ID NO: 7938892 - DNA, 21 bp, Homo sapiens
aagggagataggaatcaggcc

SEQ ID NO: 7938893 - DNA, 22 bp, Homo sapiens
aagggagaggagggtcttgttg

SEQ ID NO: 7938894 - DNA, 22 bp, Homo sapiens
aagggagcttaggagatcaggc

SEQ ID NO: 7938895 - DNA, 22 bp, Homo sapiens
aagggagcttaggagatcaggc

SEQ ID NO: 7938896 - DNA, 22 bp, Homo sapiens
aagggaggaggatttattgtac

SEQ ID NO: 7938897 - DNA, 22 bp, Homo sapiens
aagggaggaggatttattgtac

SEQ ID NO: 7938898 - DNA, 22 bp, Homo sapiens
aagggaggaggatttattgtac

SEQ ID NO: 7938899 - DNA, 22 bp, Homo sapiens
aagggaggaggatttattgtac

SEQ ID NO: 7938900 - DNA, 22 bp, Homo sapiens
aagggagcttaggagatcaggc

SEQ ID NO: 7938901 - DNA, 22 bp, Homo sapiens
aagggagcttaggagatcaggc

SEQ ID NO: 7938902 - DNA, 22 bp, Homo sapiens
aagggagcggggagaccctatg

SEQ ID NO: 7938903 - DNA, 22 bp, Homo sapiens
aagggaggccagaggttttgca

SEQ ID NO: 7938904 - DNA, 22 bp, Homo sapiens
aagggaggccagaggttttgca

SEQ ID NO: 7938905 - DNA, 22 bp, Homo sapiens
aagggctggagactgggtcttc

SEQ ID NO: 7938906 - DNA, 22 bp, Homo sapiens
aagggctggagactgggtcttc

SEQ ID NO: 7938907 - DNA, 22 bp, Homo sapiens
aaggggaagtagcaccagaggt

SEQ ID NO: 7938908 - DNA, 22 bp, Homo sapiens
aagggctggagactgggtcttc

SEQ ID NO: 7938909 - DNA, 22 bp, Homo sapiens
aacaatcaagtttctaaatgac

SEQ ID NO: 7938910 - DNA, 22 bp, Homo sapiens
aacaatcaagtttctaaatgac

SEQ ID NO: 7938911 - DNA, 22 bp, Homo sapiens
aacaatcaagtttctaaatgac

SEQ ID NO: 7938912 - DNA, 22 bp, Homo sapiens
aacaatctccaagaccaatgtg

SEQ ID NO: 7938913 - DNA, 22 bp, Homo sapiens
aacaatctccaagaccaatgtg

SEQ ID NO: 7938914 - DNA, 20 bp, Homo sapiens
aacaatctagaagctattct

SEQ ID NO: 7938915 - DNA, 20 bp, Homo sapiens
aacaatctagaagctattct

SEQ ID NO: 7938916 - DNA, 22 bp, Homo sapiens
aacaatgaggatctgttctgag

SEQ ID NO: 7938917 - DNA, 22 bp, Homo sapiens
aacaatgaccacacaatgtact

SEQ ID NO: 7938918 - DNA, 22 bp, Homo sapiens
aacaatctgttcgatagaaaat

SEQ ID NO: 7938919 - DNA, 22 bp, Homo sapiens
aacaatctgttcgatagaaaat

SEQ ID NO: 7938920 - DNA, 22 bp, Homo sapiens
aacaatctgttcgatagaaaat

SEQ ID NO: 7938921 - DNA, 22 bp, Homo sapiens
aacaatctgttcgatagaaaat

SEQ ID NO: 7938922 - DNA, 22 bp, Homo sapiens
aacaatctgttcgatagaaaat

SEQ ID NO: 7938923 - DNA, 22 bp, Homo sapiens
aagggggagaggtgtttggatg

SEQ ID NO: 7938924 - DNA, 22 bp, Homo sapiens
aagggggaaatcctagcgccgc

SEQ ID NO: 7938925 - DNA, 22 bp, Homo sapiens
aagggggagaggtgtttggatg

SEQ ID NO: 7938926 - DNA, 22 bp, Homo sapiens
aagggggcacagtcactgtaat

SEQ ID NO: 7938927 - DNA, 22 bp, Homo sapiens
aacaataattgcggttctctat

SEQ ID NO: 7938928 - DNA, 22 bp, Homo sapiens
aacaataggctatatgctaggc

SEQ ID NO: 7938929 - DNA, 22 bp, Homo sapiens
aacaatgaggatctgttctgag

SEQ ID NO: 7938930 - DNA, 22 bp, Homo sapiens
aacaatgagtcctctgaggtta

SEQ ID NO: 7938931 - DNA, 22 bp, Homo sapiens
aacaatgccaacagcatgctgg

SEQ ID NO: 7938932 - DNA, 22 bp, Homo sapiens
aacaatgcagttaatgggaaga

SEQ ID NO: 7938933 - DNA, 22 bp, Homo sapiens
aacaatgcactatcgtaagtgg

SEQ ID NO: 7938934 - DNA, 22 bp, Homo sapiens
aacaatgctgaactgaggaaag

SEQ ID NO: 7938935 - DNA, 22 bp, Homo sapiens
aacaatgcctgatgacctcctg

SEQ ID NO: 7938936 - DNA, 22 bp, Homo sapiens
aacaatgcctgatgacctcctg

SEQ ID NO: 7938937 - DNA, 22 bp, Homo sapiens
aacaatgccacattaagtgtat

SEQ ID NO: 7938938 - DNA, 22 bp, Homo sapiens
aacaatgccacattaagtgtat

SEQ ID NO: 7938939 - DNA, 16 bp, Homo sapiens
aacaatgccaatccag

SEQ ID NO: 7938940 - DNA, 22 bp, Homo sapiens
aacaatgccaacagcatgctgg

SEQ ID NO: 7938941 - DNA, 22 bp, Homo sapiens
aagtacagaaatagcaggtgca

SEQ ID NO: 7938942 - DNA, 22 bp, Homo sapiens
aagtacagaaggagcgaacaat

SEQ ID NO: 7938943 - DNA, 22 bp, Homo sapiens
aagtacagaaggagcgaacaat

SEQ ID NO: 7938944 - DNA, 22 bp, Homo sapiens
aagtatgacatttaagacaatt

SEQ ID NO: 7938945 - DNA, 22 bp, Homo sapiens
aagtatgacatttaagacaatt

SEQ ID NO: 7938946 - DNA, 22 bp, Homo sapiens
aagtatgacatttaagacaatt

SEQ ID NO: 7938947 - DNA, 22 bp, Homo sapiens
aagtatgacatttaagacaatt

SEQ ID NO: 7938948 - DNA, 22 bp, Homo sapiens
aagtatgacatttaagacaatt

SEQ ID NO: 7938949 - DNA, 22 bp, Homo sapiens
aagtacagaaatagcaggtgca

SEQ ID NO: 7938950 - DNA, 22 bp, Homo sapiens
aagtacaatctttctgtaaagg

SEQ ID NO: 7938951 - DNA, 22 bp, Homo sapiens
aagtatgctattacagtgtcat

SEQ ID NO: 7938952 - DNA, 22 bp, Homo sapiens
aagtatgtgatacatgttaatt

SEQ ID NO: 7938953 - DNA, 22 bp, Homo sapiens
aagtatgtgatacatgttaatt

SEQ ID NO: 7938954 - DNA, 22 bp, Homo sapiens
aagtatgtgtgggatgctggga

SEQ ID NO: 7938955 - DNA, 22 bp, Homo sapiens
aagtattatttaacaaatttgt

SEQ ID NO: 7938956 - DNA, 22 bp, Homo sapiens
aacaagcagatgcaatgcactt

SEQ ID NO: 7938957 - DNA, 22 bp, Homo sapiens
aacaagcagatgcaatgcactt

SEQ ID NO: 7938958 - DNA, 22 bp, Homo sapiens
aacaagcagatgcaatgcactt

SEQ ID NO: 7938959 - DNA, 22 bp, Homo sapiens
aacaagtaagtttatatatatt

SEQ ID NO: 7938960 - DNA, 22 bp, Homo sapiens
aacaaggctggtatcttaaaga

SEQ ID NO: 7938961 - DNA, 22 bp, Homo sapiens
aacaagatgggagaaggacctc

SEQ ID NO: 7938962 - DNA, 22 bp, Homo sapiens
aacaagatgttttgatatatgt

SEQ ID NO: 7938963 - DNA, 22 bp, Homo sapiens
aacaagcagatgcaatgcactt

SEQ ID NO: 7938964 - DNA, 22 bp, Homo sapiens
aacaagatgttttgatatatgt

SEQ ID NO: 7938965 - DNA, 22 bp, Homo sapiens
aacaagatgttttgatatatgt

SEQ ID NO: 7938966 - DNA, 22 bp, Homo sapiens
aacaagatagagctcttgcctt

SEQ ID NO: 7938967 - DNA, 22 bp, Homo sapiens
aacaagatcctggaaggggcca

SEQ ID NO: 7938968 - DNA, 22 bp, Homo sapiens
aacaaatgtgttttgtaattaa

SEQ ID NO: 7938969 - DNA, 22 bp, Homo sapiens
aacaaatgtgttttgtaattaa

SEQ ID NO: 7938970 - DNA, 22 bp, Homo sapiens
aacaaatgtgttttgtaattaa

SEQ ID NO: 7938971 - DNA, 22 bp, Homo sapiens
aacaaatgtgttttgtaattaa

SEQ ID NO: 7938972 - DNA, 22 bp, Homo sapiens
aacaagtaagtttatatatatt

SEQ ID NO: 7938973 - DNA, 22 bp, Homo sapiens
aacaagtaagtttatatatatt

SEQ ID NO: 7938974 - DNA, 22 bp, Homo sapiens
aacaagtaagtttatatatatt

SEQ ID NO: 7938975 - DNA, 19 bp, Homo sapiens
aacaagtaggaatggaaga

SEQ ID NO: 7938976 - DNA, 19 bp, Homo sapiens
aacaagtaggaatggaaga

SEQ ID NO: 7938977 - DNA, 19 bp, Homo sapiens
aacaagtaggaatggaaga

SEQ ID NO: 7938978 - DNA, 22 bp, Homo sapiens
aacaagtcattccatttgacag

SEQ ID NO: 7938979 - DNA, 22 bp, Homo sapiens
aacaagtgagtcatttaaactc

SEQ ID NO: 7938980 - DNA, 22 bp, Homo sapiens
aacaagtgaaagtccttttcga

SEQ ID NO: 7938981 - DNA, 22 bp, Homo sapiens
aacaagtctaagagaatggcag

SEQ ID NO: 7938982 - DNA, 22 bp, Homo sapiens
aacaagtctaagagaatggcag

SEQ ID NO: 7938983 - DNA, 22 bp, Homo sapiens
aacaagtctttggttttggcta

SEQ ID NO: 7938984 - DNA, 22 bp, Homo sapiens
aacaagtgtattaatggaaata

SEQ ID NO: 7938985 - DNA, 22 bp, Homo sapiens
aacaagtgtattaatggaaata

SEQ ID NO: 7938986 - DNA, 22 bp, Homo sapiens
aacaagttactcttaaagtata

SEQ ID NO: 7938987 - DNA, 22 bp, Homo sapiens
aacaagttactcttaaagtata

SEQ ID NO: 7938988 - DNA, 22 bp, Homo sapiens
aacaagtgatatataatggaag

SEQ ID NO: 7938989 - DNA, 22 bp, Homo sapiens
aacaagtgatgctcatgattca

SEQ ID NO: 7938990 - DNA, 22 bp, Homo sapiens
aacaataattgcggttctctat

SEQ ID NO: 7938991 - DNA, 22 bp, Homo sapiens
aacaataattgcggttctctat

SEQ ID NO: 7938992 - DNA, 22 bp, Homo sapiens
aagggagacagttgtgtgagga

SEQ ID NO: 7938993 - DNA, 22 bp, Homo sapiens
aagggagacagttgtgtgagga

SEQ ID NO: 7938994 - DNA, 22 bp, Homo sapiens
aacaataactagacatgccatg

SEQ ID NO: 7938995 - DNA, 22 bp, Homo sapiens
aacaataattgcggttctctat

SEQ ID NO: 7938996 - DNA, 22 bp, Homo sapiens
aacaataattgcggttctctat

SEQ ID NO: 7938997 - DNA, 22 bp, Homo sapiens
aagggagacagttgtgtgagga

SEQ ID NO: 7938998 - DNA, 22 bp, Homo sapiens
aagggagacagttgtgtgagga

SEQ ID NO: 7938999 - DNA, 22 bp, Homo sapiens
aagggagacccaccgtcctgga

SEQ ID NO: 7939000 - DNA, 22 bp, Homo sapiens
aagggagacagttgtgtgagga

SEQ ID NO: 7939001 - DNA, 22 bp, Homo sapiens
aacaagttctaagtgtctactt

SEQ ID NO: 7939002 - DNA, 22 bp, Homo sapiens
aacaagttctacctcacaaggt

SEQ ID NO: 7939003 - DNA, 22 bp, Homo sapiens
aacaagttctacctcacaaggt

SEQ ID NO: 7939004 - DNA, 22 bp, Homo sapiens
aacaagttactcttaaagtata

SEQ ID NO: 7939005 - DNA, 22 bp, Homo sapiens
aacaagttactcttaaagtata

SEQ ID NO: 7939006 - DNA, 22 bp, Homo sapiens
aacaagttactcttaaagtata

SEQ ID NO: 7939007 - DNA, 22 bp, Homo sapiens
aacaataactagacatgccatg

SEQ ID NO: 7939008 - DNA, 22 bp, Homo sapiens
aacaataactagacatgccatg

SEQ ID NO: 7939009 - DNA, 22 bp, Homo sapiens
aacaataactagacatgccatg

SEQ ID NO: 7939010 - DNA, 22 bp, Homo sapiens
aacaataactagacatgccatg

SEQ ID NO: 7939011 - DNA, 22 bp, Homo sapiens
aaatttcaagcaaagtagctat

SEQ ID NO: 7939012 - DNA, 22 bp, Homo sapiens
aaatttcaagcaaagtagctat

SEQ ID NO: 7939013 - DNA, 22 bp, Homo sapiens
aaatttcaagcaaagtagctat

SEQ ID NO: 7939014 - DNA, 22 bp, Homo sapiens
aaatttcaagcaaagtagctat

SEQ ID NO: 7939015 - DNA, 20 bp, Homo sapiens
aaatttaggaaattttacgc

SEQ ID NO: 7939016 - DNA, 22 bp, Homo sapiens
aaatttcagttggaatgagctc

SEQ ID NO: 7939017 - DNA, 22 bp, Homo sapiens
aaatttctaagcagccacttcc

SEQ ID NO: 7939018 - DNA, 22 bp, Homo sapiens
aaatttctaagtcaagaagaac

SEQ ID NO: 7939019 - DNA, 22 bp, Homo sapiens
aaatttctaagcagccacttcc

SEQ ID NO: 7939020 - DNA, 22 bp, Homo sapiens
aaatttcagttggaatgagctc

SEQ ID NO: 7939021 - DNA, 22 bp, Homo sapiens
aaatttcagttggaatgagctc

SEQ ID NO: 7939022 - DNA, 22 bp, Homo sapiens
aaatttccatcaggtccagtct

SEQ ID NO: 7939023 - DNA, 22 bp, Homo sapiens
aaggccaaagacacctacacag

SEQ ID NO: 7939024 - DNA, 22 bp, Homo sapiens
aaggccaaagttttcaggctaa

SEQ ID NO: 7939025 - DNA, 22 bp, Homo sapiens
aaggccaactaggatgagctag

SEQ ID NO: 7939026 - DNA, 22 bp, Homo sapiens
aaggccaactaggatgagctag

SEQ ID NO: 7939027 - DNA, 22 bp, Homo sapiens
aacaaatgtaaaatgcagatgc

SEQ ID NO: 7939028 - DNA, 22 bp, Homo sapiens
aaggccagactctggaatgaca

SEQ ID NO: 7939029 - DNA, 22 bp, Homo sapiens
aaggccagactctggaatgaca

SEQ ID NO: 7939030 - DNA, 22 bp, Homo sapiens
aacaaatgtgtggcagtgtggg

SEQ ID NO: 7939031 - DNA, 22 bp, Homo sapiens
aacaaatgtgtggcagtgtggg

SEQ ID NO: 7939032 - DNA, 23 bp, Homo sapiens
aaggccagaatttcaatggtgcc

SEQ ID NO: 7939033 - DNA, 22 bp, Homo sapiens
aaggccagacaggaccacatct

SEQ ID NO: 7939034 - DNA, 22 bp, Homo sapiens
aaggccactttaccttaaatcc

SEQ ID NO: 7939035 - DNA, 22 bp, Homo sapiens
aaggccactgaagaaatcacaa

SEQ ID NO: 7939036 - DNA, 22 bp, Homo sapiens
aaggccactttaccttaaatcc

SEQ ID NO: 7939037 - DNA, 23 bp, Homo sapiens
aaggccagaatttcaatggtgcc

SEQ ID NO: 7939038 - DNA, 23 bp, Homo sapiens
aaggccagaatttcaatggtgcc

SEQ ID NO: 7939039 - DNA, 22 bp, Homo sapiens
aaggccaaggctgcagtgagcc

SEQ ID NO: 7939040 - DNA, 22 bp, Homo sapiens
aaggccaaggctgcagtgagcc

SEQ ID NO: 7939041 - DNA, 22 bp, Homo sapiens
aaggccaaggctgcagtgagcc

SEQ ID NO: 7939042 - DNA, 22 bp, Homo sapiens
aaggccacacttgctggccagc

SEQ ID NO: 7939043 - DNA, 22 bp, Homo sapiens
aaggccacgtctccttccagag

SEQ ID NO: 7939044 - DNA, 22 bp, Homo sapiens
aaggccactgaagaaatcacaa

SEQ ID NO: 7939045 - DNA, 22 bp, Homo sapiens
aaggccacgtctccttccagag

SEQ ID NO: 7939046 - DNA, 22 bp, Homo sapiens
aaggccacagagcctcagagag

SEQ ID NO: 7939047 - DNA, 22 bp, Homo sapiens
aaggccacagagcctcagagag

SEQ ID NO: 7939048 - DNA, 22 bp, Homo sapiens
aaggccaccaccagcgaggggg

SEQ ID NO: 7939049 - DNA, 22 bp, Homo sapiens
aaatttaaaaagcagcattgca

SEQ ID NO: 7939050 - DNA, 22 bp, Homo sapiens
aaatttaaaaagcagcattgca

SEQ ID NO: 7939051 - DNA, 22 bp, Homo sapiens
aaatttaaaaagcagcattgca

SEQ ID NO: 7939052 - DNA, 20 bp, Homo sapiens
aaatttaggaaattttacgc

SEQ ID NO: 7939053 - DNA, 20 bp, Homo sapiens
aaatttaggaaattttacgc

SEQ ID NO: 7939054 - DNA, 20 bp, Homo sapiens
aaatttaggaaattttacgc

SEQ ID NO: 7939055 - DNA, 22 bp, Homo sapiens
aaatttaaggaggtgctcactt

SEQ ID NO: 7939056 - DNA, 22 bp, Homo sapiens
aaatttaagaagtgtgtgcgtg

SEQ ID NO: 7939057 - DNA, 22 bp, Homo sapiens
aaatttaaggaggtgctcactt

SEQ ID NO: 7939058 - DNA, 22 bp, Homo sapiens
aaattgttgatctacagtaagg

SEQ ID NO: 7939059 - DNA, 22 bp, Homo sapiens
aaatttaaaaagcagcattgca

SEQ ID NO: 7939060 - DNA, 22 bp, Homo sapiens
aaattgcattttaaaggtagat

SEQ ID NO: 7939061 - DNA, 22 bp, Homo sapiens
aaggactgaataattctctttc

SEQ ID NO: 7939062 - DNA, 22 bp, Homo sapiens
aaggactctccagctagcaaat

SEQ ID NO: 7939063 - DNA, 22 bp, Homo sapiens
aaggactagattatacaatagg

SEQ ID NO: 7939064 - DNA, 22 bp, Homo sapiens
aaggacctatattgtcagagga

SEQ ID NO: 7939065 - DNA, 22 bp, Homo sapiens
aaggacctgattttgagcatct

SEQ ID NO: 7939066 - DNA, 22 bp, Homo sapiens
aaggaccagattatccttaata

SEQ ID NO: 7939067 - DNA, 22 bp, Homo sapiens
aaggaccagttttgcagaattg

SEQ ID NO: 7939068 - DNA, 22 bp, Homo sapiens
aaggaccagttttgcagaattg

SEQ ID NO: 7939069 - DNA, 22 bp, Homo sapiens
aaggagaaggcatcattcaagt

SEQ ID NO: 7939070 - DNA, 22 bp, Homo sapiens
aaattgcattgagctgcttatt

SEQ ID NO: 7939071 - DNA, 22 bp, Homo sapiens
aaggagaaggcatcattcaagt

SEQ ID NO: 7939072 - DNA, 22 bp, Homo sapiens
aaggagaaggcatcattcaagt

SEQ ID NO: 7939073 - DNA, 22 bp, Homo sapiens
aaggagaaggcatcattcaagt

SEQ ID NO: 7939074 - DNA, 22 bp, Homo sapiens
aaggagaaatggtagatgtgca

SEQ ID NO: 7939075 - DNA, 22 bp, Homo sapiens
aaggagaaatggtagatgtgca

SEQ ID NO: 7939076 - DNA, 22 bp, Homo sapiens
aaggagaaatggtagatgtgca

SEQ ID NO: 7939077 - DNA, 22 bp, Homo sapiens
aaggagaaatggtagatgtgca

SEQ ID NO: 7939078 - DNA, 22 bp, Homo sapiens
aaggagaaatggtagatgtgca

SEQ ID NO: 7939079 - DNA, 22 bp, Homo sapiens
aaggactgacaaatgtcttcct

SEQ ID NO: 7939080 - DNA, 22 bp, Homo sapiens
aaggactgaataattctctttc

SEQ ID NO: 7939081 - DNA, 22 bp, Homo sapiens
aaggactgctaggaagccgtgt

SEQ ID NO: 7939082 - DNA, 22 bp, Homo sapiens
aaatgttttgctcccatgtggt

SEQ ID NO: 7939083 - DNA, 22 bp, Homo sapiens
aaggaaacagaggatgaccttg

SEQ ID NO: 7939084 - DNA, 22 bp, Homo sapiens
aaggaaacactgaactttgtag

SEQ ID NO: 7939085 - DNA, 21 bp, Homo sapiens
aaggaaaagcttggtctctga

SEQ ID NO: 7939086 - DNA, 22 bp, Homo sapiens
aaattaactatcacttttgtga

SEQ ID NO: 7939087 - DNA, 18 bp, Homo sapiens
aaattagatggacctgtg

SEQ ID NO: 7939088 - DNA, 22 bp, Homo sapiens
aaattaagagtaactctgtaga

SEQ ID NO: 7939089 - DNA, 18 bp, Homo sapiens
aaattagatggacctgtg

SEQ ID NO: 7939090 - DNA, 22 bp, Homo sapiens
aaattagtacattgcaaagtcc

SEQ ID NO: 7939091 - DNA, 22 bp, Homo sapiens
aaattagtacattgcaaagtcc

SEQ ID NO: 7939092 - DNA, 22 bp, Homo sapiens
aaattagtacattgcaaagtcc

SEQ ID NO: 7939093 - DNA, 22 bp, Homo sapiens
aaattagtacattgcaaagtcc

SEQ ID NO: 7939094 - DNA, 22 bp, Homo sapiens
aaattataggtgccaccttgga

SEQ ID NO: 7939095 - DNA, 22 bp, Homo sapiens
aaattatcatgattattgtgta

SEQ ID NO: 7939096 - DNA, 22 bp, Homo sapiens
aaattataggtgccaccttgga

SEQ ID NO: 7939097 - DNA, 22 bp, Homo sapiens
aaattataggtgccaccttgga

SEQ ID NO: 7939098 - DNA, 22 bp, Homo sapiens
aaattagtgcaccaggttgaag

SEQ ID NO: 7939099 - DNA, 22 bp, Homo sapiens
aaattagtgttttcttactggt

SEQ ID NO: 7939100 - DNA, 22 bp, Homo sapiens
aaattagtcggtttaggaattt

SEQ ID NO: 7939101 - DNA, 22 bp, Homo sapiens
aaattagtcggtttaggaattt

SEQ ID NO: 7939102 - DNA, 22 bp, Homo sapiens
aaattagtcatgttgtattact

SEQ ID NO: 7939103 - DNA, 22 bp, Homo sapiens
aaattagtcatgttgtattact

SEQ ID NO: 7939104 - DNA, 22 bp, Homo sapiens
aaattagtcatgttgtattact

SEQ ID NO: 7939105 - DNA, 22 bp, Homo sapiens
aaattagtcatgttgtattact

SEQ ID NO: 7939106 - DNA, 22 bp, Homo sapiens
aaattagtacattgcaaagtcc

SEQ ID NO: 7939107 - DNA, 22 bp, Homo sapiens
aaattatcatgattattgtgta

SEQ ID NO: 7939108 - DNA, 22 bp, Homo sapiens
aaattatcatgattattgtgta

SEQ ID NO: 7939109 - DNA, 22 bp, Homo sapiens
aaattattacaagctagttggc

SEQ ID NO: 7939110 - DNA, 22 bp, Homo sapiens
aaattattacaagctagttggc

SEQ ID NO: 7939111 - DNA, 22 bp, Homo sapiens
aaattattacaagctagttggc

SEQ ID NO: 7939112 - DNA, 22 bp, Homo sapiens
aaattattacaagctagttggc

SEQ ID NO: 7939113 - DNA, 22 bp, Homo sapiens
aaggacagggatggttgattgt

SEQ ID NO: 7939114 - DNA, 22 bp, Homo sapiens
aaggacaggttggggcttcagg

SEQ ID NO: 7939115 - DNA, 22 bp, Homo sapiens
aaattattatgcccctctataa

SEQ ID NO: 7939116 - DNA, 22 bp, Homo sapiens
aaggacagggatggttgattgt

SEQ ID NO: 7939117 - DNA, 22 bp, Homo sapiens
aaggacaggttggggcttcagg

SEQ ID NO: 7939118 - DNA, 22 bp, Homo sapiens
aaggacaggttggggcttcagg

SEQ ID NO: 7939119 - DNA, 22 bp, Homo sapiens
aaggacaggttggggcttcagg

SEQ ID NO: 7939120 - DNA, 17 bp, Homo sapiens
aaggaccaacaggaaat

SEQ ID NO: 7939121 - DNA, 17 bp, Homo sapiens
aaggaccaacaggaaat

SEQ ID NO: 7939122 - DNA, 22 bp, Homo sapiens
aagctgtagaggcagtacattt

SEQ ID NO: 7939123 - DNA, 22 bp, Homo sapiens
aagctgtagcttttcaaaacgt

SEQ ID NO: 7939124 - DNA, 22 bp, Homo sapiens
aagctgtagaggcagtacattt

SEQ ID NO: 7939125 - DNA, 22 bp, Homo sapiens
aagctgtagaggcagtacattt

SEQ ID NO: 7939126 - DNA, 22 bp, Homo sapiens
aagctgtcaatgtatctagtct

SEQ ID NO: 7939127 - DNA, 22 bp, Homo sapiens
aagctgtgaaatagattacaca

SEQ ID NO: 7939128 - DNA, 22 bp, Homo sapiens
aagctgtgaaatagattacaca

SEQ ID NO: 7939129 - DNA, 22 bp, Homo sapiens
aagctgtgaaatagattacaca

SEQ ID NO: 7939130 - DNA, 20 bp, Homo sapiens
aagctgggtaggagaggagc

SEQ ID NO: 7939131 - DNA, 22 bp, Homo sapiens
aagctggggactcagaccccat

SEQ ID NO: 7939132 - DNA, 22 bp, Homo sapiens
aagctgtacttagcattgactc

SEQ ID NO: 7939133 - DNA, 22 bp, Homo sapiens
aagctgtacttagcattgactc

SEQ ID NO: 7939134 - DNA, 20 bp, Homo sapiens
aagctgggtaggagaggagc

SEQ ID NO: 7939135 - DNA, 20 bp, Homo sapiens
aagctgggtaggagaggagc

SEQ ID NO: 7939136 - DNA, 22 bp, Homo sapiens
aagctgggacttagcgcagata

SEQ ID NO: 7939137 - DNA, 22 bp, Homo sapiens
aagctgggacttagcgcagata

SEQ ID NO: 7939138 - DNA, 22 bp, Homo sapiens
aagctgggacttagcgcagata

SEQ ID NO: 7939139 - DNA, 22 bp, Homo sapiens
aagctgggacttagcgcagata

SEQ ID NO: 7939140 - DNA, 22 bp, Homo sapiens
aagctgggagggagcccagagt

SEQ ID NO: 7939141 - DNA, 22 bp, Homo sapiens
aagctttttggatttgcttcag

SEQ ID NO: 7939142 - DNA, 22 bp, Homo sapiens
aagcttttgacttggtagggaa

SEQ ID NO: 7939143 - DNA, 21 bp, Homo sapiens
aaggaaaagcttggtctctga

SEQ ID NO: 7939144 - DNA, 21 bp, Homo sapiens
aaggaaaagcttggtctctga

SEQ ID NO: 7939145 - DNA, 22 bp, Homo sapiens
aagcttttctcagtgtccttgg

SEQ ID NO: 7939146 - DNA, 21 bp, Homo sapiens
aagcttttcctgagagttgtc

SEQ ID NO: 7939147 - DNA, 22 bp, Homo sapiens
aagctttgtccaaggccatgca

SEQ ID NO: 7939148 - DNA, 22 bp, Homo sapiens
aagctttgggcagaagaggatt

SEQ ID NO: 7939149 - DNA, 22 bp, Homo sapiens
aagctttgttcttcacagagtg

SEQ ID NO: 7939150 - DNA, 22 bp, Homo sapiens
aagctttgttcttcacagagtg

SEQ ID NO: 7939151 - DNA, 22 bp, Homo sapiens
aagctttcagagcagaatgtga

SEQ ID NO: 7939152 - DNA, 22 bp, Homo sapiens
aagctttcagagcagaatgtga

SEQ ID NO: 7939153 - DNA, 22 bp, Homo sapiens
aagctttgactactgcctcttg

SEQ ID NO: 7939154 - DNA, 22 bp, Homo sapiens
aagctttgactactgcctcttg

SEQ ID NO: 7939155 - DNA, 19 bp, Homo sapiens
aagctttcccattaacccc

SEQ ID NO: 7939156 - DNA, 22 bp, Homo sapiens
aagctttgataattggattact

SEQ ID NO: 7939157 - DNA, 22 bp, Homo sapiens
aagctttgataattggattact

SEQ ID NO: 7939158 - DNA, 22 bp, Homo sapiens
aagctttgcaatgcttcattat

SEQ ID NO: 7939159 - DNA, 22 bp, Homo sapiens
aagctttgcaccggtggctgga

SEQ ID NO: 7939160 - DNA, 22 bp, Homo sapiens
aagctttggagaggcgggcagg

SEQ ID NO: 7939161 - DNA, 22 bp, Homo sapiens
aagctttgggcagaagaggatt

SEQ ID NO: 7939162 - DNA, 22 bp, Homo sapiens
aagctttggaagggcagggttg

SEQ ID NO: 7939163 - DNA, 22 bp, Homo sapiens
aagctttggaagggcagggttg

SEQ ID NO: 7939164 - DNA, 22 bp, Homo sapiens
aagctttgcaccggtggctgga

SEQ ID NO: 7939165 - DNA, 22 bp, Homo sapiens
aagctgcaaaaaatttctgtct

SEQ ID NO: 7939166 - DNA, 22 bp, Homo sapiens
aagctggcaaacaagcatcatt

SEQ ID NO: 7939167 - DNA, 22 bp, Homo sapiens
aagccatttcctgatacaccta

SEQ ID NO: 7939168 - DNA, 22 bp, Homo sapiens
aagcccagaatcaagtctactg

SEQ ID NO: 7939169 - DNA, 22 bp, Homo sapiens
aagcccagaatcaagtctactg

SEQ ID NO: 7939170 - DNA, 22 bp, Homo sapiens
aagcccagaatcaagtctactg

SEQ ID NO: 7939171 - DNA, 22 bp, Homo sapiens
aagcccagatgagatccctgga

SEQ ID NO: 7939172 - DNA, 22 bp, Homo sapiens
aagcccagatgagatccctgga

SEQ ID NO: 7939173 - DNA, 18 bp, Homo sapiens
aagctgggaaggagacag

SEQ ID NO: 7939174 - DNA, 18 bp, Homo sapiens
aagctgggaaggagacag

SEQ ID NO: 7939175 - DNA, 18 bp, Homo sapiens
aagctgggaaggagacag

SEQ ID NO: 7939176 - DNA, 22 bp, Homo sapiens
aagctggcctcaaactcctagc

SEQ ID NO: 7939177 - DNA, 22 bp, Homo sapiens
aagctggcctgtacctgctgag

SEQ ID NO: 7939178 - DNA, 22 bp, Homo sapiens
aagctggcctgtacctgctgag

SEQ ID NO: 7939179 - DNA, 22 bp, Homo sapiens
aagctggcatgtcacctgagaa

SEQ ID NO: 7939180 - DNA, 22 bp, Homo sapiens
aagctggcatgtcacctgagaa

SEQ ID NO: 7939181 - DNA, 22 bp, Homo sapiens
aagccattcatctaatgtcctg

SEQ ID NO: 7939182 - DNA, 22 bp, Homo sapiens
aagccatttcctgatacaccta

SEQ ID NO: 7939183 - DNA, 22 bp, Homo sapiens
aagccattcccatagacttcag

SEQ ID NO: 7939184 - DNA, 22 bp, Homo sapiens
aagccatggctgcatcagcctg

SEQ ID NO: 7939185 - DNA, 22 bp, Homo sapiens
aagccatggctgcatcagcctg

SEQ ID NO: 7939186 - DNA, 22 bp, Homo sapiens
aagccatggcatgccaggatca

SEQ ID NO: 7939187 - DNA, 22 bp, Homo sapiens
aagccatgcaagccacaaggtg

SEQ ID NO: 7939188 - DNA, 16 bp, Homo sapiens
aagccagttcagcatt

SEQ ID NO: 7939189 - DNA, 16 bp, Homo sapiens
aagccagttcagcatt

SEQ ID NO: 7939190 - DNA, 22 bp, Homo sapiens
aagccagttagcacatcattgc

SEQ ID NO: 7939191 - DNA, 22 bp, Homo sapiens
aagccagtgtgacaggaaactt

SEQ ID NO: 7939192 - DNA, 22 bp, Homo sapiens
aagccagtgtgacaggaaactt

SEQ ID NO: 7939193 - DNA, 22 bp, Homo sapiens
aagccagtgtttttgagagttg

SEQ ID NO: 7939194 - DNA, 22 bp, Homo sapiens
aagccagtgtttttgagagttg

SEQ ID NO: 7939195 - DNA, 22 bp, Homo sapiens
aagccagtgtggtctgcccatt

SEQ ID NO: 7939196 - DNA, 22 bp, Homo sapiens
aagccagccagtgccagtctta

SEQ ID NO: 7939197 - DNA, 22 bp, Homo sapiens
aagccagtaagtttttgtcatt

SEQ ID NO: 7939198 - DNA, 22 bp, Homo sapiens
aagccagtattcaatggggcta

SEQ ID NO: 7939199 - DNA, 22 bp, Homo sapiens
aagccagcattttcccattcct

SEQ ID NO: 7939200 - DNA, 21 bp, Homo sapiens
aagccagcccacagtggtttg

SEQ ID NO: 7939201 - DNA, 22 bp, Homo sapiens
aagccagatttcactcttaatt

SEQ ID NO: 7939202 - DNA, 22 bp, Homo sapiens
aagccagcattttcccattcct

SEQ ID NO: 7939203 - DNA, 22 bp, Homo sapiens
aagccagtggtgagaagatagc

SEQ ID NO: 7939204 - DNA, 22 bp, Homo sapiens
aagccagtggcttctccctgct

SEQ ID NO: 7939205 - DNA, 22 bp, Homo sapiens
aagccagtgggcatagcagttg

SEQ ID NO: 7939206 - DNA, 22 bp, Homo sapiens
aagccagtgggcatagcagttg

SEQ ID NO: 7939207 - DNA, 22 bp, Homo sapiens
aagccagtgtccagaatgggca

SEQ ID NO: 7939208 - DNA, 22 bp, Homo sapiens
aagccagtgtccagaatgggca

SEQ ID NO: 7939209 - DNA, 22 bp, Homo sapiens
aagccagtcctctactgggcac

SEQ ID NO: 7939210 - DNA, 22 bp, Homo sapiens
aagccagtcctctactgggcac

SEQ ID NO: 7939211 - DNA, 22 bp, Homo sapiens
aagccagtcctctactgggcac

SEQ ID NO: 7939212 - DNA, 22 bp, Homo sapiens
tccaccagcagcctgtcagcct

SEQ ID NO: 7939213 - DNA, 22 bp, Homo sapiens
tccaccagcagcctgtcagcct

SEQ ID NO: 7939214 - DNA, 22 bp, Homo sapiens
tccaccagagccttcccatgct

SEQ ID NO: 7939215 - DNA, 22 bp, Homo sapiens
tccaccagagccttcccatgct

SEQ ID NO: 7939216 - DNA, 22 bp, Homo sapiens
tccaccagagccctctttgcgg

SEQ ID NO: 7939217 - DNA, 22 bp, Homo sapiens
tccaccagagccctctttgcgg

SEQ ID NO: 7939218 - DNA, 22 bp, Homo sapiens
tccaccacttcctgcagccatt

SEQ ID NO: 7939219 - DNA, 22 bp, Homo sapiens
tccaccagagccttcccatgct

SEQ ID NO: 7939220 - DNA, 22 bp, Homo sapiens
tccaccagagccctctttgcgg

SEQ ID NO: 7939221 - DNA, 22 bp, Homo sapiens
tccacagggatgttgagttctt

SEQ ID NO: 7939222 - DNA, 22 bp, Homo sapiens
tccacagggatgttgagttctt

SEQ ID NO: 7939223 - DNA, 22 bp, Homo sapiens
tccacagggcctttctggtgtg

SEQ ID NO: 7939224 - DNA, 22 bp, Homo sapiens
tccacagggattcacccaaaag

SEQ ID NO: 7939225 - DNA, 22 bp, Homo sapiens
tccaccacttcctgcagccatt

SEQ ID NO: 7939226 - DNA, 22 bp, Homo sapiens
tccacattgcacagccagaaca

SEQ ID NO: 7939227 - DNA, 22 bp, Homo sapiens
tccacattctctgttacagata

SEQ ID NO: 7939228 - DNA, 22 bp, Homo sapiens
tccaccagggtttcatctccct

SEQ ID NO: 7939229 - DNA, 22 bp, Homo sapiens
tccaccaggctccatgttcagt

SEQ ID NO: 7939230 - DNA, 22 bp, Homo sapiens
tccaccaggctccatgttcagt

SEQ ID NO: 7939231 - DNA, 22 bp, Homo sapiens
tccaccaggctccatgttcagt

SEQ ID NO: 7939232 - DNA, 20 bp, Homo sapiens
tccaccaggaagggtaggga

SEQ ID NO: 7939233 - DNA, 20 bp, Homo sapiens
tccaccaggaagggtaggga

SEQ ID NO: 7939234 - DNA, 22 bp, Homo sapiens
tccaccagcttcttcaccagct

SEQ ID NO: 7939235 - DNA, 22 bp, Homo sapiens
tccaccagcttcttcaccagct

SEQ ID NO: 7939236 - DNA, 22 bp, Homo sapiens
tccaccagccaggcccaggctg

SEQ ID NO: 7939237 - DNA, 22 bp, Homo sapiens
tccaccagcagcctgtcagcct

SEQ ID NO: 7939238 - DNA, 22 bp, Homo sapiens
tccaccagccaggcccaggctg

SEQ ID NO: 7939239 - DNA, 22 bp, Homo sapiens
tccaccagcagcctgtcagcct

SEQ ID NO: 7939240 - DNA, 22 bp, Homo sapiens
tccaccagccaggcccaggctg

SEQ ID NO: 7939241 - DNA, 22 bp, Homo sapiens
tccaccagccaggcccaggctg

SEQ ID NO: 7939242 - DNA, 22 bp, Homo sapiens
tccaccagccaggcccaggctg

SEQ ID NO: 7939243 - DNA, 21 bp, Homo sapiens
tccaccagctcttcctcttca

SEQ ID NO: 7939244 - DNA, 22 bp, Homo sapiens
tccaccagccaggcccaggctg

SEQ ID NO: 7939245 - DNA, 22 bp, Homo sapiens
tccaccagcttcttcaccagct

SEQ ID NO: 7939246 - DNA, 22 bp, Homo sapiens
tccaccagcttcttcaccagct

SEQ ID NO: 7939247 - DNA, 18 bp, Homo sapiens
tccaccagtcaatctgtc

SEQ ID NO: 7939248 - DNA, 22 bp, Homo sapiens
tccaccagggtttcatctccct

SEQ ID NO: 7939249 - DNA, 22 bp, Homo sapiens
tccaccagggtttcatctccct

SEQ ID NO: 7939250 - DNA, 18 bp, Homo sapiens
tccaccagtcaatctgtc

SEQ ID NO: 7939251 - DNA, 18 bp, Homo sapiens
tccaccagtcaatctgtc

SEQ ID NO: 7939252 - DNA, 22 bp, Homo sapiens
tccaccagttcaccttgtagca

SEQ ID NO: 7939253 - DNA, 22 bp, Homo sapiens
tccaccagttcaccttgtagca

SEQ ID NO: 7939254 - DNA, 18 bp, Homo sapiens
tccaccagtcaatctgtc

SEQ ID NO: 7939255 - DNA, 22 bp, Homo sapiens
tccaccatgtaacaagctctgt

SEQ ID NO: 7939256 - DNA, 22 bp, Homo sapiens
tccaccatgtaacaagctctgt

SEQ ID NO: 7939257 - DNA, 22 bp, Homo sapiens
tccaccatgtaacaagctctgt

SEQ ID NO: 7939258 - DNA, 22 bp, Homo sapiens
tccaccatgtaacaagctctgt

SEQ ID NO: 7939259 - DNA, 22 bp, Homo sapiens
tccaccatgtaacaagctctgt

SEQ ID NO: 7939260 - DNA, 22 bp, Homo sapiens
tccaccatgtaacaagctctgt

SEQ ID NO: 7939261 - DNA, 23 bp, Homo sapiens
tccaccccagctgaggcttagcc

SEQ ID NO: 7939262 - DNA, 22 bp, Homo sapiens
tccacccccagacagctggtga

SEQ ID NO: 7939263 - DNA, 22 bp, Homo sapiens
tccacccccagacagctggtga

SEQ ID NO: 7939264 - DNA, 22 bp, Homo sapiens
tccacccccagacagctggtga

SEQ ID NO: 7939265 - DNA, 22 bp, Homo sapiens
tccacccccagacagctggtga

SEQ ID NO: 7939266 - DNA, 23 bp, Homo sapiens
tccaccccagctgaggcttagcc

SEQ ID NO: 7939267 - DNA, 23 bp, Homo sapiens
tccaccccagctgaggcttagcc

SEQ ID NO: 7939268 - DNA, 19 bp, Homo sapiens
tccaccccagccagctctg

SEQ ID NO: 7939269 - DNA, 19 bp, Homo sapiens
tccaccccagccagctctg

SEQ ID NO: 7939270 - DNA, 19 bp, Homo sapiens
tccaccccagccagctctg

SEQ ID NO: 7939271 - DNA, 19 bp, Homo sapiens
tccaccccagccagctctg

SEQ ID NO: 7939272 - DNA, 22 bp, Homo sapiens
tccacccagtgtttctacaggt

SEQ ID NO: 7939273 - DNA, 22 bp, Homo sapiens
tccacccagtgtttctacaggt

SEQ ID NO: 7939274 - DNA, 22 bp, Homo sapiens
tccacccagcacactgtggtag

SEQ ID NO: 7939275 - DNA, 22 bp, Homo sapiens
tccaccctgctttcttatctcc

SEQ ID NO: 7939276 - DNA, 22 bp, Homo sapiens
tccaccctgctttcttatctcc

SEQ ID NO: 7939277 - DNA, 22 bp, Homo sapiens
tccaccctgcttttgtctttga

SEQ ID NO: 7939278 - DNA, 18 bp, Homo sapiens
tccaccgcgtgcacctct

SEQ ID NO: 7939279 - DNA, 21 bp, Homo sapiens
tccaccctctctgctcccagt

SEQ ID NO: 7939280 - DNA, 21 bp, Homo sapiens
tccaccctctctgctcccagt

SEQ ID NO: 7939281 - DNA, 21 bp, Homo sapiens
tccaccctctctgctcccagt

SEQ ID NO: 7939282 - DNA, 22 bp, Homo sapiens
tccacccctgggaatgtcaata

SEQ ID NO: 7939283 - DNA, 21 bp, Homo sapiens
tccaccctctctgctcccagt

SEQ ID NO: 7939284 - DNA, 21 bp, Homo sapiens
tccaccctctctgctcccagt

SEQ ID NO: 7939285 - DNA, 22 bp, Homo sapiens
tccacccctgggaatgtcaata

SEQ ID NO: 7939286 - DNA, 22 bp, Homo sapiens
tccacctgggcaacagtgcctc

SEQ ID NO: 7939287 - DNA, 22 bp, Homo sapiens
tccacctgagtttcagttattt

SEQ ID NO: 7939288 - DNA, 22 bp, Homo sapiens
tccacctgagtttcagttattt

SEQ ID NO: 7939289 - DNA, 22 bp, Homo sapiens
tccacgctgtgtgaccttgggc

SEQ ID NO: 7939290 - DNA, 22 bp, Homo sapiens
tccactccttatgccagacggt

SEQ ID NO: 7939291 - DNA, 22 bp, Homo sapiens
tccactctaattactaccttct

SEQ ID NO: 7939292 - DNA, 22 bp, Homo sapiens
tccactcatgagatctggctga

SEQ ID NO: 7939293 - DNA, 22 bp, Homo sapiens
tccactgacaggtgaatggata

SEQ ID NO: 7939294 - DNA, 22 bp, Homo sapiens
tccactgacaggtgaatggata

SEQ ID NO: 7939295 - DNA, 22 bp, Homo sapiens
tccactctaattactaccttct

SEQ ID NO: 7939296 - DNA, 22 bp, Homo sapiens
tccacgtgagcttcgtgtgcag

SEQ ID NO: 7939297 - DNA, 22 bp, Homo sapiens
tccacgctgtgtgaccttgggc

SEQ ID NO: 7939298 - DNA, 22 bp, Homo sapiens
tccacgtgacctttgtggtgga

SEQ ID NO: 7939299 - DNA, 22 bp, Homo sapiens
tccacgttgcatcaccagtcta

SEQ ID NO: 7939300 - DNA, 22 bp, Homo sapiens
tccacgttttcaacacagccaa

SEQ ID NO: 7939301 - DNA, 22 bp, Homo sapiens
tccacgtgagcttcgtgtgcag

SEQ ID NO: 7939302 - DNA, 22 bp, Homo sapiens
tccacgtgagcttcgtgtgcag

SEQ ID NO: 7939303 - DNA, 22 bp, Homo sapiens
tccacgtgagcttcgtgtgcag

SEQ ID NO: 7939304 - DNA, 22 bp, Homo sapiens
tccacgtgagcttcgtgtgcag

SEQ ID NO: 7939305 - DNA, 22 bp, Homo sapiens
tccacttttcttccatcatcat

SEQ ID NO: 7939306 - DNA, 22 bp, Homo sapiens
tccacttttcttccatcatcat

SEQ ID NO: 7939307 - DNA, 22 bp, Homo sapiens
tccacttttcttccatcatcat

SEQ ID NO: 7939308 - DNA, 22 bp, Homo sapiens
tccactttagcaatgattgaat

SEQ ID NO: 7939309 - DNA, 22 bp, Homo sapiens
tccactttagcaatgattgaat

SEQ ID NO: 7939310 - DNA, 22 bp, Homo sapiens
tccacttcatccagggtcacca

SEQ ID NO: 7939311 - DNA, 22 bp, Homo sapiens
tccacttcatccagggtcacca

SEQ ID NO: 7939312 - DNA, 22 bp, Homo sapiens
tccagaaaaagtaatttatttg

SEQ ID NO: 7939313 - DNA, 22 bp, Homo sapiens
tccagaaaaagtaatttatttg

SEQ ID NO: 7939314 - DNA, 22 bp, Homo sapiens
tccagaaaaagtaatttatttg

SEQ ID NO: 7939315 - DNA, 22 bp, Homo sapiens
tccagaaaaagtaatttatttg

SEQ ID NO: 7939316 - DNA, 21 bp, Homo sapiens
tccagaaaagaggtcattagc

SEQ ID NO: 7939317 - DNA, 22 bp, Homo sapiens
tccagaaaattcagaaattgtt

SEQ ID NO: 7939318 - DNA, 22 bp, Homo sapiens
tccagaaaattcagaaattgtt

SEQ ID NO: 7939319 - DNA, 22 bp, Homo sapiens
tccactgcagcttctgatggaa

SEQ ID NO: 7939320 - DNA, 20 bp, Homo sapiens
tccactgccggaccggggtt

SEQ ID NO: 7939321 - DNA, 22 bp, Homo sapiens
tccactgctcattccacaggca

SEQ ID NO: 7939322 - DNA, 22 bp, Homo sapiens
tccactgctcattccacaggca

SEQ ID NO: 7939323 - DNA, 22 bp, Homo sapiens
tccactgctacaacctcccaga

SEQ ID NO: 7939324 - DNA, 22 bp, Homo sapiens
tccactgctcattccacaggca

SEQ ID NO: 7939325 - DNA, 22 bp, Homo sapiens
tccactgctcattccacaggca

SEQ ID NO: 7939326 - DNA, 22 bp, Homo sapiens
tccactggcccacctcctcagt

SEQ ID NO: 7939327 - DNA, 22 bp, Homo sapiens
tccactggcccacctcctcagt

SEQ ID NO: 7939328 - DNA, 22 bp, Homo sapiens
tccactggaacaactctgaggc

SEQ ID NO: 7939329 - DNA, 22 bp, Homo sapiens
tccactggaacaactctgaggc

SEQ ID NO: 7939330 - DNA, 22 bp, Homo sapiens
tccactggcccacctcctcagt

SEQ ID NO: 7939331 - DNA, 22 bp, Homo sapiens
tccactggcctctgtctttcag

SEQ ID NO: 7939332 - DNA, 22 bp, Homo sapiens
tccactggtatccacagtgggg

SEQ ID NO: 7939333 - DNA, 22 bp, Homo sapiens
tccactggtatccacagtgggg

SEQ ID NO: 7939334 - DNA, 22 bp, Homo sapiens
tccactggtaatacctagatcc

SEQ ID NO: 7939335 - DNA, 22 bp, Homo sapiens
tccactggcttggaaaatcatt

SEQ ID NO: 7939336 - DNA, 22 bp, Homo sapiens
tccacaggctgaggcccttctg

SEQ ID NO: 7939337 - DNA, 22 bp, Homo sapiens
tccacaggctgaggcccttctg

SEQ ID NO: 7939338 - DNA, 22 bp, Homo sapiens
tccacaggcaagtctcttggca

SEQ ID NO: 7939339 - DNA, 22 bp, Homo sapiens
tccacaggctgaggcccttctg

SEQ ID NO: 7939340 - DNA, 22 bp, Homo sapiens
tccacaggctgaggcccttctg

SEQ ID NO: 7939341 - DNA, 22 bp, Homo sapiens
tccacaggaaagcacctcccat

SEQ ID NO: 7939342 - DNA, 22 bp, Homo sapiens
tccacaggcaagtctcttggca

SEQ ID NO: 7939343 - DNA, 22 bp, Homo sapiens
tccacaggcaagtctcttggca

SEQ ID NO: 7939344 - DNA, 22 bp, Homo sapiens
tccacaggcaagtctcttggca

SEQ ID NO: 7939345 - DNA, 22 bp, Homo sapiens
tccacagggatgttgagttctt

SEQ ID NO: 7939346 - DNA, 22 bp, Homo sapiens
tccacagggatgttgagttctt

SEQ ID NO: 7939347 - DNA, 22 bp, Homo sapiens
tccacagggatgttgagttctt

SEQ ID NO: 7939348 - DNA, 22 bp, Homo sapiens
tccacagggatgcctgcggctt

SEQ ID NO: 7939349 - DNA, 22 bp, Homo sapiens
tccacagggatgcctgcggctt

SEQ ID NO: 7939350 - DNA, 22 bp, Homo sapiens
tccacagggatgcctgcggctt

SEQ ID NO: 7939351 - DNA, 22 bp, Homo sapiens
tccacagggatgcctgcggctt

SEQ ID NO: 7939352 - DNA, 22 bp, Homo sapiens
tccacaggctgaggcccttctg

SEQ ID NO: 7939353 - DNA, 22 bp, Homo sapiens
tccacagggatgcctgcggctt

SEQ ID NO: 7939354 - DNA, 22 bp, Homo sapiens
tccacagcacaaagccagtgtg

SEQ ID NO: 7939355 - DNA, 22 bp, Homo sapiens
tccacagcacaaagccagtgtg

SEQ ID NO: 7939356 - DNA, 22 bp, Homo sapiens
tccacagcattattagaaggat

SEQ ID NO: 7939357 - DNA, 22 bp, Homo sapiens
tccacagcattattagaaggat

SEQ ID NO: 7939358 - DNA, 22 bp, Homo sapiens
tccacagcacaaagccagtgtg

SEQ ID NO: 7939359 - DNA, 22 bp, Homo sapiens
tccacaggaaagcacctcccat

SEQ ID NO: 7939360 - DNA, 22 bp, Homo sapiens
tccacaggaaagcacctcccat

SEQ ID NO: 7939361 - DNA, 22 bp, Homo sapiens
tccacaggaaagcacctcccat

SEQ ID NO: 7939362 - DNA, 22 bp, Homo sapiens
tccacagcttttaaatgtctag

SEQ ID NO: 7939363 - DNA, 22 bp, Homo sapiens
tccacagataaaaacagaggtt

SEQ ID NO: 7939364 - DNA, 22 bp, Homo sapiens
tccacagactattaagtgatct

SEQ ID NO: 7939365 - DNA, 22 bp, Homo sapiens
tccacagcacaaagccagtgtg

SEQ ID NO: 7939366 - DNA, 22 bp, Homo sapiens
tccacagaatgtaagatccaca

SEQ ID NO: 7939367 - DNA, 22 bp, Homo sapiens
tccacacacatttctatgtgca

SEQ ID NO: 7939368 - DNA, 22 bp, Homo sapiens
tccacacttgctgtctgctgag

SEQ ID NO: 7939369 - DNA, 22 bp, Homo sapiens
tccacacttgctgtctgctgag

SEQ ID NO: 7939370 - DNA, 22 bp, Homo sapiens
tccacacacatttctatgtgca

SEQ ID NO: 7939371 - DNA, 22 bp, Homo sapiens
tccacagaccagtatctgcagc

SEQ ID NO: 7939372 - DNA, 22 bp, Homo sapiens
tccacagaccagtatctgcagc

SEQ ID NO: 7939373 - DNA, 22 bp, Homo sapiens
tccacaatggcagagaaatgtc

SEQ ID NO: 7939374 - DNA, 21 bp, Homo sapiens
tccacaatagggaaattcacc

SEQ ID NO: 7939375 - DNA, 22 bp, Homo sapiens
tccacacacatttctatgtgca

SEQ ID NO: 7939376 - DNA, 22 bp, Homo sapiens
tccacacacatttctatgtgca

SEQ ID NO: 7939377 - DNA, 22 bp, Homo sapiens
tcattaataagtctaactctcc

SEQ ID NO: 7939378 - DNA, 22 bp, Homo sapiens
tcattaagattcctatggcatt

SEQ ID NO: 7939379 - DNA, 22 bp, Homo sapiens
tcattaaatgtttgttgtgcca

SEQ ID NO: 7939380 - DNA, 22 bp, Homo sapiens
tcattaaatgtttgttgtgcca

SEQ ID NO: 7939381 - DNA, 22 bp, Homo sapiens
tcattaaatgtttgttgtgcca

SEQ ID NO: 7939382 - DNA, 22 bp, Homo sapiens
tcatgtttctcttacagcagct

SEQ ID NO: 7939383 - DNA, 22 bp, Homo sapiens
tcatgtttctcttacagcagct

SEQ ID NO: 7939384 - DNA, 22 bp, Homo sapiens
tcatgtttgccctaagaaaaag

SEQ ID NO: 7939385 - DNA, 22 bp, Homo sapiens
tcatgtttgccctaagaaaaag

SEQ ID NO: 7939386 - DNA, 22 bp, Homo sapiens
tcatgtttgccctaagaaaaag

SEQ ID NO: 7939387 - DNA, 22 bp, Homo sapiens
tcatgtttgagactaatttttc

SEQ ID NO: 7939388 - DNA, 22 bp, Homo sapiens
tcatgtttgttggaaatgtggc

SEQ ID NO: 7939389 - DNA, 22 bp, Homo sapiens
tcatgtttgttggaaatgtggc

SEQ ID NO: 7939390 - DNA, 22 bp, Homo sapiens
tcatgtttgttggaaatgtggc

SEQ ID NO: 7939391 - DNA, 22 bp, Homo sapiens
tcatgtttgccctaagaaaaag

SEQ ID NO: 7939392 - DNA, 22 bp, Homo sapiens
tcatgtttggagtttgctcact

SEQ ID NO: 7939393 - DNA, 22 bp, Homo sapiens
tcatgtttggagtttgctcact

SEQ ID NO: 7939394 - DNA, 22 bp, Homo sapiens
tcatgttttagctgcaaaatga

SEQ ID NO: 7939395 - DNA, 22 bp, Homo sapiens
tcatgttttagctgcaaaatga

SEQ ID NO: 7939396 - DNA, 22 bp, Homo sapiens
tcatgttttagtaaagtgaagg

SEQ ID NO: 7939397 - DNA, 22 bp, Homo sapiens
tcatgttttagctgcaaaatga

SEQ ID NO: 7939398 - DNA, 22 bp, Homo sapiens
tcatgttttagctgcaaaatga

SEQ ID NO: 7939399 - DNA, 22 bp, Homo sapiens
tcatgttttagtaaagtgaagg

SEQ ID NO: 7939400 - DNA, 22 bp, Homo sapiens
tcatgtttttgccatatgactc

SEQ ID NO: 7939401 - DNA, 22 bp, Homo sapiens
tcatgtttttgccatatgactc

SEQ ID NO: 7939402 - DNA, 22 bp, Homo sapiens
tcatgttttagtaaagtgaagg

SEQ ID NO: 7939403 - DNA, 22 bp, Homo sapiens
tcatgttttagtaaagtgaagg

SEQ ID NO: 7939404 - DNA, 22 bp, Homo sapiens
tcatgttttagtaaagtgaagg

SEQ ID NO: 7939405 - DNA, 22 bp, Homo sapiens
tcatgtttttgccatatgactc

SEQ ID NO: 7939406 - DNA, 22 bp, Homo sapiens
tcatgtgtgtttcatgtatgga

SEQ ID NO: 7939407 - DNA, 22 bp, Homo sapiens
tcatgttattgactcataatat

SEQ ID NO: 7939408 - DNA, 22 bp, Homo sapiens
tcatgttattgactcataatat

SEQ ID NO: 7939409 - DNA, 22 bp, Homo sapiens
tcatgttatcttggctctggga

SEQ ID NO: 7939410 - DNA, 20 bp, Homo sapiens
tcatgtgtgtcctacagaga

SEQ ID NO: 7939411 - DNA, 20 bp, Homo sapiens
tcatgtgtgtcctacagaga

SEQ ID NO: 7939412 - DNA, 22 bp, Homo sapiens
tcatgtgtgtttcatgtatgga

SEQ ID NO: 7939413 - DNA, 22 bp, Homo sapiens
tcatgtgtgtttcatgtatgga

SEQ ID NO: 7939414 - DNA, 18 bp, Homo sapiens
tcatggctttagtccctc

SEQ ID NO: 7939415 - DNA, 22 bp, Homo sapiens
tcatggcttttattatgttgag

SEQ ID NO: 7939416 - DNA, 22 bp, Homo sapiens
tcatgtgtcctagttcatataa

SEQ ID NO: 7939417 - DNA, 22 bp, Homo sapiens
tcatggctggaagctcagttag

SEQ ID NO: 7939418 - DNA, 22 bp, Homo sapiens
tcatggctggaagctcagttag

SEQ ID NO: 7939419 - DNA, 22 bp, Homo sapiens
tccaggaagccacactgggcct

SEQ ID NO: 7939420 - DNA, 22 bp, Homo sapiens
tccaggaaggactaatggtttg

SEQ ID NO: 7939421 - DNA, 22 bp, Homo sapiens
tccaggaaggactaatggtttg

SEQ ID NO: 7939422 - DNA, 22 bp, Homo sapiens
tccaggaatagtcatgttttag

SEQ ID NO: 7939423 - DNA, 22 bp, Homo sapiens
tccaggaatctgtgcctagccc

SEQ ID NO: 7939424 - DNA, 22 bp, Homo sapiens
tccaggaatagatcagagattt

SEQ ID NO: 7939425 - DNA, 22 bp, Homo sapiens
tccaggaatagatcagagattt

SEQ ID NO: 7939426 - DNA, 22 bp, Homo sapiens
tccaggaatagatcagagattt

SEQ ID NO: 7939427 - DNA, 22 bp, Homo sapiens
tccaggaatagatcagagattt

SEQ ID NO: 7939428 - DNA, 22 bp, Homo sapiens
tccaggaatagtcatgttttag

SEQ ID NO: 7939429 - DNA, 22 bp, Homo sapiens
tccaggaactcttgatggtgat

SEQ ID NO: 7939430 - DNA, 22 bp, Homo sapiens
tccaggaactgaagccaggtgt

SEQ ID NO: 7939431 - DNA, 22 bp, Homo sapiens
tccaggaacagaatgttagtgc

SEQ ID NO: 7939432 - DNA, 22 bp, Homo sapiens
tccaggaactcttgatggtgat

SEQ ID NO: 7939433 - DNA, 22 bp, Homo sapiens
tccaggaagaggtgtgttggga

SEQ ID NO: 7939434 - DNA, 22 bp, Homo sapiens
tccaggaactgaagccaggtgt

SEQ ID NO: 7939435 - DNA, 22 bp, Homo sapiens
tccaggaagcagctacagatcc

SEQ ID NO: 7939436 - DNA, 22 bp, Homo sapiens
tccaggaagcagctacagatcc

SEQ ID NO: 7939437 - DNA, 22 bp, Homo sapiens
tccaggaagcagctacagatcc

SEQ ID NO: 7939438 - DNA, 22 bp, Homo sapiens
tccaggaagcagtgtttggagc

SEQ ID NO: 7939439 - DNA, 22 bp, Homo sapiens
tccaggaacgagaggctgggca

SEQ ID NO: 7939440 - DNA, 22 bp, Homo sapiens
tccaggaacagaatgttagtgc

SEQ ID NO: 7939441 - DNA, 22 bp, Homo sapiens
tccaggaacagaatgttagtgc

SEQ ID NO: 7939442 - DNA, 22 bp, Homo sapiens
tccaggaaatcataaattgctt

SEQ ID NO: 7939443 - DNA, 22 bp, Homo sapiens
tccaggaaatcataaattgctt

SEQ ID NO: 7939444 - DNA, 21 bp, Homo sapiens
tccagcctttccctcacttcc

SEQ ID NO: 7939445 - DNA, 22 bp, Homo sapiens
tccaggaaatcagaagtggtaa

SEQ ID NO: 7939446 - DNA, 22 bp, Homo sapiens
tccaggaaatcagaagtggtaa

SEQ ID NO: 7939447 - DNA, 22 bp, Homo sapiens
tccaggaaatcagaagtggtaa

SEQ ID NO: 7939448 - DNA, 21 bp, Homo sapiens
tccagcctttccctcacttcc

SEQ ID NO: 7939449 - DNA, 22 bp, Homo sapiens
tccagccttctcaaggctggct

SEQ ID NO: 7939450 - DNA, 21 bp, Homo sapiens
tccagcctttccctcacttcc

SEQ ID NO: 7939451 - DNA, 21 bp, Homo sapiens
tccagcctttccctcacttcc

SEQ ID NO: 7939452 - DNA, 22 bp, Homo sapiens
tccagccttgccacttttctgt

SEQ ID NO: 7939453 - DNA, 19 bp, Homo sapiens
tccagcctgctgtttctct

SEQ ID NO: 7939454 - DNA, 19 bp, Homo sapiens
tccagcctgctgtttctct

SEQ ID NO: 7939455 - DNA, 22 bp, Homo sapiens
tccagcctgaactttgtccaga

SEQ ID NO: 7939456 - DNA, 22 bp, Homo sapiens
tccagcctggttgcgggcatcc

SEQ ID NO: 7939457 - DNA, 22 bp, Homo sapiens
tccagccttctcaaggctggct

SEQ ID NO: 7939458 - DNA, 22 bp, Homo sapiens
tccagccttctcaaggctggct

SEQ ID NO: 7939459 - DNA, 22 bp, Homo sapiens
tccagccttctcaaggctggct

SEQ ID NO: 7939460 - DNA, 23 bp, Homo sapiens
tccagcctcttgctctcacatgc

SEQ ID NO: 7939461 - DNA, 23 bp, Homo sapiens
tccagcctcttgctctcacatgc

SEQ ID NO: 7939462 - DNA, 20 bp, Homo sapiens
tccagccctgcttctctctt

SEQ ID NO: 7939463 - DNA, 22 bp, Homo sapiens
tccagccctgtggcttccaccc

SEQ ID NO: 7939464 - DNA, 23 bp, Homo sapiens
tccagcctcttgctctcacatgc

SEQ ID NO: 7939465 - DNA, 22 bp, Homo sapiens
tccagccctgcttcctgcctca

SEQ ID NO: 7939466 - DNA, 22 bp, Homo sapiens
tccagccctgcttcctgcctca

SEQ ID NO: 7939467 - DNA, 20 bp, Homo sapiens
tccagccctgcttctctctt

SEQ ID NO: 7939468 - DNA, 20 bp, Homo sapiens
tccagccctgcttctctctt

SEQ ID NO: 7939469 - DNA, 20 bp, Homo sapiens
tccagccctgcttctctctt

SEQ ID NO: 7939470 - DNA, 20 bp, Homo sapiens
tccagccctgcttctctctt

SEQ ID NO: 7939471 - DNA, 22 bp, Homo sapiens
tccagccctgtggcttccaccc

SEQ ID NO: 7939472 - DNA, 23 bp, Homo sapiens
tccaggagcatgctggctggcga

SEQ ID NO: 7939473 - DNA, 23 bp, Homo sapiens
tccaggagcatgctggctggcga

SEQ ID NO: 7939474 - DNA, 22 bp, Homo sapiens
tccaggagctcatccacgtcaa

SEQ ID NO: 7939475 - DNA, 22 bp, Homo sapiens
tccaggagctcatccacgtcaa

SEQ ID NO: 7939476 - DNA, 22 bp, Homo sapiens
tccaggagctcatccacgtcaa

SEQ ID NO: 7939477 - DNA, 22 bp, Homo sapiens
tccaggagctcatccacgtcaa

SEQ ID NO: 7939478 - DNA, 22 bp, Homo sapiens
tccaggaggactgagggggctg

SEQ ID NO: 7939479 - DNA, 22 bp, Homo sapiens
tccaggaggactgagggggctg

SEQ ID NO: 7939480 - DNA, 22 bp, Homo sapiens
tccaggaggaggaaggctgcca

SEQ ID NO: 7939481 - DNA, 22 bp, Homo sapiens
tccaggaggaggaaggctgcca

SEQ ID NO: 7939482 - DNA, 22 bp, Homo sapiens
tccaggaggaggaaggctgcca

SEQ ID NO: 7939483 - DNA, 20 bp, Homo sapiens
tccaggagaactgggagccg

SEQ ID NO: 7939484 - DNA, 20 bp, Homo sapiens
tccaggagaactgggagccg

SEQ ID NO: 7939485 - DNA, 20 bp, Homo sapiens
tccaggagaactgggagccg

SEQ ID NO: 7939486 - DNA, 23 bp, Homo sapiens
tccaggagaacccctgtctgtcc

SEQ ID NO: 7939487 - DNA, 22 bp, Homo sapiens
tccaggagcatccaggtgaagc

SEQ ID NO: 7939488 - DNA, 23 bp, Homo sapiens
tccaggagcatgctggctggcga

SEQ ID NO: 7939489 - DNA, 22 bp, Homo sapiens
tccaggaatgtgtgtgggctag

SEQ ID NO: 7939490 - DNA, 22 bp, Homo sapiens
tccaggaatttcccctttcctg

SEQ ID NO: 7939491 - DNA, 22 bp, Homo sapiens
tccaggaatttcccctttcctg

SEQ ID NO: 7939492 - DNA, 21 bp, Homo sapiens
tccaggaatgtctgttcatct

SEQ ID NO: 7939493 - DNA, 21 bp, Homo sapiens
tccaggaatgtctgttcatct

SEQ ID NO: 7939494 - DNA, 20 bp, Homo sapiens
tccaggaatggtagaggact

SEQ ID NO: 7939495 - DNA, 22 bp, Homo sapiens
tccaggaatctgtgcctagccc

SEQ ID NO: 7939496 - DNA, 22 bp, Homo sapiens
tccaggaatctgtgcctagccc

SEQ ID NO: 7939497 - DNA, 20 bp, Homo sapiens
tccaggaatggtagaggact

SEQ ID NO: 7939498 - DNA, 20 bp, Homo sapiens
tccaggaatggtagaggact

SEQ ID NO: 7939499 - DNA, 22 bp, Homo sapiens
tccaggacagcggcaggcagat

SEQ ID NO: 7939500 - DNA, 22 bp, Homo sapiens
tccaggacagcggcaggcagat

SEQ ID NO: 7939501 - DNA, 22 bp, Homo sapiens
tccaggacagcggcaggcagat

SEQ ID NO: 7939502 - DNA, 22 bp, Homo sapiens
tccaggaccaaagacacatgta

SEQ ID NO: 7939503 - DNA, 22 bp, Homo sapiens
tccaggacagcggcaggcagat

SEQ ID NO: 7939504 - DNA, 22 bp, Homo sapiens
tccaggacctcccaggctagag

SEQ ID NO: 7939505 - DNA, 22 bp, Homo sapiens
tccaggacctcccaggctagag

SEQ ID NO: 7939506 - DNA, 22 bp, Homo sapiens
tccaggacctcccaggctagag

SEQ ID NO: 7939507 - DNA, 22 bp, Homo sapiens
tccaggacctgactgggcctgc

SEQ ID NO: 7939508 - DNA, 22 bp, Homo sapiens
tccaggacctgactgggcctgc

SEQ ID NO: 7939509 - DNA, 22 bp, Homo sapiens
tccaggagaaaactgacggtgg

SEQ ID NO: 7939510 - DNA, 21 bp, Homo sapiens
tccaggacttgagaattccag

SEQ ID NO: 7939511 - DNA, 22 bp, Homo sapiens
tccaggacttggcaggagatga

SEQ ID NO: 7939512 - DNA, 18 bp, Homo sapiens
tccaggactctgcgtggc

SEQ ID NO: 7939513 - DNA, 18 bp, Homo sapiens
tccaggactctgcgtggc

SEQ ID NO: 7939514 - DNA, 18 bp, Homo sapiens
tccaggactctgcgtggc

SEQ ID NO: 7939515 - DNA, 22 bp, Homo sapiens
tccaggactggttcacacggtg

SEQ ID NO: 7939516 - DNA, 18 bp, Homo sapiens
tccaggactctgcgtggc

SEQ ID NO: 7939517 - DNA, 22 bp, Homo sapiens
tccagccactcagcagggattg

SEQ ID NO: 7939518 - DNA, 22 bp, Homo sapiens
tccagaaacttttccagtctca

SEQ ID NO: 7939519 - DNA, 22 bp, Homo sapiens
tccagccactcagcagggattg

SEQ ID NO: 7939520 - DNA, 22 bp, Homo sapiens
tccagccactcagcagggattg

SEQ ID NO: 7939521 - DNA, 22 bp, Homo sapiens
tccagccactcagcagggattg

SEQ ID NO: 7939522 - DNA, 22 bp, Homo sapiens
tccagccactcagcagggattg

SEQ ID NO: 7939523 - DNA, 22 bp, Homo sapiens
tccagccactcagcagggattg

SEQ ID NO: 7939524 - DNA, 20 bp, Homo sapiens
tccagccacttccgctggtc

SEQ ID NO: 7939525 - DNA, 20 bp, Homo sapiens
tccagccacttccgctggtc

SEQ ID NO: 7939526 - DNA, 20 bp, Homo sapiens
tccagccacttccgctggtc

SEQ ID NO: 7939527 - DNA, 20 bp, Homo sapiens
tccagccacttccgctggtc

SEQ ID NO: 7939528 - DNA, 22 bp, Homo sapiens
tccagcccaggctggagtgtag

SEQ ID NO: 7939529 - DNA, 20 bp, Homo sapiens
tccagcccaggtcctgcctg

SEQ ID NO: 7939530 - DNA, 22 bp, Homo sapiens
tccagcccaggctggagtgtag

SEQ ID NO: 7939531 - DNA, 22 bp, Homo sapiens
tccagcccaggctggagtgtag

SEQ ID NO: 7939532 - DNA, 20 bp, Homo sapiens
tccagcccaggtcctgcctg

SEQ ID NO: 7939533 - DNA, 20 bp, Homo sapiens
tccagcccaggtcctgcctg

SEQ ID NO: 7939534 - DNA, 22 bp, Homo sapiens
tccagaaactgctgagataaga

SEQ ID NO: 7939535 - DNA, 22 bp, Homo sapiens
tccagaaactgctgagataaga

SEQ ID NO: 7939536 - DNA, 22 bp, Homo sapiens
tccagaaacttcatttgcaagc

SEQ ID NO: 7939537 - DNA, 22 bp, Homo sapiens
tccagaaacttcatttgcaagc

SEQ ID NO: 7939538 - DNA, 22 bp, Homo sapiens
tccagaaacttcatttgcaagc

SEQ ID NO: 7939539 - DNA, 22 bp, Homo sapiens
tccagaaacttttccagtctca

SEQ ID NO: 7939540 - DNA, 22 bp, Homo sapiens
tccagaaactgctgagataaga

SEQ ID NO: 7939541 - DNA, 22 bp, Homo sapiens
tccagaaaattttacagtgcct

SEQ ID NO: 7939542 - DNA, 22 bp, Homo sapiens
tccagaaaattttacagtgcct

SEQ ID NO: 7939543 - DNA, 22 bp, Homo sapiens
tccagaaaattttacagtgcct

SEQ ID NO: 7939544 - DNA, 22 bp, Homo sapiens
tccagaaagtacatgggattca

SEQ ID NO: 7939545 - DNA, 22 bp, Homo sapiens
tccagaaacttttccagtctca

SEQ ID NO: 7939546 - DNA, 22 bp, Homo sapiens
tccagaaatgcaagccaggtgt

SEQ ID NO: 7939547 - DNA, 22 bp, Homo sapiens
tccagaaatgcaagccaggtgt

SEQ ID NO: 7939548 - DNA, 22 bp, Homo sapiens
tccagaaatgcaagccaggtgt

SEQ ID NO: 7939549 - DNA, 22 bp, Homo sapiens
tccagccacgtattatctcact

SEQ ID NO: 7939550 - DNA, 20 bp, Homo sapiens
tccagcccaggtcctgcctg

SEQ ID NO: 7939551 - DNA, 22 bp, Homo sapiens
tccagcccagtttggtgaattg

SEQ ID NO: 7939552 - DNA, 20 bp, Homo sapiens
tccagcccaggtcctgcctg

SEQ ID NO: 7939553 - DNA, 20 bp, Homo sapiens
tccagcccaggtcctgcctg

SEQ ID NO: 7939554 - DNA, 22 bp, Homo sapiens
tccagcccagtttggtgaattg

SEQ ID NO: 7939555 - DNA, 22 bp, Homo sapiens
tccagcccatccctagcctggg

SEQ ID NO: 7939556 - DNA, 22 bp, Homo sapiens
tccagcccatccctagcctggg

SEQ ID NO: 7939557 - DNA, 22 bp, Homo sapiens
tccagcccatccctagcctggg

SEQ ID NO: 7939558 - DNA, 22 bp, Homo sapiens
tccagcccatccctagcctggg

SEQ ID NO: 7939559 - DNA, 22 bp, Homo sapiens
tccagcccatccctagcctggg

SEQ ID NO: 7939560 - DNA, 22 bp, Homo sapiens
tccagccccgaggccggcgacg

SEQ ID NO: 7939561 - DNA, 22 bp, Homo sapiens
tccagccccgaggccggcgacg

SEQ ID NO: 7939562 - DNA, 22 bp, Homo sapiens
tccagccccgaggccggcgacg

SEQ ID NO: 7939563 - DNA, 22 bp, Homo sapiens
tccagccccggcttccttacag

SEQ ID NO: 7939564 - DNA, 22 bp, Homo sapiens
tccagccccggcttccttacag

SEQ ID NO: 7939565 - DNA, 22 bp, Homo sapiens
tccagccccggcttccttacag

SEQ ID NO: 7939566 - DNA, 22 bp, Homo sapiens
tccagccccggcttccttacag

SEQ ID NO: 7939567 - DNA, 22 bp, Homo sapiens
tccagccccggcttccttacag

SEQ ID NO: 7939568 - DNA, 22 bp, Homo sapiens
tccagccccgggatgttcttca

SEQ ID NO: 7939569 - DNA, 22 bp, Homo sapiens
tccagccccgggatgttcttca

SEQ ID NO: 7939570 - DNA, 22 bp, Homo sapiens
tccagcccctcctgagccaagc

SEQ ID NO: 7939571 - DNA, 22 bp, Homo sapiens
tccagcccctcctgagccaagc

SEQ ID NO: 7939572 - DNA, 22 bp, Homo sapiens
tccagcccctcctgagccaagc

SEQ ID NO: 7939573 - DNA, 22 bp, Homo sapiens
tccagcccctcctgagccaagc

SEQ ID NO: 7939574 - DNA, 22 bp, Homo sapiens
tccagcccctcctgagccaagc

SEQ ID NO: 7939575 - DNA, 19 bp, Homo sapiens
tccagcccctctgtgtgtg

SEQ ID NO: 7939576 - DNA, 22 bp, Homo sapiens
tccagcccgactgggcctgccg

SEQ ID NO: 7939577 - DNA, 22 bp, Homo sapiens
tccagcccgactgggcctgccg

SEQ ID NO: 7939578 - DNA, 22 bp, Homo sapiens
tccagcccgagggcgctgatga

SEQ ID NO: 7939579 - DNA, 22 bp, Homo sapiens
tccagcccgagggcgctgatga

SEQ ID NO: 7939580 - DNA, 22 bp, Homo sapiens
tccagcccgggggcaggtgacc

SEQ ID NO: 7939581 - DNA, 22 bp, Homo sapiens
tccagcccgggggcaggtgacc

SEQ ID NO: 7939582 - DNA, 22 bp, Homo sapiens
tccagcccgggggcaggtgacc

SEQ ID NO: 7939583 - DNA, 22 bp, Homo sapiens
tccagcccgggggcaggtgacc

SEQ ID NO: 7939584 - DNA, 22 bp, Homo sapiens
tccagccctcagccaagtggaa

SEQ ID NO: 7939585 - DNA, 22 bp, Homo sapiens
tccagccctcagccaagtggaa

SEQ ID NO: 7939586 - DNA, 22 bp, Homo sapiens
tccagccctcagccaagtggaa

SEQ ID NO: 7939587 - DNA, 22 bp, Homo sapiens
tccagccctcagccaagtggaa

SEQ ID NO: 7939588 - DNA, 20 bp, Homo sapiens
tccagccctcatgtcgctca

SEQ ID NO: 7939589 - DNA, 19 bp, Homo sapiens
tccagcccctctgtgtgtg

SEQ ID NO: 7939590 - DNA, 19 bp, Homo sapiens
tccagcccctctgtgtgtg

SEQ ID NO: 7939591 - DNA, 19 bp, Homo sapiens
tccagcccctctgtgtgtg

SEQ ID NO: 7939592 - DNA, 20 bp, Homo sapiens
tccagcccctgcatgttgct

SEQ ID NO: 7939593 - DNA, 20 bp, Homo sapiens
tccagcccctgcatgttgct

SEQ ID NO: 7939594 - DNA, 20 bp, Homo sapiens
tccagcccctgcatgttgct

SEQ ID NO: 7939595 - DNA, 22 bp, Homo sapiens
tccagccccttttactcattca

SEQ ID NO: 7939596 - DNA, 22 bp, Homo sapiens
tccagcccgactgggcctgccg

SEQ ID NO: 7939597 - DNA, 22 bp, Homo sapiens
tccagcccgactgggcctgccg

SEQ ID NO: 7939598 - DNA, 22 bp, Homo sapiens
tccagcccgactgggcctgccg

SEQ ID NO: 7939599 - DNA, 22 bp, Homo sapiens
tccagccccttttactcattca

SEQ ID NO: 7939600 - DNA, 22 bp, Homo sapiens
tccagcccgactgggcctgccg

SEQ ID NO: 7939601 - DNA, 22 bp, Homo sapiens
tccagccccttttactcattca

SEQ ID NO: 7939602 - DNA, 22 bp, Homo sapiens
tccagcccgactgggcctgccg

SEQ ID NO: 7939603 - DNA, 22 bp, Homo sapiens
tccagcccgactgggcctgccg

SEQ ID NO: 7939604 - DNA, 20 bp, Homo sapiens
tccagccctcatgtcgctca

SEQ ID NO: 7939605 - DNA, 20 bp, Homo sapiens
tccagccctcatgtcgctca

SEQ ID NO: 7939606 - DNA, 22 bp, Homo sapiens
tccagccctcctgggatcacag

SEQ ID NO: 7939607 - DNA, 22 bp, Homo sapiens
tccagccctcctgggatcacag

SEQ ID NO: 7939608 - DNA, 22 bp, Homo sapiens
tccagccctcctgggatcacag

SEQ ID NO: 7939609 - DNA, 22 bp, Homo sapiens
tccagccctcctgggatcacag

SEQ ID NO: 7939610 - DNA, 22 bp, Homo sapiens
tccagccctctggcccgcggtg

SEQ ID NO: 7939611 - DNA, 22 bp, Homo sapiens
tccagccctctggcccgcggtg

SEQ ID NO: 7939612 - DNA, 22 bp, Homo sapiens
tccagccctctggcccgcggtg

SEQ ID NO: 7939613 - DNA, 22 bp, Homo sapiens
tccagccctgcactgattagat

SEQ ID NO: 7939614 - DNA, 22 bp, Homo sapiens
tccagccctgcactgattagat

SEQ ID NO: 7939615 - DNA, 22 bp, Homo sapiens
tccagccctgcactgattagat

SEQ ID NO: 7939616 - DNA, 22 bp, Homo sapiens
tccagccctgcccattctctcg

SEQ ID NO: 7939617 - DNA, 22 bp, Homo sapiens
tccagccctgcccattctctcg

SEQ ID NO: 7939618 - DNA, 17 bp, Homo sapiens
tccagccctgcccgacg

SEQ ID NO: 7939619 - DNA, 22 bp, Homo sapiens
tccagccctgcttcctgcctca

SEQ ID NO: 7939620 - DNA, 17 bp, Homo sapiens
tccagccctgcccgacg

SEQ ID NO: 7939621 - DNA, 22 bp, Homo sapiens
tccagccctgcttcctgcctca

SEQ ID NO: 7939622 - DNA, 22 bp, Homo sapiens
tccagccctgcttcctgcctca

SEQ ID NO: 7939623 - DNA, 22 bp, Homo sapiens
tccagccctgcttcctgcctca

SEQ ID NO: 7939624 - DNA, 22 bp, Homo sapiens
tccagccctgcccattctctcg

SEQ ID NO: 7939625 - DNA, 17 bp, Homo sapiens
tccagccctgcccgacg

SEQ ID NO: 7939626 - DNA, 22 bp, Homo sapiens
tccagccctgcccattctctcg

SEQ ID NO: 7939627 - DNA, 22 bp, Homo sapiens
tccagtcctagaaactggagag

SEQ ID NO: 7939628 - DNA, 22 bp, Homo sapiens
tccagtcctagaaactggagag

SEQ ID NO: 7939629 - DNA, 22 bp, Homo sapiens
tccagtcctagaaactggagag

SEQ ID NO: 7939630 - DNA, 18 bp, Homo sapiens
tccagtcccagctctgcc

SEQ ID NO: 7939631 - DNA, 18 bp, Homo sapiens
tccagtcccagctctgcc

SEQ ID NO: 7939632 - DNA, 22 bp, Homo sapiens
tccagtcccattacccacattt

SEQ ID NO: 7939633 - DNA, 23 bp, Homo sapiens
tccagtcccctaaatctcactgt

SEQ ID NO: 7939634 - DNA, 20 bp, Homo sapiens
tccagtccccacttgctcct

SEQ ID NO: 7939635 - DNA, 23 bp, Homo sapiens
tccagtcccctaaatctcactgt

SEQ ID NO: 7939636 - DNA, 22 bp, Homo sapiens
tccagtcctatctgcccttgga

SEQ ID NO: 7939637 - DNA, 22 bp, Homo sapiens
tccagtccttgcctctgtcagg

SEQ ID NO: 7939638 - DNA, 22 bp, Homo sapiens
tccagtccttgcctctgtcagg

SEQ ID NO: 7939639 - DNA, 22 bp, Homo sapiens
tccagtccttgcctctgtcagg

SEQ ID NO: 7939640 - DNA, 22 bp, Homo sapiens
tccagtccttgaaaatccaaca

SEQ ID NO: 7939641 - DNA, 22 bp, Homo sapiens
tccagtctcccagggctgggac

SEQ ID NO: 7939642 - DNA, 22 bp, Homo sapiens
tccagtgagcactacatgaact

SEQ ID NO: 7939643 - DNA, 22 bp, Homo sapiens
tccagtgagcactacatgaact

SEQ ID NO: 7939644 - DNA, 22 bp, Homo sapiens
tccagtgagcactacatgaact

SEQ ID NO: 7939645 - DNA, 22 bp, Homo sapiens
tccagtcttcttgcagctacat

SEQ ID NO: 7939646 - DNA, 22 bp, Homo sapiens
tccagtcttcttgcagctacat

SEQ ID NO: 7939647 - DNA, 22 bp, Homo sapiens
tccagtgatgctgcaagagtga

SEQ ID NO: 7939648 - DNA, 22 bp, Homo sapiens
tccagtgatgctgcaagagtga

SEQ ID NO: 7939649 - DNA, 22 bp, Homo sapiens
tccagtgcattcagacacttgg

SEQ ID NO: 7939650 - DNA, 22 bp, Homo sapiens
tccagtgcattcagacacttgg

SEQ ID NO: 7939651 - DNA, 22 bp, Homo sapiens
tccagtctggagccttctggtt

SEQ ID NO: 7939652 - DNA, 22 bp, Homo sapiens
tccagtctctactctgagataa

SEQ ID NO: 7939653 - DNA, 18 bp, Homo sapiens
tccagtcttattaccatt

SEQ ID NO: 7939654 - DNA, 22 bp, Homo sapiens
tccagtctggagccttctggtt

SEQ ID NO: 7939655 - DNA, 22 bp, Homo sapiens
tccagtggagtgtgggggtgaa

SEQ ID NO: 7939656 - DNA, 22 bp, Homo sapiens
tccagtggcactggagactaga

SEQ ID NO: 7939657 - DNA, 22 bp, Homo sapiens
tccagtggcaggcggtgaggtc

SEQ ID NO: 7939658 - DNA, 20 bp, Homo sapiens
tccagtggcctgaatctgga

SEQ ID NO: 7939659 - DNA, 22 bp, Homo sapiens
tccagtggcaggcggtgaggtc

SEQ ID NO: 7939660 - DNA, 22 bp, Homo sapiens
tccagtggcaggcggtgaggtc

SEQ ID NO: 7939661 - DNA, 22 bp, Homo sapiens
tccagtgctggaccagagcacc

SEQ ID NO: 7939662 - DNA, 22 bp, Homo sapiens
tccagtgcctcactgaggattc

SEQ ID NO: 7939663 - DNA, 22 bp, Homo sapiens
tccagtgcctcactgaggattc

SEQ ID NO: 7939664 - DNA, 22 bp, Homo sapiens
tccagtgctggaccagagcacc

SEQ ID NO: 7939665 - DNA, 22 bp, Homo sapiens
tccagtgctggaccagagcacc

SEQ ID NO: 7939666 - DNA, 21 bp, Homo sapiens
tccagtggggatctctgatat

SEQ ID NO: 7939667 - DNA, 22 bp, Homo sapiens
tccagtgggttgctgagggagg

SEQ ID NO: 7939668 - DNA, 22 bp, Homo sapiens
tccagtgggttgctgagggagg

SEQ ID NO: 7939669 - DNA, 22 bp, Homo sapiens
tccagtggctttgctgctttaa

SEQ ID NO: 7939670 - DNA, 20 bp, Homo sapiens
tccagtggcctgaatctgga

SEQ ID NO: 7939671 - DNA, 22 bp, Homo sapiens
tccagtggtggtttgaagggca

SEQ ID NO: 7939672 - DNA, 21 bp, Homo sapiens
tccagtggtgtctagaatgtg

SEQ ID NO: 7939673 - DNA, 22 bp, Homo sapiens
tccagtggtagtaaagaggtct

SEQ ID NO: 7939674 - DNA, 22 bp, Homo sapiens
tccagggagcaagtcaggccgg

SEQ ID NO: 7939675 - DNA, 22 bp, Homo sapiens
tccagggagcaagtcaggccgg

SEQ ID NO: 7939676 - DNA, 22 bp, Homo sapiens
tccagggagcaagtcaggccgg

SEQ ID NO: 7939677 - DNA, 22 bp, Homo sapiens
tccagggagcaagtcaggccgg

SEQ ID NO: 7939678 - DNA, 22 bp, Homo sapiens
tccagggagcaagtcaggccgg

SEQ ID NO: 7939679 - DNA, 22 bp, Homo sapiens
tccagggagtcaaatgaactac

SEQ ID NO: 7939680 - DNA, 22 bp, Homo sapiens
tccagggagtcaaatgaactac

SEQ ID NO: 7939681 - DNA, 22 bp, Homo sapiens
tccagggagttggctggatagt

SEQ ID NO: 7939682 - DNA, 22 bp, Homo sapiens
tccagggatgccagccatgttg

SEQ ID NO: 7939683 - DNA, 22 bp, Homo sapiens
tccagggatgccagccatgttg

SEQ ID NO: 7939684 - DNA, 22 bp, Homo sapiens
tccagggatctttagagtcttt

SEQ ID NO: 7939685 - DNA, 22 bp, Homo sapiens
tccagggatctttagagtcttt

SEQ ID NO: 7939686 - DNA, 22 bp, Homo sapiens
tccagggagttggctggatagt

SEQ ID NO: 7939687 - DNA, 22 bp, Homo sapiens
tccagggagttggctggatagt

SEQ ID NO: 7939688 - DNA, 22 bp, Homo sapiens
tccagggatctttagagtcttt

SEQ ID NO: 7939689 - DNA, 22 bp, Homo sapiens
tccagggatgtcctgtagcact

SEQ ID NO: 7939690 - DNA, 22 bp, Homo sapiens
tccagggatggtaatgagcagt

SEQ ID NO: 7939691 - DNA, 22 bp, Homo sapiens
tccagggatggtaatgagcagt

SEQ ID NO: 7939692 - DNA, 22 bp, Homo sapiens
tccagggatggtaatgagcagt

SEQ ID NO: 7939693 - DNA, 22 bp, Homo sapiens
tccagggatgccagccatgttg

SEQ ID NO: 7939694 - DNA, 22 bp, Homo sapiens
tccagggatgccagccatgttg

SEQ ID NO: 7939695 - DNA, 22 bp, Homo sapiens
tccagggatggtaatgagcagt

SEQ ID NO: 7939696 - DNA, 22 bp, Homo sapiens
tccagggatgccagccatgttg

SEQ ID NO: 7939697 - DNA, 22 bp, Homo sapiens
tccagggatggtaatgagcagt

SEQ ID NO: 7939698 - DNA, 22 bp, Homo sapiens
tccagggatgtcctgtagcact

SEQ ID NO: 7939699 - DNA, 22 bp, Homo sapiens
tccagggatgtcctgtagcact

SEQ ID NO: 7939700 - DNA, 23 bp, Homo sapiens
tccagggattaatgaagtcagtc

SEQ ID NO: 7939701 - DNA, 22 bp, Homo sapiens
tccagggatgtcctgtagcact

SEQ ID NO: 7939702 - DNA, 23 bp, Homo sapiens
tccagggattaatgaagtcagtc

SEQ ID NO: 7939703 - DNA, 23 bp, Homo sapiens
tccagggattaatgaagtcagtc

SEQ ID NO: 7939704 - DNA, 23 bp, Homo sapiens
tccagggattaatgaagtcagtc

SEQ ID NO: 7939705 - DNA, 23 bp, Homo sapiens
tccagggattaatgaagtcagtc

SEQ ID NO: 7939706 - DNA, 20 bp, Homo sapiens
tccagggcaaactcatcacc

SEQ ID NO: 7939707 - DNA, 20 bp, Homo sapiens
tccagggcaaactcatcacc

SEQ ID NO: 7939708 - DNA, 22 bp, Homo sapiens
tccagtccatggcctcagtctt

SEQ ID NO: 7939709 - DNA, 22 bp, Homo sapiens
tccagtccatggcctcagtctt

SEQ ID NO: 7939710 - DNA, 22 bp, Homo sapiens
tccagtccatggcctcagtctt

SEQ ID NO: 7939711 - DNA, 18 bp, Homo sapiens
tccagtcccaaggccagc

SEQ ID NO: 7939712 - DNA, 18 bp, Homo sapiens
tccagtcccaaggccagc

SEQ ID NO: 7939713 - DNA, 22 bp, Homo sapiens
tccagtccagggaatggctgat

SEQ ID NO: 7939714 - DNA, 22 bp, Homo sapiens
tccagtccatggcctcagtctt

SEQ ID NO: 7939715 - DNA, 22 bp, Homo sapiens
tccagtccactgccttgctctt

SEQ ID NO: 7939716 - DNA, 22 bp, Homo sapiens
tccagtcatggtgtcctcacaa

SEQ ID NO: 7939717 - DNA, 22 bp, Homo sapiens
tccagtcatttccattgttccc

SEQ ID NO: 7939718 - DNA, 22 bp, Homo sapiens
tccagggcagccgcgggtgcgc

SEQ ID NO: 7939719 - DNA, 22 bp, Homo sapiens
tccagggcagccgcgggtgcgc

SEQ ID NO: 7939720 - DNA, 22 bp, Homo sapiens
tccagggcagccgcgggtgcgc

SEQ ID NO: 7939721 - DNA, 22 bp, Homo sapiens
tccagggcaccagcgtccccct

SEQ ID NO: 7939722 - DNA, 22 bp, Homo sapiens
tccagtcatctcccttcacatt

SEQ ID NO: 7939723 - DNA, 22 bp, Homo sapiens
tccagtcatggtgtcctcacaa

SEQ ID NO: 7939724 - DNA, 22 bp, Homo sapiens
tccagtcatggtgtcctcacaa

SEQ ID NO: 7939725 - DNA, 22 bp, Homo sapiens
tccagtcaggctgaattcaagg

SEQ ID NO: 7939726 - DNA, 22 bp, Homo sapiens
tccagggcagccgcgggtgcgc

SEQ ID NO: 7939727 - DNA, 20 bp, Homo sapiens
tccagggcaaactcatcacc

SEQ ID NO: 7939728 - DNA, 20 bp, Homo sapiens
tccagggcaaactcatcacc

SEQ ID NO: 7939729 - DNA, 20 bp, Homo sapiens
tccagggcaaactcatcacc

SEQ ID NO: 7939730 - DNA, 20 bp, Homo sapiens
tccagggcaactagagtgtg

SEQ ID NO: 7939731 - DNA, 20 bp, Homo sapiens
tccagggcaactagagtgtg

SEQ ID NO: 7939732 - DNA, 22 bp, Homo sapiens
tccagggcaccagcgtccccct

SEQ ID NO: 7939733 - DNA, 20 bp, Homo sapiens
tccagggcaactagagtgtg

SEQ ID NO: 7939734 - DNA, 22 bp, Homo sapiens
tccagggcaccagcgtccccct

SEQ ID NO: 7939735 - DNA, 20 bp, Homo sapiens
tccagggcaactagagtgtg

SEQ ID NO: 7939736 - DNA, 20 bp, Homo sapiens
tccagggcaactagagtgtg

SEQ ID NO: 7939737 - DNA, 20 bp, Homo sapiens
tccagggcaactagagtgtg

SEQ ID NO: 7939738 - DNA, 20 bp, Homo sapiens
tccagggcaactagagtgtg

SEQ ID NO: 7939739 - DNA, 22 bp, Homo sapiens
tccaggaggaggaaggctgcca

SEQ ID NO: 7939740 - DNA, 22 bp, Homo sapiens
tccaggaggaggaaggctgcca

SEQ ID NO: 7939741 - DNA, 22 bp, Homo sapiens
tccaggaggaggaaggctgcca

SEQ ID NO: 7939742 - DNA, 22 bp, Homo sapiens
tccaggaggaggaaggctgcca

SEQ ID NO: 7939743 - DNA, 22 bp, Homo sapiens
tccaggaggcagggctgtgccc

SEQ ID NO: 7939744 - DNA, 22 bp, Homo sapiens
tccaggaggcacctttggacca

SEQ ID NO: 7939745 - DNA, 22 bp, Homo sapiens
tccaggaggcacctttggacca

SEQ ID NO: 7939746 - DNA, 22 bp, Homo sapiens
tccaggaggcagggctgtgccc

SEQ ID NO: 7939747 - DNA, 22 bp, Homo sapiens
tccaggccagggtaagaggaga

SEQ ID NO: 7939748 - DNA, 22 bp, Homo sapiens
tccaggccactgcagaggctct

SEQ ID NO: 7939749 - DNA, 21 bp, Homo sapiens
tccaggccatggtggggaggc

SEQ ID NO: 7939750 - DNA, 21 bp, Homo sapiens
tccaggccatggtggggaggc

SEQ ID NO: 7939751 - DNA, 22 bp, Homo sapiens
tccaggccagggtaagaggaga

SEQ ID NO: 7939752 - DNA, 22 bp, Homo sapiens
tccaggccagggtaagaggaga

SEQ ID NO: 7939753 - DNA, 21 bp, Homo sapiens
tccaggccatggtggggaggc

SEQ ID NO: 7939754 - DNA, 21 bp, Homo sapiens
tccaggccatggtggggaggc

SEQ ID NO: 7939755 - DNA, 19 bp, Homo sapiens
tccaggccattcccagagc

SEQ ID NO: 7939756 - DNA, 19 bp, Homo sapiens
tccaggccattcccagagc

SEQ ID NO: 7939757 - DNA, 19 bp, Homo sapiens
tccaggccattcccagagc

SEQ ID NO: 7939758 - DNA, 22 bp, Homo sapiens
tccaggccattgactgcatcct

SEQ ID NO: 7939759 - DNA, 22 bp, Homo sapiens
tccaggccattgactgcatcct

SEQ ID NO: 7939760 - DNA, 22 bp, Homo sapiens
tccaggccattgactgcatcct

SEQ ID NO: 7939761 - DNA, 22 bp, Homo sapiens
tccaggccattgactgcatcct

SEQ ID NO: 7939762 - DNA, 22 bp, Homo sapiens
tccaggccattgactgcatcct

SEQ ID NO: 7939763 - DNA, 22 bp, Homo sapiens
tccaggccattgactgcatcct

SEQ ID NO: 7939764 - DNA, 22 bp, Homo sapiens
tccaggccattgactgcatcct

SEQ ID NO: 7939765 - DNA, 22 bp, Homo sapiens
tccaggccattgactgcatcct

SEQ ID NO: 7939766 - DNA, 20 bp, Homo sapiens
tccaggcccactcagctgaa

SEQ ID NO: 7939767 - DNA, 20 bp, Homo sapiens
tccaggcccactcagctgaa

SEQ ID NO: 7939768 - DNA, 20 bp, Homo sapiens
tccaggcccactcagctgaa

SEQ ID NO: 7939769 - DNA, 22 bp, Homo sapiens
tccaggcccactcagctgaaat

SEQ ID NO: 7939770 - DNA, 22 bp, Homo sapiens
tccaggcccactcggtggggct

SEQ ID NO: 7939771 - DNA, 22 bp, Homo sapiens
tccaggcccactcggtggggct

SEQ ID NO: 7939772 - DNA, 20 bp, Homo sapiens
tccaggcccactcagctgaa

SEQ ID NO: 7939773 - DNA, 22 bp, Homo sapiens
tccaggcccactcagctgaaat

SEQ ID NO: 7939774 - DNA, 22 bp, Homo sapiens
tccaggcccactcagctgaaat

SEQ ID NO: 7939775 - DNA, 22 bp, Homo sapiens
tccaggcccactcagctgaaat

SEQ ID NO: 7939776 - DNA, 22 bp, Homo sapiens
tccaggcccagacggggtgagg

SEQ ID NO: 7939777 - DNA, 22 bp, Homo sapiens
tccaggcccagacggggtgagg

SEQ ID NO: 7939778 - DNA, 22 bp, Homo sapiens
tccaggcccactcggtggggct

SEQ ID NO: 7939779 - DNA, 22 bp, Homo sapiens
tccaggcccagacggggtgagg

SEQ ID NO: 7939780 - DNA, 22 bp, Homo sapiens
tccagggagatactggctgcca

SEQ ID NO: 7939781 - DNA, 22 bp, Homo sapiens
tccagggagagccgctgctcca

SEQ ID NO: 7939782 - DNA, 22 bp, Homo sapiens
tccagggagatactggctgcca

SEQ ID NO: 7939783 - DNA, 22 bp, Homo sapiens
tccagggagatactggctgcca

SEQ ID NO: 7939784 - DNA, 22 bp, Homo sapiens
tccagggagatactggctgcca

SEQ ID NO: 7939785 - DNA, 22 bp, Homo sapiens
tccagggagatactggctgcca

SEQ ID NO: 7939786 - DNA, 22 bp, Homo sapiens
tccagggagagccgctgctcca

SEQ ID NO: 7939787 - DNA, 22 bp, Homo sapiens
tccagggagatggcagaggctg

SEQ ID NO: 7939788 - DNA, 22 bp, Homo sapiens
tccagggagatggcagaggctg

SEQ ID NO: 7939789 - DNA, 22 bp, Homo sapiens
tccagggagatggcagaggctg

SEQ ID NO: 7939790 - DNA, 22 bp, Homo sapiens
tccagggagatggcagaggctg

SEQ ID NO: 7939791 - DNA, 22 bp, Homo sapiens
tccagggagatggcagaggctg

SEQ ID NO: 7939792 - DNA, 22 bp, Homo sapiens
tccagggagcaagtcaggccgg

SEQ ID NO: 7939793 - DNA, 22 bp, Homo sapiens
tccagggagatggcagaggctg

SEQ ID NO: 7939794 - DNA, 22 bp, Homo sapiens
tccagggagatggcagaggctg

SEQ ID NO: 7939795 - DNA, 22 bp, Homo sapiens
tccagggagatggcagaggctg

SEQ ID NO: 7939796 - DNA, 22 bp, Homo sapiens
tccagggagagccgctgctcca

SEQ ID NO: 7939797 - DNA, 22 bp, Homo sapiens
tccagggagagccgctgctcca

SEQ ID NO: 7939798 - DNA, 22 bp, Homo sapiens
tccagggacctccctgagagct

SEQ ID NO: 7939799 - DNA, 22 bp, Homo sapiens
tccagggacctccctgagagct

SEQ ID NO: 7939800 - DNA, 22 bp, Homo sapiens
tccagggacctccctgagagct

SEQ ID NO: 7939801 - DNA, 22 bp, Homo sapiens
tccagggacctccctgagagct

SEQ ID NO: 7939802 - DNA, 22 bp, Homo sapiens
tccagggacctccctgagagct

SEQ ID NO: 7939803 - DNA, 22 bp, Homo sapiens
tccagggacagtatagaggatc

SEQ ID NO: 7939804 - DNA, 22 bp, Homo sapiens
tccagggacagtatagaggatc

SEQ ID NO: 7939805 - DNA, 22 bp, Homo sapiens
tccagggacagtatagaggatc

SEQ ID NO: 7939806 - DNA, 22 bp, Homo sapiens
tccagggacagcgctggagcta

SEQ ID NO: 7939807 - DNA, 22 bp, Homo sapiens
tccagggacagcgctggagcta

SEQ ID NO: 7939808 - DNA, 21 bp, Homo sapiens
tccaggcctcaggaagggatg

SEQ ID NO: 7939809 - DNA, 21 bp, Homo sapiens
tccaggcctcaggaagggatg

SEQ ID NO: 7939810 - DNA, 21 bp, Homo sapiens
tccaggcctcaggaagggatg

SEQ ID NO: 7939811 - DNA, 22 bp, Homo sapiens
tccagggacagcgctggagcta

SEQ ID NO: 7939812 - DNA, 22 bp, Homo sapiens
tccagggacagcgctggagcta

SEQ ID NO: 7939813 - DNA, 22 bp, Homo sapiens
tccaggcctaggccaagtgatt

SEQ ID NO: 7939814 - DNA, 22 bp, Homo sapiens
tccaggcctaggccaagtgatt

SEQ ID NO: 7939815 - DNA, 22 bp, Homo sapiens
tccaggcctaggccaagtgatt

SEQ ID NO: 7939816 - DNA, 21 bp, Homo sapiens
tccaggcctcaggaagggatg

SEQ ID NO: 7939817 - DNA, 21 bp, Homo sapiens
tccaggcctcaggaagggatg

SEQ ID NO: 7939818 - DNA, 22 bp, Homo sapiens
tccaggccgcatagttactctg

SEQ ID NO: 7939819 - DNA, 22 bp, Homo sapiens
tccaggccgcatagttactctg

SEQ ID NO: 7939820 - DNA, 22 bp, Homo sapiens
tccaggcctaggccaagtgatt

SEQ ID NO: 7939821 - DNA, 22 bp, Homo sapiens
tccaggcctaggccaagtgatt

SEQ ID NO: 7939822 - DNA, 22 bp, Homo sapiens
tccaggccgcaggggcagcccc

SEQ ID NO: 7939823 - DNA, 22 bp, Homo sapiens
tccaggccgcaggggcagcccc

SEQ ID NO: 7939824 - DNA, 22 bp, Homo sapiens
tccaggccgcaggggcagcccc

SEQ ID NO: 7939825 - DNA, 22 bp, Homo sapiens
tccaggccgcatagttactctg

SEQ ID NO: 7939826 - DNA, 22 bp, Homo sapiens
tccaggccgcaggggcagcccc

SEQ ID NO: 7939827 - DNA, 22 bp, Homo sapiens
tccaggccgcaggggcagcccc

SEQ ID NO: 7939828 - DNA, 22 bp, Homo sapiens
tccaggccgcaggggcagcccc

SEQ ID NO: 7939829 - DNA, 22 bp, Homo sapiens
tccaggccctgggatgggagca

SEQ ID NO: 7939830 - DNA, 22 bp, Homo sapiens
tccaggccctgggatgggagca

SEQ ID NO: 7939831 - DNA, 22 bp, Homo sapiens
tccaggccgcaggggcagcccc

SEQ ID NO: 7939832 - DNA, 22 bp, Homo sapiens
tccaggccctgggatgggagca

SEQ ID NO: 7939833 - DNA, 22 bp, Homo sapiens
tccaggccctgggatgggagca

SEQ ID NO: 7939834 - DNA, 22 bp, Homo sapiens
tccaggcccatagacacttctc

SEQ ID NO: 7939835 - DNA, 22 bp, Homo sapiens
tccaggcccgagatgggctgga

SEQ ID NO: 7939836 - DNA, 22 bp, Homo sapiens
tcccactggacgtctgtgctgg

SEQ ID NO: 7939837 - DNA, 22 bp, Homo sapiens
tcccactgctttgctctgctca

SEQ ID NO: 7939838 - DNA, 22 bp, Homo sapiens
tcccactgctttgctctgctca

SEQ ID NO: 7939839 - DNA, 22 bp, Homo sapiens
tcccactgctttgctctgctca

SEQ ID NO: 7939840 - DNA, 22 bp, Homo sapiens
tcccactggacgtctgtgctgg

SEQ ID NO: 7939841 - DNA, 21 bp, Homo sapiens
tcccactggcccagggctcca

SEQ ID NO: 7939842 - DNA, 22 bp, Homo sapiens
tcccactggacgtctgtgctgg

SEQ ID NO: 7939843 - DNA, 20 bp, Homo sapiens
tcccactgggcctcagtttc

SEQ ID NO: 7939844 - DNA, 22 bp, Homo sapiens
tcccactgtctgtcttgctgca

SEQ ID NO: 7939845 - DNA, 22 bp, Homo sapiens
tcccactgtgaatccaaggcct

SEQ ID NO: 7939846 - DNA, 22 bp, Homo sapiens
tcccactgtgaatccaaggcct

SEQ ID NO: 7939847 - DNA, 22 bp, Homo sapiens
tcccactgtgcctgttgtaatc

SEQ ID NO: 7939848 - DNA, 22 bp, Homo sapiens
tcccactgtctgtcttgctgca

SEQ ID NO: 7939849 - DNA, 22 bp, Homo sapiens
tcccactgtctgtcttgctgca

SEQ ID NO: 7939850 - DNA, 22 bp, Homo sapiens
tcccactgtcttctcgtgctcg

SEQ ID NO: 7939851 - DNA, 22 bp, Homo sapiens
tcccactgtcttctcgtgctcg

SEQ ID NO: 7939852 - DNA, 22 bp, Homo sapiens
tcccagaaaaaggaggctatga

SEQ ID NO: 7939853 - DNA, 22 bp, Homo sapiens
tcccacttaactgtgacttctc

SEQ ID NO: 7939854 - DNA, 22 bp, Homo sapiens
tcccagaaacgcatatgttcat

SEQ ID NO: 7939855 - DNA, 22 bp, Homo sapiens
tcccagaaaaaggaggctatga

SEQ ID NO: 7939856 - DNA, 22 bp, Homo sapiens
tcccagaaaaaggaggctatga

SEQ ID NO: 7939857 - DNA, 22 bp, Homo sapiens
tcccagaaaaaggaggctatga

SEQ ID NO: 7939858 - DNA, 22 bp, Homo sapiens
tcccagaaacgcatatgttcat

SEQ ID NO: 7939859 - DNA, 22 bp, Homo sapiens
tcccagaaacgcatatgttcat

SEQ ID NO: 7939860 - DNA, 22 bp, Homo sapiens
tcccagaaacgcatatgttcat

SEQ ID NO: 7939861 - DNA, 19 bp, Homo sapiens
tccagtgtagctggtcatt

SEQ ID NO: 7939862 - DNA, 19 bp, Homo sapiens
tccagtgtagctggtcatt

SEQ ID NO: 7939863 - DNA, 19 bp, Homo sapiens
tccagtgtagctggtcatt

SEQ ID NO: 7939864 - DNA, 22 bp, Homo sapiens
tccagtggtttgaaaggggtgt

SEQ ID NO: 7939865 - DNA, 22 bp, Homo sapiens
tccagtgtacaaaagctatctt

SEQ ID NO: 7939866 - DNA, 22 bp, Homo sapiens
tccagtgtacaaaagctatctt

SEQ ID NO: 7939867 - DNA, 22 bp, Homo sapiens
tccagtgtgagaagcagcatga

SEQ ID NO: 7939868 - DNA, 22 bp, Homo sapiens
tccagtgtctgagcccttagct

SEQ ID NO: 7939869 - DNA, 20 bp, Homo sapiens
tccagtgtctctctggtgga

SEQ ID NO: 7939870 - DNA, 22 bp, Homo sapiens
tccagtgtctgagcccttagct

SEQ ID NO: 7939871 - DNA, 22 bp, Homo sapiens
tccagtgtggacccctgcagtc

SEQ ID NO: 7939872 - DNA, 22 bp, Homo sapiens
tccagtgtggacccctgcagtc

SEQ ID NO: 7939873 - DNA, 22 bp, Homo sapiens
tccagtgttataatatgcgtct

SEQ ID NO: 7939874 - DNA, 22 bp, Homo sapiens
tccagtgtgtgtccagctgctg

SEQ ID NO: 7939875 - DNA, 22 bp, Homo sapiens
tccagtgttgtcagatcatctg

SEQ ID NO: 7939876 - DNA, 16 bp, Homo sapiens
tccagtgttcctggat

SEQ ID NO: 7939877 - DNA, 22 bp, Homo sapiens
tccagtgtggtcaaaggggaat

SEQ ID NO: 7939878 - DNA, 22 bp, Homo sapiens
tccagtgtggaggtgaccaact

SEQ ID NO: 7939879 - DNA, 20 bp, Homo sapiens
tccagtgtggggactggggc

SEQ ID NO: 7939880 - DNA, 23 bp, Homo sapiens
tccagtgtgtgcagattaagtgc

SEQ ID NO: 7939881 - DNA, 23 bp, Homo sapiens
tccagtgtgtgcagattaagtgc

SEQ ID NO: 7939882 - DNA, 23 bp, Homo sapiens
tccagtgtgtgcagattaagtgc

SEQ ID NO: 7939883 - DNA, 22 bp, Homo sapiens
tccagtgtgtgtccagctgctg

SEQ ID NO: 7939884 - DNA, 22 bp, Homo sapiens
tccagtgtgtgtccagctgctg

SEQ ID NO: 7939885 - DNA, 22 bp, Homo sapiens
tcccactgagcccctgctggtg

SEQ ID NO: 7939886 - DNA, 22 bp, Homo sapiens
tcccactgagcccctgctggtg

SEQ ID NO: 7939887 - DNA, 22 bp, Homo sapiens
tcccactgagcccctgctggtg

SEQ ID NO: 7939888 - DNA, 22 bp, Homo sapiens
tcccactgagcccctgctggtg

SEQ ID NO: 7939889 - DNA, 22 bp, Homo sapiens
tcccacatgtgaatcctcaggt

SEQ ID NO: 7939890 - DNA, 22 bp, Homo sapiens
tcccacatatgcaatcctgaat

SEQ ID NO: 7939891 - DNA, 22 bp, Homo sapiens
tcccacatatgcaatcctgaat

SEQ ID NO: 7939892 - DNA, 22 bp, Homo sapiens
tcccacagtggtacagccctga

SEQ ID NO: 7939893 - DNA, 22 bp, Homo sapiens
tccagttctaggtcactctctg

SEQ ID NO: 7939894 - DNA, 23 bp, Homo sapiens
tccagttaatggttcccagtctg

SEQ ID NO: 7939895 - DNA, 20 bp, Homo sapiens
tccagttacatagaggaaag

SEQ ID NO: 7939896 - DNA, 22 bp, Homo sapiens
tccagttagtgggcaaaattta

SEQ ID NO: 7939897 - DNA, 22 bp, Homo sapiens
tcccacagtggtacagccctga

SEQ ID NO: 7939898 - DNA, 22 bp, Homo sapiens
tcccacagtggtacagccctga

SEQ ID NO: 7939899 - DNA, 22 bp, Homo sapiens
tcccagagttcaatgggaaggt

SEQ ID NO: 7939900 - DNA, 22 bp, Homo sapiens
tcccagagtgtgggcatcaagg

SEQ ID NO: 7939901 - DNA, 22 bp, Homo sapiens
tcccagagttcaatgggaaggt

SEQ ID NO: 7939902 - DNA, 22 bp, Homo sapiens
tcccagagttcaatgggaaggt

SEQ ID NO: 7939903 - DNA, 22 bp, Homo sapiens
tcccagagttcaatgggaaggt

SEQ ID NO: 7939904 - DNA, 22 bp, Homo sapiens
tcccagagtgtgggcatcaagg

SEQ ID NO: 7939905 - DNA, 22 bp, Homo sapiens
tcccagagtgtgggcatcaagg

SEQ ID NO: 7939906 - DNA, 22 bp, Homo sapiens
tcccagagtgtgggcatcaagg

SEQ ID NO: 7939907 - DNA, 22 bp, Homo sapiens
tcccagagtgtgggcatcaagg

SEQ ID NO: 7939908 - DNA, 22 bp, Homo sapiens
tcccagagtgtgggcatcaagg

SEQ ID NO: 7939909 - DNA, 21 bp, Homo sapiens
tcccagagtgcttgggactgc

SEQ ID NO: 7939910 - DNA, 21 bp, Homo sapiens
tcccagagtgcttgggactgc

SEQ ID NO: 7939911 - DNA, 22 bp, Homo sapiens
tcccagagtgagccaggggcag

SEQ ID NO: 7939912 - DNA, 22 bp, Homo sapiens
tcccagagtgagccaggggcag

SEQ ID NO: 7939913 - DNA, 22 bp, Homo sapiens
tcccagagtgtgggcatcaagg

SEQ ID NO: 7939914 - DNA, 22 bp, Homo sapiens
tcccagagtgtgggcatcaagg

SEQ ID NO: 7939915 - DNA, 21 bp, Homo sapiens
tcccagagtgcttgggactgc

SEQ ID NO: 7939916 - DNA, 21 bp, Homo sapiens
tcccagagtgcttgggactgc

SEQ ID NO: 7939917 - DNA, 21 bp, Homo sapiens
tcccagagtgcttgggactgc

SEQ ID NO: 7939918 - DNA, 19 bp, Homo sapiens
tcccagagtctagaggttg

SEQ ID NO: 7939919 - DNA, 19 bp, Homo sapiens
tcccagagtctagaggttg

SEQ ID NO: 7939920 - DNA, 19 bp, Homo sapiens
tcccagagtctagaggttg

SEQ ID NO: 7939921 - DNA, 22 bp, Homo sapiens
tcccagagtcagaggtggggcc

SEQ ID NO: 7939922 - DNA, 22 bp, Homo sapiens
tcccagagaaagtcaaggtctt

SEQ ID NO: 7939923 - DNA, 22 bp, Homo sapiens
tcccagagtattagcaattgct

SEQ ID NO: 7939924 - DNA, 22 bp, Homo sapiens
tcccagagtcagaggtggggcc

SEQ ID NO: 7939925 - DNA, 22 bp, Homo sapiens
tcccagagtcagaggtggggcc

SEQ ID NO: 7939926 - DNA, 22 bp, Homo sapiens
tcccagagtgagccaggggcag

SEQ ID NO: 7939927 - DNA, 22 bp, Homo sapiens
tcccagagtcttctcctgtaat

SEQ ID NO: 7939928 - DNA, 22 bp, Homo sapiens
tcccagagtcttctcctgtaat

SEQ ID NO: 7939929 - DNA, 22 bp, Homo sapiens
tcccagagtcttctcctgtaat

SEQ ID NO: 7939930 - DNA, 19 bp, Homo sapiens
tcccagagtctagaggttg

SEQ ID NO: 7939931 - DNA, 19 bp, Homo sapiens
tcccagagtctagaggttg

SEQ ID NO: 7939932 - DNA, 22 bp, Homo sapiens
tcccagaatctttggaagagca

SEQ ID NO: 7939933 - DNA, 22 bp, Homo sapiens
tcccagaatctttggaagagca

SEQ ID NO: 7939934 - DNA, 22 bp, Homo sapiens
tcccagaatctccagtgctaca

SEQ ID NO: 7939935 - DNA, 22 bp, Homo sapiens
tcccagaatctccagtgctaca

SEQ ID NO: 7939936 - DNA, 22 bp, Homo sapiens
tcccagaatctccagtgctaca

SEQ ID NO: 7939937 - DNA, 22 bp, Homo sapiens
tcccagaatctccagtgctaca

SEQ ID NO: 7939938 - DNA, 22 bp, Homo sapiens
tcccagaatctccagtgctaca

SEQ ID NO: 7939939 - DNA, 22 bp, Homo sapiens
tcccagaatctccagtgctaca

SEQ ID NO: 7939940 - DNA, 22 bp, Homo sapiens
tcccagaatctccagtgctaca

SEQ ID NO: 7939941 - DNA, 22 bp, Homo sapiens
tcccagagaaagtcaaggtctt

SEQ ID NO: 7939942 - DNA, 22 bp, Homo sapiens
tcccagagaaagtcaaggtctt

SEQ ID NO: 7939943 - DNA, 22 bp, Homo sapiens
tcccagagaaagtcaaggtctt

SEQ ID NO: 7939944 - DNA, 22 bp, Homo sapiens
tcccagagaaagtcaaggtctt

SEQ ID NO: 7939945 - DNA, 22 bp, Homo sapiens
tcccagaatggcccagctgccc

SEQ ID NO: 7939946 - DNA, 22 bp, Homo sapiens
tcccagaatggcccagctgccc

SEQ ID NO: 7939947 - DNA, 22 bp, Homo sapiens
tcccagaatggcccagctgccc

SEQ ID NO: 7939948 - DNA, 22 bp, Homo sapiens
tcccagaatctttggaagagca

SEQ ID NO: 7939949 - DNA, 22 bp, Homo sapiens
tcccagaatctttggaagagca

SEQ ID NO: 7939950 - DNA, 22 bp, Homo sapiens
tcccagaaccctgccaggtcct

SEQ ID NO: 7939951 - DNA, 22 bp, Homo sapiens
tcccagaaccctgccaggtcct

SEQ ID NO: 7939952 - DNA, 22 bp, Homo sapiens
tcccagaaccctgccaggtcct

SEQ ID NO: 7939953 - DNA, 22 bp, Homo sapiens
tcccagaacctcagagtgtgac

SEQ ID NO: 7939954 - DNA, 22 bp, Homo sapiens
tcccagaacctcagagtgtgac

SEQ ID NO: 7939955 - DNA, 22 bp, Homo sapiens
tcccagaaccttttagcttcac

SEQ ID NO: 7939956 - DNA, 22 bp, Homo sapiens
tcccagaacctcagagtgtgac

SEQ ID NO: 7939957 - DNA, 22 bp, Homo sapiens
tcccagaaccttttagcttcac

SEQ ID NO: 7939958 - DNA, 22 bp, Homo sapiens
tcccagaaccttttagcttcac

SEQ ID NO: 7939959 - DNA, 22 bp, Homo sapiens
tcccagaaccttttagcttcac

SEQ ID NO: 7939960 - DNA, 22 bp, Homo sapiens
tcccagaacctcagagtgtgac

SEQ ID NO: 7939961 - DNA, 22 bp, Homo sapiens
tcccagaagagatgccacttga

SEQ ID NO: 7939962 - DNA, 22 bp, Homo sapiens
tcccagaacgggttcttcccag

SEQ ID NO: 7939963 - DNA, 22 bp, Homo sapiens
tcccagaacgggttcttcccag

SEQ ID NO: 7939964 - DNA, 22 bp, Homo sapiens
tcccagaagagatgccacttga

SEQ ID NO: 7939965 - DNA, 22 bp, Homo sapiens
tcccagaagagatgccacttga

SEQ ID NO: 7939966 - DNA, 22 bp, Homo sapiens
tcccagaagagatgccacttga

SEQ ID NO: 7939967 - DNA, 22 bp, Homo sapiens
tcccagaagtccagccatgggc

SEQ ID NO: 7939968 - DNA, 22 bp, Homo sapiens
tcccagaagtccagccatgggc

SEQ ID NO: 7939969 - DNA, 22 bp, Homo sapiens
tcccagaagtccagccatgggc

SEQ ID NO: 7939970 - DNA, 22 bp, Homo sapiens
tcccagaagtccagccatgggc

SEQ ID NO: 7939971 - DNA, 22 bp, Homo sapiens
tcccagaagtgaaatttctaga

SEQ ID NO: 7939972 - DNA, 22 bp, Homo sapiens
tcccagaagtgaaatttctaga

SEQ ID NO: 7939973 - DNA, 22 bp, Homo sapiens
tcccagaatcctcactctatca

SEQ ID NO: 7939974 - DNA, 22 bp, Homo sapiens
tcccagaatcctcactctatca

SEQ ID NO: 7939975 - DNA, 22 bp, Homo sapiens
tcccagaagtgaaatttctaga

SEQ ID NO: 7939976 - DNA, 22 bp, Homo sapiens
tcccagaaccctgccaggtcct

SEQ ID NO: 7939977 - DNA, 22 bp, Homo sapiens
tcccagcctttcttttctgctg

SEQ ID NO: 7939978 - DNA, 22 bp, Homo sapiens
tcccagcctttcttttctgctg

SEQ ID NO: 7939979 - DNA, 22 bp, Homo sapiens
tcccagcctttcttttctgctg

SEQ ID NO: 7939980 - DNA, 22 bp, Homo sapiens
tcccagcataacaaactgcccg

SEQ ID NO: 7939981 - DNA, 22 bp, Homo sapiens
tcccagcagggccgaccagcct

SEQ ID NO: 7939982 - DNA, 22 bp, Homo sapiens
tcccagcagtcagagctatgtg

SEQ ID NO: 7939983 - DNA, 22 bp, Homo sapiens
tcccagcagtcagagctatgtg

SEQ ID NO: 7939984 - DNA, 22 bp, Homo sapiens
tcccagcagcatagctcagaat

SEQ ID NO: 7939985 - DNA, 22 bp, Homo sapiens
tcccagcagcatagctcagaat

SEQ ID NO: 7939986 - DNA, 22 bp, Homo sapiens
tcccagcagcatagctcagaat

SEQ ID NO: 7939987 - DNA, 22 bp, Homo sapiens
tcccagcagatgagctgaccta

SEQ ID NO: 7939988 - DNA, 22 bp, Homo sapiens
tcccagcagatgagctgaccta

SEQ ID NO: 7939989 - DNA, 22 bp, Homo sapiens
tcccagcaggagtccagttccc

SEQ ID NO: 7939990 - DNA, 22 bp, Homo sapiens
tcccagcaggagtccagttccc

SEQ ID NO: 7939991 - DNA, 22 bp, Homo sapiens
tcccagcagcatagctcagaat

SEQ ID NO: 7939992 - DNA, 22 bp, Homo sapiens
tcccagcagatgagctgaccta

SEQ ID NO: 7939993 - DNA, 22 bp, Homo sapiens
tcccagcagagccagcaagccg

SEQ ID NO: 7939994 - DNA, 22 bp, Homo sapiens
tcccagcagagccagcaagccg

SEQ ID NO: 7939995 - DNA, 22 bp, Homo sapiens
tcccagcactgtaattctttgg

SEQ ID NO: 7939996 - DNA, 22 bp, Homo sapiens
tcccagcactgtaattctttgg

SEQ ID NO: 7939997 - DNA, 22 bp, Homo sapiens
tcccagcaagaaagggggtggc

SEQ ID NO: 7939998 - DNA, 22 bp, Homo sapiens
tcccagcaagaaagggggtggc

SEQ ID NO: 7939999 - DNA, 22 bp, Homo sapiens
tcccagcaagaaagggggtggc

SEQ ID NO: 7940000 - DNA, 22 bp, Homo sapiens
tcccagcacagggcagatgtga

SEQ ID NO: 7940001 - DNA, 22 bp, Homo sapiens
tcccagcacagggcagatgtga

SEQ ID NO: 7940002 - DNA, 22 bp, Homo sapiens
tcccagcacgtctgctgtttct

SEQ ID NO: 7940003 - DNA, 22 bp, Homo sapiens
tcccagcacgtctgctgtttct

SEQ ID NO: 7940004 - DNA, 22 bp, Homo sapiens
tcccagattcctgctcttatat

SEQ ID NO: 7940005 - DNA, 22 bp, Homo sapiens
tcccagattcctgctcttatat

SEQ ID NO: 7940006 - DNA, 22 bp, Homo sapiens
tcccagattcctgctcttatat

SEQ ID NO: 7940007 - DNA, 22 bp, Homo sapiens
tcccagattcctgctcttatat

SEQ ID NO: 7940008 - DNA, 22 bp, Homo sapiens
tcccagagttcaatgggaaggt

SEQ ID NO: 7940009 - DNA, 22 bp, Homo sapiens
tcccagagttcaatgggaaggt

SEQ ID NO: 7940010 - DNA, 22 bp, Homo sapiens
tcccagagtttcctgtgtccca

SEQ ID NO: 7940011 - DNA, 22 bp, Homo sapiens
tcccagagtttcctgtgtccca

SEQ ID NO: 7940012 - DNA, 22 bp, Homo sapiens
tcccagagtttcctgtgtccca

SEQ ID NO: 7940013 - DNA, 22 bp, Homo sapiens
tcccagattcctgctcttatat

SEQ ID NO: 7940014 - DNA, 22 bp, Homo sapiens
tcccagagtttcctgtgtccca

SEQ ID NO: 7940015 - DNA, 22 bp, Homo sapiens
tcccagagtttcctgtgtccca

SEQ ID NO: 7940016 - DNA, 22 bp, Homo sapiens
tcccagagtttcctgtgtccca

SEQ ID NO: 7940017 - DNA, 17 bp, Homo sapiens
tcccaggaacagggaat

SEQ ID NO: 7940018 - DNA, 17 bp, Homo sapiens
tcccaggaacagggaat

SEQ ID NO: 7940019 - DNA, 17 bp, Homo sapiens
tcccaggaacagggaat

SEQ ID NO: 7940020 - DNA, 19 bp, Homo sapiens
tcccaggaaccttttattt

SEQ ID NO: 7940021 - DNA, 17 bp, Homo sapiens
tcccaggaacagggaat

SEQ ID NO: 7940022 - DNA, 17 bp, Homo sapiens
tcccaggaacagggaat

SEQ ID NO: 7940023 - DNA, 22 bp, Homo sapiens
tcccaggaagatcccagggacc

SEQ ID NO: 7940024 - DNA, 22 bp, Homo sapiens
tcccaggaagatcccagggacc

SEQ ID NO: 7940025 - DNA, 19 bp, Homo sapiens
tcccaggaaccttttattt

SEQ ID NO: 7940026 - DNA, 19 bp, Homo sapiens
tcccaggaagcaaatgtca

SEQ ID NO: 7940027 - DNA, 22 bp, Homo sapiens
tcccaggaagatcccagggacc

SEQ ID NO: 7940028 - DNA, 22 bp, Homo sapiens
tcccaggaagatcccagggacc

SEQ ID NO: 7940029 - DNA, 22 bp, Homo sapiens
tcccaggatgttggcggcaggt

SEQ ID NO: 7940030 - DNA, 22 bp, Homo sapiens
tcccaggatgttggcggcaggt

SEQ ID NO: 7940031 - DNA, 22 bp, Homo sapiens
tcccaggatgaagacagtgttg

SEQ ID NO: 7940032 - DNA, 22 bp, Homo sapiens
tcccaggatgtgcgtgccgccg

SEQ ID NO: 7940033 - DNA, 22 bp, Homo sapiens
tcccaggatgtgcgtgccgccg

SEQ ID NO: 7940034 - DNA, 22 bp, Homo sapiens
tcccaggaatccgtcctctaga

SEQ ID NO: 7940035 - DNA, 22 bp, Homo sapiens
tcccaggatgaagacagtgttg

SEQ ID NO: 7940036 - DNA, 22 bp, Homo sapiens
tcccaggaaggattcggcattt

SEQ ID NO: 7940037 - DNA, 22 bp, Homo sapiens
tcccaggaaggattcggcattt

SEQ ID NO: 7940038 - DNA, 22 bp, Homo sapiens
tcccaggaatccgtcctctaga

SEQ ID NO: 7940039 - DNA, 22 bp, Homo sapiens
tcccaggaaggattcggcattt

SEQ ID NO: 7940040 - DNA, 19 bp, Homo sapiens
tcccaggaagcaaatgtca

SEQ ID NO: 7940041 - DNA, 22 bp, Homo sapiens
tcccaggaaaacactcgaggac

SEQ ID NO: 7940042 - DNA, 22 bp, Homo sapiens
tcccaggaaaacactcgaggac

SEQ ID NO: 7940043 - DNA, 22 bp, Homo sapiens
tcccaggaaaacactcgaggac

SEQ ID NO: 7940044 - DNA, 22 bp, Homo sapiens
tcccagcttagatttgctcatt

SEQ ID NO: 7940045 - DNA, 22 bp, Homo sapiens
tcccagcttagatttgctcatt

SEQ ID NO: 7940046 - DNA, 22 bp, Homo sapiens
tcccagcttagatttgctcatt

SEQ ID NO: 7940047 - DNA, 22 bp, Homo sapiens
tcccagctgtgtggaggagatg

SEQ ID NO: 7940048 - DNA, 22 bp, Homo sapiens
tcccagctgtgtggaggagatg

SEQ ID NO: 7940049 - DNA, 22 bp, Homo sapiens
tcccagctgtgtggaggagatg

SEQ ID NO: 7940050 - DNA, 21 bp, Homo sapiens
tcccagctgggtcagtgctgc

SEQ ID NO: 7940051 - DNA, 22 bp, Homo sapiens
tcccagctgtgtggaggagatg

SEQ ID NO: 7940052 - DNA, 21 bp, Homo sapiens
tcccagctgggtcagtgctgc

SEQ ID NO: 7940053 - DNA, 22 bp, Homo sapiens
tcccagctactctagaggctga

SEQ ID NO: 7940054 - DNA, 22 bp, Homo sapiens
tcccagctactctagaggctga

SEQ ID NO: 7940055 - DNA, 22 bp, Homo sapiens
tcccagctactctagaggctga

SEQ ID NO: 7940056 - DNA, 22 bp, Homo sapiens
tcccagctactctagaggctga

SEQ ID NO: 7940057 - DNA, 22 bp, Homo sapiens
tcccagcgcggggggaggatcc

SEQ ID NO: 7940058 - DNA, 22 bp, Homo sapiens
tcccagctcacatatggtaact

SEQ ID NO: 7940059 - DNA, 22 bp, Homo sapiens
tcccagctcacatatggtaact

SEQ ID NO: 7940060 - DNA, 22 bp, Homo sapiens
tcccagctgagattgagcaagg

SEQ ID NO: 7940061 - DNA, 22 bp, Homo sapiens
tcccagctgagattgagcaagg

SEQ ID NO: 7940062 - DNA, 21 bp, Homo sapiens
tcccagctgggtcagtgctgc

SEQ ID NO: 7940063 - DNA, 21 bp, Homo sapiens
tcccagctgggtcagtgctgc

SEQ ID NO: 7940064 - DNA, 21 bp, Homo sapiens
tcccagctgggtcagtgctgc

SEQ ID NO: 7940065 - DNA, 22 bp, Homo sapiens
tcccagctgctgagatagtgct

SEQ ID NO: 7940066 - DNA, 22 bp, Homo sapiens
tcccagctgctgagatagtgct

SEQ ID NO: 7940067 - DNA, 22 bp, Homo sapiens
tcccagctgagattgagcaagg

SEQ ID NO: 7940068 - DNA, 22 bp, Homo sapiens
tccctgaggaaggggtgtggtg

SEQ ID NO: 7940069 - DNA, 22 bp, Homo sapiens
tccctgagcttctctgaaatgg

SEQ ID NO: 7940070 - DNA, 22 bp, Homo sapiens
tccctgagcttcatcaggcttt

SEQ ID NO: 7940071 - DNA, 22 bp, Homo sapiens
tccctgagcttcatcaggcttt

SEQ ID NO: 7940072 - DNA, 23 bp, Homo sapiens
tccctgagctggagagactgcac

SEQ ID NO: 7940073 - DNA, 22 bp, Homo sapiens
tccctgagctcacatggcagga

SEQ ID NO: 7940074 - DNA, 22 bp, Homo sapiens
tccctgagctgagctcaacagc

SEQ ID NO: 7940075 - DNA, 22 bp, Homo sapiens
tccctgagctgagctcaacagc

SEQ ID NO: 7940076 - DNA, 22 bp, Homo sapiens
tccctgagctgagctcaacagc

SEQ ID NO: 7940077 - DNA, 23 bp, Homo sapiens
tccctgagctggagagactgcac

SEQ ID NO: 7940078 - DNA, 19 bp, Homo sapiens
tccctgagttccagcccag

SEQ ID NO: 7940079 - DNA, 19 bp, Homo sapiens
tccctgagttccagcccag

SEQ ID NO: 7940080 - DNA, 22 bp, Homo sapiens
tccctgagtgtatgtggtgaac

SEQ ID NO: 7940081 - DNA, 16 bp, Homo sapiens
tccctgaggttttgga

SEQ ID NO: 7940082 - DNA, 22 bp, Homo sapiens
tccctgagtgggctggtagtat

SEQ ID NO: 7940083 - DNA, 22 bp, Homo sapiens
tccctgagtgggctggtagtat

SEQ ID NO: 7940084 - DNA, 22 bp, Homo sapiens
tccctgagtgtatgtggtgaac

SEQ ID NO: 7940085 - DNA, 22 bp, Homo sapiens
tccctgaggatgaggctgatca

SEQ ID NO: 7940086 - DNA, 22 bp, Homo sapiens
tccctgaggatgaggctgatca

SEQ ID NO: 7940087 - DNA, 22 bp, Homo sapiens
tccctgaggaaggggtgtggtg

SEQ ID NO: 7940088 - DNA, 22 bp, Homo sapiens
tccctgaggatggttgtattta

SEQ ID NO: 7940089 - DNA, 22 bp, Homo sapiens
tccctgagggcagctcaagtcc

SEQ ID NO: 7940090 - DNA, 22 bp, Homo sapiens
tccctgagggcagctcaagtcc

SEQ ID NO: 7940091 - DNA, 22 bp, Homo sapiens
tccctgagggcagctcaagtcc

SEQ ID NO: 7940092 - DNA, 22 bp, Homo sapiens
tcccaggcaaaggcagctcatt

SEQ ID NO: 7940093 - DNA, 22 bp, Homo sapiens
tcccaggattttaggctctcag

SEQ ID NO: 7940094 - DNA, 22 bp, Homo sapiens
tcccaggattttaggctctcag

SEQ ID NO: 7940095 - DNA, 22 bp, Homo sapiens
tcccaggattttaggctctcag

SEQ ID NO: 7940096 - DNA, 22 bp, Homo sapiens
tcccaggatgtttatggctggt

SEQ ID NO: 7940097 - DNA, 22 bp, Homo sapiens
tcccaggatgtttatggctggt

SEQ ID NO: 7940098 - DNA, 22 bp, Homo sapiens
tcccaggatgttggcggcaggt

SEQ ID NO: 7940099 - DNA, 22 bp, Homo sapiens
tcccaggatgtttatggctggt

SEQ ID NO: 7940100 - DNA, 22 bp, Homo sapiens
tcccaggatgtttatggctggt

SEQ ID NO: 7940101 - DNA, 22 bp, Homo sapiens
tcccaggattttaggctctcag

SEQ ID NO: 7940102 - DNA, 22 bp, Homo sapiens
tcccaggatgtttatggctggt

SEQ ID NO: 7940103 - DNA, 22 bp, Homo sapiens
tcccaggatgtttatggctggt

SEQ ID NO: 7940104 - DNA, 19 bp, Homo sapiens
tcccaggcaaaggcttctc

SEQ ID NO: 7940105 - DNA, 22 bp, Homo sapiens
tcccaggcagcttctttcatca

SEQ ID NO: 7940106 - DNA, 22 bp, Homo sapiens
tcccaggcaaaggcagctcatt

SEQ ID NO: 7940107 - DNA, 19 bp, Homo sapiens
tcccaggcaaaggcttctc

SEQ ID NO: 7940108 - DNA, 19 bp, Homo sapiens
tcccaggcaaaggcttctc

SEQ ID NO: 7940109 - DNA, 19 bp, Homo sapiens
tcccaggcaaaggcttctc

SEQ ID NO: 7940110 - DNA, 19 bp, Homo sapiens
tcccaggcaaaggcttctc

SEQ ID NO: 7940111 - DNA, 21 bp, Homo sapiens
tccctgagcccaaggggctcc

SEQ ID NO: 7940112 - DNA, 21 bp, Homo sapiens
tccctgagcccaaggggctcc

SEQ ID NO: 7940113 - DNA, 21 bp, Homo sapiens
tccctgagcccaaggggctcc

SEQ ID NO: 7940114 - DNA, 22 bp, Homo sapiens
tccctgagctcacatggcagga

SEQ ID NO: 7940115 - DNA, 23 bp, Homo sapiens
tccctgagatgctgctctgtccc

SEQ ID NO: 7940116 - DNA, 23 bp, Homo sapiens
tccctgagatgctgctctgtccc

SEQ ID NO: 7940117 - DNA, 23 bp, Homo sapiens
tccctgagatgctgctctgtccc

SEQ ID NO: 7940118 - DNA, 21 bp, Homo sapiens
tccctgagcccaaggggctcc

SEQ ID NO: 7940119 - DNA, 22 bp, Homo sapiens
tccctgggccacagctgtgagc

SEQ ID NO: 7940120 - DNA, 23 bp, Homo sapiens
tccctgggcccgtgccagcggtg

SEQ ID NO: 7940121 - DNA, 22 bp, Homo sapiens
tccctgggcacaatctgctggc

SEQ ID NO: 7940122 - DNA, 22 bp, Homo sapiens
tccctgggcaagtttactcttc

SEQ ID NO: 7940123 - DNA, 22 bp, Homo sapiens
tccctgccctcagtgcacccgg

SEQ ID NO: 7940124 - DNA, 22 bp, Homo sapiens
tccctgccctcagtgcacccgg

SEQ ID NO: 7940125 - DNA, 22 bp, Homo sapiens
tccctgccctcagtgcacccgg

SEQ ID NO: 7940126 - DNA, 22 bp, Homo sapiens
tccctgccagtcctggtctgaa

SEQ ID NO: 7940127 - DNA, 22 bp, Homo sapiens
tccctgccagtcctggtctgaa

SEQ ID NO: 7940128 - DNA, 22 bp, Homo sapiens
tccctgccagtcctggtctgaa

SEQ ID NO: 7940129 - DNA, 22 bp, Homo sapiens
tccctgccaatgattggagcaa

SEQ ID NO: 7940130 - DNA, 22 bp, Homo sapiens
tccctgcatttgggagagtgtc

SEQ ID NO: 7940131 - DNA, 22 bp, Homo sapiens
tccctgccaatgattggagcaa

SEQ ID NO: 7940132 - DNA, 22 bp, Homo sapiens
tccctgccaatgattggagcaa

SEQ ID NO: 7940133 - DNA, 22 bp, Homo sapiens
tccctgcaggtggggtggccag

SEQ ID NO: 7940134 - DNA, 22 bp, Homo sapiens
tccctgcagctgtaggccggcg

SEQ ID NO: 7940135 - DNA, 22 bp, Homo sapiens
tccctgcagcccctgagccttc

SEQ ID NO: 7940136 - DNA, 22 bp, Homo sapiens
tccctgcagcaggtgatcaatg

SEQ ID NO: 7940137 - DNA, 22 bp, Homo sapiens
tccctgcagcaggtgatcaatg

SEQ ID NO: 7940138 - DNA, 22 bp, Homo sapiens
tccctgcagacgtcctgcgggt

SEQ ID NO: 7940139 - DNA, 22 bp, Homo sapiens
tccctgcagcccctgagccttc

SEQ ID NO: 7940140 - DNA, 22 bp, Homo sapiens
tccctgcagacgtcctgcgggt

SEQ ID NO: 7940141 - DNA, 22 bp, Homo sapiens
tccctgcagcccctgagccttc

SEQ ID NO: 7940142 - DNA, 22 bp, Homo sapiens
tccctgcagtaggcagccctcc

SEQ ID NO: 7940143 - DNA, 22 bp, Homo sapiens
tccctgcaggtgtgcaagctga

SEQ ID NO: 7940144 - DNA, 22 bp, Homo sapiens
tccctgcagtaggcagccctcc

SEQ ID NO: 7940145 - DNA, 22 bp, Homo sapiens
tccctgcaggtgtgcaagctga

SEQ ID NO: 7940146 - DNA, 22 bp, Homo sapiens
tccctgcagctgtaggccggcg

SEQ ID NO: 7940147 - DNA, 22 bp, Homo sapiens
tccctgcagtaggcagccctcc

SEQ ID NO: 7940148 - DNA, 22 bp, Homo sapiens
tccctgcagtagtggctaagat

SEQ ID NO: 7940149 - DNA, 22 bp, Homo sapiens
tccctgcagtagtggctaagat

SEQ ID NO: 7940150 - DNA, 22 bp, Homo sapiens
tccctgcatttgggagagtgtc

SEQ ID NO: 7940151 - DNA, 22 bp, Homo sapiens
tccctgcacagccgagccatgc

SEQ ID NO: 7940152 - DNA, 22 bp, Homo sapiens
tccctgcacagccgagccatgc

SEQ ID NO: 7940153 - DNA, 22 bp, Homo sapiens
tccctgcacccttgctgggccc

SEQ ID NO: 7940154 - DNA, 22 bp, Homo sapiens
tccctgcacccttgctgggccc

SEQ ID NO: 7940155 - DNA, 22 bp, Homo sapiens
tccctgcacccttgctgggccc

SEQ ID NO: 7940156 - DNA, 22 bp, Homo sapiens
tccctgcagacgtcctgcgggt

SEQ ID NO: 7940157 - DNA, 22 bp, Homo sapiens
tccctgatgccttgatccgtgg

SEQ ID NO: 7940158 - DNA, 22 bp, Homo sapiens
tccctgatgccaaagaagcatg

SEQ ID NO: 7940159 - DNA, 22 bp, Homo sapiens
tccctgagttttctttctgact

SEQ ID NO: 7940160 - DNA, 21 bp, Homo sapiens
tccctgagttctctgagcatc

SEQ ID NO: 7940161 - DNA, 21 bp, Homo sapiens
tccctgagttctctgagcatc

SEQ ID NO: 7940162 - DNA, 22 bp, Homo sapiens
tccctggggatgttggcctgcc

SEQ ID NO: 7940163 - DNA, 22 bp, Homo sapiens
tccctggggcagtggctcggag

SEQ ID NO: 7940164 - DNA, 22 bp, Homo sapiens
tccctggggaagggcaagcaag

SEQ ID NO: 7940165 - DNA, 22 bp, Homo sapiens
tccctggggaagggcaagcaag

SEQ ID NO: 7940166 - DNA, 22 bp, Homo sapiens
tccctggggaagggcaagcaag

SEQ ID NO: 7940167 - DNA, 22 bp, Homo sapiens
tccctggggatgttggcctgcc

SEQ ID NO: 7940168 - DNA, 22 bp, Homo sapiens
tccctggggatgttggcctgcc

SEQ ID NO: 7940169 - DNA, 22 bp, Homo sapiens
tccctggggaagggcaagcaag

SEQ ID NO: 7940170 - DNA, 22 bp, Homo sapiens
tccctgggcttctccagacttg

SEQ ID NO: 7940171 - DNA, 22 bp, Homo sapiens
tccctgggcttctccagacttg

SEQ ID NO: 7940172 - DNA, 22 bp, Homo sapiens
tccctgggcggacattctccca

SEQ ID NO: 7940173 - DNA, 22 bp, Homo sapiens
tccctgggcctatcttagctcc

SEQ ID NO: 7940174 - DNA, 22 bp, Homo sapiens
tccctgggcctatcttagctcc

SEQ ID NO: 7940175 - DNA, 22 bp, Homo sapiens
tccctgggcctatcttagctcc

SEQ ID NO: 7940176 - DNA, 22 bp, Homo sapiens
tccctgggcctatcttagctcc

SEQ ID NO: 7940177 - DNA, 20 bp, Homo sapiens
tccctggggccctacttcct

SEQ ID NO: 7940178 - DNA, 20 bp, Homo sapiens
tccctggggccctacttcct

SEQ ID NO: 7940179 - DNA, 22 bp, Homo sapiens
tccctgtaaggttctgagattt

SEQ ID NO: 7940180 - DNA, 22 bp, Homo sapiens
tccctgtgaatcagaagcaggt

SEQ ID NO: 7940181 - DNA, 22 bp, Homo sapiens
tccctgtgaatcagaagcaggt

SEQ ID NO: 7940182 - DNA, 22 bp, Homo sapiens
tccctgtctcccttgagactag

SEQ ID NO: 7940183 - DNA, 22 bp, Homo sapiens
tccctgtattcgaaagtgatcg

SEQ ID NO: 7940184 - DNA, 22 bp, Homo sapiens
tccctggttacgtataaagatg

SEQ ID NO: 7940185 - DNA, 21 bp, Homo sapiens
tccctgtgagcagctcttcct

SEQ ID NO: 7940186 - DNA, 22 bp, Homo sapiens
tccctgtgacaagtctgagttc

SEQ ID NO: 7940187 - DNA, 22 bp, Homo sapiens
tccctgtgagaaatgaagcagg

SEQ ID NO: 7940188 - DNA, 22 bp, Homo sapiens
tccctgtgaatcagaagcaggt

SEQ ID NO: 7940189 - DNA, 22 bp, Homo sapiens
tccctgtgacaagtctgagttc

SEQ ID NO: 7940190 - DNA, 22 bp, Homo sapiens
tccctgtgacaagtctgagttc

SEQ ID NO: 7940191 - DNA, 21 bp, Homo sapiens
tccctgtgagcagctcttcct

SEQ ID NO: 7940192 - DNA, 22 bp, Homo sapiens
tccctgtgagtcaactaaacaa

SEQ ID NO: 7940193 - DNA, 22 bp, Homo sapiens
tccctgtgagtcaactaaacaa

SEQ ID NO: 7940194 - DNA, 22 bp, Homo sapiens
tccctgtgcctatatgtgctga

SEQ ID NO: 7940195 - DNA, 22 bp, Homo sapiens
tccctgtgcctatatgtgctga

SEQ ID NO: 7940196 - DNA, 22 bp, Homo sapiens
tccctgtggatatctgcagctg

SEQ ID NO: 7940197 - DNA, 22 bp, Homo sapiens
tccctgtggatatctgcagctg

SEQ ID NO: 7940198 - DNA, 22 bp, Homo sapiens
tccctgtggctaagacatgaca

SEQ ID NO: 7940199 - DNA, 22 bp, Homo sapiens
tccctgtggcacacccaagccc

SEQ ID NO: 7940200 - DNA, 22 bp, Homo sapiens
tccctgtggcacacccaagccc

SEQ ID NO: 7940201 - DNA, 22 bp, Homo sapiens
tccctgtggaagactgccagag

SEQ ID NO: 7940202 - DNA, 22 bp, Homo sapiens
tcccttctggcagcagtgtgag

SEQ ID NO: 7940203 - DNA, 22 bp, Homo sapiens
tcccttgaacgctggggctgga

SEQ ID NO: 7940204 - DNA, 22 bp, Homo sapiens
tcccttctggcagcagtgtgag

SEQ ID NO: 7940205 - DNA, 22 bp, Homo sapiens
tcccttggaaagtagcctcaca

SEQ ID NO: 7940206 - DNA, 22 bp, Homo sapiens
tcccttgagagttggccaattg

SEQ ID NO: 7940207 - DNA, 21 bp, Homo sapiens
tcccttgggaaactttcttga

SEQ ID NO: 7940208 - DNA, 22 bp, Homo sapiens
tcccttggttaaatatgtagga

SEQ ID NO: 7940209 - DNA, 22 bp, Homo sapiens
tcccttggtaattctgttcctt

SEQ ID NO: 7940210 - DNA, 22 bp, Homo sapiens
tcccttggttaaatatgtagga

SEQ ID NO: 7940211 - DNA, 22 bp, Homo sapiens
tcccttgtcacctcacactatg

SEQ ID NO: 7940212 - DNA, 22 bp, Homo sapiens
tcccttgtcacctcacactatg

SEQ ID NO: 7940213 - DNA, 22 bp, Homo sapiens
tcccttgtcctcttcgtcactg

SEQ ID NO: 7940214 - DNA, 22 bp, Homo sapiens
tcccttgtcctgtgggaagagc

SEQ ID NO: 7940215 - DNA, 22 bp, Homo sapiens
tcccttgtcctgtgggaagagc

SEQ ID NO: 7940216 - DNA, 22 bp, Homo sapiens
tcccttgtgagaacatgtgttg

SEQ ID NO: 7940217 - DNA, 22 bp, Homo sapiens
tcccttgtgagaacatgtgttg

SEQ ID NO: 7940218 - DNA, 22 bp, Homo sapiens
tcccttgtgagaacatgtgttg

SEQ ID NO: 7940219 - DNA, 18 bp, Homo sapiens
tcccttctcccttgcctc

SEQ ID NO: 7940220 - DNA, 19 bp, Homo sapiens
tcccttctatagtaataaa

SEQ ID NO: 7940221 - DNA, 18 bp, Homo sapiens
tcccttctcccttgcctc

SEQ ID NO: 7940222 - DNA, 18 bp, Homo sapiens
tcccttctcccttgcctc

SEQ ID NO: 7940223 - DNA, 22 bp, Homo sapiens
tcccttctggcagcagtgtgag

SEQ ID NO: 7940224 - DNA, 22 bp, Homo sapiens
tcccttctggcagcagtgtgag

SEQ ID NO: 7940225 - DNA, 22 bp, Homo sapiens
tcccttctggcagcagtgtgag

SEQ ID NO: 7940226 - DNA, 22 bp, Homo sapiens
tcccttctggcagcagtgtgag

SEQ ID NO: 7940227 - DNA, 22 bp, Homo sapiens
tcccttctggcagcagtgtgag

SEQ ID NO: 7940228 - DNA, 18 bp, Homo sapiens
tcccttctcccttgcctc

SEQ ID NO: 7940229 - DNA, 19 bp, Homo sapiens
tcccttctatagtaataaa

SEQ ID NO: 7940230 - DNA, 18 bp, Homo sapiens
tcccttctcccttgcctc

SEQ ID NO: 7940231 - DNA, 22 bp, Homo sapiens
tcccttcctcataggcagaagg

SEQ ID NO: 7940232 - DNA, 22 bp, Homo sapiens
tcccttcatcagtgagcaagcc

SEQ ID NO: 7940233 - DNA, 22 bp, Homo sapiens
tccctgtgggatgaggactctg

SEQ ID NO: 7940234 - DNA, 22 bp, Homo sapiens
tccctgtgggatgaggactctg

SEQ ID NO: 7940235 - DNA, 22 bp, Homo sapiens
tccctgtgggatgaggactctg

SEQ ID NO: 7940236 - DNA, 22 bp, Homo sapiens
tccctgtgggcagaggctgcct

SEQ ID NO: 7940237 - DNA, 22 bp, Homo sapiens
tccctgtgggcagaggctgcct

SEQ ID NO: 7940238 - DNA, 22 bp, Homo sapiens
tccctgtgggcagaggctgcct

SEQ ID NO: 7940239 - DNA, 23 bp, Homo sapiens
tccctgtgtacagcctgcatgag

SEQ ID NO: 7940240 - DNA, 23 bp, Homo sapiens
tccctgtgtacagcctgcatgag

SEQ ID NO: 7940241 - DNA, 22 bp, Homo sapiens
tccctgtgtccatgccaggagg

SEQ ID NO: 7940242 - DNA, 22 bp, Homo sapiens
tccctgtgtccatgccaggagg

SEQ ID NO: 7940243 - DNA, 22 bp, Homo sapiens
tccctgtgtccatgccaggagg

SEQ ID NO: 7940244 - DNA, 23 bp, Homo sapiens
tccctgtgtacagcctgcatgag

SEQ ID NO: 7940245 - DNA, 23 bp, Homo sapiens
tccctgtgtacagcctgcatgag

SEQ ID NO: 7940246 - DNA, 23 bp, Homo sapiens
tccctgtgtacagcctgcatgag

SEQ ID NO: 7940247 - DNA, 23 bp, Homo sapiens
tccctgtgtacagcctgcatgag

SEQ ID NO: 7940248 - DNA, 22 bp, Homo sapiens
tcccttcaagatttggggaaat

SEQ ID NO: 7940249 - DNA, 22 bp, Homo sapiens
tcccttaaccgtaggacagtct

SEQ ID NO: 7940250 - DNA, 22 bp, Homo sapiens
tcccttaagcacctgagtagtc

SEQ ID NO: 7940251 - DNA, 22 bp, Homo sapiens
tccctgttcaaagtcacatagc

SEQ ID NO: 7940252 - DNA, 22 bp, Homo sapiens
tccctgtgtgtatataaacggt

SEQ ID NO: 7940253 - DNA, 22 bp, Homo sapiens
tccctgtgtcctgggggcacct

SEQ ID NO: 7940254 - DNA, 22 bp, Homo sapiens
tccctgtgtcttcctcttgccc

SEQ ID NO: 7940255 - DNA, 22 bp, Homo sapiens
tcccttcacagatgcgatgttt

SEQ ID NO: 7940256 - DNA, 22 bp, Homo sapiens
tcccttcacagatgcgatgttt

SEQ ID NO: 7940257 - DNA, 22 bp, Homo sapiens
tcccttcatcagtgagcaagcc

SEQ ID NO: 7940258 - DNA, 22 bp, Homo sapiens
tcccttcatcagtgagcaagcc

SEQ ID NO: 7940259 - DNA, 22 bp, Homo sapiens
tcccttcaataattcaacatta

SEQ ID NO: 7940260 - DNA, 22 bp, Homo sapiens
tcccttcaataattcaacatta

SEQ ID NO: 7940261 - DNA, 22 bp, Homo sapiens
tcccttcaataattcaacatta

SEQ ID NO: 7940262 - DNA, 22 bp, Homo sapiens
tcctcctctatcagacagtgcc

SEQ ID NO: 7940263 - DNA, 22 bp, Homo sapiens
tcctcctctatcagacagtgcc

SEQ ID NO: 7940264 - DNA, 22 bp, Homo sapiens
tcctcctcctcacagtcacctg

SEQ ID NO: 7940265 - DNA, 23 bp, Homo sapiens
tcctcctgacacagcctgagtga

SEQ ID NO: 7940266 - DNA, 23 bp, Homo sapiens
tcctcctgacacagcctgagtga

SEQ ID NO: 7940267 - DNA, 23 bp, Homo sapiens
tcctcctgacacagcctgagtga

SEQ ID NO: 7940268 - DNA, 23 bp, Homo sapiens
tcctcctgacacagcctgagtga

SEQ ID NO: 7940269 - DNA, 23 bp, Homo sapiens
tcctcctgacacagcctgagtga

SEQ ID NO: 7940270 - DNA, 19 bp, Homo sapiens
tcctccctttggtgtcctg

SEQ ID NO: 7940271 - DNA, 19 bp, Homo sapiens
tcctccctttggtgtcctg

SEQ ID NO: 7940272 - DNA, 22 bp, Homo sapiens
tcctcccttggggtttcgttat

SEQ ID NO: 7940273 - DNA, 19 bp, Homo sapiens
tcctccctttggtgtcctg

SEQ ID NO: 7940274 - DNA, 22 bp, Homo sapiens
tcctcccttgactcctgctttt

SEQ ID NO: 7940275 - DNA, 22 bp, Homo sapiens
tcctcccttgactcctgctttt

SEQ ID NO: 7940276 - DNA, 22 bp, Homo sapiens
tcctcccttgactcctgctttt

SEQ ID NO: 7940277 - DNA, 22 bp, Homo sapiens
tcctcccttgactcctgctttt

SEQ ID NO: 7940278 - DNA, 22 bp, Homo sapiens
tcctcctcacgctgttgcttgt

SEQ ID NO: 7940279 - DNA, 21 bp, Homo sapiens
tcctcctccactaggctagcc

SEQ ID NO: 7940280 - DNA, 22 bp, Homo sapiens
tcctcctcacgctgttgcttgt

SEQ ID NO: 7940281 - DNA, 22 bp, Homo sapiens
tcctcctcacgctgttgcttgt

SEQ ID NO: 7940282 - DNA, 21 bp, Homo sapiens
tcctcctccactaggctagcc

SEQ ID NO: 7940283 - DNA, 21 bp, Homo sapiens
tcctcctccactaggctagcc

SEQ ID NO: 7940284 - DNA, 22 bp, Homo sapiens
tcctcctcctcacagtcacctg

SEQ ID NO: 7940285 - DNA, 21 bp, Homo sapiens
tcctcctccactaggctagcc

SEQ ID NO: 7940286 - DNA, 21 bp, Homo sapiens
tcctcctccactaggctagcc

SEQ ID NO: 7940287 - DNA, 23 bp, Homo sapiens
tcctcctgagtgagagtgccagc

SEQ ID NO: 7940288 - DNA, 23 bp, Homo sapiens
tcctcctgagtgagagtgccagc

SEQ ID NO: 7940289 - DNA, 22 bp, Homo sapiens
tcctcctgcctttgcttcttgt

SEQ ID NO: 7940290 - DNA, 22 bp, Homo sapiens
tcctcctgcctttgcttcttgt

SEQ ID NO: 7940291 - DNA, 23 bp, Homo sapiens
tcctcctgagtgagagtgccagc

SEQ ID NO: 7940292 - DNA, 23 bp, Homo sapiens
tcctcctgagtgagagtgccagc

SEQ ID NO: 7940293 - DNA, 23 bp, Homo sapiens
tcctcctgagtgagagtgccagc

SEQ ID NO: 7940294 - DNA, 21 bp, Homo sapiens
tcctcctggccaggcggcccc

SEQ ID NO: 7940295 - DNA, 21 bp, Homo sapiens
tcctcctggccaggcggcccc

SEQ ID NO: 7940296 - DNA, 23 bp, Homo sapiens
tcctcctggatacaaagggaaca

SEQ ID NO: 7940297 - DNA, 23 bp, Homo sapiens
tcctcctggatacaaagggaaca

SEQ ID NO: 7940298 - DNA, 23 bp, Homo sapiens
tcctcctggatacaaagggaaca

SEQ ID NO: 7940299 - DNA, 22 bp, Homo sapiens
tcctcctgctgttagtcttgaa

SEQ ID NO: 7940300 - DNA, 22 bp, Homo sapiens
tcctccagtgtctggggccttg

SEQ ID NO: 7940301 - DNA, 22 bp, Homo sapiens
tcctccagtgtctggggccttg

SEQ ID NO: 7940302 - DNA, 22 bp, Homo sapiens
tcctccagtggtactggccaat

SEQ ID NO: 7940303 - DNA, 22 bp, Homo sapiens
tcctccagtggtactggccaat

SEQ ID NO: 7940304 - DNA, 22 bp, Homo sapiens
tcctccagtggtactggccaat

SEQ ID NO: 7940305 - DNA, 22 bp, Homo sapiens
tcctcccctgcccatgaggagg

SEQ ID NO: 7940306 - DNA, 22 bp, Homo sapiens
tcctcccctgcccatgaggagg

SEQ ID NO: 7940307 - DNA, 22 bp, Homo sapiens
tcctcccctgcccatgaggagg

SEQ ID NO: 7940308 - DNA, 22 bp, Homo sapiens
tcctcccctgcccatgaggagg

SEQ ID NO: 7940309 - DNA, 22 bp, Homo sapiens
tcctcccctgcccatgaggagg

SEQ ID NO: 7940310 - DNA, 22 bp, Homo sapiens
tcctcccctgcccatgaggagg

SEQ ID NO: 7940311 - DNA, 22 bp, Homo sapiens
tcctcccctgcccatgaggagg

SEQ ID NO: 7940312 - DNA, 22 bp, Homo sapiens
tcctccagttccttggtttcag

SEQ ID NO: 7940313 - DNA, 22 bp, Homo sapiens
tcctccagtcttggtgaggttg

SEQ ID NO: 7940314 - DNA, 22 bp, Homo sapiens
tcctccaggtctagggtggctt

SEQ ID NO: 7940315 - DNA, 22 bp, Homo sapiens
tcctccaggtctagggtggctt

SEQ ID NO: 7940316 - DNA, 22 bp, Homo sapiens
tcctccagggggatcttcagcc

SEQ ID NO: 7940317 - DNA, 22 bp, Homo sapiens
tcctccaggtctagggtggctt

SEQ ID NO: 7940318 - DNA, 22 bp, Homo sapiens
tcctccagtggtactggccaat

SEQ ID NO: 7940319 - DNA, 22 bp, Homo sapiens
tcctccagtggtactggccaat

SEQ ID NO: 7940320 - DNA, 22 bp, Homo sapiens
tcctccagtggcccagtccttc

SEQ ID NO: 7940321 - DNA, 22 bp, Homo sapiens
tcctccagtggcccagtccttc

SEQ ID NO: 7940322 - DNA, 22 bp, Homo sapiens
tcctccagtggcccagtccttc

SEQ ID NO: 7940323 - DNA, 22 bp, Homo sapiens
tcctccagtggcccagtccttc

SEQ ID NO: 7940324 - DNA, 22 bp, Homo sapiens
tcctccctaaatcctagactgt

SEQ ID NO: 7940325 - DNA, 22 bp, Homo sapiens
tcctccctaaatcctagactgt

SEQ ID NO: 7940326 - DNA, 22 bp, Homo sapiens
tcctccctaaatcctagactgt

SEQ ID NO: 7940327 - DNA, 22 bp, Homo sapiens
tcctccctaaatcctagactgt

SEQ ID NO: 7940328 - DNA, 23 bp, Homo sapiens
tcctccctgacttctacagcaca

SEQ ID NO: 7940329 - DNA, 22 bp, Homo sapiens
tcctccctaactcatgatgagt

SEQ ID NO: 7940330 - DNA, 23 bp, Homo sapiens
tcctccctgacttctacagcaca

SEQ ID NO: 7940331 - DNA, 22 bp, Homo sapiens
tcctccctgagtggggacagct

SEQ ID NO: 7940332 - DNA, 22 bp, Homo sapiens
tcctccctgagtggggacagct

SEQ ID NO: 7940333 - DNA, 22 bp, Homo sapiens
tcctccctgtaccattcctctg

SEQ ID NO: 7940334 - DNA, 22 bp, Homo sapiens
tcctccctgtaccattcctctg

SEQ ID NO: 7940335 - DNA, 22 bp, Homo sapiens
tcctccctgtaccattcctctg

SEQ ID NO: 7940336 - DNA, 22 bp, Homo sapiens
tcctccctgggagcttctgagt

SEQ ID NO: 7940337 - DNA, 22 bp, Homo sapiens
tcctccctgggagcttctgagt

SEQ ID NO: 7940338 - DNA, 22 bp, Homo sapiens
tcctccctgggagcttctgagt

SEQ ID NO: 7940339 - DNA, 22 bp, Homo sapiens
tcctccctgggagcttctgagt

SEQ ID NO: 7940340 - DNA, 22 bp, Homo sapiens
tcctccctgggagcttctgagt

SEQ ID NO: 7940341 - DNA, 22 bp, Homo sapiens
tcctccctgcactcagtgaagt

SEQ ID NO: 7940342 - DNA, 22 bp, Homo sapiens
tccgggcaactgaagggaggtt

SEQ ID NO: 7940343 - DNA, 22 bp, Homo sapiens
tccggggcttccccgcagtgcc

SEQ ID NO: 7940344 - DNA, 23 bp, Homo sapiens
tcctcagtatataaaggcagatg

SEQ ID NO: 7940345 - DNA, 23 bp, Homo sapiens
tcctcagtatataaaggcagatg

SEQ ID NO: 7940346 - DNA, 22 bp, Homo sapiens
tcctcagtcacggtagcacatt

SEQ ID NO: 7940347 - DNA, 22 bp, Homo sapiens
tcctcagtattgtggagcagat

SEQ ID NO: 7940348 - DNA, 22 bp, Homo sapiens
tcctcagtattgtggagcagat

SEQ ID NO: 7940349 - DNA, 22 bp, Homo sapiens
tcctcagtcacggtagcacatt

SEQ ID NO: 7940350 - DNA, 22 bp, Homo sapiens
tcctcagtcacggtagcacatt

SEQ ID NO: 7940351 - DNA, 22 bp, Homo sapiens
tcctcagtcacggtagcacatt

SEQ ID NO: 7940352 - DNA, 22 bp, Homo sapiens
tcctcagtcagctccgttcttg

SEQ ID NO: 7940353 - DNA, 22 bp, Homo sapiens
tcctcagtctctaaggcctcag

SEQ ID NO: 7940354 - DNA, 22 bp, Homo sapiens
tcctcagtctctaaggcctcag

SEQ ID NO: 7940355 - DNA, 22 bp, Homo sapiens
tcctcagtcgtttgagccaaaa

SEQ ID NO: 7940356 - DNA, 22 bp, Homo sapiens
tcctcagtctctaaggcctcag

SEQ ID NO: 7940357 - DNA, 22 bp, Homo sapiens
tcctcagtcgtttgagccaaaa

SEQ ID NO: 7940358 - DNA, 22 bp, Homo sapiens
tcctcagtggggcattcattat

SEQ ID NO: 7940359 - DNA, 22 bp, Homo sapiens
tcctcagtgctagccaactgcc

SEQ ID NO: 7940360 - DNA, 22 bp, Homo sapiens
tcctcagttataaataggaaac

SEQ ID NO: 7940361 - DNA, 22 bp, Homo sapiens
tcctcagtggggcattcattat

SEQ ID NO: 7940362 - DNA, 22 bp, Homo sapiens
tcctcagtctctcaaatgaggc

SEQ ID NO: 7940363 - DNA, 22 bp, Homo sapiens
tcctcagtctctcaaatgaggc

SEQ ID NO: 7940364 - DNA, 19 bp, Homo sapiens
tcctcagtgacaacctcag

SEQ ID NO: 7940365 - DNA, 22 bp, Homo sapiens
tcctcagttataaataggaaac

SEQ ID NO: 7940366 - DNA, 22 bp, Homo sapiens
tcctcagttttctagtatggca

SEQ ID NO: 7940367 - DNA, 22 bp, Homo sapiens
tcctcagttttctagtatggca

SEQ ID NO: 7940368 - DNA, 22 bp, Homo sapiens
tcctcagttttctagtatggca

SEQ ID NO: 7940369 - DNA, 22 bp, Homo sapiens
tcctcatacatatctcagtctt

SEQ ID NO: 7940370 - DNA, 22 bp, Homo sapiens
tccgggaggcagaggttgcagt

SEQ ID NO: 7940371 - DNA, 22 bp, Homo sapiens
tccgggaggcagaggttgcagt

SEQ ID NO: 7940372 - DNA, 22 bp, Homo sapiens
tccgggaggcagaggttgcagt

SEQ ID NO: 7940373 - DNA, 22 bp, Homo sapiens
tccgggcaactgaagggaggtt

SEQ ID NO: 7940374 - DNA, 21 bp, Homo sapiens
tccgggaggtggaggctgcag

SEQ ID NO: 7940375 - DNA, 23 bp, Homo sapiens
tccggcaacttcactcctcccgc

SEQ ID NO: 7940376 - DNA, 22 bp, Homo sapiens
tccgggagctgaacgtcttgcg

SEQ ID NO: 7940377 - DNA, 22 bp, Homo sapiens
tccgggagctgaacgtcttgcg

SEQ ID NO: 7940378 - DNA, 22 bp, Homo sapiens
tccgctggagagggggctgcca

SEQ ID NO: 7940379 - DNA, 22 bp, Homo sapiens
tccggactcacctgacaatggc

SEQ ID NO: 7940380 - DNA, 22 bp, Homo sapiens
tccgccaggactgagggcccat

SEQ ID NO: 7940381 - DNA, 22 bp, Homo sapiens
tccgccaggactgagggcccat

SEQ ID NO: 7940382 - DNA, 22 bp, Homo sapiens
tccgccaggactgagggcccat

SEQ ID NO: 7940383 - DNA, 22 bp, Homo sapiens
tccgccaggactgagggcccat

SEQ ID NO: 7940384 - DNA, 22 bp, Homo sapiens
tccgccaggactgagggcccat

SEQ ID NO: 7940385 - DNA, 22 bp, Homo sapiens
tccgccaggactgagggcccat

SEQ ID NO: 7940386 - DNA, 22 bp, Homo sapiens
tccgataagcaattcttgtgct

SEQ ID NO: 7940387 - DNA, 22 bp, Homo sapiens
tccgaggccaaagctgtgaata

SEQ ID NO: 7940388 - DNA, 22 bp, Homo sapiens
tccctttggatccaagcttatg

SEQ ID NO: 7940389 - DNA, 22 bp, Homo sapiens
tccctttggatccaagcttatg

SEQ ID NO: 7940390 - DNA, 22 bp, Homo sapiens
tccctttcactactgtgttggt

SEQ ID NO: 7940391 - DNA, 22 bp, Homo sapiens
tccctttcacttaactagccca

SEQ ID NO: 7940392 - DNA, 22 bp, Homo sapiens
tccctttcactactgtgttggt

SEQ ID NO: 7940393 - DNA, 22 bp, Homo sapiens
tccctttcactactgtgttggt

SEQ ID NO: 7940394 - DNA, 22 bp, Homo sapiens
tccctttcactactgtgttggt

SEQ ID NO: 7940395 - DNA, 22 bp, Homo sapiens
tcctccagctgtatcctgcctg

SEQ ID NO: 7940396 - DNA, 22 bp, Homo sapiens
tcctccagctgtatcctgcctg

SEQ ID NO: 7940397 - DNA, 22 bp, Homo sapiens
tcctccagctgtatcctgcctg

SEQ ID NO: 7940398 - DNA, 22 bp, Homo sapiens
tcctccagctgtatcctgcctg

SEQ ID NO: 7940399 - DNA, 22 bp, Homo sapiens
tcctccaggataaaatgtgttg

SEQ ID NO: 7940400 - DNA, 22 bp, Homo sapiens
tcctccaggataaaatgtgttg

SEQ ID NO: 7940401 - DNA, 22 bp, Homo sapiens
tcctccaggcacctcactggct

SEQ ID NO: 7940402 - DNA, 22 bp, Homo sapiens
tcctccaggcacctcactggct

SEQ ID NO: 7940403 - DNA, 22 bp, Homo sapiens
tcctccagggggatcttcagcc

SEQ ID NO: 7940404 - DNA, 22 bp, Homo sapiens
tcctccagggggatcttcagcc

SEQ ID NO: 7940405 - DNA, 22 bp, Homo sapiens
tcctccagctactaggcaaata

SEQ ID NO: 7940406 - DNA, 22 bp, Homo sapiens
tcctccagctactaggcaaata

SEQ ID NO: 7940407 - DNA, 22 bp, Homo sapiens
tcctccagccctctaggaaaat

SEQ ID NO: 7940408 - DNA, 22 bp, Homo sapiens
tcctccagcaggactgaggccc

SEQ ID NO: 7940409 - DNA, 22 bp, Homo sapiens
tcctccagcaggactgaggccc

SEQ ID NO: 7940410 - DNA, 22 bp, Homo sapiens
tcctccagcaggactgaggccc

SEQ ID NO: 7940411 - DNA, 22 bp, Homo sapiens
tcctccagcaggactgaggccc

SEQ ID NO: 7940412 - DNA, 22 bp, Homo sapiens
tcctccagcaggactgaggccc

SEQ ID NO: 7940413 - DNA, 22 bp, Homo sapiens
tcctccagcaggactgaggccc

SEQ ID NO: 7940414 - DNA, 22 bp, Homo sapiens
tcctccagaccacttctgtgcg

SEQ ID NO: 7940415 - DNA, 22 bp, Homo sapiens
tcctccagaccacttctgtgcg

SEQ ID NO: 7940416 - DNA, 23 bp, Homo sapiens
tcctccagaggccctccttggcc

SEQ ID NO: 7940417 - DNA, 20 bp, Homo sapiens
tcctccagaagggcagggtg

SEQ ID NO: 7940418 - DNA, 22 bp, Homo sapiens
tcctccagaaactgaggcagaa

SEQ ID NO: 7940419 - DNA, 20 bp, Homo sapiens
tcctccagaagggcagggtg

SEQ ID NO: 7940420 - DNA, 20 bp, Homo sapiens
tcctccagaagggcagggtg

SEQ ID NO: 7940421 - DNA, 22 bp, Homo sapiens
tcctccacgtgagggcatacag

SEQ ID NO: 7940422 - DNA, 22 bp, Homo sapiens
tcctccacgtgagggcatacag

SEQ ID NO: 7940423 - DNA, 22 bp, Homo sapiens
tcctccacgatggcacacctgg

SEQ ID NO: 7940424 - DNA, 22 bp, Homo sapiens
tcctccagaaactgaggcagaa

SEQ ID NO: 7940425 - DNA, 22 bp, Homo sapiens
tcctccactttgtctagcaaca

SEQ ID NO: 7940426 - DNA, 22 bp, Homo sapiens
tcctccactttgtctagcaaca

SEQ ID NO: 7940427 - DNA, 22 bp, Homo sapiens
tcctccagaaactgaggcagaa

SEQ ID NO: 7940428 - DNA, 22 bp, Homo sapiens
tcctcattcttggtgcatcaaa

SEQ ID NO: 7940429 - DNA, 22 bp, Homo sapiens
tcctcattcttggtgcatcaaa

SEQ ID NO: 7940430 - DNA, 22 bp, Homo sapiens
tcctcattcttggtgcatcaaa

SEQ ID NO: 7940431 - DNA, 20 bp, Homo sapiens
tcctccaaccagctgctaat

SEQ ID NO: 7940432 - DNA, 22 bp, Homo sapiens
tcctcatggtagaatccaaaga

SEQ ID NO: 7940433 - DNA, 22 bp, Homo sapiens
tcctccaagcctttgtgaagtg

SEQ ID NO: 7940434 - DNA, 22 bp, Homo sapiens
tcctccaaggcagggggagaga

SEQ ID NO: 7940435 - DNA, 22 bp, Homo sapiens
tcctccacgatggcacacctgg

SEQ ID NO: 7940436 - DNA, 22 bp, Homo sapiens
tcctccacgatggcacacctgg

SEQ ID NO: 7940437 - DNA, 22 bp, Homo sapiens
tcctccacactctggactgttg

SEQ ID NO: 7940438 - DNA, 23 bp, Homo sapiens
tcctccaatctcatggcccttaa

SEQ ID NO: 7940439 - DNA, 22 bp, Homo sapiens
tcctccacactctggactgttg

SEQ ID NO: 7940440 - DNA, 22 bp, Homo sapiens
tcatctccatacggtctcgcag

SEQ ID NO: 7940441 - DNA, 20 bp, Homo sapiens
tcatggctgctgagaggttc

SEQ ID NO: 7940442 - DNA, 22 bp, Homo sapiens
tcatctaagagtcttacattta

SEQ ID NO: 7940443 - DNA, 22 bp, Homo sapiens
tcatctaagagtcttacattta

SEQ ID NO: 7940444 - DNA, 22 bp, Homo sapiens
tcatctaagagtcttacattta

SEQ ID NO: 7940445 - DNA, 22 bp, Homo sapiens
tcatctatttatgtagaacaag

SEQ ID NO: 7940446 - DNA, 22 bp, Homo sapiens
tcatctatttatgtagaacaag

SEQ ID NO: 7940447 - DNA, 22 bp, Homo sapiens
tcatctcagggcgacatcatgt

SEQ ID NO: 7940448 - DNA, 22 bp, Homo sapiens
tcatctcaaaattatgctgcac

SEQ ID NO: 7940449 - DNA, 22 bp, Homo sapiens
tcatctaagagtcttacattta

SEQ ID NO: 7940450 - DNA, 22 bp, Homo sapiens
tcatctaagagtcttacattta

SEQ ID NO: 7940451 - DNA, 22 bp, Homo sapiens
tcatctaagagtcttacattta

SEQ ID NO: 7940452 - DNA, 22 bp, Homo sapiens
tcatccttttgcatgggaaggc

SEQ ID NO: 7940453 - DNA, 22 bp, Homo sapiens
tcatcgtgctgctctgtccata

SEQ ID NO: 7940454 - DNA, 22 bp, Homo sapiens
tcatctaagagtcttacattta

SEQ ID NO: 7940455 - DNA, 22 bp, Homo sapiens
tcatccttttgcatgggaaggc

SEQ ID NO: 7940456 - DNA, 20 bp, Homo sapiens
tcatccttggcctctaccca

SEQ ID NO: 7940457 - DNA, 22 bp, Homo sapiens
tcatcctgcactggctcctcct

SEQ ID NO: 7940458 - DNA, 22 bp, Homo sapiens
tcatcctgcactggctcctcct

SEQ ID NO: 7940459 - DNA, 22 bp, Homo sapiens
tcatccagtatgactggtgtct

SEQ ID NO: 7940460 - DNA, 22 bp, Homo sapiens
tcatccagtatgactggtgtct

SEQ ID NO: 7940461 - DNA, 22 bp, Homo sapiens
tcatccagttcacatggtgagt

SEQ ID NO: 7940462 - DNA, 20 bp, Homo sapiens
tcatccagttggtttatggt

SEQ ID NO: 7940463 - DNA, 22 bp, Homo sapiens
tcatccatactattgagaggca

SEQ ID NO: 7940464 - DNA, 22 bp, Homo sapiens
tcatccatagtttggttggact

SEQ ID NO: 7940465 - DNA, 22 bp, Homo sapiens
tcatccatcctcgcctttgctt

SEQ ID NO: 7940466 - DNA, 16 bp, Homo sapiens
tcatccatgacagctc

SEQ ID NO: 7940467 - DNA, 22 bp, Homo sapiens
tcatccatgaagagtgacagaa

SEQ ID NO: 7940468 - DNA, 22 bp, Homo sapiens
tcatccatatagaaagatgatt

SEQ ID NO: 7940469 - DNA, 22 bp, Homo sapiens
tcatccatctttgatttcatag

SEQ ID NO: 7940470 - DNA, 22 bp, Homo sapiens
tcatccctaaggacagctctgc

SEQ ID NO: 7940471 - DNA, 22 bp, Homo sapiens
tcatcccagtgtccatgctcag

SEQ ID NO: 7940472 - DNA, 22 bp, Homo sapiens
tcatccctctgccaggcccagg

SEQ ID NO: 7940473 - DNA, 22 bp, Homo sapiens
tcatcctgaagaacctgcttcc

SEQ ID NO: 7940474 - DNA, 22 bp, Homo sapiens
tcatccatgtcagagcatgtat

SEQ ID NO: 7940475 - DNA, 21 bp, Homo sapiens
tcatccatggcttttgtgctt

SEQ ID NO: 7940476 - DNA, 22 bp, Homo sapiens
tcatccattgtcctcacattag

SEQ ID NO: 7940477 - DNA, 22 bp, Homo sapiens
tcatccatgtgcaaactttggt

SEQ ID NO: 7940478 - DNA, 22 bp, Homo sapiens
tcatcccagaccacttattttc

SEQ ID NO: 7940479 - DNA, 21 bp, Homo sapiens
tcatatttctcttgctattgt

SEQ ID NO: 7940480 - DNA, 22 bp, Homo sapiens
tcataaagcttgcctgcagtgt

SEQ ID NO: 7940481 - DNA, 22 bp, Homo sapiens
tcataaagatactaagtgagtt

SEQ ID NO: 7940482 - DNA, 22 bp, Homo sapiens
tcataaagatactaagtgagtt

SEQ ID NO: 7940483 - DNA, 22 bp, Homo sapiens
tcataaagagtgctgttgtttt

SEQ ID NO: 7940484 - DNA, 20 bp, Homo sapiens
tcataaagaggaaataaata

SEQ ID NO: 7940485 - DNA, 20 bp, Homo sapiens
tcataaagaggaaataaata

SEQ ID NO: 7940486 - DNA, 22 bp, Homo sapiens
tcataaaagtactcatgttcat

SEQ ID NO: 7940487 - DNA, 22 bp, Homo sapiens
tcataaaacacaccaggtagtt

SEQ ID NO: 7940488 - DNA, 22 bp, Homo sapiens
tcataaaagtactcatgttcat

SEQ ID NO: 7940489 - DNA, 22 bp, Homo sapiens
tcataaaagtactcatgttcat

SEQ ID NO: 7940490 - DNA, 22 bp, Homo sapiens
tcataaaagtactcatgttcat

SEQ ID NO: 7940491 - DNA, 22 bp, Homo sapiens
tcataaaatgctcctgatattg

SEQ ID NO: 7940492 - DNA, 22 bp, Homo sapiens
tcataaaatgctcctgatattg

SEQ ID NO: 7940493 - DNA, 22 bp, Homo sapiens
tcataaaatgctcctgatattg

SEQ ID NO: 7940494 - DNA, 21 bp, Homo sapiens
tcatccaggtcctgcttcttc

SEQ ID NO: 7940495 - DNA, 20 bp, Homo sapiens
tcatccaggacaggagtggc

SEQ ID NO: 7940496 - DNA, 21 bp, Homo sapiens
tcatccaggtcctgcttcttc

SEQ ID NO: 7940497 - DNA, 21 bp, Homo sapiens
tcatccaggtcctgcttcttc

SEQ ID NO: 7940498 - DNA, 22 bp, Homo sapiens
tcatccagaaaaatgtcttagc

SEQ ID NO: 7940499 - DNA, 22 bp, Homo sapiens
tcatccagaaaaatgtcttagc

SEQ ID NO: 7940500 - DNA, 22 bp, Homo sapiens
tcatccagagcttcataagtaa

SEQ ID NO: 7940501 - DNA, 22 bp, Homo sapiens
tcatccaggaaaagatttggaa

SEQ ID NO: 7940502 - DNA, 22 bp, Homo sapiens
tcatccagagcttcataagtaa

SEQ ID NO: 7940503 - DNA, 23 bp, Homo sapiens
tcatcaaacagctgctcaagaaa

SEQ ID NO: 7940504 - DNA, 22 bp, Homo sapiens
tcatcatctgcaagctcatgtc

SEQ ID NO: 7940505 - DNA, 22 bp, Homo sapiens
tcatcatctgggcttgggggtg

SEQ ID NO: 7940506 - DNA, 22 bp, Homo sapiens
tcatcaaaggattgcatgattt

SEQ ID NO: 7940507 - DNA, 23 bp, Homo sapiens
tcatcaaaggaagtacgtgtcac

SEQ ID NO: 7940508 - DNA, 22 bp, Homo sapiens
tcagttagggcctcagaagaca

SEQ ID NO: 7940509 - DNA, 22 bp, Homo sapiens
tcagttagggcctcagaagaca

SEQ ID NO: 7940510 - DNA, 22 bp, Homo sapiens
tcagttagggcctcagaagaca

SEQ ID NO: 7940511 - DNA, 22 bp, Homo sapiens
tcagttcaaacaggtgtctgga

SEQ ID NO: 7940512 - DNA, 20 bp, Homo sapiens
tcagttaggaagaggcactc

SEQ ID NO: 7940513 - DNA, 22 bp, Homo sapiens
tcagttagcgtaatcactgggg

SEQ ID NO: 7940514 - DNA, 22 bp, Homo sapiens
tcagttagattgcctccttaga

SEQ ID NO: 7940515 - DNA, 22 bp, Homo sapiens
tcagtggtatgcgtgggagctg

SEQ ID NO: 7940516 - DNA, 22 bp, Homo sapiens
tcagttactctgatgtcctgtg

SEQ ID NO: 7940517 - DNA, 22 bp, Homo sapiens
tcagtggtaccaagggggctgg

SEQ ID NO: 7940518 - DNA, 22 bp, Homo sapiens
tcagtggtatgcgtgggagctg

SEQ ID NO: 7940519 - DNA, 22 bp, Homo sapiens
tcagtggtatgcgtgggagctg

SEQ ID NO: 7940520 - DNA, 22 bp, Homo sapiens
tcagtggggtcgatgtgaggga

SEQ ID NO: 7940521 - DNA, 22 bp, Homo sapiens
tcagttacctgacagtggttat

SEQ ID NO: 7940522 - DNA, 22 bp, Homo sapiens
tcagtggtaccaagggggctgg

SEQ ID NO: 7940523 - DNA, 20 bp, Homo sapiens
tcagtgggaaagtgagagtg

SEQ ID NO: 7940524 - DNA, 22 bp, Homo sapiens
tcagtggattgtagaaggctta

SEQ ID NO: 7940525 - DNA, 22 bp, Homo sapiens
tcagtggattgtagaaggctta

SEQ ID NO: 7940526 - DNA, 22 bp, Homo sapiens
tcagtggattgacatgaaaaag

SEQ ID NO: 7940527 - DNA, 22 bp, Homo sapiens
tcagtggaactgtctgggtgag

SEQ ID NO: 7940528 - DNA, 22 bp, Homo sapiens
tcagtggatatttctgtggctg

SEQ ID NO: 7940529 - DNA, 22 bp, Homo sapiens
tcagtggattggatgagatctg

SEQ ID NO: 7940530 - DNA, 22 bp, Homo sapiens
tcagtggattgtagaaggctta

SEQ ID NO: 7940531 - DNA, 22 bp, Homo sapiens
tcagtggattgacatgaaaaag

SEQ ID NO: 7940532 - DNA, 22 bp, Homo sapiens
tcagtggattggatgagatctg

SEQ ID NO: 7940533 - DNA, 22 bp, Homo sapiens
tcagtggattgtagaaggctta

SEQ ID NO: 7940534 - DNA, 22 bp, Homo sapiens
tcagtggagctaagcatgagat

SEQ ID NO: 7940535 - DNA, 22 bp, Homo sapiens
tcagtggagctaagcatgagat

SEQ ID NO: 7940536 - DNA, 22 bp, Homo sapiens
tcagtggagctaagcatgagat

SEQ ID NO: 7940537 - DNA, 22 bp, Homo sapiens
tcagtggagctaagcatgagat

SEQ ID NO: 7940538 - DNA, 22 bp, Homo sapiens
tcagtggagtatggatgaagtc

SEQ ID NO: 7940539 - DNA, 22 bp, Homo sapiens
tcagtggagtatggatgaagtc

SEQ ID NO: 7940540 - DNA, 22 bp, Homo sapiens
tcagtggagtatggatgaagtc

SEQ ID NO: 7940541 - DNA, 22 bp, Homo sapiens
tcagtggatatttctgtggctg

SEQ ID NO: 7940542 - DNA, 22 bp, Homo sapiens
tcagtggagtatggatgaagtc

SEQ ID NO: 7940543 - DNA, 22 bp, Homo sapiens
tcagtggatatttctgtggctg

SEQ ID NO: 7940544 - DNA, 19 bp, Homo sapiens
tcagtggatgaacatgttt

SEQ ID NO: 7940545 - DNA, 22 bp, Homo sapiens
tcagtggattgacatgaaaaag

SEQ ID NO: 7940546 - DNA, 22 bp, Homo sapiens
tcagtgcttttgtcacatggtc

SEQ ID NO: 7940547 - DNA, 22 bp, Homo sapiens
tcagtgcttttgagaagctcct

SEQ ID NO: 7940548 - DNA, 22 bp, Homo sapiens
tcagtgcttttgagaagctcct

SEQ ID NO: 7940549 - DNA, 22 bp, Homo sapiens
tcagtgcttttgagaagctcct

SEQ ID NO: 7940550 - DNA, 22 bp, Homo sapiens
tcagtgcttgcctctggaggag

SEQ ID NO: 7940551 - DNA, 23 bp, Homo sapiens
tcagtgcttgggggtgacgcgcc

SEQ ID NO: 7940552 - DNA, 22 bp, Homo sapiens
tcagtgcttttgagaagctcct

SEQ ID NO: 7940553 - DNA, 22 bp, Homo sapiens
tcagtggaactgtctgggtgag

SEQ ID NO: 7940554 - DNA, 22 bp, Homo sapiens
tcagtggaactgtctgggtgag

SEQ ID NO: 7940555 - DNA, 22 bp, Homo sapiens
tcagtgcttttgtcacatggtc

SEQ ID NO: 7940556 - DNA, 22 bp, Homo sapiens
tcagtgcttttgtcacatggtc

SEQ ID NO: 7940557 - DNA, 19 bp, Homo sapiens
tcagtggagaaaggggaag

SEQ ID NO: 7940558 - DNA, 22 bp, Homo sapiens
tcagtggagagcttccaggatt

SEQ ID NO: 7940559 - DNA, 19 bp, Homo sapiens
tcagtggagaaaggggaag

SEQ ID NO: 7940560 - DNA, 22 bp, Homo sapiens
tcagtgcttttgtcacatggtc

SEQ ID NO: 7940561 - DNA, 22 bp, Homo sapiens
tcagtgcttgcctctggaggag

SEQ ID NO: 7940562 - DNA, 22 bp, Homo sapiens
tcagtgcttgcctctggaggag

SEQ ID NO: 7940563 - DNA, 22 bp, Homo sapiens
tcagtgcttgcctctggaggag

SEQ ID NO: 7940564 - DNA, 22 bp, Homo sapiens
tcagtgcttgacagctctggga

SEQ ID NO: 7940565 - DNA, 22 bp, Homo sapiens
tcagtgcttgacagctctggga

SEQ ID NO: 7940566 - DNA, 22 bp, Homo sapiens
tcagtgcttcggcgagcaccta

SEQ ID NO: 7940567 - DNA, 22 bp, Homo sapiens
tcagtgcttcggcgagcaccta

SEQ ID NO: 7940568 - DNA, 22 bp, Homo sapiens
tcagtgcttcctggaggaagcc

SEQ ID NO: 7940569 - DNA, 22 bp, Homo sapiens
tcagtgcttatattctgagcct

SEQ ID NO: 7940570 - DNA, 22 bp, Homo sapiens
tcagtgcttcctggaggaagcc

SEQ ID NO: 7940571 - DNA, 22 bp, Homo sapiens
tcagtgcttatattctgagcct

SEQ ID NO: 7940572 - DNA, 22 bp, Homo sapiens
tcagtgcattaataatatcagt

SEQ ID NO: 7940573 - DNA, 22 bp, Homo sapiens
tcagtgctgtgtaaatgtatta

SEQ ID NO: 7940574 - DNA, 22 bp, Homo sapiens
tcagtgcttcctggaggaagcc

SEQ ID NO: 7940575 - DNA, 22 bp, Homo sapiens
tcagtgcttcctggaggaagcc

SEQ ID NO: 7940576 - DNA, 22 bp, Homo sapiens
tcagtttgaatgttagcacagt

SEQ ID NO: 7940577 - DNA, 23 bp, Homo sapiens
tcagtttgtataatccatatgca

SEQ ID NO: 7940578 - DNA, 22 bp, Homo sapiens
tcagtttgctcataggtgaggg

SEQ ID NO: 7940579 - DNA, 22 bp, Homo sapiens
tcagttttaaggtttgagaatt

SEQ ID NO: 7940580 - DNA, 22 bp, Homo sapiens
tcagttttaaggtttgagaatt

SEQ ID NO: 7940581 - DNA, 19 bp, Homo sapiens
tcagttttagtcatcagtt

SEQ ID NO: 7940582 - DNA, 22 bp, Homo sapiens
tcagttttcaatttcatcagag

SEQ ID NO: 7940583 - DNA, 22 bp, Homo sapiens
tcagttcctgttgcacagcatc

SEQ ID NO: 7940584 - DNA, 22 bp, Homo sapiens
tcagtttctaaatcttaccaat

SEQ ID NO: 7940585 - DNA, 22 bp, Homo sapiens
tcagtttctttactcatagaat

SEQ ID NO: 7940586 - DNA, 22 bp, Homo sapiens
tcagtttcttctttagataaaa

SEQ ID NO: 7940587 - DNA, 22 bp, Homo sapiens
tcagtttctccatcgctccagt

SEQ ID NO: 7940588 - DNA, 22 bp, Homo sapiens
tcagtttcttcatctccctaac

SEQ ID NO: 7940589 - DNA, 22 bp, Homo sapiens
tcagtttttaaatgatataatt

SEQ ID NO: 7940590 - DNA, 22 bp, Homo sapiens
tcagtttttaaatgatataatt

SEQ ID NO: 7940591 - DNA, 23 bp, Homo sapiens
tcagttttggctgttcagtgttg

SEQ ID NO: 7940592 - DNA, 22 bp, Homo sapiens
tcagttttgaaaacattgaatg

SEQ ID NO: 7940593 - DNA, 22 bp, Homo sapiens
tcagttttgaaaacattgaatg

SEQ ID NO: 7940594 - DNA, 22 bp, Homo sapiens
tcagttttgattcctggttctc

SEQ ID NO: 7940595 - DNA, 22 bp, Homo sapiens
tcagttttctcatttatgagat

SEQ ID NO: 7940596 - DNA, 22 bp, Homo sapiens
tcagttttgaaaacattgaatg

SEQ ID NO: 7940597 - DNA, 22 bp, Homo sapiens
tcagttttctcatctgtgaaat

SEQ ID NO: 7940598 - DNA, 19 bp, Homo sapiens
tcataaaaatggtaaccca

SEQ ID NO: 7940599 - DNA, 22 bp, Homo sapiens
tcataaaacacaccaggtagtt

SEQ ID NO: 7940600 - DNA, 22 bp, Homo sapiens
tcataaaacacaccaggtagtt

SEQ ID NO: 7940601 - DNA, 22 bp, Homo sapiens
tcataaaacacaccaggtagtt

SEQ ID NO: 7940602 - DNA, 22 bp, Homo sapiens
tcataaaaatagactctaaagt

SEQ ID NO: 7940603 - DNA, 19 bp, Homo sapiens
tcataaaaatggtaaccca

SEQ ID NO: 7940604 - DNA, 22 bp, Homo sapiens
tcataaaaatagactctaaagt

SEQ ID NO: 7940605 - DNA, 22 bp, Homo sapiens
tcataaaaatagactctaaagt

SEQ ID NO: 7940606 - DNA, 22 bp, Homo sapiens
tcagtttttctatactttgtag

SEQ ID NO: 7940607 - DNA, 22 bp, Homo sapiens
tcaggctgaggtcatctgcatc

SEQ ID NO: 7940608 - DNA, 22 bp, Homo sapiens
tcagggactgcagagggaagct

SEQ ID NO: 7940609 - DNA, 22 bp, Homo sapiens
tcagggacttacaaaccagaag

SEQ ID NO: 7940610 - DNA, 22 bp, Homo sapiens
tcagggagagcctgtctgacgt

SEQ ID NO: 7940611 - DNA, 22 bp, Homo sapiens
tcagggagaggtgagagcctgt

SEQ ID NO: 7940612 - DNA, 22 bp, Homo sapiens
tcagggagagcctgtctgacgt

SEQ ID NO: 7940613 - DNA, 22 bp, Homo sapiens
tcagggcaaaagggaaaccatt

SEQ ID NO: 7940614 - DNA, 22 bp, Homo sapiens
tcagggcaaaagggaaaccatt

SEQ ID NO: 7940615 - DNA, 22 bp, Homo sapiens
tcaggctgagaaaatctggacc

SEQ ID NO: 7940616 - DNA, 22 bp, Homo sapiens
tcaggctgaccaggttttgctc

SEQ ID NO: 7940617 - DNA, 22 bp, Homo sapiens
tcaggctgaccaggttttgctc

SEQ ID NO: 7940618 - DNA, 22 bp, Homo sapiens
tcaggctgaccaggttttgctc

SEQ ID NO: 7940619 - DNA, 22 bp, Homo sapiens
tcaggctgaggtcatctgcatc

SEQ ID NO: 7940620 - DNA, 22 bp, Homo sapiens
tcaggctgagaaaatctggacc

SEQ ID NO: 7940621 - DNA, 22 bp, Homo sapiens
tcaggctgaggtcatctgcatc

SEQ ID NO: 7940622 - DNA, 22 bp, Homo sapiens
tcaggctgaggtcatctgcatc

SEQ ID NO: 7940623 - DNA, 22 bp, Homo sapiens
tcagggcaaagggcagagtttg

SEQ ID NO: 7940624 - DNA, 22 bp, Homo sapiens
tcagggcaaagggcagagtttg

SEQ ID NO: 7940625 - DNA, 22 bp, Homo sapiens
tcagggcaaagggcagagtttg

SEQ ID NO: 7940626 - DNA, 22 bp, Homo sapiens
tcagggcaagattggttaataa

SEQ ID NO: 7940627 - DNA, 22 bp, Homo sapiens
tcagggcaagtctcagaaggtt

SEQ ID NO: 7940628 - DNA, 22 bp, Homo sapiens
tcagggcaagtctcagaaggtt

SEQ ID NO: 7940629 - DNA, 22 bp, Homo sapiens
tcagggcaagtctcagaaggtt

SEQ ID NO: 7940630 - DNA, 22 bp, Homo sapiens
tcagggcacattctgcagtggc

SEQ ID NO: 7940631 - DNA, 22 bp, Homo sapiens
tcagggcacattctgcagtggc

SEQ ID NO: 7940632 - DNA, 22 bp, Homo sapiens
tcagggcacattctgcagtggc

SEQ ID NO: 7940633 - DNA, 22 bp, Homo sapiens
tcagggcaccaaaaaagatgcc

SEQ ID NO: 7940634 - DNA, 22 bp, Homo sapiens
tcagggcaatgtccctcagaag

SEQ ID NO: 7940635 - DNA, 22 bp, Homo sapiens
tcagggcaatgtccctcagaag

SEQ ID NO: 7940636 - DNA, 22 bp, Homo sapiens
tcagggcacaggcctgtgggtt

SEQ ID NO: 7940637 - DNA, 22 bp, Homo sapiens
tcagggcacaggcctgtgggtt

SEQ ID NO: 7940638 - DNA, 22 bp, Homo sapiens
tcaggctctgccacctagatta

SEQ ID NO: 7940639 - DNA, 18 bp, Homo sapiens
tcaggctctctggctaga

SEQ ID NO: 7940640 - DNA, 18 bp, Homo sapiens
tcaggctctctggctaga

SEQ ID NO: 7940641 - DNA, 22 bp, Homo sapiens
tcaggctctgagctgatgctaa

SEQ ID NO: 7940642 - DNA, 22 bp, Homo sapiens
tcaggctgaaaggactccagtt

SEQ ID NO: 7940643 - DNA, 22 bp, Homo sapiens
tcaggctgaaaggactccagtt

SEQ ID NO: 7940644 - DNA, 22 bp, Homo sapiens
tcaggctctgggtacacctgac

SEQ ID NO: 7940645 - DNA, 22 bp, Homo sapiens
tcaggctgaaaggactccagtt

SEQ ID NO: 7940646 - DNA, 22 bp, Homo sapiens
tcaggctctgggtacacctgac

SEQ ID NO: 7940647 - DNA, 22 bp, Homo sapiens
tcaggctctgggtacacctgac

SEQ ID NO: 7940648 - DNA, 22 bp, Homo sapiens
tcaggctgaatcatcctagctt

SEQ ID NO: 7940649 - DNA, 22 bp, Homo sapiens
tcaggctgaatcatcctagctt

SEQ ID NO: 7940650 - DNA, 22 bp, Homo sapiens
tcaggctgaatcatcctagctt

SEQ ID NO: 7940651 - DNA, 22 bp, Homo sapiens
tcaggctgaatcatcctagctt

SEQ ID NO: 7940652 - DNA, 22 bp, Homo sapiens
tcaggctgaatcatcctagctt

SEQ ID NO: 7940653 - DNA, 22 bp, Homo sapiens
tcaggctgaatcatcctagctt

SEQ ID NO: 7940654 - DNA, 22 bp, Homo sapiens
tcaggctgaaggaggcctatct

SEQ ID NO: 7940655 - DNA, 22 bp, Homo sapiens
tcaggctgaaggaggcctatct

SEQ ID NO: 7940656 - DNA, 22 bp, Homo sapiens
tcaggctgaaggaggcctatct

SEQ ID NO: 7940657 - DNA, 22 bp, Homo sapiens
tcaggctgaaggaggcctatct

SEQ ID NO: 7940658 - DNA, 22 bp, Homo sapiens
tcaggctgaaaggactccagtt

SEQ ID NO: 7940659 - DNA, 22 bp, Homo sapiens
tcaggctgaaaggactccagtt

SEQ ID NO: 7940660 - DNA, 22 bp, Homo sapiens
tcaggctctacacttgacacac

SEQ ID NO: 7940661 - DNA, 22 bp, Homo sapiens
tcaggctctcagaccaacagca

SEQ ID NO: 7940662 - DNA, 22 bp, Homo sapiens
tcaggctctcagaccaacagca

SEQ ID NO: 7940663 - DNA, 18 bp, Homo sapiens
tcaggctctctggctaga

SEQ ID NO: 7940664 - DNA, 18 bp, Homo sapiens
tcaggctctctggctaga

SEQ ID NO: 7940665 - DNA, 22 bp, Homo sapiens
tcaggctccctgctgggctctg

SEQ ID NO: 7940666 - DNA, 22 bp, Homo sapiens
tcaggctcaggttaggggccaa

SEQ ID NO: 7940667 - DNA, 22 bp, Homo sapiens
tcaggctccctgctgggctctg

SEQ ID NO: 7940668 - DNA, 22 bp, Homo sapiens
tcaggctccctgctgggctctg

SEQ ID NO: 7940669 - DNA, 22 bp, Homo sapiens
tcaggctccctgctgggctctg

SEQ ID NO: 7940670 - DNA, 22 bp, Homo sapiens
tcaggcctttcttcagagcttc

SEQ ID NO: 7940671 - DNA, 22 bp, Homo sapiens
tcaggcctttgaacttggagtg

SEQ ID NO: 7940672 - DNA, 22 bp, Homo sapiens
tcaggcctttgaacttggagtg

SEQ ID NO: 7940673 - DNA, 22 bp, Homo sapiens
tcaggcctttgaacttggagtg

SEQ ID NO: 7940674 - DNA, 22 bp, Homo sapiens
tcaggcctttgaacttggagtg

SEQ ID NO: 7940675 - DNA, 22 bp, Homo sapiens
tcaggcctttgaacttggagtg

SEQ ID NO: 7940676 - DNA, 22 bp, Homo sapiens
tcaggcctttcttcagagcttc

SEQ ID NO: 7940677 - DNA, 22 bp, Homo sapiens
tcaggcctttcttcagagcttc

SEQ ID NO: 7940678 - DNA, 22 bp, Homo sapiens
tcaggcctttcttcagagcttc

SEQ ID NO: 7940679 - DNA, 22 bp, Homo sapiens
tcaggctacactcttttcatgg

SEQ ID NO: 7940680 - DNA, 22 bp, Homo sapiens
tcaggcgaggcttaatccaagg

SEQ ID NO: 7940681 - DNA, 22 bp, Homo sapiens
tcagggtatgttctagatctga

SEQ ID NO: 7940682 - DNA, 22 bp, Homo sapiens
tcagggtcagattccagagcct

SEQ ID NO: 7940683 - DNA, 22 bp, Homo sapiens
tcagggtatgttctagatctga

SEQ ID NO: 7940684 - DNA, 22 bp, Homo sapiens
tcagggtcaggacccagctgtt

SEQ ID NO: 7940685 - DNA, 19 bp, Homo sapiens
tcagggggctgataggagg

SEQ ID NO: 7940686 - DNA, 22 bp, Homo sapiens
tcagggtgaaccaggcaggaat

SEQ ID NO: 7940687 - DNA, 21 bp, Homo sapiens
tcagggttcaaaggaactgat

SEQ ID NO: 7940688 - DNA, 22 bp, Homo sapiens
tcagggtgggaggacccttgag

SEQ ID NO: 7940689 - DNA, 22 bp, Homo sapiens
tcagggtcaggacccagctgtt

SEQ ID NO: 7940690 - DNA, 22 bp, Homo sapiens
tcagggtgaaccaggcaggaat

SEQ ID NO: 7940691 - DNA, 22 bp, Homo sapiens
tcagggtttggggctacagcca

SEQ ID NO: 7940692 - DNA, 20 bp, Homo sapiens
tcaggtagatctttgaggtc

SEQ ID NO: 7940693 - DNA, 22 bp, Homo sapiens
tcaggtaagtgtaatatataga

SEQ ID NO: 7940694 - DNA, 22 bp, Homo sapiens
tcagggttctttcagttaagtt

SEQ ID NO: 7940695 - DNA, 22 bp, Homo sapiens
tcaggtccagctcctgtgcctc

SEQ ID NO: 7940696 - DNA, 22 bp, Homo sapiens
tcaggtccaagatggccatcca

SEQ ID NO: 7940697 - DNA, 22 bp, Homo sapiens
tcaggtccagctcctgtgcctc

SEQ ID NO: 7940698 - DNA, 20 bp, Homo sapiens
tcaggtagatctttgaggtc

SEQ ID NO: 7940699 - DNA, 22 bp, Homo sapiens
tcaggtagtggttaagttctgt

SEQ ID NO: 7940700 - DNA, 22 bp, Homo sapiens
tcagtgcatggacagatttaga

SEQ ID NO: 7940701 - DNA, 22 bp, Homo sapiens
tcagtgcatggacagatttaga

SEQ ID NO: 7940702 - DNA, 22 bp, Homo sapiens
tcagtgcatcacagaactttgt

SEQ ID NO: 7940703 - DNA, 22 bp, Homo sapiens
tcagtgcagtgaaaggtttact

SEQ ID NO: 7940704 - DNA, 22 bp, Homo sapiens
tcagtgcatcacagaactttgt

SEQ ID NO: 7940705 - DNA, 22 bp, Homo sapiens
tcagtgcattaataatatcagt

SEQ ID NO: 7940706 - DNA, 22 bp, Homo sapiens
tcagtgcattaataatatcagt

SEQ ID NO: 7940707 - DNA, 22 bp, Homo sapiens
tcagtgcattcatgggtggctg

SEQ ID NO: 7940708 - DNA, 22 bp, Homo sapiens
tcagtgcagtgaaaggtttact

SEQ ID NO: 7940709 - DNA, 22 bp, Homo sapiens
tcaggtgacctgagccactatg

SEQ ID NO: 7940710 - DNA, 20 bp, Homo sapiens
tcaggtgacacacgtggcac

SEQ ID NO: 7940711 - DNA, 22 bp, Homo sapiens
tcaggtgacctgagccactatg

SEQ ID NO: 7940712 - DNA, 22 bp, Homo sapiens
tcaggtcccactgctagtaagt

SEQ ID NO: 7940713 - DNA, 22 bp, Homo sapiens
tcaggtccccaactcttctcac

SEQ ID NO: 7940714 - DNA, 22 bp, Homo sapiens
tcaggtcctctgggtcccagcc

SEQ ID NO: 7940715 - DNA, 22 bp, Homo sapiens
tcaggtctatactatgagaggc

SEQ ID NO: 7940716 - DNA, 22 bp, Homo sapiens
tcaggtccttactgtgctccct

SEQ ID NO: 7940717 - DNA, 22 bp, Homo sapiens
tcaggtctatagaagaggaggg

SEQ ID NO: 7940718 - DNA, 22 bp, Homo sapiens
tcaggtctatagaagaggaggg

SEQ ID NO: 7940719 - DNA, 22 bp, Homo sapiens
tcaggtctatactatgagaggc

SEQ ID NO: 7940720 - DNA, 22 bp, Homo sapiens
tcaggtccttttggtgtatatt

SEQ ID NO: 7940721 - DNA, 22 bp, Homo sapiens
tcaggtcttttgtctcctagaa

SEQ ID NO: 7940722 - DNA, 20 bp, Homo sapiens
tcaggtgacacacgtggcac

SEQ ID NO: 7940723 - DNA, 22 bp, Homo sapiens
tcaggtcttttgtctcctagaa

SEQ ID NO: 7940724 - DNA, 22 bp, Homo sapiens
tcaggtcttgagccatcaggat

SEQ ID NO: 7940725 - DNA, 22 bp, Homo sapiens
tcaggtcttttgtctcctagaa

SEQ ID NO: 7940726 - DNA, 22 bp, Homo sapiens
tcaggtctgatgcctcatccat

SEQ ID NO: 7940727 - DNA, 22 bp, Homo sapiens
tcaggtctgggcacatggtaca

SEQ ID NO: 7940728 - DNA, 22 bp, Homo sapiens
tcaggtctgtactattgtcttg

SEQ ID NO: 7940729 - DNA, 22 bp, Homo sapiens
tcaggtcttgagccatcaggat

SEQ ID NO: 7940730 - DNA, 22 bp, Homo sapiens
tcaggggcttgaggtgcatgtc

SEQ ID NO: 7940731 - DNA, 22 bp, Homo sapiens
tcaggggcttgaggtgcatgtc

SEQ ID NO: 7940732 - DNA, 22 bp, Homo sapiens
tcaggggcttgaggtgcatgtc

SEQ ID NO: 7940733 - DNA, 22 bp, Homo sapiens
tcaggggcttgaggtgcatgtc

SEQ ID NO: 7940734 - DNA, 21 bp, Homo sapiens
tcaggggctgtgttttccatc

SEQ ID NO: 7940735 - DNA, 22 bp, Homo sapiens
tcaggggctgtgcatttcccag

SEQ ID NO: 7940736 - DNA, 21 bp, Homo sapiens
tcaggggctgtgttttccatc

SEQ ID NO: 7940737 - DNA, 22 bp, Homo sapiens
tcaggggaaatctctcagcgaa

SEQ ID NO: 7940738 - DNA, 22 bp, Homo sapiens
tcaggggaaatctctcagcgaa

SEQ ID NO: 7940739 - DNA, 22 bp, Homo sapiens
tcaggggacttaggagagaagt

SEQ ID NO: 7940740 - DNA, 22 bp, Homo sapiens
tcaggggcagccggggaagcca

SEQ ID NO: 7940741 - DNA, 22 bp, Homo sapiens
tcaggggcagctgtgctttgtg

SEQ ID NO: 7940742 - DNA, 22 bp, Homo sapiens
tcaggggcccttccctcagcag

SEQ ID NO: 7940743 - DNA, 22 bp, Homo sapiens
tcaggggcagctgtgctttgtg

SEQ ID NO: 7940744 - DNA, 22 bp, Homo sapiens
tcaggggcagccggggaagcca

SEQ ID NO: 7940745 - DNA, 22 bp, Homo sapiens
tcaggggcagccggggaagcca

SEQ ID NO: 7940746 - DNA, 22 bp, Homo sapiens
tcagggcagaatccaaagaatt

SEQ ID NO: 7940747 - DNA, 22 bp, Homo sapiens
tcagggcagaatccaaagaatt

SEQ ID NO: 7940748 - DNA, 22 bp, Homo sapiens
tcagggcaccaaaaaagatgcc

SEQ ID NO: 7940749 - DNA, 22 bp, Homo sapiens
tcagggcactgtcacctgatat

SEQ ID NO: 7940750 - DNA, 22 bp, Homo sapiens
tcagggcacgtttctgcaatgc

SEQ ID NO: 7940751 - DNA, 22 bp, Homo sapiens
tcagggcagcctaaggcacctc

SEQ ID NO: 7940752 - DNA, 22 bp, Homo sapiens
tcagggcagcctaaggcacctc

SEQ ID NO: 7940753 - DNA, 22 bp, Homo sapiens
tcagggcagcctaaggcacctc

SEQ ID NO: 7940754 - DNA, 22 bp, Homo sapiens
tcagggcagcctaaggcacctc

SEQ ID NO: 7940755 - DNA, 21 bp, Homo sapiens
tcagggcagctgctcttcaga

SEQ ID NO: 7940756 - DNA, 22 bp, Homo sapiens
tcagggctgtggttccttttct

SEQ ID NO: 7940757 - DNA, 22 bp, Homo sapiens
tcagggctgccgggcagaccgt

SEQ ID NO: 7940758 - DNA, 22 bp, Homo sapiens
tcagggctgccgggcagaccgt

SEQ ID NO: 7940759 - DNA, 22 bp, Homo sapiens
tcagggctggcttttgcagagc

SEQ ID NO: 7940760 - DNA, 22 bp, Homo sapiens
tcagggctggcttttgcagagc

SEQ ID NO: 7940761 - DNA, 22 bp, Homo sapiens
tcagggctgccgggcagaccgt

SEQ ID NO: 7940762 - DNA, 22 bp, Homo sapiens
tcaggcaaggctggtctcatac

SEQ ID NO: 7940763 - DNA, 22 bp, Homo sapiens
tcaggcaatctgacagctggag

SEQ ID NO: 7940764 - DNA, 22 bp, Homo sapiens
tcaggcaccccttgagtagggg

SEQ ID NO: 7940765 - DNA, 22 bp, Homo sapiens
tcaggcaccctctattttcatc

SEQ ID NO: 7940766 - DNA, 22 bp, Homo sapiens
tcaggcaccccttgagtagggg

SEQ ID NO: 7940767 - DNA, 19 bp, Homo sapiens
tcaggaggtcgacctggca

SEQ ID NO: 7940768 - DNA, 22 bp, Homo sapiens
tcaggaggtctgctgcggggtg

SEQ ID NO: 7940769 - DNA, 22 bp, Homo sapiens
tcaggaggtctgctgcggggtg

SEQ ID NO: 7940770 - DNA, 22 bp, Homo sapiens
tcaggaggtgtaacgaatacag

SEQ ID NO: 7940771 - DNA, 22 bp, Homo sapiens
tcaggaggtgtaacgaatacag

SEQ ID NO: 7940772 - DNA, 22 bp, Homo sapiens
tcaggaggtgtaacgaatacag

SEQ ID NO: 7940773 - DNA, 22 bp, Homo sapiens
tcaggaggtaggacatactggt

SEQ ID NO: 7940774 - DNA, 22 bp, Homo sapiens
tcaggaggtaggacatactggt

SEQ ID NO: 7940775 - DNA, 22 bp, Homo sapiens
tcaggaggtaggacatactggt

SEQ ID NO: 7940776 - DNA, 22 bp, Homo sapiens
tcaggaggtaggacatactggt

SEQ ID NO: 7940777 - DNA, 22 bp, Homo sapiens
tcaggaggtaaggtaaaacaga

SEQ ID NO: 7940778 - DNA, 22 bp, Homo sapiens
tcaggaggtaaggtaaaacaga

SEQ ID NO: 7940779 - DNA, 22 bp, Homo sapiens
tcaggagggtgacaggccctgg

SEQ ID NO: 7940780 - DNA, 22 bp, Homo sapiens
tcaggagggtgacaggccctgg

SEQ ID NO: 7940781 - DNA, 22 bp, Homo sapiens
tcaggaggtccgcccgggaggg

SEQ ID NO: 7940782 - DNA, 22 bp, Homo sapiens
tcaggaggtccgcccgggaggg

SEQ ID NO: 7940783 - DNA, 22 bp, Homo sapiens
tcaggaggtccgcccgggaggg

SEQ ID NO: 7940784 - DNA, 22 bp, Homo sapiens
tcaggaggtccgcccgggaggg

SEQ ID NO: 7940785 - DNA, 19 bp, Homo sapiens
tcaggaggtcgacctggca

SEQ ID NO: 7940786 - DNA, 19 bp, Homo sapiens
tcaggaggtcgacctggca

SEQ ID NO: 7940787 - DNA, 22 bp, Homo sapiens
tcaggcaggaagcccctgcaca

SEQ ID NO: 7940788 - DNA, 22 bp, Homo sapiens
tcaggcaggaagcccctgcaca

SEQ ID NO: 7940789 - DNA, 22 bp, Homo sapiens
tcaggcaggaagcccctgcaca

SEQ ID NO: 7940790 - DNA, 22 bp, Homo sapiens
tcaggcaggaagcccctgcaca

SEQ ID NO: 7940791 - DNA, 22 bp, Homo sapiens
tcaggcaggaagcccctgcaca

SEQ ID NO: 7940792 - DNA, 22 bp, Homo sapiens
tcaggcagctccaggaatggta

SEQ ID NO: 7940793 - DNA, 23 bp, Homo sapiens
tcaggcagctggggtagttggag

SEQ ID NO: 7940794 - DNA, 23 bp, Homo sapiens
tcaggcagctggggtagttggag

SEQ ID NO: 7940795 - DNA, 23 bp, Homo sapiens
tcaggcagctggggtagttggag

SEQ ID NO: 7940796 - DNA, 23 bp, Homo sapiens
tcaggcagctggggtagttggag

SEQ ID NO: 7940797 - DNA, 23 bp, Homo sapiens
tcaggcagctggggtagttggag

SEQ ID NO: 7940798 - DNA, 22 bp, Homo sapiens
tcaggcagctccaggaatggta

SEQ ID NO: 7940799 - DNA, 22 bp, Homo sapiens
tcaggcagcattaaacttcagc

SEQ ID NO: 7940800 - DNA, 22 bp, Homo sapiens
tcaggcagctccaggaatggta

SEQ ID NO: 7940801 - DNA, 22 bp, Homo sapiens
tcaggcagctccaggaatggta

SEQ ID NO: 7940802 - DNA, 22 bp, Homo sapiens
tcaggcagctccaggaatggta

SEQ ID NO: 7940803 - DNA, 22 bp, Homo sapiens
tcaggcagctccaggaatggta

SEQ ID NO: 7940804 - DNA, 22 bp, Homo sapiens
tcaggcagctccaggaatggta

SEQ ID NO: 7940805 - DNA, 22 bp, Homo sapiens
tcaggcagctccaggaatggta

SEQ ID NO: 7940806 - DNA, 22 bp, Homo sapiens
tcaggcagctccaggaatggta

SEQ ID NO: 7940807 - DNA, 22 bp, Homo sapiens
tcaggcagatgcagggatggat

SEQ ID NO: 7940808 - DNA, 22 bp, Homo sapiens
tcaggcagagttaatttgctcc

SEQ ID NO: 7940809 - DNA, 22 bp, Homo sapiens
tcaggcagagttaatttgctcc

SEQ ID NO: 7940810 - DNA, 22 bp, Homo sapiens
tcaggcagagttaatttgctcc

SEQ ID NO: 7940811 - DNA, 22 bp, Homo sapiens
tcaggcagagttaatttgctcc

SEQ ID NO: 7940812 - DNA, 22 bp, Homo sapiens
tcaggcagagttaatttgctcc

SEQ ID NO: 7940813 - DNA, 22 bp, Homo sapiens
tcaggcactggctgagtgatgg

SEQ ID NO: 7940814 - DNA, 22 bp, Homo sapiens
tcaggcagaaaaatcactaatt

SEQ ID NO: 7940815 - DNA, 22 bp, Homo sapiens
tcaggcagagttaatttgctcc

SEQ ID NO: 7940816 - DNA, 22 bp, Homo sapiens
tcaggcagaaaaatcactaatt

SEQ ID NO: 7940817 - DNA, 22 bp, Homo sapiens
tcaggcaccctctattttcatc

SEQ ID NO: 7940818 - DNA, 22 bp, Homo sapiens
tcaggcactgctttctgatatg

SEQ ID NO: 7940819 - DNA, 22 bp, Homo sapiens
tcaggcagatgcagggatggat

SEQ ID NO: 7940820 - DNA, 22 bp, Homo sapiens
tcaggcagcattaaacttcagc

SEQ ID NO: 7940821 - DNA, 22 bp, Homo sapiens
tcaggcagcattaaacttcagc

SEQ ID NO: 7940822 - DNA, 22 bp, Homo sapiens
tcaggcagcattaaacttcagc

SEQ ID NO: 7940823 - DNA, 22 bp, Homo sapiens
tcaggcagcattaaacttcagc

SEQ ID NO: 7940824 - DNA, 22 bp, Homo sapiens
tcaggcagatgcagggatggat

SEQ ID NO: 7940825 - DNA, 22 bp, Homo sapiens
tcaggcagatgcagggatggat

SEQ ID NO: 7940826 - DNA, 22 bp, Homo sapiens
tcaggcagatgcagggatggat

SEQ ID NO: 7940827 - DNA, 22 bp, Homo sapiens
tcaggcagatgcagggatggat

SEQ ID NO: 7940828 - DNA, 22 bp, Homo sapiens
tcaggcagatgcagggatggat

SEQ ID NO: 7940829 - DNA, 22 bp, Homo sapiens
tcaggcagatgcagggatggat

SEQ ID NO: 7940830 - DNA, 22 bp, Homo sapiens
tcaggcagatgcagggatggat

SEQ ID NO: 7940831 - DNA, 22 bp, Homo sapiens
tcaggcaggatcccagggaagg

SEQ ID NO: 7940832 - DNA, 22 bp, Homo sapiens
tcaggcaggatcccagggaagg

SEQ ID NO: 7940833 - DNA, 22 bp, Homo sapiens
tcaggcaggatcccagggaagg

SEQ ID NO: 7940834 - DNA, 22 bp, Homo sapiens
tcaggcaggatcccagggaagg

SEQ ID NO: 7940835 - DNA, 22 bp, Homo sapiens
tcaggcaggatcccagggaagg

SEQ ID NO: 7940836 - DNA, 22 bp, Homo sapiens
tcaggcaggatcccagggaagg

SEQ ID NO: 7940837 - DNA, 23 bp, Homo sapiens
tcaggcagctggggtagttggag

SEQ ID NO: 7940838 - DNA, 22 bp, Homo sapiens
tcaggcaggatcccagggaagg

SEQ ID NO: 7940839 - DNA, 22 bp, Homo sapiens
tcaggcaggacaattatttagg

SEQ ID NO: 7940840 - DNA, 22 bp, Homo sapiens
tcaggcaggacaattatttagg

SEQ ID NO: 7940841 - DNA, 22 bp, Homo sapiens
tcaggcaggacaattatttagg

SEQ ID NO: 7940842 - DNA, 22 bp, Homo sapiens
tcaggcaggacaattatttagg

SEQ ID NO: 7940843 - DNA, 22 bp, Homo sapiens
tcaggcaggacaattatttagg

SEQ ID NO: 7940844 - DNA, 22 bp, Homo sapiens
tcaggcaggaagggaggacttg

SEQ ID NO: 7940845 - DNA, 22 bp, Homo sapiens
tcaggcaggaagggaggacttg

SEQ ID NO: 7940846 - DNA, 22 bp, Homo sapiens
tcaggcaggaagggaggacttg

SEQ ID NO: 7940847 - DNA, 22 bp, Homo sapiens
tcaggcaggaagggaggacttg

SEQ ID NO: 7940848 - DNA, 22 bp, Homo sapiens
tcaggcaggaagggaggacttg

SEQ ID NO: 7940849 - DNA, 22 bp, Homo sapiens
tcaggcaggaagggaggacttg

SEQ ID NO: 7940850 - DNA, 22 bp, Homo sapiens
tcaggcaggaagggaggacttg

SEQ ID NO: 7940851 - DNA, 22 bp, Homo sapiens
tcaggcaggaagggaggacttg

SEQ ID NO: 7940852 - DNA, 22 bp, Homo sapiens
tcaggcaggcagagggcaaatg

SEQ ID NO: 7940853 - DNA, 22 bp, Homo sapiens
tcaggcaggcagagggcaaatg

SEQ ID NO: 7940854 - DNA, 22 bp, Homo sapiens
tcaggcaggcagagggcaaatg

SEQ ID NO: 7940855 - DNA, 21 bp, Homo sapiens
tcaggcaggcgcagagggaag

SEQ ID NO: 7940856 - DNA, 22 bp, Homo sapiens
tcaggcaggcagagggcaaatg

SEQ ID NO: 7940857 - DNA, 22 bp, Homo sapiens
tcaggcaggcagagggcaaatg

SEQ ID NO: 7940858 - DNA, 21 bp, Homo sapiens
tcaggcaggcgcagagggaag

SEQ ID NO: 7940859 - DNA, 21 bp, Homo sapiens
tcaggcaggcgcagagggaag

SEQ ID NO: 7940860 - DNA, 21 bp, Homo sapiens
tcaggcaggcgcagagggaag

SEQ ID NO: 7940861 - DNA, 21 bp, Homo sapiens
tcaggcaggcgcagagggaag

SEQ ID NO: 7940862 - DNA, 21 bp, Homo sapiens
tcaggcaggcgcagagggaag

SEQ ID NO: 7940863 - DNA, 21 bp, Homo sapiens
tcaggcaggcgcagagggaag

SEQ ID NO: 7940864 - DNA, 21 bp, Homo sapiens
tcaggcaggcgcagagggaag

SEQ ID NO: 7940865 - DNA, 21 bp, Homo sapiens
tcaggcaggcgcagagggaag

SEQ ID NO: 7940866 - DNA, 21 bp, Homo sapiens
tcaggcaggcgcagagggaag

SEQ ID NO: 7940867 - DNA, 21 bp, Homo sapiens
tcaggcaggcgcagagggaag

SEQ ID NO: 7940868 - DNA, 22 bp, Homo sapiens
tcaggcaggctcagaggaaaac

SEQ ID NO: 7940869 - DNA, 21 bp, Homo sapiens
tcaggcaggcgcagagggaag

SEQ ID NO: 7940870 - DNA, 22 bp, Homo sapiens
tcaggcaggctcagaggaaaac

SEQ ID NO: 7940871 - DNA, 22 bp, Homo sapiens
tcaggcaggctcagaggaaaac

SEQ ID NO: 7940872 - DNA, 22 bp, Homo sapiens
tcaggcaggctcagaggaaaac

SEQ ID NO: 7940873 - DNA, 22 bp, Homo sapiens
tcaggcaggctcagaggaaaac

SEQ ID NO: 7940874 - DNA, 22 bp, Homo sapiens
tcaggcaggctcagaggaaaac

SEQ ID NO: 7940875 - DNA, 22 bp, Homo sapiens
tcaggcaggctcagaggaaaac

SEQ ID NO: 7940876 - DNA, 22 bp, Homo sapiens
tcaggcaggtggctggctatgg

SEQ ID NO: 7940877 - DNA, 22 bp, Homo sapiens
tcaggcaggtggctggctatgg

SEQ ID NO: 7940878 - DNA, 22 bp, Homo sapiens
tcaggcaggtggctggctatgg

SEQ ID NO: 7940879 - DNA, 21 bp, Homo sapiens
tcaggcaggtcccactgaaca

SEQ ID NO: 7940880 - DNA, 21 bp, Homo sapiens
tcaggcaggtcccactgaaca

SEQ ID NO: 7940881 - DNA, 21 bp, Homo sapiens
tcaggcaggtcccactgaaca

SEQ ID NO: 7940882 - DNA, 21 bp, Homo sapiens
tcaggcaggtcccactgaaca

SEQ ID NO: 7940883 - DNA, 22 bp, Homo sapiens
tcaggcaggttggctgcaggtc

SEQ ID NO: 7940884 - DNA, 22 bp, Homo sapiens
tcaggcaggtggctggctatgg

SEQ ID NO: 7940885 - DNA, 22 bp, Homo sapiens
tcaggcaggtggctggctatgg

SEQ ID NO: 7940886 - DNA, 22 bp, Homo sapiens
tcaggcaggtggctggctatgg

SEQ ID NO: 7940887 - DNA, 22 bp, Homo sapiens
tcaggcaggtggctggctatgg

SEQ ID NO: 7940888 - DNA, 22 bp, Homo sapiens
tcaggcaggtggctggctatgg

SEQ ID NO: 7940889 - DNA, 22 bp, Homo sapiens
tcaggcaggttggctgcaggtc

SEQ ID NO: 7940890 - DNA, 22 bp, Homo sapiens
tcaggcaggttggctgcaggtc

SEQ ID NO: 7940891 - DNA, 22 bp, Homo sapiens
tcaggcaggttggctgcaggtc

SEQ ID NO: 7940892 - DNA, 22 bp, Homo sapiens
tcaggcaggttggctgcaggtc

SEQ ID NO: 7940893 - DNA, 22 bp, Homo sapiens
tcaggcaggttggctgcaggtc

SEQ ID NO: 7940894 - DNA, 22 bp, Homo sapiens
tcaggcaggttggctgcaggtc

SEQ ID NO: 7940895 - DNA, 22 bp, Homo sapiens
tcaggccttgtcctgacctcct

SEQ ID NO: 7940896 - DNA, 22 bp, Homo sapiens
tcaggcagtagaattgcttgaa

SEQ ID NO: 7940897 - DNA, 22 bp, Homo sapiens
tcaggccttgtcctgacctcct

SEQ ID NO: 7940898 - DNA, 22 bp, Homo sapiens
tcaggcagtagaattgcttgaa

SEQ ID NO: 7940899 - DNA, 22 bp, Homo sapiens
tcaggcagtagaattgcttgaa

SEQ ID NO: 7940900 - DNA, 22 bp, Homo sapiens
tcaggcagtagaattgcttgaa

SEQ ID NO: 7940901 - DNA, 22 bp, Homo sapiens
tcaggaaagagtaatgtataca

SEQ ID NO: 7940902 - DNA, 22 bp, Homo sapiens
tcaggaaagagtaatgtataca

SEQ ID NO: 7940903 - DNA, 22 bp, Homo sapiens
tcagctttctctcgccatcagg

SEQ ID NO: 7940904 - DNA, 22 bp, Homo sapiens
tcagctttctctcgccatcagg

SEQ ID NO: 7940905 - DNA, 22 bp, Homo sapiens
tcagctttctctcgccatcagg

SEQ ID NO: 7940906 - DNA, 22 bp, Homo sapiens
tcagctttctcaaagaagctgg

SEQ ID NO: 7940907 - DNA, 22 bp, Homo sapiens
tcaggaaagagtgtatccatca

SEQ ID NO: 7940908 - DNA, 22 bp, Homo sapiens
tcaggaaagagtgtatccatca

SEQ ID NO: 7940909 - DNA, 22 bp, Homo sapiens
tcaggaaagagtgtatccatca

SEQ ID NO: 7940910 - DNA, 22 bp, Homo sapiens
tcaggaaagagttagatgatta

SEQ ID NO: 7940911 - DNA, 22 bp, Homo sapiens
tcaggaaagagtgtatccatca

SEQ ID NO: 7940912 - DNA, 22 bp, Homo sapiens
tcaggaaagagttagatgatta

SEQ ID NO: 7940913 - DNA, 22 bp, Homo sapiens
tcaggaaagagttagatgatta

SEQ ID NO: 7940914 - DNA, 22 bp, Homo sapiens
tcaggaaagagttagatgatta

SEQ ID NO: 7940915 - DNA, 22 bp, Homo sapiens
tcaggaaagagttagatgatta

SEQ ID NO: 7940916 - DNA, 22 bp, Homo sapiens
tcaggaaagtgttctcagagga

SEQ ID NO: 7940917 - DNA, 22 bp, Homo sapiens
tcaggaaaggtttgttgaatgg

SEQ ID NO: 7940918 - DNA, 22 bp, Homo sapiens
tcaggaaaggtttgttgaatgg

SEQ ID NO: 7940919 - DNA, 22 bp, Homo sapiens
tcaggaaaggtttgttgaatgg

SEQ ID NO: 7940920 - DNA, 22 bp, Homo sapiens
tcaggaaagtgttctcagagga

SEQ ID NO: 7940921 - DNA, 22 bp, Homo sapiens
tcaggaaatacaagtgacatca

SEQ ID NO: 7940922 - DNA, 22 bp, Homo sapiens
tcaggaaatggaattcttgtgt

SEQ ID NO: 7940923 - DNA, 22 bp, Homo sapiens
tcaggaaatggaattcttgtgt

SEQ ID NO: 7940924 - DNA, 22 bp, Homo sapiens
tcaggaaatggaattcttgtgt

SEQ ID NO: 7940925 - DNA, 22 bp, Homo sapiens
tcaggaaaggcagagtgtctgt

SEQ ID NO: 7940926 - DNA, 22 bp, Homo sapiens
tcaggaaaggtttgttgaatgg

SEQ ID NO: 7940927 - DNA, 22 bp, Homo sapiens
tcaggaaaggcagagtgtctgt

SEQ ID NO: 7940928 - DNA, 22 bp, Homo sapiens
tcaggaaaggcagagtgtctgt

SEQ ID NO: 7940929 - DNA, 22 bp, Homo sapiens
tcaggaaagcctagaagagaac

SEQ ID NO: 7940930 - DNA, 22 bp, Homo sapiens
tcaggaaagcctagaagagaac

SEQ ID NO: 7940931 - DNA, 22 bp, Homo sapiens
tcaggagcagccttggagagcg

SEQ ID NO: 7940932 - DNA, 22 bp, Homo sapiens
tcaggagcagcatgggtgagag

SEQ ID NO: 7940933 - DNA, 22 bp, Homo sapiens
tcaggagcagccttggagagcg

SEQ ID NO: 7940934 - DNA, 22 bp, Homo sapiens
tcaggagcagcatgggtgagag

SEQ ID NO: 7940935 - DNA, 22 bp, Homo sapiens
tcaggagcaacatctttgaatc

SEQ ID NO: 7940936 - DNA, 22 bp, Homo sapiens
tcaggagatgtaaccttagctg

SEQ ID NO: 7940937 - DNA, 22 bp, Homo sapiens
tcaggagatgtaaccttagctg

SEQ ID NO: 7940938 - DNA, 22 bp, Homo sapiens
tcaggagatgtaaccttagctg

SEQ ID NO: 7940939 - DNA, 22 bp, Homo sapiens
tcaggagatggtctttataggc

SEQ ID NO: 7940940 - DNA, 22 bp, Homo sapiens
tcaggagatggtctttataggc

SEQ ID NO: 7940941 - DNA, 22 bp, Homo sapiens
tcaggagatgtaaccttagctg

SEQ ID NO: 7940942 - DNA, 22 bp, Homo sapiens
tcaggagatggtctttataggc

SEQ ID NO: 7940943 - DNA, 22 bp, Homo sapiens
tcaggaaatggcttcatggttt

SEQ ID NO: 7940944 - DNA, 22 bp, Homo sapiens
tcaggaaatggacatctttgct

SEQ ID NO: 7940945 - DNA, 22 bp, Homo sapiens
tcaggaaatggcttcatggttt

SEQ ID NO: 7940946 - DNA, 22 bp, Homo sapiens
tcaggaaatggtgatttggttg

SEQ ID NO: 7940947 - DNA, 22 bp, Homo sapiens
tcaggaaatggtgatttggttg

SEQ ID NO: 7940948 - DNA, 22 bp, Homo sapiens
tcaggaaatggacatctttgct

SEQ ID NO: 7940949 - DNA, 22 bp, Homo sapiens
tcaggaaatggacatctttgct

SEQ ID NO: 7940950 - DNA, 22 bp, Homo sapiens
tcaggaaatggacatctttgct

SEQ ID NO: 7940951 - DNA, 22 bp, Homo sapiens
tcaggaaatggacatctttgct

SEQ ID NO: 7940952 - DNA, 22 bp, Homo sapiens
tcaggagagtgttcagtggagg

SEQ ID NO: 7940953 - DNA, 22 bp, Homo sapiens
tcaggagagtgttcagtggagg

SEQ ID NO: 7940954 - DNA, 22 bp, Homo sapiens
tcaggagagtgttcagtggagg

SEQ ID NO: 7940955 - DNA, 22 bp, Homo sapiens
tcaggaaatggtgatttggttg

SEQ ID NO: 7940956 - DNA, 22 bp, Homo sapiens
tcaggaaattaaacacttgaaa

SEQ ID NO: 7940957 - DNA, 22 bp, Homo sapiens
tcaggaaatgtcccaggttgtg

SEQ ID NO: 7940958 - DNA, 22 bp, Homo sapiens
tcaggagctcttccctggtgtg

SEQ ID NO: 7940959 - DNA, 22 bp, Homo sapiens
tcaggagctcttccctggtgtg

SEQ ID NO: 7940960 - DNA, 22 bp, Homo sapiens
tcaggagctcaggctgatggaa

SEQ ID NO: 7940961 - DNA, 22 bp, Homo sapiens
tcaggagctcaggctgatggaa

SEQ ID NO: 7940962 - DNA, 22 bp, Homo sapiens
tcaggagctcaggctgatggaa

SEQ ID NO: 7940963 - DNA, 22 bp, Homo sapiens
tcaggagctatggactgtcaaa

SEQ ID NO: 7940964 - DNA, 22 bp, Homo sapiens
tcaggagctcttccctggtgtg

SEQ ID NO: 7940965 - DNA, 22 bp, Homo sapiens
tcaggagctgcactgggcccac

SEQ ID NO: 7940966 - DNA, 22 bp, Homo sapiens
tcaggagcttagatgctttgac

SEQ ID NO: 7940967 - DNA, 22 bp, Homo sapiens
tcaggagctgtgaatacaaagg

SEQ ID NO: 7940968 - DNA, 22 bp, Homo sapiens
tcaggagctgtgaatacaaagg

SEQ ID NO: 7940969 - DNA, 22 bp, Homo sapiens
tcaggagcctgaaagaggtcta

SEQ ID NO: 7940970 - DNA, 22 bp, Homo sapiens
tcaggagctatggactgtcaaa

SEQ ID NO: 7940971 - DNA, 22 bp, Homo sapiens
tcaggagcctgaaagaggtcta

SEQ ID NO: 7940972 - DNA, 22 bp, Homo sapiens
tcaggagcctgaaagaggtcta

SEQ ID NO: 7940973 - DNA, 20 bp, Homo sapiens
tcaggagcctaggacatgat

SEQ ID NO: 7940974 - DNA, 20 bp, Homo sapiens
tcaggagcctaggacatgat

SEQ ID NO: 7940975 - DNA, 20 bp, Homo sapiens
tcaggagcctaggacatgat

SEQ ID NO: 7940976 - DNA, 22 bp, Homo sapiens
tcaggagcagggtctgttacca

SEQ ID NO: 7940977 - DNA, 22 bp, Homo sapiens
tcaggagcaggttgtttggttt

SEQ ID NO: 7940978 - DNA, 22 bp, Homo sapiens
tcaggagcagggtctgttacca

SEQ ID NO: 7940979 - DNA, 22 bp, Homo sapiens
tcaggagcagggggaagctctg

SEQ ID NO: 7940980 - DNA, 22 bp, Homo sapiens
tcaggagcagggggaagctctg

SEQ ID NO: 7940981 - DNA, 22 bp, Homo sapiens
tcaggagcagctgtaggaaggg

SEQ ID NO: 7940982 - DNA, 22 bp, Homo sapiens
tcaggagggtgacaggccctgg

SEQ ID NO: 7940983 - DNA, 22 bp, Homo sapiens
tcaggagggtgacaggccctgg

SEQ ID NO: 7940984 - DNA, 22 bp, Homo sapiens
tcaggagggtctctattttcct

SEQ ID NO: 7940985 - DNA, 22 bp, Homo sapiens
tcaggagggtgacaggccctgg

SEQ ID NO: 7940986 - DNA, 22 bp, Homo sapiens
tcaggagggctaagactgtagc

SEQ ID NO: 7940987 - DNA, 22 bp, Homo sapiens
tcaggagggtctctattttcct

SEQ ID NO: 7940988 - DNA, 22 bp, Homo sapiens
tcaggagggtctctattttcct

SEQ ID NO: 7940989 - DNA, 22 bp, Homo sapiens
tcaggagggctaagactgtagc

SEQ ID NO: 7940990 - DNA, 22 bp, Homo sapiens
tcaggagggctaagactgtagc

SEQ ID NO: 7940991 - DNA, 22 bp, Homo sapiens
tcaggagggattgttgcctatt

SEQ ID NO: 7940992 - DNA, 22 bp, Homo sapiens
tcaggagggattgttgcctatt

SEQ ID NO: 7940993 - DNA, 22 bp, Homo sapiens
tcaggagggagtgtggatagag

SEQ ID NO: 7940994 - DNA, 22 bp, Homo sapiens
tcaggagggagtgtggatagag

SEQ ID NO: 7940995 - DNA, 22 bp, Homo sapiens
tcaggagggattgttgcctatt

SEQ ID NO: 7940996 - DNA, 22 bp, Homo sapiens
tcaggagggattgttgcctatt

SEQ ID NO: 7940997 - DNA, 22 bp, Homo sapiens
tcaggagggattgttgcctatt

SEQ ID NO: 7940998 - DNA, 22 bp, Homo sapiens
tcaggaggatgtcggcaaattt

SEQ ID NO: 7940999 - DNA, 22 bp, Homo sapiens
tcaggaggatgtcggcaaattt

SEQ ID NO: 7941000 - DNA, 22 bp, Homo sapiens
tcaggaggatgtcggcaaattt

SEQ ID NO: 7941001 - DNA, 22 bp, Homo sapiens
tcaggaggatgtcggcaaattt

SEQ ID NO: 7941002 - DNA, 22 bp, Homo sapiens
tcaggagggagtgtggatagag

SEQ ID NO: 7941003 - DNA, 22 bp, Homo sapiens
tcaggaggcaagtaggtattga

SEQ ID NO: 7941004 - DNA, 22 bp, Homo sapiens
tcaggaggcaagtaggtattga

SEQ ID NO: 7941005 - DNA, 22 bp, Homo sapiens
tcaggaggcaagtaggtattga

SEQ ID NO: 7941006 - DNA, 22 bp, Homo sapiens
tcaggaggacagataaggatag

SEQ ID NO: 7941007 - DNA, 22 bp, Homo sapiens
tcaggaggacagataaggatag

SEQ ID NO: 7941008 - DNA, 22 bp, Homo sapiens
tcaggaggacagataaggatag

SEQ ID NO: 7941009 - DNA, 22 bp, Homo sapiens
tcaggagcttggtagtgtgatt

SEQ ID NO: 7941010 - DNA, 22 bp, Homo sapiens
tcaggagcttggtagtgtgatt

SEQ ID NO: 7941011 - DNA, 22 bp, Homo sapiens
tcaggagcttggtagtgtgatt

SEQ ID NO: 7941012 - DNA, 22 bp, Homo sapiens
tcaggaggagctcataagtttg

SEQ ID NO: 7941013 - DNA, 22 bp, Homo sapiens
tcaggaggagctcataagtttg

SEQ ID NO: 7941014 - DNA, 22 bp, Homo sapiens
tcaggaggagctcataagtttg

SEQ ID NO: 7941015 - DNA, 22 bp, Homo sapiens
tcaggaggacagataaggatag

SEQ ID NO: 7941016 - DNA, 22 bp, Homo sapiens
tcagaggtgagcttcttgctaa

SEQ ID NO: 7941017 - DNA, 22 bp, Homo sapiens
tcagaggtggcccctgccctca

SEQ ID NO: 7941018 - DNA, 22 bp, Homo sapiens
tcagaggtgcaagaagttctga

SEQ ID NO: 7941019 - DNA, 22 bp, Homo sapiens
tcagaggtggcaggggtgtcca

SEQ ID NO: 7941020 - DNA, 22 bp, Homo sapiens
tcagaggtggcaggggtgtcca

SEQ ID NO: 7941021 - DNA, 22 bp, Homo sapiens
tcagaggtaaaaactcactgta

SEQ ID NO: 7941022 - DNA, 22 bp, Homo sapiens
tcagagggtggctgggagcatc

SEQ ID NO: 7941023 - DNA, 22 bp, Homo sapiens
tcagaggtagtagcagagttga

SEQ ID NO: 7941024 - DNA, 22 bp, Homo sapiens
tcagaggtcacacagcaagttt

SEQ ID NO: 7941025 - DNA, 22 bp, Homo sapiens
tcagaggtcacacagcaagttt

SEQ ID NO: 7941026 - DNA, 22 bp, Homo sapiens
tcagaggtccctagcaggagtg

SEQ ID NO: 7941027 - DNA, 22 bp, Homo sapiens
tcagaggtcagcagcttgccca

SEQ ID NO: 7941028 - DNA, 22 bp, Homo sapiens
tcagaggcttgaagcccaagcc

SEQ ID NO: 7941029 - DNA, 22 bp, Homo sapiens
tcagaggcttgaagcccaagcc

SEQ ID NO: 7941030 - DNA, 22 bp, Homo sapiens
tcagaggcttgaagcccaagcc

SEQ ID NO: 7941031 - DNA, 22 bp, Homo sapiens
tcagaggcttctggccagtctg

SEQ ID NO: 7941032 - DNA, 22 bp, Homo sapiens
tcagaggcttctggccagtctg

SEQ ID NO: 7941033 - DNA, 22 bp, Homo sapiens
tcagaggcttgaagcccaagcc

SEQ ID NO: 7941034 - DNA, 22 bp, Homo sapiens
tcagaggcttgaagcccaagcc

SEQ ID NO: 7941035 - DNA, 22 bp, Homo sapiens
tcagaggctttcaatgtgtttt

SEQ ID NO: 7941036 - DNA, 17 bp, Homo sapiens
tcagagggatgagcagg

SEQ ID NO: 7941037 - DNA, 21 bp, Homo sapiens
tcagagggccctggaggctca

SEQ ID NO: 7941038 - DNA, 22 bp, Homo sapiens
tcagagggcttatgatatattg

SEQ ID NO: 7941039 - DNA, 22 bp, Homo sapiens
tcagaggcttctggccagtctg

SEQ ID NO: 7941040 - DNA, 22 bp, Homo sapiens
tcagaggcttctggccagtctg

SEQ ID NO: 7941041 - DNA, 22 bp, Homo sapiens
tcagaggcttctgctcacctca

SEQ ID NO: 7941042 - DNA, 22 bp, Homo sapiens
tcagaggcttccttcctcggag

SEQ ID NO: 7941043 - DNA, 22 bp, Homo sapiens
tcagaggcttccttcctcggag

SEQ ID NO: 7941044 - DNA, 22 bp, Homo sapiens
tcagaggcttctgctcacctca

SEQ ID NO: 7941045 - DNA, 20 bp, Homo sapiens
tcagaggctgccagctgggg

SEQ ID NO: 7941046 - DNA, 22 bp, Homo sapiens
tcagaggctggaagagcctcct

SEQ ID NO: 7941047 - DNA, 22 bp, Homo sapiens
tcagaggctggaagagcctcct

SEQ ID NO: 7941048 - DNA, 22 bp, Homo sapiens
tcagaggctggaagagcctcct

SEQ ID NO: 7941049 - DNA, 21 bp, Homo sapiens
tcagaggctgggggaatgccc

SEQ ID NO: 7941050 - DNA, 21 bp, Homo sapiens
tcagaggctgggggaatgccc

SEQ ID NO: 7941051 - DNA, 22 bp, Homo sapiens
tcagagtcttaactattcagag

SEQ ID NO: 7941052 - DNA, 22 bp, Homo sapiens
tcagagtctcccccagtttggg

SEQ ID NO: 7941053 - DNA, 22 bp, Homo sapiens
tcagagtcttggcaataggtta

SEQ ID NO: 7941054 - DNA, 22 bp, Homo sapiens
tcagagtcttaactattcagag

SEQ ID NO: 7941055 - DNA, 22 bp, Homo sapiens
tcagagtgaccttacatggtct

SEQ ID NO: 7941056 - DNA, 22 bp, Homo sapiens
tcagagtgaggcccagcaatct

SEQ ID NO: 7941057 - DNA, 22 bp, Homo sapiens
tcagagtcctcaccctgaggat

SEQ ID NO: 7941058 - DNA, 22 bp, Homo sapiens
tcagagtccatggtacttaatt

SEQ ID NO: 7941059 - DNA, 22 bp, Homo sapiens
tcagagtcattgcaagtagaag

SEQ ID NO: 7941060 - DNA, 22 bp, Homo sapiens
tcagagtccatggtacttaatt

SEQ ID NO: 7941061 - DNA, 21 bp, Homo sapiens
tcagagtctcaggagcaaggg

SEQ ID NO: 7941062 - DNA, 22 bp, Homo sapiens
tcagagtctatgcaacagaatt

SEQ ID NO: 7941063 - DNA, 22 bp, Homo sapiens
tcagagtctaaatagaagaata

SEQ ID NO: 7941064 - DNA, 22 bp, Homo sapiens
tcagagtcattgcaagtagaag

SEQ ID NO: 7941065 - DNA, 23 bp, Homo sapiens
tcagagtagcaatttttctctcc

SEQ ID NO: 7941066 - DNA, 22 bp, Homo sapiens
tcagagtaactacagtatagac

SEQ ID NO: 7941067 - DNA, 22 bp, Homo sapiens
tcagagtcaactgttgcctgtt

SEQ ID NO: 7941068 - DNA, 22 bp, Homo sapiens
tcagagtatttcattcttaggt

SEQ ID NO: 7941069 - DNA, 22 bp, Homo sapiens
tcagaggttcttctcagtggcc

SEQ ID NO: 7941070 - DNA, 22 bp, Homo sapiens
tcagaggttcttctcagtggcc

SEQ ID NO: 7941071 - DNA, 22 bp, Homo sapiens
tcagccagggctctggcctcag

SEQ ID NO: 7941072 - DNA, 22 bp, Homo sapiens
tcagccagggcagagcaggtga

SEQ ID NO: 7941073 - DNA, 22 bp, Homo sapiens
tcagccagggcagagcaggtga

SEQ ID NO: 7941074 - DNA, 22 bp, Homo sapiens
tcagccagggcagagcaggtga

SEQ ID NO: 7941075 - DNA, 22 bp, Homo sapiens
tcagagtgcagggagtagcagc

SEQ ID NO: 7941076 - DNA, 22 bp, Homo sapiens
tcagccaggccaggcattcaca

SEQ ID NO: 7941077 - DNA, 22 bp, Homo sapiens
tcagccaggccctaagagattg

SEQ ID NO: 7941078 - DNA, 22 bp, Homo sapiens
tcagccagggggagagaatgga

SEQ ID NO: 7941079 - DNA, 22 bp, Homo sapiens
tcagccaggtaatgtggagatg

SEQ ID NO: 7941080 - DNA, 22 bp, Homo sapiens
tcagccagggggagagaatgga

SEQ ID NO: 7941081 - DNA, 22 bp, Homo sapiens
tcagccagggctctggcctcag

SEQ ID NO: 7941082 - DNA, 22 bp, Homo sapiens
tcagccagggctctggcctcag

SEQ ID NO: 7941083 - DNA, 22 bp, Homo sapiens
tcagccagtatttgagtgctca

SEQ ID NO: 7941084 - DNA, 22 bp, Homo sapiens
tcagccagtatttgagtgctca

SEQ ID NO: 7941085 - DNA, 22 bp, Homo sapiens
tcagccagtgccttgatcttgc

SEQ ID NO: 7941086 - DNA, 22 bp, Homo sapiens
tcagccagtgccttgatcttgc

SEQ ID NO: 7941087 - DNA, 22 bp, Homo sapiens
tcagccagtgccttgatcttgc

SEQ ID NO: 7941088 - DNA, 20 bp, Homo sapiens
tcagccattccttacctttc

SEQ ID NO: 7941089 - DNA, 20 bp, Homo sapiens
tcagccattccttacctttc

SEQ ID NO: 7941090 - DNA, 20 bp, Homo sapiens
tcagccattccttacctttc

SEQ ID NO: 7941091 - DNA, 20 bp, Homo sapiens
tcagccattccttacctttc

SEQ ID NO: 7941092 - DNA, 22 bp, Homo sapiens
tcagccatgtcaggggaatgac

SEQ ID NO: 7941093 - DNA, 22 bp, Homo sapiens
tcagccatgtcaggggaatgac

SEQ ID NO: 7941094 - DNA, 22 bp, Homo sapiens
tcagccatggtgagagtgagag

SEQ ID NO: 7941095 - DNA, 23 bp, Homo sapiens
tcagccatgcagccgggaagtgg

SEQ ID NO: 7941096 - DNA, 23 bp, Homo sapiens
tcagccatgcagccgggaagtgg

SEQ ID NO: 7941097 - DNA, 20 bp, Homo sapiens
tcagccattccttacctttc

SEQ ID NO: 7941098 - DNA, 20 bp, Homo sapiens
tcagccattccttacctttc

SEQ ID NO: 7941099 - DNA, 22 bp, Homo sapiens
tcagcccaaccctgcacaagga

SEQ ID NO: 7941100 - DNA, 20 bp, Homo sapiens
tcagccattccttacctttc

SEQ ID NO: 7941101 - DNA, 20 bp, Homo sapiens
tcagccattccttacctttc

SEQ ID NO: 7941102 - DNA, 22 bp, Homo sapiens
tcagcccaaccctgcacaagga

SEQ ID NO: 7941103 - DNA, 22 bp, Homo sapiens
tcagcccaaccctgcacaagga

SEQ ID NO: 7941104 - DNA, 22 bp, Homo sapiens
tcagcccagaccacctcattgc

SEQ ID NO: 7941105 - DNA, 22 bp, Homo sapiens
tcagccagttaagtcaagaaat

SEQ ID NO: 7941106 - DNA, 22 bp, Homo sapiens
tcagccagttaaggcttagaca

SEQ ID NO: 7941107 - DNA, 22 bp, Homo sapiens
tcagccagttaaggcttagaca

SEQ ID NO: 7941108 - DNA, 22 bp, Homo sapiens
tcagccagttaaggcttagaca

SEQ ID NO: 7941109 - DNA, 22 bp, Homo sapiens
tcagccagtgtgcacctggagt

SEQ ID NO: 7941110 - DNA, 22 bp, Homo sapiens
tcagccagtttgattctatttg

SEQ ID NO: 7941111 - DNA, 22 bp, Homo sapiens
tcagccagttgccccagttagt

SEQ ID NO: 7941112 - DNA, 22 bp, Homo sapiens
tcagccagtttgtttattccgg

SEQ ID NO: 7941113 - DNA, 22 bp, Homo sapiens
tcagccagtttgtttattccgg

SEQ ID NO: 7941114 - DNA, 22 bp, Homo sapiens
tcagccagtttgattctatttg

SEQ ID NO: 7941115 - DNA, 22 bp, Homo sapiens
tcagcctccgaaagtgctggga

SEQ ID NO: 7941116 - DNA, 22 bp, Homo sapiens
tcagcctcattttctgctctgt

SEQ ID NO: 7941117 - DNA, 22 bp, Homo sapiens
tcagcctcattttctgctctgt

SEQ ID NO: 7941118 - DNA, 22 bp, Homo sapiens
tcagcctccgaaagtgctggga

SEQ ID NO: 7941119 - DNA, 22 bp, Homo sapiens
tcagcctcctaatttcctgtga

SEQ ID NO: 7941120 - DNA, 22 bp, Homo sapiens
tcagcctcctaatttcctgtga

SEQ ID NO: 7941121 - DNA, 22 bp, Homo sapiens
tcagcctcctaatttcctgtga

SEQ ID NO: 7941122 - DNA, 23 bp, Homo sapiens
tcagcctcttaggacttctcacc

SEQ ID NO: 7941123 - DNA, 22 bp, Homo sapiens
tcagcctctctgagtccagacc

SEQ ID NO: 7941124 - DNA, 22 bp, Homo sapiens
tcagcctcattttctgctctgt

SEQ ID NO: 7941125 - DNA, 22 bp, Homo sapiens
tcagcctcattttctgctctgt

SEQ ID NO: 7941126 - DNA, 22 bp, Homo sapiens
tcagcctcattttctgctctgt

SEQ ID NO: 7941127 - DNA, 22 bp, Homo sapiens
tcagcccttgatgtttgggggt

SEQ ID NO: 7941128 - DNA, 22 bp, Homo sapiens
tcagcctcaggtgttcagattt

SEQ ID NO: 7941129 - DNA, 22 bp, Homo sapiens
tcagcccttgatgtttgggggt

SEQ ID NO: 7941130 - DNA, 22 bp, Homo sapiens
tcagcccagcccagcaagtgca

SEQ ID NO: 7941131 - DNA, 22 bp, Homo sapiens
tcagcccagcccagcaagtgca

SEQ ID NO: 7941132 - DNA, 22 bp, Homo sapiens
tcagcccttcctggagctttta

SEQ ID NO: 7941133 - DNA, 22 bp, Homo sapiens
tcagcccaggaatgagccttct

SEQ ID NO: 7941134 - DNA, 18 bp, Homo sapiens
tcagcccagagcccagtt

SEQ ID NO: 7941135 - DNA, 18 bp, Homo sapiens
tcagcccagagcccagtt

SEQ ID NO: 7941136 - DNA, 22 bp, Homo sapiens
tcagcccagcccagcaagtgca

SEQ ID NO: 7941137 - DNA, 22 bp, Homo sapiens
tcagctttccttgctttagatt

SEQ ID NO: 7941138 - DNA, 22 bp, Homo sapiens
tcagctttcctgcagctaaggg

SEQ ID NO: 7941139 - DNA, 22 bp, Homo sapiens
tcagctttctatgttgctaaac

SEQ ID NO: 7941140 - DNA, 22 bp, Homo sapiens
tcagctttctcaaagaagctgg

SEQ ID NO: 7941141 - DNA, 22 bp, Homo sapiens
tcagctttctcaaagaagctgg

SEQ ID NO: 7941142 - DNA, 22 bp, Homo sapiens
tcagctttctatgttgctaaac

SEQ ID NO: 7941143 - DNA, 22 bp, Homo sapiens
tcagcttgtttatgataagcag

SEQ ID NO: 7941144 - DNA, 22 bp, Homo sapiens
tcagcttgtttatgataagcag

SEQ ID NO: 7941145 - DNA, 22 bp, Homo sapiens
tcagcttgggggtggcttctca

SEQ ID NO: 7941146 - DNA, 22 bp, Homo sapiens
tcagcttgggggtggcttctca

SEQ ID NO: 7941147 - DNA, 20 bp, Homo sapiens
tcagcttgggtgaagttcat

SEQ ID NO: 7941148 - DNA, 22 bp, Homo sapiens
tcagcttggacagcttggttga

SEQ ID NO: 7941149 - DNA, 22 bp, Homo sapiens
tcagcttgggaaattgagcaag

SEQ ID NO: 7941150 - DNA, 22 bp, Homo sapiens
tcagcttctcaaaatggcttag

SEQ ID NO: 7941151 - DNA, 22 bp, Homo sapiens
tcagcttcctctgtggttccag

SEQ ID NO: 7941152 - DNA, 22 bp, Homo sapiens
tcagcttccctatctgaccata

SEQ ID NO: 7941153 - DNA, 22 bp, Homo sapiens
tcagcttccctatctgaccata

SEQ ID NO: 7941154 - DNA, 22 bp, Homo sapiens
tcagcttctccaagtgacatgg

SEQ ID NO: 7941155 - DNA, 22 bp, Homo sapiens
tcagcttgcgttctgggattta

SEQ ID NO: 7941156 - DNA, 22 bp, Homo sapiens
tcagcttgatccatccaactat

SEQ ID NO: 7941157 - DNA, 22 bp, Homo sapiens
tcagcttgatccatccaactat

SEQ ID NO: 7941158 - DNA, 21 bp, Homo sapiens
tcagcttgaatctagagatag

SEQ ID NO: 7941159 - DNA, 22 bp, Homo sapiens
tcagctgtaggtatggatgtcc

SEQ ID NO: 7941160 - DNA, 22 bp, Homo sapiens
tcagctgtaggtatggatgtcc

SEQ ID NO: 7941161 - DNA, 22 bp, Homo sapiens
tcagctgtaggtatggatgtcc

SEQ ID NO: 7941162 - DNA, 22 bp, Homo sapiens
tcagctgtgatccatctatcta

SEQ ID NO: 7941163 - DNA, 22 bp, Homo sapiens
tcagctgtccgcagcccacttc

SEQ ID NO: 7941164 - DNA, 22 bp, Homo sapiens
tcagctgtgatccatctatcta

SEQ ID NO: 7941165 - DNA, 22 bp, Homo sapiens
tcagctgtatcagaaatacaat

SEQ ID NO: 7941166 - DNA, 22 bp, Homo sapiens
tcagctgtatcagaaatacaat

SEQ ID NO: 7941167 - DNA, 22 bp, Homo sapiens
tcagctgtatcttgctgcactt

SEQ ID NO: 7941168 - DNA, 22 bp, Homo sapiens
tcagcctgcgtcatggtgacac

SEQ ID NO: 7941169 - DNA, 23 bp, Homo sapiens
tcagcctcttaggacttctcacc

SEQ ID NO: 7941170 - DNA, 23 bp, Homo sapiens
tcagcctcttaggacttctcacc

SEQ ID NO: 7941171 - DNA, 23 bp, Homo sapiens
tcagcctcttaggacttctcacc

SEQ ID NO: 7941172 - DNA, 23 bp, Homo sapiens
tcagcctcttaggacttctcacc

SEQ ID NO: 7941173 - DNA, 23 bp, Homo sapiens
tcagcttcattgtcttctatggc

SEQ ID NO: 7941174 - DNA, 18 bp, Homo sapiens
tcagcttccagcatgttt

SEQ ID NO: 7941175 - DNA, 18 bp, Homo sapiens
tcagcttccagcatgttt

SEQ ID NO: 7941176 - DNA, 22 bp, Homo sapiens
tcagcttcaaatttggtgaagt

SEQ ID NO: 7941177 - DNA, 22 bp, Homo sapiens
tcagcttatatttttagtgtaa

SEQ ID NO: 7941178 - DNA, 22 bp, Homo sapiens
tcagctgttttgagtttaattg

SEQ ID NO: 7941179 - DNA, 23 bp, Homo sapiens
tcagctgttcttttccctgggac

SEQ ID NO: 7941180 - DNA, 23 bp, Homo sapiens
tcagctgttcttttccctgggac

SEQ ID NO: 7941181 - DNA, 22 bp, Homo sapiens
tcagctgtgtatcccagggcct

SEQ ID NO: 7941182 - DNA, 22 bp, Homo sapiens
tcagctgtgtatcccagggcct

SEQ ID NO: 7941183 - DNA, 22 bp, Homo sapiens
tcagctgttatcactgtctgtc

SEQ ID NO: 7941184 - DNA, 22 bp, Homo sapiens
tcagctgttatcactgtctgtc

SEQ ID NO: 7941185 - DNA, 22 bp, Homo sapiens
tcagctgtgtatcccagggcct

SEQ ID NO: 7941186 - DNA, 22 bp, Homo sapiens
tcacatcttgtgatgttttcat

SEQ ID NO: 7941187 - DNA, 22 bp, Homo sapiens
tcacatctttaggcttacaggt

SEQ ID NO: 7941188 - DNA, 18 bp, Homo sapiens
tcacatgacagctgttgc

SEQ ID NO: 7941189 - DNA, 22 bp, Homo sapiens
tcacatgagtattattttccaa

SEQ ID NO: 7941190 - DNA, 22 bp, Homo sapiens
tcacatgagtattattttccaa

SEQ ID NO: 7941191 - DNA, 20 bp, Homo sapiens
tcacatgagctggggcaggc

SEQ ID NO: 7941192 - DNA, 22 bp, Homo sapiens
tcacatgactttttggtggcct

SEQ ID NO: 7941193 - DNA, 22 bp, Homo sapiens
tcacatgaggttatgacaaagc

SEQ ID NO: 7941194 - DNA, 20 bp, Homo sapiens
tcacatctggcagctgatga

SEQ ID NO: 7941195 - DNA, 22 bp, Homo sapiens
tcacatctgcctccatagcacc

SEQ ID NO: 7941196 - DNA, 22 bp, Homo sapiens
tcacatctgttgatacagcatc

SEQ ID NO: 7941197 - DNA, 22 bp, Homo sapiens
tcacatctgtgtgattgtcatt

SEQ ID NO: 7941198 - DNA, 22 bp, Homo sapiens
tcacatcttggattacaatttt

SEQ ID NO: 7941199 - DNA, 22 bp, Homo sapiens
tcacatgccttttactctgcac

SEQ ID NO: 7941200 - DNA, 22 bp, Homo sapiens
tcacccaggctggtgcgcagtg

SEQ ID NO: 7941201 - DNA, 22 bp, Homo sapiens
tcacatgccttttactctgcac

SEQ ID NO: 7941202 - DNA, 22 bp, Homo sapiens
tcacccagggactgtgatggaa

SEQ ID NO: 7941203 - DNA, 22 bp, Homo sapiens
tcacccagggactgtgatggaa

SEQ ID NO: 7941204 - DNA, 22 bp, Homo sapiens
tcacccagggactgtgatggaa

SEQ ID NO: 7941205 - DNA, 22 bp, Homo sapiens
tcacccagggtgtttggtgtct

SEQ ID NO: 7941206 - DNA, 22 bp, Homo sapiens
tcacccaggtaatagcagtttg

SEQ ID NO: 7941207 - DNA, 22 bp, Homo sapiens
tcacccaggtccaggctctggc

SEQ ID NO: 7941208 - DNA, 22 bp, Homo sapiens
tcacatgccctacctaatctta

SEQ ID NO: 7941209 - DNA, 22 bp, Homo sapiens
tcacatgccacagatgaggcaa

SEQ ID NO: 7941210 - DNA, 22 bp, Homo sapiens
tcacatgagtcactatcttaat

SEQ ID NO: 7941211 - DNA, 22 bp, Homo sapiens
tcacatgcacatacttcctgtg

SEQ ID NO: 7941212 - DNA, 18 bp, Homo sapiens
tcacatgattaccctggg

SEQ ID NO: 7941213 - DNA, 22 bp, Homo sapiens
tcacatgcagtcactgagcagg

SEQ ID NO: 7941214 - DNA, 22 bp, Homo sapiens
tcacatgcacatacttcctgtg

SEQ ID NO: 7941215 - DNA, 21 bp, Homo sapiens
tcacgtggtcacatgagcttt

SEQ ID NO: 7941216 - DNA, 22 bp, Homo sapiens
tcacggtattcacgaacatgga

SEQ ID NO: 7941217 - DNA, 22 bp, Homo sapiens
tcacgtgagggacctgtgtctg

SEQ ID NO: 7941218 - DNA, 21 bp, Homo sapiens
tcacgtggtcacatgagcttt

SEQ ID NO: 7941219 - DNA, 21 bp, Homo sapiens
tcacgtggtcacatgagcttt

SEQ ID NO: 7941220 - DNA, 22 bp, Homo sapiens
tcacgtgagggacctgtgtctg

SEQ ID NO: 7941221 - DNA, 22 bp, Homo sapiens
tcacgtgagggacctgtgtctg

SEQ ID NO: 7941222 - DNA, 22 bp, Homo sapiens
tcaccttgtgatctccctgcct

SEQ ID NO: 7941223 - DNA, 22 bp, Homo sapiens
tcaccttgtgatctccctgcct

SEQ ID NO: 7941224 - DNA, 22 bp, Homo sapiens
tcaccttgtgatccgcccacct

SEQ ID NO: 7941225 - DNA, 22 bp, Homo sapiens
tcacctgttggatgtatactgt

SEQ ID NO: 7941226 - DNA, 22 bp, Homo sapiens
tcacctgttcaacagcaataat

SEQ ID NO: 7941227 - DNA, 21 bp, Homo sapiens
tcacctggcttctgacctggc

SEQ ID NO: 7941228 - DNA, 22 bp, Homo sapiens
tcacctcaccacccttatggtt

SEQ ID NO: 7941229 - DNA, 22 bp, Homo sapiens
tcacctaattgaagtcaggagt

SEQ ID NO: 7941230 - DNA, 22 bp, Homo sapiens
tcacctcttttttaacaggctt

SEQ ID NO: 7941231 - DNA, 22 bp, Homo sapiens
tcacctctctggccgtctacct

SEQ ID NO: 7941232 - DNA, 22 bp, Homo sapiens
tcacccctccattctctcatgt

SEQ ID NO: 7941233 - DNA, 22 bp, Homo sapiens
tcacccctaccaaggagcactg

SEQ ID NO: 7941234 - DNA, 22 bp, Homo sapiens
tcacccctaccaaggagcactg

SEQ ID NO: 7941235 - DNA, 22 bp, Homo sapiens
tcacccctggcccagtcttgga

SEQ ID NO: 7941236 - DNA, 22 bp, Homo sapiens
tcacccctccattctctcatgt

SEQ ID NO: 7941237 - DNA, 22 bp, Homo sapiens
tcaccccttgtgaatgctgctc

SEQ ID NO: 7941238 - DNA, 22 bp, Homo sapiens
tcaccccttgtgaatgctgctc

SEQ ID NO: 7941239 - DNA, 22 bp, Homo sapiens
tcacccctacatttcccttgct

SEQ ID NO: 7941240 - DNA, 22 bp, Homo sapiens
tcacccctacatttcccttgct

SEQ ID NO: 7941241 - DNA, 22 bp, Homo sapiens
tcaccccctgtattagtagcta

SEQ ID NO: 7941242 - DNA, 22 bp, Homo sapiens
tcacccctacatttcccttgct

SEQ ID NO: 7941243 - DNA, 22 bp, Homo sapiens
tcaccccaaagttgagtttgat

SEQ ID NO: 7941244 - DNA, 22 bp, Homo sapiens
tcacccatgtgtctcccttata

SEQ ID NO: 7941245 - DNA, 22 bp, Homo sapiens
tcacccaggtccaggctctggc

SEQ ID NO: 7941246 - DNA, 22 bp, Homo sapiens
tcaccggcagacgtggcctgat

SEQ ID NO: 7941247 - DNA, 22 bp, Homo sapiens
tcaccgaggctggagtgcagtg

SEQ ID NO: 7941248 - DNA, 22 bp, Homo sapiens
tcaccgaggctggagtgcagtg

SEQ ID NO: 7941249 - DNA, 22 bp, Homo sapiens
tcaccgaggctggagtgcagtg

SEQ ID NO: 7941250 - DNA, 22 bp, Homo sapiens
tcaccctgtttctcttttgtct

SEQ ID NO: 7941251 - DNA, 22 bp, Homo sapiens
tcacccttgataatgttcttct

SEQ ID NO: 7941252 - DNA, 22 bp, Homo sapiens
tcaccctgtgattgcaaagaaa

SEQ ID NO: 7941253 - DNA, 22 bp, Homo sapiens
tcaccctgtgattgcaaagaaa

SEQ ID NO: 7941254 - DNA, 20 bp, Homo sapiens
tcactggccagagtagccct

SEQ ID NO: 7941255 - DNA, 22 bp, Homo sapiens
tcactggcaacttgtgctccct

SEQ ID NO: 7941256 - DNA, 22 bp, Homo sapiens
tcactggattagtttgaactgt

SEQ ID NO: 7941257 - DNA, 22 bp, Homo sapiens
tcactggattagtttgaactgt

SEQ ID NO: 7941258 - DNA, 22 bp, Homo sapiens
tcactggattctcttttgttcc

SEQ ID NO: 7941259 - DNA, 22 bp, Homo sapiens
tcactggattaagcattgacat

SEQ ID NO: 7941260 - DNA, 22 bp, Homo sapiens
tcactggattaagcattgacat

SEQ ID NO: 7941261 - DNA, 22 bp, Homo sapiens
tcactggattaagcattgacat

SEQ ID NO: 7941262 - DNA, 22 bp, Homo sapiens
tcactggatcctagctgagcct

SEQ ID NO: 7941263 - DNA, 22 bp, Homo sapiens
tcactggatcctagctgagcct

SEQ ID NO: 7941264 - DNA, 22 bp, Homo sapiens
tcactggactcactgtggccag

SEQ ID NO: 7941265 - DNA, 22 bp, Homo sapiens
tcactggactcactgtggccag

SEQ ID NO: 7941266 - DNA, 22 bp, Homo sapiens
tcactggagaaaagtaatgtat

SEQ ID NO: 7941267 - DNA, 22 bp, Homo sapiens
tcactggagaaaagtaatgtat

SEQ ID NO: 7941268 - DNA, 20 bp, Homo sapiens
tcactggccagagtagccct

SEQ ID NO: 7941269 - DNA, 18 bp, Homo sapiens
tcactgggagaagatatt

SEQ ID NO: 7941270 - DNA, 18 bp, Homo sapiens
tcactgggagaagatatt

SEQ ID NO: 7941271 - DNA, 22 bp, Homo sapiens
tcactgggagagctgacaagga

SEQ ID NO: 7941272 - DNA, 22 bp, Homo sapiens
tcactgggagagctgacaagga

SEQ ID NO: 7941273 - DNA, 22 bp, Homo sapiens
tcactgggagatgtgggaaggg

SEQ ID NO: 7941274 - DNA, 22 bp, Homo sapiens
tcactgggagatgtgggaaggg

SEQ ID NO: 7941275 - DNA, 22 bp, Homo sapiens
tcactgggagagctgacaagga

SEQ ID NO: 7941276 - DNA, 22 bp, Homo sapiens
tcactgggagagctgacaagga

SEQ ID NO: 7941277 - DNA, 22 bp, Homo sapiens
tcactggggccatgtgagggac

SEQ ID NO: 7941278 - DNA, 22 bp, Homo sapiens
tcactggggccatgtgagggac

SEQ ID NO: 7941279 - DNA, 22 bp, Homo sapiens
tcactggggccatgtgagggac

SEQ ID NO: 7941280 - DNA, 22 bp, Homo sapiens
tcactggggccatgtgagggac

SEQ ID NO: 7941281 - DNA, 22 bp, Homo sapiens
tcactggggccatgtgagggac

SEQ ID NO: 7941282 - DNA, 22 bp, Homo sapiens
tcactggggagcactgacatgt

SEQ ID NO: 7941283 - DNA, 22 bp, Homo sapiens
tcactggggagcactgacatgt

SEQ ID NO: 7941284 - DNA, 17 bp, Homo sapiens
tcactgggcctgctccc

SEQ ID NO: 7941285 - DNA, 22 bp, Homo sapiens
tcactgggagatgtgggaaggg

SEQ ID NO: 7941286 - DNA, 22 bp, Homo sapiens
tcactgggagatgtgggaaggg

SEQ ID NO: 7941287 - DNA, 22 bp, Homo sapiens
tcactgggagatgtgggaaggg

SEQ ID NO: 7941288 - DNA, 22 bp, Homo sapiens
tcactgggcatcggagctgaaa

SEQ ID NO: 7941289 - DNA, 22 bp, Homo sapiens
tcactgggcatcggagctgaaa

SEQ ID NO: 7941290 - DNA, 22 bp, Homo sapiens
tcactgggagatgtgggaaggg

SEQ ID NO: 7941291 - DNA, 22 bp, Homo sapiens
tcactgggccctgaggtgggac

SEQ ID NO: 7941292 - DNA, 17 bp, Homo sapiens
tcactgggcctgctccc

SEQ ID NO: 7941293 - DNA, 17 bp, Homo sapiens
tcactgggcctgctccc

SEQ ID NO: 7941294 - DNA, 22 bp, Homo sapiens
tcactgggccctgaggtgggac

SEQ ID NO: 7941295 - DNA, 22 bp, Homo sapiens
tcactgggccctgaggtgggac

SEQ ID NO: 7941296 - DNA, 22 bp, Homo sapiens
tcactgctttcaaaaattattg

SEQ ID NO: 7941297 - DNA, 22 bp, Homo sapiens
tcactgctttgagccactgagc

SEQ ID NO: 7941298 - DNA, 22 bp, Homo sapiens
tcactgctttgagccactgagc

SEQ ID NO: 7941299 - DNA, 22 bp, Homo sapiens
tcactgctttcaaaaattattg

SEQ ID NO: 7941300 - DNA, 22 bp, Homo sapiens
tcactgcttcttggagaatgtc

SEQ ID NO: 7941301 - DNA, 22 bp, Homo sapiens
tcactgcttcttggagaatgtc

SEQ ID NO: 7941302 - DNA, 22 bp, Homo sapiens
tcactacaacctccgcctcctg

SEQ ID NO: 7941303 - DNA, 22 bp, Homo sapiens
tcactgctttgtttacaactat

SEQ ID NO: 7941304 - DNA, 22 bp, Homo sapiens
tcactggaaagacagcactctt

SEQ ID NO: 7941305 - DNA, 22 bp, Homo sapiens
tcactggaaagacagcactctt

SEQ ID NO: 7941306 - DNA, 22 bp, Homo sapiens
tcactggaaatgcacagctgta

SEQ ID NO: 7941307 - DNA, 22 bp, Homo sapiens
tcactgctttgagccactgagc

SEQ ID NO: 7941308 - DNA, 22 bp, Homo sapiens
tcactgctttgtttacaactat

SEQ ID NO: 7941309 - DNA, 22 bp, Homo sapiens
tcactggaaatgcacagctgta

SEQ ID NO: 7941310 - DNA, 22 bp, Homo sapiens
tcactggaaatgcacagctgta

SEQ ID NO: 7941311 - DNA, 21 bp, Homo sapiens
tcactggacgtgagccagggg

SEQ ID NO: 7941312 - DNA, 21 bp, Homo sapiens
tcactggacgtgagccagggg

SEQ ID NO: 7941313 - DNA, 21 bp, Homo sapiens
tcactggaatacaattgattt

SEQ ID NO: 7941314 - DNA, 21 bp, Homo sapiens
tcactggaatacaattgattt

SEQ ID NO: 7941315 - DNA, 21 bp, Homo sapiens
tcactggaatacaattgattt

SEQ ID NO: 7941316 - DNA, 22 bp, Homo sapiens
tcactacaacctccgcctcctg

SEQ ID NO: 7941317 - DNA, 22 bp, Homo sapiens
tcactaatgattttgaaagaag

SEQ ID NO: 7941318 - DNA, 22 bp, Homo sapiens
tcactacaaccgctacctgaca

SEQ ID NO: 7941319 - DNA, 22 bp, Homo sapiens
tcactaatgattttgaaagaag

SEQ ID NO: 7941320 - DNA, 22 bp, Homo sapiens
tcactaagttacatttagtatt

SEQ ID NO: 7941321 - DNA, 22 bp, Homo sapiens
tcactaatagggggagcatagg

SEQ ID NO: 7941322 - DNA, 22 bp, Homo sapiens
tcactaatgagctaaggaaaag

SEQ ID NO: 7941323 - DNA, 22 bp, Homo sapiens
tcactaatgagctaaggaaaag

SEQ ID NO: 7941324 - DNA, 22 bp, Homo sapiens
tcacgttttactgagtgagata

SEQ ID NO: 7941325 - DNA, 22 bp, Homo sapiens
tcacgttttactgagtgagata

SEQ ID NO: 7941326 - DNA, 22 bp, Homo sapiens
tcacgttttactgagtgagata

SEQ ID NO: 7941327 - DNA, 21 bp, Homo sapiens
tcacgtggtcacatgagcttt

SEQ ID NO: 7941328 - DNA, 23 bp, Homo sapiens
tcactaaagtgtttagtgcagat

SEQ ID NO: 7941329 - DNA, 22 bp, Homo sapiens
tcactaaagttggagaagagct

SEQ ID NO: 7941330 - DNA, 22 bp, Homo sapiens
tcactaaagttggagaagagct

SEQ ID NO: 7941331 - DNA, 22 bp, Homo sapiens
tcactaagtgccgagtttagtt

SEQ ID NO: 7941332 - DNA, 22 bp, Homo sapiens
tcactaaagttggagaagagct

SEQ ID NO: 7941333 - DNA, 22 bp, Homo sapiens
tcactaaagttggagaagagct

SEQ ID NO: 7941334 - DNA, 22 bp, Homo sapiens
tcactgtagcctcaacctttca

SEQ ID NO: 7941335 - DNA, 22 bp, Homo sapiens
tcactgtagagtctgtttccac

SEQ ID NO: 7941336 - DNA, 22 bp, Homo sapiens
tcactgtagagtctgtttccac

SEQ ID NO: 7941337 - DNA, 22 bp, Homo sapiens
tcactgtaccttccatttcatt

SEQ ID NO: 7941338 - DNA, 22 bp, Homo sapiens
tcactgtagcctcaactcttgg

SEQ ID NO: 7941339 - DNA, 22 bp, Homo sapiens
tcactgtagcctcaactcttgg

SEQ ID NO: 7941340 - DNA, 22 bp, Homo sapiens
tcactgtatgtctttttttgat

SEQ ID NO: 7941341 - DNA, 22 bp, Homo sapiens
tcactgtatgtctttttttgat

SEQ ID NO: 7941342 - DNA, 22 bp, Homo sapiens
tcactgtatcatgttgcactta

SEQ ID NO: 7941343 - DNA, 20 bp, Homo sapiens
tcactgtaacatttgggggg

SEQ ID NO: 7941344 - DNA, 22 bp, Homo sapiens
tcactgtaataggtttgaagat

SEQ ID NO: 7941345 - DNA, 22 bp, Homo sapiens
tcactgtaatttgtatctgtgg

SEQ ID NO: 7941346 - DNA, 22 bp, Homo sapiens
tcactgtaatttgtatctgtgg

SEQ ID NO: 7941347 - DNA, 20 bp, Homo sapiens
tcactgtaacatttgggggg

SEQ ID NO: 7941348 - DNA, 20 bp, Homo sapiens
tcactgtaacatttgggggg

SEQ ID NO: 7941349 - DNA, 22 bp, Homo sapiens
tcactgtaaactaggtcagtcc

SEQ ID NO: 7941350 - DNA, 22 bp, Homo sapiens
tcactggttagaagaagtaagc

SEQ ID NO: 7941351 - DNA, 22 bp, Homo sapiens
tcactgggtaggacatgctgat

SEQ ID NO: 7941352 - DNA, 18 bp, Homo sapiens
tcactgggtgtatgtggc

SEQ ID NO: 7941353 - DNA, 22 bp, Homo sapiens
tcactgggtaggacatgctgat

SEQ ID NO: 7941354 - DNA, 22 bp, Homo sapiens
tcactgggtaggacatgctgat

SEQ ID NO: 7941355 - DNA, 22 bp, Homo sapiens
tcactgggtaggacatgctgat

SEQ ID NO: 7941356 - DNA, 18 bp, Homo sapiens
tcactgggtgtatgtggc

SEQ ID NO: 7941357 - DNA, 22 bp, Homo sapiens
tcactgggtaggacatgctgat

SEQ ID NO: 7941358 - DNA, 22 bp, Homo sapiens
tcactggggcccacatcaacat

SEQ ID NO: 7941359 - DNA, 22 bp, Homo sapiens
tcactggggcctttggtcagga

SEQ ID NO: 7941360 - DNA, 22 bp, Homo sapiens
tcactggggcctttggtcagga

SEQ ID NO: 7941361 - DNA, 22 bp, Homo sapiens
tcactggggcctttggtcagga

SEQ ID NO: 7941362 - DNA, 22 bp, Homo sapiens
tcactgggtaggacatgctgat

SEQ ID NO: 7941363 - DNA, 22 bp, Homo sapiens
tcagaacagttcttaatattgc

SEQ ID NO: 7941364 - DNA, 22 bp, Homo sapiens
tcagaacagttcttaatattgc

SEQ ID NO: 7941365 - DNA, 23 bp, Homo sapiens
tcagaacagttcttggtgcatag

SEQ ID NO: 7941366 - DNA, 22 bp, Homo sapiens
tcagaacagtgcctggcactaa

SEQ ID NO: 7941367 - DNA, 20 bp, Homo sapiens
tcagaacagtagaggagcta

SEQ ID NO: 7941368 - DNA, 22 bp, Homo sapiens
tcagaacatcctggtttaaaat

SEQ ID NO: 7941369 - DNA, 22 bp, Homo sapiens
tcagaacatatattttgtgatg

SEQ ID NO: 7941370 - DNA, 23 bp, Homo sapiens
tcagaacagttcttggtgcatag

SEQ ID NO: 7941371 - DNA, 22 bp, Homo sapiens
tcagaacagttcttaatattgc

SEQ ID NO: 7941372 - DNA, 22 bp, Homo sapiens
tcagaacatatattttgtgatg

SEQ ID NO: 7941373 - DNA, 22 bp, Homo sapiens
tcagaacatatattttgtgatg

SEQ ID NO: 7941374 - DNA, 22 bp, Homo sapiens
tcagaacatatattttgtgatg

SEQ ID NO: 7941375 - DNA, 22 bp, Homo sapiens
tcactgtgaatgttatcatctt

SEQ ID NO: 7941376 - DNA, 22 bp, Homo sapiens
tcactgtgaatgttatcatctt

SEQ ID NO: 7941377 - DNA, 22 bp, Homo sapiens
tcactgtgattctgtatggatt

SEQ ID NO: 7941378 - DNA, 22 bp, Homo sapiens
tcactgtcttttaaggtggtta

SEQ ID NO: 7941379 - DNA, 22 bp, Homo sapiens
tcactgtctgaaagaaatggcc

SEQ ID NO: 7941380 - DNA, 22 bp, Homo sapiens
tcactgtgcacatatgataggt

SEQ ID NO: 7941381 - DNA, 21 bp, Homo sapiens
tcactgtgcaaatgttgatgg

SEQ ID NO: 7941382 - DNA, 21 bp, Homo sapiens
tcactgtgcaaatgttgatgg

SEQ ID NO: 7941383 - DNA, 22 bp, Homo sapiens
tcactgtgattctgtatggatt

SEQ ID NO: 7941384 - DNA, 22 bp, Homo sapiens
tcactgtctgaaagaaatggcc

SEQ ID NO: 7941385 - DNA, 22 bp, Homo sapiens
tcactgtccctgtcctcttatc

SEQ ID NO: 7941386 - DNA, 23 bp, Homo sapiens
tcactgtcctgctcctggaacgc

SEQ ID NO: 7941387 - DNA, 22 bp, Homo sapiens
tcactgtcaggctaaggttata

SEQ ID NO: 7941388 - DNA, 22 bp, Homo sapiens
tcactgtatttggaagggatgg

SEQ ID NO: 7941389 - DNA, 20 bp, Homo sapiens
tcagagagagggtgccactt

SEQ ID NO: 7941390 - DNA, 20 bp, Homo sapiens
tcagagagagggtgccactt

SEQ ID NO: 7941391 - DNA, 18 bp, Homo sapiens
tcagagagaatagtaatt

SEQ ID NO: 7941392 - DNA, 22 bp, Homo sapiens
tcagagactgtaggagcagcct

SEQ ID NO: 7941393 - DNA, 22 bp, Homo sapiens
tcagagactggtctgcagatgc

SEQ ID NO: 7941394 - DNA, 22 bp, Homo sapiens
tcagagactgtaggagcagcct

SEQ ID NO: 7941395 - DNA, 22 bp, Homo sapiens
tcagagactgtaggagcagcct

SEQ ID NO: 7941396 - DNA, 22 bp, Homo sapiens
tcagagactgtaggagcagcct

SEQ ID NO: 7941397 - DNA, 22 bp, Homo sapiens
tcagagacctagcaagaaattg

SEQ ID NO: 7941398 - DNA, 22 bp, Homo sapiens
tcagagacctagcaagaaattg

SEQ ID NO: 7941399 - DNA, 22 bp, Homo sapiens
tcagagactggtctgcagatgc

SEQ ID NO: 7941400 - DNA, 22 bp, Homo sapiens
tcagagacagtattggctattg

SEQ ID NO: 7941401 - DNA, 22 bp, Homo sapiens
tcagagacagtattggctattg

SEQ ID NO: 7941402 - DNA, 22 bp, Homo sapiens
tcagagacaccattttctttct

SEQ ID NO: 7941403 - DNA, 22 bp, Homo sapiens
tcagagacaccattttctttct

SEQ ID NO: 7941404 - DNA, 22 bp, Homo sapiens
tcagagacagttctggggcagg

SEQ ID NO: 7941405 - DNA, 22 bp, Homo sapiens
tcagagacagttctggggcagg

SEQ ID NO: 7941406 - DNA, 22 bp, Homo sapiens
tcagagacatcaggttgtagca

SEQ ID NO: 7941407 - DNA, 22 bp, Homo sapiens
tcagagagctggtgggcagagg

SEQ ID NO: 7941408 - DNA, 22 bp, Homo sapiens
tcagagagctggtgggcagagg

SEQ ID NO: 7941409 - DNA, 22 bp, Homo sapiens
tcagagagctggtgggcagagg

SEQ ID NO: 7941410 - DNA, 22 bp, Homo sapiens
tcagagagctggtgggcagagg

SEQ ID NO: 7941411 - DNA, 22 bp, Homo sapiens
tcagagagctggtgggcagagg

SEQ ID NO: 7941412 - DNA, 22 bp, Homo sapiens
tcagagagcctcaggcactgcc

SEQ ID NO: 7941413 - DNA, 22 bp, Homo sapiens
tcagagagcctcaggcactgcc

SEQ ID NO: 7941414 - DNA, 22 bp, Homo sapiens
tcagagagcctcaggcactgcc

SEQ ID NO: 7941415 - DNA, 22 bp, Homo sapiens
tcagagagcctcaggcactgcc

SEQ ID NO: 7941416 - DNA, 18 bp, Homo sapiens
tcagagagaatagtaatt

SEQ ID NO: 7941417 - DNA, 22 bp, Homo sapiens
tcagagagcctcaggcactgcc

SEQ ID NO: 7941418 - DNA, 22 bp, Homo sapiens
tcagagagcctcaggcactgcc

SEQ ID NO: 7941419 - DNA, 22 bp, Homo sapiens
tcagagagcctcaggcactgcc

SEQ ID NO: 7941420 - DNA, 20 bp, Homo sapiens
tcagagagagggtgccactt

SEQ ID NO: 7941421 - DNA, 18 bp, Homo sapiens
tcagagagcagctttatt

SEQ ID NO: 7941422 - DNA, 23 bp, Homo sapiens
tcagagagctgttgagagctgcc

SEQ ID NO: 7941423 - DNA, 23 bp, Homo sapiens
tcagagagctgttgagagctgcc

SEQ ID NO: 7941424 - DNA, 23 bp, Homo sapiens
tcagagagctgttgagagctgcc

SEQ ID NO: 7941425 - DNA, 23 bp, Homo sapiens
tcagagagctgttgagagctgcc

SEQ ID NO: 7941426 - DNA, 22 bp, Homo sapiens
tcagagaggattttaataagtg

SEQ ID NO: 7941427 - DNA, 22 bp, Homo sapiens
tcagagaggattttaataagtg

SEQ ID NO: 7941428 - DNA, 23 bp, Homo sapiens
tcagagagctgttgagagctgcc

SEQ ID NO: 7941429 - DNA, 22 bp, Homo sapiens
tcagaggaataatgctgcattt

SEQ ID NO: 7941430 - DNA, 22 bp, Homo sapiens
tcagaggaataatgctgcattt

SEQ ID NO: 7941431 - DNA, 22 bp, Homo sapiens
tcagaggaataatgctgcattt

SEQ ID NO: 7941432 - DNA, 22 bp, Homo sapiens
tcagaggaatctgtacttgaaa

SEQ ID NO: 7941433 - DNA, 22 bp, Homo sapiens
tcagaggaatttgcttttcatg

SEQ ID NO: 7941434 - DNA, 22 bp, Homo sapiens
tcagaggaatctgtacttgaaa

SEQ ID NO: 7941435 - DNA, 22 bp, Homo sapiens
tcagaggacagcagctaaataa

SEQ ID NO: 7941436 - DNA, 22 bp, Homo sapiens
tcagaggaccttactgagaacc

SEQ ID NO: 7941437 - DNA, 22 bp, Homo sapiens
tcagaggaccttactgagaacc

SEQ ID NO: 7941438 - DNA, 22 bp, Homo sapiens
tcagaggacagcagctaaataa

SEQ ID NO: 7941439 - DNA, 18 bp, Homo sapiens
tcagaggagatacctaaa

SEQ ID NO: 7941440 - DNA, 18 bp, Homo sapiens
tcagaggagatacctaaa

SEQ ID NO: 7941441 - DNA, 18 bp, Homo sapiens
tcagaggagatacctaaa

SEQ ID NO: 7941442 - DNA, 18 bp, Homo sapiens
tcagaggagatacctaaa

SEQ ID NO: 7941443 - DNA, 22 bp, Homo sapiens
tcagaggattgcctcagcgagc

SEQ ID NO: 7941444 - DNA, 19 bp, Homo sapiens
tcagaggatttggctatga

SEQ ID NO: 7941445 - DNA, 19 bp, Homo sapiens
tcagaggatttggctatga

SEQ ID NO: 7941446 - DNA, 19 bp, Homo sapiens
tcagaggatttggctatga

SEQ ID NO: 7941447 - DNA, 19 bp, Homo sapiens
tcagaggatttggctatga

SEQ ID NO: 7941448 - DNA, 22 bp, Homo sapiens
tcagaggacgcactagggttgt

SEQ ID NO: 7941449 - DNA, 22 bp, Homo sapiens
tcagaggacgcactagggttgt

SEQ ID NO: 7941450 - DNA, 22 bp, Homo sapiens
tcagaggactaccttctccagt

SEQ ID NO: 7941451 - DNA, 22 bp, Homo sapiens
tcagaggactaccttctccagt

SEQ ID NO: 7941452 - DNA, 22 bp, Homo sapiens
tcagaggctacagtctgggagt

SEQ ID NO: 7941453 - DNA, 22 bp, Homo sapiens
tcagaggctacagtctgggagt

SEQ ID NO: 7941454 - DNA, 22 bp, Homo sapiens
tcagaggctacagtctgggagt

SEQ ID NO: 7941455 - DNA, 22 bp, Homo sapiens
tcagaggccttggttatggtat

SEQ ID NO: 7941456 - DNA, 22 bp, Homo sapiens
tcagaggcctgaaagaatttgg

SEQ ID NO: 7941457 - DNA, 22 bp, Homo sapiens
tcagaggcctgaaagaatttgg

SEQ ID NO: 7941458 - DNA, 22 bp, Homo sapiens
tcagaggcctatgtctacaact

SEQ ID NO: 7941459 - DNA, 22 bp, Homo sapiens
tcagaggcctgaaagaatttgg

SEQ ID NO: 7941460 - DNA, 22 bp, Homo sapiens
tcagaggctgcatttttatcca

SEQ ID NO: 7941461 - DNA, 20 bp, Homo sapiens
tcagaggctgccagctgggg

SEQ ID NO: 7941462 - DNA, 20 bp, Homo sapiens
tcagaggctgccagctgggg

SEQ ID NO: 7941463 - DNA, 22 bp, Homo sapiens
tcagaggctcatctgccttgca

SEQ ID NO: 7941464 - DNA, 22 bp, Homo sapiens
tcagaggctcatctgccttgca

SEQ ID NO: 7941465 - DNA, 22 bp, Homo sapiens
tcagaggctcactgtctacttt

SEQ ID NO: 7941466 - DNA, 22 bp, Homo sapiens
tcagaggcatcattcatagtta

SEQ ID NO: 7941467 - DNA, 22 bp, Homo sapiens
tcagaggcatcattcatagtta

SEQ ID NO: 7941468 - DNA, 22 bp, Homo sapiens
tcagaggccaaactgagcaggg

SEQ ID NO: 7941469 - DNA, 22 bp, Homo sapiens
tcagaggccaaactgagcaggg

SEQ ID NO: 7941470 - DNA, 22 bp, Homo sapiens
tcagaggccaaactgagcaggg

SEQ ID NO: 7941471 - DNA, 21 bp, Homo sapiens
tcagaggcactgagagcaatg

SEQ ID NO: 7941472 - DNA, 21 bp, Homo sapiens
tcagaggcactgagagcaatg

SEQ ID NO: 7941473 - DNA, 21 bp, Homo sapiens
tcagaggcactgagagcaatg

SEQ ID NO: 7941474 - DNA, 21 bp, Homo sapiens
tcagaggcactgagagcaatg

SEQ ID NO: 7941475 - DNA, 22 bp, Homo sapiens
tcagaggcaaagaactttatta

SEQ ID NO: 7941476 - DNA, 21 bp, Homo sapiens
tcagaggcactgagagcaatg

SEQ ID NO: 7941477 - DNA, 22 bp, Homo sapiens
tcagaggcagctgatgttctgt

SEQ ID NO: 7941478 - DNA, 22 bp, Homo sapiens
tcagagaaggtaagtgacctgc

SEQ ID NO: 7941479 - DNA, 22 bp, Homo sapiens
tcagagaagtaaggtggggtgc

SEQ ID NO: 7941480 - DNA, 22 bp, Homo sapiens
tcagagaagtaaggtggggtgc

SEQ ID NO: 7941481 - DNA, 22 bp, Homo sapiens
tcagagaaggtaagtgacctgc

SEQ ID NO: 7941482 - DNA, 22 bp, Homo sapiens
tcagagaaggtaagtgacctgc

SEQ ID NO: 7941483 - DNA, 22 bp, Homo sapiens
tcagagaaggtaagtgacctgc

SEQ ID NO: 7941484 - DNA, 22 bp, Homo sapiens
tcagagaaggtaagtgacctgc

SEQ ID NO: 7941485 - DNA, 22 bp, Homo sapiens
tcagagaagtaaggtggggtgc

SEQ ID NO: 7941486 - DNA, 22 bp, Homo sapiens
tcagagaagtaggctaatggtg

SEQ ID NO: 7941487 - DNA, 23 bp, Homo sapiens
tcagagaagttgtaggctgggga

SEQ ID NO: 7941488 - DNA, 22 bp, Homo sapiens
tcagagaagtaggctaatggtg

SEQ ID NO: 7941489 - DNA, 23 bp, Homo sapiens
tcagagaagttgtaggctgggga

SEQ ID NO: 7941490 - DNA, 23 bp, Homo sapiens
tcagagaagttgtaggctgggga

SEQ ID NO: 7941491 - DNA, 23 bp, Homo sapiens
tcagagaataattctgatagact

SEQ ID NO: 7941492 - DNA, 22 bp, Homo sapiens
tcagaagcatgtggggagcctg

SEQ ID NO: 7941493 - DNA, 22 bp, Homo sapiens
tcagaagcatgtggggagcctg

SEQ ID NO: 7941494 - DNA, 20 bp, Homo sapiens
tcagagaagggactgagatt

SEQ ID NO: 7941495 - DNA, 20 bp, Homo sapiens
tcagagaagggactgagatt

SEQ ID NO: 7941496 - DNA, 20 bp, Homo sapiens
tcagagaagggactgagatt

SEQ ID NO: 7941497 - DNA, 22 bp, Homo sapiens
tcagaagcagatatttcaaaat

SEQ ID NO: 7941498 - DNA, 22 bp, Homo sapiens
tcagaagcaggagtgtgcacaa

SEQ ID NO: 7941499 - DNA, 22 bp, Homo sapiens
tcagaagcaggagtgtgcacaa

SEQ ID NO: 7941500 - DNA, 22 bp, Homo sapiens
tcagaagcatccatttcaccac

SEQ ID NO: 7941501 - DNA, 22 bp, Homo sapiens
tcagagaatgtgaatattaaac

SEQ ID NO: 7941502 - DNA, 22 bp, Homo sapiens
tcagagaatgtgaatattaaac

SEQ ID NO: 7941503 - DNA, 22 bp, Homo sapiens
tcagagaatgtccttcttcatt

SEQ ID NO: 7941504 - DNA, 22 bp, Homo sapiens
tcagagaattcgattaaatgca

SEQ ID NO: 7941505 - DNA, 22 bp, Homo sapiens
tcagagaattcgattaaatgca

SEQ ID NO: 7941506 - DNA, 22 bp, Homo sapiens
tcagagaattctcagatgactc

SEQ ID NO: 7941507 - DNA, 22 bp, Homo sapiens
tcagagaattctcagatgactc

SEQ ID NO: 7941508 - DNA, 22 bp, Homo sapiens
tcagagaattctcagatgactc

SEQ ID NO: 7941509 - DNA, 22 bp, Homo sapiens
tcagagaattgtttaatggaat

SEQ ID NO: 7941510 - DNA, 22 bp, Homo sapiens
tcagagacaccattttctttct

SEQ ID NO: 7941511 - DNA, 22 bp, Homo sapiens
tcagagacaccagagagctgtg

SEQ ID NO: 7941512 - DNA, 22 bp, Homo sapiens
tcagagacaccagagagctgtg

SEQ ID NO: 7941513 - DNA, 22 bp, Homo sapiens
tcagagaattctcagatgactc

SEQ ID NO: 7941514 - DNA, 22 bp, Homo sapiens
tcagagaattctcagatgactc

SEQ ID NO: 7941515 - DNA, 22 bp, Homo sapiens
tcagagaattctcagatgactc

SEQ ID NO: 7941516 - DNA, 22 bp, Homo sapiens
tcagagaattctcagatgactc

SEQ ID NO: 7941517 - DNA, 22 bp, Homo sapiens
tcagagaattgtttaatggaat

SEQ ID NO: 7941518 - DNA, 22 bp, Homo sapiens
tcagagaattctcagatgactc

SEQ ID NO: 7941519 - DNA, 22 bp, Homo sapiens
tcagagaatctctccttagttt

SEQ ID NO: 7941520 - DNA, 21 bp, Homo sapiens
tcagagaatggcctactctca

SEQ ID NO: 7941521 - DNA, 22 bp, Homo sapiens
tcagagaatctctccttagttt

SEQ ID NO: 7941522 - DNA, 22 bp, Homo sapiens
tcagagaatccgtaagtcacaa

SEQ ID NO: 7941523 - DNA, 23 bp, Homo sapiens
tcagagaataattctgatagact

SEQ ID NO: 7941524 - DNA, 22 bp, Homo sapiens
tcagagaatccgtaagtcacaa

SEQ ID NO: 7941525 - DNA, 22 bp, Homo sapiens
tcagagaatccgtaagtcacaa

SEQ ID NO: 7941526 - DNA, 23 bp, Homo sapiens
tcagagaataattctgatagact

SEQ ID NO: 7941527 - DNA, 22 bp, Homo sapiens
tcagagaatccgtaagtcacaa

SEQ ID NO: 7941528 - DNA, 22 bp, Homo sapiens
tcagagaatgtccttcttcatt

SEQ ID NO: 7941529 - DNA, 22 bp, Homo sapiens
tcagagaatgtccttcttcatt

SEQ ID NO: 7941530 - DNA, 23 bp, Homo sapiens
tcagagaatggtatgcttttcct

SEQ ID NO: 7941531 - DNA, 23 bp, Homo sapiens
tcagagaatggtatgcttttcct

SEQ ID NO: 7941532 - DNA, 23 bp, Homo sapiens
tcagagaatggtatgcttttcct

SEQ ID NO: 7941533 - DNA, 21 bp, Homo sapiens
tcagagaatggcctactctca

SEQ ID NO: 7941534 - DNA, 21 bp, Homo sapiens
tcagagaatggcctactctca

SEQ ID NO: 7941535 - DNA, 21 bp, Homo sapiens
tcagagaatggcctactctca

SEQ ID NO: 7941536 - DNA, 23 bp, Homo sapiens
tcagagaatggtatgcttttcct

SEQ ID NO: 7941537 - DNA, 22 bp, Homo sapiens
tcagaagaaagatgttattact

SEQ ID NO: 7941538 - DNA, 22 bp, Homo sapiens
tcagaagaagagactccacagc

SEQ ID NO: 7941539 - DNA, 21 bp, Homo sapiens
tcagaactggtgcagatgaat

SEQ ID NO: 7941540 - DNA, 22 bp, Homo sapiens
tcagaagaaagatgttattact

SEQ ID NO: 7941541 - DNA, 22 bp, Homo sapiens
tcagaagaaagatgttattact

SEQ ID NO: 7941542 - DNA, 22 bp, Homo sapiens
tcagaagaagagactccacagc

SEQ ID NO: 7941543 - DNA, 22 bp, Homo sapiens
tcagaagaaggtatatttatac

SEQ ID NO: 7941544 - DNA, 22 bp, Homo sapiens
tcagaacttcagttttcttaat

SEQ ID NO: 7941545 - DNA, 22 bp, Homo sapiens
tcagaagaaagatgttattact

SEQ ID NO: 7941546 - DNA, 22 bp, Homo sapiens
tcagaagaaaagacttttagag

SEQ ID NO: 7941547 - DNA, 22 bp, Homo sapiens
tcagaagaaaagacttttagag

SEQ ID NO: 7941548 - DNA, 22 bp, Homo sapiens
tcagaacttcagttttcttaat

SEQ ID NO: 7941549 - DNA, 22 bp, Homo sapiens
tcagaactatagtagtttcatg

SEQ ID NO: 7941550 - DNA, 22 bp, Homo sapiens
tcagaactcaagacttgacatc

SEQ ID NO: 7941551 - DNA, 22 bp, Homo sapiens
tcagaactcaagacttgacatc

SEQ ID NO: 7941552 - DNA, 22 bp, Homo sapiens
tcagaactggtatttatcaagg

SEQ ID NO: 7941553 - DNA, 22 bp, Homo sapiens
tcagaactggtatttatcaagg

SEQ ID NO: 7941554 - DNA, 22 bp, Homo sapiens
tcagaagagtaatagggtgaga

SEQ ID NO: 7941555 - DNA, 22 bp, Homo sapiens
tcagaagagtaatagggtgaga

SEQ ID NO: 7941556 - DNA, 22 bp, Homo sapiens
tcagaagagctggtgctgcctg

SEQ ID NO: 7941557 - DNA, 22 bp, Homo sapiens
tcagaagagctggtgctgcctg

SEQ ID NO: 7941558 - DNA, 21 bp, Homo sapiens
tcagaagagctgcctcttggt

SEQ ID NO: 7941559 - DNA, 22 bp, Homo sapiens
tcagaagagctggtgctgcctg

SEQ ID NO: 7941560 - DNA, 22 bp, Homo sapiens
tcagaagactactaggacacat

SEQ ID NO: 7941561 - DNA, 22 bp, Homo sapiens
tcagaagactactaggacacat

SEQ ID NO: 7941562 - DNA, 21 bp, Homo sapiens
tcagaagagctgcctcttggt

SEQ ID NO: 7941563 - DNA, 22 bp, Homo sapiens
tcagaagactgtcttttccatg

SEQ ID NO: 7941564 - DNA, 22 bp, Homo sapiens
tcagaagcaaacatcactctag

SEQ ID NO: 7941565 - DNA, 22 bp, Homo sapiens
tcagaagataaagctttttgtt

SEQ ID NO: 7941566 - DNA, 22 bp, Homo sapiens
tcagaagcaaacatcactctag

SEQ ID NO: 7941567 - DNA, 22 bp, Homo sapiens
tcagaagcaagcttctacttct

SEQ ID NO: 7941568 - DNA, 22 bp, Homo sapiens
tcagaagcagaaaataggtggg

SEQ ID NO: 7941569 - DNA, 22 bp, Homo sapiens
tcagaacattgacattcttatt

SEQ ID NO: 7941570 - DNA, 22 bp, Homo sapiens
tcagaacattctcattgactgc

SEQ ID NO: 7941571 - DNA, 22 bp, Homo sapiens
tcagaacatttaaaaagtggtt

SEQ ID NO: 7941572 - DNA, 22 bp, Homo sapiens
tcagaacattgacattcttatt

SEQ ID NO: 7941573 - DNA, 22 bp, Homo sapiens
tcagaacattgacattcttatt

SEQ ID NO: 7941574 - DNA, 22 bp, Homo sapiens
tcagaacatttgggactttggg

SEQ ID NO: 7941575 - DNA, 22 bp, Homo sapiens
tcagaacctgcaagtctaacct

SEQ ID NO: 7941576 - DNA, 22 bp, Homo sapiens
tcagaacctcctagcagtgttc

SEQ ID NO: 7941577 - DNA, 22 bp, Homo sapiens
tcagaaccagcccagcagatga

SEQ ID NO: 7941578 - DNA, 22 bp, Homo sapiens
tcagaacattaaggatttgaag

SEQ ID NO: 7941579 - DNA, 22 bp, Homo sapiens
tcagaacatgaaggttaatttg

SEQ ID NO: 7941580 - DNA, 22 bp, Homo sapiens
tcagaacatgaaggttaatttg

SEQ ID NO: 7941581 - DNA, 22 bp, Homo sapiens
tcagaacattctcattgactgc

SEQ ID NO: 7941582 - DNA, 22 bp, Homo sapiens
tcagaacattctcattgactgc

SEQ ID NO: 7941583 - DNA, 22 bp, Homo sapiens
tcagaacattaaggatttgaag

SEQ ID NO: 7941584 - DNA, 22 bp, Homo sapiens
tcagaacattacattttgagct

SEQ ID NO: 7941585 - DNA, 22 bp, Homo sapiens
tcagaacattacattttgagct

SEQ ID NO: 7941586 - DNA, 22 bp, Homo sapiens
tcagaacattacattttgagct

SEQ ID NO: 7941587 - DNA, 22 bp, Homo sapiens
tcacacatgagtaaatacaggg

SEQ ID NO: 7941588 - DNA, 22 bp, Homo sapiens
tcacacatgagtaaatacaggg

SEQ ID NO: 7941589 - DNA, 22 bp, Homo sapiens
tcacacatctcaggtgtttaat

SEQ ID NO: 7941590 - DNA, 22 bp, Homo sapiens
tcacacataaaaagaagactag

SEQ ID NO: 7941591 - DNA, 22 bp, Homo sapiens
tcacacatactcatgtgtgagt

SEQ ID NO: 7941592 - DNA, 20 bp, Homo sapiens
tcacacataagtgaacgcac

SEQ ID NO: 7941593 - DNA, 22 bp, Homo sapiens
tcacacagggttctggtctcat

SEQ ID NO: 7941594 - DNA, 22 bp, Homo sapiens
tcacacagggttctggtctcat

SEQ ID NO: 7941595 - DNA, 22 bp, Homo sapiens
tcacacagggttctggtctcat

SEQ ID NO: 7941596 - DNA, 22 bp, Homo sapiens
tcacacagggttctggtctcat

SEQ ID NO: 7941597 - DNA, 22 bp, Homo sapiens
tcacacaggtttgcaatgattt

SEQ ID NO: 7941598 - DNA, 22 bp, Homo sapiens
tcacacagggttctggtctcat

SEQ ID NO: 7941599 - DNA, 22 bp, Homo sapiens
tcacacagggttctggtctcat

SEQ ID NO: 7941600 - DNA, 22 bp, Homo sapiens
tcacacagggttctggtctcat

SEQ ID NO: 7941601 - DNA, 22 bp, Homo sapiens
tcacacagtgagcggggctcag

SEQ ID NO: 7941602 - DNA, 22 bp, Homo sapiens
tcacacagtggtaaaaccctga

SEQ ID NO: 7941603 - DNA, 22 bp, Homo sapiens
tcacacagtggtaaaaccctga

SEQ ID NO: 7941604 - DNA, 22 bp, Homo sapiens
tcacacaggtttgcaatgattt

SEQ ID NO: 7941605 - DNA, 22 bp, Homo sapiens
tcacacaggtttgcaatgattt

SEQ ID NO: 7941606 - DNA, 22 bp, Homo sapiens
tcacacagtgagaaagtgcgga

SEQ ID NO: 7941607 - DNA, 20 bp, Homo sapiens
tcacagaatgcctgaagaag

SEQ ID NO: 7941608 - DNA, 20 bp, Homo sapiens
tcacagaatgcctgaagaag

SEQ ID NO: 7941609 - DNA, 20 bp, Homo sapiens
tcacagaatgcctgaagaag

SEQ ID NO: 7941610 - DNA, 22 bp, Homo sapiens
tcacagaatctctgataagtct

SEQ ID NO: 7941611 - DNA, 22 bp, Homo sapiens
tcacagaatctctgataagtct

SEQ ID NO: 7941612 - DNA, 22 bp, Homo sapiens
tcacagaatctctgataagtct

SEQ ID NO: 7941613 - DNA, 18 bp, Homo sapiens
tcacagaatattgagtgg

SEQ ID NO: 7941614 - DNA, 18 bp, Homo sapiens
tcacagaatattgagtgg

SEQ ID NO: 7941615 - DNA, 22 bp, Homo sapiens
tcacagaatagcactgtaagcg

SEQ ID NO: 7941616 - DNA, 22 bp, Homo sapiens
tcacagaatagcactgtaagcg

SEQ ID NO: 7941617 - DNA, 22 bp, Homo sapiens
tcacagaataaattgagaagac

SEQ ID NO: 7941618 - DNA, 22 bp, Homo sapiens
tcacagaatttttgcttccagt

SEQ ID NO: 7941619 - DNA, 22 bp, Homo sapiens
tcacagaatttttgcttccagt

SEQ ID NO: 7941620 - DNA, 22 bp, Homo sapiens
tcacagaattgacatgggaatc

SEQ ID NO: 7941621 - DNA, 22 bp, Homo sapiens
tcacagaattgacatgggaatc

SEQ ID NO: 7941622 - DNA, 22 bp, Homo sapiens
tcacagaatttttgcttccagt

SEQ ID NO: 7941623 - DNA, 22 bp, Homo sapiens
tcacagaatttttgcttccagt

SEQ ID NO: 7941624 - DNA, 22 bp, Homo sapiens
tcacagaatgtctagcataatt

SEQ ID NO: 7941625 - DNA, 22 bp, Homo sapiens
tcacagaatgtctagcataatt

SEQ ID NO: 7941626 - DNA, 22 bp, Homo sapiens
tcacagaatgtctagcataatt

SEQ ID NO: 7941627 - DNA, 22 bp, Homo sapiens
tcacagaatgtctagcataatt

SEQ ID NO: 7941628 - DNA, 18 bp, Homo sapiens
tcacagacagctgtcttt

SEQ ID NO: 7941629 - DNA, 22 bp, Homo sapiens
tcacagacagaagggatgggat

SEQ ID NO: 7941630 - DNA, 19 bp, Homo sapiens
tcacagacagagcaatcac

SEQ ID NO: 7941631 - DNA, 19 bp, Homo sapiens
tcacagacagagcaatcac

SEQ ID NO: 7941632 - DNA, 22 bp, Homo sapiens
tcacagacactgggttattgca

SEQ ID NO: 7941633 - DNA, 22 bp, Homo sapiens
tcacagacacagggagaagcat

SEQ ID NO: 7941634 - DNA, 22 bp, Homo sapiens
tcacagacacattaaacatgtg

SEQ ID NO: 7941635 - DNA, 22 bp, Homo sapiens
tcacagacacattaaacatgtg

SEQ ID NO: 7941636 - DNA, 22 bp, Homo sapiens
tcacagacactgggttattgca

SEQ ID NO: 7941637 - DNA, 22 bp, Homo sapiens
tcacagagaactataatccatc

SEQ ID NO: 7941638 - DNA, 22 bp, Homo sapiens
tcacagacccttgctgagctct

SEQ ID NO: 7941639 - DNA, 22 bp, Homo sapiens
tcacagagaggttaagcagttg

SEQ ID NO: 7941640 - DNA, 22 bp, Homo sapiens
tcacagagagaatattgtgttt

SEQ ID NO: 7941641 - DNA, 22 bp, Homo sapiens
tcacagagaggttaagcagttg

SEQ ID NO: 7941642 - DNA, 22 bp, Homo sapiens
tcacagagaggttaagcagttg

SEQ ID NO: 7941643 - DNA, 22 bp, Homo sapiens
tcacagagagtgacttgttgct

SEQ ID NO: 7941644 - DNA, 22 bp, Homo sapiens
tcacagagcacacaagaattgc

SEQ ID NO: 7941645 - DNA, 22 bp, Homo sapiens
tcacagagatgaacttttgata

SEQ ID NO: 7941646 - DNA, 22 bp, Homo sapiens
tcacagagttaaaagtttcttt

SEQ ID NO: 7941647 - DNA, 22 bp, Homo sapiens
tcacagagttaaaagtttcttt

SEQ ID NO: 7941648 - DNA, 22 bp, Homo sapiens
tcacagagttaaaagtttcttt

SEQ ID NO: 7941649 - DNA, 20 bp, Homo sapiens
tcacagagtagccttgtctg

SEQ ID NO: 7941650 - DNA, 22 bp, Homo sapiens
tcacagagctcacagtttagca

SEQ ID NO: 7941651 - DNA, 20 bp, Homo sapiens
tcacagagtagccttgtctg

SEQ ID NO: 7941652 - DNA, 23 bp, Homo sapiens
tcacagagcatactgcattttgc

SEQ ID NO: 7941653 - DNA, 21 bp, Homo sapiens
tcacagagccacagaattggt

SEQ ID NO: 7941654 - DNA, 22 bp, Homo sapiens
tcacagagcacacaagaattgc

SEQ ID NO: 7941655 - DNA, 22 bp, Homo sapiens
tcacagagcacgtatcatgcct

SEQ ID NO: 7941656 - DNA, 23 bp, Homo sapiens
tcacagagcatactgcattttgc

SEQ ID NO: 7941657 - DNA, 22 bp, Homo sapiens
tcacagcaaaagtgtgcagagc

SEQ ID NO: 7941658 - DNA, 20 bp, Homo sapiens
tcacagatgaaagttcaaga

SEQ ID NO: 7941659 - DNA, 22 bp, Homo sapiens
tcacagcaaaagtgtgcagagc

SEQ ID NO: 7941660 - DNA, 19 bp, Homo sapiens
tcacagagttcttacggga

SEQ ID NO: 7941661 - DNA, 22 bp, Homo sapiens
tcacagcaaaagtgtgcagagc

SEQ ID NO: 7941662 - DNA, 22 bp, Homo sapiens
tcacagcaaatgctgcttctca

SEQ ID NO: 7941663 - DNA, 22 bp, Homo sapiens
tcacagcaaatgctgcttctca

SEQ ID NO: 7941664 - DNA, 22 bp, Homo sapiens
tcacagcaaatgctgcttctca

SEQ ID NO: 7941665 - DNA, 22 bp, Homo sapiens
tcacagcaaatgctgcttctca

SEQ ID NO: 7941666 - DNA, 22 bp, Homo sapiens
tcacatcatggagaattatggg

SEQ ID NO: 7941667 - DNA, 22 bp, Homo sapiens
tcacatccattaagttagaatt

SEQ ID NO: 7941668 - DNA, 20 bp, Homo sapiens
tcacatcctctcccaacatg

SEQ ID NO: 7941669 - DNA, 20 bp, Homo sapiens
tcacatcctctcccaacatg

SEQ ID NO: 7941670 - DNA, 22 bp, Homo sapiens
tcacatctatacccaataattt

SEQ ID NO: 7941671 - DNA, 22 bp, Homo sapiens
tcacatctatacccaataattt

SEQ ID NO: 7941672 - DNA, 22 bp, Homo sapiens
tcacatctatacccaataattt

SEQ ID NO: 7941673 - DNA, 22 bp, Homo sapiens
tcacatctaattccatttctgc

SEQ ID NO: 7941674 - DNA, 22 bp, Homo sapiens
tcacatctaattccatttctgc

SEQ ID NO: 7941675 - DNA, 23 bp, Homo sapiens
tcacatctgccgtagtgtattct

SEQ ID NO: 7941676 - DNA, 23 bp, Homo sapiens
tcacatctgccgtagtgtattct

SEQ ID NO: 7941677 - DNA, 22 bp, Homo sapiens
tcacatctgcctccatagcacc

SEQ ID NO: 7941678 - DNA, 22 bp, Homo sapiens
tcacatctgcaaaatccctttt

SEQ ID NO: 7941679 - DNA, 22 bp, Homo sapiens
tcacatctgaaaaaatattgag

SEQ ID NO: 7941680 - DNA, 22 bp, Homo sapiens
tcacatctgaaaaaatattgag

SEQ ID NO: 7941681 - DNA, 22 bp, Homo sapiens
tcacatctgaaaaaatattgag

SEQ ID NO: 7941682 - DNA, 21 bp, Homo sapiens
tcacatctatgttaagcaaac

SEQ ID NO: 7941683 - DNA, 22 bp, Homo sapiens
tcacatatttaagaaagttaaa

SEQ ID NO: 7941684 - DNA, 22 bp, Homo sapiens
tcacatatttaagaaagttaaa

SEQ ID NO: 7941685 - DNA, 22 bp, Homo sapiens
tcacatatttaagaaagttaaa

SEQ ID NO: 7941686 - DNA, 22 bp, Homo sapiens
tcacatcaggtgtctccccaag

SEQ ID NO: 7941687 - DNA, 22 bp, Homo sapiens
tcacatcactagctggtaatga

SEQ ID NO: 7941688 - DNA, 17 bp, Homo sapiens
tcacatcacacaagcaa

SEQ ID NO: 7941689 - DNA, 22 bp, Homo sapiens
tcacagctaagcttggtcactg

SEQ ID NO: 7941690 - DNA, 22 bp, Homo sapiens
tcacagcctggtcactctgccc

SEQ ID NO: 7941691 - DNA, 22 bp, Homo sapiens
tcacagcctggacagttgcctg

SEQ ID NO: 7941692 - DNA, 22 bp, Homo sapiens
tcacagcctggtcactctgccc

SEQ ID NO: 7941693 - DNA, 22 bp, Homo sapiens
tcacagcctggacagttgcctg

SEQ ID NO: 7941694 - DNA, 22 bp, Homo sapiens
tcacagcatttttagaaagatt

SEQ ID NO: 7941695 - DNA, 22 bp, Homo sapiens
tcacagcatttttagaaagatt

SEQ ID NO: 7941696 - DNA, 22 bp, Homo sapiens
tcacagcatttttagaaagatt

SEQ ID NO: 7941697 - DNA, 23 bp, Homo sapiens
tcacatatgtagaagtggaattc

SEQ ID NO: 7941698 - DNA, 23 bp, Homo sapiens
tcacatatcaagaaagtggtaga

SEQ ID NO: 7941699 - DNA, 22 bp, Homo sapiens
tcacagctattctcatgtattt

SEQ ID NO: 7941700 - DNA, 22 bp, Homo sapiens
tcacagctattctcatgtattt

SEQ ID NO: 7941701 - DNA, 16 bp, Homo sapiens
tcacatacttccttgc

SEQ ID NO: 7941702 - DNA, 22 bp, Homo sapiens
tcacagctaagcttggtcactg

SEQ ID NO: 7941703 - DNA, 22 bp, Homo sapiens
tcacagctaagcttggtcactg

SEQ ID NO: 7941704 - DNA, 22 bp, Homo sapiens
tcacagcagtaaagaaaacact

SEQ ID NO: 7941705 - DNA, 22 bp, Homo sapiens
tcacagcagtaaagaaaacact

SEQ ID NO: 7941706 - DNA, 22 bp, Homo sapiens
tcacagcagtaaagaaaacact

SEQ ID NO: 7941707 - DNA, 19 bp, Homo sapiens
tcacagcatctgtctgaac

SEQ ID NO: 7941708 - DNA, 19 bp, Homo sapiens
tcacagcatctgtctgaac

SEQ ID NO: 7941709 - DNA, 19 bp, Homo sapiens
tcacagcatctgtctgaac

SEQ ID NO: 7941710 - DNA, 19 bp, Homo sapiens
tcacagcatctgtctgaac

SEQ ID NO: 7941711 - DNA, 19 bp, Homo sapiens
tcacagcatctgtctgaac

SEQ ID NO: 7941712 - DNA, 22 bp, Homo sapiens
tcacagcagggtaacaggaaga

SEQ ID NO: 7941713 - DNA, 22 bp, Homo sapiens
tcacagcagggtaacaggaaga

SEQ ID NO: 7941714 - DNA, 22 bp, Homo sapiens
tcacagcagggtaacaggaaga

SEQ ID NO: 7941715 - DNA, 22 bp, Homo sapiens
tcacagcagaatttaggaggca

SEQ ID NO: 7941716 - DNA, 22 bp, Homo sapiens
tcacagcaggcagatattgttg

SEQ ID NO: 7941717 - DNA, 22 bp, Homo sapiens
tcacagcagggtaacaggaaga

SEQ ID NO: 7941718 - DNA, 22 bp, Homo sapiens
tcacagcagtaaagaaaacact

SEQ ID NO: 7941719 - DNA, 22 bp, Homo sapiens
tcacagcagggtaacaggaaga

SEQ ID NO: 7941720 - DNA, 22 bp, Homo sapiens
tcacagcattgagtgtactaga

SEQ ID NO: 7941721 - DNA, 22 bp, Homo sapiens
tcacagcattgagtgtactaga

SEQ ID NO: 7941722 - DNA, 22 bp, Homo sapiens
tcacagcattcgcaatggacag

SEQ ID NO: 7941723 - DNA, 22 bp, Homo sapiens
tcacagcattcgcaatggacag

SEQ ID NO: 7941724 - DNA, 22 bp, Homo sapiens
tcacagcattcgcaatggacag

SEQ ID NO: 7941725 - DNA, 22 bp, Homo sapiens
tcacagcattcgcaatggacag

SEQ ID NO: 7941726 - DNA, 22 bp, Homo sapiens
tcacagcattgtcacaaggctg

SEQ ID NO: 7941727 - DNA, 22 bp, Homo sapiens
tcacagcattgtcacaaggctg

SEQ ID NO: 7941728 - DNA, 22 bp, Homo sapiens
tcacagcattgtcacaaggctg

SEQ ID NO: 7941729 - DNA, 22 bp, Homo sapiens
tcacagcattgtcacaaggctg

SEQ ID NO: 7941730 - DNA, 22 bp, Homo sapiens
tcacagcattgtcacaaggctg

SEQ ID NO: 7941731 - DNA, 22 bp, Homo sapiens
tcacagcattgtcacaaggctg

SEQ ID NO: 7941732 - DNA, 22 bp, Homo sapiens
tcacagcatttttagaaagatt

SEQ ID NO: 7941733 - DNA, 22 bp, Homo sapiens
tcacagcaacactggggcagac

SEQ ID NO: 7941734 - DNA, 22 bp, Homo sapiens
tcacagcaacactggggcagac

SEQ ID NO: 7941735 - DNA, 22 bp, Homo sapiens
tcacagcaacactggggcagac

SEQ ID NO: 7941736 - DNA, 22 bp, Homo sapiens
tcacagcaaccctgaggcgagt

SEQ ID NO: 7941737 - DNA, 22 bp, Homo sapiens
tcacagcaaccctgaggcgagt

SEQ ID NO: 7941738 - DNA, 22 bp, Homo sapiens
tcacagcaccaggatctctcca

SEQ ID NO: 7941739 - DNA, 22 bp, Homo sapiens
tcacagcaccaggatctctcca

SEQ ID NO: 7941740 - DNA, 22 bp, Homo sapiens
tcacagcaccaggatctctcca

SEQ ID NO: 7941741 - DNA, 22 bp, Homo sapiens
tcacagcaccaggatctctcca

SEQ ID NO: 7941742 - DNA, 22 bp, Homo sapiens
tcacagcacatggaccgagtcc

SEQ ID NO: 7941743 - DNA, 22 bp, Homo sapiens
tcacagcacatggaccgagtcc

SEQ ID NO: 7941744 - DNA, 22 bp, Homo sapiens
tcacagcacatggaccgagtcc

SEQ ID NO: 7941745 - DNA, 22 bp, Homo sapiens
tcacagcacatggaccgagtcc

SEQ ID NO: 7941746 - DNA, 22 bp, Homo sapiens
tcacagcaaccctgaggcgagt

SEQ ID NO: 7941747 - DNA, 22 bp, Homo sapiens
tcacagcaccctgaggtgctgg

SEQ ID NO: 7941748 - DNA, 22 bp, Homo sapiens
tcacagcagaatttaggaggca

SEQ ID NO: 7941749 - DNA, 22 bp, Homo sapiens
tcacagcagggtaacaggaaga

SEQ ID NO: 7941750 - DNA, 22 bp, Homo sapiens
tcacagcagggtaacaggaaga

SEQ ID NO: 7941751 - DNA, 22 bp, Homo sapiens
tcacagcaggcagatattgttg

SEQ ID NO: 7941752 - DNA, 22 bp, Homo sapiens
tcacagcaggcagatattgttg

SEQ ID NO: 7941753 - DNA, 22 bp, Homo sapiens
tcacagcaccctgaggtgctgg

SEQ ID NO: 7941754 - DNA, 22 bp, Homo sapiens
tcacagcaccaggatctctcca

SEQ ID NO: 7941755 - DNA, 22 bp, Homo sapiens
tcacagcaccctgaggtgctgg

SEQ ID NO: 7941756 - DNA, 22 bp, Homo sapiens
tcacagcaccctgaggtgctgg

SEQ ID NO: 7941757 - DNA, 22 bp, Homo sapiens
tcacagcaccaggatctctcca

SEQ ID NO: 7941758 - DNA, 22 bp, Homo sapiens
tcacagcaccaggatctctcca

SEQ ID NO: 7941759 - DNA, 22 bp, Homo sapiens
tcacagcaccctgaggtgctgg

SEQ ID NO: 7941760 - DNA, 22 bp, Homo sapiens
tcacagcaccctgaggtgctgg

SEQ ID NO: 7941761 - DNA, 22 bp, Homo sapiens
tcaaaagacacaggaggctagt

SEQ ID NO: 7941762 - DNA, 22 bp, Homo sapiens
tcaaaagaaacaccatgttcct

SEQ ID NO: 7941763 - DNA, 22 bp, Homo sapiens
tcaaaagacacaggaggctagt

SEQ ID NO: 7941764 - DNA, 22 bp, Homo sapiens
tcaaaagacacaggaggctagt

SEQ ID NO: 7941765 - DNA, 22 bp, Homo sapiens
tcaaaaatgttttatattggta

SEQ ID NO: 7941766 - DNA, 22 bp, Homo sapiens
tcaaaaatgttttatattggta

SEQ ID NO: 7941767 - DNA, 22 bp, Homo sapiens
tcaaaaatgttttatattggta

SEQ ID NO: 7941768 - DNA, 22 bp, Homo sapiens
tcaaaaatgttttatattggta

SEQ ID NO: 7941769 - DNA, 22 bp, Homo sapiens
tcaaaaatggtctttgagctgc

SEQ ID NO: 7941770 - DNA, 22 bp, Homo sapiens
tcaaaaatggtctttgagctgc

SEQ ID NO: 7941771 - DNA, 22 bp, Homo sapiens
tcaaaaatggtctttgagctgc

SEQ ID NO: 7941772 - DNA, 22 bp, Homo sapiens
tcaaaaatggtctttgagctgc

SEQ ID NO: 7941773 - DNA, 22 bp, Homo sapiens
tcaaaaatggtctttgagctgc

SEQ ID NO: 7941774 - DNA, 22 bp, Homo sapiens
tcaaaaatggtctttgagctgc

SEQ ID NO: 7941775 - DNA, 22 bp, Homo sapiens
tcaaaaatggtctttgagctgc

SEQ ID NO: 7941776 - DNA, 20 bp, Homo sapiens
tcaaaataggtgtgggcgga

SEQ ID NO: 7941777 - DNA, 20 bp, Homo sapiens
tcaaaataggtgtgggcgga

SEQ ID NO: 7941778 - DNA, 22 bp, Homo sapiens
tcaaaagtttcacatagagata

SEQ ID NO: 7941779 - DNA, 22 bp, Homo sapiens
tcaaaagtttcacatagagata

SEQ ID NO: 7941780 - DNA, 22 bp, Homo sapiens
tcaaaagtttcacatagagata

SEQ ID NO: 7941781 - DNA, 22 bp, Homo sapiens
tcaaaagtttcacatagagata

SEQ ID NO: 7941782 - DNA, 22 bp, Homo sapiens
tcaaaagtctgcattcttcaca

SEQ ID NO: 7941783 - DNA, 18 bp, Homo sapiens
tcaaaatatttctgtgga

SEQ ID NO: 7941784 - DNA, 22 bp, Homo sapiens
tcaaaatcaaagatacttgaaa

SEQ ID NO: 7941785 - DNA, 22 bp, Homo sapiens
tcaaaatcaaagatacttgaaa

SEQ ID NO: 7941786 - DNA, 22 bp, Homo sapiens
tcaaaattagtgaccaaaggca

SEQ ID NO: 7941787 - DNA, 18 bp, Homo sapiens
tcaaaatatttctgtgga

SEQ ID NO: 7941788 - DNA, 18 bp, Homo sapiens
tcaaaatatttctgtgga

SEQ ID NO: 7941789 - DNA, 18 bp, Homo sapiens
tcaaaatatttctgtgga

SEQ ID NO: 7941790 - DNA, 18 bp, Homo sapiens
tcaaaatatttctgtgga

SEQ ID NO: 7941791 - DNA, 22 bp, Homo sapiens
tcaaacagaggaacaattgttt

SEQ ID NO: 7941792 - DNA, 22 bp, Homo sapiens
tcaaacactgtaacatggaaaa

SEQ ID NO: 7941793 - DNA, 22 bp, Homo sapiens
tcaaacagaaattgttcatgct

SEQ ID NO: 7941794 - DNA, 22 bp, Homo sapiens
tcaaaattctagggagaatggt

SEQ ID NO: 7941795 - DNA, 22 bp, Homo sapiens
tcaaaatttcagcactagccct

SEQ ID NO: 7941796 - DNA, 22 bp, Homo sapiens
tcaatgatagtacaatcagcct

SEQ ID NO: 7941797 - DNA, 22 bp, Homo sapiens
tcaatagaaatgcagagtctca

SEQ ID NO: 7941798 - DNA, 22 bp, Homo sapiens
tcaatgatagacaagatctaag

SEQ ID NO: 7941799 - DNA, 22 bp, Homo sapiens
tcaatgatagacaagatctaag

SEQ ID NO: 7941800 - DNA, 22 bp, Homo sapiens
tcaatgattagagtttagtgtg

SEQ ID NO: 7941801 - DNA, 22 bp, Homo sapiens
tcaatgatgctgaaggtagcgt

SEQ ID NO: 7941802 - DNA, 22 bp, Homo sapiens
tcaatgatatcagcaggatgtg

SEQ ID NO: 7941803 - DNA, 22 bp, Homo sapiens
tcaatgcaatcattggacaagt

SEQ ID NO: 7941804 - DNA, 22 bp, Homo sapiens
tcaatgcaatcattggacaagt

SEQ ID NO: 7941805 - DNA, 21 bp, Homo sapiens
tcaatacaggtgcatgtgtct

SEQ ID NO: 7941806 - DNA, 22 bp, Homo sapiens
tcaaacctgctgtcttgttcat

SEQ ID NO: 7941807 - DNA, 22 bp, Homo sapiens
tcaatacatacaatgtatagtg

SEQ ID NO: 7941808 - DNA, 22 bp, Homo sapiens
tcaaactagcctgactggtatt

SEQ ID NO: 7941809 - DNA, 22 bp, Homo sapiens
tcaatagaaatgcagagtctca

SEQ ID NO: 7941810 - DNA, 22 bp, Homo sapiens
tcaatacatgtgtgtggatggt

SEQ ID NO: 7941811 - DNA, 22 bp, Homo sapiens
tcaatactcacaaagagatttt

SEQ ID NO: 7941812 - DNA, 22 bp, Homo sapiens
tcaaacagcaggtctttcatag

SEQ ID NO: 7941813 - DNA, 22 bp, Homo sapiens
tcaaacaggactacattctcat

SEQ ID NO: 7941814 - DNA, 23 bp, Homo sapiens
tcaaacaggtttcagagcatctt

SEQ ID NO: 7941815 - DNA, 22 bp, Homo sapiens
tcaaacaggactacattctcat

SEQ ID NO: 7941816 - DNA, 22 bp, Homo sapiens
tcaaacagaggaacaattgttt

SEQ ID NO: 7941817 - DNA, 22 bp, Homo sapiens
tcaaacagaggaacaattgttt

SEQ ID NO: 7941818 - DNA, 22 bp, Homo sapiens
tcaaacagcaggtctttcatag

SEQ ID NO: 7941819 - DNA, 22 bp, Homo sapiens
tcaaacagcaggtctttcatag

SEQ ID NO: 7941820 - DNA, 22 bp, Homo sapiens
tcaaacatatctgattttccat

SEQ ID NO: 7941821 - DNA, 22 bp, Homo sapiens
tcaaacatatctgattttccat

SEQ ID NO: 7941822 - DNA, 22 bp, Homo sapiens
tcaaacatatctgattttccat

SEQ ID NO: 7941823 - DNA, 22 bp, Homo sapiens
tcaaacataggcacacattcag

SEQ ID NO: 7941824 - DNA, 22 bp, Homo sapiens
tcaaacataggcacacattcag

SEQ ID NO: 7941825 - DNA, 22 bp, Homo sapiens
tcaaacataaaactaaatcgag

SEQ ID NO: 7941826 - DNA, 22 bp, Homo sapiens
tcaaacataaaactaaatcgag

SEQ ID NO: 7941827 - DNA, 22 bp, Homo sapiens
tcaaacataaaactaaatcgag

SEQ ID NO: 7941828 - DNA, 23 bp, Homo sapiens
tcaaacaggtttcagagcatctt

SEQ ID NO: 7941829 - DNA, 22 bp, Homo sapiens
tcaaacatgaaagcttgatttt

SEQ ID NO: 7941830 - DNA, 21 bp, Homo sapiens
tcaaacatgatctgggtcatc

SEQ ID NO: 7941831 - DNA, 22 bp, Homo sapiens
tcaaaccaccttgttactgggg

SEQ ID NO: 7941832 - DNA, 22 bp, Homo sapiens
tcaaaccaccttgttactgggg

SEQ ID NO: 7941833 - DNA, 22 bp, Homo sapiens
tcaaaccatataatcggttaca

SEQ ID NO: 7941834 - DNA, 22 bp, Homo sapiens
tcaaaccagccttgcatcccag

SEQ ID NO: 7941835 - DNA, 22 bp, Homo sapiens
tcaaacatctaaactacccact

SEQ ID NO: 7941836 - DNA, 23 bp, Homo sapiens
tcaaacatattgtgagacacagg

SEQ ID NO: 7941837 - DNA, 23 bp, Homo sapiens
tcaaacatattgtgagacacagg

SEQ ID NO: 7941838 - DNA, 22 bp, Homo sapiens
tcaattctgcatacatttcact

SEQ ID NO: 7941839 - DNA, 22 bp, Homo sapiens
tcaattctgcatacatttcact

SEQ ID NO: 7941840 - DNA, 22 bp, Homo sapiens
tcaattctgcctctaaatattt

SEQ ID NO: 7941841 - DNA, 22 bp, Homo sapiens
tcaattctggtcctcaggaact

SEQ ID NO: 7941842 - DNA, 22 bp, Homo sapiens
tcaattctagagccttacattg

SEQ ID NO: 7941843 - DNA, 22 bp, Homo sapiens
tcaattcatagagttgacacag

SEQ ID NO: 7941844 - DNA, 22 bp, Homo sapiens
tcaattattttggctatgctaa

SEQ ID NO: 7941845 - DNA, 22 bp, Homo sapiens
tcaattattttggctatgctaa

SEQ ID NO: 7941846 - DNA, 22 bp, Homo sapiens
tcaattcaacacatgcacattg

SEQ ID NO: 7941847 - DNA, 22 bp, Homo sapiens
tcaattatttgatatgaaaggg

SEQ ID NO: 7941848 - DNA, 22 bp, Homo sapiens
tcaattatttgatatgaaaggg

SEQ ID NO: 7941849 - DNA, 22 bp, Homo sapiens
tcaattatttgatatgaaaggg

SEQ ID NO: 7941850 - DNA, 22 bp, Homo sapiens
tcaattcaattgcatttctgtg

SEQ ID NO: 7941851 - DNA, 22 bp, Homo sapiens
tcaattcaattgcatttctgtg

SEQ ID NO: 7941852 - DNA, 22 bp, Homo sapiens
tcaattcagtccaacagtaatt

SEQ ID NO: 7941853 - DNA, 22 bp, Homo sapiens
tcaattcagactgagaaatgat

SEQ ID NO: 7941854 - DNA, 22 bp, Homo sapiens
tcaattcacagctctgctattt

SEQ ID NO: 7941855 - DNA, 22 bp, Homo sapiens
tcaattcacagctctgctattt

SEQ ID NO: 7941856 - DNA, 22 bp, Homo sapiens
tcaatgtgaattaagaatactt

SEQ ID NO: 7941857 - DNA, 22 bp, Homo sapiens
tcaatgttcttggtatatcctt

SEQ ID NO: 7941858 - DNA, 22 bp, Homo sapiens
tcaatgttcaagtatgacaatg

SEQ ID NO: 7941859 - DNA, 22 bp, Homo sapiens
tcaatgttctgattcttttgca

SEQ ID NO: 7941860 - DNA, 22 bp, Homo sapiens
tcaatgtttgttcatgaaaata

SEQ ID NO: 7941861 - DNA, 22 bp, Homo sapiens
tcaatgttctgattcttttgca

SEQ ID NO: 7941862 - DNA, 22 bp, Homo sapiens
tcaatgtttggaaatcctttgt

SEQ ID NO: 7941863 - DNA, 22 bp, Homo sapiens
tcaatgtttgttcatgaaaata

SEQ ID NO: 7941864 - DNA, 22 bp, Homo sapiens
tcaatgtttgttcatgaaaata

SEQ ID NO: 7941865 - DNA, 22 bp, Homo sapiens
tcaatgtttgttcatgaaaata

SEQ ID NO: 7941866 - DNA, 20 bp, Homo sapiens
tcaatgtaatcatatcatca

SEQ ID NO: 7941867 - DNA, 22 bp, Homo sapiens
tcaatgcatgtgacaaagagta

SEQ ID NO: 7941868 - DNA, 22 bp, Homo sapiens
tcaatgtcagctggtaggaaat

SEQ ID NO: 7941869 - DNA, 22 bp, Homo sapiens
tcaattatgccattgcaatatt

SEQ ID NO: 7941870 - DNA, 23 bp, Homo sapiens
tcaattatcaatggaaagaagtt

SEQ ID NO: 7941871 - DNA, 22 bp, Homo sapiens
tcaattagggtctatttctagt

SEQ ID NO: 7941872 - DNA, 22 bp, Homo sapiens
tcaattatgccattgcaatatt

SEQ ID NO: 7941873 - DNA, 21 bp, Homo sapiens
tcaattatggatgtgtgcaaa

SEQ ID NO: 7941874 - DNA, 23 bp, Homo sapiens
tcaattatcaatggaaagaagtt

SEQ ID NO: 7941875 - DNA, 22 bp, Homo sapiens
tcaattatgccattgcaatatt

SEQ ID NO: 7941876 - DNA, 22 bp, Homo sapiens
tcaattacagcaatgactgtac

SEQ ID NO: 7941877 - DNA, 22 bp, Homo sapiens
tcaattacagcaatgactgtac

SEQ ID NO: 7941878 - DNA, 23 bp, Homo sapiens
tcaattgatgatgttctcttttg

SEQ ID NO: 7941879 - DNA, 22 bp, Homo sapiens
tcacaatttggatacagctatg

SEQ ID NO: 7941880 - DNA, 22 bp, Homo sapiens
tcacaattgagatcctcccacc

SEQ ID NO: 7941881 - DNA, 22 bp, Homo sapiens
tcaatttaaggtactactttgg

SEQ ID NO: 7941882 - DNA, 22 bp, Homo sapiens
tcacacacataatctaagatta

SEQ ID NO: 7941883 - DNA, 22 bp, Homo sapiens
tcacacacatggatagtatttt

SEQ ID NO: 7941884 - DNA, 22 bp, Homo sapiens
tcacacacataatctaagatta

SEQ ID NO: 7941885 - DNA, 22 bp, Homo sapiens
tcacacacatggatagtatttt

SEQ ID NO: 7941886 - DNA, 22 bp, Homo sapiens
tcacacacataatctaagatta

SEQ ID NO: 7941887 - DNA, 22 bp, Homo sapiens
tcacacacataatctaagatta

SEQ ID NO: 7941888 - DNA, 21 bp, Homo sapiens
tcacacacgtttccaagggca

SEQ ID NO: 7941889 - DNA, 21 bp, Homo sapiens
tcacacacgtttccaagggca

SEQ ID NO: 7941890 - DNA, 22 bp, Homo sapiens
tcacacagattggtagagctga

SEQ ID NO: 7941891 - DNA, 22 bp, Homo sapiens
tcacacagattggtagagctga

SEQ ID NO: 7941892 - DNA, 22 bp, Homo sapiens
tcacacagattggtagagctga

SEQ ID NO: 7941893 - DNA, 22 bp, Homo sapiens
tcacacacatttgctgtctgat

SEQ ID NO: 7941894 - DNA, 21 bp, Homo sapiens
tcacacacgtttccaagggca

SEQ ID NO: 7941895 - DNA, 21 bp, Homo sapiens
tcacacacgtttccaagggca

SEQ ID NO: 7941896 - DNA, 22 bp, Homo sapiens
tcacacacatggatagtatttt

SEQ ID NO: 7941897 - DNA, 22 bp, Homo sapiens
tcacacacatttgctgtctgat

SEQ ID NO: 7941898 - DNA, 22 bp, Homo sapiens
tcacacacatggatagtatttt

SEQ ID NO: 7941899 - DNA, 22 bp, Homo sapiens
tcacacacatttgctgtctgat

SEQ ID NO: 7941900 - DNA, 22 bp, Homo sapiens
tcacacacatggatagtatttt

SEQ ID NO: 7941901 - DNA, 22 bp, Homo sapiens
tcacacacatttgctgtctgat

SEQ ID NO: 7941902 - DNA, 22 bp, Homo sapiens
tcacacacatttgctgtctgat

SEQ ID NO: 7941903 - DNA, 22 bp, Homo sapiens
tcacacagctagtaagggccga

SEQ ID NO: 7941904 - DNA, 22 bp, Homo sapiens
tcacacagctagtaagggccga

SEQ ID NO: 7941905 - DNA, 22 bp, Homo sapiens
tcacacagctcctttccttagt

SEQ ID NO: 7941906 - DNA, 22 bp, Homo sapiens
tcacacagattggtagagctga

SEQ ID NO: 7941907 - DNA, 22 bp, Homo sapiens
tcacacagattggtagagctga

SEQ ID NO: 7941908 - DNA, 22 bp, Homo sapiens
tcacacagattggtagagctga

SEQ ID NO: 7941909 - DNA, 22 bp, Homo sapiens
tcacacagctgacagagccttt

SEQ ID NO: 7941910 - DNA, 22 bp, Homo sapiens
tcacacagctgacagagccttt

SEQ ID NO: 7941911 - DNA, 22 bp, Homo sapiens
tcacacagctcctttccttagt

SEQ ID NO: 7941912 - DNA, 23 bp, Homo sapiens
tcacacagctggtcaggtacaga

SEQ ID NO: 7941913 - DNA, 23 bp, Homo sapiens
tcacacagctggtcaggtacaga

SEQ ID NO: 7941914 - DNA, 22 bp, Homo sapiens
tcacacagggtcggaaagagtg

SEQ ID NO: 7941915 - DNA, 22 bp, Homo sapiens
tcacacagggtcggaaagagtg

SEQ ID NO: 7941916 - DNA, 22 bp, Homo sapiens
tcacacagggtcggaaagagtg

SEQ ID NO: 7941917 - DNA, 22 bp, Homo sapiens
tcacacagggtcggaaagagtg

SEQ ID NO: 7941918 - DNA, 22 bp, Homo sapiens
tcacacagggtcggaaagagtg

SEQ ID NO: 7941919 - DNA, 22 bp, Homo sapiens
tcacacagggtcggaaagagtg

SEQ ID NO: 7941920 - DNA, 22 bp, Homo sapiens
tcacacagcttggagttatggt

SEQ ID NO: 7941921 - DNA, 22 bp, Homo sapiens
tcacacagcttggagttatggt

SEQ ID NO: 7941922 - DNA, 22 bp, Homo sapiens
tcacacagcttggagttatggt

SEQ ID NO: 7941923 - DNA, 23 bp, Homo sapiens
tcacacagctggtcaggtacaga

SEQ ID NO: 7941924 - DNA, 23 bp, Homo sapiens
tcacacagctggtcaggtacaga

SEQ ID NO: 7941925 - DNA, 22 bp, Homo sapiens
tagtatagattgaagcagatca

SEQ ID NO: 7941926 - DNA, 22 bp, Homo sapiens
tagtataattgttctggaatca

SEQ ID NO: 7941927 - DNA, 22 bp, Homo sapiens
tagtatagattgaagcagatca

SEQ ID NO: 7941928 - DNA, 22 bp, Homo sapiens
tagtatagattgaagcagatca

SEQ ID NO: 7941929 - DNA, 22 bp, Homo sapiens
tagtatagattgaagcagatca

SEQ ID NO: 7941930 - DNA, 22 bp, Homo sapiens
tagtatagattgaagcagatca

SEQ ID NO: 7941931 - DNA, 22 bp, Homo sapiens
tagtatatctttagtacatagt

SEQ ID NO: 7941932 - DNA, 22 bp, Homo sapiens
tagtatatctttagtacatagt

SEQ ID NO: 7941933 - DNA, 22 bp, Homo sapiens
tagtatatctttagtacatagt

SEQ ID NO: 7941934 - DNA, 22 bp, Homo sapiens
tagtatatctttagtacatagt

SEQ ID NO: 7941935 - DNA, 22 bp, Homo sapiens
tagtatattttgttgcaattca

SEQ ID NO: 7941936 - DNA, 22 bp, Homo sapiens
tagtatattttgttgcaattca

SEQ ID NO: 7941937 - DNA, 22 bp, Homo sapiens
tagtacagtttactttcagcgc

SEQ ID NO: 7941938 - DNA, 22 bp, Homo sapiens
tagtacagttttggcacatgga

SEQ ID NO: 7941939 - DNA, 22 bp, Homo sapiens
tagtactacgttttctactatc

SEQ ID NO: 7941940 - DNA, 22 bp, Homo sapiens
tagtacagttttggcacatgga

SEQ ID NO: 7941941 - DNA, 22 bp, Homo sapiens
tagtacttatctctgtcattgt

SEQ ID NO: 7941942 - DNA, 22 bp, Homo sapiens
tagtacttatctctgtcattgt

SEQ ID NO: 7941943 - DNA, 22 bp, Homo sapiens
tagtagcaaaactcatctcttt

SEQ ID NO: 7941944 - DNA, 22 bp, Homo sapiens
tagtagcagggggtacctctca

SEQ ID NO: 7941945 - DNA, 19 bp, Homo sapiens
tagtagtagaaaacaatac

SEQ ID NO: 7941946 - DNA, 20 bp, Homo sapiens
tagtagtaaaaagataatct

SEQ ID NO: 7941947 - DNA, 22 bp, Homo sapiens
tagtagtgagtctttataaata

SEQ ID NO: 7941948 - DNA, 22 bp, Homo sapiens
tagtagtatcacaaagtaaaat

SEQ ID NO: 7941949 - DNA, 22 bp, Homo sapiens
taggtttactgaattagtggaa

SEQ ID NO: 7941950 - DNA, 22 bp, Homo sapiens
taggtttactgaattagtggaa

SEQ ID NO: 7941951 - DNA, 22 bp, Homo sapiens
taggtttaggagtgaaggtgaa

SEQ ID NO: 7941952 - DNA, 22 bp, Homo sapiens
taggtttaggagtgaaggtgaa

SEQ ID NO: 7941953 - DNA, 22 bp, Homo sapiens
taggtttaggagtgaaggtgaa

SEQ ID NO: 7941954 - DNA, 22 bp, Homo sapiens
taggtttaggagtgaaggtgaa

SEQ ID NO: 7941955 - DNA, 22 bp, Homo sapiens
taggtttcagaggtgccgggaa

SEQ ID NO: 7941956 - DNA, 22 bp, Homo sapiens
taggtttaggagtgaaggtgaa

SEQ ID NO: 7941957 - DNA, 22 bp, Homo sapiens
taggtttaggagtgaaggtgaa

SEQ ID NO: 7941958 - DNA, 22 bp, Homo sapiens
tagtaaaaggtcttcctttgtt

SEQ ID NO: 7941959 - DNA, 22 bp, Homo sapiens
taggtttcagaggtgccgggaa

SEQ ID NO: 7941960 - DNA, 22 bp, Homo sapiens
tagtaaaagtttagttgaaagt

SEQ ID NO: 7941961 - DNA, 22 bp, Homo sapiens
tagtaaaagtttagttgaaagt

SEQ ID NO: 7941962 - DNA, 22 bp, Homo sapiens
tagtaaacagctctgccacaat

SEQ ID NO: 7941963 - DNA, 22 bp, Homo sapiens
tagtaaaagtttagttgaaagt

SEQ ID NO: 7941964 - DNA, 22 bp, Homo sapiens
tagtaaaagtttagttgaaagt

SEQ ID NO: 7941965 - DNA, 22 bp, Homo sapiens
tagtaaaaggtcttcctttgtt

SEQ ID NO: 7941966 - DNA, 22 bp, Homo sapiens
tagtaaaagtttagttgaaagt

SEQ ID NO: 7941967 - DNA, 22 bp, Homo sapiens
tagtaaacccatgaggcttaaa

SEQ ID NO: 7941968 - DNA, 22 bp, Homo sapiens
tagtaaaagtttagttgaaagt

SEQ ID NO: 7941969 - DNA, 22 bp, Homo sapiens
tagtaaacaggcaagggaccac

SEQ ID NO: 7941970 - DNA, 22 bp, Homo sapiens
tagtaaagtgtcttaacacata

SEQ ID NO: 7941971 - DNA, 22 bp, Homo sapiens
tagtaaagtgtcttaacacata

SEQ ID NO: 7941972 - DNA, 22 bp, Homo sapiens
tagtacagtttaaatattaata

SEQ ID NO: 7941973 - DNA, 22 bp, Homo sapiens
taggttcagagaactgaaaata

SEQ ID NO: 7941974 - DNA, 22 bp, Homo sapiens
taggttcatattctagaatcat

SEQ ID NO: 7941975 - DNA, 22 bp, Homo sapiens
taggtttactgaattagtggaa

SEQ ID NO: 7941976 - DNA, 22 bp, Homo sapiens
taggtttactgaattagtggaa

SEQ ID NO: 7941977 - DNA, 22 bp, Homo sapiens
taggtttactgaattagtggaa

SEQ ID NO: 7941978 - DNA, 22 bp, Homo sapiens
taggtttactgaattagtggaa

SEQ ID NO: 7941979 - DNA, 22 bp, Homo sapiens
taggtttactgaattagtggaa

SEQ ID NO: 7941980 - DNA, 22 bp, Homo sapiens
taggttccatgagggaggcaaa

SEQ ID NO: 7941981 - DNA, 22 bp, Homo sapiens
taggttctctattgcccccaaa

SEQ ID NO: 7941982 - DNA, 22 bp, Homo sapiens
taggttccatttaaacaaagaa

SEQ ID NO: 7941983 - DNA, 22 bp, Homo sapiens
taggttcacacatcttccagat

SEQ ID NO: 7941984 - DNA, 18 bp, Homo sapiens
taggttacagccagccag

SEQ ID NO: 7941985 - DNA, 22 bp, Homo sapiens
taggtgtgattcgaagagcaaa

SEQ ID NO: 7941986 - DNA, 22 bp, Homo sapiens
taggtgtgggctcaggaatgtg

SEQ ID NO: 7941987 - DNA, 22 bp, Homo sapiens
taggctgggagcctgaggctag

SEQ ID NO: 7941988 - DNA, 22 bp, Homo sapiens
taggctgggaagaaagattctc

SEQ ID NO: 7941989 - DNA, 22 bp, Homo sapiens
taggctgggagcctgaggctag

SEQ ID NO: 7941990 - DNA, 22 bp, Homo sapiens
taggctggaacttaggcagagg

SEQ ID NO: 7941991 - DNA, 22 bp, Homo sapiens
taggctggaacttaggcagagg

SEQ ID NO: 7941992 - DNA, 22 bp, Homo sapiens
taggctggaacttaggcagagg

SEQ ID NO: 7941993 - DNA, 22 bp, Homo sapiens
taggctggaggaagcagtgcct

SEQ ID NO: 7941994 - DNA, 22 bp, Homo sapiens
taggctggaggaagcagtgcct

SEQ ID NO: 7941995 - DNA, 22 bp, Homo sapiens
taggctggaggaagcagtgcct

SEQ ID NO: 7941996 - DNA, 22 bp, Homo sapiens
taggctgaggttgatgccaggg

SEQ ID NO: 7941997 - DNA, 22 bp, Homo sapiens
taggctgacttgtttcataaag

SEQ ID NO: 7941998 - DNA, 22 bp, Homo sapiens
taggctgaggttgatgccaggg

SEQ ID NO: 7941999 - DNA, 22 bp, Homo sapiens
taggctgcaagcatagaacaaa

SEQ ID NO: 7942000 - DNA, 22 bp, Homo sapiens
taggctgctcaccaggctcaga

SEQ ID NO: 7942001 - DNA, 22 bp, Homo sapiens
taggctgaggttgatgccaggg

SEQ ID NO: 7942002 - DNA, 22 bp, Homo sapiens
taggctggaacttaggcagagg

SEQ ID NO: 7942003 - DNA, 22 bp, Homo sapiens
taggctgctcaccaggctcaga

SEQ ID NO: 7942004 - DNA, 22 bp, Homo sapiens
taggctggaacttaggcagagg

SEQ ID NO: 7942005 - DNA, 22 bp, Homo sapiens
taggctgacttgtttcataaag

SEQ ID NO: 7942006 - DNA, 22 bp, Homo sapiens
taggctgacttgtttcataaag

SEQ ID NO: 7942007 - DNA, 22 bp, Homo sapiens
taggctgagctaagagagctta

SEQ ID NO: 7942008 - DNA, 22 bp, Homo sapiens
taggctgagctaagagagctta

SEQ ID NO: 7942009 - DNA, 22 bp, Homo sapiens
taggctgagcttgtagatcgta

SEQ ID NO: 7942010 - DNA, 22 bp, Homo sapiens
taggctgagcttgtagatcgta

SEQ ID NO: 7942011 - DNA, 22 bp, Homo sapiens
taggctgagcttgtagatcgta

SEQ ID NO: 7942012 - DNA, 22 bp, Homo sapiens
taggctgagctaagagagctta

SEQ ID NO: 7942013 - DNA, 22 bp, Homo sapiens
tagtatttataatcatgcttaa

SEQ ID NO: 7942014 - DNA, 22 bp, Homo sapiens
tagtatctttctatatttccca

SEQ ID NO: 7942015 - DNA, 22 bp, Homo sapiens
tagtatctttctatatttccca

SEQ ID NO: 7942016 - DNA, 22 bp, Homo sapiens
tagtatttaatcacttttgtct

SEQ ID NO: 7942017 - DNA, 22 bp, Homo sapiens
tagtatttaatcacttttgtct

SEQ ID NO: 7942018 - DNA, 22 bp, Homo sapiens
tagtcaaacctcagaatacccc

SEQ ID NO: 7942019 - DNA, 22 bp, Homo sapiens
tagtcaactagtgagcatatgg

SEQ ID NO: 7942020 - DNA, 22 bp, Homo sapiens
tagtcacaaccttcaagttgtc

SEQ ID NO: 7942021 - DNA, 22 bp, Homo sapiens
tagtcaagattggaataatgta

SEQ ID NO: 7942022 - DNA, 22 bp, Homo sapiens
tagtcaaacctcagaatacccc

SEQ ID NO: 7942023 - DNA, 22 bp, Homo sapiens
tagtcaagattggaataatgta

SEQ ID NO: 7942024 - DNA, 22 bp, Homo sapiens
tagtattttagaaaaccatgaa

SEQ ID NO: 7942025 - DNA, 20 bp, Homo sapiens
tagtatttgcataaggatag

SEQ ID NO: 7942026 - DNA, 22 bp, Homo sapiens
tagtatttgcagatttgtgtca

SEQ ID NO: 7942027 - DNA, 20 bp, Homo sapiens
tagtatttgcataaggatag

SEQ ID NO: 7942028 - DNA, 22 bp, Homo sapiens
tagtcacagtacaggataaaga

SEQ ID NO: 7942029 - DNA, 22 bp, Homo sapiens
tagtcacagtacaggataaaga

SEQ ID NO: 7942030 - DNA, 22 bp, Homo sapiens
tagtcacaggaagtttcaatgt

SEQ ID NO: 7942031 - DNA, 22 bp, Homo sapiens
tagtcacacaattgtgtacatt

SEQ ID NO: 7942032 - DNA, 22 bp, Homo sapiens
tagtcacacaattgtgtacatt

SEQ ID NO: 7942033 - DNA, 22 bp, Homo sapiens
tagtcacacaattgtgtacatt

SEQ ID NO: 7942034 - DNA, 22 bp, Homo sapiens
tagtcacatgatcacaggatcg

SEQ ID NO: 7942035 - DNA, 22 bp, Homo sapiens
tagtcaccagctacaggacagc

SEQ ID NO: 7942036 - DNA, 22 bp, Homo sapiens
tagtcacctttggcacctgcaa

SEQ ID NO: 7942037 - DNA, 22 bp, Homo sapiens
tagtcacttttttaccatgtgc

SEQ ID NO: 7942038 - DNA, 22 bp, Homo sapiens
tagtcacctctttaaatgtcct

SEQ ID NO: 7942039 - DNA, 22 bp, Homo sapiens
tagtcagacccaagagagccat

SEQ ID NO: 7942040 - DNA, 22 bp, Homo sapiens
tagtcagagtcttctctgttgt

SEQ ID NO: 7942041 - DNA, 22 bp, Homo sapiens
tagtcagatatatgacttacgt

SEQ ID NO: 7942042 - DNA, 22 bp, Homo sapiens
tagtcagagtcttctctgttgt

SEQ ID NO: 7942043 - DNA, 22 bp, Homo sapiens
tagtcagggatgcaattatgtg

SEQ ID NO: 7942044 - DNA, 22 bp, Homo sapiens
tagtcagtagcaaggtattttg

SEQ ID NO: 7942045 - DNA, 22 bp, Homo sapiens
tagtcagtatgaaattgctcaa

SEQ ID NO: 7942046 - DNA, 23 bp, Homo sapiens
tagtcagtatgtaagtctaattg

SEQ ID NO: 7942047 - DNA, 22 bp, Homo sapiens
tagtcagtcttacatatttgaa

SEQ ID NO: 7942048 - DNA, 22 bp, Homo sapiens
tagtcagtgatcagtggagttg

SEQ ID NO: 7942049 - DNA, 22 bp, Homo sapiens
tagtcagtgcacagacacttgt

SEQ ID NO: 7942050 - DNA, 22 bp, Homo sapiens
tagtcagttgggtctagtggca

SEQ ID NO: 7942051 - DNA, 22 bp, Homo sapiens
tagtccagccttgggtgtagcc

SEQ ID NO: 7942052 - DNA, 22 bp, Homo sapiens
tagtccacagactctacagcat

SEQ ID NO: 7942053 - DNA, 22 bp, Homo sapiens
tagtccacagactctacagcat

SEQ ID NO: 7942054 - DNA, 22 bp, Homo sapiens
tagtccagaaactgagcttata

SEQ ID NO: 7942055 - DNA, 22 bp, Homo sapiens
tagtccacaaaaagtcttgacc

SEQ ID NO: 7942056 - DNA, 20 bp, Homo sapiens
tagtccaatacttagtccat

SEQ ID NO: 7942057 - DNA, 20 bp, Homo sapiens
tagtccaatacttagtccat

SEQ ID NO: 7942058 - DNA, 22 bp, Homo sapiens
tagtcagttgggtctagtggca

SEQ ID NO: 7942059 - DNA, 22 bp, Homo sapiens
tagtcatctgggtaatgttcaa

SEQ ID NO: 7942060 - DNA, 22 bp, Homo sapiens
tagtcattctccttacaaagcc

SEQ ID NO: 7942061 - DNA, 23 bp, Homo sapiens
tagtgtatatcaacatttgtccc

SEQ ID NO: 7942062 - DNA, 23 bp, Homo sapiens
tagtgtatatcaacatttgtccc

SEQ ID NO: 7942063 - DNA, 22 bp, Homo sapiens
tagtgtatctgttcttttatct

SEQ ID NO: 7942064 - DNA, 22 bp, Homo sapiens
tagtgggttaactagaagttaa

SEQ ID NO: 7942065 - DNA, 22 bp, Homo sapiens
tagtgggtttatacaatttaaa

SEQ ID NO: 7942066 - DNA, 22 bp, Homo sapiens
tagtggggcctgggagggttcc

SEQ ID NO: 7942067 - DNA, 22 bp, Homo sapiens
tagtgggtagaggccagggacg

SEQ ID NO: 7942068 - DNA, 22 bp, Homo sapiens
tagtggggcctgggagggttcc

SEQ ID NO: 7942069 - DNA, 22 bp, Homo sapiens
tagtgggtcttataattttagg

SEQ ID NO: 7942070 - DNA, 22 bp, Homo sapiens
tagtgggtgatttgatgaggaa

SEQ ID NO: 7942071 - DNA, 22 bp, Homo sapiens
tagtgggtggaggccagggatg

SEQ ID NO: 7942072 - DNA, 22 bp, Homo sapiens
tagtgggtgatttgatgaggaa

SEQ ID NO: 7942073 - DNA, 22 bp, Homo sapiens
tagtctctaggaggggaaaaga

SEQ ID NO: 7942074 - DNA, 22 bp, Homo sapiens
tagtctctaggaggggaaaaga

SEQ ID NO: 7942075 - DNA, 22 bp, Homo sapiens
tagtggctgcagggctgtttga

SEQ ID NO: 7942076 - DNA, 22 bp, Homo sapiens
tagtggcattgttgtgaggatt

SEQ ID NO: 7942077 - DNA, 22 bp, Homo sapiens
tagtggctgcagggctgtttga

SEQ ID NO: 7942078 - DNA, 22 bp, Homo sapiens
tagtggctgcttcattggtgag

SEQ ID NO: 7942079 - DNA, 22 bp, Homo sapiens
tagtggggaaggaggacaagaa

SEQ ID NO: 7942080 - DNA, 22 bp, Homo sapiens
tagtggatgattatcagatcat

SEQ ID NO: 7942081 - DNA, 22 bp, Homo sapiens
tagtggcaaaagcattttgggt

SEQ ID NO: 7942082 - DNA, 17 bp, Homo sapiens
tagtggcaggaaatgaa

SEQ ID NO: 7942083 - DNA, 22 bp, Homo sapiens
tagtggcattgttgtgaggatt

SEQ ID NO: 7942084 - DNA, 22 bp, Homo sapiens
tagtccttacttactagaataa

SEQ ID NO: 7942085 - DNA, 22 bp, Homo sapiens
tagtcctgaccagctggatgtt

SEQ ID NO: 7942086 - DNA, 22 bp, Homo sapiens
tagtcctgaccagctggatgtt

SEQ ID NO: 7942087 - DNA, 22 bp, Homo sapiens
tagtcctgaccttgccaccagc

SEQ ID NO: 7942088 - DNA, 22 bp, Homo sapiens
tagtccttggtaaaattctatg

SEQ ID NO: 7942089 - DNA, 22 bp, Homo sapiens
tagtcctttatcaaacatttat

SEQ ID NO: 7942090 - DNA, 22 bp, Homo sapiens
tagtcccattttgaggtatttg

SEQ ID NO: 7942091 - DNA, 22 bp, Homo sapiens
tagtccattttcacactgctga

SEQ ID NO: 7942092 - DNA, 22 bp, Homo sapiens
tagtcctaaaattcagctatat

SEQ ID NO: 7942093 - DNA, 22 bp, Homo sapiens
tagtcccggaactccttcaggt

SEQ ID NO: 7942094 - DNA, 22 bp, Homo sapiens
tagtccagtgtttgaattcaat

SEQ ID NO: 7942095 - DNA, 22 bp, Homo sapiens
tagtccagtaaaacagctaacg

SEQ ID NO: 7942096 - DNA, 22 bp, Homo sapiens
tagtccaggtttccatctccac

SEQ ID NO: 7942097 - DNA, 22 bp, Homo sapiens
tagtccaggtttccatctccac

SEQ ID NO: 7942098 - DNA, 22 bp, Homo sapiens
tagtccaggacaatcttcatat

SEQ ID NO: 7942099 - DNA, 22 bp, Homo sapiens
tagtccaggttaatccctgcct

SEQ ID NO: 7942100 - DNA, 20 bp, Homo sapiens
tagtccagtaggggggcttt

SEQ ID NO: 7942101 - DNA, 23 bp, Homo sapiens
tagtccagtatggcaatgctatg

SEQ ID NO: 7942102 - DNA, 15 bp, Homo sapiens
tagtccagtgatagt

SEQ ID NO: 7942103 - DNA, 20 bp, Homo sapiens
tagtccagtaggggggcttt

SEQ ID NO: 7942104 - DNA, 22 bp, Homo sapiens
tagtccagtaaaacagctaacg

SEQ ID NO: 7942105 - DNA, 22 bp, Homo sapiens
tagtccaggaaggtggggcaga

SEQ ID NO: 7942106 - DNA, 22 bp, Homo sapiens
tagtccagaaactgagcttata

SEQ ID NO: 7942107 - DNA, 22 bp, Homo sapiens
tagtccagccttgggtgtagcc

SEQ ID NO: 7942108 - DNA, 22 bp, Homo sapiens
tagtccagccttgggtgtagcc

SEQ ID NO: 7942109 - DNA, 22 bp, Homo sapiens
tagtccaggttaatccctgcct

SEQ ID NO: 7942110 - DNA, 22 bp, Homo sapiens
tagtccaggttaatccctgcct

SEQ ID NO: 7942111 - DNA, 22 bp, Homo sapiens
tagtccaggaaggtggggcaga

SEQ ID NO: 7942112 - DNA, 22 bp, Homo sapiens
tagtccaggacaatcttcatat

SEQ ID NO: 7942113 - DNA, 22 bp, Homo sapiens
tagcccagaaagcaaatgtctc

SEQ ID NO: 7942114 - DNA, 22 bp, Homo sapiens
tagcccagaagagggaagcaac

SEQ ID NO: 7942115 - DNA, 22 bp, Homo sapiens
tagcccagaagagggaagcaac

SEQ ID NO: 7942116 - DNA, 19 bp, Homo sapiens
tagcccagagcctggctac

SEQ ID NO: 7942117 - DNA, 19 bp, Homo sapiens
tagcccagagcctggctac

SEQ ID NO: 7942118 - DNA, 19 bp, Homo sapiens
tagcccagagcctggctac

SEQ ID NO: 7942119 - DNA, 19 bp, Homo sapiens
tagcccagagcctggctac

SEQ ID NO: 7942120 - DNA, 22 bp, Homo sapiens
tagcccagagagccaggggctt

SEQ ID NO: 7942121 - DNA, 22 bp, Homo sapiens
tagcccagagagccaggggctt

SEQ ID NO: 7942122 - DNA, 22 bp, Homo sapiens
tagcccagatgattgaaccatg

SEQ ID NO: 7942123 - DNA, 22 bp, Homo sapiens
tagcccagcatgagcagagctg

SEQ ID NO: 7942124 - DNA, 22 bp, Homo sapiens
tagcccagatgattgaaccatg

SEQ ID NO: 7942125 - DNA, 22 bp, Homo sapiens
tagcccagatgattgaaccatg

SEQ ID NO: 7942126 - DNA, 22 bp, Homo sapiens
tagcccagatgattgaaccatg

SEQ ID NO: 7942127 - DNA, 22 bp, Homo sapiens
tagcccagagtcccaattccag

SEQ ID NO: 7942128 - DNA, 22 bp, Homo sapiens
tagcccagatacaaatcatgat

SEQ ID NO: 7942129 - DNA, 22 bp, Homo sapiens
taggaaagaaatgagtagtgat

SEQ ID NO: 7942130 - DNA, 22 bp, Homo sapiens
taggaaactctcagctggtcat

SEQ ID NO: 7942131 - DNA, 16 bp, Homo sapiens
taggaaactgcatgtg

SEQ ID NO: 7942132 - DNA, 22 bp, Homo sapiens
taggaaatatttgaacatagga

SEQ ID NO: 7942133 - DNA, 22 bp, Homo sapiens
taggaaatcagagaaagaggtg

SEQ ID NO: 7942134 - DNA, 22 bp, Homo sapiens
taggaaatatttgaacatagga

SEQ ID NO: 7942135 - DNA, 22 bp, Homo sapiens
taggaaatcagagaaagaggtg

SEQ ID NO: 7942136 - DNA, 22 bp, Homo sapiens
taggaaatcagagaaagaggtg

SEQ ID NO: 7942137 - DNA, 20 bp, Homo sapiens
taggaaatcgaggcagggtg

SEQ ID NO: 7942138 - DNA, 20 bp, Homo sapiens
taggaaatcgaggcagggtg

SEQ ID NO: 7942139 - DNA, 20 bp, Homo sapiens
taggaaatcgaggcagggtg

SEQ ID NO: 7942140 - DNA, 20 bp, Homo sapiens
taggaaatcgaggcagggtg

SEQ ID NO: 7942141 - DNA, 22 bp, Homo sapiens
taggaaatgaatgcaggctccc

SEQ ID NO: 7942142 - DNA, 22 bp, Homo sapiens
taggaaatattgatttcagtca

SEQ ID NO: 7942143 - DNA, 22 bp, Homo sapiens
taggaaatattgatttcagtca

SEQ ID NO: 7942144 - DNA, 22 bp, Homo sapiens
taggaaatattgatttcagtca

SEQ ID NO: 7942145 - DNA, 22 bp, Homo sapiens
taggaaatatttgaacatagga

SEQ ID NO: 7942146 - DNA, 22 bp, Homo sapiens
taggaaatatttgaacatagga

SEQ ID NO: 7942147 - DNA, 22 bp, Homo sapiens
taggaaatatttgaacatagga

SEQ ID NO: 7942148 - DNA, 22 bp, Homo sapiens
taggaaatatttgaacatagga

SEQ ID NO: 7942149 - DNA, 22 bp, Homo sapiens
taggaaatatttgaacatagga

SEQ ID NO: 7942150 - DNA, 18 bp, Homo sapiens
taggaaatagggctgtga

SEQ ID NO: 7942151 - DNA, 18 bp, Homo sapiens
taggaaatagggctgtga

SEQ ID NO: 7942152 - DNA, 22 bp, Homo sapiens
taggaaatactgtaagtttggg

SEQ ID NO: 7942153 - DNA, 22 bp, Homo sapiens
taggaaatactgtaagtttggg

SEQ ID NO: 7942154 - DNA, 22 bp, Homo sapiens
taggaaataattcactctggct

SEQ ID NO: 7942155 - DNA, 20 bp, Homo sapiens
taggaaatatgtttttaccc

SEQ ID NO: 7942156 - DNA, 20 bp, Homo sapiens
taggaaatatgtttttaccc

SEQ ID NO: 7942157 - DNA, 18 bp, Homo sapiens
taggaaatagggctgtga

SEQ ID NO: 7942158 - DNA, 20 bp, Homo sapiens
taggaaatatgtttttaccc

SEQ ID NO: 7942159 - DNA, 22 bp, Homo sapiens
taggaaataaatacttatggtt

SEQ ID NO: 7942160 - DNA, 22 bp, Homo sapiens
taggaaataaatacttatggtt

SEQ ID NO: 7942161 - DNA, 22 bp, Homo sapiens
taggaaataaatacttatggtt

SEQ ID NO: 7942162 - DNA, 22 bp, Homo sapiens
taggaaataattcactctggct

SEQ ID NO: 7942163 - DNA, 22 bp, Homo sapiens
taggaaataattcactctggct

SEQ ID NO: 7942164 - DNA, 22 bp, Homo sapiens
taggaaagcagtagagccagga

SEQ ID NO: 7942165 - DNA, 22 bp, Homo sapiens
taggaaatgctccattgcataa

SEQ ID NO: 7942166 - DNA, 22 bp, Homo sapiens
taggaaatggctcagttactgc

SEQ ID NO: 7942167 - DNA, 22 bp, Homo sapiens
taggaaatggctcagttactgc

SEQ ID NO: 7942168 - DNA, 22 bp, Homo sapiens
taggaaatggctcagttactgc

SEQ ID NO: 7942169 - DNA, 22 bp, Homo sapiens
taggaaatggctcagttactgc

SEQ ID NO: 7942170 - DNA, 22 bp, Homo sapiens
taggaaatggctcagttactgc

SEQ ID NO: 7942171 - DNA, 22 bp, Homo sapiens
taggaaatggctcagttactgc

SEQ ID NO: 7942172 - DNA, 23 bp, Homo sapiens
taggaactttatatttgttagtc

SEQ ID NO: 7942173 - DNA, 22 bp, Homo sapiens
taggaacttagatgaacacatg

SEQ ID NO: 7942174 - DNA, 22 bp, Homo sapiens
taggaactagtagatgtgtaaa

SEQ ID NO: 7942175 - DNA, 21 bp, Homo sapiens
taggaactgttctgagtggtc

SEQ ID NO: 7942176 - DNA, 22 bp, Homo sapiens
taggaactagtagatgtgtaaa

SEQ ID NO: 7942177 - DNA, 22 bp, Homo sapiens
taggaactagactcatgactca

SEQ ID NO: 7942178 - DNA, 22 bp, Homo sapiens
taggaactagactcatgactca

SEQ ID NO: 7942179 - DNA, 22 bp, Homo sapiens
taggaagaagcagccttgctta

SEQ ID NO: 7942180 - DNA, 23 bp, Homo sapiens
taggaagacagcaaaagaatgga

SEQ ID NO: 7942181 - DNA, 22 bp, Homo sapiens
taggaaatgctccattgcataa

SEQ ID NO: 7942182 - DNA, 22 bp, Homo sapiens
taggaaatgctccattgcataa

SEQ ID NO: 7942183 - DNA, 22 bp, Homo sapiens
taggaaatgctgtcttattgta

SEQ ID NO: 7942184 - DNA, 22 bp, Homo sapiens
taggaaatgctgtcttattgta

SEQ ID NO: 7942185 - DNA, 22 bp, Homo sapiens
taggaaatgctgtcttattgta

SEQ ID NO: 7942186 - DNA, 22 bp, Homo sapiens
taggaaatgctgtcttattgta

SEQ ID NO: 7942187 - DNA, 22 bp, Homo sapiens
taggaaatgctgtcttattgta

SEQ ID NO: 7942188 - DNA, 22 bp, Homo sapiens
taggaaatgctgtcttattgta

SEQ ID NO: 7942189 - DNA, 22 bp, Homo sapiens
taggaaatgaggccaacatgtg

SEQ ID NO: 7942190 - DNA, 22 bp, Homo sapiens
taggaaatgaatgcaggctccc

SEQ ID NO: 7942191 - DNA, 22 bp, Homo sapiens
taggaaatgccagccttcctcc

SEQ ID NO: 7942192 - DNA, 22 bp, Homo sapiens
taggaaatgccagccttcctcc

SEQ ID NO: 7942193 - DNA, 22 bp, Homo sapiens
taggaaatgctccattgcataa

SEQ ID NO: 7942194 - DNA, 22 bp, Homo sapiens
taggaaatgctccattgcataa

SEQ ID NO: 7942195 - DNA, 22 bp, Homo sapiens
taggaaatgctccattgcataa

SEQ ID NO: 7942196 - DNA, 22 bp, Homo sapiens
taggaaatgctccattgcataa

SEQ ID NO: 7942197 - DNA, 22 bp, Homo sapiens
taggaaatgctccattgcataa

SEQ ID NO: 7942198 - DNA, 22 bp, Homo sapiens
taggaaatgctccattgcataa

SEQ ID NO: 7942199 - DNA, 22 bp, Homo sapiens
taggaagatgagtatcaacttg

SEQ ID NO: 7942200 - DNA, 22 bp, Homo sapiens
taggaagatgagtatcaacttg

SEQ ID NO: 7942201 - DNA, 22 bp, Homo sapiens
taggaagatgagtatcaacttg

SEQ ID NO: 7942202 - DNA, 22 bp, Homo sapiens
taggaagatcaagtttatctca

SEQ ID NO: 7942203 - DNA, 22 bp, Homo sapiens
taggaagatcaagtttatctca

SEQ ID NO: 7942204 - DNA, 23 bp, Homo sapiens
taggaagacagcaaaagaatgga

SEQ ID NO: 7942205 - DNA, 23 bp, Homo sapiens
taggaagacagcaaaagaatgga

SEQ ID NO: 7942206 - DNA, 23 bp, Homo sapiens
taggaagacagcaaaagaatgga

SEQ ID NO: 7942207 - DNA, 22 bp, Homo sapiens
taggaagataaacatttgtatg

SEQ ID NO: 7942208 - DNA, 22 bp, Homo sapiens
taggaagataaacatttgtatg

SEQ ID NO: 7942209 - DNA, 22 bp, Homo sapiens
taggaagcattatcatcactga

SEQ ID NO: 7942210 - DNA, 22 bp, Homo sapiens
taggaagcatttaaagagatgg

SEQ ID NO: 7942211 - DNA, 22 bp, Homo sapiens
taggaagatgagtatcaacttg

SEQ ID NO: 7942212 - DNA, 22 bp, Homo sapiens
taggaagcctgctgtgcacagc

SEQ ID NO: 7942213 - DNA, 22 bp, Homo sapiens
taggaagcctaaattaagtggt

SEQ ID NO: 7942214 - DNA, 22 bp, Homo sapiens
taggaagctctttgttttgtga

SEQ ID NO: 7942215 - DNA, 18 bp, Homo sapiens
taggaagcttaatgtttt

SEQ ID NO: 7942216 - DNA, 22 bp, Homo sapiens
taggaagctgagcagcattcct

SEQ ID NO: 7942217 - DNA, 22 bp, Homo sapiens
taggaaggaagagcctcagatt

SEQ ID NO: 7942218 - DNA, 22 bp, Homo sapiens
taggaagtagataggttgttct

SEQ ID NO: 7942219 - DNA, 22 bp, Homo sapiens
taggaatccagatctagactgt

SEQ ID NO: 7942220 - DNA, 22 bp, Homo sapiens
taggaagtctgtgatgttgttt

SEQ ID NO: 7942221 - DNA, 22 bp, Homo sapiens
taggaatgaaaatggccataga

SEQ ID NO: 7942222 - DNA, 22 bp, Homo sapiens
taggaatgaaagtgttttgaaa

SEQ ID NO: 7942223 - DNA, 22 bp, Homo sapiens
taggaatgaagaagtatgatat

SEQ ID NO: 7942224 - DNA, 22 bp, Homo sapiens
taggaatgaaggataaggtgtg

SEQ ID NO: 7942225 - DNA, 22 bp, Homo sapiens
taggaatgagaaagaattagat

SEQ ID NO: 7942226 - DNA, 22 bp, Homo sapiens
taggaatgagagggtgaggatt

SEQ ID NO: 7942227 - DNA, 22 bp, Homo sapiens
taggaatgataatagtaaagag

SEQ ID NO: 7942228 - DNA, 22 bp, Homo sapiens
taggaatgatgtatttttctct

SEQ ID NO: 7942229 - DNA, 22 bp, Homo sapiens
taggaatgatgtatttttctct

SEQ ID NO: 7942230 - DNA, 22 bp, Homo sapiens
taggaatgattggaattccagg

SEQ ID NO: 7942231 - DNA, 22 bp, Homo sapiens
taggaaggtgtttttaaggagc

SEQ ID NO: 7942232 - DNA, 22 bp, Homo sapiens
taggaaggtgtttttaaggagc

SEQ ID NO: 7942233 - DNA, 22 bp, Homo sapiens
taggaaggtccatgtcttatct

SEQ ID NO: 7942234 - DNA, 22 bp, Homo sapiens
taggaaggtccatgtcttatct

SEQ ID NO: 7942235 - DNA, 22 bp, Homo sapiens
taggaaggtccatgtcttatct

SEQ ID NO: 7942236 - DNA, 22 bp, Homo sapiens
taggaagggctcagggctcggt

SEQ ID NO: 7942237 - DNA, 22 bp, Homo sapiens
taggaaggaggccatcttggcg

SEQ ID NO: 7942238 - DNA, 22 bp, Homo sapiens
taggaaggaggccatcttggcg

SEQ ID NO: 7942239 - DNA, 22 bp, Homo sapiens
taggaaggcctgtcactacttg

SEQ ID NO: 7942240 - DNA, 22 bp, Homo sapiens
taggaaggcctgtcactacttg

SEQ ID NO: 7942241 - DNA, 22 bp, Homo sapiens
taggaaggcctgtcactacttg

SEQ ID NO: 7942242 - DNA, 22 bp, Homo sapiens
taggaagggaaaggcttcaact

SEQ ID NO: 7942243 - DNA, 22 bp, Homo sapiens
taggaagggaaaggcttcaact

SEQ ID NO: 7942244 - DNA, 22 bp, Homo sapiens
taggacagagctggttacaatg

SEQ ID NO: 7942245 - DNA, 22 bp, Homo sapiens
taggacagagatttgttttatg

SEQ ID NO: 7942246 - DNA, 22 bp, Homo sapiens
taggacagagctggttacaatg

SEQ ID NO: 7942247 - DNA, 23 bp, Homo sapiens
taggacagaatgcagaaaaatac

SEQ ID NO: 7942248 - DNA, 22 bp, Homo sapiens
taggacaattatcaactaggct

SEQ ID NO: 7942249 - DNA, 22 bp, Homo sapiens
taggaatttttgtaatggtact

SEQ ID NO: 7942250 - DNA, 22 bp, Homo sapiens
taggaattttgcatgggaattt

SEQ ID NO: 7942251 - DNA, 22 bp, Homo sapiens
taggaattgcccgtggggtcct

SEQ ID NO: 7942252 - DNA, 22 bp, Homo sapiens
taggaattgaaaagtggtctga

SEQ ID NO: 7942253 - DNA, 22 bp, Homo sapiens
taggaattatgatgctatcaag

SEQ ID NO: 7942254 - DNA, 22 bp, Homo sapiens
taggaatgtctatgcagtgagg

SEQ ID NO: 7942255 - DNA, 22 bp, Homo sapiens
taggaatgtggcaggcagaaca

SEQ ID NO: 7942256 - DNA, 22 bp, Homo sapiens
taggaatgtttttatcaactta

SEQ ID NO: 7942257 - DNA, 22 bp, Homo sapiens
taggaatgcagtgagacacaga

SEQ ID NO: 7942258 - DNA, 22 bp, Homo sapiens
taggaatgattggaattccagg

SEQ ID NO: 7942259 - DNA, 22 bp, Homo sapiens
taggaatgcagatgcataataa

SEQ ID NO: 7942260 - DNA, 22 bp, Homo sapiens
taggaatgcatgggggattctg

SEQ ID NO: 7942261 - DNA, 22 bp, Homo sapiens
taggaatggaacactttgattt

SEQ ID NO: 7942262 - DNA, 22 bp, Homo sapiens
taggaatggcagcagccggggg

SEQ ID NO: 7942263 - DNA, 22 bp, Homo sapiens
taggaatgggcaagacaaagaa

SEQ ID NO: 7942264 - DNA, 22 bp, Homo sapiens
taggaatggtgctcagcagaaa

SEQ ID NO: 7942265 - DNA, 22 bp, Homo sapiens
taggaatgggctatcccaagct

SEQ ID NO: 7942266 - DNA, 19 bp, Homo sapiens
taggaatgtagaatcctag

SEQ ID NO: 7942267 - DNA, 22 bp, Homo sapiens
taggaatgtaatctctgttatg

SEQ ID NO: 7942268 - DNA, 21 bp, Homo sapiens
taggacagcccccctgccctc

SEQ ID NO: 7942269 - DNA, 22 bp, Homo sapiens
taggacaggatcatgatgctgg

SEQ ID NO: 7942270 - DNA, 22 bp, Homo sapiens
taggacaggatcatgatgctgg

SEQ ID NO: 7942271 - DNA, 22 bp, Homo sapiens
taggacagagttccctgatggc

SEQ ID NO: 7942272 - DNA, 22 bp, Homo sapiens
taggacagagttccctgatggc

SEQ ID NO: 7942273 - DNA, 22 bp, Homo sapiens
taggacagagttccctgatggc

SEQ ID NO: 7942274 - DNA, 20 bp, Homo sapiens
taggacaggcagccgagggg

SEQ ID NO: 7942275 - DNA, 22 bp, Homo sapiens
taggacaggctaaaagggataa

SEQ ID NO: 7942276 - DNA, 22 bp, Homo sapiens
taggacaggctaaaagggataa

SEQ ID NO: 7942277 - DNA, 22 bp, Homo sapiens
taggacaggctaaaagggataa

SEQ ID NO: 7942278 - DNA, 22 bp, Homo sapiens
taggacaggatcatgatgctgg

SEQ ID NO: 7942279 - DNA, 20 bp, Homo sapiens
taggacaggcagccgagggg

SEQ ID NO: 7942280 - DNA, 20 bp, Homo sapiens
taggacagggcctggcttct

SEQ ID NO: 7942281 - DNA, 22 bp, Homo sapiens
taggacagggacatctttttga

SEQ ID NO: 7942282 - DNA, 20 bp, Homo sapiens
taggacagggcctggcttct

SEQ ID NO: 7942283 - DNA, 22 bp, Homo sapiens
taggcccagttccgcctcccgg

SEQ ID NO: 7942284 - DNA, 22 bp, Homo sapiens
taggcctggatctctgggagca

SEQ ID NO: 7942285 - DNA, 22 bp, Homo sapiens
taggcctggatctctgggagca

SEQ ID NO: 7942286 - DNA, 23 bp, Homo sapiens
taggcctccctggagcacccagc

SEQ ID NO: 7942287 - DNA, 22 bp, Homo sapiens
taggcctcaggaccccagggct

SEQ ID NO: 7942288 - DNA, 22 bp, Homo sapiens
taggcctcaggaccccagggct

SEQ ID NO: 7942289 - DNA, 19 bp, Homo sapiens
taggccctagctctgcagt

SEQ ID NO: 7942290 - DNA, 22 bp, Homo sapiens
taggcccctagtgccacgtggc

SEQ ID NO: 7942291 - DNA, 22 bp, Homo sapiens
taggcctggtactgtgttaata

SEQ ID NO: 7942292 - DNA, 22 bp, Homo sapiens
taggccttagaggaccaggatt

SEQ ID NO: 7942293 - DNA, 23 bp, Homo sapiens
taggccttagcgatcactgtcag

SEQ ID NO: 7942294 - DNA, 22 bp, Homo sapiens
taggccttgaaagtagctctgc

SEQ ID NO: 7942295 - DNA, 22 bp, Homo sapiens
taggccttctgaggtgacctgc

SEQ ID NO: 7942296 - DNA, 22 bp, Homo sapiens
taggccttcggtgtgtgcttgg

SEQ ID NO: 7942297 - DNA, 22 bp, Homo sapiens
taggccttttgcatgcaatgtt

SEQ ID NO: 7942298 - DNA, 22 bp, Homo sapiens
taggccttttgaattggtttcc

SEQ ID NO: 7942299 - DNA, 22 bp, Homo sapiens
taggccttttctcgtttctcca

SEQ ID NO: 7942300 - DNA, 22 bp, Homo sapiens
taggccttgtcacaggaataca

SEQ ID NO: 7942301 - DNA, 22 bp, Homo sapiens
taggccttgcctggcttcacac

SEQ ID NO: 7942302 - DNA, 22 bp, Homo sapiens
taggccttgaattgagggatgt

SEQ ID NO: 7942303 - DNA, 22 bp, Homo sapiens
taggctcagaaggcactgaaaa

SEQ ID NO: 7942304 - DNA, 22 bp, Homo sapiens
taggctcacatagcactaagtg

SEQ ID NO: 7942305 - DNA, 22 bp, Homo sapiens
taggctcagaggcagaggctga

SEQ ID NO: 7942306 - DNA, 22 bp, Homo sapiens
taggctcagaggcagaggctga

SEQ ID NO: 7942307 - DNA, 22 bp, Homo sapiens
taggctcagggtctcagaggct

SEQ ID NO: 7942308 - DNA, 22 bp, Homo sapiens
taggctcagggctgggtgacgg

SEQ ID NO: 7942309 - DNA, 22 bp, Homo sapiens
taggctcacatagcactaagtg

SEQ ID NO: 7942310 - DNA, 22 bp, Homo sapiens
taggctgaaaggagaggtgaag

SEQ ID NO: 7942311 - DNA, 23 bp, Homo sapiens
taggctctgtaggtagagatggg

SEQ ID NO: 7942312 - DNA, 23 bp, Homo sapiens
taggctctgtaggtagagatggg

SEQ ID NO: 7942313 - DNA, 22 bp, Homo sapiens
taggctgaaaggagaggtgaag

SEQ ID NO: 7942314 - DNA, 23 bp, Homo sapiens
taggctctgtaggtagagatggg

SEQ ID NO: 7942315 - DNA, 22 bp, Homo sapiens
taggctcctgagtccacagcac

SEQ ID NO: 7942316 - DNA, 22 bp, Homo sapiens
taggctcctgagtccacagcac

SEQ ID NO: 7942317 - DNA, 22 bp, Homo sapiens
taggctcattttttaagtggtt

SEQ ID NO: 7942318 - DNA, 22 bp, Homo sapiens
taggctcagtgagtagggagtt

SEQ ID NO: 7942319 - DNA, 22 bp, Homo sapiens
taggctcagtgagtagggagtt

SEQ ID NO: 7942320 - DNA, 22 bp, Homo sapiens
taggctcattaagtccccaggg

SEQ ID NO: 7942321 - DNA, 22 bp, Homo sapiens
tagagctactggcagcctcttc

SEQ ID NO: 7942322 - DNA, 22 bp, Homo sapiens
tagagctagcttcaaaatgcga

SEQ ID NO: 7942323 - DNA, 22 bp, Homo sapiens
tagagctagcttcaaaatgcga

SEQ ID NO: 7942324 - DNA, 22 bp, Homo sapiens
tagagctatacactgagtaaaa

SEQ ID NO: 7942325 - DNA, 21 bp, Homo sapiens
tagagccagtggtgttctgac

SEQ ID NO: 7942326 - DNA, 22 bp, Homo sapiens
tagagcatttagaggggcagga

SEQ ID NO: 7942327 - DNA, 22 bp, Homo sapiens
tagagctatttagagcatttta

SEQ ID NO: 7942328 - DNA, 22 bp, Homo sapiens
tagagctcattttaagcagaca

SEQ ID NO: 7942329 - DNA, 22 bp, Homo sapiens
tagagctatttatcagccagaa

SEQ ID NO: 7942330 - DNA, 22 bp, Homo sapiens
tagagctgagttgactccattt

SEQ ID NO: 7942331 - DNA, 22 bp, Homo sapiens
tagagctctccttcctctgtgg

SEQ ID NO: 7942332 - DNA, 22 bp, Homo sapiens
tagagctgataatgaggccaag

SEQ ID NO: 7942333 - DNA, 22 bp, Homo sapiens
tagagctgagttgactccattt

SEQ ID NO: 7942334 - DNA, 22 bp, Homo sapiens
tagagctgagttgactccattt

SEQ ID NO: 7942335 - DNA, 22 bp, Homo sapiens
tagagctgataatgaggccaag

SEQ ID NO: 7942336 - DNA, 22 bp, Homo sapiens
tagagcagttggcagctgtatt

SEQ ID NO: 7942337 - DNA, 22 bp, Homo sapiens
tagagcagttggcagctgtatt

SEQ ID NO: 7942338 - DNA, 22 bp, Homo sapiens
tagagcagttggcagctgtatt

SEQ ID NO: 7942339 - DNA, 23 bp, Homo sapiens
tagagcagtagatcaccatggga

SEQ ID NO: 7942340 - DNA, 22 bp, Homo sapiens
tagagcagtgggtaccatggca

SEQ ID NO: 7942341 - DNA, 22 bp, Homo sapiens
tagagatagcagtattgattcg

SEQ ID NO: 7942342 - DNA, 18 bp, Homo sapiens
tagaatctgttattgcct

SEQ ID NO: 7942343 - DNA, 22 bp, Homo sapiens
tagaatctgtgttcaaacctac

SEQ ID NO: 7942344 - DNA, 21 bp, Homo sapiens
tagagatgacgagctctagca

SEQ ID NO: 7942345 - DNA, 22 bp, Homo sapiens
tagagatgaattctgcagtctt

SEQ ID NO: 7942346 - DNA, 22 bp, Homo sapiens
tagagatgccctagctgaagta

SEQ ID NO: 7942347 - DNA, 22 bp, Homo sapiens
tagagatgccctagctgaagta

SEQ ID NO: 7942348 - DNA, 23 bp, Homo sapiens
tagaatctgtatttctgcagttc

SEQ ID NO: 7942349 - DNA, 20 bp, Homo sapiens
tagaatctggtgatgtatcg

SEQ ID NO: 7942350 - DNA, 23 bp, Homo sapiens
tagaatctgtatttctgcagttc

SEQ ID NO: 7942351 - DNA, 22 bp, Homo sapiens
tagaatctggaaggggctattc

SEQ ID NO: 7942352 - DNA, 22 bp, Homo sapiens
tagaatctggatctgggcgcat

SEQ ID NO: 7942353 - DNA, 20 bp, Homo sapiens
tagaatctggtgatgtatcg

SEQ ID NO: 7942354 - DNA, 22 bp, Homo sapiens
tagaatctgattaccctatgaa

SEQ ID NO: 7942355 - DNA, 22 bp, Homo sapiens
tagaatctgatggcccgtctgg

SEQ ID NO: 7942356 - DNA, 22 bp, Homo sapiens
tagaatctgaatgtagagctga

SEQ ID NO: 7942357 - DNA, 22 bp, Homo sapiens
tagaatctggaaggggctattc

SEQ ID NO: 7942358 - DNA, 22 bp, Homo sapiens
tagaatctgcctgcagcaaaga

SEQ ID NO: 7942359 - DNA, 22 bp, Homo sapiens
tagaatctgcctgcagcaaaga

SEQ ID NO: 7942360 - DNA, 23 bp, Homo sapiens
tagagcagccccgaggtgctgtc

SEQ ID NO: 7942361 - DNA, 23 bp, Homo sapiens
tagagcagccccgaggtgctgtc

SEQ ID NO: 7942362 - DNA, 23 bp, Homo sapiens
tagagcagccccgaggtgctgtc

SEQ ID NO: 7942363 - DNA, 22 bp, Homo sapiens
tagagcagccttcagagcagtt

SEQ ID NO: 7942364 - DNA, 22 bp, Homo sapiens
tagagcagccttcagagcagtt

SEQ ID NO: 7942365 - DNA, 23 bp, Homo sapiens
tagagcagggaaatctgtcagag

SEQ ID NO: 7942366 - DNA, 22 bp, Homo sapiens
tagagcagaacttgttaacacc

SEQ ID NO: 7942367 - DNA, 22 bp, Homo sapiens
tagagcacagtttcagggtgta

SEQ ID NO: 7942368 - DNA, 22 bp, Homo sapiens
tagagcaatgctctactccttg

SEQ ID NO: 7942369 - DNA, 22 bp, Homo sapiens
tagagcaatgctctactccttg

SEQ ID NO: 7942370 - DNA, 22 bp, Homo sapiens
tagagatggggtcttgctatga

SEQ ID NO: 7942371 - DNA, 22 bp, Homo sapiens
tagagatgtgatatagcagagt

SEQ ID NO: 7942372 - DNA, 22 bp, Homo sapiens
tagagctgctggactgtaacag

SEQ ID NO: 7942373 - DNA, 22 bp, Homo sapiens
tagagctgataatgaggccaag

SEQ ID NO: 7942374 - DNA, 22 bp, Homo sapiens
tagagctgataatgaggccaag

SEQ ID NO: 7942375 - DNA, 22 bp, Homo sapiens
tagagctgataatgaggccaag

SEQ ID NO: 7942376 - DNA, 22 bp, Homo sapiens
tagaggagagttgctggatgga

SEQ ID NO: 7942377 - DNA, 22 bp, Homo sapiens
tagaggagcggcgagctgagct

SEQ ID NO: 7942378 - DNA, 22 bp, Homo sapiens
tagaggagcggcgagctgagct

SEQ ID NO: 7942379 - DNA, 22 bp, Homo sapiens
tagaggcacagtctatgtagag

SEQ ID NO: 7942380 - DNA, 22 bp, Homo sapiens
tagaggcacagtctatgtagag

SEQ ID NO: 7942381 - DNA, 22 bp, Homo sapiens
tagaggcacagtctatgtagag

SEQ ID NO: 7942382 - DNA, 22 bp, Homo sapiens
tagaggcaccctggaggagact

SEQ ID NO: 7942383 - DNA, 22 bp, Homo sapiens
tagaggcaccctggaggagact

SEQ ID NO: 7942384 - DNA, 22 bp, Homo sapiens
tagaggattttgcatttcatat

SEQ ID NO: 7942385 - DNA, 22 bp, Homo sapiens
tagaggcaaccagtgttgagaa

SEQ ID NO: 7942386 - DNA, 22 bp, Homo sapiens
tagaggcacagtctatgtagag

SEQ ID NO: 7942387 - DNA, 22 bp, Homo sapiens
tagaggcaaccagtgttgagaa

SEQ ID NO: 7942388 - DNA, 22 bp, Homo sapiens
tagaggcaaccagtgttgagaa

SEQ ID NO: 7942389 - DNA, 22 bp, Homo sapiens
tagaggattttgcatttcatat

SEQ ID NO: 7942390 - DNA, 22 bp, Homo sapiens
tagaggatgatccttccttgcc

SEQ ID NO: 7942391 - DNA, 22 bp, Homo sapiens
tagaggatgcaggattgtttgt

SEQ ID NO: 7942392 - DNA, 22 bp, Homo sapiens
tagaggagggctgttcttcagt

SEQ ID NO: 7942393 - DNA, 22 bp, Homo sapiens
tagatgaccttgtgttaggcaa

SEQ ID NO: 7942394 - DNA, 22 bp, Homo sapiens
tagaggcaccctggaggagact

SEQ ID NO: 7942395 - DNA, 22 bp, Homo sapiens
tagaggcagaagaaattgacaa

SEQ ID NO: 7942396 - DNA, 22 bp, Homo sapiens
tagaggcaccctggaggagact

SEQ ID NO: 7942397 - DNA, 22 bp, Homo sapiens
tagaggcaccctggaggagact

SEQ ID NO: 7942398 - DNA, 22 bp, Homo sapiens
tagatgattttcagtcaaagca

SEQ ID NO: 7942399 - DNA, 22 bp, Homo sapiens
tagatgatggtaaaaagaagtt

SEQ ID NO: 7942400 - DNA, 22 bp, Homo sapiens
tagatgatggaaaaaagcaata

SEQ ID NO: 7942401 - DNA, 22 bp, Homo sapiens
tagatgatagggccagaatttg

SEQ ID NO: 7942402 - DNA, 22 bp, Homo sapiens
tagatgcatagagcacagcaca

SEQ ID NO: 7942403 - DNA, 22 bp, Homo sapiens
tagatgctactttacatagggt

SEQ ID NO: 7942404 - DNA, 22 bp, Homo sapiens
tagatgcttgcagacagaatga

SEQ ID NO: 7942405 - DNA, 22 bp, Homo sapiens
tagatgcttgcagacagaatga

SEQ ID NO: 7942406 - DNA, 22 bp, Homo sapiens
tagatgcttcatgagaaatata

SEQ ID NO: 7942407 - DNA, 22 bp, Homo sapiens
tagatggacgtcaagtctactc

SEQ ID NO: 7942408 - DNA, 22 bp, Homo sapiens
tagatgcttgttcagaaatagg

SEQ ID NO: 7942409 - DNA, 22 bp, Homo sapiens
tagatgctcatgagtcagccag

SEQ ID NO: 7942410 - DNA, 20 bp, Homo sapiens
tagatgctgccataagattc

SEQ ID NO: 7942411 - DNA, 22 bp, Homo sapiens
tagatgcttataaagagcatat

SEQ ID NO: 7942412 - DNA, 22 bp, Homo sapiens
tactttctaagacatacaactt

SEQ ID NO: 7942413 - DNA, 22 bp, Homo sapiens
tactttctaagacatacaactt

SEQ ID NO: 7942414 - DNA, 22 bp, Homo sapiens
tactttctaagacatacaactt

SEQ ID NO: 7942415 - DNA, 22 bp, Homo sapiens
tactttccctcatcaacaatca

SEQ ID NO: 7942416 - DNA, 22 bp, Homo sapiens
tactttcatgtctatacatatt

SEQ ID NO: 7942417 - DNA, 22 bp, Homo sapiens
tactttcatgtctatacatatt

SEQ ID NO: 7942418 - DNA, 22 bp, Homo sapiens
tactttcatgtctatacatatt

SEQ ID NO: 7942419 - DNA, 22 bp, Homo sapiens
tactttctgtccttctgttaaa

SEQ ID NO: 7942420 - DNA, 22 bp, Homo sapiens
tactttctgtccttctgttaaa

SEQ ID NO: 7942421 - DNA, 22 bp, Homo sapiens
tactttctaagacatacaactt

SEQ ID NO: 7942422 - DNA, 22 bp, Homo sapiens
tactttctagctctccccagtt

SEQ ID NO: 7942423 - DNA, 22 bp, Homo sapiens
tacttgttaaaatattagctat

SEQ ID NO: 7942424 - DNA, 22 bp, Homo sapiens
tacttgtctcttctgacaaagt

SEQ ID NO: 7942425 - DNA, 22 bp, Homo sapiens
tacttgtatctttaccaatttt

SEQ ID NO: 7942426 - DNA, 22 bp, Homo sapiens
tacttgtatctttaccaatttt

SEQ ID NO: 7942427 - DNA, 23 bp, Homo sapiens
tacttggttttgatagaaatcca

SEQ ID NO: 7942428 - DNA, 22 bp, Homo sapiens
tacttgtagcaggtggcattta

SEQ ID NO: 7942429 - DNA, 22 bp, Homo sapiens
tacttggattaataatttgttt

SEQ ID NO: 7942430 - DNA, 22 bp, Homo sapiens
tacttggagttcataatctggt

SEQ ID NO: 7942431 - DNA, 22 bp, Homo sapiens
tacttggtaaatgcttatggaa

SEQ ID NO: 7942432 - DNA, 22 bp, Homo sapiens
tacttgctgggtgtaattttct

SEQ ID NO: 7942433 - DNA, 22 bp, Homo sapiens
tacttgcttggatttcaccaga

SEQ ID NO: 7942434 - DNA, 22 bp, Homo sapiens
tacttgctgttagtattttaca

SEQ ID NO: 7942435 - DNA, 22 bp, Homo sapiens
tactttctttcccaagaggtgg

SEQ ID NO: 7942436 - DNA, 22 bp, Homo sapiens
tactttctttcccaagaggtgg

SEQ ID NO: 7942437 - DNA, 22 bp, Homo sapiens
tactttctttcccaagaggtgg

SEQ ID NO: 7942438 - DNA, 22 bp, Homo sapiens
tactttcttgttcctttcataa

SEQ ID NO: 7942439 - DNA, 22 bp, Homo sapiens
tactttcttgttcctttcataa

SEQ ID NO: 7942440 - DNA, 22 bp, Homo sapiens
tactttctgtccttctgttaaa

SEQ ID NO: 7942441 - DNA, 22 bp, Homo sapiens
tactttctgtccttctgttaaa

SEQ ID NO: 7942442 - DNA, 22 bp, Homo sapiens
tactttcttgttcctttcataa

SEQ ID NO: 7942443 - DNA, 22 bp, Homo sapiens
tactttcttgttcctttcataa

SEQ ID NO: 7942444 - DNA, 22 bp, Homo sapiens
tactttcttgttcctttcataa

SEQ ID NO: 7942445 - DNA, 22 bp, Homo sapiens
tagaagcaccactcatcacgtg

SEQ ID NO: 7942446 - DNA, 22 bp, Homo sapiens
tagaagcaccactcatcacgtg

SEQ ID NO: 7942447 - DNA, 19 bp, Homo sapiens
tagaagcactaggcaaact

SEQ ID NO: 7942448 - DNA, 22 bp, Homo sapiens
tagaagcaccactcatcacgtg

SEQ ID NO: 7942449 - DNA, 22 bp, Homo sapiens
tagaagcaccactcatcacgtg

SEQ ID NO: 7942450 - DNA, 22 bp, Homo sapiens
tagaagcaccactcatcacgtg

SEQ ID NO: 7942451 - DNA, 22 bp, Homo sapiens
tactttctttctgatccttatg

SEQ ID NO: 7942452 - DNA, 22 bp, Homo sapiens
tactttctttctgatccttatg

SEQ ID NO: 7942453 - DNA, 22 bp, Homo sapiens
tactttctttcccaagaggtgg

SEQ ID NO: 7942454 - DNA, 22 bp, Homo sapiens
tactttctttctgatccttatg

SEQ ID NO: 7942455 - DNA, 22 bp, Homo sapiens
tagaagcagtaatagaaatagg

SEQ ID NO: 7942456 - DNA, 19 bp, Homo sapiens
tagaagcagggaagctgag

SEQ ID NO: 7942457 - DNA, 19 bp, Homo sapiens
tagaagcagggaagctgag

SEQ ID NO: 7942458 - DNA, 22 bp, Homo sapiens
tagaagcagcaggactcatggt

SEQ ID NO: 7942459 - DNA, 22 bp, Homo sapiens
tagaagcagcaggagtaaaggc

SEQ ID NO: 7942460 - DNA, 22 bp, Homo sapiens
tagaagcagcaggactcatggt

SEQ ID NO: 7942461 - DNA, 22 bp, Homo sapiens
tagaagcagcaggagtaaaggc

SEQ ID NO: 7942462 - DNA, 22 bp, Homo sapiens
tagaagcagcaggagtaaaggc

SEQ ID NO: 7942463 - DNA, 22 bp, Homo sapiens
tagaagcagcaggactcatggt

SEQ ID NO: 7942464 - DNA, 22 bp, Homo sapiens
tagaagcagaaggaaggtggct

SEQ ID NO: 7942465 - DNA, 22 bp, Homo sapiens
tagaagcagaaggaaggtggct

SEQ ID NO: 7942466 - DNA, 22 bp, Homo sapiens
tagaagcactgacagagtttga

SEQ ID NO: 7942467 - DNA, 19 bp, Homo sapiens
tagaagcactaggcaaact

SEQ ID NO: 7942468 - DNA, 19 bp, Homo sapiens
tagaagcactaggcaaact

SEQ ID NO: 7942469 - DNA, 20 bp, Homo sapiens
tagaatctactatttggccc

SEQ ID NO: 7942470 - DNA, 21 bp, Homo sapiens
tagaatcctggactgggactc

SEQ ID NO: 7942471 - DNA, 21 bp, Homo sapiens
tagaatcctggactgggactc

SEQ ID NO: 7942472 - DNA, 21 bp, Homo sapiens
tagaatcctggactgggactc

SEQ ID NO: 7942473 - DNA, 22 bp, Homo sapiens
tagaatccaagaaggtgagcaa

SEQ ID NO: 7942474 - DNA, 22 bp, Homo sapiens
tagaatctgaatattcttattt

SEQ ID NO: 7942475 - DNA, 22 bp, Homo sapiens
tagaatctgaaagtggctgtga

SEQ ID NO: 7942476 - DNA, 22 bp, Homo sapiens
tagaatctccagcattggttgt

SEQ ID NO: 7942477 - DNA, 22 bp, Homo sapiens
tagaatctagttcattcatttg

SEQ ID NO: 7942478 - DNA, 22 bp, Homo sapiens
tagaatctagttcattcatttg

SEQ ID NO: 7942479 - DNA, 22 bp, Homo sapiens
tagaatccaagaaggtgagcaa

SEQ ID NO: 7942480 - DNA, 22 bp, Homo sapiens
tagaatccacctacacaagaga

SEQ ID NO: 7942481 - DNA, 22 bp, Homo sapiens
tagaatcccagccagctggaag

SEQ ID NO: 7942482 - DNA, 23 bp, Homo sapiens
tagaatcctctgagatggaatag

SEQ ID NO: 7942483 - DNA, 23 bp, Homo sapiens
tagaatcctctgagatggaatag

SEQ ID NO: 7942484 - DNA, 22 bp, Homo sapiens
tagaatccagattctatgctaa

SEQ ID NO: 7942485 - DNA, 22 bp, Homo sapiens
tagaatccacctacacaagaga

SEQ ID NO: 7942486 - DNA, 22 bp, Homo sapiens
tagaatcattgagaataacagg

SEQ ID NO: 7942487 - DNA, 22 bp, Homo sapiens
tagaatcattgagaataacagg

SEQ ID NO: 7942488 - DNA, 22 bp, Homo sapiens
tagaatcattgagaataacagg

SEQ ID NO: 7942489 - DNA, 22 bp, Homo sapiens
tagaatcatacctctaggaaca

SEQ ID NO: 7942490 - DNA, 22 bp, Homo sapiens
tagaatcatacctctaggaaca

SEQ ID NO: 7942491 - DNA, 22 bp, Homo sapiens
tagaatcatacctctaggaaca

SEQ ID NO: 7942492 - DNA, 22 bp, Homo sapiens
tagaataagttgatgatatatg

SEQ ID NO: 7942493 - DNA, 22 bp, Homo sapiens
tagaataagttgatgatatatg

SEQ ID NO: 7942494 - DNA, 22 bp, Homo sapiens
tagaataagttgatgatatatg

SEQ ID NO: 7942495 - DNA, 22 bp, Homo sapiens
tagaagtttcaaaagacttcat

SEQ ID NO: 7942496 - DNA, 22 bp, Homo sapiens
tagaagttgctcaataaatgtt

SEQ ID NO: 7942497 - DNA, 22 bp, Homo sapiens
tagaagttgctcaataaatgtt

SEQ ID NO: 7942498 - DNA, 22 bp, Homo sapiens
tagaatcagaagatttgactgt

SEQ ID NO: 7942499 - DNA, 22 bp, Homo sapiens
tagaatcagaagatttgactgt

SEQ ID NO: 7942500 - DNA, 22 bp, Homo sapiens
tagaatcagaagatttgactgt

SEQ ID NO: 7942501 - DNA, 22 bp, Homo sapiens
tagaataagttgatgatatatg

SEQ ID NO: 7942502 - DNA, 22 bp, Homo sapiens
tagaataagttgatgatatatg

SEQ ID NO: 7942503 - DNA, 22 bp, Homo sapiens
tagaataagttgatgatatatg

SEQ ID NO: 7942504 - DNA, 22 bp, Homo sapiens
tagaataagttgatgatatatg

SEQ ID NO: 7942505 - DNA, 22 bp, Homo sapiens
tagaaggcccattcatttgttc

SEQ ID NO: 7942506 - DNA, 22 bp, Homo sapiens
tagaaggcaggtggttggagtt

SEQ ID NO: 7942507 - DNA, 22 bp, Homo sapiens
tagaaggcaggtggttggagtt

SEQ ID NO: 7942508 - DNA, 22 bp, Homo sapiens
tagaaggcatttcctttatttt

SEQ ID NO: 7942509 - DNA, 22 bp, Homo sapiens
tagaaggtaatgaaatgctgat

SEQ ID NO: 7942510 - DNA, 22 bp, Homo sapiens
tagaaggcggactctccctctg

SEQ ID NO: 7942511 - DNA, 22 bp, Homo sapiens
tagaaggctttgagagatactt

SEQ ID NO: 7942512 - DNA, 22 bp, Homo sapiens
tagaagtctctcaagaaacata

SEQ ID NO: 7942513 - DNA, 22 bp, Homo sapiens
tagaagtctctcaagaaacata

SEQ ID NO: 7942514 - DNA, 22 bp, Homo sapiens
tagaaggcaagcttggtacagg

SEQ ID NO: 7942515 - DNA, 22 bp, Homo sapiens
tagaaggaggactggcagtgtt

SEQ ID NO: 7942516 - DNA, 22 bp, Homo sapiens
tagaagctcaggaataggcata

SEQ ID NO: 7942517 - DNA, 22 bp, Homo sapiens
tagaagctcaggaataggcata

SEQ ID NO: 7942518 - DNA, 22 bp, Homo sapiens
tagaagcagtaatagaaatagg

SEQ ID NO: 7942519 - DNA, 22 bp, Homo sapiens
tagaagttaggaaataggaata

SEQ ID NO: 7942520 - DNA, 22 bp, Homo sapiens
tagaagttatgataataatagt

SEQ ID NO: 7942521 - DNA, 22 bp, Homo sapiens
tagaagttgaactaaaaatatt

SEQ ID NO: 7942522 - DNA, 22 bp, Homo sapiens
tagaagttcatgcgaattattt

SEQ ID NO: 7942523 - DNA, 22 bp, Homo sapiens
tagaagttcatgcgaattattt

SEQ ID NO: 7942524 - DNA, 22 bp, Homo sapiens
tagaagttaggaaataggaata

SEQ ID NO: 7942525 - DNA, 22 bp, Homo sapiens
tagcaagaggtgaaggtttcat

SEQ ID NO: 7942526 - DNA, 22 bp, Homo sapiens
tagcacaaagtcttgccctttt

SEQ ID NO: 7942527 - DNA, 22 bp, Homo sapiens
tagcaagaggtgaaggtttcat

SEQ ID NO: 7942528 - DNA, 22 bp, Homo sapiens
tagcaagaggaaacaaggggcc

SEQ ID NO: 7942529 - DNA, 22 bp, Homo sapiens
tagcaagaccaatatgtagata

SEQ ID NO: 7942530 - DNA, 22 bp, Homo sapiens
tagcaagaccaatatgtagata

SEQ ID NO: 7942531 - DNA, 22 bp, Homo sapiens
tagcaagaccaatatgtagata

SEQ ID NO: 7942532 - DNA, 22 bp, Homo sapiens
tagcaagacaacttttctcagt

SEQ ID NO: 7942533 - DNA, 22 bp, Homo sapiens
tagcacaagaagtacacataga

SEQ ID NO: 7942534 - DNA, 22 bp, Homo sapiens
tagcacaagaagtacacataga

SEQ ID NO: 7942535 - DNA, 22 bp, Homo sapiens
tagcacaagcaactactgaagt

SEQ ID NO: 7942536 - DNA, 22 bp, Homo sapiens
tagcacaatatcatgtctgtga

SEQ ID NO: 7942537 - DNA, 22 bp, Homo sapiens
tagcacaatatcatgtctgtga

SEQ ID NO: 7942538 - DNA, 22 bp, Homo sapiens
tagcacaatatcatgtctgtga

SEQ ID NO: 7942539 - DNA, 22 bp, Homo sapiens
tagcacaagtatctgcttttcc

SEQ ID NO: 7942540 - DNA, 22 bp, Homo sapiens
tagcacaagtatctgcttttcc

SEQ ID NO: 7942541 - DNA, 22 bp, Homo sapiens
tagcacaagcaactactgaagt

SEQ ID NO: 7942542 - DNA, 22 bp, Homo sapiens
tagcaaaaactgcagttacttt

SEQ ID NO: 7942543 - DNA, 22 bp, Homo sapiens
tagcaaaaactgcagttacttt

SEQ ID NO: 7942544 - DNA, 22 bp, Homo sapiens
tagcaaaaactgcagttacttt

SEQ ID NO: 7942545 - DNA, 22 bp, Homo sapiens
tagcaaaaactgcagttacttt

SEQ ID NO: 7942546 - DNA, 22 bp, Homo sapiens
tagcaaaaactgcagttacttt

SEQ ID NO: 7942547 - DNA, 22 bp, Homo sapiens
tagcaaaaaaactggcatctcc

SEQ ID NO: 7942548 - DNA, 22 bp, Homo sapiens
tagcaaaaaaactggcatctcc

SEQ ID NO: 7942549 - DNA, 22 bp, Homo sapiens
tagcaagacaacttttctcagt

SEQ ID NO: 7942550 - DNA, 22 bp, Homo sapiens
tagcaagacaacttttctcagt

SEQ ID NO: 7942551 - DNA, 22 bp, Homo sapiens
tagcaagaagtagctctggatt

SEQ ID NO: 7942552 - DNA, 22 bp, Homo sapiens
tagcaagaagggagatggggtt

SEQ ID NO: 7942553 - DNA, 22 bp, Homo sapiens
tagcaaaagccacgattacttt

SEQ ID NO: 7942554 - DNA, 22 bp, Homo sapiens
tagcaaaagccacgattacttt

SEQ ID NO: 7942555 - DNA, 22 bp, Homo sapiens
tagcaaaagccacgattacttt

SEQ ID NO: 7942556 - DNA, 22 bp, Homo sapiens
tagcaaaagccacgattacttt

SEQ ID NO: 7942557 - DNA, 22 bp, Homo sapiens
tagcaaaaactgcagttacttt

SEQ ID NO: 7942558 - DNA, 22 bp, Homo sapiens
tagcaaaagccacgattacttt

SEQ ID NO: 7942559 - DNA, 22 bp, Homo sapiens
tagcacagcttcttgatgtcac

SEQ ID NO: 7942560 - DNA, 22 bp, Homo sapiens
tagcacagcttcttgatgtcac

SEQ ID NO: 7942561 - DNA, 22 bp, Homo sapiens
tagcacagcttcttgatgtcac

SEQ ID NO: 7942562 - DNA, 21 bp, Homo sapiens
tagcacagctgtagacagttt

SEQ ID NO: 7942563 - DNA, 21 bp, Homo sapiens
tagcacagctgtagacagttt

SEQ ID NO: 7942564 - DNA, 22 bp, Homo sapiens
tagcacagagcttttaaacttc

SEQ ID NO: 7942565 - DNA, 21 bp, Homo sapiens
tagcacagctgtagacagttt

SEQ ID NO: 7942566 - DNA, 18 bp, Homo sapiens
tagcacagagcaggatgt

SEQ ID NO: 7942567 - DNA, 18 bp, Homo sapiens
tagcacagagcaggatgt

SEQ ID NO: 7942568 - DNA, 22 bp, Homo sapiens
tagcacactgcatatgaagatt

SEQ ID NO: 7942569 - DNA, 22 bp, Homo sapiens
tagcacacactgcatctacaaa

SEQ ID NO: 7942570 - DNA, 22 bp, Homo sapiens
tagcacagacagaatggtcata

SEQ ID NO: 7942571 - DNA, 22 bp, Homo sapiens
tagcacagacagaatggtcata

SEQ ID NO: 7942572 - DNA, 18 bp, Homo sapiens
tagcacagagcaggatgt

SEQ ID NO: 7942573 - DNA, 22 bp, Homo sapiens
tagcacagggctcctcaaccca

SEQ ID NO: 7942574 - DNA, 22 bp, Homo sapiens
tagcacaggtcttgttgccatt

SEQ ID NO: 7942575 - DNA, 22 bp, Homo sapiens
tagcacagggctcctcaaccca

SEQ ID NO: 7942576 - DNA, 22 bp, Homo sapiens
tagcacaggtcttgttgccatt

SEQ ID NO: 7942577 - DNA, 22 bp, Homo sapiens
tagcacaggtcttgttgccatt

SEQ ID NO: 7942578 - DNA, 17 bp, Homo sapiens
tagcacagtgcctggta

SEQ ID NO: 7942579 - DNA, 22 bp, Homo sapiens
tagcacagtgttcacaacagtg

SEQ ID NO: 7942580 - DNA, 22 bp, Homo sapiens
tagcacagtgttcacaacagtg

SEQ ID NO: 7942581 - DNA, 22 bp, Homo sapiens
tagcacagtgttcacaacagtg

SEQ ID NO: 7942582 - DNA, 22 bp, Homo sapiens
tagcacagtatttctcaactgg

SEQ ID NO: 7942583 - DNA, 22 bp, Homo sapiens
tagcacagtatttctcaactgg

SEQ ID NO: 7942584 - DNA, 22 bp, Homo sapiens
tagcacagtatttctcaactgg

SEQ ID NO: 7942585 - DNA, 22 bp, Homo sapiens
tagcacagtatttctcaactgg

SEQ ID NO: 7942586 - DNA, 22 bp, Homo sapiens
tagatgttaagcttctagaagg

SEQ ID NO: 7942587 - DNA, 22 bp, Homo sapiens
tagatgttaagcttctagaagg

SEQ ID NO: 7942588 - DNA, 22 bp, Homo sapiens
tagatgtgagcccaggctgctt

SEQ ID NO: 7942589 - DNA, 22 bp, Homo sapiens
tagatgtgaggattcaggagtt

SEQ ID NO: 7942590 - DNA, 22 bp, Homo sapiens
tagatgtgtgatattctcagat

SEQ ID NO: 7942591 - DNA, 22 bp, Homo sapiens
tagatgttccacatatatatgt

SEQ ID NO: 7942592 - DNA, 22 bp, Homo sapiens
tagatgttccacatatatatgt

SEQ ID NO: 7942593 - DNA, 22 bp, Homo sapiens
tagatgttgaagtcatatttgg

SEQ ID NO: 7942594 - DNA, 20 bp, Homo sapiens
tagatgtttcctgtcataaa

SEQ ID NO: 7942595 - DNA, 20 bp, Homo sapiens
tagatgtttcctgtcataaa

SEQ ID NO: 7942596 - DNA, 22 bp, Homo sapiens
tagatgttttaactcttggtta

SEQ ID NO: 7942597 - DNA, 22 bp, Homo sapiens
tagatgttttaactcttggtta

SEQ ID NO: 7942598 - DNA, 22 bp, Homo sapiens
tagatgtttgagaagtttatgt

SEQ ID NO: 7942599 - DNA, 22 bp, Homo sapiens
tagattttgcatttctaacaag

SEQ ID NO: 7942600 - DNA, 22 bp, Homo sapiens
tagattttgcatttctaacaag

SEQ ID NO: 7942601 - DNA, 22 bp, Homo sapiens
tagattttgcatttctaacaag

SEQ ID NO: 7942602 - DNA, 22 bp, Homo sapiens
tagattttgcatttctaacaag

SEQ ID NO: 7942603 - DNA, 22 bp, Homo sapiens
tagattttaggagattttactg

SEQ ID NO: 7942604 - DNA, 22 bp, Homo sapiens
tagattttaggagattttactg

SEQ ID NO: 7942605 - DNA, 22 bp, Homo sapiens
tagattttaggagattttactg

SEQ ID NO: 7942606 - DNA, 22 bp, Homo sapiens
tagattttacttctgtcattac

SEQ ID NO: 7942607 - DNA, 22 bp, Homo sapiens
tagattttacttctgtcattac

SEQ ID NO: 7942608 - DNA, 22 bp, Homo sapiens
tagattttacttctgtcattac

SEQ ID NO: 7942609 - DNA, 22 bp, Homo sapiens
tagattttacttctgtcattac

SEQ ID NO: 7942610 - DNA, 22 bp, Homo sapiens
tagattatccctgatttgtcca

SEQ ID NO: 7942611 - DNA, 22 bp, Homo sapiens
tagattaagatgccagttttga

SEQ ID NO: 7942612 - DNA, 22 bp, Homo sapiens
tagattaacagttttgttgaag

SEQ ID NO: 7942613 - DNA, 22 bp, Homo sapiens
tagattaacagttttgttgaag

SEQ ID NO: 7942614 - DNA, 23 bp, Homo sapiens
tagatgtttggggaactttgccc

SEQ ID NO: 7942615 - DNA, 18 bp, Homo sapiens
tagattaaaattgaattc

SEQ ID NO: 7942616 - DNA, 18 bp, Homo sapiens
tagattaaaattgaattc

SEQ ID NO: 7942617 - DNA, 22 bp, Homo sapiens
tagatgttttgatatttgctga

SEQ ID NO: 7942618 - DNA, 22 bp, Homo sapiens
tagatgttttgatatttgctga

SEQ ID NO: 7942619 - DNA, 17 bp, Homo sapiens
tagattaaacacggcca

SEQ ID NO: 7942620 - DNA, 22 bp, Homo sapiens
tagcacagttcactatgataca

SEQ ID NO: 7942621 - DNA, 22 bp, Homo sapiens
tagcacagttcactatgataca

SEQ ID NO: 7942622 - DNA, 22 bp, Homo sapiens
tagcacagttcactatgataca

SEQ ID NO: 7942623 - DNA, 22 bp, Homo sapiens
tagcacagttcctgactctttg

SEQ ID NO: 7942624 - DNA, 22 bp, Homo sapiens
tagcacatacataatagataga

SEQ ID NO: 7942625 - DNA, 22 bp, Homo sapiens
tagcacagttcctgactctttg

SEQ ID NO: 7942626 - DNA, 22 bp, Homo sapiens
tagcacagtgttcacaacagtg

SEQ ID NO: 7942627 - DNA, 22 bp, Homo sapiens
tagcacataacttagaatagtt

SEQ ID NO: 7942628 - DNA, 22 bp, Homo sapiens
tagcacataacttagaatagtt

SEQ ID NO: 7942629 - DNA, 22 bp, Homo sapiens
tagcaccaaaactgaagaacat

SEQ ID NO: 7942630 - DNA, 22 bp, Homo sapiens
tagcacattgttgaccagaagg

SEQ ID NO: 7942631 - DNA, 22 bp, Homo sapiens
tagcaccaaacatatactcagt

SEQ ID NO: 7942632 - DNA, 22 bp, Homo sapiens
tagcacatctggcgcttatagg

SEQ ID NO: 7942633 - DNA, 22 bp, Homo sapiens
tagcacatctggcgcttatagg

SEQ ID NO: 7942634 - DNA, 22 bp, Homo sapiens
tagcacattgttgaccagaagg

SEQ ID NO: 7942635 - DNA, 22 bp, Homo sapiens
tagcacatcttcttggcctgca

SEQ ID NO: 7942636 - DNA, 22 bp, Homo sapiens
tagcaccttaactctgctgcgt

SEQ ID NO: 7942637 - DNA, 22 bp, Homo sapiens
tagcacctgtgcacaccaggca

SEQ ID NO: 7942638 - DNA, 22 bp, Homo sapiens
tagcacctggtcaattcagtca

SEQ ID NO: 7942639 - DNA, 22 bp, Homo sapiens
tagcacctgcaggatgtgcaca

SEQ ID NO: 7942640 - DNA, 22 bp, Homo sapiens
tagcacctgcaggatgtgcaca

SEQ ID NO: 7942641 - DNA, 22 bp, Homo sapiens
tagcaccggatggcaagcaaca

SEQ ID NO: 7942642 - DNA, 22 bp, Homo sapiens
tagcaccggcagtggtaggtgc

SEQ ID NO: 7942643 - DNA, 22 bp, Homo sapiens
tagcacccatggaatctgctgg

SEQ ID NO: 7942644 - DNA, 22 bp, Homo sapiens
tagcacctgatacctagtatgt

SEQ ID NO: 7942645 - DNA, 22 bp, Homo sapiens
tagcacctagagtattttatca

SEQ ID NO: 7942646 - DNA, 22 bp, Homo sapiens
tagcacccacctcgtggggttt

SEQ ID NO: 7942647 - DNA, 22 bp, Homo sapiens
tagcaccatacccggcagctcg

SEQ ID NO: 7942648 - DNA, 22 bp, Homo sapiens
tagcagggttttgaagagggtt

SEQ ID NO: 7942649 - DNA, 22 bp, Homo sapiens
tagcagggttttgaagagggtt

SEQ ID NO: 7942650 - DNA, 20 bp, Homo sapiens
tagcaggtagctgcacgttt

SEQ ID NO: 7942651 - DNA, 22 bp, Homo sapiens
tagcaggtgctcatttaactcc

SEQ ID NO: 7942652 - DNA, 22 bp, Homo sapiens
tagcagaaccagcagtcaattt

SEQ ID NO: 7942653 - DNA, 22 bp, Homo sapiens
tagcagtatattttaaggaagc

SEQ ID NO: 7942654 - DNA, 22 bp, Homo sapiens
tagcagtatggagcgaggccca

SEQ ID NO: 7942655 - DNA, 22 bp, Homo sapiens
tagcagtattccggaatacttt

SEQ ID NO: 7942656 - DNA, 22 bp, Homo sapiens
tagcagtactgggcatgtgttt

SEQ ID NO: 7942657 - DNA, 22 bp, Homo sapiens
tagcagtcatcggcagagaaaa

SEQ ID NO: 7942658 - DNA, 22 bp, Homo sapiens
tagcagtgccctgtggaataag

SEQ ID NO: 7942659 - DNA, 22 bp, Homo sapiens
tagcagtgccaggattttgctg

SEQ ID NO: 7942660 - DNA, 22 bp, Homo sapiens
tagcaccttagcatttctagtg

SEQ ID NO: 7942661 - DNA, 21 bp, Homo sapiens
tagcacttcgctgtaattggg

SEQ ID NO: 7942662 - DNA, 22 bp, Homo sapiens
tagcacttctggggaatagaat

SEQ ID NO: 7942663 - DNA, 22 bp, Homo sapiens
tagcacttgtgttatgccttgt

SEQ ID NO: 7942664 - DNA, 21 bp, Homo sapiens
tagcagaaacagttcaggcca

SEQ ID NO: 7942665 - DNA, 22 bp, Homo sapiens
tagcacttgtgttatgccttgt

SEQ ID NO: 7942666 - DNA, 22 bp, Homo sapiens
tagcagaacaatagtcaatgat

SEQ ID NO: 7942667 - DNA, 22 bp, Homo sapiens
tagcagaaactgttacagaagg

SEQ ID NO: 7942668 - DNA, 21 bp, Homo sapiens
tagcagaaacagttcaggcca

SEQ ID NO: 7942669 - DNA, 22 bp, Homo sapiens
tagcagaaactgttacagaagg

SEQ ID NO: 7942670 - DNA, 22 bp, Homo sapiens
tagccatgtgtggaacacagcc

SEQ ID NO: 7942671 - DNA, 22 bp, Homo sapiens
tagccatgagcagatcactata

SEQ ID NO: 7942672 - DNA, 22 bp, Homo sapiens
tagccagttgcccagagtagaa

SEQ ID NO: 7942673 - DNA, 22 bp, Homo sapiens
tagccagtgagacccagaaata

SEQ ID NO: 7942674 - DNA, 22 bp, Homo sapiens
tagccagtgccatgggactgat

SEQ ID NO: 7942675 - DNA, 22 bp, Homo sapiens
tagccagtgggacggtgctgca

SEQ ID NO: 7942676 - DNA, 23 bp, Homo sapiens
tagccagtcattccagcaaggcc

SEQ ID NO: 7942677 - DNA, 22 bp, Homo sapiens
tagccagtgaatgtttccagtg

SEQ ID NO: 7942678 - DNA, 22 bp, Homo sapiens
tagccaggctggaagcaaaagg

SEQ ID NO: 7942679 - DNA, 22 bp, Homo sapiens
tagccaggctggaagcaaaagg

SEQ ID NO: 7942680 - DNA, 22 bp, Homo sapiens
tagccagggagacactgtggag

SEQ ID NO: 7942681 - DNA, 22 bp, Homo sapiens
tagccagggagacactgtggag

SEQ ID NO: 7942682 - DNA, 22 bp, Homo sapiens
tagccaggcgaggtcagtgtcg

SEQ ID NO: 7942683 - DNA, 23 bp, Homo sapiens
tagccaggcccagcatggacacc

SEQ ID NO: 7942684 - DNA, 23 bp, Homo sapiens
tagccaggcccagcatggacacc

SEQ ID NO: 7942685 - DNA, 22 bp, Homo sapiens
tagccaggcctttgatcccggc

SEQ ID NO: 7942686 - DNA, 22 bp, Homo sapiens
tagccaggctgcagctgatccg

SEQ ID NO: 7942687 - DNA, 22 bp, Homo sapiens
tagccaggctgcagctgatccg

SEQ ID NO: 7942688 - DNA, 22 bp, Homo sapiens
tagccaggctgcagctgatccg

SEQ ID NO: 7942689 - DNA, 22 bp, Homo sapiens
tagccaggcgaggtcagtgtcg

SEQ ID NO: 7942690 - DNA, 22 bp, Homo sapiens
tagccaggcctttgatcccggc

SEQ ID NO: 7942691 - DNA, 22 bp, Homo sapiens
tagccaggcaattatgggtgat

SEQ ID NO: 7942692 - DNA, 22 bp, Homo sapiens
tagccagctggataatgtgggg

SEQ ID NO: 7942693 - DNA, 22 bp, Homo sapiens
tagccaggcaattatgggtgat

SEQ ID NO: 7942694 - DNA, 23 bp, Homo sapiens
tagccaggcccagcatggacacc

SEQ ID NO: 7942695 - DNA, 22 bp, Homo sapiens
tagccactcccttaaggaggtt

SEQ ID NO: 7942696 - DNA, 22 bp, Homo sapiens
tagccactattcctgagctaga

SEQ ID NO: 7942697 - DNA, 22 bp, Homo sapiens
tagccactacctataccataag

SEQ ID NO: 7942698 - DNA, 22 bp, Homo sapiens
tagccaggcaattatgggtgat

SEQ ID NO: 7942699 - DNA, 22 bp, Homo sapiens
tagcatttggacattgtcacct

SEQ ID NO: 7942700 - DNA, 22 bp, Homo sapiens
tagcatttggcaccagttattt

SEQ ID NO: 7942701 - DNA, 22 bp, Homo sapiens
tagcatttctggcctctactca

SEQ ID NO: 7942702 - DNA, 22 bp, Homo sapiens
tagcatttcccaaatgcatttg

SEQ ID NO: 7942703 - DNA, 22 bp, Homo sapiens
tagcatttcccaaatgcatttg

SEQ ID NO: 7942704 - DNA, 22 bp, Homo sapiens
tagcatttctggcctctactca

SEQ ID NO: 7942705 - DNA, 22 bp, Homo sapiens
tagccaccagaaaggttttcag

SEQ ID NO: 7942706 - DNA, 22 bp, Homo sapiens
tagccacatgcagactttcatg

SEQ ID NO: 7942707 - DNA, 22 bp, Homo sapiens
tagccaatctccagcataaatc

SEQ ID NO: 7942708 - DNA, 22 bp, Homo sapiens
tagccaatctgaccagtctttt

SEQ ID NO: 7942709 - DNA, 22 bp, Homo sapiens
tagccaaagaaggtatatttgt

SEQ ID NO: 7942710 - DNA, 22 bp, Homo sapiens
tagccaaagaccttttcaaccc

SEQ ID NO: 7942711 - DNA, 21 bp, Homo sapiens
tagcatttttgtattgctgaa

SEQ ID NO: 7942712 - DNA, 22 bp, Homo sapiens
tagcatttattccagatttgga

SEQ ID NO: 7942713 - DNA, 22 bp, Homo sapiens
tagcatttatggtcatgtgtcc

SEQ ID NO: 7942714 - DNA, 22 bp, Homo sapiens
tagcatttatggtcatgtgtcc

SEQ ID NO: 7942715 - DNA, 17 bp, Homo sapiens
tagcatttatcttcctt

SEQ ID NO: 7942716 - DNA, 22 bp, Homo sapiens
tagcatttagaacaccttgaga

SEQ ID NO: 7942717 - DNA, 22 bp, Homo sapiens
tagcatttagaacaccttgaga

SEQ ID NO: 7942718 - DNA, 22 bp, Homo sapiens
tagcattccttgtggcttctga

SEQ ID NO: 7942719 - DNA, 22 bp, Homo sapiens
tagcagtggaatcttttgtcca

SEQ ID NO: 7942720 - DNA, 22 bp, Homo sapiens
tagcagtgccctgtggaataag

SEQ ID NO: 7942721 - DNA, 22 bp, Homo sapiens
tagcatttcactgatcttcact

SEQ ID NO: 7942722 - DNA, 22 bp, Homo sapiens
tagcatttcactgatcttcact

SEQ ID NO: 7942723 - DNA, 22 bp, Homo sapiens
tagcatttcccaaatgcatttg

SEQ ID NO: 7942724 - DNA, 22 bp, Homo sapiens
tagcatttcccaaatgcatttg

SEQ ID NO: 7942725 - DNA, 22 bp, Homo sapiens
tagcatttcactgatcttcact

SEQ ID NO: 7942726 - DNA, 22 bp, Homo sapiens
tagcatttcactgatcttcact

SEQ ID NO: 7942727 - DNA, 22 bp, Homo sapiens
tagcatttattccagatttgga

SEQ ID NO: 7942728 - DNA, 22 bp, Homo sapiens
tatgcatagtgatttagaacag

SEQ ID NO: 7942729 - DNA, 22 bp, Homo sapiens
tatgcatacaatgagatattcc

SEQ ID NO: 7942730 - DNA, 22 bp, Homo sapiens
tatgcagtggtatcattttaaa

SEQ ID NO: 7942731 - DNA, 21 bp, Homo sapiens
tatgcagtttacttaggtatt

SEQ ID NO: 7942732 - DNA, 22 bp, Homo sapiens
tatgcagtgtatgcactgagat

SEQ ID NO: 7942733 - DNA, 22 bp, Homo sapiens
tatgcataattggataagtaga

SEQ ID NO: 7942734 - DNA, 22 bp, Homo sapiens
tatgcataattggataagtaga

SEQ ID NO: 7942735 - DNA, 22 bp, Homo sapiens
tatgcatgtctttgcacacaaa

SEQ ID NO: 7942736 - DNA, 22 bp, Homo sapiens
tatgcatatgtgttcattggag

SEQ ID NO: 7942737 - DNA, 22 bp, Homo sapiens
tatgccactgctctccatccta

SEQ ID NO: 7942738 - DNA, 22 bp, Homo sapiens
tatgccactgctctccatccta

SEQ ID NO: 7942739 - DNA, 22 bp, Homo sapiens
tatgcattgtgagactgtggga

SEQ ID NO: 7942740 - DNA, 22 bp, Homo sapiens
tatctttgcaaatatctctaag

SEQ ID NO: 7942741 - DNA, 22 bp, Homo sapiens
tatgagttgtggcttagtcaca

SEQ ID NO: 7942742 - DNA, 22 bp, Homo sapiens
tatgagtttaaggctaaaatag

SEQ ID NO: 7942743 - DNA, 22 bp, Homo sapiens
tatctttgtatcaatctccatt

SEQ ID NO: 7942744 - DNA, 22 bp, Homo sapiens
tatgagtttaaggctaaaatag

SEQ ID NO: 7942745 - DNA, 22 bp, Homo sapiens
tatgagtttaaggctaaaatag

SEQ ID NO: 7942746 - DNA, 20 bp, Homo sapiens
tatgataattacaaaatagt

SEQ ID NO: 7942747 - DNA, 20 bp, Homo sapiens
tatgataattacaaaatagt

SEQ ID NO: 7942748 - DNA, 20 bp, Homo sapiens
tatgataattacaaaatagt

SEQ ID NO: 7942749 - DNA, 22 bp, Homo sapiens
tatgcagcatgagatcatcata

SEQ ID NO: 7942750 - DNA, 22 bp, Homo sapiens
tatgcagctggttaagaacaca

SEQ ID NO: 7942751 - DNA, 22 bp, Homo sapiens
tatgcagggtgggttctctgag

SEQ ID NO: 7942752 - DNA, 20 bp, Homo sapiens
tatgcagtatgtgtgtataa

SEQ ID NO: 7942753 - DNA, 22 bp, Homo sapiens
tatgcagagcatgactgtacca

SEQ ID NO: 7942754 - DNA, 22 bp, Homo sapiens
tatgcagagcatgactgtacca

SEQ ID NO: 7942755 - DNA, 22 bp, Homo sapiens
tatgcagaagtagggattggag

SEQ ID NO: 7942756 - DNA, 22 bp, Homo sapiens
tatgcactgaaaattaacagtt

SEQ ID NO: 7942757 - DNA, 22 bp, Homo sapiens
tatgcactggtactattcgtgt

SEQ ID NO: 7942758 - DNA, 22 bp, Homo sapiens
tatgcacattatctaatccatt

SEQ ID NO: 7942759 - DNA, 22 bp, Homo sapiens
tatgcacatataacctgcactg

SEQ ID NO: 7942760 - DNA, 22 bp, Homo sapiens
tatgatatgcactttatcagaa

SEQ ID NO: 7942761 - DNA, 22 bp, Homo sapiens
tatctttagaggaagagaatct

SEQ ID NO: 7942762 - DNA, 22 bp, Homo sapiens
tatctttaatgcttggaggtta

SEQ ID NO: 7942763 - DNA, 22 bp, Homo sapiens
tatctttaatgcttggaggtta

SEQ ID NO: 7942764 - DNA, 22 bp, Homo sapiens
tatctttaatgcttggaggtta

SEQ ID NO: 7942765 - DNA, 22 bp, Homo sapiens
tatctttaacttgcagtattta

SEQ ID NO: 7942766 - DNA, 22 bp, Homo sapiens
tatctttaacttgcagtattta

SEQ ID NO: 7942767 - DNA, 22 bp, Homo sapiens
tatctttaacttgcagtattta

SEQ ID NO: 7942768 - DNA, 22 bp, Homo sapiens
tatctttaacttgcagtattta

SEQ ID NO: 7942769 - DNA, 22 bp, Homo sapiens
tatctttaacttgcagtattta

SEQ ID NO: 7942770 - DNA, 22 bp, Homo sapiens
tatcttgcctttaactgctcat

SEQ ID NO: 7942771 - DNA, 22 bp, Homo sapiens
tatcttgatcaagtagaagagg

SEQ ID NO: 7942772 - DNA, 22 bp, Homo sapiens
tatcttgagagacaacacagca

SEQ ID NO: 7942773 - DNA, 21 bp, Homo sapiens
tatcttgggctctgtgcttga

SEQ ID NO: 7942774 - DNA, 22 bp, Homo sapiens
tatcttgtaataggtccacttg

SEQ ID NO: 7942775 - DNA, 22 bp, Homo sapiens
tatcttgtttaggtgcacaggt

SEQ ID NO: 7942776 - DNA, 22 bp, Homo sapiens
tatcttgtgggagagcagtgga

SEQ ID NO: 7942777 - DNA, 22 bp, Homo sapiens
tatctttagaggaagagaatct

SEQ ID NO: 7942778 - DNA, 22 bp, Homo sapiens
tatctttagaggaagagaatct

SEQ ID NO: 7942779 - DNA, 22 bp, Homo sapiens
tatctttagaggaagagaatct

SEQ ID NO: 7942780 - DNA, 22 bp, Homo sapiens
tatctttagaggaagagaatct

SEQ ID NO: 7942781 - DNA, 22 bp, Homo sapiens
tatctttagaggaagagaatct

SEQ ID NO: 7942782 - DNA, 22 bp, Homo sapiens
tatctttagaggaagagaatct

SEQ ID NO: 7942783 - DNA, 19 bp, Homo sapiens
tatctttatgcagtggtgg

SEQ ID NO: 7942784 - DNA, 19 bp, Homo sapiens
tatctttatgcagtggtgg

SEQ ID NO: 7942785 - DNA, 19 bp, Homo sapiens
tatctttatgcagtggtgg

SEQ ID NO: 7942786 - DNA, 22 bp, Homo sapiens
tatctttattatgtctatctgc

SEQ ID NO: 7942787 - DNA, 22 bp, Homo sapiens
tatctttctgtcctagattctg

SEQ ID NO: 7942788 - DNA, 22 bp, Homo sapiens
tatctttgatgccagatgttac

SEQ ID NO: 7942789 - DNA, 22 bp, Homo sapiens
tatctttgatgccagatgttac

SEQ ID NO: 7942790 - DNA, 22 bp, Homo sapiens
tatctttgatgccagatgttac

SEQ ID NO: 7942791 - DNA, 19 bp, Homo sapiens
tatctttatgcagtggtgg

SEQ ID NO: 7942792 - DNA, 19 bp, Homo sapiens
tatctttatgcagtggtgg

SEQ ID NO: 7942793 - DNA, 22 bp, Homo sapiens
tatctttattatgtctatctgc

SEQ ID NO: 7942794 - DNA, 22 bp, Homo sapiens
tatctttattatgtctatctgc

SEQ ID NO: 7942795 - DNA, 22 bp, Homo sapiens
tatctgtttttacagtgtcttt

SEQ ID NO: 7942796 - DNA, 22 bp, Homo sapiens
tatcttaaatgcatgatagaca

SEQ ID NO: 7942797 - DNA, 22 bp, Homo sapiens
tatcttaaatgcatgatagaca

SEQ ID NO: 7942798 - DNA, 19 bp, Homo sapiens
tatctgtttcctgcttgtc

SEQ ID NO: 7942799 - DNA, 19 bp, Homo sapiens
tatctgtttcctgcttgtc

SEQ ID NO: 7942800 - DNA, 22 bp, Homo sapiens
tatctgtttgctcacaggtgtt

SEQ ID NO: 7942801 - DNA, 22 bp, Homo sapiens
tatctgtttttacagtgtcttt

SEQ ID NO: 7942802 - DNA, 22 bp, Homo sapiens
tatctgttggctttggaaataa

SEQ ID NO: 7942803 - DNA, 22 bp, Homo sapiens
tatctgttgtagtacagatgat

SEQ ID NO: 7942804 - DNA, 22 bp, Homo sapiens
tatctgttgtccatgcagaaag

SEQ ID NO: 7942805 - DNA, 22 bp, Homo sapiens
tatctgttgtccatgcagaaag

SEQ ID NO: 7942806 - DNA, 22 bp, Homo sapiens
tatctgttgtccatgcagaaag

SEQ ID NO: 7942807 - DNA, 22 bp, Homo sapiens
tatctgttgtcttttacatgta

SEQ ID NO: 7942808 - DNA, 22 bp, Homo sapiens
tatctgttgtcttttacatgta

SEQ ID NO: 7942809 - DNA, 22 bp, Homo sapiens
tatctgtttattgttactgtca

SEQ ID NO: 7942810 - DNA, 22 bp, Homo sapiens
tatcttcatagatttttacacc

SEQ ID NO: 7942811 - DNA, 22 bp, Homo sapiens
tatcttcacttatatctttctt

SEQ ID NO: 7942812 - DNA, 22 bp, Homo sapiens
tatcttcagcacagatcctgtg

SEQ ID NO: 7942813 - DNA, 22 bp, Homo sapiens
tatcttcagctgaagcagagtc

SEQ ID NO: 7942814 - DNA, 22 bp, Homo sapiens
tatcttcagcacagatcctgtg

SEQ ID NO: 7942815 - DNA, 22 bp, Homo sapiens
tatcttcatagatttttacacc

SEQ ID NO: 7942816 - DNA, 22 bp, Homo sapiens
tatcttacagactgaatgttgg

SEQ ID NO: 7942817 - DNA, 23 bp, Homo sapiens
tatcttacctcccttctttcctg

SEQ ID NO: 7942818 - DNA, 22 bp, Homo sapiens
tatcttcaatttattcaaggag

SEQ ID NO: 7942819 - DNA, 22 bp, Homo sapiens
tatatttaattagttgctggat

SEQ ID NO: 7942820 - DNA, 22 bp, Homo sapiens
tatatttaatcctagagccatt

SEQ ID NO: 7942821 - DNA, 22 bp, Homo sapiens
tatatttaatcctagagccatt

SEQ ID NO: 7942822 - DNA, 22 bp, Homo sapiens
tatattcaacaggctaatgtca

SEQ ID NO: 7942823 - DNA, 22 bp, Homo sapiens
tatattcaacaggctaatgtca

SEQ ID NO: 7942824 - DNA, 22 bp, Homo sapiens
tatattcaacaggctaatgtca

SEQ ID NO: 7942825 - DNA, 22 bp, Homo sapiens
tatatttaaatccaggttgaaa

SEQ ID NO: 7942826 - DNA, 22 bp, Homo sapiens
tatatttaatcctagagccatt

SEQ ID NO: 7942827 - DNA, 18 bp, Homo sapiens
tatatttcacacatattc

SEQ ID NO: 7942828 - DNA, 18 bp, Homo sapiens
tatatttcacacatattc

SEQ ID NO: 7942829 - DNA, 18 bp, Homo sapiens
tatatttcacacatattc

SEQ ID NO: 7942830 - DNA, 18 bp, Homo sapiens
tatatttcacacatattc

SEQ ID NO: 7942831 - DNA, 22 bp, Homo sapiens
tatatttgtgtgtgatttatga

SEQ ID NO: 7942832 - DNA, 22 bp, Homo sapiens
tatatttgtgtgtgatttatga

SEQ ID NO: 7942833 - DNA, 22 bp, Homo sapiens
tatatttgctaaatgtgtgcaa

SEQ ID NO: 7942834 - DNA, 22 bp, Homo sapiens
tatattttagacaccctcacgc

SEQ ID NO: 7942835 - DNA, 19 bp, Homo sapiens
tatatttgttgaataaaaa

SEQ ID NO: 7942836 - DNA, 19 bp, Homo sapiens
tatatttgttgaataaaaa

SEQ ID NO: 7942837 - DNA, 20 bp, Homo sapiens
tatattttctctttggcctt

SEQ ID NO: 7942838 - DNA, 20 bp, Homo sapiens
tatattttctctttggcctt

SEQ ID NO: 7942839 - DNA, 20 bp, Homo sapiens
tatattttctctttggcctt

SEQ ID NO: 7942840 - DNA, 22 bp, Homo sapiens
tatattttagacaccctcacgc

SEQ ID NO: 7942841 - DNA, 22 bp, Homo sapiens
tatattttagacaccctcacgc

SEQ ID NO: 7942842 - DNA, 22 bp, Homo sapiens
tatcaaaaggagttgaaagggg

SEQ ID NO: 7942843 - DNA, 22 bp, Homo sapiens
tatcaaaaggagttgaaagggg

SEQ ID NO: 7942844 - DNA, 22 bp, Homo sapiens
tatcaaaaggagttgaaagggg

SEQ ID NO: 7942845 - DNA, 22 bp, Homo sapiens
tatcaaaaggagttgaaagggg

SEQ ID NO: 7942846 - DNA, 20 bp, Homo sapiens
tatattttctctttggcctt

SEQ ID NO: 7942847 - DNA, 22 bp, Homo sapiens
tatcaaattgaggcagctgggg

SEQ ID NO: 7942848 - DNA, 22 bp, Homo sapiens
tatcaaattgaggcagctgggg

SEQ ID NO: 7942849 - DNA, 22 bp, Homo sapiens
tatcaaacttgttttttggtgt

SEQ ID NO: 7942850 - DNA, 22 bp, Homo sapiens
tatctgtgaaatgtgtttgtat

SEQ ID NO: 7942851 - DNA, 22 bp, Homo sapiens
tatctgtctttatcaggattta

SEQ ID NO: 7942852 - DNA, 22 bp, Homo sapiens
tatctgtctaatgggcagcaga

SEQ ID NO: 7942853 - DNA, 22 bp, Homo sapiens
tatctgtctaatgggcagcaga

SEQ ID NO: 7942854 - DNA, 22 bp, Homo sapiens
tatctataagtactaacatggt

SEQ ID NO: 7942855 - DNA, 22 bp, Homo sapiens
tatctataatgttttacttcct

SEQ ID NO: 7942856 - DNA, 22 bp, Homo sapiens
tatctgtcgcatacatacttgg

SEQ ID NO: 7942857 - DNA, 22 bp, Homo sapiens
tatctgtcgcatacatacttgg

SEQ ID NO: 7942858 - DNA, 22 bp, Homo sapiens
tatctgtcacctgtagggtagg

SEQ ID NO: 7942859 - DNA, 22 bp, Homo sapiens
tatctagtttgtctagctttgc

SEQ ID NO: 7942860 - DNA, 22 bp, Homo sapiens
tatctataagtactaacatggt

SEQ ID NO: 7942861 - DNA, 22 bp, Homo sapiens
tatctagatttctttctctgtg

SEQ ID NO: 7942862 - DNA, 22 bp, Homo sapiens
tatctagatttctttctctgtg

SEQ ID NO: 7942863 - DNA, 22 bp, Homo sapiens
tatctagatttctttctctgtg

SEQ ID NO: 7942864 - DNA, 22 bp, Homo sapiens
tatctagatggattttagtgaa

SEQ ID NO: 7942865 - DNA, 22 bp, Homo sapiens
tatctagatggattttagtgaa

SEQ ID NO: 7942866 - DNA, 22 bp, Homo sapiens
tatctagatggattttagtgaa

SEQ ID NO: 7942867 - DNA, 22 bp, Homo sapiens
tatctgttctgcttgattttga

SEQ ID NO: 7942868 - DNA, 22 bp, Homo sapiens
tatctgttggctcctagttgta

SEQ ID NO: 7942869 - DNA, 22 bp, Homo sapiens
tatctgttcttagctatagatg

SEQ ID NO: 7942870 - DNA, 22 bp, Homo sapiens
tatctgttctgcttgattttga

SEQ ID NO: 7942871 - DNA, 22 bp, Homo sapiens
tatctgttcatgtttatatgtc

SEQ ID NO: 7942872 - DNA, 22 bp, Homo sapiens
tatctgttccaggcactcagct

SEQ ID NO: 7942873 - DNA, 22 bp, Homo sapiens
tatctgttcatgtttatatgtc

SEQ ID NO: 7942874 - DNA, 22 bp, Homo sapiens
tatctgttcaatggaagatgac

SEQ ID NO: 7942875 - DNA, 22 bp, Homo sapiens
tatctgttatgggctgaattgc

SEQ ID NO: 7942876 - DNA, 22 bp, Homo sapiens
tatctgttatgggctgaattgc

SEQ ID NO: 7942877 - DNA, 22 bp, Homo sapiens
tatctgttaggatcagagctgg

SEQ ID NO: 7942878 - DNA, 22 bp, Homo sapiens
tatctgttaaaacaagctttaa

SEQ ID NO: 7942879 - DNA, 22 bp, Homo sapiens
tatctgttaggatcagagctgg

SEQ ID NO: 7942880 - DNA, 22 bp, Homo sapiens
tatcaattgggccaaatggtac

SEQ ID NO: 7942881 - DNA, 22 bp, Homo sapiens
tatcaattgggccaaatggtac

SEQ ID NO: 7942882 - DNA, 19 bp, Homo sapiens
tatcaatcacggcatcttt

SEQ ID NO: 7942883 - DNA, 22 bp, Homo sapiens
tatcaatatctcagtgtgcttc

SEQ ID NO: 7942884 - DNA, 22 bp, Homo sapiens
tatcaatatctcagtgtgcttc

SEQ ID NO: 7942885 - DNA, 22 bp, Homo sapiens
tatcaatacatgttatcagtgt

SEQ ID NO: 7942886 - DNA, 22 bp, Homo sapiens
tatcaatacatgttatcagtgt

SEQ ID NO: 7942887 - DNA, 22 bp, Homo sapiens
tatcacaattcctatagtttgt

SEQ ID NO: 7942888 - DNA, 22 bp, Homo sapiens
tatcacaattcctatagtttgt

SEQ ID NO: 7942889 - DNA, 22 bp, Homo sapiens
tatcacacgccttgcttcattt

SEQ ID NO: 7942890 - DNA, 22 bp, Homo sapiens
tatcacactcggaaatctagga

SEQ ID NO: 7942891 - DNA, 22 bp, Homo sapiens
tatcacagccttttggtgaggg

SEQ ID NO: 7942892 - DNA, 22 bp, Homo sapiens
tatctagatatttggataaatg

SEQ ID NO: 7942893 - DNA, 22 bp, Homo sapiens
tatcaatacatgttatcagtgt

SEQ ID NO: 7942894 - DNA, 21 bp, Homo sapiens
tatcaagatgttatggttgaa

SEQ ID NO: 7942895 - DNA, 22 bp, Homo sapiens
tatcaaggcatggaaaatgcta

SEQ ID NO: 7942896 - DNA, 22 bp, Homo sapiens
tatcaaggcatggaaaatgcta

SEQ ID NO: 7942897 - DNA, 21 bp, Homo sapiens
tatcaagatgttatggttgaa

SEQ ID NO: 7942898 - DNA, 22 bp, Homo sapiens
tatcaatacatgttatcagtgt

SEQ ID NO: 7942899 - DNA, 22 bp, Homo sapiens
tatcaatacatgttatcagtgt

SEQ ID NO: 7942900 - DNA, 22 bp, Homo sapiens
tatcaatacatgttatcagtgt

SEQ ID NO: 7942901 - DNA, 22 bp, Homo sapiens
tatcaatacatgttatcagtgt

SEQ ID NO: 7942902 - DNA, 22 bp, Homo sapiens
tatcaatacatgttatcagtgt

SEQ ID NO: 7942903 - DNA, 22 bp, Homo sapiens
tatcaatacatgttatcagtgt

SEQ ID NO: 7942904 - DNA, 22 bp, Homo sapiens
tatcaactgagattaaatattt

SEQ ID NO: 7942905 - DNA, 22 bp, Homo sapiens
tatcaacattaatattttctgg

SEQ ID NO: 7942906 - DNA, 22 bp, Homo sapiens
tatcaacattaatattttctgg

SEQ ID NO: 7942907 - DNA, 22 bp, Homo sapiens
tatattatcataaaaccattca

SEQ ID NO: 7942908 - DNA, 22 bp, Homo sapiens
tatattatcataaaaccattca

SEQ ID NO: 7942909 - DNA, 22 bp, Homo sapiens
tatattataagccctttcagaa

SEQ ID NO: 7942910 - DNA, 22 bp, Homo sapiens
tatattacctgcctgatctata

SEQ ID NO: 7942911 - DNA, 22 bp, Homo sapiens
tatattacctgcctgatctata

SEQ ID NO: 7942912 - DNA, 22 bp, Homo sapiens
tatattacctgcctgatctata

SEQ ID NO: 7942913 - DNA, 22 bp, Homo sapiens
tatattacctgcctgatctata

SEQ ID NO: 7942914 - DNA, 22 bp, Homo sapiens
tatattaacacccacttgcctc

SEQ ID NO: 7942915 - DNA, 22 bp, Homo sapiens
tatattaacacccacttgcctc

SEQ ID NO: 7942916 - DNA, 22 bp, Homo sapiens
tatattaaccatagggttctag

SEQ ID NO: 7942917 - DNA, 22 bp, Homo sapiens
tatattaacttgtgatcctgga

SEQ ID NO: 7942918 - DNA, 22 bp, Homo sapiens
tatattaacttgtgatcctgga

SEQ ID NO: 7942919 - DNA, 22 bp, Homo sapiens
tatattaacttgtgatcctgga

SEQ ID NO: 7942920 - DNA, 22 bp, Homo sapiens
tatattacatagtgtttgagat

SEQ ID NO: 7942921 - DNA, 22 bp, Homo sapiens
tatattacctgcctgatctata

SEQ ID NO: 7942922 - DNA, 22 bp, Homo sapiens
tatattaaatgaccagttttaa

SEQ ID NO: 7942923 - DNA, 22 bp, Homo sapiens
tatattaaatgaccagttttaa

SEQ ID NO: 7942924 - DNA, 22 bp, Homo sapiens
tatattaaagtgctttgcagtg

SEQ ID NO: 7942925 - DNA, 22 bp, Homo sapiens
tatattaaagtgctttgcagtg

SEQ ID NO: 7942926 - DNA, 22 bp, Homo sapiens
tatattaaatgaccagttttaa

SEQ ID NO: 7942927 - DNA, 22 bp, Homo sapiens
tatattaaagtgctttgcagtg

SEQ ID NO: 7942928 - DNA, 22 bp, Homo sapiens
tatattaaaccctctctgtagg

SEQ ID NO: 7942929 - DNA, 22 bp, Homo sapiens
tatattaaaccctctctgtagg

SEQ ID NO: 7942930 - DNA, 22 bp, Homo sapiens
tatattaaaccctctctgtagg

SEQ ID NO: 7942931 - DNA, 22 bp, Homo sapiens
tatattaaaccctctctgtagg

SEQ ID NO: 7942932 - DNA, 20 bp, Homo sapiens
tatatgtgtacatacacaca

SEQ ID NO: 7942933 - DNA, 22 bp, Homo sapiens
tatatgttgatactaattctgg

SEQ ID NO: 7942934 - DNA, 20 bp, Homo sapiens
tatatgtgtacatacacaca

SEQ ID NO: 7942935 - DNA, 22 bp, Homo sapiens
tatatgtagattgtaccaatgt

SEQ ID NO: 7942936 - DNA, 22 bp, Homo sapiens
tatatgtagattgtaccaatgt

SEQ ID NO: 7942937 - DNA, 22 bp, Homo sapiens
tatatgtagtcagtcagagtaa

SEQ ID NO: 7942938 - DNA, 22 bp, Homo sapiens
tatatgtagtcagtcagagtaa

SEQ ID NO: 7942939 - DNA, 22 bp, Homo sapiens
tatatgtagattgtaccaatgt

SEQ ID NO: 7942940 - DNA, 22 bp, Homo sapiens
tatatgtagattgtaccaatgt

SEQ ID NO: 7942941 - DNA, 22 bp, Homo sapiens
tatatgtagattgtaccaatgt

SEQ ID NO: 7942942 - DNA, 17 bp, Homo sapiens
tatatgtatgcctctcc

SEQ ID NO: 7942943 - DNA, 17 bp, Homo sapiens
tatatgtatgcctctcc

SEQ ID NO: 7942944 - DNA, 22 bp, Homo sapiens
tatatgtagtcagtcagagtaa

SEQ ID NO: 7942945 - DNA, 22 bp, Homo sapiens
tatatgtagtcagtcagagtaa

SEQ ID NO: 7942946 - DNA, 22 bp, Homo sapiens
tatatgtagtcagtcagagtaa

SEQ ID NO: 7942947 - DNA, 22 bp, Homo sapiens
tatatgtaaataagtctaatgt

SEQ ID NO: 7942948 - DNA, 22 bp, Homo sapiens
tatatgtaaataagtctaatgt

SEQ ID NO: 7942949 - DNA, 22 bp, Homo sapiens
tatatgtaaataagtctaatgt

SEQ ID NO: 7942950 - DNA, 22 bp, Homo sapiens
tatatgtaagctatgtaagagt

SEQ ID NO: 7942951 - DNA, 22 bp, Homo sapiens
tatatgtaagctatgtaagagt

SEQ ID NO: 7942952 - DNA, 22 bp, Homo sapiens
tatatgcatgcccatgtataca

SEQ ID NO: 7942953 - DNA, 22 bp, Homo sapiens
tatatgcatgcccatgtataca

SEQ ID NO: 7942954 - DNA, 22 bp, Homo sapiens
tatatgcatgcccatgtataca

SEQ ID NO: 7942955 - DNA, 22 bp, Homo sapiens
tatatgcttgggaaatggtaga

SEQ ID NO: 7942956 - DNA, 22 bp, Homo sapiens
tatatgcatgcccatgtataca

SEQ ID NO: 7942957 - DNA, 22 bp, Homo sapiens
tatatgcagattttcatcatcg

SEQ ID NO: 7942958 - DNA, 22 bp, Homo sapiens
tatatgcagtgtgtcattcaag

SEQ ID NO: 7942959 - DNA, 22 bp, Homo sapiens
tatatgcagattttcatcatcg

SEQ ID NO: 7942960 - DNA, 22 bp, Homo sapiens
tatagcaagcaggacagtctca

SEQ ID NO: 7942961 - DNA, 22 bp, Homo sapiens
tatagcaaggacataatatgct

SEQ ID NO: 7942962 - DNA, 22 bp, Homo sapiens
tatagcaaggacataatatgct

SEQ ID NO: 7942963 - DNA, 22 bp, Homo sapiens
tatagatagactgacgatacag

SEQ ID NO: 7942964 - DNA, 22 bp, Homo sapiens
tatagatagactgacgatacag

SEQ ID NO: 7942965 - DNA, 20 bp, Homo sapiens
tatagatcacatcttctagc

SEQ ID NO: 7942966 - DNA, 22 bp, Homo sapiens
tatagatcccccgtatgtgtga

SEQ ID NO: 7942967 - DNA, 22 bp, Homo sapiens
tatagatcttgctatttaagga

SEQ ID NO: 7942968 - DNA, 22 bp, Homo sapiens
tatagatagactgacgatacag

SEQ ID NO: 7942969 - DNA, 22 bp, Homo sapiens
tatagcaaaatagtttccacac

SEQ ID NO: 7942970 - DNA, 22 bp, Homo sapiens
tatagactgtgaaatttaggca

SEQ ID NO: 7942971 - DNA, 22 bp, Homo sapiens
tatagactagcagcagaattta

SEQ ID NO: 7942972 - DNA, 22 bp, Homo sapiens
tatagacaagcgtaacaagaag

SEQ ID NO: 7942973 - DNA, 22 bp, Homo sapiens
tatagacaagcgtaacaagaag

SEQ ID NO: 7942974 - DNA, 22 bp, Homo sapiens
tatagacaagcgtaacaagaag

SEQ ID NO: 7942975 - DNA, 22 bp, Homo sapiens
tatagacttggcatgcatgttc

SEQ ID NO: 7942976 - DNA, 22 bp, Homo sapiens
tatagactgtgaaatttaggca

SEQ ID NO: 7942977 - DNA, 22 bp, Homo sapiens
tatagacttgatggtattaagt

SEQ ID NO: 7942978 - DNA, 22 bp, Homo sapiens
tatagaggccaccaacatgaaa

SEQ ID NO: 7942979 - DNA, 20 bp, Homo sapiens
tatactaacatatatctgtt

SEQ ID NO: 7942980 - DNA, 20 bp, Homo sapiens
tatactaacatatatctgtt

SEQ ID NO: 7942981 - DNA, 22 bp, Homo sapiens
tataccttgagcagggcggccc

SEQ ID NO: 7942982 - DNA, 22 bp, Homo sapiens
tatacctttaccttgaccaaat

SEQ ID NO: 7942983 - DNA, 22 bp, Homo sapiens
tataccttccacaaaacagctt

SEQ ID NO: 7942984 - DNA, 22 bp, Homo sapiens
tataccatgtgtgcacactccc

SEQ ID NO: 7942985 - DNA, 20 bp, Homo sapiens
tatactaacatatatctgtt

SEQ ID NO: 7942986 - DNA, 22 bp, Homo sapiens
tatactatgcttctgatccaat

SEQ ID NO: 7942987 - DNA, 22 bp, Homo sapiens
tatactatgcttctgatccaat

SEQ ID NO: 7942988 - DNA, 22 bp, Homo sapiens
tataccatgtgtgcacactccc

SEQ ID NO: 7942989 - DNA, 22 bp, Homo sapiens
tataccaaaatatcagaaaggg

SEQ ID NO: 7942990 - DNA, 22 bp, Homo sapiens
tataccaaaaaaattcttgtct

SEQ ID NO: 7942991 - DNA, 22 bp, Homo sapiens
tatacatgttttacataagtga

SEQ ID NO: 7942992 - DNA, 22 bp, Homo sapiens
tataccaaaaaaattcttgtct

SEQ ID NO: 7942993 - DNA, 22 bp, Homo sapiens
tatacatgttttacataagtga

SEQ ID NO: 7942994 - DNA, 22 bp, Homo sapiens
tatacatgttttacataagtga

SEQ ID NO: 7942995 - DNA, 22 bp, Homo sapiens
tatacagatatctaagatgtaa

SEQ ID NO: 7942996 - DNA, 22 bp, Homo sapiens
tatacagatatctaagatgtaa

SEQ ID NO: 7942997 - DNA, 22 bp, Homo sapiens
tatacagatatctaagatgtaa

SEQ ID NO: 7942998 - DNA, 21 bp, Homo sapiens
tatacatgtgtgcatacgtgt

SEQ ID NO: 7942999 - DNA, 22 bp, Homo sapiens
tatacagataatgaagaccaag

SEQ ID NO: 7943000 - DNA, 22 bp, Homo sapiens
tatacagataatgaagaccaag

SEQ ID NO: 7943001 - DNA, 22 bp, Homo sapiens
tatacttatgctaaaaaatgtt

SEQ ID NO: 7943002 - DNA, 22 bp, Homo sapiens
tatacttatgctaaaaaatgtt

SEQ ID NO: 7943003 - DNA, 22 bp, Homo sapiens
tatacttatgctaaaaaatgtt

SEQ ID NO: 7943004 - DNA, 22 bp, Homo sapiens
tatactgtcgcattacactcac

SEQ ID NO: 7943005 - DNA, 22 bp, Homo sapiens
tatactgtcgcattacactcac

SEQ ID NO: 7943006 - DNA, 22 bp, Homo sapiens
tatactgatttgtctatactct

SEQ ID NO: 7943007 - DNA, 22 bp, Homo sapiens
tatactgatttgtctatactct

SEQ ID NO: 7943008 - DNA, 22 bp, Homo sapiens
tatactgatttgtctatactct

SEQ ID NO: 7943009 - DNA, 22 bp, Homo sapiens
tatactgatttgtctatactct

SEQ ID NO: 7943010 - DNA, 22 bp, Homo sapiens
tatactctgagaaacgtgtcac

SEQ ID NO: 7943011 - DNA, 22 bp, Homo sapiens
tatactgagagcaaatacattc

SEQ ID NO: 7943012 - DNA, 22 bp, Homo sapiens
tatactgagtgtgttaatgatg

SEQ ID NO: 7943013 - DNA, 22 bp, Homo sapiens
tatactgatcactgaggtcatc

SEQ ID NO: 7943014 - DNA, 22 bp, Homo sapiens
tatactgagagcaaatacattc

SEQ ID NO: 7943015 - DNA, 22 bp, Homo sapiens
tatagacaagcgtaacaagaag

SEQ ID NO: 7943016 - DNA, 22 bp, Homo sapiens
tatagaagtaagcattgtgatg

SEQ ID NO: 7943017 - DNA, 22 bp, Homo sapiens
tatagaagtaagcattgtgatg

SEQ ID NO: 7943018 - DNA, 22 bp, Homo sapiens
tatagaacaagttatttatgct

SEQ ID NO: 7943019 - DNA, 22 bp, Homo sapiens
tatagaagagacatgtgcatag

SEQ ID NO: 7943020 - DNA, 22 bp, Homo sapiens
tatactttcctgcaactttgat

SEQ ID NO: 7943021 - DNA, 22 bp, Homo sapiens
tatactttcctgcaactttgat

SEQ ID NO: 7943022 - DNA, 22 bp, Homo sapiens
tatacttatgctaaaaaatgtt

SEQ ID NO: 7943023 - DNA, 22 bp, Homo sapiens
tatacttatgctaaaaaatgtt

SEQ ID NO: 7943024 - DNA, 22 bp, Homo sapiens
tagtgtcaaacagggattagaa

SEQ ID NO: 7943025 - DNA, 22 bp, Homo sapiens
tagtgtcaaacagggattagaa

SEQ ID NO: 7943026 - DNA, 22 bp, Homo sapiens
tagtgtcaaatagcctgagctt

SEQ ID NO: 7943027 - DNA, 23 bp, Homo sapiens
tagtgtcaagagggagtgtaatt

SEQ ID NO: 7943028 - DNA, 23 bp, Homo sapiens
tagtgtcaagagggagtgtaatt

SEQ ID NO: 7943029 - DNA, 23 bp, Homo sapiens
tagtgtcaagagggagtgtaatt

SEQ ID NO: 7943030 - DNA, 22 bp, Homo sapiens
tagtgtcagggagtgataaatg

SEQ ID NO: 7943031 - DNA, 22 bp, Homo sapiens
tagtgtcaggagggaaatgcaa

SEQ ID NO: 7943032 - DNA, 22 bp, Homo sapiens
tagtgtcatcgttgcagctgag

SEQ ID NO: 7943033 - DNA, 23 bp, Homo sapiens
tagtgtcatcctcagcttctgtt

SEQ ID NO: 7943034 - DNA, 19 bp, Homo sapiens
tagtgtcaaggaggagggt

SEQ ID NO: 7943035 - DNA, 22 bp, Homo sapiens
tagtgtcagagaatcttggttt

SEQ ID NO: 7943036 - DNA, 19 bp, Homo sapiens
tagtgtcaaggaggagggt

SEQ ID NO: 7943037 - DNA, 22 bp, Homo sapiens
tagtgtcagcatctcattgagc

SEQ ID NO: 7943038 - DNA, 22 bp, Homo sapiens
tagtgtcaggagggaaatgcaa

SEQ ID NO: 7943039 - DNA, 22 bp, Homo sapiens
tagtgttttctagaatggtttt

SEQ ID NO: 7943040 - DNA, 22 bp, Homo sapiens
tagtgtttagtacatatgcata

SEQ ID NO: 7943041 - DNA, 22 bp, Homo sapiens
tagtgtttgggaattgtagaga

SEQ ID NO: 7943042 - DNA, 22 bp, Homo sapiens
tagttaaaataatggagatgtt

SEQ ID NO: 7943043 - DNA, 22 bp, Homo sapiens
tagtgtcatgaaaagtacacta

SEQ ID NO: 7943044 - DNA, 22 bp, Homo sapiens
tagtgtcatcgttgcagctgag

SEQ ID NO: 7943045 - DNA, 22 bp, Homo sapiens
tagtgtcatttcagtggagttt

SEQ ID NO: 7943046 - DNA, 22 bp, Homo sapiens
tagtgtcatgaaaagtacacta

SEQ ID NO: 7943047 - DNA, 22 bp, Homo sapiens
tagtgtcatttcagtggagttt

SEQ ID NO: 7943048 - DNA, 22 bp, Homo sapiens
tagtgtttagtacatatgcata

SEQ ID NO: 7943049 - DNA, 22 bp, Homo sapiens
tatacagaaccgcctgaagtct

SEQ ID NO: 7943050 - DNA, 22 bp, Homo sapiens
tatacagaactgcacgtgcacg

SEQ ID NO: 7943051 - DNA, 22 bp, Homo sapiens
tagttaattctttaagaacaag

SEQ ID NO: 7943052 - DNA, 22 bp, Homo sapiens
tatacagaactgcacgtgcacg

SEQ ID NO: 7943053 - DNA, 21 bp, Homo sapiens
tatacagaggggaacaggaga

SEQ ID NO: 7943054 - DNA, 22 bp, Homo sapiens
tagttaatgctaattaacaaat

SEQ ID NO: 7943055 - DNA, 22 bp, Homo sapiens
tagttaaggccacttgcctaag

SEQ ID NO: 7943056 - DNA, 22 bp, Homo sapiens
tagttaatggaaatgatggaaa

SEQ ID NO: 7943057 - DNA, 22 bp, Homo sapiens
tagttaatgctaattaacaaat

SEQ ID NO: 7943058 - DNA, 22 bp, Homo sapiens
tagttaaagattctgttaagag

SEQ ID NO: 7943059 - DNA, 22 bp, Homo sapiens
tagttaaagattctgttaagag

SEQ ID NO: 7943060 - DNA, 22 bp, Homo sapiens
tagttaaaataatggagatgtt

SEQ ID NO: 7943061 - DNA, 22 bp, Homo sapiens
tagttaaaccaccattctggta

SEQ ID NO: 7943062 - DNA, 22 bp, Homo sapiens
tagttaaagccctaaattgata

SEQ ID NO: 7943063 - DNA, 22 bp, Homo sapiens
tagttaaagccctaaattgata

SEQ ID NO: 7943064 - DNA, 22 bp, Homo sapiens
tagttaaagccctaaattgata

SEQ ID NO: 7943065 - DNA, 22 bp, Homo sapiens
tagttaaagccctaaattgata

SEQ ID NO: 7943066 - DNA, 22 bp, Homo sapiens
tagttaaagccctaaattgata

SEQ ID NO: 7943067 - DNA, 22 bp, Homo sapiens
tagttaactcttggtaataggt

SEQ ID NO: 7943068 - DNA, 22 bp, Homo sapiens
tagttaaagccctaaattgata

SEQ ID NO: 7943069 - DNA, 22 bp, Homo sapiens
tagttaaagccctaaattgata

SEQ ID NO: 7943070 - DNA, 22 bp, Homo sapiens
tatgcgtgcctctgtctgtctg

SEQ ID NO: 7943071 - DNA, 22 bp, Homo sapiens
tatgctagatggaaaaatattg

SEQ ID NO: 7943072 - DNA, 22 bp, Homo sapiens
tatgctattttaatgaagatgt

SEQ ID NO: 7943073 - DNA, 22 bp, Homo sapiens
tatgctattttaatgaagatgt

SEQ ID NO: 7943074 - DNA, 22 bp, Homo sapiens
tatgctactagaaataaaatgg

SEQ ID NO: 7943075 - DNA, 22 bp, Homo sapiens
tatgctgagtatataaaacaga

SEQ ID NO: 7943076 - DNA, 22 bp, Homo sapiens
tatgctgattatatctttggtt

SEQ ID NO: 7943077 - DNA, 22 bp, Homo sapiens
tatgccagggactgtttcacca

SEQ ID NO: 7943078 - DNA, 22 bp, Homo sapiens
tatgccaggcgtggggtgaccg

SEQ ID NO: 7943079 - DNA, 22 bp, Homo sapiens
tatgccagactgtgagcttctt

SEQ ID NO: 7943080 - DNA, 22 bp, Homo sapiens
tatgccactgctctccatccta

SEQ ID NO: 7943081 - DNA, 22 bp, Homo sapiens
tatgccagcacttagatgagat

SEQ ID NO: 7943082 - DNA, 22 bp, Homo sapiens
tatgccactgctctccatccta

SEQ ID NO: 7943083 - DNA, 22 bp, Homo sapiens
tatgcctggaacctttctcttt

SEQ ID NO: 7943084 - DNA, 22 bp, Homo sapiens
tatgcctggggtgctcaggcca

SEQ ID NO: 7943085 - DNA, 22 bp, Homo sapiens
tatgcctatatgtgtgtttata

SEQ ID NO: 7943086 - DNA, 22 bp, Homo sapiens
tatgcctatatgtgtgtttata

SEQ ID NO: 7943087 - DNA, 22 bp, Homo sapiens
tatgccgcagccggatttcccc

SEQ ID NO: 7943088 - DNA, 22 bp, Homo sapiens
tatgcctgataactgtgtctct

SEQ ID NO: 7943089 - DNA, 16 bp, Homo sapiens
tatgtgtgtgggagtg

SEQ ID NO: 7943090 - DNA, 17 bp, Homo sapiens
tatgtgtgtgtttatac

SEQ ID NO: 7943091 - DNA, 17 bp, Homo sapiens
tatgtgtgtgtttatac

SEQ ID NO: 7943092 - DNA, 22 bp, Homo sapiens
tatgctgtattctgtatgttag

SEQ ID NO: 7943093 - DNA, 22 bp, Homo sapiens
tatgctttaacattaaacaaca

SEQ ID NO: 7943094 - DNA, 22 bp, Homo sapiens
tatgctttaacattaaacaaca

SEQ ID NO: 7943095 - DNA, 22 bp, Homo sapiens
tatgctttaacattaaacaaca

SEQ ID NO: 7943096 - DNA, 17 bp, Homo sapiens
tatgtgtgtttgcagca

SEQ ID NO: 7943097 - DNA, 22 bp, Homo sapiens
tatgtgtgtttcagtggaaatg

SEQ ID NO: 7943098 - DNA, 22 bp, Homo sapiens
tatgtgttgtatatgtgcagag

SEQ ID NO: 7943099 - DNA, 22 bp, Homo sapiens
tatgtgtttgacaccctgcaag

SEQ ID NO: 7943100 - DNA, 22 bp, Homo sapiens
tatgtgtttgacaccctgcaag

SEQ ID NO: 7943101 - DNA, 22 bp, Homo sapiens
tatgtttacgctggtagaatta

SEQ ID NO: 7943102 - DNA, 22 bp, Homo sapiens
tatgtttacgctggtagaatta

SEQ ID NO: 7943103 - DNA, 22 bp, Homo sapiens
tatgtttacgctggtagaatta

SEQ ID NO: 7943104 - DNA, 22 bp, Homo sapiens
tatgtttacgctggtagaatta

SEQ ID NO: 7943105 - DNA, 22 bp, Homo sapiens
tatgtttacgctggtagaatta

SEQ ID NO: 7943106 - DNA, 22 bp, Homo sapiens
tatgtttagtatccattttcag

SEQ ID NO: 7943107 - DNA, 22 bp, Homo sapiens
tatgtttagtatccattttcag

SEQ ID NO: 7943108 - DNA, 22 bp, Homo sapiens
tatgtttaaatgtatgtgtatg

SEQ ID NO: 7943109 - DNA, 22 bp, Homo sapiens
tatgtttaaatgtatgtgtatg

SEQ ID NO: 7943110 - DNA, 22 bp, Homo sapiens
tatgtttaaatgtatgtgtatg

SEQ ID NO: 7943111 - DNA, 22 bp, Homo sapiens
tatgttgtagctagtaataaat

SEQ ID NO: 7943112 - DNA, 22 bp, Homo sapiens
tatgttgtggcctgaataactg

SEQ ID NO: 7943113 - DNA, 22 bp, Homo sapiens
tatgttgtggcctgaataactg

SEQ ID NO: 7943114 - DNA, 22 bp, Homo sapiens
tatgttgtggggtgcatcaaaa

SEQ ID NO: 7943115 - DNA, 22 bp, Homo sapiens
tatgttgtggggtgcatcaaaa

SEQ ID NO: 7943116 - DNA, 22 bp, Homo sapiens
tatgtttaaatgtatgtgtatg

SEQ ID NO: 7943117 - DNA, 22 bp, Homo sapiens
tatgttgagtgaaagaagctag

SEQ ID NO: 7943118 - DNA, 22 bp, Homo sapiens
tatgttgaaattctgaccttca

SEQ ID NO: 7943119 - DNA, 22 bp, Homo sapiens
tatgttgcaccaacctaataat

SEQ ID NO: 7943120 - DNA, 22 bp, Homo sapiens
tatgttgcaccaacctaataat

SEQ ID NO: 7943121 - DNA, 22 bp, Homo sapiens
tatgttgagcattcagtgatct

SEQ ID NO: 7943122 - DNA, 22 bp, Homo sapiens
tatgttctttacatctgtgcaa

SEQ ID NO: 7943123 - DNA, 22 bp, Homo sapiens
tatgttctgtctgtacagattt

SEQ ID NO: 7943124 - DNA, 22 bp, Homo sapiens
tatgttcttagaagaggcagca

SEQ ID NO: 7943125 - DNA, 22 bp, Homo sapiens
tatgttcttggactaagttgtt

SEQ ID NO: 7943126 - DNA, 22 bp, Homo sapiens
tatgttcttggaaatgaagctt

SEQ ID NO: 7943127 - DNA, 22 bp, Homo sapiens
tatgttctgactctacatggga

SEQ ID NO: 7943128 - DNA, 22 bp, Homo sapiens
tatgttctctgctctaggatgt

SEQ ID NO: 7943129 - DNA, 22 bp, Homo sapiens
tatgttctgactctacatggga

SEQ ID NO: 7943130 - DNA, 22 bp, Homo sapiens
tatgttctgactctacatggga

SEQ ID NO: 7943131 - DNA, 22 bp, Homo sapiens
tatgttcagaagaagaatgggg

SEQ ID NO: 7943132 - DNA, 22 bp, Homo sapiens
tatgttcatctggtgcatcagt

SEQ ID NO: 7943133 - DNA, 22 bp, Homo sapiens
tatgttcagaagaagaatgggg

SEQ ID NO: 7943134 - DNA, 22 bp, Homo sapiens
tatgttcagaagaagaatgggg

SEQ ID NO: 7943135 - DNA, 22 bp, Homo sapiens
tatgttcatagaaatcatgacc

SEQ ID NO: 7943136 - DNA, 22 bp, Homo sapiens
tatgttattttcatacaacaga

SEQ ID NO: 7943137 - DNA, 22 bp, Homo sapiens
tatgttattttcatacaacaga

SEQ ID NO: 7943138 - DNA, 22 bp, Homo sapiens
tatgttctaaccttgtctttcc

SEQ ID NO: 7943139 - DNA, 22 bp, Homo sapiens
tatgttcatgtcaaacaaatgc

SEQ ID NO: 7943140 - DNA, 22 bp, Homo sapiens
tatgttctaaccttgtctttcc

SEQ ID NO: 7943141 - DNA, 22 bp, Homo sapiens
tatgttctagacttttgctgtg

SEQ ID NO: 7943142 - DNA, 22 bp, Homo sapiens
tatgttctaggaatggttgatg

SEQ ID NO: 7943143 - DNA, 22 bp, Homo sapiens
tatgttcatgcttatgcagaat

SEQ ID NO: 7943144 - DNA, 22 bp, Homo sapiens
tatgttcatgcttatgcagaat

SEQ ID NO: 7943145 - DNA, 22 bp, Homo sapiens
tatgttcatctggtgcatcagt

SEQ ID NO: 7943146 - DNA, 22 bp, Homo sapiens
tatgttcatctggtgcatcagt

SEQ ID NO: 7943147 - DNA, 22 bp, Homo sapiens
tatgttaagtgggataatcaaa

SEQ ID NO: 7943148 - DNA, 22 bp, Homo sapiens
tatgttaagtgggataatcaaa

SEQ ID NO: 7943149 - DNA, 22 bp, Homo sapiens
tatgttaagtgggataatcaaa

SEQ ID NO: 7943150 - DNA, 22 bp, Homo sapiens
tatgttaagtgggataatcaaa

SEQ ID NO: 7943151 - DNA, 22 bp, Homo sapiens
tatgttaagtgggataatcaaa

SEQ ID NO: 7943152 - DNA, 22 bp, Homo sapiens
tatgttacaaagtttttctaaa

SEQ ID NO: 7943153 - DNA, 22 bp, Homo sapiens
tatgttactcacatgttcttgc

SEQ ID NO: 7943154 - DNA, 22 bp, Homo sapiens
tatgttacaaagtttttctaaa

SEQ ID NO: 7943155 - DNA, 21 bp, Homo sapiens
tatgttagtgatgtttgtagg

SEQ ID NO: 7943156 - DNA, 19 bp, Homo sapiens
tatgttatgttgtttactc

SEQ ID NO: 7943157 - DNA, 22 bp, Homo sapiens
tatgttactcacatgttcttgc

SEQ ID NO: 7943158 - DNA, 22 bp, Homo sapiens
tatgttacttctgtatctgctt

SEQ ID NO: 7943159 - DNA, 22 bp, Homo sapiens
tatgttattttcatacaacaga

SEQ ID NO: 7943160 - DNA, 22 bp, Homo sapiens
tatgttattttcatacaacaga

SEQ ID NO: 7943161 - DNA, 19 bp, Homo sapiens
tatgttatgttgtttactc

SEQ ID NO: 7943162 - DNA, 22 bp, Homo sapiens
tattcacatgaaaacaaatttt

SEQ ID NO: 7943163 - DNA, 22 bp, Homo sapiens
tattcacatgaaaacaaatttt

SEQ ID NO: 7943164 - DNA, 22 bp, Homo sapiens
tattcacatgaaaacaaatttt

SEQ ID NO: 7943165 - DNA, 22 bp, Homo sapiens
tattcacatgaaaacaaatttt

SEQ ID NO: 7943166 - DNA, 22 bp, Homo sapiens
tattcacatgtacatatgctca

SEQ ID NO: 7943167 - DNA, 22 bp, Homo sapiens
tattcacatgtacatatgctca

SEQ ID NO: 7943168 - DNA, 22 bp, Homo sapiens
tattcacattaataagtcttca

SEQ ID NO: 7943169 - DNA, 22 bp, Homo sapiens
tattcacattaataagtcttca

SEQ ID NO: 7943170 - DNA, 22 bp, Homo sapiens
tattcacatgtacatatgctca

SEQ ID NO: 7943171 - DNA, 22 bp, Homo sapiens
tattcacatgtacatatgctca

SEQ ID NO: 7943172 - DNA, 22 bp, Homo sapiens
tattcacatgaaaacaaatttt

SEQ ID NO: 7943173 - DNA, 22 bp, Homo sapiens
tattcacagttgatttacagtt

SEQ ID NO: 7943174 - DNA, 22 bp, Homo sapiens
tattcacagttgatttacagtt

SEQ ID NO: 7943175 - DNA, 22 bp, Homo sapiens
tattcacagttgatttacagtt

SEQ ID NO: 7943176 - DNA, 22 bp, Homo sapiens
tattcacagttgatttacagtt

SEQ ID NO: 7943177 - DNA, 22 bp, Homo sapiens
tattcacagttgatttacagtt

SEQ ID NO: 7943178 - DNA, 22 bp, Homo sapiens
tattcacaggctggagtgatgt

SEQ ID NO: 7943179 - DNA, 22 bp, Homo sapiens
tattcacaggttctggggatca

SEQ ID NO: 7943180 - DNA, 22 bp, Homo sapiens
tattcacaggttccggagatta

SEQ ID NO: 7943181 - DNA, 22 bp, Homo sapiens
tattcacaggttccggagatta

SEQ ID NO: 7943182 - DNA, 22 bp, Homo sapiens
tattcacaggctggagtgatgt

SEQ ID NO: 7943183 - DNA, 22 bp, Homo sapiens
tattcacaggctggagtgatgt

SEQ ID NO: 7943184 - DNA, 22 bp, Homo sapiens
tattcacagctgccgcactcag

SEQ ID NO: 7943185 - DNA, 22 bp, Homo sapiens
tattcacaaaatgaggtcctca

SEQ ID NO: 7943186 - DNA, 22 bp, Homo sapiens
tattcacaaaatgaggtcctca

SEQ ID NO: 7943187 - DNA, 22 bp, Homo sapiens
tattcacaggcacgaaatattg

SEQ ID NO: 7943188 - DNA, 22 bp, Homo sapiens
tattcacaggcacgaaatattg

SEQ ID NO: 7943189 - DNA, 22 bp, Homo sapiens
tattcacaggcacgaaatattg

SEQ ID NO: 7943190 - DNA, 22 bp, Homo sapiens
tattcacaggctggagtgatgt

SEQ ID NO: 7943191 - DNA, 22 bp, Homo sapiens
tattcacaggcacgaaatattg

SEQ ID NO: 7943192 - DNA, 22 bp, Homo sapiens
tatgtttatactttgatgtact

SEQ ID NO: 7943193 - DNA, 22 bp, Homo sapiens
tattcaaagtaccttcattgcc

SEQ ID NO: 7943194 - DNA, 22 bp, Homo sapiens
tatgtttatactttgatgtact

SEQ ID NO: 7943195 - DNA, 22 bp, Homo sapiens
tatgtttatactttgatgtact

SEQ ID NO: 7943196 - DNA, 22 bp, Homo sapiens
tatgtttatactttgatgtact

SEQ ID NO: 7943197 - DNA, 22 bp, Homo sapiens
tattcaagattgaactggcaga

SEQ ID NO: 7943198 - DNA, 20 bp, Homo sapiens
tattcaactttaaaaactta

SEQ ID NO: 7943199 - DNA, 22 bp, Homo sapiens
tattcaagattgaactggcaga

SEQ ID NO: 7943200 - DNA, 22 bp, Homo sapiens
tattcaaagtgcgaggtcaggg

SEQ ID NO: 7943201 - DNA, 22 bp, Homo sapiens
tattcaaagtgcgaggtcaggg

SEQ ID NO: 7943202 - DNA, 22 bp, Homo sapiens
tattcaaagtgcgaggtcaggg

SEQ ID NO: 7943203 - DNA, 20 bp, Homo sapiens
tattcaactttaaaaactta

SEQ ID NO: 7943204 - DNA, 22 bp, Homo sapiens
tattgaggtgcttagctggggg

SEQ ID NO: 7943205 - DNA, 22 bp, Homo sapiens
tattgagtaattattacttcaa

SEQ ID NO: 7943206 - DNA, 22 bp, Homo sapiens
tattgaggattgaggaaagcac

SEQ ID NO: 7943207 - DNA, 22 bp, Homo sapiens
tattgaggaaacagagcaggca

SEQ ID NO: 7943208 - DNA, 22 bp, Homo sapiens
tattgaggtgcttagctggggg

SEQ ID NO: 7943209 - DNA, 20 bp, Homo sapiens
tattgagtacctactgtata

SEQ ID NO: 7943210 - DNA, 22 bp, Homo sapiens
tattgataaaatgctcactatg

SEQ ID NO: 7943211 - DNA, 22 bp, Homo sapiens
tattgataaaatgctcactatg

SEQ ID NO: 7943212 - DNA, 22 bp, Homo sapiens
tattgataaaatgctcactatg

SEQ ID NO: 7943213 - DNA, 22 bp, Homo sapiens
tattgatgtatttctaggtgct

SEQ ID NO: 7943214 - DNA, 22 bp, Homo sapiens
tattgatgcttggattgggcca

SEQ ID NO: 7943215 - DNA, 22 bp, Homo sapiens
tattgatgtatttctaggtgct

SEQ ID NO: 7943216 - DNA, 22 bp, Homo sapiens
tattgatgcttggattgggcca

SEQ ID NO: 7943217 - DNA, 22 bp, Homo sapiens
tattgatgcagagccaaattgc

SEQ ID NO: 7943218 - DNA, 22 bp, Homo sapiens
tattgatgaaagggattttgga

SEQ ID NO: 7943219 - DNA, 22 bp, Homo sapiens
tattgatgcagagccaaattgc

SEQ ID NO: 7943220 - DNA, 22 bp, Homo sapiens
tattgatatgcagaactgactt

SEQ ID NO: 7943221 - DNA, 22 bp, Homo sapiens
tattgatatgcagaactgactt

SEQ ID NO: 7943222 - DNA, 22 bp, Homo sapiens
tattgatatgcagaactgactt

SEQ ID NO: 7943223 - DNA, 22 bp, Homo sapiens
tattgatatgcagaactgactt

SEQ ID NO: 7943224 - DNA, 22 bp, Homo sapiens
tattgatctggatatttagaca

SEQ ID NO: 7943225 - DNA, 22 bp, Homo sapiens
tattgatgaaagggattttgga

SEQ ID NO: 7943226 - DNA, 22 bp, Homo sapiens
tattcatgacattgcatatgca

SEQ ID NO: 7943227 - DNA, 22 bp, Homo sapiens
tattcatattgtaaaagaagtg

SEQ ID NO: 7943228 - DNA, 22 bp, Homo sapiens
tattgacatttttatagcttga

SEQ ID NO: 7943229 - DNA, 17 bp, Homo sapiens
tattgacctttgtatgt

SEQ ID NO: 7943230 - DNA, 22 bp, Homo sapiens
tattgaccagactgacacacat

SEQ ID NO: 7943231 - DNA, 22 bp, Homo sapiens
tattgacttgggcattgagaga

SEQ ID NO: 7943232 - DNA, 22 bp, Homo sapiens
tattgacttgggcattgagaga

SEQ ID NO: 7943233 - DNA, 22 bp, Homo sapiens
tattgagacttccagtatatga

SEQ ID NO: 7943234 - DNA, 22 bp, Homo sapiens
tattgagaccagtgcttgctta

SEQ ID NO: 7943235 - DNA, 22 bp, Homo sapiens
tattgaggaaacagagcaggca

SEQ ID NO: 7943236 - DNA, 19 bp, Homo sapiens
tattcaggatgatggcaca

SEQ ID NO: 7943237 - DNA, 22 bp, Homo sapiens
tattcagagtattccatgaggt

SEQ ID NO: 7943238 - DNA, 22 bp, Homo sapiens
tattcagattacttgtgcctgc

SEQ ID NO: 7943239 - DNA, 22 bp, Homo sapiens
tattcagagtgtagcaaataga

SEQ ID NO: 7943240 - DNA, 22 bp, Homo sapiens
tattcagagtgtagcaaataga

SEQ ID NO: 7943241 - DNA, 22 bp, Homo sapiens
tattcaggtcgagctaactgct

SEQ ID NO: 7943242 - DNA, 22 bp, Homo sapiens
tattcagtgacagggtattatg

SEQ ID NO: 7943243 - DNA, 22 bp, Homo sapiens
tattcatagtaaacaaaagtgg

SEQ ID NO: 7943244 - DNA, 22 bp, Homo sapiens
tattcatagtaaacaaaagtgg

SEQ ID NO: 7943245 - DNA, 22 bp, Homo sapiens
tattcatattgtaaaagaagtg

SEQ ID NO: 7943246 - DNA, 22 bp, Homo sapiens
tattcatagtaaacaaaagtgg

SEQ ID NO: 7943247 - DNA, 22 bp, Homo sapiens
tattcatagtaaacaaaagtgg

SEQ ID NO: 7943248 - DNA, 22 bp, Homo sapiens
tattcagaaaataaattggatt

SEQ ID NO: 7943249 - DNA, 21 bp, Homo sapiens
tattcaccgtaagaggagttc

SEQ ID NO: 7943250 - DNA, 22 bp, Homo sapiens
tattcagaaaactgagcgatga

SEQ ID NO: 7943251 - DNA, 22 bp, Homo sapiens
tattcagaataaagactacatt

SEQ ID NO: 7943252 - DNA, 22 bp, Homo sapiens
tattcacattctcaggcctggt

SEQ ID NO: 7943253 - DNA, 22 bp, Homo sapiens
tattcacattctcaggcctggt

SEQ ID NO: 7943254 - DNA, 22 bp, Homo sapiens
tattcacctcttgttcttcata

SEQ ID NO: 7943255 - DNA, 22 bp, Homo sapiens
tattcaccctgcctcctagttg

SEQ ID NO: 7943256 - DNA, 22 bp, Homo sapiens
tattcaccagatcccatatctt

SEQ ID NO: 7943257 - DNA, 22 bp, Homo sapiens
tatttgtatgtgtgtacatata

SEQ ID NO: 7943258 - DNA, 22 bp, Homo sapiens
tatttgtatgtgtgtacatata

SEQ ID NO: 7943259 - DNA, 22 bp, Homo sapiens
tatttgtatgtgtgtacatata

SEQ ID NO: 7943260 - DNA, 22 bp, Homo sapiens
tatttgtatttcatgcagtaaa

SEQ ID NO: 7943261 - DNA, 22 bp, Homo sapiens
tatttgtatttcatgcagtaaa

SEQ ID NO: 7943262 - DNA, 22 bp, Homo sapiens
tatttgtatttcatgcagtaaa

SEQ ID NO: 7943263 - DNA, 22 bp, Homo sapiens
tatttgtatgtgtgtacatata

SEQ ID NO: 7943264 - DNA, 22 bp, Homo sapiens
tatttgtagcttcccaaagctt

SEQ ID NO: 7943265 - DNA, 22 bp, Homo sapiens
tatttgtatgtgtgtacatata

SEQ ID NO: 7943266 - DNA, 22 bp, Homo sapiens
tatttgtatgtgtgtacatata

SEQ ID NO: 7943267 - DNA, 22 bp, Homo sapiens
tatttgtatgtgtgtacatata

SEQ ID NO: 7943268 - DNA, 22 bp, Homo sapiens
tatttgtatgtgtgtacatata

SEQ ID NO: 7943269 - DNA, 22 bp, Homo sapiens
tatttctaagctgtaagtctga

SEQ ID NO: 7943270 - DNA, 22 bp, Homo sapiens
tatttctaagctgtaagtctga

SEQ ID NO: 7943271 - DNA, 22 bp, Homo sapiens
tatttggagtgatggaaatgtt

SEQ ID NO: 7943272 - DNA, 22 bp, Homo sapiens
tatttggagtgatggaaatgtt

SEQ ID NO: 7943273 - DNA, 22 bp, Homo sapiens
tatttggaggccactgttgagt

SEQ ID NO: 7943274 - DNA, 22 bp, Homo sapiens
tatttggatacaatcatttgct

SEQ ID NO: 7943275 - DNA, 22 bp, Homo sapiens
tatttgtagaatggattaaggg

SEQ ID NO: 7943276 - DNA, 22 bp, Homo sapiens
tatttggttcttcttctgtgta

SEQ ID NO: 7943277 - DNA, 22 bp, Homo sapiens
tatttcagggagaataaatttg

SEQ ID NO: 7943278 - DNA, 22 bp, Homo sapiens
tatttccaggccccactctaga

SEQ ID NO: 7943279 - DNA, 22 bp, Homo sapiens
tatttccagcagtaagaagaca

SEQ ID NO: 7943280 - DNA, 22 bp, Homo sapiens
tatttccagcagtaagaagaca

SEQ ID NO: 7943281 - DNA, 22 bp, Homo sapiens
tatttccagcagtaagaagaca

SEQ ID NO: 7943282 - DNA, 22 bp, Homo sapiens
tatttccaggccccactctaga

SEQ ID NO: 7943283 - DNA, 22 bp, Homo sapiens
tatttccatgttagaactaagt

SEQ ID NO: 7943284 - DNA, 22 bp, Homo sapiens
tatttccatgttagaactaagt

SEQ ID NO: 7943285 - DNA, 22 bp, Homo sapiens
tatttcctgtggatacttttag

SEQ ID NO: 7943286 - DNA, 22 bp, Homo sapiens
tatttcctgtggatacttttag

SEQ ID NO: 7943287 - DNA, 22 bp, Homo sapiens
tatttcctgtggatacttttag

SEQ ID NO: 7943288 - DNA, 22 bp, Homo sapiens
tatttccatgttagaactaagt

SEQ ID NO: 7943289 - DNA, 22 bp, Homo sapiens
tatttcctgcatggtgatgtaa

SEQ ID NO: 7943290 - DNA, 22 bp, Homo sapiens
tatttctaagagatatctgtac

SEQ ID NO: 7943291 - DNA, 22 bp, Homo sapiens
tatttctaagagatatctgtac

SEQ ID NO: 7943292 - DNA, 22 bp, Homo sapiens
tatttctaagagatatctgtac

SEQ ID NO: 7943293 - DNA, 22 bp, Homo sapiens
tatttgttgcgggaattgctat

SEQ ID NO: 7943294 - DNA, 22 bp, Homo sapiens
tatttgttgcgggaattgctat

SEQ ID NO: 7943295 - DNA, 22 bp, Homo sapiens
tatttgtttctagtggcagcaa

SEQ ID NO: 7943296 - DNA, 22 bp, Homo sapiens
tatttgttgcgggaattgctat

SEQ ID NO: 7943297 - DNA, 22 bp, Homo sapiens
tattttcaccatgtatccctgt

SEQ ID NO: 7943298 - DNA, 22 bp, Homo sapiens
tattttcaccatgtatccctgt

SEQ ID NO: 7943299 - DNA, 22 bp, Homo sapiens
tattttcaccttctctggatat

SEQ ID NO: 7943300 - DNA, 22 bp, Homo sapiens
tattttcaccttctctggatat

SEQ ID NO: 7943301 - DNA, 22 bp, Homo sapiens
tattttcaccttctctggatat

SEQ ID NO: 7943302 - DNA, 22 bp, Homo sapiens
tattttcaccttctctggatat

SEQ ID NO: 7943303 - DNA, 22 bp, Homo sapiens
tattttcaccttctctggatat

SEQ ID NO: 7943304 - DNA, 22 bp, Homo sapiens
tattttcaccttctctggatat

SEQ ID NO: 7943305 - DNA, 22 bp, Homo sapiens
tattttcatcttgtccttggat

SEQ ID NO: 7943306 - DNA, 22 bp, Homo sapiens
tattttcatcttgtccttggat

SEQ ID NO: 7943307 - DNA, 22 bp, Homo sapiens
tattttcattctgtgtgactgt

SEQ ID NO: 7943308 - DNA, 22 bp, Homo sapiens
tattttcaccttctctggatat

SEQ ID NO: 7943309 - DNA, 22 bp, Homo sapiens
tattttcattctgtgtgactgt

SEQ ID NO: 7943310 - DNA, 22 bp, Homo sapiens
tattttcattctgtgtgactgt

SEQ ID NO: 7943311 - DNA, 22 bp, Homo sapiens
tattttcattctgtgtgactgt

SEQ ID NO: 7943312 - DNA, 22 bp, Homo sapiens
tattttcattctgtgtgactgt

SEQ ID NO: 7943313 - DNA, 22 bp, Homo sapiens
tattttcattctgtgtgactgt

SEQ ID NO: 7943314 - DNA, 22 bp, Homo sapiens
tattttcattctgtgtgactgt

SEQ ID NO: 7943315 - DNA, 22 bp, Homo sapiens
tatttgttccagagataaaaat

SEQ ID NO: 7943316 - DNA, 22 bp, Homo sapiens
tatttgttccagagataaaaat

SEQ ID NO: 7943317 - DNA, 22 bp, Homo sapiens
tatttgttccagagataaaaat

SEQ ID NO: 7943318 - DNA, 22 bp, Homo sapiens
tatttgtgtgggtatctatata

SEQ ID NO: 7943319 - DNA, 22 bp, Homo sapiens
tatttgttgagttgttatgtct

SEQ ID NO: 7943320 - DNA, 22 bp, Homo sapiens
tatttgttccagagataaaaat

SEQ ID NO: 7943321 - DNA, 22 bp, Homo sapiens
tatttgttgagttgttatgtct

SEQ ID NO: 7943322 - DNA, 22 bp, Homo sapiens
tatttgttgagttgttatgtct

SEQ ID NO: 7943323 - DNA, 22 bp, Homo sapiens
tatttgttgagttgttatgtct

SEQ ID NO: 7943324 - DNA, 22 bp, Homo sapiens
tatttgttgagttgttatgtct

SEQ ID NO: 7943325 - DNA, 22 bp, Homo sapiens
tatttgttgagttgttatgtct

SEQ ID NO: 7943326 - DNA, 22 bp, Homo sapiens
tatttgttgagttgttatgtct

SEQ ID NO: 7943327 - DNA, 22 bp, Homo sapiens
tatttgttgagttgttatgtct

SEQ ID NO: 7943328 - DNA, 22 bp, Homo sapiens
tatttgttgaatacccctgtct

SEQ ID NO: 7943329 - DNA, 22 bp, Homo sapiens
tatttgtatttcatgcagtaaa

SEQ ID NO: 7943330 - DNA, 22 bp, Homo sapiens
tatttgtatttcatgcagtaaa

SEQ ID NO: 7943331 - DNA, 22 bp, Homo sapiens
tatttgtatttcatgcagtaaa

SEQ ID NO: 7943332 - DNA, 22 bp, Homo sapiens
tatttgtatttcatgcagtaaa

SEQ ID NO: 7943333 - DNA, 22 bp, Homo sapiens
tatttgtcacctatggctgtcc

SEQ ID NO: 7943334 - DNA, 22 bp, Homo sapiens
tatttgtcacctatggctgtcc

SEQ ID NO: 7943335 - DNA, 20 bp, Homo sapiens
tatttgtatttgggaaagtt

SEQ ID NO: 7943336 - DNA, 22 bp, Homo sapiens
tatttgtcactagaaagggtaa

SEQ ID NO: 7943337 - DNA, 22 bp, Homo sapiens
tatttgtcactgcacttgaaat

SEQ ID NO: 7943338 - DNA, 22 bp, Homo sapiens
tatttgtcactgcacttgaaat

SEQ ID NO: 7943339 - DNA, 22 bp, Homo sapiens
tatttgtctggtctaaggaggg

SEQ ID NO: 7943340 - DNA, 22 bp, Homo sapiens
tatttgtctaagaggctgacag

SEQ ID NO: 7943341 - DNA, 22 bp, Homo sapiens
tatttgtccttattaagatctg

SEQ ID NO: 7943342 - DNA, 22 bp, Homo sapiens
tatttcacagcagctcatttaa

SEQ ID NO: 7943343 - DNA, 22 bp, Homo sapiens
tatttcacagcagctcatttaa

SEQ ID NO: 7943344 - DNA, 22 bp, Homo sapiens
tatttcacagcagctcatttaa

SEQ ID NO: 7943345 - DNA, 22 bp, Homo sapiens
tatttcacagcagctcatttaa

SEQ ID NO: 7943346 - DNA, 22 bp, Homo sapiens
tatttcacataccacagagtgt

SEQ ID NO: 7943347 - DNA, 22 bp, Homo sapiens
tatttcacataccacagagtgt

SEQ ID NO: 7943348 - DNA, 22 bp, Homo sapiens
tatttcacagcagctcatttaa

SEQ ID NO: 7943349 - DNA, 22 bp, Homo sapiens
tatttcacataccacagagtgt

SEQ ID NO: 7943350 - DNA, 22 bp, Homo sapiens
tatttcacctaaaagtgtcaaa

SEQ ID NO: 7943351 - DNA, 22 bp, Homo sapiens
tatttcacctcacccaggagaa

SEQ ID NO: 7943352 - DNA, 22 bp, Homo sapiens
tatttcaccatgttttccccat

SEQ ID NO: 7943353 - DNA, 22 bp, Homo sapiens
tatttcacattagataggtctg

SEQ ID NO: 7943354 - DNA, 22 bp, Homo sapiens
tatttcaacgtatgaaaagctg

SEQ ID NO: 7943355 - DNA, 22 bp, Homo sapiens
tatttcaacgtatgaaaagctg

SEQ ID NO: 7943356 - DNA, 22 bp, Homo sapiens
tattgtatcttaccacatgtat

SEQ ID NO: 7943357 - DNA, 22 bp, Homo sapiens
tattgtatcttaccacatgtat

SEQ ID NO: 7943358 - DNA, 22 bp, Homo sapiens
tattgtatcttaccacatgtat

SEQ ID NO: 7943359 - DNA, 22 bp, Homo sapiens
tattgtacatttcaaagtagct

SEQ ID NO: 7943360 - DNA, 22 bp, Homo sapiens
tatttcaagaacttctatccat

SEQ ID NO: 7943361 - DNA, 22 bp, Homo sapiens
tatttcaagaacttctatccat

SEQ ID NO: 7943362 - DNA, 22 bp, Homo sapiens
tatttcaagaacttctatccat

SEQ ID NO: 7943363 - DNA, 22 bp, Homo sapiens
tatttcaagaacttctatccat

SEQ ID NO: 7943364 - DNA, 22 bp, Homo sapiens
tatttcagcacatgggataggt

SEQ ID NO: 7943365 - DNA, 22 bp, Homo sapiens
tatttcagcaagaagaatgtgg

SEQ ID NO: 7943366 - DNA, 22 bp, Homo sapiens
tatttcagcaagaagaatgtgg

SEQ ID NO: 7943367 - DNA, 19 bp, Homo sapiens
tatttcaggctcagagtct

SEQ ID NO: 7943368 - DNA, 22 bp, Homo sapiens
tatttcagggagaataaatttg

SEQ ID NO: 7943369 - DNA, 22 bp, Homo sapiens
tatttcaggctatatttcttgt

SEQ ID NO: 7943370 - DNA, 22 bp, Homo sapiens
tatttcaggctatatttcttgt

SEQ ID NO: 7943371 - DNA, 22 bp, Homo sapiens
tatttcactattctctgtaact

SEQ ID NO: 7943372 - DNA, 22 bp, Homo sapiens
tatttcactattctctgtaact

SEQ ID NO: 7943373 - DNA, 22 bp, Homo sapiens
tatttcactcagtataccatag

SEQ ID NO: 7943374 - DNA, 22 bp, Homo sapiens
tatttcactcagtataccatag

SEQ ID NO: 7943375 - DNA, 22 bp, Homo sapiens
tatttcactattctctgtaact

SEQ ID NO: 7943376 - DNA, 22 bp, Homo sapiens
tatttcagagttgttttctgtc

SEQ ID NO: 7943377 - DNA, 18 bp, Homo sapiens
tatttcacttttgggcat

SEQ ID NO: 7943378 - DNA, 17 bp, Homo sapiens
tatttcactggctcccc

SEQ ID NO: 7943379 - DNA, 21 bp, Homo sapiens
tatttcagaagagtctcagag

SEQ ID NO: 7943380 - DNA, 22 bp, Homo sapiens
tattggtgatgacttgaggcca

SEQ ID NO: 7943381 - DNA, 22 bp, Homo sapiens
tattggtgatgacttgaggcca

SEQ ID NO: 7943382 - DNA, 22 bp, Homo sapiens
tattggtctgcttaagtggatt

SEQ ID NO: 7943383 - DNA, 22 bp, Homo sapiens
tattggtatctgagacagagtt

SEQ ID NO: 7943384 - DNA, 22 bp, Homo sapiens
tattggtatctgagacagagtt

SEQ ID NO: 7943385 - DNA, 22 bp, Homo sapiens
tattggtatggtaagaattgaa

SEQ ID NO: 7943386 - DNA, 22 bp, Homo sapiens
tattgcatgtgatagaggcagg

SEQ ID NO: 7943387 - DNA, 22 bp, Homo sapiens
tattgcattatggtaggaaagg

SEQ ID NO: 7943388 - DNA, 22 bp, Homo sapiens
tattgcattatggtaggaaagg

SEQ ID NO: 7943389 - DNA, 22 bp, Homo sapiens
tattgggtaaagatccagtttt

SEQ ID NO: 7943390 - DNA, 22 bp, Homo sapiens
tattggtagatggagagagaca

SEQ ID NO: 7943391 - DNA, 22 bp, Homo sapiens
tattggtaggactcagctgaga

SEQ ID NO: 7943392 - DNA, 22 bp, Homo sapiens
tattgggtaaagatccagtttt

SEQ ID NO: 7943393 - DNA, 22 bp, Homo sapiens
tattgggtaaagatccagtttt

SEQ ID NO: 7943394 - DNA, 22 bp, Homo sapiens
tattgtacatttcaaagtagct

SEQ ID NO: 7943395 - DNA, 22 bp, Homo sapiens
tattgtacatttcaaagtagct

SEQ ID NO: 7943396 - DNA, 22 bp, Homo sapiens
tattgtacatttcaaagtagct

SEQ ID NO: 7943397 - DNA, 22 bp, Homo sapiens
tattgtacatttccaaattgct

SEQ ID NO: 7943398 - DNA, 22 bp, Homo sapiens
tattgtacatttcaaagtagct

SEQ ID NO: 7943399 - DNA, 22 bp, Homo sapiens
tattgtactgaggaataaagct

SEQ ID NO: 7943400 - DNA, 22 bp, Homo sapiens
tattgtacatttccaaattgct

SEQ ID NO: 7943401 - DNA, 22 bp, Homo sapiens
tattgtacatggttatgcagga

SEQ ID NO: 7943402 - DNA, 22 bp, Homo sapiens
tattgtacatggttatgcagga

SEQ ID NO: 7943403 - DNA, 22 bp, Homo sapiens
tattgtacatttcaaaattgct

SEQ ID NO: 7943404 - DNA, 22 bp, Homo sapiens
tattgtacatggttatgcagga

SEQ ID NO: 7943405 - DNA, 22 bp, Homo sapiens
tattgtacagagagagaggttt

SEQ ID NO: 7943406 - DNA, 22 bp, Homo sapiens
tattggtttattgtgtatgaga

SEQ ID NO: 7943407 - DNA, 22 bp, Homo sapiens
tattggtttattgtgtatgaga

SEQ ID NO: 7943408 - DNA, 22 bp, Homo sapiens
tattggtgtacttatagcagag

SEQ ID NO: 7943409 - DNA, 22 bp, Homo sapiens
tattggtgggggcagagagaga

SEQ ID NO: 7943410 - DNA, 21 bp, Homo sapiens
tattgattcaatttcttgagt

SEQ ID NO: 7943411 - DNA, 22 bp, Homo sapiens
tattgcaagtggcataaaattt

SEQ ID NO: 7943412 - DNA, 22 bp, Homo sapiens
tattgcaagcaattccaaaagg

SEQ ID NO: 7943413 - DNA, 22 bp, Homo sapiens
tattgcacgatagtgtgggctt

SEQ ID NO: 7943414 - DNA, 22 bp, Homo sapiens
tattgcacatgcgctagaacca

SEQ ID NO: 7943415 - DNA, 23 bp, Homo sapiens
tattgcacacatagaaacataga

SEQ ID NO: 7943416 - DNA, 22 bp, Homo sapiens
tattgcacatgcgctagaacca

SEQ ID NO: 7943417 - DNA, 23 bp, Homo sapiens
tattgcacaaagagatgcacagg

SEQ ID NO: 7943418 - DNA, 22 bp, Homo sapiens
tattgcacaatgagctgtgtat

SEQ ID NO: 7943419 - DNA, 23 bp, Homo sapiens
tattgcacaaagagatgcacagg

SEQ ID NO: 7943420 - DNA, 22 bp, Homo sapiens
tattgcatattgtacttgaatg

SEQ ID NO: 7943421 - DNA, 22 bp, Homo sapiens
tattgcatattgtacttgaatg

SEQ ID NO: 7943422 - DNA, 22 bp, Homo sapiens
tattgcatcagtaatttagtgt

SEQ ID NO: 7943423 - DNA, 22 bp, Homo sapiens
tattgcagacaaaatgagctac

SEQ ID NO: 7943424 - DNA, 22 bp, Homo sapiens
tactgcgccttcaccaagcggc

SEQ ID NO: 7943425 - DNA, 22 bp, Homo sapiens
tactgctgaatggtgctgggca

SEQ ID NO: 7943426 - DNA, 22 bp, Homo sapiens
tactgccaaattgcagcaatgt

SEQ ID NO: 7943427 - DNA, 22 bp, Homo sapiens
tactggatgtaaatctggaagc

SEQ ID NO: 7943428 - DNA, 20 bp, Homo sapiens
tactggagtgagcctgtagc

SEQ ID NO: 7943429 - DNA, 22 bp, Homo sapiens
tactggagatggaatgcttttg

SEQ ID NO: 7943430 - DNA, 20 bp, Homo sapiens
tactggattagggctcaccc

SEQ ID NO: 7943431 - DNA, 23 bp, Homo sapiens
tactgggcagctgctctgacacc

SEQ ID NO: 7943432 - DNA, 22 bp, Homo sapiens
tactggggtatgctcagatata

SEQ ID NO: 7943433 - DNA, 20 bp, Homo sapiens
tactggaaatttctccacct

SEQ ID NO: 7943434 - DNA, 20 bp, Homo sapiens
tactggaaatttctccacct

SEQ ID NO: 7943435 - DNA, 23 bp, Homo sapiens
tactggaaatttgacagatttga

SEQ ID NO: 7943436 - DNA, 22 bp, Homo sapiens
tactggaaggctggaagtcagg

SEQ ID NO: 7943437 - DNA, 22 bp, Homo sapiens
tactggaagttagagatctttt

SEQ ID NO: 7943438 - DNA, 22 bp, Homo sapiens
tactggaatcccgggtggctgg

SEQ ID NO: 7943439 - DNA, 22 bp, Homo sapiens
tactggaatcccgggtggctgg

SEQ ID NO: 7943440 - DNA, 22 bp, Homo sapiens
tactgagtggcaaaggcaagaa

SEQ ID NO: 7943441 - DNA, 22 bp, Homo sapiens
tactgagtaccaagcattgtgt

SEQ ID NO: 7943442 - DNA, 18 bp, Homo sapiens
tactgatttttcagagtc

SEQ ID NO: 7943443 - DNA, 22 bp, Homo sapiens
tactgatagcacaaatgacatt

SEQ ID NO: 7943444 - DNA, 18 bp, Homo sapiens
tactgatttttcagagtc

SEQ ID NO: 7943445 - DNA, 22 bp, Homo sapiens
tactgcaaaactactcagtaat

SEQ ID NO: 7943446 - DNA, 20 bp, Homo sapiens
tactgcaggaatcagctagc

SEQ ID NO: 7943447 - DNA, 22 bp, Homo sapiens
tactgcacttgagaaagctgag

SEQ ID NO: 7943448 - DNA, 22 bp, Homo sapiens
tactgcactccagcctgggtga

SEQ ID NO: 7943449 - DNA, 22 bp, Homo sapiens
tactgcatagacactgggatat

SEQ ID NO: 7943450 - DNA, 17 bp, Homo sapiens
tactgaggggtctggag

SEQ ID NO: 7943451 - DNA, 22 bp, Homo sapiens
tactgagggcaaagagtgaagc

SEQ ID NO: 7943452 - DNA, 22 bp, Homo sapiens
tactgagggcaaagagtgaagc

SEQ ID NO: 7943453 - DNA, 22 bp, Homo sapiens
tactgaggctgaattcttagca

SEQ ID NO: 7943454 - DNA, 18 bp, Homo sapiens
tactgagcaacaggagaa

SEQ ID NO: 7943455 - DNA, 22 bp, Homo sapiens
tactgaattgtaagatgatgcc

SEQ ID NO: 7943456 - DNA, 21 bp, Homo sapiens
tactgagacctcacagtgtgc

SEQ ID NO: 7943457 - DNA, 22 bp, Homo sapiens
tacttattgttgaactgaatca

SEQ ID NO: 7943458 - DNA, 22 bp, Homo sapiens
tacttcatacctgctagaatgg

SEQ ID NO: 7943459 - DNA, 19 bp, Homo sapiens
tacttattagaaatatggg

SEQ ID NO: 7943460 - DNA, 19 bp, Homo sapiens
tacttattagaaatatggg

SEQ ID NO: 7943461 - DNA, 19 bp, Homo sapiens
tacttattagaaatatggg

SEQ ID NO: 7943462 - DNA, 22 bp, Homo sapiens
tacttataaggaggcacacaaa

SEQ ID NO: 7943463 - DNA, 22 bp, Homo sapiens
tacttaggtgagatattttctt

SEQ ID NO: 7943464 - DNA, 22 bp, Homo sapiens
tactggggtatgctcagatata

SEQ ID NO: 7943465 - DNA, 20 bp, Homo sapiens
tactgggtctgggtcctgga

SEQ ID NO: 7943466 - DNA, 22 bp, Homo sapiens
tactgggtatacaaagatgaat

SEQ ID NO: 7943467 - DNA, 22 bp, Homo sapiens
tactgtaaactgtaacttcctt

SEQ ID NO: 7943468 - DNA, 22 bp, Homo sapiens
tactgtaaactgtaacttcctt

SEQ ID NO: 7943469 - DNA, 22 bp, Homo sapiens
tactgtaagtcaaatgaaacat

SEQ ID NO: 7943470 - DNA, 22 bp, Homo sapiens
tactgtaatcagggcttaggta

SEQ ID NO: 7943471 - DNA, 22 bp, Homo sapiens
tactgtaatgagattagcttcc

SEQ ID NO: 7943472 - DNA, 22 bp, Homo sapiens
tactgtaatgagattagcttcc

SEQ ID NO: 7943473 - DNA, 22 bp, Homo sapiens
tacttagagcgataatttatac

SEQ ID NO: 7943474 - DNA, 22 bp, Homo sapiens
tacttagagcgataatttatac

SEQ ID NO: 7943475 - DNA, 22 bp, Homo sapiens
tacttagactctatctagagat

SEQ ID NO: 7943476 - DNA, 22 bp, Homo sapiens
tacttacatttctgtaatcggc

SEQ ID NO: 7943477 - DNA, 22 bp, Homo sapiens
tacttgagtatagtcgcttcac

SEQ ID NO: 7943478 - DNA, 22 bp, Homo sapiens
tacttgccatcagagtttatta

SEQ ID NO: 7943479 - DNA, 22 bp, Homo sapiens
tacttgccatcagagtttatta

SEQ ID NO: 7943480 - DNA, 22 bp, Homo sapiens
tacttgaattggtttctgcaga

SEQ ID NO: 7943481 - DNA, 22 bp, Homo sapiens
tacttgaattggtttctgcaga

SEQ ID NO: 7943482 - DNA, 22 bp, Homo sapiens
tacttctgtaagtgcgccaagg

SEQ ID NO: 7943483 - DNA, 22 bp, Homo sapiens
tacttctgttcttaaaccaaga

SEQ ID NO: 7943484 - DNA, 22 bp, Homo sapiens
tacttctgttagctctgagagt

SEQ ID NO: 7943485 - DNA, 23 bp, Homo sapiens
tacttgaaatcaggcttacttcc

SEQ ID NO: 7943486 - DNA, 20 bp, Homo sapiens
tacttgaatgttgcagcagt

SEQ ID NO: 7943487 - DNA, 22 bp, Homo sapiens
tacttctgcaccaaccttaata

SEQ ID NO: 7943488 - DNA, 22 bp, Homo sapiens
tacttctgccttagagaacact

SEQ ID NO: 7943489 - DNA, 22 bp, Homo sapiens
tacttctagcctgccccttgtg

SEQ ID NO: 7943490 - DNA, 22 bp, Homo sapiens
tacttcattcaagttcgctata

SEQ ID NO: 7943491 - DNA, 22 bp, Homo sapiens
tacttcattcaagttcgctata

SEQ ID NO: 7943492 - DNA, 22 bp, Homo sapiens
tacttcattattctagttttga

SEQ ID NO: 7943493 - DNA, 22 bp, Homo sapiens
tacttcatgggacagagagctg

SEQ ID NO: 7943494 - DNA, 22 bp, Homo sapiens
tacttcccactggggtctacca

SEQ ID NO: 7943495 - DNA, 22 bp, Homo sapiens
tacttcctgtttccatgtctgt

SEQ ID NO: 7943496 - DNA, 22 bp, Homo sapiens
tacttccaggcggacaaagccc

SEQ ID NO: 7943497 - DNA, 22 bp, Homo sapiens
tacttccagcaatctgcatatt

SEQ ID NO: 7943498 - DNA, 22 bp, Homo sapiens
tactaattgttcacacttgttt

SEQ ID NO: 7943499 - DNA, 22 bp, Homo sapiens
tactaacaatgagaacaagcca

SEQ ID NO: 7943500 - DNA, 22 bp, Homo sapiens
tactgaaagaatacataatttc

SEQ ID NO: 7943501 - DNA, 22 bp, Homo sapiens
tactacaaggccgaagctctca

SEQ ID NO: 7943502 - DNA, 22 bp, Homo sapiens
tactgaaagactgaatatttag

SEQ ID NO: 7943503 - DNA, 22 bp, Homo sapiens
tactgaaagactgaatatttag

SEQ ID NO: 7943504 - DNA, 22 bp, Homo sapiens
tactgaaagactgaatatttag

SEQ ID NO: 7943505 - DNA, 22 bp, Homo sapiens
tactgaaagagtggtggactct

SEQ ID NO: 7943506 - DNA, 22 bp, Homo sapiens
tactgaaagagtggtggactct

SEQ ID NO: 7943507 - DNA, 22 bp, Homo sapiens
tactgaaagtggtcaacagtgg

SEQ ID NO: 7943508 - DNA, 22 bp, Homo sapiens
tactgaaatactaagaagttaa

SEQ ID NO: 7943509 - DNA, 22 bp, Homo sapiens
tactgaaatactaagaagttaa

SEQ ID NO: 7943510 - DNA, 22 bp, Homo sapiens
tactgaaatagcactctgatgc

SEQ ID NO: 7943511 - DNA, 22 bp, Homo sapiens
tactgacacaaagccaatccct

SEQ ID NO: 7943512 - DNA, 22 bp, Homo sapiens
tactgaagcaccattaaagaca

SEQ ID NO: 7943513 - DNA, 22 bp, Homo sapiens
tactgaaatggcagatatataa

SEQ ID NO: 7943514 - DNA, 20 bp, Homo sapiens
tactgaagaagctgcccaga

SEQ ID NO: 7943515 - DNA, 22 bp, Homo sapiens
tactgaaatggcagatatataa

SEQ ID NO: 7943516 - DNA, 22 bp, Homo sapiens
tacgattggtttgttcagatct

SEQ ID NO: 7943517 - DNA, 22 bp, Homo sapiens
tacgcctgtaatcccagcactt

SEQ ID NO: 7943518 - DNA, 22 bp, Homo sapiens
tacgagcgctcttgctggccaa

SEQ ID NO: 7943519 - DNA, 22 bp, Homo sapiens
tacgaacagggccatagaaact

SEQ ID NO: 7943520 - DNA, 22 bp, Homo sapiens
tacgcctgtaatcccagcactt

SEQ ID NO: 7943521 - DNA, 22 bp, Homo sapiens
tacgcctgtaatcccagcactt

SEQ ID NO: 7943522 - DNA, 22 bp, Homo sapiens
tacgaacagggccatagaaact

SEQ ID NO: 7943523 - DNA, 22 bp, Homo sapiens
tacctttgatctggaattttaa

SEQ ID NO: 7943524 - DNA, 22 bp, Homo sapiens
taccttttgcttattatgacac

SEQ ID NO: 7943525 - DNA, 22 bp, Homo sapiens
tacctttgatctggaattttaa

SEQ ID NO: 7943526 - DNA, 23 bp, Homo sapiens
tacctttccctgggagactgctc

SEQ ID NO: 7943527 - DNA, 22 bp, Homo sapiens
tacctttaaggagatttgacaa

SEQ ID NO: 7943528 - DNA, 22 bp, Homo sapiens
taccttgtgagatgtcagtgag

SEQ ID NO: 7943529 - DNA, 22 bp, Homo sapiens
tactaaatgattaagcaggaat

SEQ ID NO: 7943530 - DNA, 22 bp, Homo sapiens
tactaaatagtttaattcctca

SEQ ID NO: 7943531 - DNA, 22 bp, Homo sapiens
tactaaatgattaagcaggaat

SEQ ID NO: 7943532 - DNA, 22 bp, Homo sapiens
tacgggaagtacagcggaaccc

SEQ ID NO: 7943533 - DNA, 22 bp, Homo sapiens
tacggataatgctcttagcacg

SEQ ID NO: 7943534 - DNA, 22 bp, Homo sapiens
tacgctccaaaatcagaattga

SEQ ID NO: 7943535 - DNA, 22 bp, Homo sapiens
tacgggcacgcaccacgatgcc

SEQ ID NO: 7943536 - DNA, 22 bp, Homo sapiens
tacggtgacatttaatttatgg

SEQ ID NO: 7943537 - DNA, 22 bp, Homo sapiens
tacgggcacgcaccacgatgcc

SEQ ID NO: 7943538 - DNA, 21 bp, Homo sapiens
tacgtgtgtgcatgtttatat

SEQ ID NO: 7943539 - DNA, 22 bp, Homo sapiens
tactaaacatctggcattaaat

SEQ ID NO: 7943540 - DNA, 21 bp, Homo sapiens
tacgtgtgtgcatgtttatat

SEQ ID NO: 7943541 - DNA, 22 bp, Homo sapiens
tacgtgcgtggatggaggttaa

SEQ ID NO: 7943542 - DNA, 22 bp, Homo sapiens
tacgtttagctttatgagacat

SEQ ID NO: 7943543 - DNA, 22 bp, Homo sapiens
tacccagagggagagcaactat

SEQ ID NO: 7943544 - DNA, 22 bp, Homo sapiens
tacccagatatactttatgtta

SEQ ID NO: 7943545 - DNA, 22 bp, Homo sapiens
tacccagagggagagcaactat

SEQ ID NO: 7943546 - DNA, 22 bp, Homo sapiens
tacccagagggagagcaactat

SEQ ID NO: 7943547 - DNA, 22 bp, Homo sapiens
tacccagaagattgtcagcaaa

SEQ ID NO: 7943548 - DNA, 22 bp, Homo sapiens
tacccaaggccctttcaatttc

SEQ ID NO: 7943549 - DNA, 22 bp, Homo sapiens
taccattttgaggatggagaga

SEQ ID NO: 7943550 - DNA, 22 bp, Homo sapiens
tacattcccccaattaccaatg

SEQ ID NO: 7943551 - DNA, 22 bp, Homo sapiens
tacattcccccaattaccaatg

SEQ ID NO: 7943552 - DNA, 22 bp, Homo sapiens
tacattccatgtgtgtgtattc

SEQ ID NO: 7943553 - DNA, 22 bp, Homo sapiens
tacattccacaagcattgcttt

SEQ ID NO: 7943554 - DNA, 19 bp, Homo sapiens
tacattccacacaatctct

SEQ ID NO: 7943555 - DNA, 22 bp, Homo sapiens
tacctgcaaagttccttttgcc

SEQ ID NO: 7943556 - DNA, 22 bp, Homo sapiens
tacctgagcccagtgcagcata

SEQ ID NO: 7943557 - DNA, 22 bp, Homo sapiens
tacctgaattaccaaaagcttt

SEQ ID NO: 7943558 - DNA, 22 bp, Homo sapiens
tacccagcaatccctagaggtt

SEQ ID NO: 7943559 - DNA, 22 bp, Homo sapiens
tacctgttgtcacgataacact

SEQ ID NO: 7943560 - DNA, 22 bp, Homo sapiens
tacctgttttaaagctaaaagg

SEQ ID NO: 7943561 - DNA, 22 bp, Homo sapiens
taccttcaccagcgaatgtttg

SEQ ID NO: 7943562 - DNA, 22 bp, Homo sapiens
taccttgattttgaatccatga

SEQ ID NO: 7943563 - DNA, 20 bp, Homo sapiens
taccttgaacctccacctgg

SEQ ID NO: 7943564 - DNA, 22 bp, Homo sapiens
taccttctctagatctttattc

SEQ ID NO: 7943565 - DNA, 22 bp, Homo sapiens
tacctggcagtcagtctttccg

SEQ ID NO: 7943566 - DNA, 22 bp, Homo sapiens
tacctggccttaaggtgctgac

SEQ ID NO: 7943567 - DNA, 22 bp, Homo sapiens
tacctggcaagggtcccaggat

SEQ ID NO: 7943568 - DNA, 22 bp, Homo sapiens
tacctggctggggaatagccag

SEQ ID NO: 7943569 - DNA, 22 bp, Homo sapiens
tacctgtcaaaagacatggaga

SEQ ID NO: 7943570 - DNA, 22 bp, Homo sapiens
tacatacaagatgtgtttaaaa

SEQ ID NO: 7943571 - DNA, 22 bp, Homo sapiens
tacatacaagatgtgtttaaaa

SEQ ID NO: 7943572 - DNA, 22 bp, Homo sapiens
tacatacaagatgtgtttaaaa

SEQ ID NO: 7943573 - DNA, 22 bp, Homo sapiens
tacataattaatctttaagttc

SEQ ID NO: 7943574 - DNA, 22 bp, Homo sapiens
tacataattaatctttaagttc

SEQ ID NO: 7943575 - DNA, 22 bp, Homo sapiens
tacataattgtctttgtcctca

SEQ ID NO: 7943576 - DNA, 22 bp, Homo sapiens
tacataattgtctttgtcctca

SEQ ID NO: 7943577 - DNA, 22 bp, Homo sapiens
tacataattgtctttgtcctca

SEQ ID NO: 7943578 - DNA, 22 bp, Homo sapiens
tacataattgtctttgtcctca

SEQ ID NO: 7943579 - DNA, 22 bp, Homo sapiens
tacataattaatctttaagttc

SEQ ID NO: 7943580 - DNA, 22 bp, Homo sapiens
tacataattaatctttaagttc

SEQ ID NO: 7943581 - DNA, 22 bp, Homo sapiens
tacataattaatctttaagttc

SEQ ID NO: 7943582 - DNA, 22 bp, Homo sapiens
tacataatgagctagttaagtt

SEQ ID NO: 7943583 - DNA, 22 bp, Homo sapiens
tacataatgagctagttaagtt

SEQ ID NO: 7943584 - DNA, 22 bp, Homo sapiens
tacataataaggggcatggtgt

SEQ ID NO: 7943585 - DNA, 22 bp, Homo sapiens
tacataatgagctagttaagtt

SEQ ID NO: 7943586 - DNA, 22 bp, Homo sapiens
tacataataaggggcatggtgt

SEQ ID NO: 7943587 - DNA, 22 bp, Homo sapiens
tacagtttttattcatgacaag

SEQ ID NO: 7943588 - DNA, 22 bp, Homo sapiens
tacagttttggtgatgatgatg

SEQ ID NO: 7943589 - DNA, 22 bp, Homo sapiens
tacagttttggtgatgatgatg

SEQ ID NO: 7943590 - DNA, 22 bp, Homo sapiens
tacagttttggtgatgatgatg

SEQ ID NO: 7943591 - DNA, 22 bp, Homo sapiens
tacagtttttattcatgacaag

SEQ ID NO: 7943592 - DNA, 22 bp, Homo sapiens
tacagtttttattcatgacaag

SEQ ID NO: 7943593 - DNA, 22 bp, Homo sapiens
tacagtttttattcatgacaag

SEQ ID NO: 7943594 - DNA, 22 bp, Homo sapiens
tacagtttttcactgaagatgt

SEQ ID NO: 7943595 - DNA, 22 bp, Homo sapiens
tacagtttttcactgaagatgt

SEQ ID NO: 7943596 - DNA, 22 bp, Homo sapiens
tacagtttttcactgaagatgt

SEQ ID NO: 7943597 - DNA, 22 bp, Homo sapiens
tacataataaggggcatggtgt

SEQ ID NO: 7943598 - DNA, 22 bp, Homo sapiens
tacataataaggggcatggtgt

SEQ ID NO: 7943599 - DNA, 22 bp, Homo sapiens
tacataataaggggcatggtgt

SEQ ID NO: 7943600 - DNA, 22 bp, Homo sapiens
tacagttactttgaaaattgat

SEQ ID NO: 7943601 - DNA, 22 bp, Homo sapiens
tacagttactgcatttctaata

SEQ ID NO: 7943602 - DNA, 22 bp, Homo sapiens
tacagttacgctgagaaacgaa

SEQ ID NO: 7943603 - DNA, 22 bp, Homo sapiens
tacagttactgcatttctaata

SEQ ID NO: 7943604 - DNA, 22 bp, Homo sapiens
tacagttactgcatttctaata

SEQ ID NO: 7943605 - DNA, 22 bp, Homo sapiens
tacagttactgcatttctaata

SEQ ID NO: 7943606 - DNA, 22 bp, Homo sapiens
tacagttaaaaagttcaatggt

SEQ ID NO: 7943607 - DNA, 17 bp, Homo sapiens
tacaggagagcaggaac

SEQ ID NO: 7943608 - DNA, 22 bp, Homo sapiens
tacaggagagatttagtaatca

SEQ ID NO: 7943609 - DNA, 22 bp, Homo sapiens
tacagttaccctggaaagaaat

SEQ ID NO: 7943610 - DNA, 22 bp, Homo sapiens
tacagttaccctggaaagaaat

SEQ ID NO: 7943611 - DNA, 22 bp, Homo sapiens
tacagttaccctggaaagaaat

SEQ ID NO: 7943612 - DNA, 20 bp, Homo sapiens
tacaggaatcaagactgcat

SEQ ID NO: 7943613 - DNA, 20 bp, Homo sapiens
tacaggaatcaagactgcat

SEQ ID NO: 7943614 - DNA, 20 bp, Homo sapiens
tacaggaatcaagactgcat

SEQ ID NO: 7943615 - DNA, 22 bp, Homo sapiens
tacaggaagttacagactatga

SEQ ID NO: 7943616 - DNA, 20 bp, Homo sapiens
tacaggaatcaagactgcat

SEQ ID NO: 7943617 - DNA, 20 bp, Homo sapiens
tacaggaccttctttgtatc

SEQ ID NO: 7943618 - DNA, 22 bp, Homo sapiens
tacactatgggctttgtgtaat

SEQ ID NO: 7943619 - DNA, 22 bp, Homo sapiens
tacactattttactgatacaaa

SEQ ID NO: 7943620 - DNA, 22 bp, Homo sapiens
tacactatgggctttgtgtaat

SEQ ID NO: 7943621 - DNA, 22 bp, Homo sapiens
tacactatgggctttgtgtaat

SEQ ID NO: 7943622 - DNA, 22 bp, Homo sapiens
tacagcactgtgcatagtggtt

SEQ ID NO: 7943623 - DNA, 22 bp, Homo sapiens
tacactatgggctttgtgtaat

SEQ ID NO: 7943624 - DNA, 22 bp, Homo sapiens
tacagcagactgaaggttgtgt

SEQ ID NO: 7943625 - DNA, 20 bp, Homo sapiens
tacagcagaaatgttttgct

SEQ ID NO: 7943626 - DNA, 22 bp, Homo sapiens
tacagcacttaattaccttgag

SEQ ID NO: 7943627 - DNA, 22 bp, Homo sapiens
tacagcagagtgggatgcatct

SEQ ID NO: 7943628 - DNA, 22 bp, Homo sapiens
tacagcagcatcgcagtgacct

SEQ ID NO: 7943629 - DNA, 22 bp, Homo sapiens
tacagcagcatcgcagtgacct

SEQ ID NO: 7943630 - DNA, 22 bp, Homo sapiens
tacagcagagtgggatgcatct

SEQ ID NO: 7943631 - DNA, 22 bp, Homo sapiens
tacagcttaaaagatgcattta

SEQ ID NO: 7943632 - DNA, 22 bp, Homo sapiens
tacagcttatccagcttgatag

SEQ ID NO: 7943633 - DNA, 22 bp, Homo sapiens
tacagcagcccaccttcttctg

SEQ ID NO: 7943634 - DNA, 22 bp, Homo sapiens
tacagcagcccaccttcttctg

SEQ ID NO: 7943635 - DNA, 22 bp, Homo sapiens
tacagctttagcaaattaccta

SEQ ID NO: 7943636 - DNA, 22 bp, Homo sapiens
tacagctttagcaaattaccta

SEQ ID NO: 7943637 - DNA, 22 bp, Homo sapiens
tacagcttgatgtttgtgtgtt

SEQ ID NO: 7943638 - DNA, 22 bp, Homo sapiens
tacagctttatacccatcaaaa

SEQ ID NO: 7943639 - DNA, 22 bp, Homo sapiens
tacagctttgggaaggccccat

SEQ ID NO: 7943640 - DNA, 22 bp, Homo sapiens
tacagcttttcatatttgtgtt

SEQ ID NO: 7943641 - DNA, 18 bp, Homo sapiens
tacagcttgagttgactg

SEQ ID NO: 7943642 - DNA, 22 bp, Homo sapiens
tacagcttgatgagagcgcgag

SEQ ID NO: 7943643 - DNA, 22 bp, Homo sapiens
tacagcttgacccataatgtct

SEQ ID NO: 7943644 - DNA, 18 bp, Homo sapiens
tacagcttgagttgactg

SEQ ID NO: 7943645 - DNA, 22 bp, Homo sapiens
tacagcttcagtgtgccccagt

SEQ ID NO: 7943646 - DNA, 22 bp, Homo sapiens
tacagcttgacccataatgtct

SEQ ID NO: 7943647 - DNA, 22 bp, Homo sapiens
tacagcttcagtgtgccccagt

SEQ ID NO: 7943648 - DNA, 22 bp, Homo sapiens
tacagcagactgaaggttgtgt

SEQ ID NO: 7943649 - DNA, 22 bp, Homo sapiens
tacaggaagtaagtaatgaaat

SEQ ID NO: 7943650 - DNA, 22 bp, Homo sapiens
tacaggaagtaagtaatgaaat

SEQ ID NO: 7943651 - DNA, 22 bp, Homo sapiens
tacaggaagtaagtaatgaaat

SEQ ID NO: 7943652 - DNA, 22 bp, Homo sapiens
tacaggaagtaagtaatgaaat

SEQ ID NO: 7943653 - DNA, 22 bp, Homo sapiens
tacaggaagtctcagtacagta

SEQ ID NO: 7943654 - DNA, 22 bp, Homo sapiens
tacaggaagtctcagtacagta

SEQ ID NO: 7943655 - DNA, 22 bp, Homo sapiens
tacaggaagtctcagtacagta

SEQ ID NO: 7943656 - DNA, 22 bp, Homo sapiens
tacaggaagtctcagtacagta

SEQ ID NO: 7943657 - DNA, 22 bp, Homo sapiens
tacaggaaggctctggaggtgc

SEQ ID NO: 7943658 - DNA, 18 bp, Homo sapiens
tacaggaaggggttctcg

SEQ ID NO: 7943659 - DNA, 22 bp, Homo sapiens
tacaggaaggagcacatcggga

SEQ ID NO: 7943660 - DNA, 22 bp, Homo sapiens
tacaggaagcactcaagaaatg

SEQ ID NO: 7943661 - DNA, 22 bp, Homo sapiens
tacagcttttgcagctgttttg

SEQ ID NO: 7943662 - DNA, 18 bp, Homo sapiens
tacaggaaaagtgttaca

SEQ ID NO: 7943663 - DNA, 18 bp, Homo sapiens
tacaggaaaagtgttaca

SEQ ID NO: 7943664 - DNA, 22 bp, Homo sapiens
tacaggaaagaaatttgaactc

SEQ ID NO: 7943665 - DNA, 22 bp, Homo sapiens
tacaggaaagaaatttgaactc

SEQ ID NO: 7943666 - DNA, 22 bp, Homo sapiens
tacaggaaccagattgttcagc

SEQ ID NO: 7943667 - DNA, 22 bp, Homo sapiens
tacaggaagcactcaagaaatg

SEQ ID NO: 7943668 - DNA, 22 bp, Homo sapiens
tacaggaactgggcaggacatt

SEQ ID NO: 7943669 - DNA, 22 bp, Homo sapiens
tacaggaactgggcaggacatt

SEQ ID NO: 7943670 - DNA, 22 bp, Homo sapiens
tacaggaactgggcaggacatt

SEQ ID NO: 7943671 - DNA, 22 bp, Homo sapiens
tacaggaactgggcaggacatt

SEQ ID NO: 7943672 - DNA, 22 bp, Homo sapiens
tacaggaaccagattgttcagc

SEQ ID NO: 7943673 - DNA, 22 bp, Homo sapiens
tacaggaaccagattgttcagc

SEQ ID NO: 7943674 - DNA, 22 bp, Homo sapiens
tacaggaactgggcaggacatt

SEQ ID NO: 7943675 - DNA, 22 bp, Homo sapiens
tacatacatggtggaatggtta

SEQ ID NO: 7943676 - DNA, 22 bp, Homo sapiens
tacatacatggtggaatggtta

SEQ ID NO: 7943677 - DNA, 22 bp, Homo sapiens
tacatacatattcatacaggtg

SEQ ID NO: 7943678 - DNA, 22 bp, Homo sapiens
tacatacatattcatacaggtg

SEQ ID NO: 7943679 - DNA, 22 bp, Homo sapiens
tacatacatattcatacaggtg

SEQ ID NO: 7943680 - DNA, 22 bp, Homo sapiens
tacatacatattcatacaggtg

SEQ ID NO: 7943681 - DNA, 22 bp, Homo sapiens
tacatacatattcatacaggtg

SEQ ID NO: 7943682 - DNA, 22 bp, Homo sapiens
tacatacatattcatacaggtg

SEQ ID NO: 7943683 - DNA, 22 bp, Homo sapiens
tacatacagtggatgctttagg

SEQ ID NO: 7943684 - DNA, 22 bp, Homo sapiens
tacatacatattcatacaggtg

SEQ ID NO: 7943685 - DNA, 22 bp, Homo sapiens
tacatacatattcatacaggtg

SEQ ID NO: 7943686 - DNA, 22 bp, Homo sapiens
tacatgtctacatgcatttttg

SEQ ID NO: 7943687 - DNA, 22 bp, Homo sapiens
tacatgtctacagccatgtctg

SEQ ID NO: 7943688 - DNA, 22 bp, Homo sapiens
tacatgtattgatttctcttct

SEQ ID NO: 7943689 - DNA, 22 bp, Homo sapiens
tacatgtatgtttatcttgaga

SEQ ID NO: 7943690 - DNA, 22 bp, Homo sapiens
tacatacatggtggaatggtta

SEQ ID NO: 7943691 - DNA, 22 bp, Homo sapiens
tacatgtatgtttatcttgaga

SEQ ID NO: 7943692 - DNA, 22 bp, Homo sapiens
tacatgtatgtttatcttgaga

SEQ ID NO: 7943693 - DNA, 22 bp, Homo sapiens
tacattaacttacgtccacatg

SEQ ID NO: 7943694 - DNA, 22 bp, Homo sapiens
tacattaacttacgtccacatg

SEQ ID NO: 7943695 - DNA, 22 bp, Homo sapiens
tacattaaggatatggacatga

SEQ ID NO: 7943696 - DNA, 22 bp, Homo sapiens
tacattaaggatatggacatga

SEQ ID NO: 7943697 - DNA, 22 bp, Homo sapiens
tacattaaggatatggacatga

SEQ ID NO: 7943698 - DNA, 22 bp, Homo sapiens
tacattaaggatatggacatga

SEQ ID NO: 7943699 - DNA, 22 bp, Homo sapiens
tacatgtttggtaaatgatggc

SEQ ID NO: 7943700 - DNA, 22 bp, Homo sapiens
tacatgtctgggttttgtttcc

SEQ ID NO: 7943701 - DNA, 22 bp, Homo sapiens
tacatacaagcattcaatttta

SEQ ID NO: 7943702 - DNA, 22 bp, Homo sapiens
tacatacaagcattcaatttta

SEQ ID NO: 7943703 - DNA, 22 bp, Homo sapiens
tacatacaagatgtgtttaaaa

SEQ ID NO: 7943704 - DNA, 22 bp, Homo sapiens
tacatacaagcattcaatttta

SEQ ID NO: 7943705 - DNA, 22 bp, Homo sapiens
tacatacaagcattcaatttta

SEQ ID NO: 7943706 - DNA, 22 bp, Homo sapiens
tacatacaagcattcaatttta

SEQ ID NO: 7943707 - DNA, 22 bp, Homo sapiens
tacatacacaaatatactgttt

SEQ ID NO: 7943708 - DNA, 22 bp, Homo sapiens
tacatacacaaatatactgttt

SEQ ID NO: 7943709 - DNA, 22 bp, Homo sapiens
tacatacacaaatatactgttt

SEQ ID NO: 7943710 - DNA, 22 bp, Homo sapiens
tacatacacaaatatactgttt

SEQ ID NO: 7943711 - DNA, 22 bp, Homo sapiens
tacatacacaaatatactgttt

SEQ ID NO: 7943712 - DNA, 22 bp, Homo sapiens
tacatacacaaatatactgttt

SEQ ID NO: 7943713 - DNA, 22 bp, Homo sapiens
tacatacacaaatatactgttt

SEQ ID NO: 7943714 - DNA, 22 bp, Homo sapiens
tacatacacaaatatactgttt

SEQ ID NO: 7943715 - DNA, 22 bp, Homo sapiens
tacatacagccaagtatgaagt

SEQ ID NO: 7943716 - DNA, 22 bp, Homo sapiens
tacatacagccaagtatgaagt

SEQ ID NO: 7943717 - DNA, 22 bp, Homo sapiens
tacatacagccaagtatgaagt

SEQ ID NO: 7943718 - DNA, 22 bp, Homo sapiens
tacatacagccaagtatgaagt

SEQ ID NO: 7943719 - DNA, 22 bp, Homo sapiens
tacatacagagatgctagttaa

SEQ ID NO: 7943720 - DNA, 22 bp, Homo sapiens
tacatacagagatgctagttaa

SEQ ID NO: 7943721 - DNA, 22 bp, Homo sapiens
tacatacagagatgctagttaa

SEQ ID NO: 7943722 - DNA, 22 bp, Homo sapiens
tacatacagagatgctagttaa

SEQ ID NO: 7943723 - DNA, 22 bp, Homo sapiens
tacatacagagatgctagttaa

SEQ ID NO: 7943724 - DNA, 22 bp, Homo sapiens
tacatacacaaatgctgaatgg

SEQ ID NO: 7943725 - DNA, 22 bp, Homo sapiens
tacatacacaaatgctgaatgg

SEQ ID NO: 7943726 - DNA, 22 bp, Homo sapiens
tacatacacaaatgctgaatgg

SEQ ID NO: 7943727 - DNA, 22 bp, Homo sapiens
tacatacacaaatatactgttt

SEQ ID NO: 7943728 - DNA, 22 bp, Homo sapiens
tacatacacaaatatactgttt

SEQ ID NO: 7943729 - DNA, 22 bp, Homo sapiens
tacatacacaaatatactgttt

SEQ ID NO: 7943730 - DNA, 22 bp, Homo sapiens
tacatacacaaatatactgttt

SEQ ID NO: 7943731 - DNA, 22 bp, Homo sapiens
tacattatcttgttatctttca

SEQ ID NO: 7943732 - DNA, 22 bp, Homo sapiens
tacattatcctgtctttgtcct

SEQ ID NO: 7943733 - DNA, 22 bp, Homo sapiens
tacattacaggaaagataaaga

SEQ ID NO: 7943734 - DNA, 22 bp, Homo sapiens
tacattacaggaaagataaaga

SEQ ID NO: 7943735 - DNA, 22 bp, Homo sapiens
tacattacaggaaagataaaga

SEQ ID NO: 7943736 - DNA, 22 bp, Homo sapiens
tacattatcttgttatctttca

SEQ ID NO: 7943737 - DNA, 22 bp, Homo sapiens
tacattatcttgttatctttca

SEQ ID NO: 7943738 - DNA, 22 bp, Homo sapiens
tacattatcttgttatctttca

SEQ ID NO: 7943739 - DNA, 20 bp, Homo sapiens
tacattcaaaacaaactctg

SEQ ID NO: 7943740 - DNA, 22 bp, Homo sapiens
tacattcaacatgtcactatgt

SEQ ID NO: 7943741 - DNA, 22 bp, Homo sapiens
tacattcacagttgttcatctc

SEQ ID NO: 7943742 - DNA, 22 bp, Homo sapiens
tacattcaacatgtcactatgt

SEQ ID NO: 7943743 - DNA, 22 bp, Homo sapiens
tacattcaacatgtcactatgt

SEQ ID NO: 7943744 - DNA, 22 bp, Homo sapiens
tacattcaacatgtcactatgt

SEQ ID NO: 7943745 - DNA, 22 bp, Homo sapiens
tacattcaacatgtcactatgt

SEQ ID NO: 7943746 - DNA, 22 bp, Homo sapiens
tacattcaacatgtcactatgt

SEQ ID NO: 7943747 - DNA, 22 bp, Homo sapiens
tacattcaacatgtcactatgt

SEQ ID NO: 7943748 - DNA, 22 bp, Homo sapiens
tacattcaacatgtcactatgt

SEQ ID NO: 7943749 - DNA, 22 bp, Homo sapiens
tacattcaaacgatttattgat

SEQ ID NO: 7943750 - DNA, 22 bp, Homo sapiens
tacattcaaacgatttattgat

SEQ ID NO: 7943751 - DNA, 20 bp, Homo sapiens
tacattcaaaacaaactctg

SEQ ID NO: 7943752 - DNA, 22 bp, Homo sapiens
tacattcaacatgtcactatgt

SEQ ID NO: 7943753 - DNA, 22 bp, Homo sapiens
tacattcaaacgatttattgat

SEQ ID NO: 7943754 - DNA, 22 bp, Homo sapiens
tacattcaaacgatttattgat

SEQ ID NO: 7943755 - DNA, 22 bp, Homo sapiens
tacattcaaacgatttattgat

SEQ ID NO: 7943756 - DNA, 22 bp, Homo sapiens
tacattcagagaaagtttccat

SEQ ID NO: 7943757 - DNA, 22 bp, Homo sapiens
tacattcagagaaagtttccat

SEQ ID NO: 7943758 - DNA, 22 bp, Homo sapiens
tacattcagcaaaagaatggtt

SEQ ID NO: 7943759 - DNA, 22 bp, Homo sapiens
tacattcagcaaaagaatggtt

SEQ ID NO: 7943760 - DNA, 22 bp, Homo sapiens
tacattcagcaaaagaatggtt

SEQ ID NO: 7943761 - DNA, 22 bp, Homo sapiens
tacattcagagaaagtttccat

SEQ ID NO: 7943762 - DNA, 22 bp, Homo sapiens
tacattcagaattgggaggcaa

SEQ ID NO: 7943763 - DNA, 22 bp, Homo sapiens
tacattcagaattgggaggcaa

SEQ ID NO: 7943764 - DNA, 22 bp, Homo sapiens
tacattcagaagaatggacacg

SEQ ID NO: 7943765 - DNA, 22 bp, Homo sapiens
tacattcagaagaatggacacg

SEQ ID NO: 7943766 - DNA, 22 bp, Homo sapiens
tacattcagaagaatggacacg

SEQ ID NO: 7943767 - DNA, 22 bp, Homo sapiens
tacattcagaagaatggacacg

SEQ ID NO: 7943768 - DNA, 22 bp, Homo sapiens
tacattcacagttgttcatctc

SEQ ID NO: 7943769 - DNA, 22 bp, Homo sapiens
tacattcacagttgttcatctc

SEQ ID NO: 7943770 - DNA, 22 bp, Homo sapiens
tacattcacttgttgaaggtgg

SEQ ID NO: 7943771 - DNA, 22 bp, Homo sapiens
tacattcacttgttgaaggtgg

SEQ ID NO: 7943772 - DNA, 22 bp, Homo sapiens
tacattcatggtgacttgtatg

SEQ ID NO: 7943773 - DNA, 22 bp, Homo sapiens
tacattcatatgtgtgcataca

SEQ ID NO: 7943774 - DNA, 22 bp, Homo sapiens
tacattcatggtgacttgtatg

SEQ ID NO: 7943775 - DNA, 22 bp, Homo sapiens
tacattcatggtgacttgtatg

SEQ ID NO: 7943776 - DNA, 22 bp, Homo sapiens
tacattcatggtgacttgtatg

SEQ ID NO: 7943777 - DNA, 22 bp, Homo sapiens
tacattcagcaaaagaatggtt

SEQ ID NO: 7943778 - DNA, 22 bp, Homo sapiens
tacattcagcaaaagaatggtt

SEQ ID NO: 7943779 - DNA, 22 bp, Homo sapiens
tacattcatatgtgtgcataca

SEQ ID NO: 7943780 - DNA, 22 bp, Homo sapiens
tacattcatatgtgtgcataca

SEQ ID NO: 7943781 - DNA, 22 bp, Homo sapiens
tacattcatatgtgtgcataca

SEQ ID NO: 7943782 - DNA, 15 bp, Homo sapiens
tacattcatttccac

SEQ ID NO: 7943783 - DNA, 22 bp, Homo sapiens
tacattcatggtgacttgtatg

SEQ ID NO: 7943784 - DNA, 22 bp, Homo sapiens
tacattcatggtgacttgtatg

SEQ ID NO: 7943785 - DNA, 22 bp, Homo sapiens
tacattcatggtgacttgtatg

SEQ ID NO: 7943786 - DNA, 15 bp, Homo sapiens
tacattcatttccac

SEQ ID NO: 7943787 - DNA, 23 bp, Homo sapiens
tacattcatttgcacagccagta

SEQ ID NO: 7943788 - DNA, 23 bp, Homo sapiens
tacattcatttgcacagccagta

SEQ ID NO: 7943789 - DNA, 22 bp, Homo sapiens
taagttaaccctgttaatagat

SEQ ID NO: 7943790 - DNA, 22 bp, Homo sapiens
taagtgttgttttcaagagata

SEQ ID NO: 7943791 - DNA, 22 bp, Homo sapiens
taagtgtttctccagtgtcttt

SEQ ID NO: 7943792 - DNA, 19 bp, Homo sapiens
taagtgttggtgaatttct

SEQ ID NO: 7943793 - DNA, 19 bp, Homo sapiens
taagtgttggtgaatttct

SEQ ID NO: 7943794 - DNA, 22 bp, Homo sapiens
taagtgttggtaattacaatga

SEQ ID NO: 7943795 - DNA, 22 bp, Homo sapiens
taagttcaccagttgtaataag

SEQ ID NO: 7943796 - DNA, 22 bp, Homo sapiens
taagttcaaatcatcccaactt

SEQ ID NO: 7943797 - DNA, 22 bp, Homo sapiens
taagttcaagtcttggatataa

SEQ ID NO: 7943798 - DNA, 22 bp, Homo sapiens
taagttcaaatcatcccaactt

SEQ ID NO: 7943799 - DNA, 22 bp, Homo sapiens
taagttatcggagtgtgtttca

SEQ ID NO: 7943800 - DNA, 17 bp, Homo sapiens
taagttatagcagaaga

SEQ ID NO: 7943801 - DNA, 22 bp, Homo sapiens
taagttatcggagtgtgtttca

SEQ ID NO: 7943802 - DNA, 22 bp, Homo sapiens
taagttatcggagtgtgtttca

SEQ ID NO: 7943803 - DNA, 22 bp, Homo sapiens
taagttcattagactacagata

SEQ ID NO: 7943804 - DNA, 22 bp, Homo sapiens
taagttcattagactacagata

SEQ ID NO: 7943805 - DNA, 22 bp, Homo sapiens
taagttcattagactacagata

SEQ ID NO: 7943806 - DNA, 22 bp, Homo sapiens
taagttcataagcttattctta

SEQ ID NO: 7943807 - DNA, 22 bp, Homo sapiens
taagttcagttggtcgaagtag

SEQ ID NO: 7943808 - DNA, 22 bp, Homo sapiens
taagttcaccagttgtaataag

SEQ ID NO: 7943809 - DNA, 22 bp, Homo sapiens
taagcaatgagataatcatggg

SEQ ID NO: 7943810 - DNA, 22 bp, Homo sapiens
taagcaatgctgtagttcagtc

SEQ ID NO: 7943811 - DNA, 22 bp, Homo sapiens
taagcacacaatatctggagag

SEQ ID NO: 7943812 - DNA, 20 bp, Homo sapiens
taagcacatgaacagtcctc

SEQ ID NO: 7943813 - DNA, 20 bp, Homo sapiens
taagcacatgaacagtcctc

SEQ ID NO: 7943814 - DNA, 22 bp, Homo sapiens
taagcaatgagataatcatggg

SEQ ID NO: 7943815 - DNA, 18 bp, Homo sapiens
taagcaatgacattgcaa

SEQ ID NO: 7943816 - DNA, 22 bp, Homo sapiens
taagcaagtggtagaaggacaa

SEQ ID NO: 7943817 - DNA, 18 bp, Homo sapiens
taagcaatgacattgcaa

SEQ ID NO: 7943818 - DNA, 22 bp, Homo sapiens
taagcaggtgccttctgtgacc

SEQ ID NO: 7943819 - DNA, 22 bp, Homo sapiens
taagcagtttttcttgtattaa

SEQ ID NO: 7943820 - DNA, 20 bp, Homo sapiens
taagcacatgaacagtcctc

SEQ ID NO: 7943821 - DNA, 22 bp, Homo sapiens
taagcagatgctgtctgcacaa

SEQ ID NO: 7943822 - DNA, 22 bp, Homo sapiens
taagcagatgctgtctgcacaa

SEQ ID NO: 7943823 - DNA, 22 bp, Homo sapiens
taagcagatgctgtctgcacaa

SEQ ID NO: 7943824 - DNA, 22 bp, Homo sapiens
taagcagagccctctttattag

SEQ ID NO: 7943825 - DNA, 22 bp, Homo sapiens
taagcagaaaaagtgggagtta

SEQ ID NO: 7943826 - DNA, 22 bp, Homo sapiens
taagcataactaaaaatgattt

SEQ ID NO: 7943827 - DNA, 22 bp, Homo sapiens
taagcatacattctctcctttc

SEQ ID NO: 7943828 - DNA, 22 bp, Homo sapiens
taagttttaagcaatctgataa

SEQ ID NO: 7943829 - DNA, 22 bp, Homo sapiens
taagttttctggaataacttgg

SEQ ID NO: 7943830 - DNA, 22 bp, Homo sapiens
taataaatgaaagtgctggcat

SEQ ID NO: 7943831 - DNA, 22 bp, Homo sapiens
taataaatgaaagtgctggcat

SEQ ID NO: 7943832 - DNA, 22 bp, Homo sapiens
taataaatgaaagtgctggcat

SEQ ID NO: 7943833 - DNA, 22 bp, Homo sapiens
taataaatgaaagtgctggcat

SEQ ID NO: 7943834 - DNA, 22 bp, Homo sapiens
taataaatgaaagtgctggcat

SEQ ID NO: 7943835 - DNA, 22 bp, Homo sapiens
taataaatgaaagtgctggcat

SEQ ID NO: 7943836 - DNA, 22 bp, Homo sapiens
taataacaattgtaggacatga

SEQ ID NO: 7943837 - DNA, 22 bp, Homo sapiens
taataacaattgtaggacatga

SEQ ID NO: 7943838 - DNA, 22 bp, Homo sapiens
taataacaattgtaggacatga

SEQ ID NO: 7943839 - DNA, 22 bp, Homo sapiens
taataacaattgtaggacatga

SEQ ID NO: 7943840 - DNA, 22 bp, Homo sapiens
taataacaattgtaggacatga

SEQ ID NO: 7943841 - DNA, 22 bp, Homo sapiens
taataacaattgtaggacatga

SEQ ID NO: 7943842 - DNA, 22 bp, Homo sapiens
taataacaattgtaggacatga

SEQ ID NO: 7943843 - DNA, 22 bp, Homo sapiens
taataacaattgtaggacatga

SEQ ID NO: 7943844 - DNA, 22 bp, Homo sapiens
taataaatgaaagtgctggcat

SEQ ID NO: 7943845 - DNA, 22 bp, Homo sapiens
taataaatgaaagtgctggcat

SEQ ID NO: 7943846 - DNA, 22 bp, Homo sapiens
taataaatgaaagtgctggcat

SEQ ID NO: 7943847 - DNA, 22 bp, Homo sapiens
taataaatgaaagtgctggcat

SEQ ID NO: 7943848 - DNA, 22 bp, Homo sapiens
taataaactgctacgcttagtt

SEQ ID NO: 7943849 - DNA, 22 bp, Homo sapiens
taataaatgaaagtgctggcat

SEQ ID NO: 7943850 - DNA, 22 bp, Homo sapiens
taataaatgaaagtgctggcat

SEQ ID NO: 7943851 - DNA, 22 bp, Homo sapiens
taataaatgaaagtgctggcat

SEQ ID NO: 7943852 - DNA, 22 bp, Homo sapiens
taagtttaaatgtacatgaagc

SEQ ID NO: 7943853 - DNA, 22 bp, Homo sapiens
taagtttaaatgtacatgaagc

SEQ ID NO: 7943854 - DNA, 22 bp, Homo sapiens
taagtttaaatgtacatgaagc

SEQ ID NO: 7943855 - DNA, 22 bp, Homo sapiens
taagttctcaatacattgtagc

SEQ ID NO: 7943856 - DNA, 22 bp, Homo sapiens
taagttcctagcctttacatag

SEQ ID NO: 7943857 - DNA, 22 bp, Homo sapiens
taagttctgagtaaatactgtt

SEQ ID NO: 7943858 - DNA, 22 bp, Homo sapiens
taagttcttttctatgtaatat

SEQ ID NO: 7943859 - DNA, 22 bp, Homo sapiens
taagtttatagataaatgccta

SEQ ID NO: 7943860 - DNA, 22 bp, Homo sapiens
taagtttagagagaatggggac

SEQ ID NO: 7943861 - DNA, 22 bp, Homo sapiens
taagtttaccactttcagaatt

SEQ ID NO: 7943862 - DNA, 22 bp, Homo sapiens
taagtttaccactttcagaatt

SEQ ID NO: 7943863 - DNA, 22 bp, Homo sapiens
taagtttaagtcatgtttgatg

SEQ ID NO: 7943864 - DNA, 22 bp, Homo sapiens
taagtttaagtcatgtttgatg

SEQ ID NO: 7943865 - DNA, 23 bp, Homo sapiens
taatgagaagctttgtttcctga

SEQ ID NO: 7943866 - DNA, 22 bp, Homo sapiens
taatgagactcaattgtgtgtg

SEQ ID NO: 7943867 - DNA, 23 bp, Homo sapiens
taatgagaagctttgtttcctga

SEQ ID NO: 7943868 - DNA, 22 bp, Homo sapiens
taatgagaattctttttgggta

SEQ ID NO: 7943869 - DNA, 22 bp, Homo sapiens
taatgagatcatatcttctgag

SEQ ID NO: 7943870 - DNA, 22 bp, Homo sapiens
taatgagatcatatcttctgag

SEQ ID NO: 7943871 - DNA, 22 bp, Homo sapiens
taatgaggaaggagactttcac

SEQ ID NO: 7943872 - DNA, 22 bp, Homo sapiens
taatgaatgagaatataacaga

SEQ ID NO: 7943873 - DNA, 22 bp, Homo sapiens
taatgaatgagaatataacaga

SEQ ID NO: 7943874 - DNA, 22 bp, Homo sapiens
taatgaatgagaatataacaga

SEQ ID NO: 7943875 - DNA, 22 bp, Homo sapiens
taatgacattgtatccacagag

SEQ ID NO: 7943876 - DNA, 22 bp, Homo sapiens
taatgccaatttaatgatccat

SEQ ID NO: 7943877 - DNA, 22 bp, Homo sapiens
taatgcacagaattgacatggg

SEQ ID NO: 7943878 - DNA, 22 bp, Homo sapiens
taatgcaatttagcaaagtttt

SEQ ID NO: 7943879 - DNA, 22 bp, Homo sapiens
taatgatgtgtgcaaactgaat

SEQ ID NO: 7943880 - DNA, 22 bp, Homo sapiens
taatgcaacgtgagataattaa

SEQ ID NO: 7943881 - DNA, 22 bp, Homo sapiens
taatgcaacgtgagataattaa

SEQ ID NO: 7943882 - DNA, 22 bp, Homo sapiens
taatgcaaggaattccaagtag

SEQ ID NO: 7943883 - DNA, 22 bp, Homo sapiens
taatgcaacgtgagataattaa

SEQ ID NO: 7943884 - DNA, 22 bp, Homo sapiens
taatgcttttccttcaaataag

SEQ ID NO: 7943885 - DNA, 22 bp, Homo sapiens
taatgcttttccttcaaataag

SEQ ID NO: 7943886 - DNA, 22 bp, Homo sapiens
taatgctttgtcagcctaaggg

SEQ ID NO: 7943887 - DNA, 22 bp, Homo sapiens
taatgctttgttttgatctaac

SEQ ID NO: 7943888 - DNA, 22 bp, Homo sapiens
taatgcttcctatatagcactc

SEQ ID NO: 7943889 - DNA, 22 bp, Homo sapiens
taatgcttctgttaggatcttc

SEQ ID NO: 7943890 - DNA, 22 bp, Homo sapiens
taatgcttgcaaattatgggac

SEQ ID NO: 7943891 - DNA, 22 bp, Homo sapiens
taatgcttatgttatgcaattt

SEQ ID NO: 7943892 - DNA, 22 bp, Homo sapiens
taatgcttatgttatgcaattt

SEQ ID NO: 7943893 - DNA, 22 bp, Homo sapiens
taatgcttcaatttccttgatt

SEQ ID NO: 7943894 - DNA, 22 bp, Homo sapiens
taatgcttaattttcacaagcc

SEQ ID NO: 7943895 - DNA, 22 bp, Homo sapiens
taatgcttaacagctggctttt

SEQ ID NO: 7943896 - DNA, 20 bp, Homo sapiens
taatgcttaacacatcccct

SEQ ID NO: 7943897 - DNA, 22 bp, Homo sapiens
taatgcttaatgtaggctggaa

SEQ ID NO: 7943898 - DNA, 22 bp, Homo sapiens
taatgcttaacagctggctttt

SEQ ID NO: 7943899 - DNA, 22 bp, Homo sapiens
taatgctgtggtctaatgggga

SEQ ID NO: 7943900 - DNA, 22 bp, Homo sapiens
taatgctggattctttcttgtc

SEQ ID NO: 7943901 - DNA, 22 bp, Homo sapiens
taatgctgccaagccatgcaga

SEQ ID NO: 7943902 - DNA, 22 bp, Homo sapiens
taatgctaacatcatatcactg

SEQ ID NO: 7943903 - DNA, 22 bp, Homo sapiens
taatgctaacatcatatcactg

SEQ ID NO: 7943904 - DNA, 20 bp, Homo sapiens
taatgcctcatgatactaga

SEQ ID NO: 7943905 - DNA, 22 bp, Homo sapiens
taatgccttatgtcaaatgtaa

SEQ ID NO: 7943906 - DNA, 22 bp, Homo sapiens
taatttcactgatatgaagtca

SEQ ID NO: 7943907 - DNA, 22 bp, Homo sapiens
taatttctaattcattttcagt

SEQ ID NO: 7943908 - DNA, 22 bp, Homo sapiens
taatttctaattcattttcagt

SEQ ID NO: 7943909 - DNA, 22 bp, Homo sapiens
taatttcagtgggctctgggct

SEQ ID NO: 7943910 - DNA, 22 bp, Homo sapiens
taatttcaccgttgctagaaat

SEQ ID NO: 7943911 - DNA, 22 bp, Homo sapiens
taatttcaccgttgctagaaat

SEQ ID NO: 7943912 - DNA, 22 bp, Homo sapiens
taatttcactgatatgaagtca

SEQ ID NO: 7943913 - DNA, 22 bp, Homo sapiens
taatggattaacgtccctgtcg

SEQ ID NO: 7943914 - DNA, 22 bp, Homo sapiens
taatggattaacgtccctgtcg

SEQ ID NO: 7943915 - DNA, 22 bp, Homo sapiens
taatggattaacgtccctgtcg

SEQ ID NO: 7943916 - DNA, 22 bp, Homo sapiens
taatggattaacgtccctgtcg

SEQ ID NO: 7943917 - DNA, 22 bp, Homo sapiens
taatggaggtggcaaaaggtct

SEQ ID NO: 7943918 - DNA, 22 bp, Homo sapiens
taatggagtgacaaattggatt

SEQ ID NO: 7943919 - DNA, 22 bp, Homo sapiens
taatggagttggaattaataag

SEQ ID NO: 7943920 - DNA, 23 bp, Homo sapiens
taatggagtgtggctgcttcgag

SEQ ID NO: 7943921 - DNA, 22 bp, Homo sapiens
taatggagatgctgaagtcaca

SEQ ID NO: 7943922 - DNA, 22 bp, Homo sapiens
taatggaagttaaatatggtat

SEQ ID NO: 7943923 - DNA, 22 bp, Homo sapiens
taatggagcctgccttccaggg

SEQ ID NO: 7943924 - DNA, 22 bp, Homo sapiens
taatggagccagaagatcttga

SEQ ID NO: 7943925 - DNA, 22 bp, Homo sapiens
taatggagcaagccactgaatg

SEQ ID NO: 7943926 - DNA, 22 bp, Homo sapiens
taatttcaatagcttgcataat

SEQ ID NO: 7943927 - DNA, 22 bp, Homo sapiens
taatttcacagttcaacgcaca

SEQ ID NO: 7943928 - DNA, 22 bp, Homo sapiens
taatttttccacgtacactggg

SEQ ID NO: 7943929 - DNA, 22 bp, Homo sapiens
taatttttccacgtacactggg

SEQ ID NO: 7943930 - DNA, 22 bp, Homo sapiens
taatttttccacgtacactggg

SEQ ID NO: 7943931 - DNA, 22 bp, Homo sapiens
taatttttccacgtacactggg

SEQ ID NO: 7943932 - DNA, 22 bp, Homo sapiens
tacaaaaaattgatactgacga

SEQ ID NO: 7943933 - DNA, 22 bp, Homo sapiens
tacaagctcgggcagctcatta

SEQ ID NO: 7943934 - DNA, 22 bp, Homo sapiens
tacaaaaaattgatactgacga

SEQ ID NO: 7943935 - DNA, 22 bp, Homo sapiens
tacaagctcacaaatttttaag

SEQ ID NO: 7943936 - DNA, 22 bp, Homo sapiens
tacaaaaaattgatactgacga

SEQ ID NO: 7943937 - DNA, 22 bp, Homo sapiens
tacaagctggcgcagttaagat

SEQ ID NO: 7943938 - DNA, 22 bp, Homo sapiens
tacaagctgaccctgaagatga

SEQ ID NO: 7943939 - DNA, 22 bp, Homo sapiens
tacaatatgtggccttttgtga

SEQ ID NO: 7943940 - DNA, 22 bp, Homo sapiens
tacaatatgtggccttttgtga

SEQ ID NO: 7943941 - DNA, 22 bp, Homo sapiens
tacaatatgtggccttttgtga

SEQ ID NO: 7943942 - DNA, 22 bp, Homo sapiens
tacaatatgtggccttttgtga

SEQ ID NO: 7943943 - DNA, 22 bp, Homo sapiens
tacaatatgtggccttttgtga

SEQ ID NO: 7943944 - DNA, 22 bp, Homo sapiens
tacaatcacccaaagagccaga

SEQ ID NO: 7943945 - DNA, 22 bp, Homo sapiens
tacaatcaggataataatagtg

SEQ ID NO: 7943946 - DNA, 20 bp, Homo sapiens
tacaatattcccactttgct

SEQ ID NO: 7943947 - DNA, 20 bp, Homo sapiens
tacaatattcccactttgct

SEQ ID NO: 7943948 - DNA, 20 bp, Homo sapiens
tacaatattcccactttgct

SEQ ID NO: 7943949 - DNA, 22 bp, Homo sapiens
tacaatgtaattctgattatgt

SEQ ID NO: 7943950 - DNA, 22 bp, Homo sapiens
tacaatgtaattctgattatgt

SEQ ID NO: 7943951 - DNA, 22 bp, Homo sapiens
tacaatgtacttccttgcacag

SEQ ID NO: 7943952 - DNA, 22 bp, Homo sapiens
tacaatgtacttccttgcacag

SEQ ID NO: 7943953 - DNA, 22 bp, Homo sapiens
tacaatgtacttccttgcacag

SEQ ID NO: 7943954 - DNA, 16 bp, Homo sapiens
tacaatgtagaaaaca

SEQ ID NO: 7943955 - DNA, 22 bp, Homo sapiens
tacaatgtctctcacctgactt

SEQ ID NO: 7943956 - DNA, 22 bp, Homo sapiens
tacaatgtctctcacctgactt

SEQ ID NO: 7943957 - DNA, 22 bp, Homo sapiens
tacaatgctgtttgtttctact

SEQ ID NO: 7943958 - DNA, 22 bp, Homo sapiens
tacaatgtaattctgattatgt

SEQ ID NO: 7943959 - DNA, 22 bp, Homo sapiens
tacaatgtaattctgattatgt

SEQ ID NO: 7943960 - DNA, 22 bp, Homo sapiens
tacaatgtaattctgattatgt

SEQ ID NO: 7943961 - DNA, 22 bp, Homo sapiens
tacaatgcattcatttttgagg

SEQ ID NO: 7943962 - DNA, 22 bp, Homo sapiens
tacaatgcaaaatactgtctgc

SEQ ID NO: 7943963 - DNA, 22 bp, Homo sapiens
tacaatctttatgttgagtggt

SEQ ID NO: 7943964 - DNA, 22 bp, Homo sapiens
tacaatcaggctctagcttctc

SEQ ID NO: 7943965 - DNA, 22 bp, Homo sapiens
tacaatgaccatattatgtaag

SEQ ID NO: 7943966 - DNA, 19 bp, Homo sapiens
tacaatgatgttacctttg

SEQ ID NO: 7943967 - DNA, 22 bp, Homo sapiens
tacaatgatgatactttactgg

SEQ ID NO: 7943968 - DNA, 22 bp, Homo sapiens
tacaatgagctgtacatctcca

SEQ ID NO: 7943969 - DNA, 22 bp, Homo sapiens
tacaatgagctgtacatctcca

SEQ ID NO: 7943970 - DNA, 22 bp, Homo sapiens
taattttccactctgtttatct

SEQ ID NO: 7943971 - DNA, 22 bp, Homo sapiens
taattttccactctgtttatct

SEQ ID NO: 7943972 - DNA, 22 bp, Homo sapiens
taattttgctgtgaccattgaa

SEQ ID NO: 7943973 - DNA, 22 bp, Homo sapiens
taattttccactctgtttatct

SEQ ID NO: 7943974 - DNA, 22 bp, Homo sapiens
taattttatgacagtgtatttt

SEQ ID NO: 7943975 - DNA, 22 bp, Homo sapiens
taattttccactctgtttatct

SEQ ID NO: 7943976 - DNA, 22 bp, Homo sapiens
taattttccactctgtttatct

SEQ ID NO: 7943977 - DNA, 22 bp, Homo sapiens
taattttccactctgtttatct

SEQ ID NO: 7943978 - DNA, 23 bp, Homo sapiens
taattttagccttacaggaccct

SEQ ID NO: 7943979 - DNA, 22 bp, Homo sapiens
taattttatgacagtgtatttt

SEQ ID NO: 7943980 - DNA, 23 bp, Homo sapiens
taattttagccttacaggaccct

SEQ ID NO: 7943981 - DNA, 22 bp, Homo sapiens
taattttatgacagtgtatttt

SEQ ID NO: 7943982 - DNA, 22 bp, Homo sapiens
taattttatgacagtgtatttt

SEQ ID NO: 7943983 - DNA, 22 bp, Homo sapiens
taattttatgacagtgtatttt

SEQ ID NO: 7943984 - DNA, 22 bp, Homo sapiens
taattttatgacagtgtatttt

SEQ ID NO: 7943985 - DNA, 22 bp, Homo sapiens
taattttatgacagtgtatttt

SEQ ID NO: 7943986 - DNA, 22 bp, Homo sapiens
taattttatgacagtgtatttt

SEQ ID NO: 7943987 - DNA, 22 bp, Homo sapiens
taattttgtccccctgcacata

SEQ ID NO: 7943988 - DNA, 22 bp, Homo sapiens
taattttgtccccctgcacata

SEQ ID NO: 7943989 - DNA, 22 bp, Homo sapiens
taatttttccacgtacactggg

SEQ ID NO: 7943990 - DNA, 22 bp, Homo sapiens
taattttgtcacagtgacatgc

SEQ ID NO: 7943991 - DNA, 22 bp, Homo sapiens
taattttgtcacagtgacatgc

SEQ ID NO: 7943992 - DNA, 22 bp, Homo sapiens
taattttgctgtgaccattgaa

SEQ ID NO: 7943993 - DNA, 22 bp, Homo sapiens
taattttgtattgccattgtag

SEQ ID NO: 7943994 - DNA, 22 bp, Homo sapiens
taattttgtattgccattgtag

SEQ ID NO: 7943995 - DNA, 22 bp, Homo sapiens
taattttgtattgccattgtag

SEQ ID NO: 7943996 - DNA, 22 bp, Homo sapiens
taattttgtcacagtgacatgc

SEQ ID NO: 7943997 - DNA, 20 bp, Homo sapiens
taatttgatatctataagtt

SEQ ID NO: 7943998 - DNA, 22 bp, Homo sapiens
taattttaactgtgctgtttgg

SEQ ID NO: 7943999 - DNA, 18 bp, Homo sapiens
taatttgcacagttgcaa

SEQ ID NO: 7944000 - DNA, 22 bp, Homo sapiens
taatttcttcatctctgcagct

SEQ ID NO: 7944001 - DNA, 22 bp, Homo sapiens
taatttctagggactaaggtgc

SEQ ID NO: 7944002 - DNA, 22 bp, Homo sapiens
taattttaactgtgctgtttgg

SEQ ID NO: 7944003 - DNA, 22 bp, Homo sapiens
taattttaactgtgctgtttgg

SEQ ID NO: 7944004 - DNA, 22 bp, Homo sapiens
taattttaatagtatgtggcat

SEQ ID NO: 7944005 - DNA, 22 bp, Homo sapiens
taattttaatagtatgtggcat

SEQ ID NO: 7944006 - DNA, 22 bp, Homo sapiens
taattttacttcctgagcacct

SEQ ID NO: 7944007 - DNA, 22 bp, Homo sapiens
taattttacttcctgagcacct

SEQ ID NO: 7944008 - DNA, 22 bp, Homo sapiens
taattttaatagtatgtggcat

SEQ ID NO: 7944009 - DNA, 22 bp, Homo sapiens
taattttacttcctgagcacct

SEQ ID NO: 7944010 - DNA, 22 bp, Homo sapiens
taattttacttcctgagcacct

SEQ ID NO: 7944011 - DNA, 22 bp, Homo sapiens
taattttacttcctgagcacct

SEQ ID NO: 7944012 - DNA, 22 bp, Homo sapiens
taattttacttcctgagcacct

SEQ ID NO: 7944013 - DNA, 22 bp, Homo sapiens
tacacatatgtgtgtatatgtg

SEQ ID NO: 7944014 - DNA, 22 bp, Homo sapiens
tacacatatgtgtgtatatgtg

SEQ ID NO: 7944015 - DNA, 22 bp, Homo sapiens
tacacatcactgtatctttcag

SEQ ID NO: 7944016 - DNA, 22 bp, Homo sapiens
tacacatcaacctggctttggc

SEQ ID NO: 7944017 - DNA, 22 bp, Homo sapiens
tacacatatgtccattaatcag

SEQ ID NO: 7944018 - DNA, 22 bp, Homo sapiens
tacacatatgtccattaatcag

SEQ ID NO: 7944019 - DNA, 22 bp, Homo sapiens
tacacaaaggcactctgttgtt

SEQ ID NO: 7944020 - DNA, 22 bp, Homo sapiens
tacacatatgtccattaatcag

SEQ ID NO: 7944021 - DNA, 22 bp, Homo sapiens
tacacatatgtgtgtatatgtg

SEQ ID NO: 7944022 - DNA, 22 bp, Homo sapiens
tacacatctctgtcagtagtga

SEQ ID NO: 7944023 - DNA, 22 bp, Homo sapiens
tacacatctctgtcagtagtga

SEQ ID NO: 7944024 - DNA, 22 bp, Homo sapiens
tacacatgacagtggactgaga

SEQ ID NO: 7944025 - DNA, 22 bp, Homo sapiens
tacacatgatcatttagtagca

SEQ ID NO: 7944026 - DNA, 22 bp, Homo sapiens
tacacatgacagtggactgaga

SEQ ID NO: 7944027 - DNA, 22 bp, Homo sapiens
tacacatccttctgaacaacct

SEQ ID NO: 7944028 - DNA, 22 bp, Homo sapiens
tacacatctctgtcagtagtga

SEQ ID NO: 7944029 - DNA, 22 bp, Homo sapiens
tacacatcccagactcccagga

SEQ ID NO: 7944030 - DNA, 22 bp, Homo sapiens
tacacatccatgttttgacttt

SEQ ID NO: 7944031 - DNA, 22 bp, Homo sapiens
tacacatccatgttttgacttt

SEQ ID NO: 7944032 - DNA, 22 bp, Homo sapiens
tacaatgttaaggaaagagaga

SEQ ID NO: 7944033 - DNA, 22 bp, Homo sapiens
tacaatgttaaggaaagagaga

SEQ ID NO: 7944034 - DNA, 22 bp, Homo sapiens
tacaatgttaaggaaagagaga

SEQ ID NO: 7944035 - DNA, 22 bp, Homo sapiens
tacaatgttaaggaaagagaga

SEQ ID NO: 7944036 - DNA, 22 bp, Homo sapiens
tacaatgttcatagctttggca

SEQ ID NO: 7944037 - DNA, 17 bp, Homo sapiens
tacaatgtgattcaatc

SEQ ID NO: 7944038 - DNA, 17 bp, Homo sapiens
tacaatgtgattcaatc

SEQ ID NO: 7944039 - DNA, 22 bp, Homo sapiens
tacaatgtgtgcttcttgtcac

SEQ ID NO: 7944040 - DNA, 22 bp, Homo sapiens
tacaatgtgtgcttcttgtcac

SEQ ID NO: 7944041 - DNA, 22 bp, Homo sapiens
tacaatgtgtgcttcttgtcac

SEQ ID NO: 7944042 - DNA, 22 bp, Homo sapiens
tacaatgtgtgcttcttgtcac

SEQ ID NO: 7944043 - DNA, 22 bp, Homo sapiens
tacaatgtgtgcttcttgtcac

SEQ ID NO: 7944044 - DNA, 22 bp, Homo sapiens
tacaattactcagctctgctgt

SEQ ID NO: 7944045 - DNA, 22 bp, Homo sapiens
tacaattactcagctctgctgt

SEQ ID NO: 7944046 - DNA, 22 bp, Homo sapiens
tacaattctttgtaaggtggtc

SEQ ID NO: 7944047 - DNA, 22 bp, Homo sapiens
tacaattctttgtaaggtggtc

SEQ ID NO: 7944048 - DNA, 22 bp, Homo sapiens
tacaatgttggtaaagtatcat

SEQ ID NO: 7944049 - DNA, 22 bp, Homo sapiens
tacaatgttggtaaagtatcat

SEQ ID NO: 7944050 - DNA, 22 bp, Homo sapiens
tacaatgttggtaaagtatcat

SEQ ID NO: 7944051 - DNA, 22 bp, Homo sapiens
tacaatgttggtaaagtatcat

SEQ ID NO: 7944052 - DNA, 22 bp, Homo sapiens
tacaatgttcgcattctctctg

SEQ ID NO: 7944053 - DNA, 22 bp, Homo sapiens
tacaatgttcatagctttggca

SEQ ID NO: 7944054 - DNA, 22 bp, Homo sapiens
tacaatgttggtaaagtatcat

SEQ ID NO: 7944055 - DNA, 22 bp, Homo sapiens
tacaatgttggtaaagtatcat

SEQ ID NO: 7944056 - DNA, 22 bp, Homo sapiens
tacaatgttcctagcaggaaag

SEQ ID NO: 7944057 - DNA, 22 bp, Homo sapiens
tacaatgttcctagcaggaaag

SEQ ID NO: 7944058 - DNA, 22 bp, Homo sapiens
tacaatgttcgcattctctctg

SEQ ID NO: 7944059 - DNA, 22 bp, Homo sapiens
tacacaaaggcactctgttgtt

SEQ ID NO: 7944060 - DNA, 22 bp, Homo sapiens
tacacaaaggcactctgttgtt

SEQ ID NO: 7944061 - DNA, 22 bp, Homo sapiens
tacacaaaggcactctgttgtt

SEQ ID NO: 7944062 - DNA, 22 bp, Homo sapiens
tacacaaaggcactctgttgtt

SEQ ID NO: 7944063 - DNA, 21 bp, Homo sapiens
tacacaaagcgtggtccagag

SEQ ID NO: 7944064 - DNA, 21 bp, Homo sapiens
tacacaaagcgtggtccagag

SEQ ID NO: 7944065 - DNA, 22 bp, Homo sapiens
tacacaaaggcactctgttgtt

SEQ ID NO: 7944066 - DNA, 19 bp, Homo sapiens
tacaattggctttccattg

SEQ ID NO: 7944067 - DNA, 22 bp, Homo sapiens
tacaatttagtggtgtgtggtt

SEQ ID NO: 7944068 - DNA, 21 bp, Homo sapiens
tacacaaagcgtggtccagag

SEQ ID NO: 7944069 - DNA, 21 bp, Homo sapiens
tacacaaagcgtggtccagag

SEQ ID NO: 7944070 - DNA, 21 bp, Homo sapiens
tacacaaagcgtggtccagag

SEQ ID NO: 7944071 - DNA, 21 bp, Homo sapiens
tacacaaagcgtggtccagag

SEQ ID NO: 7944072 - DNA, 22 bp, Homo sapiens
tacacatgtatttatgtgtaca

SEQ ID NO: 7944073 - DNA, 22 bp, Homo sapiens
tacacatgtccaaggtgtcacc

SEQ ID NO: 7944074 - DNA, 22 bp, Homo sapiens
tacacatgtgcacgcgtgtcct

SEQ ID NO: 7944075 - DNA, 22 bp, Homo sapiens
tacacatgtccaaggtgtcacc

SEQ ID NO: 7944076 - DNA, 22 bp, Homo sapiens
tacacatgtttggcaagtatgt

SEQ ID NO: 7944077 - DNA, 22 bp, Homo sapiens
tacacatgtttggcaagtatgt

SEQ ID NO: 7944078 - DNA, 22 bp, Homo sapiens
tacacatgtttggcaagtatgt

SEQ ID NO: 7944079 - DNA, 22 bp, Homo sapiens
tacacatgtttggcaagtatgt

SEQ ID NO: 7944080 - DNA, 22 bp, Homo sapiens
tacacatgtatttatgtgtaca

SEQ ID NO: 7944081 - DNA, 22 bp, Homo sapiens
tacacatgtatttatgtgtaca

SEQ ID NO: 7944082 - DNA, 22 bp, Homo sapiens
tacacatgcatgtactccagga

SEQ ID NO: 7944083 - DNA, 22 bp, Homo sapiens
tacacatgctcagattcctgtg

SEQ ID NO: 7944084 - DNA, 22 bp, Homo sapiens
tacacatgatcatttagtagca

SEQ ID NO: 7944085 - DNA, 22 bp, Homo sapiens
tacacatgcatgtactccagga

SEQ ID NO: 7944086 - DNA, 22 bp, Homo sapiens
tacacattacataatactatct

SEQ ID NO: 7944087 - DNA, 22 bp, Homo sapiens
tacacattacataatactatct

SEQ ID NO: 7944088 - DNA, 22 bp, Homo sapiens
tacacattacataatactatct

SEQ ID NO: 7944089 - DNA, 22 bp, Homo sapiens
tacacattagtcaagagtttga

SEQ ID NO: 7944090 - DNA, 22 bp, Homo sapiens
tacacattctagggcacagtta

SEQ ID NO: 7944091 - DNA, 22 bp, Homo sapiens
tacacatttctcttagagacac

SEQ ID NO: 7944092 - DNA, 22 bp, Homo sapiens
tacacatttctcttagagacac

SEQ ID NO: 7944093 - DNA, 22 bp, Homo sapiens
tacacattctagggcacagtta

SEQ ID NO: 7944094 - DNA, 22 bp, Homo sapiens
tacactaatgtttttgcaaagc

SEQ ID NO: 7944095 - DNA, 22 bp, Homo sapiens
tacactacacgaaggcattgca

SEQ ID NO: 7944096 - DNA, 22 bp, Homo sapiens
tacactaatgtttttgcaaagc

SEQ ID NO: 7944097 - DNA, 22 bp, Homo sapiens
tacactaatgtttttgcaaagc

SEQ ID NO: 7944098 - DNA, 22 bp, Homo sapiens
tacactaatagccacactaatg

SEQ ID NO: 7944099 - DNA, 22 bp, Homo sapiens
tacactaatagccacactaatg

SEQ ID NO: 7944100 - DNA, 22 bp, Homo sapiens
tacactaatagccacactaatg

SEQ ID NO: 7944101 - DNA, 22 bp, Homo sapiens
tacacgtgtgtgtatgtacata

SEQ ID NO: 7944102 - DNA, 22 bp, Homo sapiens
tacacgtgcaaattcaatgtat

SEQ ID NO: 7944103 - DNA, 22 bp, Homo sapiens
tacacgatatttttacagatac

SEQ ID NO: 7944104 - DNA, 22 bp, Homo sapiens
tacacccttctcctgagtgtgt

SEQ ID NO: 7944105 - DNA, 22 bp, Homo sapiens
tacacccttctcctgagtgtgt

SEQ ID NO: 7944106 - DNA, 22 bp, Homo sapiens
tacacccaggtaccgtgatttc

SEQ ID NO: 7944107 - DNA, 22 bp, Homo sapiens
tacacccacattgagcatggga

SEQ ID NO: 7944108 - DNA, 22 bp, Homo sapiens
tacaccattcccaggtggattt

SEQ ID NO: 7944109 - DNA, 22 bp, Homo sapiens
tacaccattcccaggtggattt

SEQ ID NO: 7944110 - DNA, 22 bp, Homo sapiens
tacaccattcccaggtggattt

SEQ ID NO: 7944111 - DNA, 22 bp, Homo sapiens
tacacccacatgcctaggaggg

SEQ ID NO: 7944112 - DNA, 22 bp, Homo sapiens
tacaccattttctgcagtgttt

SEQ ID NO: 7944113 - DNA, 22 bp, Homo sapiens
tacacccacattgagcatggga

SEQ ID NO: 7944114 - DNA, 22 bp, Homo sapiens
tacacccacattgagcatggga

SEQ ID NO: 7944115 - DNA, 22 bp, Homo sapiens
tacaccaggttaccaatcactg

SEQ ID NO: 7944116 - DNA, 22 bp, Homo sapiens
tacaccaggtgttatggtcaat

SEQ ID NO: 7944117 - DNA, 22 bp, Homo sapiens
tacaccagtatcttaagcatga

SEQ ID NO: 7944118 - DNA, 22 bp, Homo sapiens
tacaccagattatttataacat

SEQ ID NO: 7944119 - DNA, 22 bp, Homo sapiens
tacaccagaatctctgtgggga

SEQ ID NO: 7944120 - DNA, 22 bp, Homo sapiens
tacacattttgcgggtacatgt

SEQ ID NO: 7944121 - DNA, 22 bp, Homo sapiens
tacacattttgcgggtacatgt

SEQ ID NO: 7944122 - DNA, 22 bp, Homo sapiens
tacacatttctcttagagacac

SEQ ID NO: 7944123 - DNA, 21 bp, Homo sapiens
taaataataagttgctgagat

SEQ ID NO: 7944124 - DNA, 22 bp, Homo sapiens
taaataagttcttcattgtttg

SEQ ID NO: 7944125 - DNA, 22 bp, Homo sapiens
taaataagttcttcattgtttg

SEQ ID NO: 7944126 - DNA, 22 bp, Homo sapiens
taaataagttcttcattgtttg

SEQ ID NO: 7944127 - DNA, 21 bp, Homo sapiens
taaataataagttgctgagat

SEQ ID NO: 7944128 - DNA, 21 bp, Homo sapiens
taaataataagttgctgagat

SEQ ID NO: 7944129 - DNA, 21 bp, Homo sapiens
taaataataagttgctgagat

SEQ ID NO: 7944130 - DNA, 17 bp, Homo sapiens
taaatacacaagggtat

SEQ ID NO: 7944131 - DNA, 17 bp, Homo sapiens
taaatacacaagggtat

SEQ ID NO: 7944132 - DNA, 17 bp, Homo sapiens
taaatacacaagggtat

SEQ ID NO: 7944133 - DNA, 22 bp, Homo sapiens
taaagtttggcagacaataaca

SEQ ID NO: 7944134 - DNA, 22 bp, Homo sapiens
taaagtttggcagacaataaca

SEQ ID NO: 7944135 - DNA, 22 bp, Homo sapiens
taaagtttggcagacaataaca

SEQ ID NO: 7944136 - DNA, 22 bp, Homo sapiens
taaagtttgtagcaattgatat

SEQ ID NO: 7944137 - DNA, 22 bp, Homo sapiens
taaagtttgtagcaattgatat

SEQ ID NO: 7944138 - DNA, 22 bp, Homo sapiens
taaataagttcttcattgtttg

SEQ ID NO: 7944139 - DNA, 22 bp, Homo sapiens
taaataagtcactgaccattta

SEQ ID NO: 7944140 - DNA, 22 bp, Homo sapiens
taaataagtcactgaccattta

SEQ ID NO: 7944141 - DNA, 22 bp, Homo sapiens
taaataagtcactgaccattta

SEQ ID NO: 7944142 - DNA, 22 bp, Homo sapiens
taaagtttattggcaccaccat

SEQ ID NO: 7944143 - DNA, 22 bp, Homo sapiens
taaagtttattggcaccaccat

SEQ ID NO: 7944144 - DNA, 22 bp, Homo sapiens
taaagttcttagaacaaggcct

SEQ ID NO: 7944145 - DNA, 22 bp, Homo sapiens
taaagttctggtgagaggtaag

SEQ ID NO: 7944146 - DNA, 22 bp, Homo sapiens
taaagttataaattacctgtca

SEQ ID NO: 7944147 - DNA, 22 bp, Homo sapiens
taaagttcagtgcatgaatgtg

SEQ ID NO: 7944148 - DNA, 22 bp, Homo sapiens
taaagtttggcagacaataaca

SEQ ID NO: 7944149 - DNA, 22 bp, Homo sapiens
taaagtttggcagacaataaca

SEQ ID NO: 7944150 - DNA, 22 bp, Homo sapiens
taaagtttatttgaacatctct

SEQ ID NO: 7944151 - DNA, 22 bp, Homo sapiens
taaagtttatttgaacatctct

SEQ ID NO: 7944152 - DNA, 22 bp, Homo sapiens
taaagtgttgtacaaatgtatg

SEQ ID NO: 7944153 - DNA, 22 bp, Homo sapiens
taaagtgttagagtctagcttc

SEQ ID NO: 7944154 - DNA, 22 bp, Homo sapiens
taaagtgttgtacaaatgtatg

SEQ ID NO: 7944155 - DNA, 22 bp, Homo sapiens
taaagtgttgtacaaatgtatg

SEQ ID NO: 7944156 - DNA, 22 bp, Homo sapiens
taaagtgtttgtatgcagataa

SEQ ID NO: 7944157 - DNA, 22 bp, Homo sapiens
taaagttataaattacctgtca

SEQ ID NO: 7944158 - DNA, 22 bp, Homo sapiens
taaagtgttgtacaaatgtatg

SEQ ID NO: 7944159 - DNA, 22 bp, Homo sapiens
taaagtgtttgtatgcagataa

SEQ ID NO: 7944160 - DNA, 22 bp, Homo sapiens
taaagtgtttgtatgcagataa

SEQ ID NO: 7944161 - DNA, 22 bp, Homo sapiens
taaagtgtgtatatacatatgg

SEQ ID NO: 7944162 - DNA, 22 bp, Homo sapiens
taaagtgtgtatatacatatgg

SEQ ID NO: 7944163 - DNA, 22 bp, Homo sapiens
taaagtgtggatatgattagta

SEQ ID NO: 7944164 - DNA, 22 bp, Homo sapiens
taaagtgtggatatgattagta

SEQ ID NO: 7944165 - DNA, 22 bp, Homo sapiens
taaagtgtggatatgattagta

SEQ ID NO: 7944166 - DNA, 22 bp, Homo sapiens
taaagtgtgtgggttctaaatt

SEQ ID NO: 7944167 - DNA, 22 bp, Homo sapiens
taaagtgtgttttgattacgtc

SEQ ID NO: 7944168 - DNA, 22 bp, Homo sapiens
taaagtgtgtatatacatatgg

SEQ ID NO: 7944169 - DNA, 22 bp, Homo sapiens
taaagtgtgtatatacatatgg

SEQ ID NO: 7944170 - DNA, 22 bp, Homo sapiens
taaagtgtggacagtatctata

SEQ ID NO: 7944171 - DNA, 22 bp, Homo sapiens
taaagtgtggacagtatctata

SEQ ID NO: 7944172 - DNA, 22 bp, Homo sapiens
taaagtgtggacagtatctata

SEQ ID NO: 7944173 - DNA, 22 bp, Homo sapiens
taaagtgtggacagtatctata

SEQ ID NO: 7944174 - DNA, 22 bp, Homo sapiens
taaagacactggttttaatcat

SEQ ID NO: 7944175 - DNA, 22 bp, Homo sapiens
taaagacactggttttaatcat

SEQ ID NO: 7944176 - DNA, 22 bp, Homo sapiens
taaagtgtgcatggtcaaatat

SEQ ID NO: 7944177 - DNA, 22 bp, Homo sapiens
taaagacacccagggagggact

SEQ ID NO: 7944178 - DNA, 22 bp, Homo sapiens
taaagacaatttcgagctgtag

SEQ ID NO: 7944179 - DNA, 22 bp, Homo sapiens
taaagacaatttcgagctgtag

SEQ ID NO: 7944180 - DNA, 22 bp, Homo sapiens
taaacatgttgacatcttacct

SEQ ID NO: 7944181 - DNA, 22 bp, Homo sapiens
taaactgtggaatgttctcttt

SEQ ID NO: 7944182 - DNA, 21 bp, Homo sapiens
taaagaagatgaatgtgatca

SEQ ID NO: 7944183 - DNA, 21 bp, Homo sapiens
taaagaagatgaatgtgatca

SEQ ID NO: 7944184 - DNA, 21 bp, Homo sapiens
taaagaagatgaatgtgatca

SEQ ID NO: 7944185 - DNA, 22 bp, Homo sapiens
taaactgtggaatgttctcttt

SEQ ID NO: 7944186 - DNA, 22 bp, Homo sapiens
taaagaacacagggaatagcac

SEQ ID NO: 7944187 - DNA, 22 bp, Homo sapiens
taaagacaaacccactagggtt

SEQ ID NO: 7944188 - DNA, 22 bp, Homo sapiens
taaagacaaacccactagggtt

SEQ ID NO: 7944189 - DNA, 22 bp, Homo sapiens
taaagaataatacccatggagc

SEQ ID NO: 7944190 - DNA, 22 bp, Homo sapiens
taaagacaaatgacattacggc

SEQ ID NO: 7944191 - DNA, 22 bp, Homo sapiens
taaagacaataggaaagttgtt

SEQ ID NO: 7944192 - DNA, 22 bp, Homo sapiens
taaagacaataggaaagttgtt

SEQ ID NO: 7944193 - DNA, 22 bp, Homo sapiens
taaagacaataggaaagttgtt

SEQ ID NO: 7944194 - DNA, 22 bp, Homo sapiens
taaagacaataggaaagttgtt

SEQ ID NO: 7944195 - DNA, 22 bp, Homo sapiens
taaacagagtgctagttcacgg

SEQ ID NO: 7944196 - DNA, 22 bp, Homo sapiens
taaacagagatgcctgggtctg

SEQ ID NO: 7944197 - DNA, 22 bp, Homo sapiens
taaacagagatgcctgggtctg

SEQ ID NO: 7944198 - DNA, 22 bp, Homo sapiens
taaacagagagtgcagttatag

SEQ ID NO: 7944199 - DNA, 22 bp, Homo sapiens
taaacagagagtgcagttatag

SEQ ID NO: 7944200 - DNA, 16 bp, Homo sapiens
taaacagcagacagtt

SEQ ID NO: 7944201 - DNA, 22 bp, Homo sapiens
taaacagagtgctagttcacgg

SEQ ID NO: 7944202 - DNA, 22 bp, Homo sapiens
taaacagagtgctagttcacgg

SEQ ID NO: 7944203 - DNA, 22 bp, Homo sapiens
taaacagagtgctagttcacgg

SEQ ID NO: 7944204 - DNA, 22 bp, Homo sapiens
taaacagagtgctagttcacgg

SEQ ID NO: 7944205 - DNA, 22 bp, Homo sapiens
taaacagcctaaaactttcttt

SEQ ID NO: 7944206 - DNA, 22 bp, Homo sapiens
taaacagcctcccctttcactc

SEQ ID NO: 7944207 - DNA, 22 bp, Homo sapiens
gttttcaattataagatggctt

SEQ ID NO: 7944208 - DNA, 22 bp, Homo sapiens
gttttcaattataagatggctt

SEQ ID NO: 7944209 - DNA, 22 bp, Homo sapiens
gttttcaaggggatttaactga

SEQ ID NO: 7944210 - DNA, 22 bp, Homo sapiens
gttttcaattataagatggctt

SEQ ID NO: 7944211 - DNA, 22 bp, Homo sapiens
gttttcaattataagatggctt

SEQ ID NO: 7944212 - DNA, 22 bp, Homo sapiens
gttttcaaggggatttaactga

SEQ ID NO: 7944213 - DNA, 23 bp, Homo sapiens
gttttcaacacaataaatgtaac

SEQ ID NO: 7944214 - DNA, 21 bp, Homo sapiens
gttttcatgatagagtctgta

SEQ ID NO: 7944215 - DNA, 22 bp, Homo sapiens
taaacagagaagactttgagca

SEQ ID NO: 7944216 - DNA, 22 bp, Homo sapiens
taaacagagaagactttgagca

SEQ ID NO: 7944217 - DNA, 22 bp, Homo sapiens
taaacagagaagactttgagca

SEQ ID NO: 7944218 - DNA, 22 bp, Homo sapiens
gttttcagccaggagcacattt

SEQ ID NO: 7944219 - DNA, 22 bp, Homo sapiens
gttttcaattataagatggctt

SEQ ID NO: 7944220 - DNA, 21 bp, Homo sapiens
gttttcatgatagagtctgta

SEQ ID NO: 7944221 - DNA, 22 bp, Homo sapiens
taaacatctgtcatgtgtttat

SEQ ID NO: 7944222 - DNA, 22 bp, Homo sapiens
taaacatggctgtttcagttat

SEQ ID NO: 7944223 - DNA, 22 bp, Homo sapiens
taaacatggctgtttcagttat

SEQ ID NO: 7944224 - DNA, 22 bp, Homo sapiens
taaacatgtgagtgtgcatata

SEQ ID NO: 7944225 - DNA, 22 bp, Homo sapiens
taaacatgtgagtgtgcatata

SEQ ID NO: 7944226 - DNA, 22 bp, Homo sapiens
taaacatgcccagtgacaggga

SEQ ID NO: 7944227 - DNA, 22 bp, Homo sapiens
taaacatgcccagtgacaggga

SEQ ID NO: 7944228 - DNA, 22 bp, Homo sapiens
taaacatggattctgatcacag

SEQ ID NO: 7944229 - DNA, 22 bp, Homo sapiens
taaacatggattctgatcacag

SEQ ID NO: 7944230 - DNA, 22 bp, Homo sapiens
taaacatctgaatcctgcttcc

SEQ ID NO: 7944231 - DNA, 22 bp, Homo sapiens
taaacatctgtagccttcagtc

SEQ ID NO: 7944232 - DNA, 22 bp, Homo sapiens
taaacatctgaatcctgcttcc

SEQ ID NO: 7944233 - DNA, 22 bp, Homo sapiens
taaacatctgaatcctgcttcc

SEQ ID NO: 7944234 - DNA, 22 bp, Homo sapiens
taaacatctgtagccttcagtc

SEQ ID NO: 7944235 - DNA, 22 bp, Homo sapiens
taaacagttaacatgccagaat

SEQ ID NO: 7944236 - DNA, 22 bp, Homo sapiens
taaacatcaccttctgcagttg

SEQ ID NO: 7944237 - DNA, 22 bp, Homo sapiens
taaacatcagtacaaagactaa

SEQ ID NO: 7944238 - DNA, 22 bp, Homo sapiens
taaacatcagtacaaagactaa

SEQ ID NO: 7944239 - DNA, 22 bp, Homo sapiens
taaacatcaggaatgaaaacct

SEQ ID NO: 7944240 - DNA, 22 bp, Homo sapiens
taaacatctgaatcctgcttcc

SEQ ID NO: 7944241 - DNA, 22 bp, Homo sapiens
taaacagtgatacgttccagct

SEQ ID NO: 7944242 - DNA, 20 bp, Homo sapiens
taaacagtatttactaggag

SEQ ID NO: 7944243 - DNA, 22 bp, Homo sapiens
taaacagctactgtgtcaaagg

SEQ ID NO: 7944244 - DNA, 22 bp, Homo sapiens
taaacagctactgtgtcaaagg

SEQ ID NO: 7944245 - DNA, 22 bp, Homo sapiens
taaacagctactgtgtcaaagg

SEQ ID NO: 7944246 - DNA, 22 bp, Homo sapiens
taaacaggagttgaagcagtaa

SEQ ID NO: 7944247 - DNA, 22 bp, Homo sapiens
gttttattggaacacagccatg

SEQ ID NO: 7944248 - DNA, 22 bp, Homo sapiens
gttttattggaacacagccatg

SEQ ID NO: 7944249 - DNA, 22 bp, Homo sapiens
gttttatatgtctctgctgaca

SEQ ID NO: 7944250 - DNA, 22 bp, Homo sapiens
gttttattggaacacagccatg

SEQ ID NO: 7944251 - DNA, 22 bp, Homo sapiens
gttttattggaacacagccatg

SEQ ID NO: 7944252 - DNA, 22 bp, Homo sapiens
gttttattggaacacagccatg

SEQ ID NO: 7944253 - DNA, 22 bp, Homo sapiens
gttttattggaacacagccatg

SEQ ID NO: 7944254 - DNA, 22 bp, Homo sapiens
gttttattggaacacagccatg

SEQ ID NO: 7944255 - DNA, 22 bp, Homo sapiens
gttttattggaacacagccatg

SEQ ID NO: 7944256 - DNA, 22 bp, Homo sapiens
gttttattggaacacagccatg

SEQ ID NO: 7944257 - DNA, 22 bp, Homo sapiens
gttttatttccatgagagaccg

SEQ ID NO: 7944258 - DNA, 22 bp, Homo sapiens
gttttatttccatgagagaccg

SEQ ID NO: 7944259 - DNA, 22 bp, Homo sapiens
gttttatttccatgagagaccg

SEQ ID NO: 7944260 - DNA, 22 bp, Homo sapiens
gttttatttccatgagagaccg

SEQ ID NO: 7944261 - DNA, 22 bp, Homo sapiens
gttttatttccatgagagaccg

SEQ ID NO: 7944262 - DNA, 22 bp, Homo sapiens
gttttatttccatgagagaccg

SEQ ID NO: 7944263 - DNA, 22 bp, Homo sapiens
gttttatttccatgagagaccg

SEQ ID NO: 7944264 - DNA, 22 bp, Homo sapiens
gttttatttccatgagagaccg

SEQ ID NO: 7944265 - DNA, 22 bp, Homo sapiens
gttttatttccatgagagaccg

SEQ ID NO: 7944266 - DNA, 23 bp, Homo sapiens
gttttcaacacaataaatgtaac

SEQ ID NO: 7944267 - DNA, 23 bp, Homo sapiens
gttttcaacacaataaatgtaac

SEQ ID NO: 7944268 - DNA, 23 bp, Homo sapiens
gttttcaacacaataaatgtaac

SEQ ID NO: 7944269 - DNA, 22 bp, Homo sapiens
gttttatttccatgagagaccg

SEQ ID NO: 7944270 - DNA, 22 bp, Homo sapiens
gttttataggtgaaatattact

SEQ ID NO: 7944271 - DNA, 22 bp, Homo sapiens
gttttataggtgaaatattact

SEQ ID NO: 7944272 - DNA, 22 bp, Homo sapiens
gttttataggtgaaatattact

SEQ ID NO: 7944273 - DNA, 22 bp, Homo sapiens
gttttataggtgaaatattact

SEQ ID NO: 7944274 - DNA, 22 bp, Homo sapiens
gttttataggtgaaatattact

SEQ ID NO: 7944275 - DNA, 22 bp, Homo sapiens
gttttataggtgaaatattact

SEQ ID NO: 7944276 - DNA, 22 bp, Homo sapiens
gttttataggtgaaatattact

SEQ ID NO: 7944277 - DNA, 22 bp, Homo sapiens
gttttatagttcgggacctgtt

SEQ ID NO: 7944278 - DNA, 22 bp, Homo sapiens
gttttatagttcgggacctgtt

SEQ ID NO: 7944279 - DNA, 22 bp, Homo sapiens
gttttatatgtctctgctgaca

SEQ ID NO: 7944280 - DNA, 22 bp, Homo sapiens
gttttatgagacctcaggaata

SEQ ID NO: 7944281 - DNA, 20 bp, Homo sapiens
gttttatgccagttctgtgt

SEQ ID NO: 7944282 - DNA, 22 bp, Homo sapiens
gttttataattgcttcataaga

SEQ ID NO: 7944283 - DNA, 22 bp, Homo sapiens
gttttataattgcttcataaga

SEQ ID NO: 7944284 - DNA, 22 bp, Homo sapiens
gttttagtgggtggccactgat

SEQ ID NO: 7944285 - DNA, 22 bp, Homo sapiens
gttttataattgcttcataaga

SEQ ID NO: 7944286 - DNA, 22 bp, Homo sapiens
gttttataggctgttgctatat

SEQ ID NO: 7944287 - DNA, 22 bp, Homo sapiens
gttttataggctgttgctatat

SEQ ID NO: 7944288 - DNA, 22 bp, Homo sapiens
gttttataggctgttgctatat

SEQ ID NO: 7944289 - DNA, 22 bp, Homo sapiens
gttttataggctgttgctatat

SEQ ID NO: 7944290 - DNA, 22 bp, Homo sapiens
gttttataattgcttcataaga

SEQ ID NO: 7944291 - DNA, 22 bp, Homo sapiens
taagaaactgtcacagtactat

SEQ ID NO: 7944292 - DNA, 22 bp, Homo sapiens
taagaaactattgtctctgaac

SEQ ID NO: 7944293 - DNA, 22 bp, Homo sapiens
taagaaactgtcacagtactat

SEQ ID NO: 7944294 - DNA, 22 bp, Homo sapiens
taagaaatttagttatagaatg

SEQ ID NO: 7944295 - DNA, 22 bp, Homo sapiens
taagaaatttagttatagaatg

SEQ ID NO: 7944296 - DNA, 22 bp, Homo sapiens
taagaaatttagttatagaatg

SEQ ID NO: 7944297 - DNA, 22 bp, Homo sapiens
taagaaatttagttatagaatg

SEQ ID NO: 7944298 - DNA, 22 bp, Homo sapiens
taagaaatttagttatagaatg

SEQ ID NO: 7944299 - DNA, 22 bp, Homo sapiens
taagaaatttagttatagaatg

SEQ ID NO: 7944300 - DNA, 22 bp, Homo sapiens
taagaaacccaggaatttctta

SEQ ID NO: 7944301 - DNA, 22 bp, Homo sapiens
taacttctggaaatgcatctgc

SEQ ID NO: 7944302 - DNA, 22 bp, Homo sapiens
taagaaactatggagaagaact

SEQ ID NO: 7944303 - DNA, 22 bp, Homo sapiens
taagaaactaatgcaataagag

SEQ ID NO: 7944304 - DNA, 22 bp, Homo sapiens
taagaaactaatgcaataagag

SEQ ID NO: 7944305 - DNA, 22 bp, Homo sapiens
taagaaactaatgcaataagag

SEQ ID NO: 7944306 - DNA, 22 bp, Homo sapiens
taactgtttttgaaatatatct

SEQ ID NO: 7944307 - DNA, 23 bp, Homo sapiens
taacttacatcattctgcacaag

SEQ ID NO: 7944308 - DNA, 22 bp, Homo sapiens
taactgttgtgcgggtctctgg

SEQ ID NO: 7944309 - DNA, 22 bp, Homo sapiens
taactgtgtgaacgtgatcatt

SEQ ID NO: 7944310 - DNA, 22 bp, Homo sapiens
taacttctctgagcctcattcc

SEQ ID NO: 7944311 - DNA, 22 bp, Homo sapiens
taacttctctgagcctcattcc

SEQ ID NO: 7944312 - DNA, 22 bp, Homo sapiens
taacttctctgctatcatagga

SEQ ID NO: 7944313 - DNA, 22 bp, Homo sapiens
taacttcactggactcagcagc

SEQ ID NO: 7944314 - DNA, 22 bp, Homo sapiens
taactgtatttttctgagattc

SEQ ID NO: 7944315 - DNA, 22 bp, Homo sapiens
taactgtatattaaggtggccc

SEQ ID NO: 7944316 - DNA, 22 bp, Homo sapiens
taactgtattttaggtctcatt

SEQ ID NO: 7944317 - DNA, 22 bp, Homo sapiens
taactgtatagcttggactaaa

SEQ ID NO: 7944318 - DNA, 22 bp, Homo sapiens
taactgtatagcttggactaaa

SEQ ID NO: 7944319 - DNA, 22 bp, Homo sapiens
taactgtacctagataacgaac

SEQ ID NO: 7944320 - DNA, 22 bp, Homo sapiens
taactgtacaactggttagtca

SEQ ID NO: 7944321 - DNA, 22 bp, Homo sapiens
taactgtagttataaagctatc

SEQ ID NO: 7944322 - DNA, 22 bp, Homo sapiens
taactgtagtaattctagtttt

SEQ ID NO: 7944323 - DNA, 22 bp, Homo sapiens
taactgtagctaaccgatgaga

SEQ ID NO: 7944324 - DNA, 22 bp, Homo sapiens
taactgtagtaattctagtttt

SEQ ID NO: 7944325 - DNA, 22 bp, Homo sapiens
taagaaatttagttatagaatg

SEQ ID NO: 7944326 - DNA, 22 bp, Homo sapiens
taagagtaagtgattaagaaga

SEQ ID NO: 7944327 - DNA, 22 bp, Homo sapiens
taagagtaagtgattaagaaga

SEQ ID NO: 7944328 - DNA, 22 bp, Homo sapiens
taagagttagggctagcaatat

SEQ ID NO: 7944329 - DNA, 22 bp, Homo sapiens
taagagttactggtttagaacc

SEQ ID NO: 7944330 - DNA, 22 bp, Homo sapiens
taagagttgaaggagattttca

SEQ ID NO: 7944331 - DNA, 22 bp, Homo sapiens
taagagttgaaggagattttca

SEQ ID NO: 7944332 - DNA, 22 bp, Homo sapiens
taagagttactggtttagaacc

SEQ ID NO: 7944333 - DNA, 22 bp, Homo sapiens
taagataatccattataatgtt

SEQ ID NO: 7944334 - DNA, 22 bp, Homo sapiens
taagataatccattataatgtt

SEQ ID NO: 7944335 - DNA, 22 bp, Homo sapiens
taagataataccatgggccagg

SEQ ID NO: 7944336 - DNA, 22 bp, Homo sapiens
taagataataagtatgtctatg

SEQ ID NO: 7944337 - DNA, 22 bp, Homo sapiens
taagataataagtatgtctatg

SEQ ID NO: 7944338 - DNA, 22 bp, Homo sapiens
taagataaggagagtgctagta

SEQ ID NO: 7944339 - DNA, 22 bp, Homo sapiens
taagataagtgggttgagatgg

SEQ ID NO: 7944340 - DNA, 22 bp, Homo sapiens
taagataagtgggttgagatgg

SEQ ID NO: 7944341 - DNA, 22 bp, Homo sapiens
taagataatccattataatgtt

SEQ ID NO: 7944342 - DNA, 22 bp, Homo sapiens
taagatagaactctgaggctac

SEQ ID NO: 7944343 - DNA, 22 bp, Homo sapiens
taagatatggtaggaagtttgg

SEQ ID NO: 7944344 - DNA, 22 bp, Homo sapiens
taagatcagttcaaacatgtgt

SEQ ID NO: 7944345 - DNA, 22 bp, Homo sapiens
taagatgactacttaccactga

SEQ ID NO: 7944346 - DNA, 20 bp, Homo sapiens
taagatgagctataagaagt

SEQ ID NO: 7944347 - DNA, 20 bp, Homo sapiens
taagatgagctataagaagt

SEQ ID NO: 7944348 - DNA, 22 bp, Homo sapiens
taagatgaccttataaagagca

SEQ ID NO: 7944349 - DNA, 22 bp, Homo sapiens
taagatcagttcaaacatgtgt

SEQ ID NO: 7944350 - DNA, 22 bp, Homo sapiens
taagatcatgggaaatggacat

SEQ ID NO: 7944351 - DNA, 22 bp, Homo sapiens
taagatgaagcagaagagttat

SEQ ID NO: 7944352 - DNA, 22 bp, Homo sapiens
taagatggcagatgagcttgtt

SEQ ID NO: 7944353 - DNA, 22 bp, Homo sapiens
taagatggcagatgagcttgtt

SEQ ID NO: 7944354 - DNA, 22 bp, Homo sapiens
taagatgatcaccaaatgctgg

SEQ ID NO: 7944355 - DNA, 22 bp, Homo sapiens
taagatgaggtaggtaagactt

SEQ ID NO: 7944356 - DNA, 22 bp, Homo sapiens
taagatgaggtaggtaagactt

SEQ ID NO: 7944357 - DNA, 22 bp, Homo sapiens
taagatgggggaaagaaatagt

SEQ ID NO: 7944358 - DNA, 22 bp, Homo sapiens
taagatgggggaaagaaatagt

SEQ ID NO: 7944359 - DNA, 22 bp, Homo sapiens
taagatggtccagaagggaggc

SEQ ID NO: 7944360 - DNA, 22 bp, Homo sapiens
taagatggttgtagatggactg

SEQ ID NO: 7944361 - DNA, 22 bp, Homo sapiens
taagcaacaagtggctggagga

SEQ ID NO: 7944362 - DNA, 22 bp, Homo sapiens
taagcaagtggtagaaggacaa

SEQ ID NO: 7944363 - DNA, 22 bp, Homo sapiens
taagcaagggtctctgtatcag

SEQ ID NO: 7944364 - DNA, 21 bp, Homo sapiens
taagcaaggaaagggcagccc

SEQ ID NO: 7944365 - DNA, 22 bp, Homo sapiens
taagcaagatttattgaatttt

SEQ ID NO: 7944366 - DNA, 22 bp, Homo sapiens
taacacaaaagaatatgtgtgt

SEQ ID NO: 7944367 - DNA, 22 bp, Homo sapiens
taacaatttgcttcatttgttt

SEQ ID NO: 7944368 - DNA, 22 bp, Homo sapiens
taacaatttgcttcatttgttt

SEQ ID NO: 7944369 - DNA, 22 bp, Homo sapiens
taacaatttgcttcatttgttt

SEQ ID NO: 7944370 - DNA, 22 bp, Homo sapiens
taacaatttgcttcatttgttt

SEQ ID NO: 7944371 - DNA, 20 bp, Homo sapiens
taacacagaaagcttccttc

SEQ ID NO: 7944372 - DNA, 22 bp, Homo sapiens
taacacagacagccactagtaa

SEQ ID NO: 7944373 - DNA, 22 bp, Homo sapiens
taacacagagtaagtggtcaat

SEQ ID NO: 7944374 - DNA, 22 bp, Homo sapiens
taacacagacagccactagtaa

SEQ ID NO: 7944375 - DNA, 17 bp, Homo sapiens
taacacaggctcagaga

SEQ ID NO: 7944376 - DNA, 22 bp, Homo sapiens
taacacagagttttaaatgtgg

SEQ ID NO: 7944377 - DNA, 22 bp, Homo sapiens
taacacagagttttaaatgtgg

SEQ ID NO: 7944378 - DNA, 21 bp, Homo sapiens
taacaatctctacttctcatt

SEQ ID NO: 7944379 - DNA, 22 bp, Homo sapiens
taacaatagtgtttgctagtca

SEQ ID NO: 7944380 - DNA, 21 bp, Homo sapiens
taacaatctctacttctcatt

SEQ ID NO: 7944381 - DNA, 22 bp, Homo sapiens
taacaatgcaaaatgaatttag

SEQ ID NO: 7944382 - DNA, 22 bp, Homo sapiens
taacaatgcaaaatgaatttag

SEQ ID NO: 7944383 - DNA, 22 bp, Homo sapiens
taacaatgcaaaatgaatttag

SEQ ID NO: 7944384 - DNA, 23 bp, Homo sapiens
taacaatggactcctcttagcta

SEQ ID NO: 7944385 - DNA, 22 bp, Homo sapiens
taacaatggagttttgagaaag

SEQ ID NO: 7944386 - DNA, 22 bp, Homo sapiens
taacaattctcaaaagagggga

SEQ ID NO: 7944387 - DNA, 22 bp, Homo sapiens
taaatacttagttttgtgtcta

SEQ ID NO: 7944388 - DNA, 22 bp, Homo sapiens
taaatacttagttttgtgtcta

SEQ ID NO: 7944389 - DNA, 22 bp, Homo sapiens
taaatactttacaggatgtctc

SEQ ID NO: 7944390 - DNA, 22 bp, Homo sapiens
taaatacttagttttgtgtcta

SEQ ID NO: 7944391 - DNA, 22 bp, Homo sapiens
taaatacttagttttgtgtcta

SEQ ID NO: 7944392 - DNA, 22 bp, Homo sapiens
taaatttttgttaacagcctct

SEQ ID NO: 7944393 - DNA, 22 bp, Homo sapiens
taaatacagtcatttgagccat

SEQ ID NO: 7944394 - DNA, 22 bp, Homo sapiens
taaatacagtcatttgagccat

SEQ ID NO: 7944395 - DNA, 22 bp, Homo sapiens
taaatacagtcatttgagccat

SEQ ID NO: 7944396 - DNA, 22 bp, Homo sapiens
taaatactgagttggagttggc

SEQ ID NO: 7944397 - DNA, 22 bp, Homo sapiens
taaatactgagttggagttggc

SEQ ID NO: 7944398 - DNA, 22 bp, Homo sapiens
taacaatagtgtttgctagtca

SEQ ID NO: 7944399 - DNA, 22 bp, Homo sapiens
taacaatagtgtttgctagtca

SEQ ID NO: 7944400 - DNA, 22 bp, Homo sapiens
taacaatagtgtttgctagtca

SEQ ID NO: 7944401 - DNA, 21 bp, Homo sapiens
taacaaagacttctggtcagg

SEQ ID NO: 7944402 - DNA, 22 bp, Homo sapiens
taacaaactggaaattgacatt

SEQ ID NO: 7944403 - DNA, 21 bp, Homo sapiens
taacaaagacttctggtcagg

SEQ ID NO: 7944404 - DNA, 22 bp, Homo sapiens
taacaaactggaaattgacatt

SEQ ID NO: 7944405 - DNA, 22 bp, Homo sapiens
taacaaactggaaattgacatt

SEQ ID NO: 7944406 - DNA, 22 bp, Homo sapiens
taacaaactggaaattgacatt

SEQ ID NO: 7944407 - DNA, 22 bp, Homo sapiens
taacaaactggaaattgacatt

SEQ ID NO: 7944408 - DNA, 22 bp, Homo sapiens
taacaaactggaaattgacatt

SEQ ID NO: 7944409 - DNA, 22 bp, Homo sapiens
taaatttttgttaacagcctct

SEQ ID NO: 7944410 - DNA, 21 bp, Homo sapiens
taacacattttggtactttgg

SEQ ID NO: 7944411 - DNA, 21 bp, Homo sapiens
taacacattttggtactttgg

SEQ ID NO: 7944412 - DNA, 22 bp, Homo sapiens
taacacattttcctcatacgga

SEQ ID NO: 7944413 - DNA, 22 bp, Homo sapiens
taacacattttaagccatttta

SEQ ID NO: 7944414 - DNA, 22 bp, Homo sapiens
taacacattttcctcatacgga

SEQ ID NO: 7944415 - DNA, 22 bp, Homo sapiens
taacacattttcctcatacgga

SEQ ID NO: 7944416 - DNA, 22 bp, Homo sapiens
taacacattagttctcctagat

SEQ ID NO: 7944417 - DNA, 22 bp, Homo sapiens
taacacattagttctcctagat

SEQ ID NO: 7944418 - DNA, 22 bp, Homo sapiens
taacacatgtctgggatgtgaa

SEQ ID NO: 7944419 - DNA, 22 bp, Homo sapiens
taacacatgtctgggatgtgaa

SEQ ID NO: 7944420 - DNA, 22 bp, Homo sapiens
taacacatggttctgtcaggaa

SEQ ID NO: 7944421 - DNA, 22 bp, Homo sapiens
taacacatggttctgtcaggaa

SEQ ID NO: 7944422 - DNA, 22 bp, Homo sapiens
taacacatggttctgtcaggaa

SEQ ID NO: 7944423 - DNA, 22 bp, Homo sapiens
taacacatggttagtacacaat

SEQ ID NO: 7944424 - DNA, 21 bp, Homo sapiens
taacacattttggtactttgg

SEQ ID NO: 7944425 - DNA, 22 bp, Homo sapiens
taactggtatatcagtgtacac

SEQ ID NO: 7944426 - DNA, 22 bp, Homo sapiens
taactggtcctcggatgttgtg

SEQ ID NO: 7944427 - DNA, 22 bp, Homo sapiens
taactggtcctcggatgttgtg

SEQ ID NO: 7944428 - DNA, 22 bp, Homo sapiens
taactggtcctgaacagcccag

SEQ ID NO: 7944429 - DNA, 22 bp, Homo sapiens
taactggtgagtaggatttata

SEQ ID NO: 7944430 - DNA, 22 bp, Homo sapiens
taactggtgagttggttgagtg

SEQ ID NO: 7944431 - DNA, 19 bp, Homo sapiens
taactggtgccttcagtca

SEQ ID NO: 7944432 - DNA, 19 bp, Homo sapiens
taactggttaaaaagcttg

SEQ ID NO: 7944433 - DNA, 22 bp, Homo sapiens
taactggttaagggtgaaatcc

SEQ ID NO: 7944434 - DNA, 22 bp, Homo sapiens
taactggtttcatatcatttcc

SEQ ID NO: 7944435 - DNA, 18 bp, Homo sapiens
taactggtttcttcccat

SEQ ID NO: 7944436 - DNA, 22 bp, Homo sapiens
taactggtttggctcagggtct

SEQ ID NO: 7944437 - DNA, 22 bp, Homo sapiens
taactgtaatataaatatgagt

SEQ ID NO: 7944438 - DNA, 22 bp, Homo sapiens
taacacataagctgagaccatg

SEQ ID NO: 7944439 - DNA, 22 bp, Homo sapiens
taacacataagctgagaccatg

SEQ ID NO: 7944440 - DNA, 22 bp, Homo sapiens
taacacagttctctgttgcaca

SEQ ID NO: 7944441 - DNA, 22 bp, Homo sapiens
taacacatagatattttaactt

SEQ ID NO: 7944442 - DNA, 17 bp, Homo sapiens
taacacaggctcagaga

SEQ ID NO: 7944443 - DNA, 17 bp, Homo sapiens
taacacaggctcagaga

SEQ ID NO: 7944444 - DNA, 22 bp, Homo sapiens
taacacagtgtcctcagaaaca

SEQ ID NO: 7944445 - DNA, 22 bp, Homo sapiens
taacacagtgtcctcagaaaca

SEQ ID NO: 7944446 - DNA, 22 bp, Homo sapiens
taacacagtgtcctcagaaaca

SEQ ID NO: 7944447 - DNA, 22 bp, Homo sapiens
taacacagtgtcctcagaaaca

SEQ ID NO: 7944448 - DNA, 22 bp, Homo sapiens
taacacagttctctgttgcaca

SEQ ID NO: 7944449 - DNA, 22 bp, Homo sapiens
taacacagttctctgttgcaca

SEQ ID NO: 7944450 - DNA, 22 bp, Homo sapiens
taacacagttctctgttgcaca

SEQ ID NO: 7944451 - DNA, 22 bp, Homo sapiens
taacacagtgtctaccattatt

SEQ ID NO: 7944452 - DNA, 22 bp, Homo sapiens
taacacagtgtctaccattatt

SEQ ID NO: 7944453 - DNA, 22 bp, Homo sapiens
taacacatatctacaacatgtg

SEQ ID NO: 7944454 - DNA, 22 bp, Homo sapiens
taacacatatttcaagagtagt

SEQ ID NO: 7944455 - DNA, 22 bp, Homo sapiens
taacacatatttcaagagtagt

SEQ ID NO: 7944456 - DNA, 22 bp, Homo sapiens
taacacatatttcaagagtagt

SEQ ID NO: 7944457 - DNA, 22 bp, Homo sapiens
taacacatatttcaagagtagt

SEQ ID NO: 7944458 - DNA, 22 bp, Homo sapiens
taacacatggttagtacacaat

SEQ ID NO: 7944459 - DNA, 22 bp, Homo sapiens
taacacatggttagtacacaat

SEQ ID NO: 7944460 - DNA, 22 bp, Homo sapiens
taacacatatttgcagtaagca

SEQ ID NO: 7944461 - DNA, 22 bp, Homo sapiens
taacacatgaaagcaccttctt

SEQ ID NO: 7944462 - DNA, 22 bp, Homo sapiens
taacacatgaaagcaccttctt

SEQ ID NO: 7944463 - DNA, 22 bp, Homo sapiens
taacacatatttgcagtaagca

SEQ ID NO: 7944464 - DNA, 22 bp, Homo sapiens
gttcatttttactttgatctac

SEQ ID NO: 7944465 - DNA, 22 bp, Homo sapiens
gttcatttttactttgatctac

SEQ ID NO: 7944466 - DNA, 23 bp, Homo sapiens
gttcattttattgtctgattgct

SEQ ID NO: 7944467 - DNA, 22 bp, Homo sapiens
gttcatttttactttgatctac

SEQ ID NO: 7944468 - DNA, 22 bp, Homo sapiens
gttcatttttagaatgctagta

SEQ ID NO: 7944469 - DNA, 22 bp, Homo sapiens
gttcatttttccctaatgagta

SEQ ID NO: 7944470 - DNA, 22 bp, Homo sapiens
gttcatttttccctaatgagta

SEQ ID NO: 7944471 - DNA, 22 bp, Homo sapiens
gttcatttttccctaatgagta

SEQ ID NO: 7944472 - DNA, 22 bp, Homo sapiens
gttccaaatttggatctttagg

SEQ ID NO: 7944473 - DNA, 22 bp, Homo sapiens
gttccaaatttggatctttagg

SEQ ID NO: 7944474 - DNA, 22 bp, Homo sapiens
gttccaaatttggatctttagg

SEQ ID NO: 7944475 - DNA, 22 bp, Homo sapiens
gttccaattccaaattccaagg

SEQ ID NO: 7944476 - DNA, 22 bp, Homo sapiens
gttccacaaaaggtctagttta

SEQ ID NO: 7944477 - DNA, 22 bp, Homo sapiens
gttccaaagtctctgagctgag

SEQ ID NO: 7944478 - DNA, 22 bp, Homo sapiens
gttccaaagttagagtgtattg

SEQ ID NO: 7944479 - DNA, 22 bp, Homo sapiens
gttccaaagttagagtgtattg

SEQ ID NO: 7944480 - DNA, 22 bp, Homo sapiens
gttccaaagttagagtgtattg

SEQ ID NO: 7944481 - DNA, 22 bp, Homo sapiens
gttccaaatttggatctttagg

SEQ ID NO: 7944482 - DNA, 22 bp, Homo sapiens
gttccaaagtctctgagctgag

SEQ ID NO: 7944483 - DNA, 22 bp, Homo sapiens
gttccaaagtctctgagctgag

SEQ ID NO: 7944484 - DNA, 19 bp, Homo sapiens
gttccaaaggccagacctt

SEQ ID NO: 7944485 - DNA, 19 bp, Homo sapiens
gttccaaaggccagacctt

SEQ ID NO: 7944486 - DNA, 19 bp, Homo sapiens
gttccaaaggccagacctt

SEQ ID NO: 7944487 - DNA, 19 bp, Homo sapiens
gttccaaaggccagacctt

SEQ ID NO: 7944488 - DNA, 22 bp, Homo sapiens
gttccaaacaagtcataaagta

SEQ ID NO: 7944489 - DNA, 22 bp, Homo sapiens
gttccaaacaagtcataaagta

SEQ ID NO: 7944490 - DNA, 22 bp, Homo sapiens
gttccaaacaagtcataaagta

SEQ ID NO: 7944491 - DNA, 22 bp, Homo sapiens
gttccaaacaagtcataaagta

SEQ ID NO: 7944492 - DNA, 22 bp, Homo sapiens
gttccaaagcaaaggaggtgag

SEQ ID NO: 7944493 - DNA, 22 bp, Homo sapiens
gttccaaagcaaaggaggtgag

SEQ ID NO: 7944494 - DNA, 22 bp, Homo sapiens
gttccaaagcaaaggaggtgag

SEQ ID NO: 7944495 - DNA, 22 bp, Homo sapiens
gttccaaacaagtcataaagta

SEQ ID NO: 7944496 - DNA, 22 bp, Homo sapiens
gttcattttactgtaaatagca

SEQ ID NO: 7944497 - DNA, 22 bp, Homo sapiens
gttcattttactgtaaatagca

SEQ ID NO: 7944498 - DNA, 22 bp, Homo sapiens
gttcattttactgtaaatagca

SEQ ID NO: 7944499 - DNA, 22 bp, Homo sapiens
gttataaatacctaataggatt

SEQ ID NO: 7944500 - DNA, 22 bp, Homo sapiens
gttataaatacctaataggatt

SEQ ID NO: 7944501 - DNA, 22 bp, Homo sapiens
gttataaatacctaataggatt

SEQ ID NO: 7944502 - DNA, 22 bp, Homo sapiens
gttataaaggtgataatggtca

SEQ ID NO: 7944503 - DNA, 22 bp, Homo sapiens
gttataaatacctaataggatt

SEQ ID NO: 7944504 - DNA, 22 bp, Homo sapiens
gttataaatacctaataggatt

SEQ ID NO: 7944505 - DNA, 22 bp, Homo sapiens
gttataaatacctaataggatt

SEQ ID NO: 7944506 - DNA, 22 bp, Homo sapiens
gttataaaggtgataatggtca

SEQ ID NO: 7944507 - DNA, 22 bp, Homo sapiens
gttataaaggtgataatggtca

SEQ ID NO: 7944508 - DNA, 22 bp, Homo sapiens
gttataaaggtgataatggtca

SEQ ID NO: 7944509 - DNA, 22 bp, Homo sapiens
gttataaaggtgataatggtca

SEQ ID NO: 7944510 - DNA, 22 bp, Homo sapiens
gttataaaatgcacagttgttt

SEQ ID NO: 7944511 - DNA, 22 bp, Homo sapiens
gttataaaatgcacagttgttt

SEQ ID NO: 7944512 - DNA, 22 bp, Homo sapiens
gttataaaatgcacagttgttt

SEQ ID NO: 7944513 - DNA, 22 bp, Homo sapiens
gttataaaatgcacagttgttt

SEQ ID NO: 7944514 - DNA, 22 bp, Homo sapiens
gttataaaatgcacagttgttt

SEQ ID NO: 7944515 - DNA, 22 bp, Homo sapiens
gttagtgtatattgccttcaaa

SEQ ID NO: 7944516 - DNA, 22 bp, Homo sapiens
gttagtgtatattgccttcaaa

SEQ ID NO: 7944517 - DNA, 22 bp, Homo sapiens
gttagtgtgactgaggaatgca

SEQ ID NO: 7944518 - DNA, 22 bp, Homo sapiens
gttagtgtgactgaggaatgca

SEQ ID NO: 7944519 - DNA, 22 bp, Homo sapiens
gttagtgtgactgaggaatgca

SEQ ID NO: 7944520 - DNA, 22 bp, Homo sapiens
gttagtgcttattaaatagtat

SEQ ID NO: 7944521 - DNA, 22 bp, Homo sapiens
gttacaaatgccaaagctgaga

SEQ ID NO: 7944522 - DNA, 22 bp, Homo sapiens
gttactcttccccggggtctgg

SEQ ID NO: 7944523 - DNA, 22 bp, Homo sapiens
gttactcttccccggggtctgg

SEQ ID NO: 7944524 - DNA, 22 bp, Homo sapiens
gttacaaaggtcataaaagtgt

SEQ ID NO: 7944525 - DNA, 22 bp, Homo sapiens
gttacaaaggtcataaaagtgt

SEQ ID NO: 7944526 - DNA, 22 bp, Homo sapiens
gttacaaaggtcataaaagtgt

SEQ ID NO: 7944527 - DNA, 22 bp, Homo sapiens
gttacaaaggtcataaaagtgt

SEQ ID NO: 7944528 - DNA, 22 bp, Homo sapiens
gttacaaaggtcataaaagtgt

SEQ ID NO: 7944529 - DNA, 22 bp, Homo sapiens
gtgttacttgccatacagaaaa

SEQ ID NO: 7944530 - DNA, 22 bp, Homo sapiens
gtgttacttacctgggacagca

SEQ ID NO: 7944531 - DNA, 22 bp, Homo sapiens
gtgttacttaattagaatctgc

SEQ ID NO: 7944532 - DNA, 22 bp, Homo sapiens
gtgttacttgccatacagaaaa

SEQ ID NO: 7944533 - DNA, 22 bp, Homo sapiens
gtgttattagagcattaatttt

SEQ ID NO: 7944534 - DNA, 22 bp, Homo sapiens
gttactcttgagaggctgaggt

SEQ ID NO: 7944535 - DNA, 22 bp, Homo sapiens
gttagaaacacattcttattga

SEQ ID NO: 7944536 - DNA, 22 bp, Homo sapiens
gttactcttgagaggctgaggt

SEQ ID NO: 7944537 - DNA, 22 bp, Homo sapiens
gttactcttgagaggctgaggt

SEQ ID NO: 7944538 - DNA, 22 bp, Homo sapiens
gttactcttgagaggctgaggt

SEQ ID NO: 7944539 - DNA, 22 bp, Homo sapiens
gttactcttgagaggctgaggt

SEQ ID NO: 7944540 - DNA, 22 bp, Homo sapiens
gttagaaacacattcttattga

SEQ ID NO: 7944541 - DNA, 22 bp, Homo sapiens
gttagaaacacattcttattga

SEQ ID NO: 7944542 - DNA, 22 bp, Homo sapiens
gttagaaacgcaggctctccgg

SEQ ID NO: 7944543 - DNA, 22 bp, Homo sapiens
gttagagcacatactttgcatg

SEQ ID NO: 7944544 - DNA, 22 bp, Homo sapiens
gttagacatgcagaatctcagg

SEQ ID NO: 7944545 - DNA, 22 bp, Homo sapiens
gttagacatgagtgtgcttaca

SEQ ID NO: 7944546 - DNA, 22 bp, Homo sapiens
gttagacatgagtgtgcttaca

SEQ ID NO: 7944547 - DNA, 22 bp, Homo sapiens
gttagaaatgcagaaacttgac

SEQ ID NO: 7944548 - DNA, 22 bp, Homo sapiens
gttagaaagtgtctgcttgggt

SEQ ID NO: 7944549 - DNA, 22 bp, Homo sapiens
gttagaaacgcaggctctccgg

SEQ ID NO: 7944550 - DNA, 22 bp, Homo sapiens
gttagaaagtgtctgcttgggt

SEQ ID NO: 7944551 - DNA, 22 bp, Homo sapiens
gttaggcaatacctcttacacc

SEQ ID NO: 7944552 - DNA, 22 bp, Homo sapiens
gttaggtagaagtttactttga

SEQ ID NO: 7944553 - DNA, 20 bp, Homo sapiens
gttaggaggttggacatgga

SEQ ID NO: 7944554 - DNA, 20 bp, Homo sapiens
gttaggaggttggacatgga

SEQ ID NO: 7944555 - DNA, 20 bp, Homo sapiens
gttaggaggttggacatgga

SEQ ID NO: 7944556 - DNA, 22 bp, Homo sapiens
gttaggaatttgttactgtgta

SEQ ID NO: 7944557 - DNA, 20 bp, Homo sapiens
gttaggaggttggacatgga

SEQ ID NO: 7944558 - DNA, 20 bp, Homo sapiens
gttaggacttaaataaagga

SEQ ID NO: 7944559 - DNA, 22 bp, Homo sapiens
gttagcatgattcctgctcatt

SEQ ID NO: 7944560 - DNA, 22 bp, Homo sapiens
gttagcatttgtttaatatcag

SEQ ID NO: 7944561 - DNA, 22 bp, Homo sapiens
gttagagggctgccttttgttt

SEQ ID NO: 7944562 - DNA, 22 bp, Homo sapiens
gttagcaaaatgtttttgaggc

SEQ ID NO: 7944563 - DNA, 22 bp, Homo sapiens
gttagaggttcagtcgctataa

SEQ ID NO: 7944564 - DNA, 22 bp, Homo sapiens
gttagagggaaaaatcatttgc

SEQ ID NO: 7944565 - DNA, 22 bp, Homo sapiens
gttagagacatctctggtttct

SEQ ID NO: 7944566 - DNA, 22 bp, Homo sapiens
gttagagacatctctggtttct

SEQ ID NO: 7944567 - DNA, 22 bp, Homo sapiens
gttagagggaaaaatcatttgc

SEQ ID NO: 7944568 - DNA, 22 bp, Homo sapiens
gttagcacaaccaagaaatgcg

SEQ ID NO: 7944569 - DNA, 22 bp, Homo sapiens
gttagcaattgcttaagactag

SEQ ID NO: 7944570 - DNA, 22 bp, Homo sapiens
gttagcaccagtgctcataaca

SEQ ID NO: 7944571 - DNA, 22 bp, Homo sapiens
gttagcaatgcccaggaatgca

SEQ ID NO: 7944572 - DNA, 22 bp, Homo sapiens
gttagcaacaagtctcaatgac

SEQ ID NO: 7944573 - DNA, 22 bp, Homo sapiens
gttagcaatgaaatctggatgc

SEQ ID NO: 7944574 - DNA, 22 bp, Homo sapiens
gtgtgtgtgcatataacatata

SEQ ID NO: 7944575 - DNA, 22 bp, Homo sapiens
gtgtgtgtgcatataacatata

SEQ ID NO: 7944576 - DNA, 22 bp, Homo sapiens
gtgtgtgtgcatataacatata

SEQ ID NO: 7944577 - DNA, 22 bp, Homo sapiens
gtgtgtgtgcatctcttttatt

SEQ ID NO: 7944578 - DNA, 22 bp, Homo sapiens
gtgtgtgtgcatctcttttatt

SEQ ID NO: 7944579 - DNA, 22 bp, Homo sapiens
gtgtgtgtgcatctcttttatt

SEQ ID NO: 7944580 - DNA, 22 bp, Homo sapiens
gtgtgtgtgcatctcttttatt

SEQ ID NO: 7944581 - DNA, 22 bp, Homo sapiens
gtgtgtgtgcatataacatata

SEQ ID NO: 7944582 - DNA, 22 bp, Homo sapiens
gtgtgtgtctccgcggccgtag

SEQ ID NO: 7944583 - DNA, 22 bp, Homo sapiens
gtgtgtgtctccgcggccgtag

SEQ ID NO: 7944584 - DNA, 22 bp, Homo sapiens
gtgtgtgtctccgcggccgtag

SEQ ID NO: 7944585 - DNA, 22 bp, Homo sapiens
gtgtgtgtctccgcggccgtag

SEQ ID NO: 7944586 - DNA, 22 bp, Homo sapiens
gtgtgtgtgcatataacatata

SEQ ID NO: 7944587 - DNA, 22 bp, Homo sapiens
gtgtgtgtatctgcctatcaca

SEQ ID NO: 7944588 - DNA, 22 bp, Homo sapiens
gtgtgtgtatctgcctatcaca

SEQ ID NO: 7944589 - DNA, 22 bp, Homo sapiens
gtgtgtccttgggcctctgcag

SEQ ID NO: 7944590 - DNA, 21 bp, Homo sapiens
gtgtgtctaatgtagtggaaa

SEQ ID NO: 7944591 - DNA, 22 bp, Homo sapiens
gtgtgtgtatctgcctatcaca

SEQ ID NO: 7944592 - DNA, 19 bp, Homo sapiens
gtgctttttaagagctcag

SEQ ID NO: 7944593 - DNA, 19 bp, Homo sapiens
gtgctttttaagagctcag

SEQ ID NO: 7944594 - DNA, 19 bp, Homo sapiens
gtgctttttaagagctcag

SEQ ID NO: 7944595 - DNA, 22 bp, Homo sapiens
gtgtgtcctcataagatggagg

SEQ ID NO: 7944596 - DNA, 22 bp, Homo sapiens
gtgtgtcctcttaactattatg

SEQ ID NO: 7944597 - DNA, 22 bp, Homo sapiens
gtgtgtcctgttttaaaatagt

SEQ ID NO: 7944598 - DNA, 22 bp, Homo sapiens
gtgctttaaaccactgtgctgt

SEQ ID NO: 7944599 - DNA, 22 bp, Homo sapiens
gtgctttaaagacagttatgct

SEQ ID NO: 7944600 - DNA, 22 bp, Homo sapiens
gtgctttaaaccactgtgctgt

SEQ ID NO: 7944601 - DNA, 22 bp, Homo sapiens
gtgctttaataagatttcactt

SEQ ID NO: 7944602 - DNA, 22 bp, Homo sapiens
gtgctttaaaaataggagatga

SEQ ID NO: 7944603 - DNA, 22 bp, Homo sapiens
gtgcttggcttggtgtgacctg

SEQ ID NO: 7944604 - DNA, 22 bp, Homo sapiens
gtgctttaaaccactgtgctgt

SEQ ID NO: 7944605 - DNA, 22 bp, Homo sapiens
gtgctttagttcttgcaactgg

SEQ ID NO: 7944606 - DNA, 22 bp, Homo sapiens
gtgctttagttcttgcaactgg

SEQ ID NO: 7944607 - DNA, 22 bp, Homo sapiens
gtgctttagttcttgcaactgg

SEQ ID NO: 7944608 - DNA, 22 bp, Homo sapiens
gtgctttagttcttgcaactgg

SEQ ID NO: 7944609 - DNA, 22 bp, Homo sapiens
gtgctttaggtgtttggctgaa

SEQ ID NO: 7944610 - DNA, 22 bp, Homo sapiens
gtgctttactggcagtgatgta

SEQ ID NO: 7944611 - DNA, 22 bp, Homo sapiens
gtgctttaccttattggtctcg

SEQ ID NO: 7944612 - DNA, 22 bp, Homo sapiens
gtgctttactggcagtgatgta

SEQ ID NO: 7944613 - DNA, 22 bp, Homo sapiens
gtgctttagctgagttggtcaa

SEQ ID NO: 7944614 - DNA, 22 bp, Homo sapiens
gtgctttactgtgttgccttta

SEQ ID NO: 7944615 - DNA, 22 bp, Homo sapiens
gtgctttccatcctccctgctg

SEQ ID NO: 7944616 - DNA, 22 bp, Homo sapiens
gtgctttatatgtgggtatcca

SEQ ID NO: 7944617 - DNA, 23 bp, Homo sapiens
gtgctttatgatctgctgtccct

SEQ ID NO: 7944618 - DNA, 21 bp, Homo sapiens
gtgcttttccttaatgttctt

SEQ ID NO: 7944619 - DNA, 22 bp, Homo sapiens
gtgctttgttaagtctgaaatt

SEQ ID NO: 7944620 - DNA, 22 bp, Homo sapiens
gtgcttttaaaggcaattagta

SEQ ID NO: 7944621 - DNA, 22 bp, Homo sapiens
gtgtgtgtgtaaaaatccagag

SEQ ID NO: 7944622 - DNA, 22 bp, Homo sapiens
gtgtgtgtgtaaaaatccagag

SEQ ID NO: 7944623 - DNA, 22 bp, Homo sapiens
gtgtgtgtgcctgcacacacac

SEQ ID NO: 7944624 - DNA, 22 bp, Homo sapiens
gtgtgtgtgtaaaaatccagag

SEQ ID NO: 7944625 - DNA, 22 bp, Homo sapiens
gtgtgtgttcaataaatttaag

SEQ ID NO: 7944626 - DNA, 22 bp, Homo sapiens
gtgtgtgtgtaaaaatccagag

SEQ ID NO: 7944627 - DNA, 22 bp, Homo sapiens
gtgtgtgtgcctgcacacacac

SEQ ID NO: 7944628 - DNA, 22 bp, Homo sapiens
gtgtgtgtgcctgcacacacac

SEQ ID NO: 7944629 - DNA, 22 bp, Homo sapiens
gtgtgtgtgcctgcacacacac

SEQ ID NO: 7944630 - DNA, 22 bp, Homo sapiens
gtgtgtgtgcatctcttttatt

SEQ ID NO: 7944631 - DNA, 22 bp, Homo sapiens
gtgtgtttagcattagcagggg

SEQ ID NO: 7944632 - DNA, 22 bp, Homo sapiens
gtgtgttcccgtttccttcact

SEQ ID NO: 7944633 - DNA, 22 bp, Homo sapiens
gtgtgtttcaccctgacaccaa

SEQ ID NO: 7944634 - DNA, 22 bp, Homo sapiens
gtgtgtttagcattagcagggg

SEQ ID NO: 7944635 - DNA, 22 bp, Homo sapiens
gtgtgtttagcattagcagggg

SEQ ID NO: 7944636 - DNA, 22 bp, Homo sapiens
gtgtgtttcagaagccaggtgt

SEQ ID NO: 7944637 - DNA, 22 bp, Homo sapiens
gtgtgtttcagaagccaggtgt

SEQ ID NO: 7944638 - DNA, 22 bp, Homo sapiens
gtgtgtttcagaagccaggtgt

SEQ ID NO: 7944639 - DNA, 22 bp, Homo sapiens
gtgtgtgttcaataaatttaag

SEQ ID NO: 7944640 - DNA, 22 bp, Homo sapiens
gtgtgtgttcaataaatttaag

SEQ ID NO: 7944641 - DNA, 22 bp, Homo sapiens
gtgtgtgttcaataaatttaag

SEQ ID NO: 7944642 - DNA, 22 bp, Homo sapiens
gtgtgttcagcaagaggtaagg

SEQ ID NO: 7944643 - DNA, 22 bp, Homo sapiens
gtgttaaaaatcccatgatatg

SEQ ID NO: 7944644 - DNA, 22 bp, Homo sapiens
gtgttaaaaatcccatgatatg

SEQ ID NO: 7944645 - DNA, 22 bp, Homo sapiens
gtgttaaaaatcccatgatatg

SEQ ID NO: 7944646 - DNA, 22 bp, Homo sapiens
gtgttaaacatgttcacagcat

SEQ ID NO: 7944647 - DNA, 22 bp, Homo sapiens
gtgttaaatgcaatcacatgca

SEQ ID NO: 7944648 - DNA, 22 bp, Homo sapiens
gtgttaaatttctaatttgtga

SEQ ID NO: 7944649 - DNA, 22 bp, Homo sapiens
gtgttactaaaatttgattctt

SEQ ID NO: 7944650 - DNA, 22 bp, Homo sapiens
gtgttactaaaatttgattctt

SEQ ID NO: 7944651 - DNA, 22 bp, Homo sapiens
gtgttacatattctaaaatgct

SEQ ID NO: 7944652 - DNA, 22 bp, Homo sapiens
gtgttactcaagagatagcttt

SEQ ID NO: 7944653 - DNA, 23 bp, Homo sapiens
gtgttactaaagatgaacattta

SEQ ID NO: 7944654 - DNA, 23 bp, Homo sapiens
gtgttactaaagatgaacattta

SEQ ID NO: 7944655 - DNA, 22 bp, Homo sapiens
gtgttactgggaggacggaggt

SEQ ID NO: 7944656 - DNA, 22 bp, Homo sapiens
gtgttactgcttttatctacca

SEQ ID NO: 7944657 - DNA, 22 bp, Homo sapiens
gtgttactgacacatttttgtc

SEQ ID NO: 7944658 - DNA, 22 bp, Homo sapiens
gtgttactgacacatttttgtc

SEQ ID NO: 7944659 - DNA, 23 bp, Homo sapiens
gtgttactctgataggtgctttt

SEQ ID NO: 7944660 - DNA, 22 bp, Homo sapiens
gtgttaatgaaaaacaactcat

SEQ ID NO: 7944661 - DNA, 22 bp, Homo sapiens
gtgttaatggtagaatctgagt

SEQ ID NO: 7944662 - DNA, 22 bp, Homo sapiens
gtgttacatatacctgagctta

SEQ ID NO: 7944663 - DNA, 22 bp, Homo sapiens
gtgttacatatatacccacacc

SEQ ID NO: 7944664 - DNA, 22 bp, Homo sapiens
gtgttacatatacctgagctta

SEQ ID NO: 7944665 - DNA, 22 bp, Homo sapiens
gtgttacagtaccttgtcacaa

SEQ ID NO: 7944666 - DNA, 22 bp, Homo sapiens
gtgttacaaatcacctgtgctg

SEQ ID NO: 7944667 - DNA, 18 bp, Homo sapiens
gtgttacaggagtgcagc

SEQ ID NO: 7944668 - DNA, 22 bp, Homo sapiens
gtttaattttaggttgtcaagc

SEQ ID NO: 7944669 - DNA, 22 bp, Homo sapiens
gttcctttgtttagcagagaca

SEQ ID NO: 7944670 - DNA, 22 bp, Homo sapiens
gtttacaaatattttaaatggt

SEQ ID NO: 7944671 - DNA, 22 bp, Homo sapiens
gttccttgtaatttgttaagga

SEQ ID NO: 7944672 - DNA, 22 bp, Homo sapiens
gttccttgggaacaacgctgaa

SEQ ID NO: 7944673 - DNA, 22 bp, Homo sapiens
gttcctttcctatttggataag

SEQ ID NO: 7944674 - DNA, 22 bp, Homo sapiens
gttcctttcctatttggataag

SEQ ID NO: 7944675 - DNA, 22 bp, Homo sapiens
gttccttgtatttcagacatga

SEQ ID NO: 7944676 - DNA, 22 bp, Homo sapiens
gttccttgtatttcagacatga

SEQ ID NO: 7944677 - DNA, 22 bp, Homo sapiens
gttccttgtatttcagacatga

SEQ ID NO: 7944678 - DNA, 22 bp, Homo sapiens
gttcctggtggtcatggcagct

SEQ ID NO: 7944679 - DNA, 22 bp, Homo sapiens
gttcctgggaggcatgggctgg

SEQ ID NO: 7944680 - DNA, 22 bp, Homo sapiens
gttcctgtggggttaaccctga

SEQ ID NO: 7944681 - DNA, 23 bp, Homo sapiens
gttccttcatgtggtcattggtt

SEQ ID NO: 7944682 - DNA, 23 bp, Homo sapiens
gttccttcatgtggtcattggtt

SEQ ID NO: 7944683 - DNA, 22 bp, Homo sapiens
gttcctggtggtcatggcagct

SEQ ID NO: 7944684 - DNA, 23 bp, Homo sapiens
gttccttcatgtggtcattggtt

SEQ ID NO: 7944685 - DNA, 22 bp, Homo sapiens
gttccttgggaacaacgctgaa

SEQ ID NO: 7944686 - DNA, 22 bp, Homo sapiens
gttccttggaagaacttgaggt

SEQ ID NO: 7944687 - DNA, 22 bp, Homo sapiens
gttccagggaagggaaggcaga

SEQ ID NO: 7944688 - DNA, 22 bp, Homo sapiens
gttccaggtggtcacagagctc

SEQ ID NO: 7944689 - DNA, 22 bp, Homo sapiens
gttccaggcagtggcaacagct

SEQ ID NO: 7944690 - DNA, 22 bp, Homo sapiens
gttccaggtggtcacagagctc

SEQ ID NO: 7944691 - DNA, 22 bp, Homo sapiens
gttcccacagtatatttttgca

SEQ ID NO: 7944692 - DNA, 22 bp, Homo sapiens
gttcccacttggtgcactatga

SEQ ID NO: 7944693 - DNA, 22 bp, Homo sapiens
gttcccacttggtgcactatga

SEQ ID NO: 7944694 - DNA, 22 bp, Homo sapiens
gttcccacgcctcctctccagc

SEQ ID NO: 7944695 - DNA, 22 bp, Homo sapiens
gttcccactagactgctactta

SEQ ID NO: 7944696 - DNA, 22 bp, Homo sapiens
gttcccacccctgagctccgat

SEQ ID NO: 7944697 - DNA, 22 bp, Homo sapiens
gttcccaccatgctgcacccat

SEQ ID NO: 7944698 - DNA, 22 bp, Homo sapiens
gttcccacgcctcctctccagc

SEQ ID NO: 7944699 - DNA, 20 bp, Homo sapiens
gttcccaggaattgaagacc

SEQ ID NO: 7944700 - DNA, 18 bp, Homo sapiens
gttcccagatggtgctga

SEQ ID NO: 7944701 - DNA, 22 bp, Homo sapiens
gttccagacttgccagtggaag

SEQ ID NO: 7944702 - DNA, 22 bp, Homo sapiens
gttccacatttgtaaaatgagg

SEQ ID NO: 7944703 - DNA, 22 bp, Homo sapiens
gttccacataacacatctacaa

SEQ ID NO: 7944704 - DNA, 22 bp, Homo sapiens
gttccaggaccctggcctctga

SEQ ID NO: 7944705 - DNA, 22 bp, Homo sapiens
gttccagacttgccagtggaag

SEQ ID NO: 7944706 - DNA, 22 bp, Homo sapiens
gttccacagtgagataaaagca

SEQ ID NO: 7944707 - DNA, 22 bp, Homo sapiens
gttccacataacacatctacaa

SEQ ID NO: 7944708 - DNA, 22 bp, Homo sapiens
gttccacataacacatctacaa

SEQ ID NO: 7944709 - DNA, 22 bp, Homo sapiens
gttccacaaagattgtctctct

SEQ ID NO: 7944710 - DNA, 22 bp, Homo sapiens
gttccacaaaatgtacccagtt

SEQ ID NO: 7944711 - DNA, 22 bp, Homo sapiens
gttccacaaaaggtctagttta

SEQ ID NO: 7944712 - DNA, 22 bp, Homo sapiens
gtttacaaatattttaaatggt

SEQ ID NO: 7944713 - DNA, 22 bp, Homo sapiens
gttccttgtatttcagacatga

SEQ ID NO: 7944714 - DNA, 22 bp, Homo sapiens
gtttactgttttctgataagtg

SEQ ID NO: 7944715 - DNA, 22 bp, Homo sapiens
gtttacttagatgctcatgcag

SEQ ID NO: 7944716 - DNA, 22 bp, Homo sapiens
gtttacttgtgccttggcttaa

SEQ ID NO: 7944717 - DNA, 22 bp, Homo sapiens
gtttactgctctaggttgcaca

SEQ ID NO: 7944718 - DNA, 22 bp, Homo sapiens
gtttactggagaagatgacctg

SEQ ID NO: 7944719 - DNA, 22 bp, Homo sapiens
gtttactgtcttgcacagtgca

SEQ ID NO: 7944720 - DNA, 22 bp, Homo sapiens
gtttactgttaaccaacgaatg

SEQ ID NO: 7944721 - DNA, 22 bp, Homo sapiens
gtttactgttaaccaacgaatg

SEQ ID NO: 7944722 - DNA, 22 bp, Homo sapiens
gtttagaagccaagatttgggt

SEQ ID NO: 7944723 - DNA, 22 bp, Homo sapiens
gtttagaacacggaaatactga

SEQ ID NO: 7944724 - DNA, 22 bp, Homo sapiens
gtttagaagccaagatttgggt

SEQ ID NO: 7944725 - DNA, 22 bp, Homo sapiens
gtttagaagccaagatttgggt

SEQ ID NO: 7944726 - DNA, 21 bp, Homo sapiens
gtttagaagtagtctggctca

SEQ ID NO: 7944727 - DNA, 22 bp, Homo sapiens
gtttagaatgaaacttttgagc

SEQ ID NO: 7944728 - DNA, 21 bp, Homo sapiens
gtttagaagtagtctggctca

SEQ ID NO: 7944729 - DNA, 21 bp, Homo sapiens
gtttagaagtagtctggctca

SEQ ID NO: 7944730 - DNA, 22 bp, Homo sapiens
gtttagaagccaagatttgggt

SEQ ID NO: 7944731 - DNA, 21 bp, Homo sapiens
gtttagaagtagtctggctca

SEQ ID NO: 7944732 - DNA, 22 bp, Homo sapiens
gtttagaacacggaaatactga

SEQ ID NO: 7944733 - DNA, 22 bp, Homo sapiens
gtttagaacacggaaatactga

SEQ ID NO: 7944734 - DNA, 22 bp, Homo sapiens
gtttagaacacggaaatactga

SEQ ID NO: 7944735 - DNA, 22 bp, Homo sapiens
gtttagaacacggaaatactga

SEQ ID NO: 7944736 - DNA, 22 bp, Homo sapiens
gtttagaaaatagtgaagcaag

SEQ ID NO: 7944737 - DNA, 22 bp, Homo sapiens
gtttagaaaatagtgaagcaag

SEQ ID NO: 7944738 - DNA, 22 bp, Homo sapiens
gtttacttgtgccttggcttaa

SEQ ID NO: 7944739 - DNA, 22 bp, Homo sapiens
gtttagaaaatagtgaagcaag

SEQ ID NO: 7944740 - DNA, 22 bp, Homo sapiens
gtttagaaaatagtgaagcaag

SEQ ID NO: 7944741 - DNA, 22 bp, Homo sapiens
gtttagaaaatagtgaagcaag

SEQ ID NO: 7944742 - DNA, 22 bp, Homo sapiens
gtttagaatggcaaaattaagt

SEQ ID NO: 7944743 - DNA, 22 bp, Homo sapiens
gtttagaatgaaacttttgagc

SEQ ID NO: 7944744 - DNA, 22 bp, Homo sapiens
gtttagaatgaaacttttgagc

SEQ ID NO: 7944745 - DNA, 22 bp, Homo sapiens
gtttagaatggcaaaattaagt

SEQ ID NO: 7944746 - DNA, 22 bp, Homo sapiens
gtttagaatggcaaaattaagt

SEQ ID NO: 7944747 - DNA, 22 bp, Homo sapiens
gtttagaatggcaaaattaagt

SEQ ID NO: 7944748 - DNA, 22 bp, Homo sapiens
gtttagaatggcaaaattaagt

SEQ ID NO: 7944749 - DNA, 22 bp, Homo sapiens
gtttagaatggcaaaattaagt

SEQ ID NO: 7944750 - DNA, 22 bp, Homo sapiens
gtttagaattctaactttaagg

SEQ ID NO: 7944751 - DNA, 22 bp, Homo sapiens
gtttagaattctaactttaagg

SEQ ID NO: 7944752 - DNA, 22 bp, Homo sapiens
gtttagaattctaactttaagg

SEQ ID NO: 7944753 - DNA, 22 bp, Homo sapiens
gtttagaattctaactttaagg

SEQ ID NO: 7944754 - DNA, 22 bp, Homo sapiens
gtttagaattctaactttaagg

SEQ ID NO: 7944755 - DNA, 22 bp, Homo sapiens
gtttataaggcccaatatttct

SEQ ID NO: 7944756 - DNA, 22 bp, Homo sapiens
gtttataaggcccaatatttct

SEQ ID NO: 7944757 - DNA, 22 bp, Homo sapiens
gtttataaattctgcttttgtt

SEQ ID NO: 7944758 - DNA, 22 bp, Homo sapiens
gtttagtgtttcaagactcttt

SEQ ID NO: 7944759 - DNA, 20 bp, Homo sapiens
gtttagcatggcagtgaaag

SEQ ID NO: 7944760 - DNA, 20 bp, Homo sapiens
gtttagcatggcagtgaaag

SEQ ID NO: 7944761 - DNA, 22 bp, Homo sapiens
gtttagcaataaaaacacatga

SEQ ID NO: 7944762 - DNA, 22 bp, Homo sapiens
gtttagcaataaaaacacatga

SEQ ID NO: 7944763 - DNA, 18 bp, Homo sapiens
gtttaggctacttaaaat

SEQ ID NO: 7944764 - DNA, 16 bp, Homo sapiens
gtttaggcacattaag

SEQ ID NO: 7944765 - DNA, 18 bp, Homo sapiens
gtttaggctacttaaaat

SEQ ID NO: 7944766 - DNA, 23 bp, Homo sapiens
gttttacaggtgagaaaatggag

SEQ ID NO: 7944767 - DNA, 23 bp, Homo sapiens
gttttacaggtgagaaaatggag

SEQ ID NO: 7944768 - DNA, 23 bp, Homo sapiens
gttttacaggtgagaaaatggag

SEQ ID NO: 7944769 - DNA, 23 bp, Homo sapiens
gttttacaggtgagaaaatggag

SEQ ID NO: 7944770 - DNA, 22 bp, Homo sapiens
gttttagataaagctgtccttg

SEQ ID NO: 7944771 - DNA, 23 bp, Homo sapiens
gttttacaggtgagaaaatggag

SEQ ID NO: 7944772 - DNA, 22 bp, Homo sapiens
gttttacaaggttaatcagcag

SEQ ID NO: 7944773 - DNA, 22 bp, Homo sapiens
gttttacaaggttaatcagcag

SEQ ID NO: 7944774 - DNA, 22 bp, Homo sapiens
gttttacacacctatgaaagac

SEQ ID NO: 7944775 - DNA, 22 bp, Homo sapiens
gttttacacacctatgaaagac

SEQ ID NO: 7944776 - DNA, 22 bp, Homo sapiens
gttttacacacctatgaaagac

SEQ ID NO: 7944777 - DNA, 22 bp, Homo sapiens
gttttacacacctatgaaagac

SEQ ID NO: 7944778 - DNA, 22 bp, Homo sapiens
gttttacacacctatgaaagac

SEQ ID NO: 7944779 - DNA, 22 bp, Homo sapiens
gttttacaaggttaatcagcag

SEQ ID NO: 7944780 - DNA, 22 bp, Homo sapiens
gttttacaaggttaatcagcag

SEQ ID NO: 7944781 - DNA, 22 bp, Homo sapiens
gtttcttaagttacaaaatctt

SEQ ID NO: 7944782 - DNA, 22 bp, Homo sapiens
gtttcttaagttacaaaatctt

SEQ ID NO: 7944783 - DNA, 22 bp, Homo sapiens
gtttcttaaatgtagcaggacc

SEQ ID NO: 7944784 - DNA, 22 bp, Homo sapiens
gtttctgttgctcagataatgc

SEQ ID NO: 7944785 - DNA, 22 bp, Homo sapiens
gtttctgttgctcagataatgc

SEQ ID NO: 7944786 - DNA, 22 bp, Homo sapiens
gtttctcagtttggtctgcaga

SEQ ID NO: 7944787 - DNA, 22 bp, Homo sapiens
gtttctcagtttggtctgcaga

SEQ ID NO: 7944788 - DNA, 22 bp, Homo sapiens
gtttctcctctgtgtcttgttt

SEQ ID NO: 7944789 - DNA, 22 bp, Homo sapiens
gtttctcctctgtgtcttgttt

SEQ ID NO: 7944790 - DNA, 22 bp, Homo sapiens
gtttctcctctgtgtcttgttt

SEQ ID NO: 7944791 - DNA, 18 bp, Homo sapiens
gtttctcccaggcggggc

SEQ ID NO: 7944792 - DNA, 22 bp, Homo sapiens
gtttctcatcagtttctgatat

SEQ ID NO: 7944793 - DNA, 21 bp, Homo sapiens
gtttctcatgtggccttatgg

SEQ ID NO: 7944794 - DNA, 22 bp, Homo sapiens
gtttctctgtacctctgtccca

SEQ ID NO: 7944795 - DNA, 22 bp, Homo sapiens
gtttctctgtctgttacattgg

SEQ ID NO: 7944796 - DNA, 22 bp, Homo sapiens
gtttctctgtctgttacattgg

SEQ ID NO: 7944797 - DNA, 22 bp, Homo sapiens
gtttctctgtacctctgtccca

SEQ ID NO: 7944798 - DNA, 22 bp, Homo sapiens
gtttctctgtctgttacattgg

SEQ ID NO: 7944799 - DNA, 22 bp, Homo sapiens
gtttctcttaacacataaagta

SEQ ID NO: 7944800 - DNA, 22 bp, Homo sapiens
gtttctctgtctgttacattgg

SEQ ID NO: 7944801 - DNA, 22 bp, Homo sapiens
gtttctctgtctgttacattgg

SEQ ID NO: 7944802 - DNA, 22 bp, Homo sapiens
gtttctgctccagtgatgcaag

SEQ ID NO: 7944803 - DNA, 22 bp, Homo sapiens
gtttctgctgcgtgctccagga

SEQ ID NO: 7944804 - DNA, 22 bp, Homo sapiens
gtttctgtgttagatgagtctt

SEQ ID NO: 7944805 - DNA, 22 bp, Homo sapiens
gtttctcttaacacataaagta

SEQ ID NO: 7944806 - DNA, 22 bp, Homo sapiens
gtttctctttgaagcctggctg

SEQ ID NO: 7944807 - DNA, 22 bp, Homo sapiens
gtttctcttaacacataaagta

SEQ ID NO: 7944808 - DNA, 22 bp, Homo sapiens
gtttataatccaactctgctcc

SEQ ID NO: 7944809 - DNA, 22 bp, Homo sapiens
gtttataatgtctgtgccaaaa

SEQ ID NO: 7944810 - DNA, 20 bp, Homo sapiens
gtttatacagaagaccccaa

SEQ ID NO: 7944811 - DNA, 22 bp, Homo sapiens
gtttataatgtctgtgccaaaa

SEQ ID NO: 7944812 - DNA, 22 bp, Homo sapiens
gtttataaggtaaaggagagag

SEQ ID NO: 7944813 - DNA, 22 bp, Homo sapiens
gtttataaggcccaatatttct

SEQ ID NO: 7944814 - DNA, 22 bp, Homo sapiens
gtttatacagtgcatggtgtta

SEQ ID NO: 7944815 - DNA, 20 bp, Homo sapiens
gtttatacagaagaccccaa

SEQ ID NO: 7944816 - DNA, 22 bp, Homo sapiens
gtttataaggtaaaggagagag

SEQ ID NO: 7944817 - DNA, 22 bp, Homo sapiens
gtttatacagtgcatggtgtta

SEQ ID NO: 7944818 - DNA, 22 bp, Homo sapiens
gtttcccatatctagggagagg

SEQ ID NO: 7944819 - DNA, 22 bp, Homo sapiens
gtttcctttgccagtaaatggg

SEQ ID NO: 7944820 - DNA, 22 bp, Homo sapiens
gtttcctttgccagtaaatggg

SEQ ID NO: 7944821 - DNA, 22 bp, Homo sapiens
gtttcctttgccagtaaatggg

SEQ ID NO: 7944822 - DNA, 22 bp, Homo sapiens
gtttccttttggaattagagct

SEQ ID NO: 7944823 - DNA, 22 bp, Homo sapiens
gtttccttttggaattagagct

SEQ ID NO: 7944824 - DNA, 22 bp, Homo sapiens
gtttccttttggaattagagct

SEQ ID NO: 7944825 - DNA, 22 bp, Homo sapiens
gtttccttttggaattagagct

SEQ ID NO: 7944826 - DNA, 22 bp, Homo sapiens
gtttccttttggaattagagct

SEQ ID NO: 7944827 - DNA, 22 bp, Homo sapiens
gtttctcacttaccaacacatg

SEQ ID NO: 7944828 - DNA, 22 bp, Homo sapiens
gtttctcacttaccaacacatg

SEQ ID NO: 7944829 - DNA, 22 bp, Homo sapiens
gtttctcaagcttgaatgcaca

SEQ ID NO: 7944830 - DNA, 22 bp, Homo sapiens
gtttctcaagcttgaatgcaca

SEQ ID NO: 7944831 - DNA, 22 bp, Homo sapiens
gtttctcaagcttgaatgcaca

SEQ ID NO: 7944832 - DNA, 22 bp, Homo sapiens
gtttctcagcaactatatgact

SEQ ID NO: 7944833 - DNA, 22 bp, Homo sapiens
gtttctcagcatgtcagtacaa

SEQ ID NO: 7944834 - DNA, 22 bp, Homo sapiens
gtttctcaacatgctttctaac

SEQ ID NO: 7944835 - DNA, 22 bp, Homo sapiens
gtttctcaagcttgaatgcaca

SEQ ID NO: 7944836 - DNA, 22 bp, Homo sapiens
gtttctcaaattatttcagctt

SEQ ID NO: 7944837 - DNA, 22 bp, Homo sapiens
gtttctatggtttatattactg

SEQ ID NO: 7944838 - DNA, 22 bp, Homo sapiens
gtttctatggtttatattactg

SEQ ID NO: 7944839 - DNA, 22 bp, Homo sapiens
gtttctaagggagagctgccag

SEQ ID NO: 7944840 - DNA, 22 bp, Homo sapiens
gtttctaattggaactttgagg

SEQ ID NO: 7944841 - DNA, 22 bp, Homo sapiens
gtttctaagcacatgtgagtgt

SEQ ID NO: 7944842 - DNA, 22 bp, Homo sapiens
gtttctacatgcctctttcacc

SEQ ID NO: 7944843 - DNA, 22 bp, Homo sapiens
gtttctaagcacatgtgagtgt

SEQ ID NO: 7944844 - DNA, 22 bp, Homo sapiens
gtttctaattggaactttgagg

SEQ ID NO: 7944845 - DNA, 22 bp, Homo sapiens
gtttcctttttctgccctcaat

SEQ ID NO: 7944846 - DNA, 22 bp, Homo sapiens
gtttcctttttctgccctcaat

SEQ ID NO: 7944847 - DNA, 22 bp, Homo sapiens
gtttctaaatgttctgagtttt

SEQ ID NO: 7944848 - DNA, 22 bp, Homo sapiens
gtttctaaatgttctgagtttt

SEQ ID NO: 7944849 - DNA, 22 bp, Homo sapiens
gtttctaagcacatgtgagtgt

SEQ ID NO: 7944850 - DNA, 22 bp, Homo sapiens
gtttctaaatgttctgagtttt

SEQ ID NO: 7944851 - DNA, 22 bp, Homo sapiens
gcctggctgtctggcaaggttc

SEQ ID NO: 7944852 - DNA, 22 bp, Homo sapiens
gcctggctgtctggcaaggttc

SEQ ID NO: 7944853 - DNA, 22 bp, Homo sapiens
gcctggctgtctggcaaggttc

SEQ ID NO: 7944854 - DNA, 22 bp, Homo sapiens
gcctggctgtcaaacccagaag

SEQ ID NO: 7944855 - DNA, 22 bp, Homo sapiens
gcctggctggtcactgcctggc

SEQ ID NO: 7944856 - DNA, 22 bp, Homo sapiens
gcctggctgtctggcaaggttc

SEQ ID NO: 7944857 - DNA, 22 bp, Homo sapiens
gcctggctggtcactgcctggc

SEQ ID NO: 7944858 - DNA, 22 bp, Homo sapiens
gcctggctggtcactgcctggc

SEQ ID NO: 7944859 - DNA, 22 bp, Homo sapiens
gcctggctggtcactgcctggc

SEQ ID NO: 7944860 - DNA, 22 bp, Homo sapiens
gcctggctggtcactgcctggc

SEQ ID NO: 7944861 - DNA, 22 bp, Homo sapiens
gcctggctggtcactgcctggc

SEQ ID NO: 7944862 - DNA, 22 bp, Homo sapiens
gcctggctggtagagggggctc

SEQ ID NO: 7944863 - DNA, 22 bp, Homo sapiens
gcctggctggtcactgcctggc

SEQ ID NO: 7944864 - DNA, 19 bp, Homo sapiens
gcctggctgggatgagccc

SEQ ID NO: 7944865 - DNA, 22 bp, Homo sapiens
gcctggctgcttagcctacttc

SEQ ID NO: 7944866 - DNA, 19 bp, Homo sapiens
gcctggctgggatgagccc

SEQ ID NO: 7944867 - DNA, 19 bp, Homo sapiens
gcctggctgggatgagccc

SEQ ID NO: 7944868 - DNA, 22 bp, Homo sapiens
gcctggctgggcaccaggggag

SEQ ID NO: 7944869 - DNA, 22 bp, Homo sapiens
gcctggctggtagagggggctc

SEQ ID NO: 7944870 - DNA, 22 bp, Homo sapiens
gcctggctggtagagggggctc

SEQ ID NO: 7944871 - DNA, 22 bp, Homo sapiens
gcctggctgggctgaatgctta

SEQ ID NO: 7944872 - DNA, 22 bp, Homo sapiens
gcctggctgggctgaatgctta

SEQ ID NO: 7944873 - DNA, 22 bp, Homo sapiens
gcctggctgggctgaatgctta

SEQ ID NO: 7944874 - DNA, 22 bp, Homo sapiens
gcctggctgggcaccaggggag

SEQ ID NO: 7944875 - DNA, 22 bp, Homo sapiens
gcctggctgggcaccaggggag

SEQ ID NO: 7944876 - DNA, 22 bp, Homo sapiens
gcctggctgggcaccaggggag

SEQ ID NO: 7944877 - DNA, 22 bp, Homo sapiens
gcctggcttggggctcagtggt

SEQ ID NO: 7944878 - DNA, 22 bp, Homo sapiens
gcctggcttggggctcagtggt

SEQ ID NO: 7944879 - DNA, 22 bp, Homo sapiens
gcctggcttggggctcagtggt

SEQ ID NO: 7944880 - DNA, 22 bp, Homo sapiens
gcctggcttggggctcagtggt

SEQ ID NO: 7944881 - DNA, 22 bp, Homo sapiens
gcctggggaacttgatcctgtc

SEQ ID NO: 7944882 - DNA, 22 bp, Homo sapiens
gcctggggaacttgatcctgtc

SEQ ID NO: 7944883 - DNA, 22 bp, Homo sapiens
gcctggggaacttgatcctgtc

SEQ ID NO: 7944884 - DNA, 22 bp, Homo sapiens
gcctggcttgccagccctggcg

SEQ ID NO: 7944885 - DNA, 22 bp, Homo sapiens
gcctggcttgccagccctggcg

SEQ ID NO: 7944886 - DNA, 22 bp, Homo sapiens
gcctggcttgccagccctggcg

SEQ ID NO: 7944887 - DNA, 22 bp, Homo sapiens
gcctggcttgccagccctggcg

SEQ ID NO: 7944888 - DNA, 22 bp, Homo sapiens
gcctggcttgccagccctggcg

SEQ ID NO: 7944889 - DNA, 22 bp, Homo sapiens
gcctggcttgccagccctggcg

SEQ ID NO: 7944890 - DNA, 22 bp, Homo sapiens
gcctggcttgccagccctggcg

SEQ ID NO: 7944891 - DNA, 22 bp, Homo sapiens
gcctggcttgccagccctggcg

SEQ ID NO: 7944892 - DNA, 22 bp, Homo sapiens
gcctggcttcccttggagcatt

SEQ ID NO: 7944893 - DNA, 22 bp, Homo sapiens
gcctggcttcccttggagcatt

SEQ ID NO: 7944894 - DNA, 18 bp, Homo sapiens
gcctggcttcggagccgc

SEQ ID NO: 7944895 - DNA, 18 bp, Homo sapiens
gcctggcttcggagccgc

SEQ ID NO: 7944896 - DNA, 21 bp, Homo sapiens
gcctggcttcacaggcactga

SEQ ID NO: 7944897 - DNA, 21 bp, Homo sapiens
gcctggcttcacaggcactga

SEQ ID NO: 7944898 - DNA, 21 bp, Homo sapiens
gcctggcttcacaggcactga

SEQ ID NO: 7944899 - DNA, 21 bp, Homo sapiens
gcctggcttcacaggcactga

SEQ ID NO: 7944900 - DNA, 21 bp, Homo sapiens
gcctggcttcacaggcactga

SEQ ID NO: 7944901 - DNA, 23 bp, Homo sapiens
gcctggcttccaaggtaggggag

SEQ ID NO: 7944902 - DNA, 22 bp, Homo sapiens
gcctggcttcccttggagcatt

SEQ ID NO: 7944903 - DNA, 22 bp, Homo sapiens
gcctggctagttagtgtcaggt

SEQ ID NO: 7944904 - DNA, 22 bp, Homo sapiens
gcctggctagttagtgtcaggt

SEQ ID NO: 7944905 - DNA, 21 bp, Homo sapiens
gcctggctagaagctcctagc

SEQ ID NO: 7944906 - DNA, 22 bp, Homo sapiens
gcctggctagttagtgtcaggt

SEQ ID NO: 7944907 - DNA, 22 bp, Homo sapiens
gcctggctagttagtgtcaggt

SEQ ID NO: 7944908 - DNA, 22 bp, Homo sapiens
gcctggctatggcctcccccat

SEQ ID NO: 7944909 - DNA, 22 bp, Homo sapiens
gcctggctatggcctcccccat

SEQ ID NO: 7944910 - DNA, 22 bp, Homo sapiens
gcctggctgccggccttggcaa

SEQ ID NO: 7944911 - DNA, 22 bp, Homo sapiens
gcctggctgccggccttggcaa

SEQ ID NO: 7944912 - DNA, 22 bp, Homo sapiens
gcctggctgccggccttggcaa

SEQ ID NO: 7944913 - DNA, 18 bp, Homo sapiens
gcctggctgccaacccag

SEQ ID NO: 7944914 - DNA, 22 bp, Homo sapiens
gcctggctgctcagccactcac

SEQ ID NO: 7944915 - DNA, 22 bp, Homo sapiens
gcctggctgctcagccactcac

SEQ ID NO: 7944916 - DNA, 22 bp, Homo sapiens
gcctggctgctcagccactcac

SEQ ID NO: 7944917 - DNA, 22 bp, Homo sapiens
gcctggctgctagccagaggca

SEQ ID NO: 7944918 - DNA, 22 bp, Homo sapiens
gcctggctgctagccagaggca

SEQ ID NO: 7944919 - DNA, 22 bp, Homo sapiens
gcctggctgctagccagaggca

SEQ ID NO: 7944920 - DNA, 22 bp, Homo sapiens
gcctggctgctagccagaggca

SEQ ID NO: 7944921 - DNA, 22 bp, Homo sapiens
gcctggctgctagccagaggca

SEQ ID NO: 7944922 - DNA, 22 bp, Homo sapiens
gcctggctgctggttctgagga

SEQ ID NO: 7944923 - DNA, 22 bp, Homo sapiens
gcctggctgctcagccactcac

SEQ ID NO: 7944924 - DNA, 22 bp, Homo sapiens
gcctggctgctcagccactcac

SEQ ID NO: 7944925 - DNA, 22 bp, Homo sapiens
gcctggctgctcagccactcac

SEQ ID NO: 7944926 - DNA, 22 bp, Homo sapiens
gcctggctgcttagcctacttc

SEQ ID NO: 7944927 - DNA, 22 bp, Homo sapiens
gcctggctgcttagcctacttc

SEQ ID NO: 7944928 - DNA, 22 bp, Homo sapiens
gcctggctgctggttctgagga

SEQ ID NO: 7944929 - DNA, 22 bp, Homo sapiens
gcctggctgctggttctgagga

SEQ ID NO: 7944930 - DNA, 22 bp, Homo sapiens
gcctggctaattttggtatttt

SEQ ID NO: 7944931 - DNA, 22 bp, Homo sapiens
gcctggctaagcagaaggaccc

SEQ ID NO: 7944932 - DNA, 22 bp, Homo sapiens
gcctcagggataggatgagcat

SEQ ID NO: 7944933 - DNA, 22 bp, Homo sapiens
gcctcagggggagaggccagct

SEQ ID NO: 7944934 - DNA, 22 bp, Homo sapiens
gcctggctacccactgaaatat

SEQ ID NO: 7944935 - DNA, 22 bp, Homo sapiens
gcctggctaattttggtatttt

SEQ ID NO: 7944936 - DNA, 21 bp, Homo sapiens
gcctggctagaagctcctagc

SEQ ID NO: 7944937 - DNA, 21 bp, Homo sapiens
gcctggctagaagctcctagc

SEQ ID NO: 7944938 - DNA, 21 bp, Homo sapiens
gcctggctagaagctcctagc

SEQ ID NO: 7944939 - DNA, 22 bp, Homo sapiens
gcctcagggataggatgagcat

SEQ ID NO: 7944940 - DNA, 22 bp, Homo sapiens
gcctcagggataggatgagcat

SEQ ID NO: 7944941 - DNA, 22 bp, Homo sapiens
gcctcagggataggatgagcat

SEQ ID NO: 7944942 - DNA, 22 bp, Homo sapiens
gcctcagggataggatgagcat

SEQ ID NO: 7944943 - DNA, 22 bp, Homo sapiens
gcctcagggataggatgagcat

SEQ ID NO: 7944944 - DNA, 22 bp, Homo sapiens
gcctcagggataggatgagcat

SEQ ID NO: 7944945 - DNA, 22 bp, Homo sapiens
gcctcagggataggatgagcat

SEQ ID NO: 7944946 - DNA, 22 bp, Homo sapiens
gcctcagggataggatgagcat

SEQ ID NO: 7944947 - DNA, 22 bp, Homo sapiens
gcctcagggggagaggccagct

SEQ ID NO: 7944948 - DNA, 22 bp, Homo sapiens
gcctcaggccgccctgctgctc

SEQ ID NO: 7944949 - DNA, 22 bp, Homo sapiens
gcctcaggccgccctgctgctc

SEQ ID NO: 7944950 - DNA, 22 bp, Homo sapiens
gcctcaggccgccctgctgctc

SEQ ID NO: 7944951 - DNA, 22 bp, Homo sapiens
gcctcaggcctatagctgctgt

SEQ ID NO: 7944952 - DNA, 22 bp, Homo sapiens
gcctcaggcctatagctgctgt

SEQ ID NO: 7944953 - DNA, 22 bp, Homo sapiens
gcctcaggcctatagctgctgt

SEQ ID NO: 7944954 - DNA, 22 bp, Homo sapiens
gcctcaggcctatagctgctgt

SEQ ID NO: 7944955 - DNA, 22 bp, Homo sapiens
gcctcaggcctatagctgctgt

SEQ ID NO: 7944956 - DNA, 22 bp, Homo sapiens
gcctcaggcctatagctgctgt

SEQ ID NO: 7944957 - DNA, 22 bp, Homo sapiens
gcctcaggcctatagctgctgt

SEQ ID NO: 7944958 - DNA, 22 bp, Homo sapiens
gcctcaggcctatagctgctgt

SEQ ID NO: 7944959 - DNA, 22 bp, Homo sapiens
gcctcaggcctatagctgctgt

SEQ ID NO: 7944960 - DNA, 22 bp, Homo sapiens
gcctcagggataggatgagcat

SEQ ID NO: 7944961 - DNA, 22 bp, Homo sapiens
gcctcagggataggatgagcat

SEQ ID NO: 7944962 - DNA, 22 bp, Homo sapiens
gcctcaggcctatagctgctgt

SEQ ID NO: 7944963 - DNA, 22 bp, Homo sapiens
gcctggggaacttgatcctgtc

SEQ ID NO: 7944964 - DNA, 22 bp, Homo sapiens
gcctggggcatgcagctgatac

SEQ ID NO: 7944965 - DNA, 22 bp, Homo sapiens
gcctggggcatgcagctgatac

SEQ ID NO: 7944966 - DNA, 22 bp, Homo sapiens
gcctggggcatgcagctgatac

SEQ ID NO: 7944967 - DNA, 22 bp, Homo sapiens
gcctggggccagcttgggctga

SEQ ID NO: 7944968 - DNA, 22 bp, Homo sapiens
gcctggggccagcttgggctga

SEQ ID NO: 7944969 - DNA, 22 bp, Homo sapiens
gcctggggtctctgactcacag

SEQ ID NO: 7944970 - DNA, 22 bp, Homo sapiens
gcctggggtctctgactcacag

SEQ ID NO: 7944971 - DNA, 22 bp, Homo sapiens
gcctggggtctctgactcacag

SEQ ID NO: 7944972 - DNA, 22 bp, Homo sapiens
gcctgggtaggagacaaaaggt

SEQ ID NO: 7944973 - DNA, 22 bp, Homo sapiens
gcctggggtctctgactcacag

SEQ ID NO: 7944974 - DNA, 22 bp, Homo sapiens
gcctggggtctctgactcacag

SEQ ID NO: 7944975 - DNA, 22 bp, Homo sapiens
gcctggggggcatgtcataata

SEQ ID NO: 7944976 - DNA, 22 bp, Homo sapiens
gcctggggtcccttgttggcac

SEQ ID NO: 7944977 - DNA, 22 bp, Homo sapiens
gcctggggtcccttgttggcac

SEQ ID NO: 7944978 - DNA, 22 bp, Homo sapiens
gcctggggtcccttgttggcac

SEQ ID NO: 7944979 - DNA, 22 bp, Homo sapiens
gcctggggtcccttgttggcac

SEQ ID NO: 7944980 - DNA, 22 bp, Homo sapiens
gcctggggtcccttgttggcac

SEQ ID NO: 7944981 - DNA, 22 bp, Homo sapiens
gcctggtgataagcagtgacct

SEQ ID NO: 7944982 - DNA, 22 bp, Homo sapiens
gcctggtgataagcagtgacct

SEQ ID NO: 7944983 - DNA, 22 bp, Homo sapiens
gcctggtgataagcagtgacct

SEQ ID NO: 7944984 - DNA, 22 bp, Homo sapiens
gcctggtgataagcagtgacct

SEQ ID NO: 7944985 - DNA, 22 bp, Homo sapiens
gcctggtgaaaggcagagagcg

SEQ ID NO: 7944986 - DNA, 22 bp, Homo sapiens
gcctggtgataagcagtgacct

SEQ ID NO: 7944987 - DNA, 22 bp, Homo sapiens
gcctggtgaaaggcagagagcg

SEQ ID NO: 7944988 - DNA, 22 bp, Homo sapiens
gcctggtgaaaggcagagagcg

SEQ ID NO: 7944989 - DNA, 22 bp, Homo sapiens
gcctggtgaaaggcagagagcg

SEQ ID NO: 7944990 - DNA, 22 bp, Homo sapiens
gcctggtgaaaggcagagagcg

SEQ ID NO: 7944991 - DNA, 22 bp, Homo sapiens
gcctggtgaaaggcagagagcg

SEQ ID NO: 7944992 - DNA, 22 bp, Homo sapiens
gcctggtgaaaggcagagagcg

SEQ ID NO: 7944993 - DNA, 22 bp, Homo sapiens
gcctggtgaaaggcagagagcg

SEQ ID NO: 7944994 - DNA, 22 bp, Homo sapiens
gcctggtctctggggttgggta

SEQ ID NO: 7944995 - DNA, 23 bp, Homo sapiens
gcctgggttgtaactagtgcatc

SEQ ID NO: 7944996 - DNA, 23 bp, Homo sapiens
gcctgggttgtaactagtgcatc

SEQ ID NO: 7944997 - DNA, 22 bp, Homo sapiens
gcctggtctctttcatgtcagt

SEQ ID NO: 7944998 - DNA, 22 bp, Homo sapiens
gcctggtctctttcatgtcagt

SEQ ID NO: 7944999 - DNA, 22 bp, Homo sapiens
gcctggtgaaaggcagagagcg

SEQ ID NO: 7945000 - DNA, 22 bp, Homo sapiens
gcctggtgaaaggcagagagcg

SEQ ID NO: 7945001 - DNA, 22 bp, Homo sapiens
gcctgggtgcccaatgatgaga

SEQ ID NO: 7945002 - DNA, 22 bp, Homo sapiens
gcctgggtgcccaatgatgaga

SEQ ID NO: 7945003 - DNA, 22 bp, Homo sapiens
gcctgggttccatgatctccag

SEQ ID NO: 7945004 - DNA, 23 bp, Homo sapiens
gcctgggtctagagataagagcc

SEQ ID NO: 7945005 - DNA, 22 bp, Homo sapiens
gcctgggtccactgatcatgct

SEQ ID NO: 7945006 - DNA, 22 bp, Homo sapiens
gcctgggtgagggtctccttca

SEQ ID NO: 7945007 - DNA, 22 bp, Homo sapiens
gcctggtggacactgggcatca

SEQ ID NO: 7945008 - DNA, 22 bp, Homo sapiens
gcctggtggtatcctggcaaga

SEQ ID NO: 7945009 - DNA, 22 bp, Homo sapiens
gcctggtgctatgagggccagc

SEQ ID NO: 7945010 - DNA, 22 bp, Homo sapiens
gcctggtgctatgagggccagc

SEQ ID NO: 7945011 - DNA, 22 bp, Homo sapiens
gcctggtgctatgagggccagc

SEQ ID NO: 7945012 - DNA, 22 bp, Homo sapiens
gcctggtggacactgggcatca

SEQ ID NO: 7945013 - DNA, 22 bp, Homo sapiens
gcctggtgataagcagtgacct

SEQ ID NO: 7945014 - DNA, 22 bp, Homo sapiens
gcctggtgctatgagggccagc

SEQ ID NO: 7945015 - DNA, 22 bp, Homo sapiens
gcctggtgctatgagggccagc

SEQ ID NO: 7945016 - DNA, 22 bp, Homo sapiens
gcctggtgtccagaggcgagtg

SEQ ID NO: 7945017 - DNA, 22 bp, Homo sapiens
gcctggtgtccagaggcgagtg

SEQ ID NO: 7945018 - DNA, 22 bp, Homo sapiens
gcctggtggacactgggcatca

SEQ ID NO: 7945019 - DNA, 22 bp, Homo sapiens
gcctggtggtatcctggcaaga

SEQ ID NO: 7945020 - DNA, 22 bp, Homo sapiens
gcctggtgtccagaggcgagtg

SEQ ID NO: 7945021 - DNA, 22 bp, Homo sapiens
gcctggtggtgtgctcaagtgg

SEQ ID NO: 7945022 - DNA, 22 bp, Homo sapiens
gcctggtggtatcctggcaaga

SEQ ID NO: 7945023 - DNA, 22 bp, Homo sapiens
gcctggtggtatcctggcaaga

SEQ ID NO: 7945024 - DNA, 22 bp, Homo sapiens
gccttcagagtaccatgtcctc

SEQ ID NO: 7945025 - DNA, 22 bp, Homo sapiens
gccttcagagtaccatgtcctc

SEQ ID NO: 7945026 - DNA, 18 bp, Homo sapiens
gccttcagactgcatgct

SEQ ID NO: 7945027 - DNA, 18 bp, Homo sapiens
gccttcagactgcatgct

SEQ ID NO: 7945028 - DNA, 22 bp, Homo sapiens
gccttcagccctgactggccag

SEQ ID NO: 7945029 - DNA, 22 bp, Homo sapiens
gccttcagagtaccatgtcctc

SEQ ID NO: 7945030 - DNA, 22 bp, Homo sapiens
gccttcagccctgactggccag

SEQ ID NO: 7945031 - DNA, 22 bp, Homo sapiens
gccttcagcggccgctcgctgc

SEQ ID NO: 7945032 - DNA, 18 bp, Homo sapiens
gccttcagactgcatgct

SEQ ID NO: 7945033 - DNA, 18 bp, Homo sapiens
gccttcagactgcatgct

SEQ ID NO: 7945034 - DNA, 21 bp, Homo sapiens
gccttcactcccagagtttgt

SEQ ID NO: 7945035 - DNA, 22 bp, Homo sapiens
gccttattacctgcactttgaa

SEQ ID NO: 7945036 - DNA, 22 bp, Homo sapiens
gccttaggggtcagacagagct

SEQ ID NO: 7945037 - DNA, 22 bp, Homo sapiens
gccttattacctgcactttgaa

SEQ ID NO: 7945038 - DNA, 22 bp, Homo sapiens
gccttattacctgcactttgaa

SEQ ID NO: 7945039 - DNA, 22 bp, Homo sapiens
gccttcaggaaatcagtccttg

SEQ ID NO: 7945040 - DNA, 22 bp, Homo sapiens
gccttcaggaaatcagtccttg

SEQ ID NO: 7945041 - DNA, 22 bp, Homo sapiens
gccttcaggaaatcagtccttg

SEQ ID NO: 7945042 - DNA, 22 bp, Homo sapiens
gccttcaggagggttccagaca

SEQ ID NO: 7945043 - DNA, 22 bp, Homo sapiens
gccttcaggtgctgccaggcta

SEQ ID NO: 7945044 - DNA, 22 bp, Homo sapiens
gccttcaggtgctgccaggcta

SEQ ID NO: 7945045 - DNA, 22 bp, Homo sapiens
gccttcaggagggttccagaca

SEQ ID NO: 7945046 - DNA, 22 bp, Homo sapiens
gccttcaggagggttccagaca

SEQ ID NO: 7945047 - DNA, 23 bp, Homo sapiens
gccttcagctcgggaaggctccc

SEQ ID NO: 7945048 - DNA, 22 bp, Homo sapiens
gccttcaggaaatcagtccttg

SEQ ID NO: 7945049 - DNA, 22 bp, Homo sapiens
gccttcagcggccgctcgctgc

SEQ ID NO: 7945050 - DNA, 22 bp, Homo sapiens
gccttcagcggccgctcgctgc

SEQ ID NO: 7945051 - DNA, 23 bp, Homo sapiens
gccttcagctcgggaaggctccc

SEQ ID NO: 7945052 - DNA, 22 bp, Homo sapiens
gccttcagtagtgtcagctgta

SEQ ID NO: 7945053 - DNA, 22 bp, Homo sapiens
gccttcagtagtatcctcatga

SEQ ID NO: 7945054 - DNA, 22 bp, Homo sapiens
gccttcagtagtgtcagctgta

SEQ ID NO: 7945055 - DNA, 22 bp, Homo sapiens
gccttcagtagtgtcagctgta

SEQ ID NO: 7945056 - DNA, 22 bp, Homo sapiens
gccttcagtagtgtcagctgta

SEQ ID NO: 7945057 - DNA, 22 bp, Homo sapiens
gccttcagtagtgtcagctgta

SEQ ID NO: 7945058 - DNA, 22 bp, Homo sapiens
gccttccacctaggcctctgct

SEQ ID NO: 7945059 - DNA, 22 bp, Homo sapiens
gccttcatagagtgtaggcctt

SEQ ID NO: 7945060 - DNA, 22 bp, Homo sapiens
gccttcaggtgtccctgtgggc

SEQ ID NO: 7945061 - DNA, 22 bp, Homo sapiens
gccttcaggtgctgccaggcta

SEQ ID NO: 7945062 - DNA, 22 bp, Homo sapiens
gccttcagtagtatcctcatga

SEQ ID NO: 7945063 - DNA, 22 bp, Homo sapiens
gccttcagtagtatcctcatga

SEQ ID NO: 7945064 - DNA, 22 bp, Homo sapiens
gccttcagtaactgagacggaa

SEQ ID NO: 7945065 - DNA, 22 bp, Homo sapiens
gccttcagtagtatcctcatga

SEQ ID NO: 7945066 - DNA, 22 bp, Homo sapiens
gcggggacagaaggcggttctc

SEQ ID NO: 7945067 - DNA, 22 bp, Homo sapiens
gcggggcacagtgatggagcac

SEQ ID NO: 7945068 - DNA, 18 bp, Homo sapiens
gcgggcggtgcagtgggc

SEQ ID NO: 7945069 - DNA, 22 bp, Homo sapiens
gcggggcacagtgatggagcac

SEQ ID NO: 7945070 - DNA, 22 bp, Homo sapiens
gcggggcacagtgatggagcac

SEQ ID NO: 7945071 - DNA, 19 bp, Homo sapiens
gcgggcggcgcctgcgagg

SEQ ID NO: 7945072 - DNA, 22 bp, Homo sapiens
gcgggcgctcaggctgcagctg

SEQ ID NO: 7945073 - DNA, 22 bp, Homo sapiens
gcgggcagggcactggtcccct

SEQ ID NO: 7945074 - DNA, 19 bp, Homo sapiens
gcgggcggcgcctgcgagg

SEQ ID NO: 7945075 - DNA, 18 bp, Homo sapiens
gcgggcggtgcagtgggc

SEQ ID NO: 7945076 - DNA, 22 bp, Homo sapiens
gcgggcgggggttcccaggtct

SEQ ID NO: 7945077 - DNA, 18 bp, Homo sapiens
gcgggcggtgcagtgggc

SEQ ID NO: 7945078 - DNA, 18 bp, Homo sapiens
gcgggcggtgcagtgggc

SEQ ID NO: 7945079 - DNA, 22 bp, Homo sapiens
gcgggcgctcaggctgcagctg

SEQ ID NO: 7945080 - DNA, 22 bp, Homo sapiens
gcgggcgctcaggctgcagctg

SEQ ID NO: 7945081 - DNA, 22 bp, Homo sapiens
gcgggccaccttggagagcgct

SEQ ID NO: 7945082 - DNA, 22 bp, Homo sapiens
gcgggccaccttggagagcgct

SEQ ID NO: 7945083 - DNA, 22 bp, Homo sapiens
gcgggccaccttggagagcgct

SEQ ID NO: 7945084 - DNA, 22 bp, Homo sapiens
gcgggccaccttggagagcgct

SEQ ID NO: 7945085 - DNA, 22 bp, Homo sapiens
gcggcccgagcaggacgggtgg

SEQ ID NO: 7945086 - DNA, 22 bp, Homo sapiens
gcggccttgtggcggagcaggc

SEQ ID NO: 7945087 - DNA, 22 bp, Homo sapiens
gcggccttgtggcggagcaggc

SEQ ID NO: 7945088 - DNA, 22 bp, Homo sapiens
gcggccttgtggcggagcaggc

SEQ ID NO: 7945089 - DNA, 22 bp, Homo sapiens
gcggcccgagcaggacgggtgg

SEQ ID NO: 7945090 - DNA, 22 bp, Homo sapiens
gcggcccgagcaggacgggtgg

SEQ ID NO: 7945091 - DNA, 22 bp, Homo sapiens
gcggcccgagcaggacgggtgg

SEQ ID NO: 7945092 - DNA, 22 bp, Homo sapiens
gcggcccgagcaggacgggtgg

SEQ ID NO: 7945093 - DNA, 22 bp, Homo sapiens
gcggcaggagtaaaggaggaag

SEQ ID NO: 7945094 - DNA, 22 bp, Homo sapiens
gcggcggagacagcaggaagcc

SEQ ID NO: 7945095 - DNA, 22 bp, Homo sapiens
gcggcggagacagcaggaagcc

SEQ ID NO: 7945096 - DNA, 22 bp, Homo sapiens
gcggcgcctgggacccgccagc

SEQ ID NO: 7945097 - DNA, 22 bp, Homo sapiens
gcggcgcctaagccccgacctc

SEQ ID NO: 7945098 - DNA, 22 bp, Homo sapiens
gcggcgcctaagccccgacctc

SEQ ID NO: 7945099 - DNA, 22 bp, Homo sapiens
gcgggaagaacgaccaggctcg

SEQ ID NO: 7945100 - DNA, 22 bp, Homo sapiens
gcgggcagggcactggtcccct

SEQ ID NO: 7945101 - DNA, 22 bp, Homo sapiens
gcggctgccgagacaagccggt

SEQ ID NO: 7945102 - DNA, 22 bp, Homo sapiens
gcgggaagaacgaccaggctcg

SEQ ID NO: 7945103 - DNA, 22 bp, Homo sapiens
gcggcggagacagcaggaagcc

SEQ ID NO: 7945104 - DNA, 22 bp, Homo sapiens
gcggcggcggtcattgagcatg

SEQ ID NO: 7945105 - DNA, 22 bp, Homo sapiens
gcggaggttttcttgctcactt

SEQ ID NO: 7945106 - DNA, 22 bp, Homo sapiens
gcggagggcgagcccgcggagc

SEQ ID NO: 7945107 - DNA, 22 bp, Homo sapiens
gcggaggtgaggaagtggggca

SEQ ID NO: 7945108 - DNA, 19 bp, Homo sapiens
gcgctttattgattgcaag

SEQ ID NO: 7945109 - DNA, 22 bp, Homo sapiens
gcggaaacacagggaagtagca

SEQ ID NO: 7945110 - DNA, 23 bp, Homo sapiens
gcggaaggggtcataatggagac

SEQ ID NO: 7945111 - DNA, 22 bp, Homo sapiens
gcggagaggcagagactccgcg

SEQ ID NO: 7945112 - DNA, 22 bp, Homo sapiens
gcggagcggagctgccggtgat

SEQ ID NO: 7945113 - DNA, 22 bp, Homo sapiens
gcggagcggagctgccggtgat

SEQ ID NO: 7945114 - DNA, 22 bp, Homo sapiens
gcggaggacaggaatgcgggcg

SEQ ID NO: 7945115 - DNA, 22 bp, Homo sapiens
gcggagggagataggccttgct

SEQ ID NO: 7945116 - DNA, 22 bp, Homo sapiens
gcggagggagataggccttgct

SEQ ID NO: 7945117 - DNA, 22 bp, Homo sapiens
gcggagaggcagagactccgcg

SEQ ID NO: 7945118 - DNA, 22 bp, Homo sapiens
gcgcgtctgtgtgtgcaggcat

SEQ ID NO: 7945119 - DNA, 22 bp, Homo sapiens
gcgcggggtacacgcggtggcc

SEQ ID NO: 7945120 - DNA, 22 bp, Homo sapiens
gcgcggcctcacccctcggtga

SEQ ID NO: 7945121 - DNA, 22 bp, Homo sapiens
gcgcggggtacacgcggtggcc

SEQ ID NO: 7945122 - DNA, 22 bp, Homo sapiens
gcgctcaggtgccaggcctgcg

SEQ ID NO: 7945123 - DNA, 22 bp, Homo sapiens
gcgctcaggtgccaggcctgcg

SEQ ID NO: 7945124 - DNA, 22 bp, Homo sapiens
gcgctcaggtgccaggcctgcg

SEQ ID NO: 7945125 - DNA, 22 bp, Homo sapiens
gcgcgacatttttaacactaca

SEQ ID NO: 7945126 - DNA, 18 bp, Homo sapiens
gcgctggctgtcctgtcc

SEQ ID NO: 7945127 - DNA, 18 bp, Homo sapiens
gcgctggctgtcctgtcc

SEQ ID NO: 7945128 - DNA, 16 bp, Homo sapiens
gcgcctcctcggcctc

SEQ ID NO: 7945129 - DNA, 22 bp, Homo sapiens
gcgagaaactaagtgccctttg

SEQ ID NO: 7945130 - DNA, 22 bp, Homo sapiens
gcgccccatctacagtactttt

SEQ ID NO: 7945131 - DNA, 22 bp, Homo sapiens
gcgactgtacagaattgcccct

SEQ ID NO: 7945132 - DNA, 22 bp, Homo sapiens
gcgcgctgagtgtccgttgggg

SEQ ID NO: 7945133 - DNA, 22 bp, Homo sapiens
gcgcgcggggcatcagtggccg

SEQ ID NO: 7945134 - DNA, 22 bp, Homo sapiens
gcgcgcggggcatcagtggccg

SEQ ID NO: 7945135 - DNA, 22 bp, Homo sapiens
gcgcctggcacacagcaagggc

SEQ ID NO: 7945136 - DNA, 22 bp, Homo sapiens
gccttttttaaactccaagtct

SEQ ID NO: 7945137 - DNA, 22 bp, Homo sapiens
gccttttttaaactccaagtct

SEQ ID NO: 7945138 - DNA, 22 bp, Homo sapiens
gccttttttaaactccaagtct

SEQ ID NO: 7945139 - DNA, 22 bp, Homo sapiens
gcgaaaaatgtgtaaatatgtt

SEQ ID NO: 7945140 - DNA, 22 bp, Homo sapiens
gccttttttgttgctctgtcac

SEQ ID NO: 7945141 - DNA, 22 bp, Homo sapiens
gccttgccaaggggcagcagag

SEQ ID NO: 7945142 - DNA, 21 bp, Homo sapiens
gccttgccacatgtgccacag

SEQ ID NO: 7945143 - DNA, 22 bp, Homo sapiens
gccttgagaagtcctgcagtga

SEQ ID NO: 7945144 - DNA, 22 bp, Homo sapiens
gccttgatctgctgtgtttgag

SEQ ID NO: 7945145 - DNA, 22 bp, Homo sapiens
gccttctctgtgagctcctagg

SEQ ID NO: 7945146 - DNA, 17 bp, Homo sapiens
gccttctctgccctcac

SEQ ID NO: 7945147 - DNA, 22 bp, Homo sapiens
gccttccacctaggcctctgct

SEQ ID NO: 7945148 - DNA, 22 bp, Homo sapiens
gccttccacctaggcctctgct

SEQ ID NO: 7945149 - DNA, 22 bp, Homo sapiens
gccttccacctaggcctctgct

SEQ ID NO: 7945150 - DNA, 22 bp, Homo sapiens
gccttccacgtcaggggaaata

SEQ ID NO: 7945151 - DNA, 22 bp, Homo sapiens
gccttccacgtcaggggaaata

SEQ ID NO: 7945152 - DNA, 22 bp, Homo sapiens
gccttccacctaggcctctgct

SEQ ID NO: 7945153 - DNA, 22 bp, Homo sapiens
gccttccacctaggcctctgct

SEQ ID NO: 7945154 - DNA, 22 bp, Homo sapiens
gccttctctgtgagctcctagg

SEQ ID NO: 7945155 - DNA, 22 bp, Homo sapiens
gccttctctgtgagctcctagg

SEQ ID NO: 7945156 - DNA, 22 bp, Homo sapiens
gccttctgatcgctggactgac

SEQ ID NO: 7945157 - DNA, 22 bp, Homo sapiens
gccttctgatatctcttggcat

SEQ ID NO: 7945158 - DNA, 22 bp, Homo sapiens
gccttctgcgctcgtgtctccg

SEQ ID NO: 7945159 - DNA, 22 bp, Homo sapiens
gccttctgcgctcgtgtctccg

SEQ ID NO: 7945160 - DNA, 22 bp, Homo sapiens
gccttctgatcgctggactgac

SEQ ID NO: 7945161 - DNA, 22 bp, Homo sapiens
gccttctgattgctggactgac

SEQ ID NO: 7945162 - DNA, 22 bp, Homo sapiens
gccttctgattgctggactgac

SEQ ID NO: 7945163 - DNA, 22 bp, Homo sapiens
gccttctgtgctcctggccttt

SEQ ID NO: 7945164 - DNA, 22 bp, Homo sapiens
gccttgaactcatgtatattga

SEQ ID NO: 7945165 - DNA, 22 bp, Homo sapiens
gccttctgtgctcctggccttt

SEQ ID NO: 7945166 - DNA, 22 bp, Homo sapiens
gccttctgtccaaccccacgat

SEQ ID NO: 7945167 - DNA, 22 bp, Homo sapiens
gccttctgtgctcctggccttt

SEQ ID NO: 7945168 - DNA, 22 bp, Homo sapiens
gccttctgtgctcctggccttt

SEQ ID NO: 7945169 - DNA, 22 bp, Homo sapiens
gcggggggaggaacatcttgca

SEQ ID NO: 7945170 - DNA, 22 bp, Homo sapiens
gcggggggaggaacatcttgca

SEQ ID NO: 7945171 - DNA, 22 bp, Homo sapiens
gcgggggcagactgggcagttc

SEQ ID NO: 7945172 - DNA, 22 bp, Homo sapiens
gcgggggcggcgcagacctcag

SEQ ID NO: 7945173 - DNA, 22 bp, Homo sapiens
gcgggggcagactgggcagttc

SEQ ID NO: 7945174 - DNA, 22 bp, Homo sapiens
gcgggggcagactgggcagttc

SEQ ID NO: 7945175 - DNA, 22 bp, Homo sapiens
gcggggcccggacccagcctct

SEQ ID NO: 7945176 - DNA, 22 bp, Homo sapiens
gcggggcacagtgatggagcac

SEQ ID NO: 7945177 - DNA, 22 bp, Homo sapiens
gcggggccatgtccaacggcct

SEQ ID NO: 7945178 - DNA, 22 bp, Homo sapiens
gcggggcgtgctgctgctgagg

SEQ ID NO: 7945179 - DNA, 22 bp, Homo sapiens
gcggggcctgactctgacccgc

SEQ ID NO: 7945180 - DNA, 22 bp, Homo sapiens
gcggggcctgactctgacccgc

SEQ ID NO: 7945181 - DNA, 22 bp, Homo sapiens
gctatctaccaactcccattat

SEQ ID NO: 7945182 - DNA, 22 bp, Homo sapiens
gctatctctttagtactagatt

SEQ ID NO: 7945183 - DNA, 18 bp, Homo sapiens
gctatctctaagatcttt

SEQ ID NO: 7945184 - DNA, 22 bp, Homo sapiens
gctatctccctctaactttgac

SEQ ID NO: 7945185 - DNA, 22 bp, Homo sapiens
gcggggggaggaacatcttgca

SEQ ID NO: 7945186 - DNA, 22 bp, Homo sapiens
gcggggggaggaacatcttgca

SEQ ID NO: 7945187 - DNA, 22 bp, Homo sapiens
gctatacagcaggagaatggaa

SEQ ID NO: 7945188 - DNA, 22 bp, Homo sapiens
gcggggggaggaacatcttgca

SEQ ID NO: 7945189 - DNA, 22 bp, Homo sapiens
gctatcatccttgtcagtgact

SEQ ID NO: 7945190 - DNA, 22 bp, Homo sapiens
gctatcccaccaaggtcccagt

SEQ ID NO: 7945191 - DNA, 22 bp, Homo sapiens
gctcaatgctcaatgctgcaaa

SEQ ID NO: 7945192 - DNA, 22 bp, Homo sapiens
gctcacagaacttctcttccca

SEQ ID NO: 7945193 - DNA, 21 bp, Homo sapiens
gctcaagtttctctggcaaca

SEQ ID NO: 7945194 - DNA, 22 bp, Homo sapiens
gctcaagggatgggagtgggtg

SEQ ID NO: 7945195 - DNA, 22 bp, Homo sapiens
gctcaagccttctgcccacctc

SEQ ID NO: 7945196 - DNA, 22 bp, Homo sapiens
gctcaagccttctgcccacctc

SEQ ID NO: 7945197 - DNA, 22 bp, Homo sapiens
gctcaagccttctgcccacctc

SEQ ID NO: 7945198 - DNA, 22 bp, Homo sapiens
gctcaagccttctgcccacctc

SEQ ID NO: 7945199 - DNA, 22 bp, Homo sapiens
gctcaagccttctgcccacctc

SEQ ID NO: 7945200 - DNA, 22 bp, Homo sapiens
gctcaagccttctgcccacctc

SEQ ID NO: 7945201 - DNA, 22 bp, Homo sapiens
gctcaagaccaagggagcgggg

SEQ ID NO: 7945202 - DNA, 22 bp, Homo sapiens
gctcaactgctaactgttttga

SEQ ID NO: 7945203 - DNA, 22 bp, Homo sapiens
gctcaagaccagacaaagcctg

SEQ ID NO: 7945204 - DNA, 22 bp, Homo sapiens
gctcaagaccagacaaagcctg

SEQ ID NO: 7945205 - DNA, 22 bp, Homo sapiens
gctcaaatttcagactcatgaa

SEQ ID NO: 7945206 - DNA, 21 bp, Homo sapiens
gctatgaatgtagaaaattat

SEQ ID NO: 7945207 - DNA, 22 bp, Homo sapiens
gctcaagagagatgcagttctt

SEQ ID NO: 7945208 - DNA, 22 bp, Homo sapiens
gctcaagactgttagcctggca

SEQ ID NO: 7945209 - DNA, 22 bp, Homo sapiens
gctcaagacccctctgtgactg

SEQ ID NO: 7945210 - DNA, 22 bp, Homo sapiens
gctcaagccttctgcccacctc

SEQ ID NO: 7945211 - DNA, 22 bp, Homo sapiens
gctcaagatgtggcctctgaag

SEQ ID NO: 7945212 - DNA, 22 bp, Homo sapiens
gctcaagatgtggcctctgaag

SEQ ID NO: 7945213 - DNA, 22 bp, Homo sapiens
gctcaagagccagcgtctcctg

SEQ ID NO: 7945214 - DNA, 20 bp, Homo sapiens
gctcaagagcccattctgaa

SEQ ID NO: 7945215 - DNA, 22 bp, Homo sapiens
gctcacatcatagtaagctcat

SEQ ID NO: 7945216 - DNA, 22 bp, Homo sapiens
gctcacctcgctgcaggtgggt

SEQ ID NO: 7945217 - DNA, 22 bp, Homo sapiens
gctcaccttcgtccagcagccg

SEQ ID NO: 7945218 - DNA, 22 bp, Homo sapiens
gctcaccactgctagagtctat

SEQ ID NO: 7945219 - DNA, 22 bp, Homo sapiens
gctcaccaagcagagactctgg

SEQ ID NO: 7945220 - DNA, 22 bp, Homo sapiens
gctcagctgcacctggagagcc

SEQ ID NO: 7945221 - DNA, 22 bp, Homo sapiens
gctcactgcaacctccgccttc

SEQ ID NO: 7945222 - DNA, 22 bp, Homo sapiens
gctcaccttcgtccagcagccg

SEQ ID NO: 7945223 - DNA, 22 bp, Homo sapiens
gctcagctggagagggacgggt

SEQ ID NO: 7945224 - DNA, 22 bp, Homo sapiens
gctcagctggagagggacgggt

SEQ ID NO: 7945225 - DNA, 21 bp, Homo sapiens
gctcagctgcttggttcctgt

SEQ ID NO: 7945226 - DNA, 22 bp, Homo sapiens
gctcagctggaccatcgtgttt

SEQ ID NO: 7945227 - DNA, 22 bp, Homo sapiens
gctcaggcccagcggctggtgt

SEQ ID NO: 7945228 - DNA, 18 bp, Homo sapiens
gctcaggccctagtcagt

SEQ ID NO: 7945229 - DNA, 18 bp, Homo sapiens
gctcaggccctagtcagt

SEQ ID NO: 7945230 - DNA, 22 bp, Homo sapiens
gctcaggcccagcggctggtgt

SEQ ID NO: 7945231 - DNA, 22 bp, Homo sapiens
gctcaggcccagcggctggtgt

SEQ ID NO: 7945232 - DNA, 22 bp, Homo sapiens
gctcaggcccagcggctggtgt

SEQ ID NO: 7945233 - DNA, 22 bp, Homo sapiens
gctcaggcatgtatgtggttgc

SEQ ID NO: 7945234 - DNA, 22 bp, Homo sapiens
gctcacagtctggcatagtctc

SEQ ID NO: 7945235 - DNA, 22 bp, Homo sapiens
gctcacagtctgctgagtgcag

SEQ ID NO: 7945236 - DNA, 22 bp, Homo sapiens
gctcacagtctgctgagtgcag

SEQ ID NO: 7945237 - DNA, 22 bp, Homo sapiens
gctcacagtctgctgagtgcag

SEQ ID NO: 7945238 - DNA, 22 bp, Homo sapiens
gctcacagtacagtgctggctc

SEQ ID NO: 7945239 - DNA, 22 bp, Homo sapiens
gctcacagtacagtgctggctc

SEQ ID NO: 7945240 - DNA, 22 bp, Homo sapiens
gctcacaggggcagacgagttg

SEQ ID NO: 7945241 - DNA, 22 bp, Homo sapiens
gctcacaggggcagacgagttg

SEQ ID NO: 7945242 - DNA, 22 bp, Homo sapiens
gctcacaggtctgtggctattg

SEQ ID NO: 7945243 - DNA, 22 bp, Homo sapiens
gctcacagtacagtgctggctc

SEQ ID NO: 7945244 - DNA, 22 bp, Homo sapiens
gctcacagagggtgcttaatac

SEQ ID NO: 7945245 - DNA, 22 bp, Homo sapiens
gctcacagcccaggccagcgtg

SEQ ID NO: 7945246 - DNA, 23 bp, Homo sapiens
gctcacagaatgttgaagggaat

SEQ ID NO: 7945247 - DNA, 22 bp, Homo sapiens
gctcacactctgaaatttaagc

SEQ ID NO: 7945248 - DNA, 22 bp, Homo sapiens
gctcacagaacttctcttccca

SEQ ID NO: 7945249 - DNA, 22 bp, Homo sapiens
gctcacagccggctggcagggg

SEQ ID NO: 7945250 - DNA, 22 bp, Homo sapiens
gctcacagccggctggcagggg

SEQ ID NO: 7945251 - DNA, 22 bp, Homo sapiens
gctcacagccggctggcagggg

SEQ ID NO: 7945252 - DNA, 22 bp, Homo sapiens
gctcacagccggctggcagggg

SEQ ID NO: 7945253 - DNA, 22 bp, Homo sapiens
gctcacagccggctggcagggg

SEQ ID NO: 7945254 - DNA, 22 bp, Homo sapiens
gctcacagccggctggcagggg

SEQ ID NO: 7945255 - DNA, 22 bp, Homo sapiens
gctcacaggcagtgttgggaga

SEQ ID NO: 7945256 - DNA, 22 bp, Homo sapiens
gctgatgcagggttgagaggag

SEQ ID NO: 7945257 - DNA, 22 bp, Homo sapiens
gctgatggaaggacaggcgccg

SEQ ID NO: 7945258 - DNA, 23 bp, Homo sapiens
gctgatggagacttgtggcctcc

SEQ ID NO: 7945259 - DNA, 22 bp, Homo sapiens
gctgatggcttgctggctgaca

SEQ ID NO: 7945260 - DNA, 23 bp, Homo sapiens
gctgatggagacttgtggcctcc

SEQ ID NO: 7945261 - DNA, 23 bp, Homo sapiens
gctgatggagacttgtggcctcc

SEQ ID NO: 7945262 - DNA, 22 bp, Homo sapiens
gctgatggcttgctggctgaca

SEQ ID NO: 7945263 - DNA, 22 bp, Homo sapiens
gctgatgtaagacttttggttt

SEQ ID NO: 7945264 - DNA, 22 bp, Homo sapiens
gctgatgggagctggctcaccc

SEQ ID NO: 7945265 - DNA, 22 bp, Homo sapiens
gctgatgggagctggctcaccc

SEQ ID NO: 7945266 - DNA, 22 bp, Homo sapiens
gctgatgtgatgtcagaagagg

SEQ ID NO: 7945267 - DNA, 22 bp, Homo sapiens
gctgatgtttagttgatgttac

SEQ ID NO: 7945268 - DNA, 22 bp, Homo sapiens
gctgatattttgaagggcaagg

SEQ ID NO: 7945269 - DNA, 22 bp, Homo sapiens
gctgatcacatttccaaaaccc

SEQ ID NO: 7945270 - DNA, 22 bp, Homo sapiens
gctgatataaaattacagagga

SEQ ID NO: 7945271 - DNA, 22 bp, Homo sapiens
gctgatagactgaatgttggga

SEQ ID NO: 7945272 - DNA, 22 bp, Homo sapiens
gctgatatgattgataaaggta

SEQ ID NO: 7945273 - DNA, 22 bp, Homo sapiens
gctgaataatgtgtaatgtctc

SEQ ID NO: 7945274 - DNA, 22 bp, Homo sapiens
gctgaataattctttgttgtgg

SEQ ID NO: 7945275 - DNA, 22 bp, Homo sapiens
gctgaatacagcatgccttatg

SEQ ID NO: 7945276 - DNA, 22 bp, Homo sapiens
gctgaatagaagtcttcaaagg

SEQ ID NO: 7945277 - DNA, 22 bp, Homo sapiens
gctgaataggactgtcatctct

SEQ ID NO: 7945278 - DNA, 22 bp, Homo sapiens
gctgaataggcacagagggcat

SEQ ID NO: 7945279 - DNA, 22 bp, Homo sapiens
gctgcacatggcagaggccttt

SEQ ID NO: 7945280 - DNA, 22 bp, Homo sapiens
gctgcaccagctccaccagggc

SEQ ID NO: 7945281 - DNA, 22 bp, Homo sapiens
gctgcacttgagcctgggagaa

SEQ ID NO: 7945282 - DNA, 22 bp, Homo sapiens
gctgcacttgagcctgggagaa

SEQ ID NO: 7945283 - DNA, 22 bp, Homo sapiens
gctgcagaatttccttctcatt

SEQ ID NO: 7945284 - DNA, 22 bp, Homo sapiens
gctgcactttgactgctggggt

SEQ ID NO: 7945285 - DNA, 22 bp, Homo sapiens
gctgcaagttagtatacattct

SEQ ID NO: 7945286 - DNA, 22 bp, Homo sapiens
gctgcaagttagtatacattct

SEQ ID NO: 7945287 - DNA, 22 bp, Homo sapiens
gctgcaatggagtcaggctggt

SEQ ID NO: 7945288 - DNA, 22 bp, Homo sapiens
gctgcacaaagtgttggttaag

SEQ ID NO: 7945289 - DNA, 22 bp, Homo sapiens
gctgcacatggcagaggccttt

SEQ ID NO: 7945290 - DNA, 22 bp, Homo sapiens
gctgcacatggcagaggccttt

SEQ ID NO: 7945291 - DNA, 22 bp, Homo sapiens
gctgcacagacttgctcattta

SEQ ID NO: 7945292 - DNA, 22 bp, Homo sapiens
gctgcacagaacagtcattggc

SEQ ID NO: 7945293 - DNA, 22 bp, Homo sapiens
gctgattttgtcacatagcaag

SEQ ID NO: 7945294 - DNA, 22 bp, Homo sapiens
gctgattttgtcacatagcaag

SEQ ID NO: 7945295 - DNA, 22 bp, Homo sapiens
gctgattttgtcacatagcaag

SEQ ID NO: 7945296 - DNA, 22 bp, Homo sapiens
gctgattttgagaagcacagtc

SEQ ID NO: 7945297 - DNA, 22 bp, Homo sapiens
gctgattttgagaagcacagtc

SEQ ID NO: 7945298 - DNA, 22 bp, Homo sapiens
gctgattttgagaagcacagtc

SEQ ID NO: 7945299 - DNA, 22 bp, Homo sapiens
gctgattaacttcattgtagtt

SEQ ID NO: 7945300 - DNA, 22 bp, Homo sapiens
gctgattattacatgtctgtgg

SEQ ID NO: 7945301 - DNA, 22 bp, Homo sapiens
gctgattctgaggtgctttcct

SEQ ID NO: 7945302 - DNA, 22 bp, Homo sapiens
gctgcaagcatgtcatcctcac

SEQ ID NO: 7945303 - DNA, 22 bp, Homo sapiens
gctgcaagtcacagaaacagtg

SEQ ID NO: 7945304 - DNA, 22 bp, Homo sapiens
gctgcaagtcatggcttttgca

SEQ ID NO: 7945305 - DNA, 22 bp, Homo sapiens
gctgcaagtccttccctctctt

SEQ ID NO: 7945306 - DNA, 21 bp, Homo sapiens
gctgcaaattctaacaattat

SEQ ID NO: 7945307 - DNA, 22 bp, Homo sapiens
gctgcaactgttgctctctgca

SEQ ID NO: 7945308 - DNA, 22 bp, Homo sapiens
gctgcaactgttgctctctgca

SEQ ID NO: 7945309 - DNA, 22 bp, Homo sapiens
gctgaagctgcagcaggaggaa

SEQ ID NO: 7945310 - DNA, 22 bp, Homo sapiens
gctgaagctgcagcaggaggaa

SEQ ID NO: 7945311 - DNA, 22 bp, Homo sapiens
gctgaagctgcagcaggaggaa

SEQ ID NO: 7945312 - DNA, 22 bp, Homo sapiens
gctgaaggagcctggggtggga

SEQ ID NO: 7945313 - DNA, 22 bp, Homo sapiens
gctgaaggagcctggggtggga

SEQ ID NO: 7945314 - DNA, 19 bp, Homo sapiens
gctgaaggaggtgcctgca

SEQ ID NO: 7945315 - DNA, 19 bp, Homo sapiens
gctgaaggaggtgcctgca

SEQ ID NO: 7945316 - DNA, 22 bp, Homo sapiens
gctgaaggaggctctggtacta

SEQ ID NO: 7945317 - DNA, 19 bp, Homo sapiens
gctgaaggaggtgcctgca

SEQ ID NO: 7945318 - DNA, 22 bp, Homo sapiens
gctgaaggaggctctggtacta

SEQ ID NO: 7945319 - DNA, 22 bp, Homo sapiens
gctgaaggaggctctggtacta

SEQ ID NO: 7945320 - DNA, 22 bp, Homo sapiens
gctgaaggaggctctggtacta

SEQ ID NO: 7945321 - DNA, 22 bp, Homo sapiens
gctgaaggcccggaggacaggg

SEQ ID NO: 7945322 - DNA, 22 bp, Homo sapiens
gctgaaggcccggaggacaggg

SEQ ID NO: 7945323 - DNA, 22 bp, Homo sapiens
gctgaaggcccggaggacaggg

SEQ ID NO: 7945324 - DNA, 22 bp, Homo sapiens
gctgaaggcccggaggacaggg

SEQ ID NO: 7945325 - DNA, 22 bp, Homo sapiens
gctgaaggcccggaggacaggg

SEQ ID NO: 7945326 - DNA, 22 bp, Homo sapiens
gctgaagggagtgctgagtctg

SEQ ID NO: 7945327 - DNA, 22 bp, Homo sapiens
gctgaagggagtgctgagtctg

SEQ ID NO: 7945328 - DNA, 22 bp, Homo sapiens
gctgaagggagtgctgagtctg

SEQ ID NO: 7945329 - DNA, 19 bp, Homo sapiens
gctgaaggcgctcagaagc

SEQ ID NO: 7945330 - DNA, 19 bp, Homo sapiens
gctgaaggcgctcagaagc

SEQ ID NO: 7945331 - DNA, 19 bp, Homo sapiens
gctgaaggcgctcagaagc

SEQ ID NO: 7945332 - DNA, 22 bp, Homo sapiens
gctgaagctgacacatagtgct

SEQ ID NO: 7945333 - DNA, 22 bp, Homo sapiens
gctgaagctgacacatagtgct

SEQ ID NO: 7945334 - DNA, 22 bp, Homo sapiens
gctgaagctgcagcaggaggaa

SEQ ID NO: 7945335 - DNA, 20 bp, Homo sapiens
gctgaagattcccatgcaag

SEQ ID NO: 7945336 - DNA, 22 bp, Homo sapiens
gctgaagataggcatttcagca

SEQ ID NO: 7945337 - DNA, 22 bp, Homo sapiens
gctgaagataagtgaagaggct

SEQ ID NO: 7945338 - DNA, 22 bp, Homo sapiens
gctgaagataagtgaagaggct

SEQ ID NO: 7945339 - DNA, 22 bp, Homo sapiens
gctgaagggagtgctgagtctg

SEQ ID NO: 7945340 - DNA, 19 bp, Homo sapiens
gctgaaggcgctcagaagc

SEQ ID NO: 7945341 - DNA, 22 bp, Homo sapiens
gctgaagggagtgctgagtctg

SEQ ID NO: 7945342 - DNA, 20 bp, Homo sapiens
gctgaaggggtgggtttgtt

SEQ ID NO: 7945343 - DNA, 22 bp, Homo sapiens
gctgaaggtatgagttttatct

SEQ ID NO: 7945344 - DNA, 20 bp, Homo sapiens
gctgaaggggtgggtttgtt

SEQ ID NO: 7945345 - DNA, 20 bp, Homo sapiens
gctgaaggggtgggtttgtt

SEQ ID NO: 7945346 - DNA, 22 bp, Homo sapiens
gctgaaggtctctggagaggtc

SEQ ID NO: 7945347 - DNA, 22 bp, Homo sapiens
gctgaaggtctctggagaggtc

SEQ ID NO: 7945348 - DNA, 22 bp, Homo sapiens
gctgaaggtctctggagaggtc

SEQ ID NO: 7945349 - DNA, 22 bp, Homo sapiens
gctgaaggtctctggagaggtc

SEQ ID NO: 7945350 - DNA, 22 bp, Homo sapiens
gctgaaggtatgagttttatct

SEQ ID NO: 7945351 - DNA, 22 bp, Homo sapiens
gctgaaggtgtgtggagagagg

SEQ ID NO: 7945352 - DNA, 22 bp, Homo sapiens
gctgaaggtgtgtggagagagg

SEQ ID NO: 7945353 - DNA, 22 bp, Homo sapiens
gctgaaggtgtgtggagagagg

SEQ ID NO: 7945354 - DNA, 22 bp, Homo sapiens
gctgaaggtgtgtggagagagg

SEQ ID NO: 7945355 - DNA, 22 bp, Homo sapiens
gctgaaggtggttttcaagtat

SEQ ID NO: 7945356 - DNA, 22 bp, Homo sapiens
gctgaaggtggttttcaagtat

SEQ ID NO: 7945357 - DNA, 21 bp, Homo sapiens
gctgaaggtgggttgtacagg

SEQ ID NO: 7945358 - DNA, 22 bp, Homo sapiens
gctgaagttttgcagagagtaa

SEQ ID NO: 7945359 - DNA, 22 bp, Homo sapiens
gctgaataagagtctactttgc

SEQ ID NO: 7945360 - DNA, 22 bp, Homo sapiens
gctgaagtgtggagtgacagtt

SEQ ID NO: 7945361 - DNA, 22 bp, Homo sapiens
gctgccagtgtggcatgatgca

SEQ ID NO: 7945362 - DNA, 22 bp, Homo sapiens
gctgccagttccttcttactcc

SEQ ID NO: 7945363 - DNA, 22 bp, Homo sapiens
gctgccagttccttcttactcc

SEQ ID NO: 7945364 - DNA, 22 bp, Homo sapiens
gctgccatctcctgaggacagg

SEQ ID NO: 7945365 - DNA, 22 bp, Homo sapiens
gctgccatctcctgaggacagg

SEQ ID NO: 7945366 - DNA, 22 bp, Homo sapiens
gctgccatcccctgctgggctg

SEQ ID NO: 7945367 - DNA, 22 bp, Homo sapiens
gctgccatcccctgctgggctg

SEQ ID NO: 7945368 - DNA, 22 bp, Homo sapiens
gctgccagtgtggcatgatgca

SEQ ID NO: 7945369 - DNA, 22 bp, Homo sapiens
gctgccagtgtggcatgatgca

SEQ ID NO: 7945370 - DNA, 22 bp, Homo sapiens
gctgccagtgtggcatgatgca

SEQ ID NO: 7945371 - DNA, 22 bp, Homo sapiens
gctgccagtgtggcatgatgca

SEQ ID NO: 7945372 - DNA, 20 bp, Homo sapiens
gctgccagtgcctgatgctt

SEQ ID NO: 7945373 - DNA, 20 bp, Homo sapiens
gctgccagtgcctgatgctt

SEQ ID NO: 7945374 - DNA, 20 bp, Homo sapiens
gctgccagtgcctgatgctt

SEQ ID NO: 7945375 - DNA, 20 bp, Homo sapiens
gctgccagtgcctgatgctt

SEQ ID NO: 7945376 - DNA, 20 bp, Homo sapiens
gctgccagtgcctgatgctt

SEQ ID NO: 7945377 - DNA, 22 bp, Homo sapiens
gctgccagtagttggagctcca

SEQ ID NO: 7945378 - DNA, 22 bp, Homo sapiens
gctgccagtagttggagctcca

SEQ ID NO: 7945379 - DNA, 22 bp, Homo sapiens
gctgccagtagttggagctcca

SEQ ID NO: 7945380 - DNA, 22 bp, Homo sapiens
gctgccagtagttggagctcca

SEQ ID NO: 7945381 - DNA, 22 bp, Homo sapiens
gctgccagtagttggagctcca

SEQ ID NO: 7945382 - DNA, 22 bp, Homo sapiens
gctgccagtagttggagctcca

SEQ ID NO: 7945383 - DNA, 22 bp, Homo sapiens
gctgccagtagttggagctcca

SEQ ID NO: 7945384 - DNA, 22 bp, Homo sapiens
gctgccaggggcagctgtctca

SEQ ID NO: 7945385 - DNA, 22 bp, Homo sapiens
gctgccaggggcagctgtctca

SEQ ID NO: 7945386 - DNA, 22 bp, Homo sapiens
gctgccaggggcagctgtctca

SEQ ID NO: 7945387 - DNA, 22 bp, Homo sapiens
gctgccaggggcagctgtctca

SEQ ID NO: 7945388 - DNA, 20 bp, Homo sapiens
gctgccagggcggagacatc

SEQ ID NO: 7945389 - DNA, 22 bp, Homo sapiens
gctgccaggggcagctgtctca

SEQ ID NO: 7945390 - DNA, 22 bp, Homo sapiens
gctgccagggaggtggtggagg

SEQ ID NO: 7945391 - DNA, 20 bp, Homo sapiens
gctgccagggcggagacatc

SEQ ID NO: 7945392 - DNA, 22 bp, Homo sapiens
gctgccagctcactctcctgag

SEQ ID NO: 7945393 - DNA, 22 bp, Homo sapiens
gctgccagcgtcagacctgggg

SEQ ID NO: 7945394 - DNA, 22 bp, Homo sapiens
gctgccagctgcggcccacgcg

SEQ ID NO: 7945395 - DNA, 22 bp, Homo sapiens
gctgccagctcactctcctgag

SEQ ID NO: 7945396 - DNA, 22 bp, Homo sapiens
gctgccagccctcggggtctga

SEQ ID NO: 7945397 - DNA, 22 bp, Homo sapiens
gctgccagccctcggggtctga

SEQ ID NO: 7945398 - DNA, 22 bp, Homo sapiens
gctgccagcgtcagacctgggg

SEQ ID NO: 7945399 - DNA, 22 bp, Homo sapiens
gctgccagcccagcaaggtgtg

SEQ ID NO: 7945400 - DNA, 22 bp, Homo sapiens
gctgccagccagggtgggatcc

SEQ ID NO: 7945401 - DNA, 22 bp, Homo sapiens
gctgccagccagggtgggatcc

SEQ ID NO: 7945402 - DNA, 22 bp, Homo sapiens
gctgccaggccctggggctatg

SEQ ID NO: 7945403 - DNA, 22 bp, Homo sapiens
gctgccaggacggagaggagcg

SEQ ID NO: 7945404 - DNA, 22 bp, Homo sapiens
gctgccagggaggtggtggagg

SEQ ID NO: 7945405 - DNA, 22 bp, Homo sapiens
gctgccaggccctggggctatg

SEQ ID NO: 7945406 - DNA, 22 bp, Homo sapiens
gctgccagggaggtggtggagg

SEQ ID NO: 7945407 - DNA, 22 bp, Homo sapiens
gctgccagctttccttggctga

SEQ ID NO: 7945408 - DNA, 22 bp, Homo sapiens
gctgccagctttccttggctga

SEQ ID NO: 7945409 - DNA, 19 bp, Homo sapiens
gctgccaggacagttactg

SEQ ID NO: 7945410 - DNA, 19 bp, Homo sapiens
gctgccaggacagttactg

SEQ ID NO: 7945411 - DNA, 22 bp, Homo sapiens
gctgccaggacggagaggagcg

SEQ ID NO: 7945412 - DNA, 22 bp, Homo sapiens
gctgccactctgagcttgcttc

SEQ ID NO: 7945413 - DNA, 22 bp, Homo sapiens
gctgcaggtttgtctagtctgg

SEQ ID NO: 7945414 - DNA, 22 bp, Homo sapiens
gctgccagaagaggaggggtta

SEQ ID NO: 7945415 - DNA, 22 bp, Homo sapiens
gctgccacttggtcatgtcatg

SEQ ID NO: 7945416 - DNA, 22 bp, Homo sapiens
gctgccactctgagcttgcttc

SEQ ID NO: 7945417 - DNA, 22 bp, Homo sapiens
gctgccagaatgggaaatctga

SEQ ID NO: 7945418 - DNA, 22 bp, Homo sapiens
gctgccagcacagttcagctgt

SEQ ID NO: 7945419 - DNA, 22 bp, Homo sapiens
gctgccagcacagttcagctgt

SEQ ID NO: 7945420 - DNA, 22 bp, Homo sapiens
gctgccagccaacttgctgtgc

SEQ ID NO: 7945421 - DNA, 22 bp, Homo sapiens
gctgcaggatgaggctctgctc

SEQ ID NO: 7945422 - DNA, 22 bp, Homo sapiens
gctgcaggatgaggctctgctc

SEQ ID NO: 7945423 - DNA, 22 bp, Homo sapiens
gctgcaggatgaggctctgctc

SEQ ID NO: 7945424 - DNA, 22 bp, Homo sapiens
gctgcaggatgaggctctgctc

SEQ ID NO: 7945425 - DNA, 22 bp, Homo sapiens
gctgcaggttgggcaacagagt

SEQ ID NO: 7945426 - DNA, 22 bp, Homo sapiens
gctgcagggggtgggcgtctcc

SEQ ID NO: 7945427 - DNA, 22 bp, Homo sapiens
gctgcaggttgggcaacagagt

SEQ ID NO: 7945428 - DNA, 22 bp, Homo sapiens
gctgcaggagctggagctgtgg

SEQ ID NO: 7945429 - DNA, 22 bp, Homo sapiens
gctgcaggagctggagctgtgg

SEQ ID NO: 7945430 - DNA, 22 bp, Homo sapiens
gctgcaggagctggagctgtgg

SEQ ID NO: 7945431 - DNA, 22 bp, Homo sapiens
gctgcaggagctggagctgtgg

SEQ ID NO: 7945432 - DNA, 22 bp, Homo sapiens
gctgcagctttaggatccagtg

SEQ ID NO: 7945433 - DNA, 22 bp, Homo sapiens
gctgcaggagattttgagagtc

SEQ ID NO: 7945434 - DNA, 22 bp, Homo sapiens
gctgcaggagattttgagagtc

SEQ ID NO: 7945435 - DNA, 22 bp, Homo sapiens
gctgcaggagattttgagagtc

SEQ ID NO: 7945436 - DNA, 22 bp, Homo sapiens
gctgcaggagattttgagagtc

SEQ ID NO: 7945437 - DNA, 22 bp, Homo sapiens
gctgcaggagctggagctgtgg

SEQ ID NO: 7945438 - DNA, 22 bp, Homo sapiens
gctgcagctttaggatccagtg

SEQ ID NO: 7945439 - DNA, 23 bp, Homo sapiens
gctgcagctgtggatgttctcag

SEQ ID NO: 7945440 - DNA, 23 bp, Homo sapiens
gctgcagctgtggatgttctcag

SEQ ID NO: 7945441 - DNA, 22 bp, Homo sapiens
gctgcagaatttccttctcatt

SEQ ID NO: 7945442 - DNA, 22 bp, Homo sapiens
gctgcagacctcatgcaggtgg

SEQ ID NO: 7945443 - DNA, 22 bp, Homo sapiens
gctgcagactgggaggcaggtg

SEQ ID NO: 7945444 - DNA, 22 bp, Homo sapiens
gctgcagactgggaggcaggtg

SEQ ID NO: 7945445 - DNA, 22 bp, Homo sapiens
gctgcagactgggaggcaggtg

SEQ ID NO: 7945446 - DNA, 22 bp, Homo sapiens
gctcctggtctggagcttcaag

SEQ ID NO: 7945447 - DNA, 22 bp, Homo sapiens
gctcctggtctggagcttcaag

SEQ ID NO: 7945448 - DNA, 22 bp, Homo sapiens
gctcagggaactttttgcaggc

SEQ ID NO: 7945449 - DNA, 22 bp, Homo sapiens
gctcctggtgcaaagtttcttc

SEQ ID NO: 7945450 - DNA, 22 bp, Homo sapiens
gctcctggtctggagcttcaag

SEQ ID NO: 7945451 - DNA, 22 bp, Homo sapiens
gctcctggtgcaaagtttcttc

SEQ ID NO: 7945452 - DNA, 22 bp, Homo sapiens
gctcctggtgcaaagtttcttc

SEQ ID NO: 7945453 - DNA, 21 bp, Homo sapiens
gctcctggtgctgcgtggcgc

SEQ ID NO: 7945454 - DNA, 21 bp, Homo sapiens
gctcctggtgctgcgtggcgc

SEQ ID NO: 7945455 - DNA, 21 bp, Homo sapiens
gctcctggtgctgcgtggcgc

SEQ ID NO: 7945456 - DNA, 21 bp, Homo sapiens
gctcaggctcttgacagagca

SEQ ID NO: 7945457 - DNA, 22 bp, Homo sapiens
gctcaggctggattgcagtggc

SEQ ID NO: 7945458 - DNA, 19 bp, Homo sapiens
gctcaggctgtgtgtgggg

SEQ ID NO: 7945459 - DNA, 22 bp, Homo sapiens
gctcaggctggattgcagtggc

SEQ ID NO: 7945460 - DNA, 22 bp, Homo sapiens
gctcagggaaagagctcctgtc

SEQ ID NO: 7945461 - DNA, 22 bp, Homo sapiens
gctcagggaaagagctcctgtc

SEQ ID NO: 7945462 - DNA, 22 bp, Homo sapiens
gctcagggaaagagctcctgtc

SEQ ID NO: 7945463 - DNA, 22 bp, Homo sapiens
gctcagggaaagagctcctgtc

SEQ ID NO: 7945464 - DNA, 22 bp, Homo sapiens
gctcagggaaagagctcctgtc

SEQ ID NO: 7945465 - DNA, 19 bp, Homo sapiens
gctcaggctgtgtgtgggg

SEQ ID NO: 7945466 - DNA, 22 bp, Homo sapiens
gctcaggcttcttctataaaga

SEQ ID NO: 7945467 - DNA, 22 bp, Homo sapiens
gctcaggctctcccaggggaat

SEQ ID NO: 7945468 - DNA, 22 bp, Homo sapiens
gctcaggctctcccaggggaat

SEQ ID NO: 7945469 - DNA, 21 bp, Homo sapiens
gctcaggctcttgacagagca

SEQ ID NO: 7945470 - DNA, 21 bp, Homo sapiens
gctcaggctcttgacagagca

SEQ ID NO: 7945471 - DNA, 21 bp, Homo sapiens
gctcaggctcaggttcaggtt

SEQ ID NO: 7945472 - DNA, 22 bp, Homo sapiens
gctcaggctctcccaggggaat

SEQ ID NO: 7945473 - DNA, 22 bp, Homo sapiens
gctcaggctctcccaggggaat

SEQ ID NO: 7945474 - DNA, 22 bp, Homo sapiens
gctcaggcctggctatccattg

SEQ ID NO: 7945475 - DNA, 22 bp, Homo sapiens
gctcaggcctccagaggggcaa

SEQ ID NO: 7945476 - DNA, 22 bp, Homo sapiens
gctcaggcctccagaggggcaa

SEQ ID NO: 7945477 - DNA, 22 bp, Homo sapiens
gctcaggcctccagaggggcaa

SEQ ID NO: 7945478 - DNA, 18 bp, Homo sapiens
gctcaggccctagtcagt

SEQ ID NO: 7945479 - DNA, 18 bp, Homo sapiens
gctcaggccctagtcagt

SEQ ID NO: 7945480 - DNA, 22 bp, Homo sapiens
gctcaggcctcactccatttgg

SEQ ID NO: 7945481 - DNA, 22 bp, Homo sapiens
gctcaggcctccagaggggcaa

SEQ ID NO: 7945482 - DNA, 22 bp, Homo sapiens
gctcaggcctccagaggggcaa

SEQ ID NO: 7945483 - DNA, 22 bp, Homo sapiens
gctcaggcctccagaggggcaa

SEQ ID NO: 7945484 - DNA, 22 bp, Homo sapiens
gctcaggcctcggacacacaat

SEQ ID NO: 7945485 - DNA, 22 bp, Homo sapiens
gctcaggcctcggacacacaat

SEQ ID NO: 7945486 - DNA, 22 bp, Homo sapiens
gctcaggcctggcccatgggac

SEQ ID NO: 7945487 - DNA, 22 bp, Homo sapiens
gctcaggcctcggacacacaat

SEQ ID NO: 7945488 - DNA, 22 bp, Homo sapiens
gctcaggcctggcccatgggac

SEQ ID NO: 7945489 - DNA, 21 bp, Homo sapiens
gctcctggtgctgcgtggcgc

SEQ ID NO: 7945490 - DNA, 21 bp, Homo sapiens
gctcctggtgctgcgtggcgc

SEQ ID NO: 7945491 - DNA, 21 bp, Homo sapiens
gctcctggtgctgcgtggcgc

SEQ ID NO: 7945492 - DNA, 21 bp, Homo sapiens
gctcctggtgctgcgtggcgc

SEQ ID NO: 7945493 - DNA, 21 bp, Homo sapiens
gctcctggtgctgcgtggcgc

SEQ ID NO: 7945494 - DNA, 21 bp, Homo sapiens
gctcctggtgctgcgtggcgc

SEQ ID NO: 7945495 - DNA, 21 bp, Homo sapiens
gctcctggtgctgcgtggcgc

SEQ ID NO: 7945496 - DNA, 21 bp, Homo sapiens
gctcctggtgctgcgtggcgc

SEQ ID NO: 7945497 - DNA, 22 bp, Homo sapiens
gctcctggtgctgtagagattt

SEQ ID NO: 7945498 - DNA, 22 bp, Homo sapiens
gctcctggtgctgtagagattt

SEQ ID NO: 7945499 - DNA, 22 bp, Homo sapiens
gctcctggtgctgtagagattt

SEQ ID NO: 7945500 - DNA, 22 bp, Homo sapiens
gctcctggtgctgtagagattt

SEQ ID NO: 7945501 - DNA, 18 bp, Homo sapiens
gctcctggttggaaagaa

SEQ ID NO: 7945502 - DNA, 18 bp, Homo sapiens
gctcctggttggaaagaa

SEQ ID NO: 7945503 - DNA, 22 bp, Homo sapiens
gctcctggtgctgtagagattt

SEQ ID NO: 7945504 - DNA, 18 bp, Homo sapiens
gctcctggttggaaagaa

SEQ ID NO: 7945505 - DNA, 18 bp, Homo sapiens
gctcctggttggaaagaa

SEQ ID NO: 7945506 - DNA, 18 bp, Homo sapiens
gctcctggttggaaagaa

SEQ ID NO: 7945507 - DNA, 22 bp, Homo sapiens
gctcctgtcagtcatcaggtgc

SEQ ID NO: 7945508 - DNA, 20 bp, Homo sapiens
gctcctgtcctggtggaggg

SEQ ID NO: 7945509 - DNA, 22 bp, Homo sapiens
gctcctgtcttggggcactggc

SEQ ID NO: 7945510 - DNA, 22 bp, Homo sapiens
gctcctgtccttagccccagag

SEQ ID NO: 7945511 - DNA, 22 bp, Homo sapiens
gctcctgtccttagccccagag

SEQ ID NO: 7945512 - DNA, 22 bp, Homo sapiens
gctcctgtgaaggcattaggtg

SEQ ID NO: 7945513 - DNA, 22 bp, Homo sapiens
gctcctgtgaaggcattaggtg

SEQ ID NO: 7945514 - DNA, 22 bp, Homo sapiens
gctcctgtcttggggcactggc

SEQ ID NO: 7945515 - DNA, 22 bp, Homo sapiens
gctctcagaagagccaggctac

SEQ ID NO: 7945516 - DNA, 22 bp, Homo sapiens
gctctcagaagagccaggctac

SEQ ID NO: 7945517 - DNA, 22 bp, Homo sapiens
gctctcactttaggttggaccg

SEQ ID NO: 7945518 - DNA, 22 bp, Homo sapiens
gctctcactttaggttggaccg

SEQ ID NO: 7945519 - DNA, 22 bp, Homo sapiens
gctctattactttcaataaaaa

SEQ ID NO: 7945520 - DNA, 22 bp, Homo sapiens
gctctcagaagtaacttgtcca

SEQ ID NO: 7945521 - DNA, 22 bp, Homo sapiens
gctctcagaagagccaggctac

SEQ ID NO: 7945522 - DNA, 22 bp, Homo sapiens
gctctcagaagagccaggctac

SEQ ID NO: 7945523 - DNA, 22 bp, Homo sapiens
gctctcagaagagccaggctac

SEQ ID NO: 7945524 - DNA, 22 bp, Homo sapiens
gctctcagatgctccagcagcc

SEQ ID NO: 7945525 - DNA, 22 bp, Homo sapiens
gctctcagatgctccagcagcc

SEQ ID NO: 7945526 - DNA, 22 bp, Homo sapiens
gctctcagatgctccagcagcc

SEQ ID NO: 7945527 - DNA, 22 bp, Homo sapiens
gctctcagcccactgaggggaa

SEQ ID NO: 7945528 - DNA, 21 bp, Homo sapiens
gctctcagctgcctgctggtt

SEQ ID NO: 7945529 - DNA, 21 bp, Homo sapiens
gctctcagctgcctgctggtt

SEQ ID NO: 7945530 - DNA, 21 bp, Homo sapiens
gctctcagctgcctgctggtt

SEQ ID NO: 7945531 - DNA, 21 bp, Homo sapiens
gctctcagctgcctgctggtt

SEQ ID NO: 7945532 - DNA, 17 bp, Homo sapiens
gctccttctaacttcca

SEQ ID NO: 7945533 - DNA, 17 bp, Homo sapiens
gctccttctaacttcca

SEQ ID NO: 7945534 - DNA, 22 bp, Homo sapiens
gctccttcaggtggtagctgtt

SEQ ID NO: 7945535 - DNA, 22 bp, Homo sapiens
gctctattactttcaataaaaa

SEQ ID NO: 7945536 - DNA, 22 bp, Homo sapiens
gctcctgttttcttccagaaat

SEQ ID NO: 7945537 - DNA, 22 bp, Homo sapiens
gctccttcaggtggtagctgtt

SEQ ID NO: 7945538 - DNA, 22 bp, Homo sapiens
gctcctgtttgtttgttcctga

SEQ ID NO: 7945539 - DNA, 22 bp, Homo sapiens
gctccttcaggtggtagctgtt

SEQ ID NO: 7945540 - DNA, 22 bp, Homo sapiens
gctcctgtttgtttgttcctga

SEQ ID NO: 7945541 - DNA, 22 bp, Homo sapiens
gctctcaggtacaaagctgtgt

SEQ ID NO: 7945542 - DNA, 22 bp, Homo sapiens
gctctcaggtacaaagctgtgt

SEQ ID NO: 7945543 - DNA, 21 bp, Homo sapiens
gctctcagctgcctgctggtt

SEQ ID NO: 7945544 - DNA, 22 bp, Homo sapiens
gctctcagggtgatggcatact

SEQ ID NO: 7945545 - DNA, 22 bp, Homo sapiens
gctctcaggtgccactttgtgg

SEQ ID NO: 7945546 - DNA, 22 bp, Homo sapiens
gctctccaaaccctgtggcttt

SEQ ID NO: 7945547 - DNA, 21 bp, Homo sapiens
gctctccagggccagcccagg

SEQ ID NO: 7945548 - DNA, 22 bp, Homo sapiens
gctctccagattcaggagggat

SEQ ID NO: 7945549 - DNA, 21 bp, Homo sapiens
gctctccagggccagcccagg

SEQ ID NO: 7945550 - DNA, 22 bp, Homo sapiens
gctctccactgaccacggggca

SEQ ID NO: 7945551 - DNA, 22 bp, Homo sapiens
gctctccagattcaggagggat

SEQ ID NO: 7945552 - DNA, 22 bp, Homo sapiens
gctctccaaaccctgtggcttt

SEQ ID NO: 7945553 - DNA, 18 bp, Homo sapiens
gctctgcccaggctgccc

SEQ ID NO: 7945554 - DNA, 18 bp, Homo sapiens
gctctgcccaggctgccc

SEQ ID NO: 7945555 - DNA, 22 bp, Homo sapiens
gctctgcccaggaccgtccttg

SEQ ID NO: 7945556 - DNA, 22 bp, Homo sapiens
gctctgcccagtgccctgagac

SEQ ID NO: 7945557 - DNA, 18 bp, Homo sapiens
gctctgcccaggctgccc

SEQ ID NO: 7945558 - DNA, 22 bp, Homo sapiens
gctctgcccagtgccctgagac

SEQ ID NO: 7945559 - DNA, 17 bp, Homo sapiens
gctctgccccagcctct

SEQ ID NO: 7945560 - DNA, 17 bp, Homo sapiens
gctctgccccagcctct

SEQ ID NO: 7945561 - DNA, 17 bp, Homo sapiens
gctctgcctctcccacc

SEQ ID NO: 7945562 - DNA, 17 bp, Homo sapiens
gctctgcctctcccacc

SEQ ID NO: 7945563 - DNA, 22 bp, Homo sapiens
gctctgccccaggaactcagcc

SEQ ID NO: 7945564 - DNA, 17 bp, Homo sapiens
gctctgcctctcccacc

SEQ ID NO: 7945565 - DNA, 22 bp, Homo sapiens
gctctgctccctcaaatgacat

SEQ ID NO: 7945566 - DNA, 22 bp, Homo sapiens
gctctgctccctcaaatgacat

SEQ ID NO: 7945567 - DNA, 23 bp, Homo sapiens
gctctgctctgtttcatagacag

SEQ ID NO: 7945568 - DNA, 22 bp, Homo sapiens
gctctgctctaacattcctgac

SEQ ID NO: 7945569 - DNA, 22 bp, Homo sapiens
gctctgcctttgtcttacacgg

SEQ ID NO: 7945570 - DNA, 22 bp, Homo sapiens
gctctgctaatattgtagtacc

SEQ ID NO: 7945571 - DNA, 23 bp, Homo sapiens
gctctggcagcttgtgtcagcac

SEQ ID NO: 7945572 - DNA, 23 bp, Homo sapiens
gctctggcagcttgtgtcagcac

SEQ ID NO: 7945573 - DNA, 22 bp, Homo sapiens
gctctggccagaccctcagtgg

SEQ ID NO: 7945574 - DNA, 23 bp, Homo sapiens
gctctggcagcttgtgtcagcac

SEQ ID NO: 7945575 - DNA, 23 bp, Homo sapiens
gctctggcagcttgtgtcagcac

SEQ ID NO: 7945576 - DNA, 22 bp, Homo sapiens
gctctggcagctgatattagga

SEQ ID NO: 7945577 - DNA, 23 bp, Homo sapiens
gctctggcagcttgtgtcagcac

SEQ ID NO: 7945578 - DNA, 23 bp, Homo sapiens
gctctggcagcttgtgtcagcac

SEQ ID NO: 7945579 - DNA, 22 bp, Homo sapiens
gctctggcactggcgcgggatg

SEQ ID NO: 7945580 - DNA, 17 bp, Homo sapiens
gctctggcacaggattg

SEQ ID NO: 7945581 - DNA, 22 bp, Homo sapiens
gctctggcactggcgcgggatg

SEQ ID NO: 7945582 - DNA, 22 bp, Homo sapiens
gctctggcagctgatattagga

SEQ ID NO: 7945583 - DNA, 22 bp, Homo sapiens
gctctggcagctgatattagga

SEQ ID NO: 7945584 - DNA, 22 bp, Homo sapiens
gctctggcactggcgcgggatg

SEQ ID NO: 7945585 - DNA, 22 bp, Homo sapiens
gctctgctggaagttctctgga

SEQ ID NO: 7945586 - DNA, 22 bp, Homo sapiens
gctctgctggaagttctctgga

SEQ ID NO: 7945587 - DNA, 17 bp, Homo sapiens
gctctggcacaggattg

SEQ ID NO: 7945588 - DNA, 22 bp, Homo sapiens
gctctgctgaagccccttgcat

SEQ ID NO: 7945589 - DNA, 22 bp, Homo sapiens
gctctgctgaagccccttgcat

SEQ ID NO: 7945590 - DNA, 22 bp, Homo sapiens
gctctgctgaagccccttgcat

SEQ ID NO: 7945591 - DNA, 22 bp, Homo sapiens
gctctgctcttgacttaccagg

SEQ ID NO: 7945592 - DNA, 22 bp, Homo sapiens
gctctgctcttgacttaccagg

SEQ ID NO: 7945593 - DNA, 22 bp, Homo sapiens
gctctgctgatccgcagccatc

SEQ ID NO: 7945594 - DNA, 22 bp, Homo sapiens
gctctgctgcttactagatggt

SEQ ID NO: 7945595 - DNA, 22 bp, Homo sapiens
gctctggcccaaaccctttcta

SEQ ID NO: 7945596 - DNA, 22 bp, Homo sapiens
gctctggcccaaaccctttcta

SEQ ID NO: 7945597 - DNA, 21 bp, Homo sapiens
gctctggcctactgttccctc

SEQ ID NO: 7945598 - DNA, 22 bp, Homo sapiens
gctctggcccaaaccctttcta

SEQ ID NO: 7945599 - DNA, 22 bp, Homo sapiens
gctctggccagaccctcagtgg

SEQ ID NO: 7945600 - DNA, 22 bp, Homo sapiens
gctctggccagaccctcagtgg

SEQ ID NO: 7945601 - DNA, 22 bp, Homo sapiens
gctctggccagaccctcagtgg

SEQ ID NO: 7945602 - DNA, 22 bp, Homo sapiens
gctctggccagaccctcagtgg

SEQ ID NO: 7945603 - DNA, 22 bp, Homo sapiens
gctctggctactccaccctgtt

SEQ ID NO: 7945604 - DNA, 22 bp, Homo sapiens
gctctggctactccaccctgtt

SEQ ID NO: 7945605 - DNA, 21 bp, Homo sapiens
gctctggcctactgttccctc

SEQ ID NO: 7945606 - DNA, 22 bp, Homo sapiens
gctctggctactccaccctgtt

SEQ ID NO: 7945607 - DNA, 21 bp, Homo sapiens
gctctggcctactgttccctc

SEQ ID NO: 7945608 - DNA, 21 bp, Homo sapiens
gctctggcctactgttccctc

SEQ ID NO: 7945609 - DNA, 22 bp, Homo sapiens
gctctggctactccaccctgtt

SEQ ID NO: 7945610 - DNA, 22 bp, Homo sapiens
gctctggctactccaccctgtt

SEQ ID NO: 7945611 - DNA, 22 bp, Homo sapiens
gctctggctactccaccctgtt

SEQ ID NO: 7945612 - DNA, 22 bp, Homo sapiens
gctctggctactgtggctaccg

SEQ ID NO: 7945613 - DNA, 22 bp, Homo sapiens
gctctggctactccaccctgtt

SEQ ID NO: 7945614 - DNA, 22 bp, Homo sapiens
gctctggctactgtggctaccg

SEQ ID NO: 7945615 - DNA, 22 bp, Homo sapiens
gctctggctactgtggctaccg

SEQ ID NO: 7945616 - DNA, 22 bp, Homo sapiens
gctctggctactgtggctaccg

SEQ ID NO: 7945617 - DNA, 22 bp, Homo sapiens
gctgaagagacttctgttcgaa

SEQ ID NO: 7945618 - DNA, 22 bp, Homo sapiens
gctgaagagcaaggctgggtct

SEQ ID NO: 7945619 - DNA, 22 bp, Homo sapiens
ggaaagggagttttgcttatga

SEQ ID NO: 7945620 - DNA, 22 bp, Homo sapiens
ggaaagggcagaggccttggag

SEQ ID NO: 7945621 - DNA, 22 bp, Homo sapiens
ggaaagggagttttgcttatga

SEQ ID NO: 7945622 - DNA, 22 bp, Homo sapiens
ggaaaggctaacagtcatggaa

SEQ ID NO: 7945623 - DNA, 22 bp, Homo sapiens
ggaaaggctaacagtcatggaa

SEQ ID NO: 7945624 - DNA, 22 bp, Homo sapiens
ggaaaggcctgggtgtcctggg

SEQ ID NO: 7945625 - DNA, 22 bp, Homo sapiens
ggaaaggagatgaataggatta

SEQ ID NO: 7945626 - DNA, 22 bp, Homo sapiens
ggaaaggagatattggagagtg

SEQ ID NO: 7945627 - DNA, 22 bp, Homo sapiens
ggaaaggagatgaataggatta

SEQ ID NO: 7945628 - DNA, 22 bp, Homo sapiens
ggaaagctttgtacttgaaaac

SEQ ID NO: 7945629 - DNA, 22 bp, Homo sapiens
ggaaagctttgttttcctcacc

SEQ ID NO: 7945630 - DNA, 22 bp, Homo sapiens
ggaaaggagatattggagagtg

SEQ ID NO: 7945631 - DNA, 22 bp, Homo sapiens
ggaaaggagatattggagagtg

SEQ ID NO: 7945632 - DNA, 22 bp, Homo sapiens
ggaaaggagatattggagagtg

SEQ ID NO: 7945633 - DNA, 22 bp, Homo sapiens
ggaaaggagatattggagagtg

SEQ ID NO: 7945634 - DNA, 22 bp, Homo sapiens
ggaaagctcagatcttgttgga

SEQ ID NO: 7945635 - DNA, 22 bp, Homo sapiens
ggaaagctttgtacttgaaaac

SEQ ID NO: 7945636 - DNA, 22 bp, Homo sapiens
gcttcctggaacaactgttgct

SEQ ID NO: 7945637 - DNA, 22 bp, Homo sapiens
gcttcctgatattcatactgtt

SEQ ID NO: 7945638 - DNA, 22 bp, Homo sapiens
gcttcctgatattcatactgtt

SEQ ID NO: 7945639 - DNA, 22 bp, Homo sapiens
gcttcctgagtacaccctcatc

SEQ ID NO: 7945640 - DNA, 22 bp, Homo sapiens
ggaaagggcagaggccttggag

SEQ ID NO: 7945641 - DNA, 22 bp, Homo sapiens
ggaaagggcatggccttttcac

SEQ ID NO: 7945642 - DNA, 22 bp, Homo sapiens
ggaaaggggcctggatcttttg

SEQ ID NO: 7945643 - DNA, 22 bp, Homo sapiens
ggaaaggggcctggatcttttg

SEQ ID NO: 7945644 - DNA, 17 bp, Homo sapiens
ggaaaggtagagtaatc

SEQ ID NO: 7945645 - DNA, 17 bp, Homo sapiens
ggaaaggtagagtaatc

SEQ ID NO: 7945646 - DNA, 22 bp, Homo sapiens
ggaaagtccttctaaagccaga

SEQ ID NO: 7945647 - DNA, 22 bp, Homo sapiens
ggaaatacaaagatacaccact

SEQ ID NO: 7945648 - DNA, 22 bp, Homo sapiens
ggaaatacaaagatacaccact

SEQ ID NO: 7945649 - DNA, 22 bp, Homo sapiens
ggaaatataagcagtttgtgtg

SEQ ID NO: 7945650 - DNA, 22 bp, Homo sapiens
ggaaatatcttgtactatgtga

SEQ ID NO: 7945651 - DNA, 22 bp, Homo sapiens
ggaaatatcttgtactatgtga

SEQ ID NO: 7945652 - DNA, 22 bp, Homo sapiens
ggaaatattttgtctaatttgt

SEQ ID NO: 7945653 - DNA, 22 bp, Homo sapiens
ggaaatattttgtctaatttgt

SEQ ID NO: 7945654 - DNA, 22 bp, Homo sapiens
ggaaatattgattgctctgtat

SEQ ID NO: 7945655 - DNA, 22 bp, Homo sapiens
ggaaatcaaggggacaaattgt

SEQ ID NO: 7945656 - DNA, 22 bp, Homo sapiens
ggaaatattttgtctaatttgt

SEQ ID NO: 7945657 - DNA, 22 bp, Homo sapiens
ggaaatcaagaagcagatgagt

SEQ ID NO: 7945658 - DNA, 22 bp, Homo sapiens
ggaaatctcagatctcccagat

SEQ ID NO: 7945659 - DNA, 22 bp, Homo sapiens
ggaaatcatgggagagttggaa

SEQ ID NO: 7945660 - DNA, 22 bp, Homo sapiens
ggaaatcagcagatgctggtga

SEQ ID NO: 7945661 - DNA, 22 bp, Homo sapiens
ggaaatcatctgattggctttc

SEQ ID NO: 7945662 - DNA, 22 bp, Homo sapiens
ggaaatcaggggtgttgctttc

SEQ ID NO: 7945663 - DNA, 22 bp, Homo sapiens
ggaaatcaaggggacaaattgt

SEQ ID NO: 7945664 - DNA, 23 bp, Homo sapiens
gcttcccagacaatactgcttcc

SEQ ID NO: 7945665 - DNA, 22 bp, Homo sapiens
gcttcccagcagaggaaagact

SEQ ID NO: 7945666 - DNA, 22 bp, Homo sapiens
gcttcccaggcgcctgaccttt

SEQ ID NO: 7945667 - DNA, 22 bp, Homo sapiens
gcttcccaggcgcctgaccttt

SEQ ID NO: 7945668 - DNA, 20 bp, Homo sapiens
gcttcccaattcttgatctg

SEQ ID NO: 7945669 - DNA, 20 bp, Homo sapiens
gcttcccaattcttgatctg

SEQ ID NO: 7945670 - DNA, 22 bp, Homo sapiens
gcttcccaatgtgctagtttct

SEQ ID NO: 7945671 - DNA, 19 bp, Homo sapiens
gcttcccaccagccagccc

SEQ ID NO: 7945672 - DNA, 19 bp, Homo sapiens
gcttcccaccagccagccc

SEQ ID NO: 7945673 - DNA, 22 bp, Homo sapiens
gcttcccacagctggactgggg

SEQ ID NO: 7945674 - DNA, 22 bp, Homo sapiens
gcttcccacagctggactgggg

SEQ ID NO: 7945675 - DNA, 22 bp, Homo sapiens
gcttcccattatggaaactctt

SEQ ID NO: 7945676 - DNA, 22 bp, Homo sapiens
gcttcccattatggaaactctt

SEQ ID NO: 7945677 - DNA, 22 bp, Homo sapiens
gcttcccatagtggaattcggg

SEQ ID NO: 7945678 - DNA, 17 bp, Homo sapiens
gcttcccctgccctctc

SEQ ID NO: 7945679 - DNA, 17 bp, Homo sapiens
gcttcccctgccctctc

SEQ ID NO: 7945680 - DNA, 22 bp, Homo sapiens
gcttccggagccaaaaggcccc

SEQ ID NO: 7945681 - DNA, 22 bp, Homo sapiens
gcttcctcaccttctcttgcat

SEQ ID NO: 7945682 - DNA, 17 bp, Homo sapiens
gcttcctcatgcagttc

SEQ ID NO: 7945683 - DNA, 17 bp, Homo sapiens
gcttcctcatgcagttc

SEQ ID NO: 7945684 - DNA, 22 bp, Homo sapiens
gcttcctcaccttctcttgcat

SEQ ID NO: 7945685 - DNA, 22 bp, Homo sapiens
gcttcctcaccttctcttgcat

SEQ ID NO: 7945686 - DNA, 18 bp, Homo sapiens
gcttcctgaaagctgccc

SEQ ID NO: 7945687 - DNA, 22 bp, Homo sapiens
gcttcctcgctgggcagaggca

SEQ ID NO: 7945688 - DNA, 22 bp, Homo sapiens
gcttcctgagagagacagttcc

SEQ ID NO: 7945689 - DNA, 22 bp, Homo sapiens
gcttcctgagagagacagttcc

SEQ ID NO: 7945690 - DNA, 22 bp, Homo sapiens
gcttcctgagacaacattgagt

SEQ ID NO: 7945691 - DNA, 22 bp, Homo sapiens
gcttcctgagaaacaatctgat

SEQ ID NO: 7945692 - DNA, 22 bp, Homo sapiens
gcttcctgagacaacattgagt

SEQ ID NO: 7945693 - DNA, 22 bp, Homo sapiens
gcttcctccctgctgctcacta

SEQ ID NO: 7945694 - DNA, 22 bp, Homo sapiens
gcttcctccctgctgctcacta

SEQ ID NO: 7945695 - DNA, 22 bp, Homo sapiens
gcttcctcctggaggtcactca

SEQ ID NO: 7945696 - DNA, 22 bp, Homo sapiens
gcttcctcctggaggtcactca

SEQ ID NO: 7945697 - DNA, 22 bp, Homo sapiens
gcttcctccctgctgctcacta

SEQ ID NO: 7945698 - DNA, 22 bp, Homo sapiens
gcttcctccctgctgctcacta

SEQ ID NO: 7945699 - DNA, 22 bp, Homo sapiens
gcttcctccctgctgctcacta

SEQ ID NO: 7945700 - DNA, 22 bp, Homo sapiens
gcttcctccctgctgctcacta

SEQ ID NO: 7945701 - DNA, 17 bp, Homo sapiens
gcttcctcatgcagttc

SEQ ID NO: 7945702 - DNA, 22 bp, Homo sapiens
gcttcctccatctggggcttgc

SEQ ID NO: 7945703 - DNA, 22 bp, Homo sapiens
gcttcctccatctggggcttgc

SEQ ID NO: 7945704 - DNA, 21 bp, Homo sapiens
ggaacattgttaatagtctct

SEQ ID NO: 7945705 - DNA, 22 bp, Homo sapiens
ggaacatttaaattcttatttg

SEQ ID NO: 7945706 - DNA, 22 bp, Homo sapiens
ggaaccagtaactggtcattgc

SEQ ID NO: 7945707 - DNA, 22 bp, Homo sapiens
ggaaccaggagttacacgagtt

SEQ ID NO: 7945708 - DNA, 22 bp, Homo sapiens
ggaaccttcatactgtttacca

SEQ ID NO: 7945709 - DNA, 22 bp, Homo sapiens
ggaaccttattcacgccattta

SEQ ID NO: 7945710 - DNA, 23 bp, Homo sapiens
ggaaccttcttagcccctgagca

SEQ ID NO: 7945711 - DNA, 22 bp, Homo sapiens
ggaaccttagtgttcttttacc

SEQ ID NO: 7945712 - DNA, 19 bp, Homo sapiens
ggaaccttagagcttcagc

SEQ ID NO: 7945713 - DNA, 19 bp, Homo sapiens
ggaaccttagagcttcagc

SEQ ID NO: 7945714 - DNA, 22 bp, Homo sapiens
ggaaccttacctaccagtggag

SEQ ID NO: 7945715 - DNA, 22 bp, Homo sapiens
ggaacatactgtgtagactttg

SEQ ID NO: 7945716 - DNA, 21 bp, Homo sapiens
ggaacattgttaatagtctct

SEQ ID NO: 7945717 - DNA, 22 bp, Homo sapiens
ggaaatctgcattttgaacaca

SEQ ID NO: 7945718 - DNA, 22 bp, Homo sapiens
ggaaatctctactttgtcattt

SEQ ID NO: 7945719 - DNA, 22 bp, Homo sapiens
ggaaatctcttttgtggtgttt

SEQ ID NO: 7945720 - DNA, 22 bp, Homo sapiens
ggaaatctggtggtagatggga

SEQ ID NO: 7945721 - DNA, 22 bp, Homo sapiens
ggaaatctggtggtagatggga

SEQ ID NO: 7945722 - DNA, 22 bp, Homo sapiens
ggaacagggatttggcctggtt

SEQ ID NO: 7945723 - DNA, 22 bp, Homo sapiens
ggaacagttgcgtcatgggcct

SEQ ID NO: 7945724 - DNA, 21 bp, Homo sapiens
ggaagcagtggcggcaactcc

SEQ ID NO: 7945725 - DNA, 21 bp, Homo sapiens
ggaagcagtggcggcaactcc

SEQ ID NO: 7945726 - DNA, 21 bp, Homo sapiens
ggaagcagtggcggcaactcc

SEQ ID NO: 7945727 - DNA, 21 bp, Homo sapiens
ggaagcagtggcggcaactcc

SEQ ID NO: 7945728 - DNA, 22 bp, Homo sapiens
ggaaccttgataataagttgtt

SEQ ID NO: 7945729 - DNA, 22 bp, Homo sapiens
ggaaccttgctagatgctgagg

SEQ ID NO: 7945730 - DNA, 22 bp, Homo sapiens
ggaaccttgctagatgctgagg

SEQ ID NO: 7945731 - DNA, 22 bp, Homo sapiens
ggaagccaaggtggcctctatt

SEQ ID NO: 7945732 - DNA, 22 bp, Homo sapiens
ggaagccacccagctttgatag

SEQ ID NO: 7945733 - DNA, 22 bp, Homo sapiens
ggaagccagaaagtgagaatat

SEQ ID NO: 7945734 - DNA, 22 bp, Homo sapiens
ggaagccagagtgctgggcagg

SEQ ID NO: 7945735 - DNA, 22 bp, Homo sapiens
ggaagccagaaagtgagaatat

SEQ ID NO: 7945736 - DNA, 22 bp, Homo sapiens
ggaagccagagtgctgggcagg

SEQ ID NO: 7945737 - DNA, 22 bp, Homo sapiens
ggaagccaggcccagagatgct

SEQ ID NO: 7945738 - DNA, 22 bp, Homo sapiens
ggaagccaggctgggggatctg

SEQ ID NO: 7945739 - DNA, 22 bp, Homo sapiens
ggaagccaggctgggggatctg

SEQ ID NO: 7945740 - DNA, 20 bp, Homo sapiens
ggaagccagggtgcagggga

SEQ ID NO: 7945741 - DNA, 20 bp, Homo sapiens
ggaagccagggtgcagggga

SEQ ID NO: 7945742 - DNA, 22 bp, Homo sapiens
ggaagccaggccaatgagaaca

SEQ ID NO: 7945743 - DNA, 20 bp, Homo sapiens
ggaagccagcatccttgagg

SEQ ID NO: 7945744 - DNA, 20 bp, Homo sapiens
ggaagccagcatccttgagg

SEQ ID NO: 7945745 - DNA, 22 bp, Homo sapiens
ggaagccaggccaatgagaaca

SEQ ID NO: 7945746 - DNA, 20 bp, Homo sapiens
ggaagccagcatccttgagg

SEQ ID NO: 7945747 - DNA, 22 bp, Homo sapiens
ggaagccaggccaatgagaaca

SEQ ID NO: 7945748 - DNA, 22 bp, Homo sapiens
ggaagccaggccaatgagaaca

SEQ ID NO: 7945749 - DNA, 22 bp, Homo sapiens
ggaagctgttgtgagtgcagca

SEQ ID NO: 7945750 - DNA, 22 bp, Homo sapiens
ggaagctgttgtgagtgcagca

SEQ ID NO: 7945751 - DNA, 22 bp, Homo sapiens
ggaagctgttgtgagtgcagca

SEQ ID NO: 7945752 - DNA, 22 bp, Homo sapiens
ggaagctgttgtgagtgcagca

SEQ ID NO: 7945753 - DNA, 22 bp, Homo sapiens
ggaagcttcatacctttattta

SEQ ID NO: 7945754 - DNA, 22 bp, Homo sapiens
ggaagcttaatgcctaatttcc

SEQ ID NO: 7945755 - DNA, 22 bp, Homo sapiens
ggaagcttcatacctttattta

SEQ ID NO: 7945756 - DNA, 21 bp, Homo sapiens
ggaagctgtgtccatgctcct

SEQ ID NO: 7945757 - DNA, 21 bp, Homo sapiens
ggaagctgtgtccatgctcct

SEQ ID NO: 7945758 - DNA, 22 bp, Homo sapiens
ggaagctgttcctgtgtggcca

SEQ ID NO: 7945759 - DNA, 22 bp, Homo sapiens
ggaagctgttgtgagtgcagca

SEQ ID NO: 7945760 - DNA, 21 bp, Homo sapiens
ggaagctgtgtccatgctcct

SEQ ID NO: 7945761 - DNA, 17 bp, Homo sapiens
ggaagcccttctgcctg

SEQ ID NO: 7945762 - DNA, 19 bp, Homo sapiens
ggaagccctgggtcagagc

SEQ ID NO: 7945763 - DNA, 19 bp, Homo sapiens
ggaagccctaaaggaccta

SEQ ID NO: 7945764 - DNA, 22 bp, Homo sapiens
ggaagccccagcatggccttgg

SEQ ID NO: 7945765 - DNA, 22 bp, Homo sapiens
ggaagccccagctgtgggatcc

SEQ ID NO: 7945766 - DNA, 22 bp, Homo sapiens
ggaagccccagcatggccttgg

SEQ ID NO: 7945767 - DNA, 22 bp, Homo sapiens
ggaagccccagacccagagtct

SEQ ID NO: 7945768 - DNA, 22 bp, Homo sapiens
ggaagcccagctgtctcctgtc

SEQ ID NO: 7945769 - DNA, 22 bp, Homo sapiens
ggaagcccagctgtctcctgtc

SEQ ID NO: 7945770 - DNA, 22 bp, Homo sapiens
ggaagccatgagggacagttct

SEQ ID NO: 7945771 - DNA, 22 bp, Homo sapiens
ggaagccataccctgatttctg

SEQ ID NO: 7945772 - DNA, 22 bp, Homo sapiens
ggaagccagttgcttggtgtgg

SEQ ID NO: 7945773 - DNA, 22 bp, Homo sapiens
ggaagccataccctgatttctg

SEQ ID NO: 7945774 - DNA, 22 bp, Homo sapiens
ggaagccagttgcttggtgtgg

SEQ ID NO: 7945775 - DNA, 22 bp, Homo sapiens
ggaaggaagtgaccaggatatc

SEQ ID NO: 7945776 - DNA, 22 bp, Homo sapiens
ggaaggaagtgaccaggatatc

SEQ ID NO: 7945777 - DNA, 22 bp, Homo sapiens
ggaaggaagtgaccaggatatc

SEQ ID NO: 7945778 - DNA, 23 bp, Homo sapiens
ggacacatttatttcagaattca

SEQ ID NO: 7945779 - DNA, 21 bp, Homo sapiens
ggacaccagtcacactggatt

SEQ ID NO: 7945780 - DNA, 22 bp, Homo sapiens
ggaaggaagtaaatgatgctat

SEQ ID NO: 7945781 - DNA, 22 bp, Homo sapiens
ggaaggaagtaaatgatgctat

SEQ ID NO: 7945782 - DNA, 22 bp, Homo sapiens
ggaaggaagaggaccgagctgg

SEQ ID NO: 7945783 - DNA, 22 bp, Homo sapiens
ggaaggaagtaaatgatgctat

SEQ ID NO: 7945784 - DNA, 22 bp, Homo sapiens
ggaaggaagattctaactggag

SEQ ID NO: 7945785 - DNA, 22 bp, Homo sapiens
ggaaggaagaggaccgagctgg

SEQ ID NO: 7945786 - DNA, 22 bp, Homo sapiens
ggaaggaagaggaccgagctgg

SEQ ID NO: 7945787 - DNA, 18 bp, Homo sapiens
ggaaggaagaatgcattt

SEQ ID NO: 7945788 - DNA, 18 bp, Homo sapiens
ggaaggaagaatgcattt

SEQ ID NO: 7945789 - DNA, 22 bp, Homo sapiens
ggaaggaacaaaccctgtgtgg

SEQ ID NO: 7945790 - DNA, 22 bp, Homo sapiens
ggaaggaacaaaccctgtgtgg

SEQ ID NO: 7945791 - DNA, 22 bp, Homo sapiens
ggaaggaacaaaccctgtgtgg

SEQ ID NO: 7945792 - DNA, 18 bp, Homo sapiens
ggaaggaagaatgcattt

SEQ ID NO: 7945793 - DNA, 22 bp, Homo sapiens
ggaagctttctctgtttcctta

SEQ ID NO: 7945794 - DNA, 22 bp, Homo sapiens
ggaaggaaagcagcttggccct

SEQ ID NO: 7945795 - DNA, 22 bp, Homo sapiens
ggaaggaaattggggcagttgt

SEQ ID NO: 7945796 - DNA, 22 bp, Homo sapiens
ggaaggaaattggggcagttgt

SEQ ID NO: 7945797 - DNA, 22 bp, Homo sapiens
ggaaggaaattggggcagttgt

SEQ ID NO: 7945798 - DNA, 22 bp, Homo sapiens
ggaaggaaattggggcagttgt

SEQ ID NO: 7945799 - DNA, 22 bp, Homo sapiens
ggaccggtggcttcctcgggtc

SEQ ID NO: 7945800 - DNA, 22 bp, Homo sapiens
ggacctgccagaactcaggcta

SEQ ID NO: 7945801 - DNA, 22 bp, Homo sapiens
ggacctgccagaactcaggcta

SEQ ID NO: 7945802 - DNA, 22 bp, Homo sapiens
ggacctgccagaactcaggcta

SEQ ID NO: 7945803 - DNA, 22 bp, Homo sapiens
ggaccctgtaaagtcgtgtcca

SEQ ID NO: 7945804 - DNA, 22 bp, Homo sapiens
ggaccctgtaaagtcgtgtcca

SEQ ID NO: 7945805 - DNA, 23 bp, Homo sapiens
ggaccctgtggagggtgagagtc

SEQ ID NO: 7945806 - DNA, 23 bp, Homo sapiens
ggaccctgtggagggtgagagtc

SEQ ID NO: 7945807 - DNA, 23 bp, Homo sapiens
ggaccctgtggagggtgagagtc

SEQ ID NO: 7945808 - DNA, 22 bp, Homo sapiens
ggacccttggcttctgcagatt

SEQ ID NO: 7945809 - DNA, 23 bp, Homo sapiens
ggaccctgtggagggtgagagtc

SEQ ID NO: 7945810 - DNA, 22 bp, Homo sapiens
ggaccctgggcagctggctgct

SEQ ID NO: 7945811 - DNA, 22 bp, Homo sapiens
ggaccctgggctctgggcctat

SEQ ID NO: 7945812 - DNA, 22 bp, Homo sapiens
ggaccctgggctctgggcctat

SEQ ID NO: 7945813 - DNA, 22 bp, Homo sapiens
ggaccctgggcttgctcctggg

SEQ ID NO: 7945814 - DNA, 22 bp, Homo sapiens
ggaccctgggcttgctcctggg

SEQ ID NO: 7945815 - DNA, 22 bp, Homo sapiens
ggaccctgggcttgctcctggg

SEQ ID NO: 7945816 - DNA, 22 bp, Homo sapiens
ggaccctgggcttgctcctggg

SEQ ID NO: 7945817 - DNA, 22 bp, Homo sapiens
ggaccctggagacccactggga

SEQ ID NO: 7945818 - DNA, 22 bp, Homo sapiens
ggaccctgggcagctggctgct

SEQ ID NO: 7945819 - DNA, 22 bp, Homo sapiens
ggaccctgggcagctggctgct

SEQ ID NO: 7945820 - DNA, 22 bp, Homo sapiens
ggaccctgggcagctggctgct

SEQ ID NO: 7945821 - DNA, 22 bp, Homo sapiens
ggaccctggagacccactggga

SEQ ID NO: 7945822 - DNA, 22 bp, Homo sapiens
ggaccctggagacccactggga

SEQ ID NO: 7945823 - DNA, 22 bp, Homo sapiens
ggacccaggtagggaggaagat

SEQ ID NO: 7945824 - DNA, 22 bp, Homo sapiens
ggaccctgcgtgtatccacact

SEQ ID NO: 7945825 - DNA, 18 bp, Homo sapiens
ggacccagggcctcaccc

SEQ ID NO: 7945826 - DNA, 18 bp, Homo sapiens
ggacccagggcctcaccc

SEQ ID NO: 7945827 - DNA, 18 bp, Homo sapiens
ggacccagggcctcaccc

SEQ ID NO: 7945828 - DNA, 22 bp, Homo sapiens
ggacccaggtagggaggaagat

SEQ ID NO: 7945829 - DNA, 22 bp, Homo sapiens
ggacccaggtagggaggaagat

SEQ ID NO: 7945830 - DNA, 22 bp, Homo sapiens
ggacccagctctgagaccctgc

SEQ ID NO: 7945831 - DNA, 22 bp, Homo sapiens
ggacccagctctgagaccctgc

SEQ ID NO: 7945832 - DNA, 22 bp, Homo sapiens
ggacccagaggggagtctggca

SEQ ID NO: 7945833 - DNA, 22 bp, Homo sapiens
ggacccaggaattaattaagag

SEQ ID NO: 7945834 - DNA, 18 bp, Homo sapiens
ggacccagggcctcaccc

SEQ ID NO: 7945835 - DNA, 18 bp, Homo sapiens
ggacccagggcctcaccc

SEQ ID NO: 7945836 - DNA, 22 bp, Homo sapiens
ggacccagctctgagaccctgc

SEQ ID NO: 7945837 - DNA, 22 bp, Homo sapiens
ggacccagctctgagaccctgc

SEQ ID NO: 7945838 - DNA, 22 bp, Homo sapiens
ggacccagctctgagaccctgc

SEQ ID NO: 7945839 - DNA, 22 bp, Homo sapiens
ggacagagggcaggagcccaga

SEQ ID NO: 7945840 - DNA, 22 bp, Homo sapiens
ggacagagggcaggagcccaga

SEQ ID NO: 7945841 - DNA, 22 bp, Homo sapiens
ggacagagggcaggagcccaga

SEQ ID NO: 7945842 - DNA, 21 bp, Homo sapiens
ggacagaggagaaggcaccct

SEQ ID NO: 7945843 - DNA, 22 bp, Homo sapiens
ggacagagggcaggagcccaga

SEQ ID NO: 7945844 - DNA, 22 bp, Homo sapiens
ggacagagggcaggagcccaga

SEQ ID NO: 7945845 - DNA, 22 bp, Homo sapiens
ggacagagggcaggagcccaga

SEQ ID NO: 7945846 - DNA, 22 bp, Homo sapiens
ggacagagggcaggagcccaga

SEQ ID NO: 7945847 - DNA, 22 bp, Homo sapiens
ggacagagggcaggagcccaga

SEQ ID NO: 7945848 - DNA, 22 bp, Homo sapiens
ggacccaccaggccgggctcca

SEQ ID NO: 7945849 - DNA, 22 bp, Homo sapiens
ggacactgaagaatctcagatg

SEQ ID NO: 7945850 - DNA, 21 bp, Homo sapiens
ggacactgataatcttgttgc

SEQ ID NO: 7945851 - DNA, 22 bp, Homo sapiens
ggacactgaagaatctcagatg

SEQ ID NO: 7945852 - DNA, 21 bp, Homo sapiens
ggacactgataatcttgttgc

SEQ ID NO: 7945853 - DNA, 23 bp, Homo sapiens
ggacactgctataaaggatctgc

SEQ ID NO: 7945854 - DNA, 23 bp, Homo sapiens
ggacactgctataaaggatctgc

SEQ ID NO: 7945855 - DNA, 17 bp, Homo sapiens
ggacacctggagtctcc

SEQ ID NO: 7945856 - DNA, 22 bp, Homo sapiens
ggacacgtggctgaaggcggcc

SEQ ID NO: 7945857 - DNA, 22 bp, Homo sapiens
ggacacgatttattgctaaggg

SEQ ID NO: 7945858 - DNA, 22 bp, Homo sapiens
ggacacgtggctgaaggcggcc

SEQ ID NO: 7945859 - DNA, 22 bp, Homo sapiens
ggacactgttcatggggagggg

SEQ ID NO: 7945860 - DNA, 23 bp, Homo sapiens
ggacactgtgcagatgctagtgc

SEQ ID NO: 7945861 - DNA, 22 bp, Homo sapiens
ggacactgtataagttagagta

SEQ ID NO: 7945862 - DNA, 23 bp, Homo sapiens
ggacactgtgcagatgctagtgc

SEQ ID NO: 7945863 - DNA, 22 bp, Homo sapiens
ggacactggccacatttcaaaa

SEQ ID NO: 7945864 - DNA, 20 bp, Homo sapiens
ggacactgtagatttcaaac

SEQ ID NO: 7945865 - DNA, 22 bp, Homo sapiens
ggacactgtataagttagagta

SEQ ID NO: 7945866 - DNA, 22 bp, Homo sapiens
ggacactgtataagttagagta

SEQ ID NO: 7945867 - DNA, 22 bp, Homo sapiens
ggacagaaaccatatgagtgta

SEQ ID NO: 7945868 - DNA, 22 bp, Homo sapiens
ggacagaaattcttgttggaca

SEQ ID NO: 7945869 - DNA, 22 bp, Homo sapiens
ggacactgttcatggggagggg

SEQ ID NO: 7945870 - DNA, 22 bp, Homo sapiens
ggacactgttcatggggagggg

SEQ ID NO: 7945871 - DNA, 22 bp, Homo sapiens
ggacactgtataagttagagta

SEQ ID NO: 7945872 - DNA, 22 bp, Homo sapiens
ggacagagccctggtggcctaa

SEQ ID NO: 7945873 - DNA, 22 bp, Homo sapiens
ggacagagccctggtggcctaa

SEQ ID NO: 7945874 - DNA, 22 bp, Homo sapiens
ggacagagccctggtggcctaa

SEQ ID NO: 7945875 - DNA, 22 bp, Homo sapiens
ggacagagccctggtggcctaa

SEQ ID NO: 7945876 - DNA, 22 bp, Homo sapiens
ggacagagccctggtggcctaa

SEQ ID NO: 7945877 - DNA, 22 bp, Homo sapiens
ggacagagccctggtggcctaa

SEQ ID NO: 7945878 - DNA, 22 bp, Homo sapiens
ggacagagccctggtggcctaa

SEQ ID NO: 7945879 - DNA, 19 bp, Homo sapiens
ggacagacgcagagatctg

SEQ ID NO: 7945880 - DNA, 19 bp, Homo sapiens
ggacagacgcagagatctg

SEQ ID NO: 7945881 - DNA, 22 bp, Homo sapiens
ggacagacagtgtgagtgaggc

SEQ ID NO: 7945882 - DNA, 22 bp, Homo sapiens
ggacagagcagacgagcagcgg

SEQ ID NO: 7945883 - DNA, 22 bp, Homo sapiens
ggacagagcagacgagcagcgg

SEQ ID NO: 7945884 - DNA, 22 bp, Homo sapiens
ggacagagcagacgagcagcgg

SEQ ID NO: 7945885 - DNA, 22 bp, Homo sapiens
ggacagagcagacgagcagcgg

SEQ ID NO: 7945886 - DNA, 22 bp, Homo sapiens
ggacagagcagacgagcagcgg

SEQ ID NO: 7945887 - DNA, 22 bp, Homo sapiens
ggacagagagtgaatatgacat

SEQ ID NO: 7945888 - DNA, 22 bp, Homo sapiens
ggacagagagtgaatatgacat

SEQ ID NO: 7945889 - DNA, 22 bp, Homo sapiens
ggacagagagtgaatatgacat

SEQ ID NO: 7945890 - DNA, 22 bp, Homo sapiens
ggagagagatgccgccttgctc

SEQ ID NO: 7945891 - DNA, 22 bp, Homo sapiens
ggagagagatgccgccttgctc

SEQ ID NO: 7945892 - DNA, 22 bp, Homo sapiens
ggagagagatgccgccttgctc

SEQ ID NO: 7945893 - DNA, 22 bp, Homo sapiens
ggactgaggcccacttgaggga

SEQ ID NO: 7945894 - DNA, 22 bp, Homo sapiens
ggactgcaacaggcttattcaa

SEQ ID NO: 7945895 - DNA, 22 bp, Homo sapiens
ggactgaggcccacttgaggga

SEQ ID NO: 7945896 - DNA, 22 bp, Homo sapiens
ggactgaggcccacttgaggga

SEQ ID NO: 7945897 - DNA, 22 bp, Homo sapiens
ggagagaggagcccactgctgt

SEQ ID NO: 7945898 - DNA, 22 bp, Homo sapiens
ggagagctggtagctggctcca

SEQ ID NO: 7945899 - DNA, 22 bp, Homo sapiens
ggagagagatgccgccttgctc

SEQ ID NO: 7945900 - DNA, 22 bp, Homo sapiens
ggagagagatgccgccttgctc

SEQ ID NO: 7945901 - DNA, 22 bp, Homo sapiens
ggagagaggagcccactgctgt

SEQ ID NO: 7945902 - DNA, 22 bp, Homo sapiens
ggagagaggagcccactgctgt

SEQ ID NO: 7945903 - DNA, 22 bp, Homo sapiens
ggactgaggacatgtgaggcat

SEQ ID NO: 7945904 - DNA, 22 bp, Homo sapiens
ggactgaggacatgtgaggcat

SEQ ID NO: 7945905 - DNA, 22 bp, Homo sapiens
ggactgaggacatgtgaggcat

SEQ ID NO: 7945906 - DNA, 22 bp, Homo sapiens
ggactgaggacatgtgaggcat

SEQ ID NO: 7945907 - DNA, 22 bp, Homo sapiens
ggactgaggacatgtgaggcat

SEQ ID NO: 7945908 - DNA, 22 bp, Homo sapiens
ggactgaggacatgtgaggcat

SEQ ID NO: 7945909 - DNA, 22 bp, Homo sapiens
ggactgaggacatgtgaggcat

SEQ ID NO: 7945910 - DNA, 19 bp, Homo sapiens
ggacctggcaatctgcatt

SEQ ID NO: 7945911 - DNA, 22 bp, Homo sapiens
ggaccttcctggctcctggggt

SEQ ID NO: 7945912 - DNA, 22 bp, Homo sapiens
ggacctggcaatttgcatctct

SEQ ID NO: 7945913 - DNA, 22 bp, Homo sapiens
ggacctggcaatttgcatctct

SEQ ID NO: 7945914 - DNA, 22 bp, Homo sapiens
ggacgcagccgagggagcaggg

SEQ ID NO: 7945915 - DNA, 22 bp, Homo sapiens
ggacgcagccgagggagcaggg

SEQ ID NO: 7945916 - DNA, 22 bp, Homo sapiens
ggacgcagccgagggagcaggg

SEQ ID NO: 7945917 - DNA, 22 bp, Homo sapiens
ggacgcttaccagtaacgactt

SEQ ID NO: 7945918 - DNA, 22 bp, Homo sapiens
ggacgcagcgagggaagcagcc

SEQ ID NO: 7945919 - DNA, 22 bp, Homo sapiens
ggacggctctctggcactgtgg

SEQ ID NO: 7945920 - DNA, 22 bp, Homo sapiens
ggacgcagcgagggaagcagcc

SEQ ID NO: 7945921 - DNA, 22 bp, Homo sapiens
ggacgcagcgagggaagcagcc

SEQ ID NO: 7945922 - DNA, 22 bp, Homo sapiens
ggacgcagcgagggaagcagcc

SEQ ID NO: 7945923 - DNA, 22 bp, Homo sapiens
ggacgcagcgagggaagcagcc

SEQ ID NO: 7945924 - DNA, 22 bp, Homo sapiens
ggacggggagctggaaagggga

SEQ ID NO: 7945925 - DNA, 22 bp, Homo sapiens
ggacggggagctggaaagggga

SEQ ID NO: 7945926 - DNA, 22 bp, Homo sapiens
ggacggggagctggaaagggga

SEQ ID NO: 7945927 - DNA, 20 bp, Homo sapiens
ggactacaatttgcagtgtg

SEQ ID NO: 7945928 - DNA, 22 bp, Homo sapiens
ggactcctctagaagttgaggc

SEQ ID NO: 7945929 - DNA, 22 bp, Homo sapiens
ggactcctctagaagttgaggc

SEQ ID NO: 7945930 - DNA, 22 bp, Homo sapiens
ggactctggctcagtgttgctt

SEQ ID NO: 7945931 - DNA, 22 bp, Homo sapiens
ggactctgtagaggttctcatt

SEQ ID NO: 7945932 - DNA, 22 bp, Homo sapiens
ggactctggtatttcactcttg

SEQ ID NO: 7945933 - DNA, 22 bp, Homo sapiens
ggagagctggtatatgaagaca

SEQ ID NO: 7945934 - DNA, 22 bp, Homo sapiens
ggagagaggagcccactgctgt

SEQ ID NO: 7945935 - DNA, 22 bp, Homo sapiens
ggagagctggtatatgaagaca

SEQ ID NO: 7945936 - DNA, 22 bp, Homo sapiens
ggagagcttggagtgcgatttt

SEQ ID NO: 7945937 - DNA, 22 bp, Homo sapiens
ggagagcttggagtgcgatttt

SEQ ID NO: 7945938 - DNA, 22 bp, Homo sapiens
ggagagcttggagtgcgatttt

SEQ ID NO: 7945939 - DNA, 22 bp, Homo sapiens
ggagaggaaatgccagcacttc

SEQ ID NO: 7945940 - DNA, 22 bp, Homo sapiens
ggagaggaaatgccagcacttc

SEQ ID NO: 7945941 - DNA, 22 bp, Homo sapiens
ggagaggaaatgccagcacttc

SEQ ID NO: 7945942 - DNA, 22 bp, Homo sapiens
ggagaggaaatgccagcacttc

SEQ ID NO: 7945943 - DNA, 22 bp, Homo sapiens
ggagaggaaatgccagcacttc

SEQ ID NO: 7945944 - DNA, 22 bp, Homo sapiens
ggagaggagattgtggcatttt

SEQ ID NO: 7945945 - DNA, 22 bp, Homo sapiens
ggagaggagctattgggggctc

SEQ ID NO: 7945946 - DNA, 22 bp, Homo sapiens
ggagaggagctattgggggctc

SEQ ID NO: 7945947 - DNA, 22 bp, Homo sapiens
ggagaggagctattgggggctc

SEQ ID NO: 7945948 - DNA, 22 bp, Homo sapiens
ggagaggacatggctcccacag

SEQ ID NO: 7945949 - DNA, 22 bp, Homo sapiens
ggagaggcgatgagtcacagcc

SEQ ID NO: 7945950 - DNA, 22 bp, Homo sapiens
ggagaggcgatgagtcacagcc

SEQ ID NO: 7945951 - DNA, 22 bp, Homo sapiens
ggagaggcgatgagtcacagcc

SEQ ID NO: 7945952 - DNA, 22 bp, Homo sapiens
ggagaggcgatgagtcacagcc

SEQ ID NO: 7945953 - DNA, 22 bp, Homo sapiens
ggagaggcgatgagtcacagcc

SEQ ID NO: 7945954 - DNA, 22 bp, Homo sapiens
ggagaggcgatgagtcacagcc

SEQ ID NO: 7945955 - DNA, 22 bp, Homo sapiens
ggagaggcgatgagtcacagcc

SEQ ID NO: 7945956 - DNA, 22 bp, Homo sapiens
ggagaggatgttttagtaactt

SEQ ID NO: 7945957 - DNA, 22 bp, Homo sapiens
ggagaggagctattgggggctc

SEQ ID NO: 7945958 - DNA, 22 bp, Homo sapiens
ggagaggagctattgggggctc

SEQ ID NO: 7945959 - DNA, 22 bp, Homo sapiens
ggagaggcttccagagtcgtgc

SEQ ID NO: 7945960 - DNA, 22 bp, Homo sapiens
ggagaggcttccagagtcgtgc

SEQ ID NO: 7945961 - DNA, 22 bp, Homo sapiens
ggagaggcttccagagtcgtgc

SEQ ID NO: 7945962 - DNA, 22 bp, Homo sapiens
ggagaggcttccagagtcgtgc

SEQ ID NO: 7945963 - DNA, 19 bp, Homo sapiens
ggagaggctggagggatgc

SEQ ID NO: 7945964 - DNA, 19 bp, Homo sapiens
ggagaggctggagggatgc

SEQ ID NO: 7945965 - DNA, 19 bp, Homo sapiens
ggagaggctggagggatgc

SEQ ID NO: 7945966 - DNA, 19 bp, Homo sapiens
ggagaggctggagggatgc

SEQ ID NO: 7945967 - DNA, 19 bp, Homo sapiens
ggagaggctggagggatgc

SEQ ID NO: 7945968 - DNA, 22 bp, Homo sapiens
gctgggaggatctctccctgtc

SEQ ID NO: 7945969 - DNA, 22 bp, Homo sapiens
gctgggaggatctctccctgtc

SEQ ID NO: 7945970 - DNA, 22 bp, Homo sapiens
gctgggagcaaagccatgcata

SEQ ID NO: 7945971 - DNA, 22 bp, Homo sapiens
gctgggagcaaagccatgcata

SEQ ID NO: 7945972 - DNA, 22 bp, Homo sapiens
gctgggagaggccctgaagtga

SEQ ID NO: 7945973 - DNA, 22 bp, Homo sapiens
gctgggagaggccctgaagtga

SEQ ID NO: 7945974 - DNA, 22 bp, Homo sapiens
gctgggagcaaagccatgcata

SEQ ID NO: 7945975 - DNA, 22 bp, Homo sapiens
gctgggagcaaagccatgcata

SEQ ID NO: 7945976 - DNA, 22 bp, Homo sapiens
gctgggagaggccctgaagtga

SEQ ID NO: 7945977 - DNA, 22 bp, Homo sapiens
gctgggagacagacttggaacc

SEQ ID NO: 7945978 - DNA, 22 bp, Homo sapiens
gctgggagacagacttggaacc

SEQ ID NO: 7945979 - DNA, 22 bp, Homo sapiens
gctgggagaggccctgaagtga

SEQ ID NO: 7945980 - DNA, 22 bp, Homo sapiens
gctgggagaggccctgaagtga

SEQ ID NO: 7945981 - DNA, 22 bp, Homo sapiens
gctgggagaggccctgaagtga

SEQ ID NO: 7945982 - DNA, 22 bp, Homo sapiens
gctgggagaggcagctttcgga

SEQ ID NO: 7945983 - DNA, 22 bp, Homo sapiens
gctgggagacagacttggaacc

SEQ ID NO: 7945984 - DNA, 22 bp, Homo sapiens
gctgggacggctcagtaagaag

SEQ ID NO: 7945985 - DNA, 22 bp, Homo sapiens
gctgggacggctcagtaagaag

SEQ ID NO: 7945986 - DNA, 22 bp, Homo sapiens
gctgggactgagacagtgacct

SEQ ID NO: 7945987 - DNA, 22 bp, Homo sapiens
gctgggactgagacagtgacct

SEQ ID NO: 7945988 - DNA, 22 bp, Homo sapiens
gctgggacaggcttggccctgt

SEQ ID NO: 7945989 - DNA, 22 bp, Homo sapiens
gctgggacaggcttggccctgt

SEQ ID NO: 7945990 - DNA, 20 bp, Homo sapiens
gctgggacgcccggtccgga

SEQ ID NO: 7945991 - DNA, 22 bp, Homo sapiens
gctgggacggctcagtaagaag

SEQ ID NO: 7945992 - DNA, 22 bp, Homo sapiens
gctgggacaggcttggccctgt

SEQ ID NO: 7945993 - DNA, 22 bp, Homo sapiens
gctgggaatgattttggagagg

SEQ ID NO: 7945994 - DNA, 22 bp, Homo sapiens
gctgggaagtggcagagctgga

SEQ ID NO: 7945995 - DNA, 22 bp, Homo sapiens
gctgggacaggcttggccctgt

SEQ ID NO: 7945996 - DNA, 22 bp, Homo sapiens
gctgggacaacaggtgagcacc

SEQ ID NO: 7945997 - DNA, 22 bp, Homo sapiens
gctgggaagtgcaagatcaagg

SEQ ID NO: 7945998 - DNA, 22 bp, Homo sapiens
gctgggaagagatgcacatgat

SEQ ID NO: 7945999 - DNA, 22 bp, Homo sapiens
gctgggaagagatgcacatgat

SEQ ID NO: 7946000 - DNA, 22 bp, Homo sapiens
gctgggaagagatgcacatgat

SEQ ID NO: 7946001 - DNA, 22 bp, Homo sapiens
gctgggaagtgcaagatcaagg

SEQ ID NO: 7946002 - DNA, 22 bp, Homo sapiens
gctgggaagtgcaagatcaagg

SEQ ID NO: 7946003 - DNA, 22 bp, Homo sapiens
gctgggaagtggcagagctgga

SEQ ID NO: 7946004 - DNA, 22 bp, Homo sapiens
gctgggaagtggcagagctgga

SEQ ID NO: 7946005 - DNA, 22 bp, Homo sapiens
gctgggaagtggcagagctgga

SEQ ID NO: 7946006 - DNA, 22 bp, Homo sapiens
gctgggaagaacaggagagaat

SEQ ID NO: 7946007 - DNA, 22 bp, Homo sapiens
gctgggaaccatgggaaggcag

SEQ ID NO: 7946008 - DNA, 22 bp, Homo sapiens
gctgggaaccatgggaaggcag

SEQ ID NO: 7946009 - DNA, 22 bp, Homo sapiens
gctgggaaccatgggaaggcag

SEQ ID NO: 7946010 - DNA, 22 bp, Homo sapiens
gctgggaagaacaggagagaat

SEQ ID NO: 7946011 - DNA, 22 bp, Homo sapiens
gctggctctacatttgaggtca

SEQ ID NO: 7946012 - DNA, 21 bp, Homo sapiens
gctggctctctgacgtgcttt

SEQ ID NO: 7946013 - DNA, 22 bp, Homo sapiens
gctggctctcctcacagtacag

SEQ ID NO: 7946014 - DNA, 22 bp, Homo sapiens
gctggctctcctcacagtacag

SEQ ID NO: 7946015 - DNA, 22 bp, Homo sapiens
gctggctctcctcacagtacag

SEQ ID NO: 7946016 - DNA, 22 bp, Homo sapiens
gctggctctcctcacagtacag

SEQ ID NO: 7946017 - DNA, 21 bp, Homo sapiens
gctggctctctgacgtgcttt

SEQ ID NO: 7946018 - DNA, 21 bp, Homo sapiens
gctggctctctgacgtgcttt

SEQ ID NO: 7946019 - DNA, 22 bp, Homo sapiens
gctggctcccattggtccttcc

SEQ ID NO: 7946020 - DNA, 22 bp, Homo sapiens
gctggctcccattggtccttcc

SEQ ID NO: 7946021 - DNA, 22 bp, Homo sapiens
gctggctcccattggtccttcc

SEQ ID NO: 7946022 - DNA, 22 bp, Homo sapiens
gctggctcccattggtccttcc

SEQ ID NO: 7946023 - DNA, 22 bp, Homo sapiens
gctggctcctctgtcctcacgg

SEQ ID NO: 7946024 - DNA, 22 bp, Homo sapiens
gctggctcggatttgaacagga

SEQ ID NO: 7946025 - DNA, 22 bp, Homo sapiens
gctggctcggatttgaacagga

SEQ ID NO: 7946026 - DNA, 22 bp, Homo sapiens
gctggctcggatttgaacagga

SEQ ID NO: 7946027 - DNA, 22 bp, Homo sapiens
gctggctcctctgtcctcacgg

SEQ ID NO: 7946028 - DNA, 22 bp, Homo sapiens
gctggctcctctgtcctcacgg

SEQ ID NO: 7946029 - DNA, 22 bp, Homo sapiens
gctggctcgggaagcaggggat

SEQ ID NO: 7946030 - DNA, 22 bp, Homo sapiens
gctggctcgggaagcaggggat

SEQ ID NO: 7946031 - DNA, 22 bp, Homo sapiens
gctggctctgatgggctccagg

SEQ ID NO: 7946032 - DNA, 22 bp, Homo sapiens
gctggctctgatgggctccagg

SEQ ID NO: 7946033 - DNA, 22 bp, Homo sapiens
gctggctctgatgggctccagg

SEQ ID NO: 7946034 - DNA, 22 bp, Homo sapiens
gctggctctgatgggctccagg

SEQ ID NO: 7946035 - DNA, 22 bp, Homo sapiens
gctggctctgatgggctccagg

SEQ ID NO: 7946036 - DNA, 22 bp, Homo sapiens
gctggctctgcacccaggcctc

SEQ ID NO: 7946037 - DNA, 22 bp, Homo sapiens
gctggctctgcacccaggcctc

SEQ ID NO: 7946038 - DNA, 22 bp, Homo sapiens
gctggctctgcacccaggcctc

SEQ ID NO: 7946039 - DNA, 22 bp, Homo sapiens
gctggctctgatgggctccagg

SEQ ID NO: 7946040 - DNA, 22 bp, Homo sapiens
gctggctctgcacccaggcctc

SEQ ID NO: 7946041 - DNA, 22 bp, Homo sapiens
gctggctctgatgggctccagg

SEQ ID NO: 7946042 - DNA, 22 bp, Homo sapiens
gctggctctgccccacctgttc

SEQ ID NO: 7946043 - DNA, 22 bp, Homo sapiens
gctggctctgccccacctgttc

SEQ ID NO: 7946044 - DNA, 22 bp, Homo sapiens
gctggctctgcacccaggcctc

SEQ ID NO: 7946045 - DNA, 22 bp, Homo sapiens
gctggctctgcacccaggcctc

SEQ ID NO: 7946046 - DNA, 22 bp, Homo sapiens
gctggctctgcacccaggcctc

SEQ ID NO: 7946047 - DNA, 22 bp, Homo sapiens
gctggctctgtggtagttggca

SEQ ID NO: 7946048 - DNA, 22 bp, Homo sapiens
gctggctctgccccacctgttc

SEQ ID NO: 7946049 - DNA, 22 bp, Homo sapiens
gctggctcttcagtggagatag

SEQ ID NO: 7946050 - DNA, 22 bp, Homo sapiens
gctggctcttcagtggagatag

SEQ ID NO: 7946051 - DNA, 22 bp, Homo sapiens
gctggctctgtggtagttggca

SEQ ID NO: 7946052 - DNA, 22 bp, Homo sapiens
gctggctcttcagtggagatag

SEQ ID NO: 7946053 - DNA, 22 bp, Homo sapiens
gctggctgccaatttcagagct

SEQ ID NO: 7946054 - DNA, 22 bp, Homo sapiens
gctggctgcagattttagaggt

SEQ ID NO: 7946055 - DNA, 22 bp, Homo sapiens
gctggctgcagattttagaggt

SEQ ID NO: 7946056 - DNA, 22 bp, Homo sapiens
gctggctgcagattttagaggt

SEQ ID NO: 7946057 - DNA, 18 bp, Homo sapiens
gctggctgcacttctgct

SEQ ID NO: 7946058 - DNA, 22 bp, Homo sapiens
gctggctgccttactttgtgga

SEQ ID NO: 7946059 - DNA, 22 bp, Homo sapiens
gctggctgccttactttgtgga

SEQ ID NO: 7946060 - DNA, 22 bp, Homo sapiens
gctggctgccttactttgtgga

SEQ ID NO: 7946061 - DNA, 22 bp, Homo sapiens
gctggctgccaatttcagagct

SEQ ID NO: 7946062 - DNA, 22 bp, Homo sapiens
gctggctgccaatttcagagct

SEQ ID NO: 7946063 - DNA, 18 bp, Homo sapiens
gctggctgcacttctgct

SEQ ID NO: 7946064 - DNA, 18 bp, Homo sapiens
gctggctgcacttctgct

SEQ ID NO: 7946065 - DNA, 18 bp, Homo sapiens
gctggctgcacttctgct

SEQ ID NO: 7946066 - DNA, 18 bp, Homo sapiens
gctggctgcacttctgct

SEQ ID NO: 7946067 - DNA, 22 bp, Homo sapiens
gctggctgcacaggggctcact

SEQ ID NO: 7946068 - DNA, 22 bp, Homo sapiens
gctggctgcacaggggctcact

SEQ ID NO: 7946069 - DNA, 22 bp, Homo sapiens
gctggctgcacaggggctcact

SEQ ID NO: 7946070 - DNA, 22 bp, Homo sapiens
gctggctgcacaggggctcact

SEQ ID NO: 7946071 - DNA, 22 bp, Homo sapiens
gctggctcttcagtggagatag

SEQ ID NO: 7946072 - DNA, 22 bp, Homo sapiens
gctggctgcacaggggctcact

SEQ ID NO: 7946073 - DNA, 22 bp, Homo sapiens
gctggctgcacaggggctcact

SEQ ID NO: 7946074 - DNA, 22 bp, Homo sapiens
gctggctgagttctgtcgtctg

SEQ ID NO: 7946075 - DNA, 22 bp, Homo sapiens
gctggctgcacaggggctcact

SEQ ID NO: 7946076 - DNA, 22 bp, Homo sapiens
gctggctcttcagtggagatag

SEQ ID NO: 7946077 - DNA, 21 bp, Homo sapiens
gctgcccaaccctgcatctcc

SEQ ID NO: 7946078 - DNA, 21 bp, Homo sapiens
gctgcccaaccctgcatctcc

SEQ ID NO: 7946079 - DNA, 22 bp, Homo sapiens
gctgcccaatggtagtgtcttt

SEQ ID NO: 7946080 - DNA, 22 bp, Homo sapiens
gctgcccaatggtagtgtcttt

SEQ ID NO: 7946081 - DNA, 22 bp, Homo sapiens
gctggattggagcaatagagtc

SEQ ID NO: 7946082 - DNA, 22 bp, Homo sapiens
gctggattggagcaatagagtc

SEQ ID NO: 7946083 - DNA, 22 bp, Homo sapiens
gctggatttagggttccctcct

SEQ ID NO: 7946084 - DNA, 22 bp, Homo sapiens
gctggatttagggttccctcct

SEQ ID NO: 7946085 - DNA, 22 bp, Homo sapiens
gctggcaatggtgtggtctggt

SEQ ID NO: 7946086 - DNA, 22 bp, Homo sapiens
gctggcaaggtgctggagggcc

SEQ ID NO: 7946087 - DNA, 22 bp, Homo sapiens
gctgccatgttgtgaggacact

SEQ ID NO: 7946088 - DNA, 22 bp, Homo sapiens
gctgccatggcctcctgcaagg

SEQ ID NO: 7946089 - DNA, 22 bp, Homo sapiens
gctgccatgttgtgaggacact

SEQ ID NO: 7946090 - DNA, 22 bp, Homo sapiens
gctgccatgccacagcactcac

SEQ ID NO: 7946091 - DNA, 22 bp, Homo sapiens
gctgccatggcctcctgcaagg

SEQ ID NO: 7946092 - DNA, 22 bp, Homo sapiens
gctgccatggctgggggccgtg

SEQ ID NO: 7946093 - DNA, 22 bp, Homo sapiens
gctggcactgggaaggactgag

SEQ ID NO: 7946094 - DNA, 22 bp, Homo sapiens
gctggcactgggaaggactgag

SEQ ID NO: 7946095 - DNA, 22 bp, Homo sapiens
gctggcactgggaaggactgag

SEQ ID NO: 7946096 - DNA, 22 bp, Homo sapiens
gctggcacatggctcagggcct

SEQ ID NO: 7946097 - DNA, 22 bp, Homo sapiens
gctggcacacagtacacgcctt

SEQ ID NO: 7946098 - DNA, 22 bp, Homo sapiens
gctggcacatggctcagggcct

SEQ ID NO: 7946099 - DNA, 22 bp, Homo sapiens
gctggcacatggctcagggcct

SEQ ID NO: 7946100 - DNA, 22 bp, Homo sapiens
gctggcacctatttggacctgg

SEQ ID NO: 7946101 - DNA, 22 bp, Homo sapiens
gctggcacatggctcagggcct

SEQ ID NO: 7946102 - DNA, 22 bp, Homo sapiens
gctggcacatggctcagggcct

SEQ ID NO: 7946103 - DNA, 22 bp, Homo sapiens
gctggcagacttcctctggaac

SEQ ID NO: 7946104 - DNA, 22 bp, Homo sapiens
gctggcagacttcctctggaac

SEQ ID NO: 7946105 - DNA, 22 bp, Homo sapiens
gctggcagacttcctctggaac

SEQ ID NO: 7946106 - DNA, 22 bp, Homo sapiens
gctggcagacttcctctggaac

SEQ ID NO: 7946107 - DNA, 22 bp, Homo sapiens
gctggcagacttcctctggaac

SEQ ID NO: 7946108 - DNA, 22 bp, Homo sapiens
gctggcagacttcctctggaac

SEQ ID NO: 7946109 - DNA, 22 bp, Homo sapiens
gctggcagacttcctctggaac

SEQ ID NO: 7946110 - DNA, 22 bp, Homo sapiens
gctggcagacttcctctggaac

SEQ ID NO: 7946111 - DNA, 22 bp, Homo sapiens
gctggcagacttcctctggaac

SEQ ID NO: 7946112 - DNA, 22 bp, Homo sapiens
gctggcagacttcctctggaac

SEQ ID NO: 7946113 - DNA, 22 bp, Homo sapiens
gctggcagactgggggcagaac

SEQ ID NO: 7946114 - DNA, 22 bp, Homo sapiens
gctggcagactgggggcagaac

SEQ ID NO: 7946115 - DNA, 22 bp, Homo sapiens
gctggcagactgggggcagaac

SEQ ID NO: 7946116 - DNA, 22 bp, Homo sapiens
gctggcagactgggggcagaac

SEQ ID NO: 7946117 - DNA, 22 bp, Homo sapiens
gctggcagactgggggcagaac

SEQ ID NO: 7946118 - DNA, 22 bp, Homo sapiens
gctggcagactgggggcagaac

SEQ ID NO: 7946119 - DNA, 19 bp, Homo sapiens
gctggcagaattttgaacc

SEQ ID NO: 7946120 - DNA, 22 bp, Homo sapiens
gctggcagaatttcttcttgct

SEQ ID NO: 7946121 - DNA, 22 bp, Homo sapiens
gctggcagaatttcttcttgct

SEQ ID NO: 7946122 - DNA, 22 bp, Homo sapiens
gctggcagaatttcttcttgct

SEQ ID NO: 7946123 - DNA, 22 bp, Homo sapiens
gctggcagaatttcttcttgct

SEQ ID NO: 7946124 - DNA, 22 bp, Homo sapiens
gctggcagaagagctggttcaa

SEQ ID NO: 7946125 - DNA, 22 bp, Homo sapiens
gctggcagaagagctggttcaa

SEQ ID NO: 7946126 - DNA, 22 bp, Homo sapiens
gctggcagaagagctggttcaa

SEQ ID NO: 7946127 - DNA, 22 bp, Homo sapiens
gctggcagaagagctggttcaa

SEQ ID NO: 7946128 - DNA, 22 bp, Homo sapiens
gctggcagaagagctggttcaa

SEQ ID NO: 7946129 - DNA, 22 bp, Homo sapiens
gctggcagggacagctgcgtgt

SEQ ID NO: 7946130 - DNA, 22 bp, Homo sapiens
gctggcagggacagctgcgtgt

SEQ ID NO: 7946131 - DNA, 22 bp, Homo sapiens
gctggcagggacagctgcgtgt

SEQ ID NO: 7946132 - DNA, 22 bp, Homo sapiens
gctggcagggacagctgcgtgt

SEQ ID NO: 7946133 - DNA, 22 bp, Homo sapiens
gctggcagggacagctgcgtgt

SEQ ID NO: 7946134 - DNA, 22 bp, Homo sapiens
gctggcagggacagctgcgtgt

SEQ ID NO: 7946135 - DNA, 22 bp, Homo sapiens
gctggcagggacagctgcgtgt

SEQ ID NO: 7946136 - DNA, 22 bp, Homo sapiens
gctggcagggacagctgcgtgt

SEQ ID NO: 7946137 - DNA, 21 bp, Homo sapiens
gctggctcaaatgcttgtgtc

SEQ ID NO: 7946138 - DNA, 21 bp, Homo sapiens
gctggctcaaatgcttgtgtc

SEQ ID NO: 7946139 - DNA, 22 bp, Homo sapiens
gctggctcaagaggtccagagg

SEQ ID NO: 7946140 - DNA, 21 bp, Homo sapiens
gctggctcaaatgcttgtgtc

SEQ ID NO: 7946141 - DNA, 21 bp, Homo sapiens
gctggctcaaatgcttgtgtc

SEQ ID NO: 7946142 - DNA, 22 bp, Homo sapiens
gctggctcaagaggtccagagg

SEQ ID NO: 7946143 - DNA, 22 bp, Homo sapiens
gctggctcaagaggtccagagg

SEQ ID NO: 7946144 - DNA, 22 bp, Homo sapiens
gctggctcaagtgtgcttccca

SEQ ID NO: 7946145 - DNA, 22 bp, Homo sapiens
gctggctcaagtgtgcttccca

SEQ ID NO: 7946146 - DNA, 22 bp, Homo sapiens
gctggctcaagtgtgcttccca

SEQ ID NO: 7946147 - DNA, 22 bp, Homo sapiens
gctggctcaagtgtgcttccca

SEQ ID NO: 7946148 - DNA, 22 bp, Homo sapiens
gctggctcaagtgtgcttccca

SEQ ID NO: 7946149 - DNA, 22 bp, Homo sapiens
gctggctcaagtgtgcttccca

SEQ ID NO: 7946150 - DNA, 22 bp, Homo sapiens
gctggctcaagtgtgcttccca

SEQ ID NO: 7946151 - DNA, 22 bp, Homo sapiens
gctggctcaagtgtgcttccca

SEQ ID NO: 7946152 - DNA, 22 bp, Homo sapiens
gctggctcagggactagagttt

SEQ ID NO: 7946153 - DNA, 22 bp, Homo sapiens
gctggctcagggactagagttt

SEQ ID NO: 7946154 - DNA, 22 bp, Homo sapiens
gctggctcagggggattagcaa

SEQ ID NO: 7946155 - DNA, 22 bp, Homo sapiens
gctggctccaaaagcaggggct

SEQ ID NO: 7946156 - DNA, 22 bp, Homo sapiens
gctggctcagggggattagcaa

SEQ ID NO: 7946157 - DNA, 22 bp, Homo sapiens
gctggctcagggggattagcaa

SEQ ID NO: 7946158 - DNA, 22 bp, Homo sapiens
gctggctcagggggattagcaa

SEQ ID NO: 7946159 - DNA, 22 bp, Homo sapiens
gctggctccaaaagcaggggct

SEQ ID NO: 7946160 - DNA, 22 bp, Homo sapiens
gctggctcccagaggccccagc

SEQ ID NO: 7946161 - DNA, 22 bp, Homo sapiens
gctggctcccagaggccccagc

SEQ ID NO: 7946162 - DNA, 22 bp, Homo sapiens
gctggctcccagaggccccagc

SEQ ID NO: 7946163 - DNA, 22 bp, Homo sapiens
gctggctcccagaggccccagc

SEQ ID NO: 7946164 - DNA, 22 bp, Homo sapiens
gctggctcccagaggccccagc

SEQ ID NO: 7946165 - DNA, 22 bp, Homo sapiens
gctggctcccagaggccccagc

SEQ ID NO: 7946166 - DNA, 22 bp, Homo sapiens
gctggcaggatagaagtctaat

SEQ ID NO: 7946167 - DNA, 22 bp, Homo sapiens
gctggcaggatagaagtctaat

SEQ ID NO: 7946168 - DNA, 22 bp, Homo sapiens
gctggcaggagcctttcccttt

SEQ ID NO: 7946169 - DNA, 22 bp, Homo sapiens
gctggcaggataacttctaagc

SEQ ID NO: 7946170 - DNA, 22 bp, Homo sapiens
gctggcaggataacttctaagc

SEQ ID NO: 7946171 - DNA, 22 bp, Homo sapiens
gctggcaggagaccatacccta

SEQ ID NO: 7946172 - DNA, 22 bp, Homo sapiens
gctggcaggagcctttcccttt

SEQ ID NO: 7946173 - DNA, 22 bp, Homo sapiens
gctggcaggagaaacggggtgc

SEQ ID NO: 7946174 - DNA, 22 bp, Homo sapiens
gctggcaggagaccatacccta

SEQ ID NO: 7946175 - DNA, 22 bp, Homo sapiens
gctggcaggagaaacggggtgc

SEQ ID NO: 7946176 - DNA, 22 bp, Homo sapiens
gctggcaggagaaacggggtgc

SEQ ID NO: 7946177 - DNA, 22 bp, Homo sapiens
gctggcagagacaagaagacta

SEQ ID NO: 7946178 - DNA, 22 bp, Homo sapiens
gctggcagagacaagaagacta

SEQ ID NO: 7946179 - DNA, 22 bp, Homo sapiens
gctggcagagagctggtgagga

SEQ ID NO: 7946180 - DNA, 22 bp, Homo sapiens
gctggcagagacaagaagacta

SEQ ID NO: 7946181 - DNA, 22 bp, Homo sapiens
gctggcagagacaagaagacta

SEQ ID NO: 7946182 - DNA, 22 bp, Homo sapiens
gctggcagagacaagaagacta

SEQ ID NO: 7946183 - DNA, 22 bp, Homo sapiens
gctggcaggagaaacggggtgc

SEQ ID NO: 7946184 - DNA, 22 bp, Homo sapiens
gctggcagctggaagttgggct

SEQ ID NO: 7946185 - DNA, 22 bp, Homo sapiens
gctggcagctggaagttgggct

SEQ ID NO: 7946186 - DNA, 22 bp, Homo sapiens
gctggcagccaagtgaagaggg

SEQ ID NO: 7946187 - DNA, 22 bp, Homo sapiens
gctggcagctggaagttgggct

SEQ ID NO: 7946188 - DNA, 22 bp, Homo sapiens
gctggcagctggaagttgggct

SEQ ID NO: 7946189 - DNA, 20 bp, Homo sapiens
gcttcatttgcaagtctagt

SEQ ID NO: 7946190 - DNA, 22 bp, Homo sapiens
gcttccaaacaaaattttgatg

SEQ ID NO: 7946191 - DNA, 22 bp, Homo sapiens
gcttcattttgccctctggtgg

SEQ ID NO: 7946192 - DNA, 22 bp, Homo sapiens
gcttccaaatctgttcaaaatg

SEQ ID NO: 7946193 - DNA, 21 bp, Homo sapiens
gcttccaagatggcaccttga

SEQ ID NO: 7946194 - DNA, 22 bp, Homo sapiens
gcttccaagcggtagatagcat

SEQ ID NO: 7946195 - DNA, 21 bp, Homo sapiens
gcttccaagatggcaccttga

SEQ ID NO: 7946196 - DNA, 22 bp, Homo sapiens
gcttccacctactaaatgccac

SEQ ID NO: 7946197 - DNA, 22 bp, Homo sapiens
gcttccagtaactcttgaaagg

SEQ ID NO: 7946198 - DNA, 22 bp, Homo sapiens
gcttccagtaactcttgaaagg

SEQ ID NO: 7946199 - DNA, 22 bp, Homo sapiens
gcttccagtaagttgctgccat

SEQ ID NO: 7946200 - DNA, 22 bp, Homo sapiens
gcttccagtaagttgctgccat

SEQ ID NO: 7946201 - DNA, 22 bp, Homo sapiens
gcttccagtaagttgctgccat

SEQ ID NO: 7946202 - DNA, 22 bp, Homo sapiens
gcttccagtaactcttgaaagg

SEQ ID NO: 7946203 - DNA, 22 bp, Homo sapiens
gcttccacctactaaatgccac

SEQ ID NO: 7946204 - DNA, 22 bp, Homo sapiens
gcttccaatgcttctatcacat

SEQ ID NO: 7946205 - DNA, 22 bp, Homo sapiens
gcttccaatgcttctatcacat

SEQ ID NO: 7946206 - DNA, 22 bp, Homo sapiens
gcttccaagtcaatcaatgctg

SEQ ID NO: 7946207 - DNA, 22 bp, Homo sapiens
gcttccaagcggtagatagcat

SEQ ID NO: 7946208 - DNA, 22 bp, Homo sapiens
gcttccagtcctcagaggctgg

SEQ ID NO: 7946209 - DNA, 22 bp, Homo sapiens
gcttccagtcctcagaggctgg

SEQ ID NO: 7946210 - DNA, 22 bp, Homo sapiens
gcttccagtcctcagaggctgg

SEQ ID NO: 7946211 - DNA, 22 bp, Homo sapiens
gcttccagtaagttgctgccat

SEQ ID NO: 7946212 - DNA, 22 bp, Homo sapiens
gcttccagtaagttgctgccat

SEQ ID NO: 7946213 - DNA, 22 bp, Homo sapiens
gcttccagtaagttgctgccat

SEQ ID NO: 7946214 - DNA, 22 bp, Homo sapiens
gcttccagtgactttggtcgtg

SEQ ID NO: 7946215 - DNA, 16 bp, Homo sapiens
gcttccagtttagtgg

SEQ ID NO: 7946216 - DNA, 16 bp, Homo sapiens
gcttccagtttagtgg

SEQ ID NO: 7946217 - DNA, 22 bp, Homo sapiens
gcttccagtgactttggtcgtg

SEQ ID NO: 7946218 - DNA, 22 bp, Homo sapiens
gcttccagtcctcagaggctgg

SEQ ID NO: 7946219 - DNA, 22 bp, Homo sapiens
gcttccagtcctcagaggctgg

SEQ ID NO: 7946220 - DNA, 22 bp, Homo sapiens
gcttccagtcctcagaggctgg

SEQ ID NO: 7946221 - DNA, 22 bp, Homo sapiens
gcttcccaaacttgtggataga

SEQ ID NO: 7946222 - DNA, 22 bp, Homo sapiens
gcttcccaaacttgtggataga

SEQ ID NO: 7946223 - DNA, 22 bp, Homo sapiens
gcttccatttgctaggggattt

SEQ ID NO: 7946224 - DNA, 22 bp, Homo sapiens
gcttccagtcctcagaggctgg

SEQ ID NO: 7946225 - DNA, 22 bp, Homo sapiens
gctgtgcatcttcattctggac

SEQ ID NO: 7946226 - DNA, 22 bp, Homo sapiens
gctgtgcatggagggccgttca

SEQ ID NO: 7946227 - DNA, 22 bp, Homo sapiens
gctgtgcattgagcctgagagt

SEQ ID NO: 7946228 - DNA, 20 bp, Homo sapiens
gctgtgccatgaccctcgag

SEQ ID NO: 7946229 - DNA, 22 bp, Homo sapiens
gctgtgcataagtataataaac

SEQ ID NO: 7946230 - DNA, 22 bp, Homo sapiens
gctgtgcagtgggagttcggtg

SEQ ID NO: 7946231 - DNA, 22 bp, Homo sapiens
gctgtgcagtctttggtgtgcc

SEQ ID NO: 7946232 - DNA, 22 bp, Homo sapiens
gctgtgcccagctccagctctg

SEQ ID NO: 7946233 - DNA, 22 bp, Homo sapiens
gctgtgcccatattctgctgac

SEQ ID NO: 7946234 - DNA, 22 bp, Homo sapiens
gctgtgcccatattctgctgac

SEQ ID NO: 7946235 - DNA, 22 bp, Homo sapiens
gctgtgcccatattctgctgac

SEQ ID NO: 7946236 - DNA, 22 bp, Homo sapiens
gctgtgcccatattctgctgac

SEQ ID NO: 7946237 - DNA, 22 bp, Homo sapiens
gctgtgcccagccattctagat

SEQ ID NO: 7946238 - DNA, 22 bp, Homo sapiens
gctgtgcccagctccagctctg

SEQ ID NO: 7946239 - DNA, 22 bp, Homo sapiens
gctgtgcccagccattctagat

SEQ ID NO: 7946240 - DNA, 22 bp, Homo sapiens
gctgtgcccagctccagctctg

SEQ ID NO: 7946241 - DNA, 22 bp, Homo sapiens
gctgtgcccagctccagctctg

SEQ ID NO: 7946242 - DNA, 22 bp, Homo sapiens
gctgtgcagccaagtgcctctg

SEQ ID NO: 7946243 - DNA, 22 bp, Homo sapiens
gctgtgcagccaagtgcctctg

SEQ ID NO: 7946244 - DNA, 22 bp, Homo sapiens
gctgtgcaggggatttggttat

SEQ ID NO: 7946245 - DNA, 21 bp, Homo sapiens
gctgtgcaggattgaaagcag

SEQ ID NO: 7946246 - DNA, 22 bp, Homo sapiens
gctgtgcaggtccccactgcct

SEQ ID NO: 7946247 - DNA, 22 bp, Homo sapiens
gctgtgcaggtccccactgcct

SEQ ID NO: 7946248 - DNA, 21 bp, Homo sapiens
gctgtgcaggtgcccctgctc

SEQ ID NO: 7946249 - DNA, 21 bp, Homo sapiens
gctgtgcaggtgcccctgctc

SEQ ID NO: 7946250 - DNA, 22 bp, Homo sapiens
gctgtgcagtagtaggtacagt

SEQ ID NO: 7946251 - DNA, 22 bp, Homo sapiens
gctgtgagccgctgctgagcat

SEQ ID NO: 7946252 - DNA, 22 bp, Homo sapiens
gctgtgagccgctgctgagcat

SEQ ID NO: 7946253 - DNA, 22 bp, Homo sapiens
gctgtgagcactgctgggtgga

SEQ ID NO: 7946254 - DNA, 22 bp, Homo sapiens
gctgtgagctgcctgtgtcaca

SEQ ID NO: 7946255 - DNA, 22 bp, Homo sapiens
gctgtgagccgctgctgagcat

SEQ ID NO: 7946256 - DNA, 22 bp, Homo sapiens
gctgtgagctgcctgtgtcaca

SEQ ID NO: 7946257 - DNA, 22 bp, Homo sapiens
gctgtgagaaacagggagtgtc

SEQ ID NO: 7946258 - DNA, 22 bp, Homo sapiens
gctgtgagaaacagggagtgtc

SEQ ID NO: 7946259 - DNA, 22 bp, Homo sapiens
gctgtgagcactgctgggtgga

SEQ ID NO: 7946260 - DNA, 22 bp, Homo sapiens
gctgtgagcactgctgggtgga

SEQ ID NO: 7946261 - DNA, 22 bp, Homo sapiens
gctgtcttttcctggcagtaaa

SEQ ID NO: 7946262 - DNA, 22 bp, Homo sapiens
gctgtcttgtatgttgtaggac

SEQ ID NO: 7946263 - DNA, 22 bp, Homo sapiens
gctgtcttgtatgttgtaggac

SEQ ID NO: 7946264 - DNA, 22 bp, Homo sapiens
gctgtctttcccctgctccaga

SEQ ID NO: 7946265 - DNA, 22 bp, Homo sapiens
gctgtcttgatgattggatgct

SEQ ID NO: 7946266 - DNA, 22 bp, Homo sapiens
gctgtcttgatgattggatgct

SEQ ID NO: 7946267 - DNA, 22 bp, Homo sapiens
gctgtcttgctcactcttgcag

SEQ ID NO: 7946268 - DNA, 22 bp, Homo sapiens
gctgtcttgggtagaaagaggt

SEQ ID NO: 7946269 - DNA, 22 bp, Homo sapiens
gctgtcttggaaaaggcaaaga

SEQ ID NO: 7946270 - DNA, 22 bp, Homo sapiens
gctgtcttgctcactcttgcag

SEQ ID NO: 7946271 - DNA, 22 bp, Homo sapiens
gctgtgagtggaggaggctgag

SEQ ID NO: 7946272 - DNA, 22 bp, Homo sapiens
gctgtgagtggaggaggctgag

SEQ ID NO: 7946273 - DNA, 22 bp, Homo sapiens
gctgtgagtggaggaggctgag

SEQ ID NO: 7946274 - DNA, 22 bp, Homo sapiens
gctgtgagtgagctgcctaggc

SEQ ID NO: 7946275 - DNA, 22 bp, Homo sapiens
gctgtgagtacaaggccctggg

SEQ ID NO: 7946276 - DNA, 22 bp, Homo sapiens
gctgtgagggtctagtgaggtg

SEQ ID NO: 7946277 - DNA, 22 bp, Homo sapiens
gctgtgagggtctagtgaggtg

SEQ ID NO: 7946278 - DNA, 22 bp, Homo sapiens
gctgtgagggtctagtgaggtg

SEQ ID NO: 7946279 - DNA, 22 bp, Homo sapiens
gctgtgagggcttctgaggcat

SEQ ID NO: 7946280 - DNA, 22 bp, Homo sapiens
gctgtgagggcttctgaggcat

SEQ ID NO: 7946281 - DNA, 22 bp, Homo sapiens
gctgtgagggcttctgaggcat

SEQ ID NO: 7946282 - DNA, 22 bp, Homo sapiens
gctgtgagctgcctgtgtcaca

SEQ ID NO: 7946283 - DNA, 22 bp, Homo sapiens
gctgtgagggcttctgaggcat

SEQ ID NO: 7946284 - DNA, 22 bp, Homo sapiens
gctgtgagggcttctgaggcat

SEQ ID NO: 7946285 - DNA, 22 bp, Homo sapiens
gctgtgataaatgcagatgtca

SEQ ID NO: 7946286 - DNA, 22 bp, Homo sapiens
gctgtgagtggagttctgtgct

SEQ ID NO: 7946287 - DNA, 22 bp, Homo sapiens
gctgtgatccttgagagaaggt

SEQ ID NO: 7946288 - DNA, 22 bp, Homo sapiens
gctgtgatgtggagggtgctga

SEQ ID NO: 7946289 - DNA, 22 bp, Homo sapiens
gctgtgattgtcagtcttcaat

SEQ ID NO: 7946290 - DNA, 21 bp, Homo sapiens
gctgtgcacatagtagaagtg

SEQ ID NO: 7946291 - DNA, 23 bp, Homo sapiens
gctgtgcacgagccactgcctgt

SEQ ID NO: 7946292 - DNA, 22 bp, Homo sapiens
gctgtgcaaatcgatttgttgg

SEQ ID NO: 7946293 - DNA, 22 bp, Homo sapiens
gctgtgcaaatcgatttgttgg

SEQ ID NO: 7946294 - DNA, 23 bp, Homo sapiens
gctgtgcacgagccactgcctgt

SEQ ID NO: 7946295 - DNA, 23 bp, Homo sapiens
gctgtgcacgagccactgcctgt

SEQ ID NO: 7946296 - DNA, 22 bp, Homo sapiens
gctgtgcactacctatacatcc

SEQ ID NO: 7946297 - DNA, 23 bp, Homo sapiens
gctgtgcacgagccactgcctgt

SEQ ID NO: 7946298 - DNA, 22 bp, Homo sapiens
gctgtgcagagcacagggtccc

SEQ ID NO: 7946299 - DNA, 21 bp, Homo sapiens
gctgtgcagaggatggagtgg

SEQ ID NO: 7946300 - DNA, 22 bp, Homo sapiens
gctgtgcagaggtgagaatcca

SEQ ID NO: 7946301 - DNA, 22 bp, Homo sapiens
gctgtgcagatgtagggagtgg

SEQ ID NO: 7946302 - DNA, 16 bp, Homo sapiens
gctgggagggagaggt

SEQ ID NO: 7946303 - DNA, 16 bp, Homo sapiens
gctgggagggagaggt

SEQ ID NO: 7946304 - DNA, 22 bp, Homo sapiens
gctgggaggcagcacctttagc

SEQ ID NO: 7946305 - DNA, 16 bp, Homo sapiens
gctgggagggagaggt

SEQ ID NO: 7946306 - DNA, 22 bp, Homo sapiens
gctgggaggcagcacctttagc

SEQ ID NO: 7946307 - DNA, 22 bp, Homo sapiens
gctgggaggatctctccctgtc

SEQ ID NO: 7946308 - DNA, 16 bp, Homo sapiens
gctgggagggagaggt

SEQ ID NO: 7946309 - DNA, 16 bp, Homo sapiens
gctgggagggagaggt

SEQ ID NO: 7946310 - DNA, 22 bp, Homo sapiens
gctgggagtcgcgtctgtggcc

SEQ ID NO: 7946311 - DNA, 22 bp, Homo sapiens
gctgggagtcgcgtctgtggcc

SEQ ID NO: 7946312 - DNA, 20 bp, Homo sapiens
gctgggggtgtgctgagtga

SEQ ID NO: 7946313 - DNA, 20 bp, Homo sapiens
gctgggggtgtgctgagtga

SEQ ID NO: 7946314 - DNA, 20 bp, Homo sapiens
gctgggggtgtgctgagtga

SEQ ID NO: 7946315 - DNA, 20 bp, Homo sapiens
gctgggggtgtgctgagtga

SEQ ID NO: 7946316 - DNA, 20 bp, Homo sapiens
gctgggggtgtgctgagtga

SEQ ID NO: 7946317 - DNA, 20 bp, Homo sapiens
gctgggggtgtgctgagtga

SEQ ID NO: 7946318 - DNA, 22 bp, Homo sapiens
gctggggctgggctgaggaaga

SEQ ID NO: 7946319 - DNA, 20 bp, Homo sapiens
gctgggggtgtgctgagtga

SEQ ID NO: 7946320 - DNA, 21 bp, Homo sapiens
gctgggtcagcaggtcctctg

SEQ ID NO: 7946321 - DNA, 21 bp, Homo sapiens
gctgggtcagcaggtcctctg

SEQ ID NO: 7946322 - DNA, 22 bp, Homo sapiens
gctgggtcagaatctccctgtg

SEQ ID NO: 7946323 - DNA, 22 bp, Homo sapiens
gctgggtcagaatctccctgtg

SEQ ID NO: 7946324 - DNA, 22 bp, Homo sapiens
gctgggtcagaatctccctgtg

SEQ ID NO: 7946325 - DNA, 22 bp, Homo sapiens
gctgggtcagaatctccctgtg

SEQ ID NO: 7946326 - DNA, 18 bp, Homo sapiens
gctggggttgagctctcc

SEQ ID NO: 7946327 - DNA, 18 bp, Homo sapiens
gctggggttgagctctcc

SEQ ID NO: 7946328 - DNA, 22 bp, Homo sapiens
gctgggtcagaatctccctgtg

SEQ ID NO: 7946329 - DNA, 22 bp, Homo sapiens
gctgggtattttaagaaaggaa

SEQ ID NO: 7946330 - DNA, 22 bp, Homo sapiens
gctgggtcccaagcctggggag

SEQ ID NO: 7946331 - DNA, 22 bp, Homo sapiens
gctgggtccatggtcctcgggt

SEQ ID NO: 7946332 - DNA, 22 bp, Homo sapiens
gctgggtccatggtcctcgggt

SEQ ID NO: 7946333 - DNA, 22 bp, Homo sapiens
gctgggtcctatgctggtagag

SEQ ID NO: 7946334 - DNA, 22 bp, Homo sapiens
gctgggtccatggtcctcgggt

SEQ ID NO: 7946335 - DNA, 22 bp, Homo sapiens
gctgggtccatggtcctcgggt

SEQ ID NO: 7946336 - DNA, 21 bp, Homo sapiens
gctgggtcagcaggtcctctg

SEQ ID NO: 7946337 - DNA, 21 bp, Homo sapiens
gctgggtcagcaggtcctctg

SEQ ID NO: 7946338 - DNA, 22 bp, Homo sapiens
gctgggtccatggtcctcgggt

SEQ ID NO: 7946339 - DNA, 22 bp, Homo sapiens
gctggggtgtggtggataagct

SEQ ID NO: 7946340 - DNA, 22 bp, Homo sapiens
gctggggtgtggtggataagct

SEQ ID NO: 7946341 - DNA, 22 bp, Homo sapiens
gctggggtctgtgaggagggct

SEQ ID NO: 7946342 - DNA, 22 bp, Homo sapiens
gctggggtctgtgaggagggct

SEQ ID NO: 7946343 - DNA, 18 bp, Homo sapiens
gctggggttgagctctcc

SEQ ID NO: 7946344 - DNA, 18 bp, Homo sapiens
gctggggttgagctctcc

SEQ ID NO: 7946345 - DNA, 22 bp, Homo sapiens
gctggggtctgtgaggagggct

SEQ ID NO: 7946346 - DNA, 22 bp, Homo sapiens
gctggggtctgtgaggagggct

SEQ ID NO: 7946347 - DNA, 20 bp, Homo sapiens
gctgggggtgtgctgagtga

SEQ ID NO: 7946348 - DNA, 22 bp, Homo sapiens
gctggggtctgtgaggagggct

SEQ ID NO: 7946349 - DNA, 20 bp, Homo sapiens
gctgggggtgtgctgagtga

SEQ ID NO: 7946350 - DNA, 20 bp, Homo sapiens
gctgggggtgtgctgagtga

SEQ ID NO: 7946351 - DNA, 22 bp, Homo sapiens
gctggtcagagagaaaggaggc

SEQ ID NO: 7946352 - DNA, 22 bp, Homo sapiens
gctggtcactctgggagctgct

SEQ ID NO: 7946353 - DNA, 22 bp, Homo sapiens
gctgtcttcacttcctggtttc

SEQ ID NO: 7946354 - DNA, 22 bp, Homo sapiens
gctgtcttccttgctccaaggg

SEQ ID NO: 7946355 - DNA, 22 bp, Homo sapiens
gctgtcttccttgctccaaggg

SEQ ID NO: 7946356 - DNA, 22 bp, Homo sapiens
gctgtcttgatgattggatgct

SEQ ID NO: 7946357 - DNA, 22 bp, Homo sapiens
gctggtagacctcactgcactc

SEQ ID NO: 7946358 - DNA, 22 bp, Homo sapiens
gctggtagacctcactgcactc

SEQ ID NO: 7946359 - DNA, 22 bp, Homo sapiens
gctggtagacctcactgcactc

SEQ ID NO: 7946360 - DNA, 16 bp, Homo sapiens
gctggtcaagcagcag

SEQ ID NO: 7946361 - DNA, 22 bp, Homo sapiens
gctgggttttcttccgggccta

SEQ ID NO: 7946362 - DNA, 22 bp, Homo sapiens
gctgggttttcttccgggccta

SEQ ID NO: 7946363 - DNA, 22 bp, Homo sapiens
gctgggttttcttccgggccta

SEQ ID NO: 7946364 - DNA, 22 bp, Homo sapiens
gctgggttttcttccgggccta

SEQ ID NO: 7946365 - DNA, 22 bp, Homo sapiens
gctgggttttcttccgggccta

SEQ ID NO: 7946366 - DNA, 22 bp, Homo sapiens
gctgggttttcttccgggccta

SEQ ID NO: 7946367 - DNA, 22 bp, Homo sapiens
gctgggtttccagcaggcagga

SEQ ID NO: 7946368 - DNA, 22 bp, Homo sapiens
gctgggtttccagcaggcagga

SEQ ID NO: 7946369 - DNA, 22 bp, Homo sapiens
gctgggtgtcacggggctcgtg

SEQ ID NO: 7946370 - DNA, 22 bp, Homo sapiens
gctgggtgtcacggggctcgtg

SEQ ID NO: 7946371 - DNA, 22 bp, Homo sapiens
gctgggtgtcacggggctcgtg

SEQ ID NO: 7946372 - DNA, 22 bp, Homo sapiens
gctgggtgtcacggggctcgtg

SEQ ID NO: 7946373 - DNA, 22 bp, Homo sapiens
gctgggtctggatgctcaggtg

SEQ ID NO: 7946374 - DNA, 22 bp, Homo sapiens
gctgggtctggatgctcaggtg

SEQ ID NO: 7946375 - DNA, 22 bp, Homo sapiens
gctgggtctggctgtgagccgg

SEQ ID NO: 7946376 - DNA, 22 bp, Homo sapiens
gctgggtctggctgtgagccgg

SEQ ID NO: 7946377 - DNA, 22 bp, Homo sapiens
gctgggtctggctgtgagccgg

SEQ ID NO: 7946378 - DNA, 19 bp, Homo sapiens
gctgggtgaggtcgttgga

SEQ ID NO: 7946379 - DNA, 22 bp, Homo sapiens
gctgggtcctatgctggtagag

SEQ ID NO: 7946380 - DNA, 22 bp, Homo sapiens
gctgggtcctatgctggtagag

SEQ ID NO: 7946381 - DNA, 22 bp, Homo sapiens
gctgggtctctccctggtcctg

SEQ ID NO: 7946382 - DNA, 22 bp, Homo sapiens
gctgggtctctccctggtcctg

SEQ ID NO: 7946383 - DNA, 22 bp, Homo sapiens
gctgggtcccaagcctggggag

SEQ ID NO: 7946384 - DNA, 22 bp, Homo sapiens
gctgggtcctatgctggtagag

SEQ ID NO: 7946385 - DNA, 22 bp, Homo sapiens
gctgggtctctccctggtcctg

SEQ ID NO: 7946386 - DNA, 22 bp, Homo sapiens
gctgggtctctccctggtcctg

SEQ ID NO: 7946387 - DNA, 22 bp, Homo sapiens
gctgggtctggatgctcaggtg

SEQ ID NO: 7946388 - DNA, 22 bp, Homo sapiens
gctgggtctggatgctcaggtg

SEQ ID NO: 7946389 - DNA, 22 bp, Homo sapiens
gctgggtggatcggaggctctg

SEQ ID NO: 7946390 - DNA, 22 bp, Homo sapiens
gctgggtggatcggaggctctg

SEQ ID NO: 7946391 - DNA, 22 bp, Homo sapiens
gctgggtggatcggaggctctg

SEQ ID NO: 7946392 - DNA, 22 bp, Homo sapiens
gctgggtggatcggaggctctg

SEQ ID NO: 7946393 - DNA, 22 bp, Homo sapiens
gctgggtggatcggaggctctg

SEQ ID NO: 7946394 - DNA, 22 bp, Homo sapiens
gctgggtggatcggaggctctg

SEQ ID NO: 7946395 - DNA, 22 bp, Homo sapiens
gctgggtggatcggaggctctg

SEQ ID NO: 7946396 - DNA, 22 bp, Homo sapiens
gctgggtgtcacggggctcgtg

SEQ ID NO: 7946397 - DNA, 22 bp, Homo sapiens
gctgggtgtcacggggctcgtg

SEQ ID NO: 7946398 - DNA, 22 bp, Homo sapiens
gctgggtgtcacggggctcgtg

SEQ ID NO: 7946399 - DNA, 22 bp, Homo sapiens
gctgggtggatcggaggctctg

SEQ ID NO: 7946400 - DNA, 22 bp, Homo sapiens
gctgggtggatcggaggctctg

SEQ ID NO: 7946401 - DNA, 19 bp, Homo sapiens
gctgggtggggtccacagc

SEQ ID NO: 7946402 - DNA, 19 bp, Homo sapiens
gctgggtggggtccacagc

SEQ ID NO: 7946403 - DNA, 22 bp, Homo sapiens
gcccacaggtcctacctctttc

SEQ ID NO: 7946404 - DNA, 22 bp, Homo sapiens
gcccacaggggacctggtggct

SEQ ID NO: 7946405 - DNA, 22 bp, Homo sapiens
gccagtggcttgccaggcagga

SEQ ID NO: 7946406 - DNA, 22 bp, Homo sapiens
gccagtggcttgccaggcagga

SEQ ID NO: 7946407 - DNA, 22 bp, Homo sapiens
gcccacaggtcctacctctttc

SEQ ID NO: 7946408 - DNA, 22 bp, Homo sapiens
gcccacaggtcctacctctttc

SEQ ID NO: 7946409 - DNA, 22 bp, Homo sapiens
gcccacagtacgaggctcaggc

SEQ ID NO: 7946410 - DNA, 22 bp, Homo sapiens
gcccacagtacgaggctcaggc

SEQ ID NO: 7946411 - DNA, 22 bp, Homo sapiens
gcccacagtacgaggctcaggc

SEQ ID NO: 7946412 - DNA, 22 bp, Homo sapiens
gcccacagtacgaggctcaggc

SEQ ID NO: 7946413 - DNA, 22 bp, Homo sapiens
gcccactctggagcctgttccc

SEQ ID NO: 7946414 - DNA, 22 bp, Homo sapiens
gccagtggccctctggagaagg

SEQ ID NO: 7946415 - DNA, 22 bp, Homo sapiens
gccagtggccctctggagaagg

SEQ ID NO: 7946416 - DNA, 22 bp, Homo sapiens
gccagtggccctctggagaagg

SEQ ID NO: 7946417 - DNA, 22 bp, Homo sapiens
gccagtggccctctggagaagg

SEQ ID NO: 7946418 - DNA, 22 bp, Homo sapiens
gccagtggcttgccaggcagga

SEQ ID NO: 7946419 - DNA, 22 bp, Homo sapiens
gccagtggcttgccaggcagga

SEQ ID NO: 7946420 - DNA, 22 bp, Homo sapiens
gccagtggcttgccaggcagga

SEQ ID NO: 7946421 - DNA, 22 bp, Homo sapiens
gccagtggcttgccaggcagga

SEQ ID NO: 7946422 - DNA, 22 bp, Homo sapiens
gccagtggcttgccaggcagga

SEQ ID NO: 7946423 - DNA, 22 bp, Homo sapiens
gccagtggaggacccatggaga

SEQ ID NO: 7946424 - DNA, 22 bp, Homo sapiens
gccagtggaggacccatggaga

SEQ ID NO: 7946425 - DNA, 22 bp, Homo sapiens
gccagtggagcacatggtgaag

SEQ ID NO: 7946426 - DNA, 22 bp, Homo sapiens
gccagtggatgaggacttaact

SEQ ID NO: 7946427 - DNA, 22 bp, Homo sapiens
gccagtggcatgcggcagggac

SEQ ID NO: 7946428 - DNA, 22 bp, Homo sapiens
gccagtggcatgcggcagggac

SEQ ID NO: 7946429 - DNA, 22 bp, Homo sapiens
gccagtggcatgcggcagggac

SEQ ID NO: 7946430 - DNA, 22 bp, Homo sapiens
gccaggttgctgacgacgatct

SEQ ID NO: 7946431 - DNA, 22 bp, Homo sapiens
gccaggttgctgacgacgatct

SEQ ID NO: 7946432 - DNA, 22 bp, Homo sapiens
gccagtaagtggtagagttgag

SEQ ID NO: 7946433 - DNA, 22 bp, Homo sapiens
gccagtaaaacaaaggccatgt

SEQ ID NO: 7946434 - DNA, 22 bp, Homo sapiens
gccaggttgctgacgacgatct

SEQ ID NO: 7946435 - DNA, 22 bp, Homo sapiens
gccagtctgataggggagaagt

SEQ ID NO: 7946436 - DNA, 22 bp, Homo sapiens
gccagtctgataggggagaagt

SEQ ID NO: 7946437 - DNA, 22 bp, Homo sapiens
gccagtctgctcccacaagttc

SEQ ID NO: 7946438 - DNA, 22 bp, Homo sapiens
gccagtctccctcagtcctctg

SEQ ID NO: 7946439 - DNA, 22 bp, Homo sapiens
gccagtcagctggccaggctgg

SEQ ID NO: 7946440 - DNA, 22 bp, Homo sapiens
gccagtcagctggccaggctgg

SEQ ID NO: 7946441 - DNA, 22 bp, Homo sapiens
gccagtggagcacatggtgaag

SEQ ID NO: 7946442 - DNA, 22 bp, Homo sapiens
gccagtggagactgaaacccat

SEQ ID NO: 7946443 - DNA, 22 bp, Homo sapiens
gccagtggagactgaaacccat

SEQ ID NO: 7946444 - DNA, 22 bp, Homo sapiens
gccagtggagcacatggtgaag

SEQ ID NO: 7946445 - DNA, 22 bp, Homo sapiens
gccagtgcttgtggagctggca

SEQ ID NO: 7946446 - DNA, 22 bp, Homo sapiens
gccagtgcttgtggagctggca

SEQ ID NO: 7946447 - DNA, 22 bp, Homo sapiens
gccagtggagactgaaacccat

SEQ ID NO: 7946448 - DNA, 22 bp, Homo sapiens
gccagtgcttgtggagctggca

SEQ ID NO: 7946449 - DNA, 22 bp, Homo sapiens
gccagtgcttgtggagctggca

SEQ ID NO: 7946450 - DNA, 22 bp, Homo sapiens
gccagtgcctgctgctcagggc

SEQ ID NO: 7946451 - DNA, 22 bp, Homo sapiens
gccagtgcctgctgctcagggc

SEQ ID NO: 7946452 - DNA, 22 bp, Homo sapiens
gccagtgcctgctgctcagggc

SEQ ID NO: 7946453 - DNA, 22 bp, Homo sapiens
gccagtgcctgctgctcagggc

SEQ ID NO: 7946454 - DNA, 21 bp, Homo sapiens
gccagtgctgtctgtgtgatc

SEQ ID NO: 7946455 - DNA, 18 bp, Homo sapiens
gccagtgccctggctcac

SEQ ID NO: 7946456 - DNA, 22 bp, Homo sapiens
gccagtgcctcgccgcgctcct

SEQ ID NO: 7946457 - DNA, 18 bp, Homo sapiens
gccagtgccctggctcac

SEQ ID NO: 7946458 - DNA, 18 bp, Homo sapiens
gccagtgccctggctcac

SEQ ID NO: 7946459 - DNA, 22 bp, Homo sapiens
gcccagagagatgaagtgatgg

SEQ ID NO: 7946460 - DNA, 22 bp, Homo sapiens
gcccagagagatgctgtagacc

SEQ ID NO: 7946461 - DNA, 22 bp, Homo sapiens
gcccagagagatgctgtagacc

SEQ ID NO: 7946462 - DNA, 22 bp, Homo sapiens
gcccagagagatgctgtagacc

SEQ ID NO: 7946463 - DNA, 22 bp, Homo sapiens
gcccagaagtgactcagcactg

SEQ ID NO: 7946464 - DNA, 21 bp, Homo sapiens
gcccagaagactggctctgcc

SEQ ID NO: 7946465 - DNA, 21 bp, Homo sapiens
gcccagaagactggctctgcc

SEQ ID NO: 7946466 - DNA, 21 bp, Homo sapiens
gcccagaagactggctctgcc

SEQ ID NO: 7946467 - DNA, 22 bp, Homo sapiens
gcccagaagttgaggctgcagt

SEQ ID NO: 7946468 - DNA, 22 bp, Homo sapiens
gcccagaagttgaggctgcagt

SEQ ID NO: 7946469 - DNA, 22 bp, Homo sapiens
gcccagaagttgaggctgcagt

SEQ ID NO: 7946470 - DNA, 22 bp, Homo sapiens
gcccagaaagcatcattgtgga

SEQ ID NO: 7946471 - DNA, 22 bp, Homo sapiens
gcccagaaagcatcattgtgga

SEQ ID NO: 7946472 - DNA, 22 bp, Homo sapiens
gcccagaaagactgcctaacag

SEQ ID NO: 7946473 - DNA, 22 bp, Homo sapiens
gcccagaaagactgcctaacag

SEQ ID NO: 7946474 - DNA, 22 bp, Homo sapiens
gcccagaaatgaacttgctgtg

SEQ ID NO: 7946475 - DNA, 22 bp, Homo sapiens
gcccagaaatgaacttgctgtg

SEQ ID NO: 7946476 - DNA, 22 bp, Homo sapiens
gcccagaaatgaacttgctgtg

SEQ ID NO: 7946477 - DNA, 22 bp, Homo sapiens
gcccactgagtgactccctcag

SEQ ID NO: 7946478 - DNA, 22 bp, Homo sapiens
gcccactggctggagtgctggt

SEQ ID NO: 7946479 - DNA, 22 bp, Homo sapiens
gcccactttctgccagctcacc

SEQ ID NO: 7946480 - DNA, 22 bp, Homo sapiens
gcccagagtgagtcctgggccc

SEQ ID NO: 7946481 - DNA, 22 bp, Homo sapiens
gcccagagtgagtcctgggccc

SEQ ID NO: 7946482 - DNA, 22 bp, Homo sapiens
gcccagagtgagtcctgggccc

SEQ ID NO: 7946483 - DNA, 22 bp, Homo sapiens
gcccagagtgagtcctgggccc

SEQ ID NO: 7946484 - DNA, 22 bp, Homo sapiens
gcccagagtgagtcctgggccc

SEQ ID NO: 7946485 - DNA, 22 bp, Homo sapiens
gcccagagtgagtcctgggccc

SEQ ID NO: 7946486 - DNA, 18 bp, Homo sapiens
gcccagaggtctgggccc

SEQ ID NO: 7946487 - DNA, 18 bp, Homo sapiens
gcccagaggtctgggccc

SEQ ID NO: 7946488 - DNA, 18 bp, Homo sapiens
gcccagaggtctgggccc

SEQ ID NO: 7946489 - DNA, 21 bp, Homo sapiens
gcccagagtcctcccactcca

SEQ ID NO: 7946490 - DNA, 21 bp, Homo sapiens
gcccagagtcctcccactcca

SEQ ID NO: 7946491 - DNA, 21 bp, Homo sapiens
gcccagagtcctcccactcca

SEQ ID NO: 7946492 - DNA, 18 bp, Homo sapiens
gcccagaggtctgggccc

SEQ ID NO: 7946493 - DNA, 23 bp, Homo sapiens
gcccagagaggctcaccaggaat

SEQ ID NO: 7946494 - DNA, 23 bp, Homo sapiens
gcccagagaggctcaccaggaat

SEQ ID NO: 7946495 - DNA, 23 bp, Homo sapiens
gcccagagaggctcaccaggaat

SEQ ID NO: 7946496 - DNA, 22 bp, Homo sapiens
gcccagagagatgctgtagacc

SEQ ID NO: 7946497 - DNA, 23 bp, Homo sapiens
gcccagagaggctcaccaggaat

SEQ ID NO: 7946498 - DNA, 23 bp, Homo sapiens
gcccagagaggctcaccaggaat

SEQ ID NO: 7946499 - DNA, 18 bp, Homo sapiens
gcccagagccctcttatt

SEQ ID NO: 7946500 - DNA, 18 bp, Homo sapiens
gcccagagccctcttatt

SEQ ID NO: 7946501 - DNA, 22 bp, Homo sapiens
gcccagagggaagaggtgtcat

SEQ ID NO: 7946502 - DNA, 22 bp, Homo sapiens
gcccagagggaagaggtgtcat

SEQ ID NO: 7946503 - DNA, 18 bp, Homo sapiens
gcccagaggtctgggccc

SEQ ID NO: 7946504 - DNA, 18 bp, Homo sapiens
gcccagaggtctgggccc

SEQ ID NO: 7946505 - DNA, 21 bp, Homo sapiens
gcccagagggagccaagccca

SEQ ID NO: 7946506 - DNA, 21 bp, Homo sapiens
gcccagagggagccaagccca

SEQ ID NO: 7946507 - DNA, 18 bp, Homo sapiens
gcccagaggtctgggccc

SEQ ID NO: 7946508 - DNA, 22 bp, Homo sapiens
gccaggaatttcaagagccact

SEQ ID NO: 7946509 - DNA, 22 bp, Homo sapiens
gccaggaatttcaagagccact

SEQ ID NO: 7946510 - DNA, 22 bp, Homo sapiens
gccaggaatttcaagagccact

SEQ ID NO: 7946511 - DNA, 22 bp, Homo sapiens
gccaggaatttcaagagccact

SEQ ID NO: 7946512 - DNA, 22 bp, Homo sapiens
gccaggaatggagaggtggcct

SEQ ID NO: 7946513 - DNA, 22 bp, Homo sapiens
gccaggaatggagaggtggcct

SEQ ID NO: 7946514 - DNA, 22 bp, Homo sapiens
gccaggaatggagaggtggcct

SEQ ID NO: 7946515 - DNA, 22 bp, Homo sapiens
gccaggaatggagaggtggcct

SEQ ID NO: 7946516 - DNA, 22 bp, Homo sapiens
gccaggacctcagatgcagggc

SEQ ID NO: 7946517 - DNA, 22 bp, Homo sapiens
gccaggacctcagatgcagggc

SEQ ID NO: 7946518 - DNA, 22 bp, Homo sapiens
gccaggaccctggagggcatct

SEQ ID NO: 7946519 - DNA, 22 bp, Homo sapiens
gccaggaccctggagggcatct

SEQ ID NO: 7946520 - DNA, 19 bp, Homo sapiens
gccaggacatcctcctgct

SEQ ID NO: 7946521 - DNA, 22 bp, Homo sapiens
gccaggaatttcaagagccact

SEQ ID NO: 7946522 - DNA, 19 bp, Homo sapiens
gccaggacatcctcctgct

SEQ ID NO: 7946523 - DNA, 21 bp, Homo sapiens
gccaggaccagcagaccactt

SEQ ID NO: 7946524 - DNA, 21 bp, Homo sapiens
gccaggaccagcagaccactt

SEQ ID NO: 7946525 - DNA, 22 bp, Homo sapiens
gccaggactgagaatgggagca

SEQ ID NO: 7946526 - DNA, 22 bp, Homo sapiens
gccaggactgagaatgggagca

SEQ ID NO: 7946527 - DNA, 22 bp, Homo sapiens
gccaggagaaaaggcgaatgat

SEQ ID NO: 7946528 - DNA, 22 bp, Homo sapiens
gccaggagaaaaggcgaatgat

SEQ ID NO: 7946529 - DNA, 22 bp, Homo sapiens
gccaggactcttcctagaaggt

SEQ ID NO: 7946530 - DNA, 22 bp, Homo sapiens
gccaggacggtgaatgggctac

SEQ ID NO: 7946531 - DNA, 22 bp, Homo sapiens
gccaggacggtgaatgggctac

SEQ ID NO: 7946532 - DNA, 22 bp, Homo sapiens
gccaggacctcccagagctttc

SEQ ID NO: 7946533 - DNA, 22 bp, Homo sapiens
gccaggaggctgctgtgtaggc

SEQ ID NO: 7946534 - DNA, 22 bp, Homo sapiens
gccaggaggctgctgtgtaggc

SEQ ID NO: 7946535 - DNA, 22 bp, Homo sapiens
gccaggagccctgggcaagttc

SEQ ID NO: 7946536 - DNA, 22 bp, Homo sapiens
gccaggagccctgggcaagttc

SEQ ID NO: 7946537 - DNA, 22 bp, Homo sapiens
gccaggagccctgggcaagttc

SEQ ID NO: 7946538 - DNA, 22 bp, Homo sapiens
gccaggagccagcttcttagca

SEQ ID NO: 7946539 - DNA, 22 bp, Homo sapiens
gccaggagagctccttcaggtt

SEQ ID NO: 7946540 - DNA, 22 bp, Homo sapiens
gccaggagagctccttcaggtt

SEQ ID NO: 7946541 - DNA, 22 bp, Homo sapiens
gccaggagagctccttcaggtt

SEQ ID NO: 7946542 - DNA, 22 bp, Homo sapiens
gccaggagagctccttcaggtt

SEQ ID NO: 7946543 - DNA, 22 bp, Homo sapiens
gccaggagagctccttcaggtt

SEQ ID NO: 7946544 - DNA, 22 bp, Homo sapiens
gccaggagagctccttcaggtt

SEQ ID NO: 7946545 - DNA, 22 bp, Homo sapiens
gccaggagagctccttcaggtt

SEQ ID NO: 7946546 - DNA, 22 bp, Homo sapiens
gccaggagaatgctagcagagg

SEQ ID NO: 7946547 - DNA, 22 bp, Homo sapiens
gccaggagaatgctagcagagg

SEQ ID NO: 7946548 - DNA, 22 bp, Homo sapiens
gccaggagaatgctagcagagg

SEQ ID NO: 7946549 - DNA, 22 bp, Homo sapiens
gccaggagaatgctagcagagg

SEQ ID NO: 7946550 - DNA, 22 bp, Homo sapiens
gccaggagaatgctagcagagg

SEQ ID NO: 7946551 - DNA, 22 bp, Homo sapiens
gccaggagaatgctagcagagg

SEQ ID NO: 7946552 - DNA, 22 bp, Homo sapiens
gccaggcaatgtgttagaagcg

SEQ ID NO: 7946553 - DNA, 22 bp, Homo sapiens
gccaggcaatgtgttagaagcg

SEQ ID NO: 7946554 - DNA, 22 bp, Homo sapiens
gccaggcaaattaaggaatgca

SEQ ID NO: 7946555 - DNA, 22 bp, Homo sapiens
gccaggcaaattaaggaatgca

SEQ ID NO: 7946556 - DNA, 22 bp, Homo sapiens
gccaggcaaattaaggaatgca

SEQ ID NO: 7946557 - DNA, 22 bp, Homo sapiens
gccaggcaaattaaggaatgca

SEQ ID NO: 7946558 - DNA, 22 bp, Homo sapiens
gccaggcaaattaaggaatgca

SEQ ID NO: 7946559 - DNA, 22 bp, Homo sapiens
gccaggatgactatacaacagc

SEQ ID NO: 7946560 - DNA, 22 bp, Homo sapiens
gccaggagttcagatgcatgtt

SEQ ID NO: 7946561 - DNA, 22 bp, Homo sapiens
gccaggagttcagatgcatgtt

SEQ ID NO: 7946562 - DNA, 22 bp, Homo sapiens
gccaggagttcagatgcatgtt

SEQ ID NO: 7946563 - DNA, 22 bp, Homo sapiens
gccaggagttcagatgcatgtt

SEQ ID NO: 7946564 - DNA, 22 bp, Homo sapiens
gccaggagttcagatgcatgtt

SEQ ID NO: 7946565 - DNA, 22 bp, Homo sapiens
gccaggagttcagatgcatgtt

SEQ ID NO: 7946566 - DNA, 22 bp, Homo sapiens
gccaggagttcagatgcatgtt

SEQ ID NO: 7946567 - DNA, 22 bp, Homo sapiens
gccaggagttcagatgcatgtt

SEQ ID NO: 7946568 - DNA, 23 bp, Homo sapiens
gccaggcacatggtggacacgca

SEQ ID NO: 7946569 - DNA, 23 bp, Homo sapiens
gccaggcacatggtggacacgca

SEQ ID NO: 7946570 - DNA, 23 bp, Homo sapiens
gccaggcacatggtggacacgca

SEQ ID NO: 7946571 - DNA, 23 bp, Homo sapiens
gccaggcacatggtggacacgca

SEQ ID NO: 7946572 - DNA, 23 bp, Homo sapiens
gccaggcacatggtggacacgca

SEQ ID NO: 7946573 - DNA, 22 bp, Homo sapiens
gccaggtccagggtggagcgct

SEQ ID NO: 7946574 - DNA, 23 bp, Homo sapiens
gccaggcacatggtggacacgca

SEQ ID NO: 7946575 - DNA, 22 bp, Homo sapiens
gccaggcacagttctaggtgct

SEQ ID NO: 7946576 - DNA, 22 bp, Homo sapiens
gccaggcacagttctaggtgct

SEQ ID NO: 7946577 - DNA, 22 bp, Homo sapiens
gccaggcacagttctaggtgct

SEQ ID NO: 7946578 - DNA, 22 bp, Homo sapiens
gccaggcacagttctaggtgct

SEQ ID NO: 7946579 - DNA, 22 bp, Homo sapiens
gccaggcacagttctaggtgct

SEQ ID NO: 7946580 - DNA, 22 bp, Homo sapiens
gccaggcacagttctaggtgct

SEQ ID NO: 7946581 - DNA, 22 bp, Homo sapiens
gccaggcacagttctaggtgct

SEQ ID NO: 7946582 - DNA, 22 bp, Homo sapiens
gccaggtctgggtagcagagga

SEQ ID NO: 7946583 - DNA, 22 bp, Homo sapiens
gccaggtctgggtagcagagga

SEQ ID NO: 7946584 - DNA, 22 bp, Homo sapiens
gccaggtggctgagtgactgag

SEQ ID NO: 7946585 - DNA, 22 bp, Homo sapiens
gccaggtgggagacagacagca

SEQ ID NO: 7946586 - DNA, 22 bp, Homo sapiens
gccaggtggctgagtgactgag

SEQ ID NO: 7946587 - DNA, 22 bp, Homo sapiens
gccaggtcgtctccatgtccaa

SEQ ID NO: 7946588 - DNA, 22 bp, Homo sapiens
gccaggtcccctcatggctcct

SEQ ID NO: 7946589 - DNA, 22 bp, Homo sapiens
gccaggtcccctcatggctcct

SEQ ID NO: 7946590 - DNA, 22 bp, Homo sapiens
gccaggtctcataaatgcagct

SEQ ID NO: 7946591 - DNA, 22 bp, Homo sapiens
gccaggtctcataaatgcagct

SEQ ID NO: 7946592 - DNA, 22 bp, Homo sapiens
gccaggtctcataaatgcagct

SEQ ID NO: 7946593 - DNA, 22 bp, Homo sapiens
gccaggtctcataaatgcagct

SEQ ID NO: 7946594 - DNA, 22 bp, Homo sapiens
gccaggttctggggaggtacaa

SEQ ID NO: 7946595 - DNA, 22 bp, Homo sapiens
gccaggtgtcctcacagtgagg

SEQ ID NO: 7946596 - DNA, 22 bp, Homo sapiens
gccaggtgtcctcacagtgagg

SEQ ID NO: 7946597 - DNA, 22 bp, Homo sapiens
gccaggtggtctggctccagag

SEQ ID NO: 7946598 - DNA, 22 bp, Homo sapiens
gccaggtggtctggctccagag

SEQ ID NO: 7946599 - DNA, 22 bp, Homo sapiens
gccaggtgtagtggccacacct

SEQ ID NO: 7946600 - DNA, 22 bp, Homo sapiens
gccctctggcagccttggctgg

SEQ ID NO: 7946601 - DNA, 22 bp, Homo sapiens
gccctctggcagccttggctgg

SEQ ID NO: 7946602 - DNA, 22 bp, Homo sapiens
gccctctggcagccttggctgg

SEQ ID NO: 7946603 - DNA, 22 bp, Homo sapiens
gccctctggggcacacagagga

SEQ ID NO: 7946604 - DNA, 22 bp, Homo sapiens
gccctctggggcacacagagga

SEQ ID NO: 7946605 - DNA, 22 bp, Homo sapiens
gccctctggggcacacagagga

SEQ ID NO: 7946606 - DNA, 22 bp, Homo sapiens
gccctctggggcacacagagga

SEQ ID NO: 7946607 - DNA, 18 bp, Homo sapiens
gccctctggctgctgatg

SEQ ID NO: 7946608 - DNA, 22 bp, Homo sapiens
gccctctggtgggtgagccccg

SEQ ID NO: 7946609 - DNA, 22 bp, Homo sapiens
gccctctggtgggtgagccccg

SEQ ID NO: 7946610 - DNA, 22 bp, Homo sapiens
gccctctggtgggtgagccccg

SEQ ID NO: 7946611 - DNA, 22 bp, Homo sapiens
gccctctggggcacacagagga

SEQ ID NO: 7946612 - DNA, 22 bp, Homo sapiens
gccctctggtggccgcctcggc

SEQ ID NO: 7946613 - DNA, 22 bp, Homo sapiens
gccctctggtggccgcctcggc

SEQ ID NO: 7946614 - DNA, 22 bp, Homo sapiens
gccctctgttattgcatcctta

SEQ ID NO: 7946615 - DNA, 22 bp, Homo sapiens
gccctctgttattgcatcctta

SEQ ID NO: 7946616 - DNA, 22 bp, Homo sapiens
gccctctgtgtaacaatccaga

SEQ ID NO: 7946617 - DNA, 23 bp, Homo sapiens
gcccatgctgttgggcccgagca

SEQ ID NO: 7946618 - DNA, 22 bp, Homo sapiens
gcccatgctctcaggcgggcct

SEQ ID NO: 7946619 - DNA, 22 bp, Homo sapiens
gcccatgcccctccttctggca

SEQ ID NO: 7946620 - DNA, 22 bp, Homo sapiens
gcccatgctctcaggcgggcct

SEQ ID NO: 7946621 - DNA, 20 bp, Homo sapiens
gcccatgaggactgcagctg

SEQ ID NO: 7946622 - DNA, 20 bp, Homo sapiens
gcccatgaggactgcagctg

SEQ ID NO: 7946623 - DNA, 22 bp, Homo sapiens
gcccatgaggtggaggctgcag

SEQ ID NO: 7946624 - DNA, 22 bp, Homo sapiens
gcccatgcactttctgtgatgg

SEQ ID NO: 7946625 - DNA, 22 bp, Homo sapiens
gcccatggaaaacctgtcctct

SEQ ID NO: 7946626 - DNA, 22 bp, Homo sapiens
gcccatggaaaacctgtcctct

SEQ ID NO: 7946627 - DNA, 23 bp, Homo sapiens
gcccatgctgttgggcccgagca

SEQ ID NO: 7946628 - DNA, 23 bp, Homo sapiens
gcccatgctgttgggcccgagca

SEQ ID NO: 7946629 - DNA, 22 bp, Homo sapiens
gcccatggacacccaagtgcca

SEQ ID NO: 7946630 - DNA, 23 bp, Homo sapiens
gcccatggagtctggatctggcc

SEQ ID NO: 7946631 - DNA, 22 bp, Homo sapiens
gcccaggggcagcgcatagtgg

SEQ ID NO: 7946632 - DNA, 22 bp, Homo sapiens
gcccaggggcagcgcatagtgg

SEQ ID NO: 7946633 - DNA, 22 bp, Homo sapiens
gcccaggggcagcgcatagtgg

SEQ ID NO: 7946634 - DNA, 22 bp, Homo sapiens
gcccaggggcagcgcatagtgg

SEQ ID NO: 7946635 - DNA, 22 bp, Homo sapiens
gcccaggggagtagtcaattta

SEQ ID NO: 7946636 - DNA, 22 bp, Homo sapiens
gcccagggcttcaaagagagaa

SEQ ID NO: 7946637 - DNA, 22 bp, Homo sapiens
gcccagggcttcaaagagagaa

SEQ ID NO: 7946638 - DNA, 22 bp, Homo sapiens
gcccagggcttcaaagagagaa

SEQ ID NO: 7946639 - DNA, 22 bp, Homo sapiens
gcccagggcttcaaagagagaa

SEQ ID NO: 7946640 - DNA, 22 bp, Homo sapiens
gcccagggcttcaaagagagaa

SEQ ID NO: 7946641 - DNA, 22 bp, Homo sapiens
gcccagtggtaaaagcaggcct

SEQ ID NO: 7946642 - DNA, 22 bp, Homo sapiens
gcccagtggtaaaagcaggcct

SEQ ID NO: 7946643 - DNA, 22 bp, Homo sapiens
gcccagtggtaaaagcaggcct

SEQ ID NO: 7946644 - DNA, 22 bp, Homo sapiens
gcccagtggtaaaagcaggcct

SEQ ID NO: 7946645 - DNA, 22 bp, Homo sapiens
gcccagtttcagctctgccttt

SEQ ID NO: 7946646 - DNA, 22 bp, Homo sapiens
gcccagtgtctaggaggtgaac

SEQ ID NO: 7946647 - DNA, 22 bp, Homo sapiens
gcccagtgtctaggaggtgaac

SEQ ID NO: 7946648 - DNA, 22 bp, Homo sapiens
gcccatccatggggtcatggcc

SEQ ID NO: 7946649 - DNA, 22 bp, Homo sapiens
gcccatcttctagcagctgtta

SEQ ID NO: 7946650 - DNA, 22 bp, Homo sapiens
gcccatcttctagcagctgtta

SEQ ID NO: 7946651 - DNA, 22 bp, Homo sapiens
gcccatcttctagcagctgtta

SEQ ID NO: 7946652 - DNA, 22 bp, Homo sapiens
gcccagtttcagctctgccttt

SEQ ID NO: 7946653 - DNA, 22 bp, Homo sapiens
gcccagagttcaaggctgcagt

SEQ ID NO: 7946654 - DNA, 22 bp, Homo sapiens
gcccagagttcaaggctgcagt

SEQ ID NO: 7946655 - DNA, 22 bp, Homo sapiens
gcccagagttcaaggctgcagt

SEQ ID NO: 7946656 - DNA, 22 bp, Homo sapiens
gcccagagttcaaggctgcagt

SEQ ID NO: 7946657 - DNA, 22 bp, Homo sapiens
gcccagagtttgaagatacagt

SEQ ID NO: 7946658 - DNA, 22 bp, Homo sapiens
gcccagagttcaaggctgcagt

SEQ ID NO: 7946659 - DNA, 22 bp, Homo sapiens
gcccagagtggccacttggctc

SEQ ID NO: 7946660 - DNA, 22 bp, Homo sapiens
gcccagagtggccacttggctc

SEQ ID NO: 7946661 - DNA, 21 bp, Homo sapiens
gcccagagttaagcccaccca

SEQ ID NO: 7946662 - DNA, 21 bp, Homo sapiens
gcccagagttaagcccaccca

SEQ ID NO: 7946663 - DNA, 22 bp, Homo sapiens
gcccagagttcaaggctgcagt

SEQ ID NO: 7946664 - DNA, 22 bp, Homo sapiens
gcccagagttcaaggctgcagt

SEQ ID NO: 7946665 - DNA, 22 bp, Homo sapiens
gcccagagttcaaggctgcagt

SEQ ID NO: 7946666 - DNA, 22 bp, Homo sapiens
gcccagagttcaaggctgcagt

SEQ ID NO: 7946667 - DNA, 22 bp, Homo sapiens
gcccaggctggagtgcagtggt

SEQ ID NO: 7946668 - DNA, 22 bp, Homo sapiens
gcccaggctggagtgcagtggt

SEQ ID NO: 7946669 - DNA, 22 bp, Homo sapiens
gcccaggctggagtgcagtggt

SEQ ID NO: 7946670 - DNA, 22 bp, Homo sapiens
gcccagcaaggaccaagggccg

SEQ ID NO: 7946671 - DNA, 22 bp, Homo sapiens
gcccagcaaggaccaagggccg

SEQ ID NO: 7946672 - DNA, 22 bp, Homo sapiens
gcccagcaaggaccaagggccg

SEQ ID NO: 7946673 - DNA, 22 bp, Homo sapiens
gcccaggctggagtgcagtggt

SEQ ID NO: 7946674 - DNA, 22 bp, Homo sapiens
gcccagcaaggaccaagggccg

SEQ ID NO: 7946675 - DNA, 22 bp, Homo sapiens
gcccagcaaggaccaagggccg

SEQ ID NO: 7946676 - DNA, 22 bp, Homo sapiens
gcccagcaactgcacccttctt

SEQ ID NO: 7946677 - DNA, 22 bp, Homo sapiens
gcccagggcgatggtcggggcc

SEQ ID NO: 7946678 - DNA, 22 bp, Homo sapiens
gcccagggcgatggtcggggcc

SEQ ID NO: 7946679 - DNA, 22 bp, Homo sapiens
gcccagggcgatggtcggggcc

SEQ ID NO: 7946680 - DNA, 22 bp, Homo sapiens
gcccagggcgatggtcggggcc

SEQ ID NO: 7946681 - DNA, 22 bp, Homo sapiens
gcccagggctgcaagtggacgc

SEQ ID NO: 7946682 - DNA, 22 bp, Homo sapiens
gcccagggctgcaagtggacgc

SEQ ID NO: 7946683 - DNA, 22 bp, Homo sapiens
gcccagggcgatggtcggggcc

SEQ ID NO: 7946684 - DNA, 22 bp, Homo sapiens
gcccagggctgcaagtggacgc

SEQ ID NO: 7946685 - DNA, 22 bp, Homo sapiens
gcccagggctgcaagtggacgc

SEQ ID NO: 7946686 - DNA, 22 bp, Homo sapiens
gcccagggctgcaagtggacgc

SEQ ID NO: 7946687 - DNA, 22 bp, Homo sapiens
gcccagggcagggcaagagtga

SEQ ID NO: 7946688 - DNA, 22 bp, Homo sapiens
gcccagggcagggcaagagtga

SEQ ID NO: 7946689 - DNA, 22 bp, Homo sapiens
gcccagggcagggcaagagtga

SEQ ID NO: 7946690 - DNA, 22 bp, Homo sapiens
gcccagggcagggcaagagtga

SEQ ID NO: 7946691 - DNA, 22 bp, Homo sapiens
gcccagggcagggcaagagtga

SEQ ID NO: 7946692 - DNA, 22 bp, Homo sapiens
gcccagggcagggcaagagtga

SEQ ID NO: 7946693 - DNA, 22 bp, Homo sapiens
gcccaggctggagttcagtggt

SEQ ID NO: 7946694 - DNA, 23 bp, Homo sapiens
gcccagggactgggaatcagtgg

SEQ ID NO: 7946695 - DNA, 22 bp, Homo sapiens
gcccaggctggagtgcagtggt

SEQ ID NO: 7946696 - DNA, 22 bp, Homo sapiens
gcccaggctggagttcagtggt

SEQ ID NO: 7946697 - DNA, 23 bp, Homo sapiens
gcccagggactgggaatcagtgg

SEQ ID NO: 7946698 - DNA, 22 bp, Homo sapiens
gcctacatttcccagttgaatg

SEQ ID NO: 7946699 - DNA, 22 bp, Homo sapiens
gcctacagttggctgagggcct

SEQ ID NO: 7946700 - DNA, 22 bp, Homo sapiens
gcctagagagggagtgccacac

SEQ ID NO: 7946701 - DNA, 22 bp, Homo sapiens
gcctagagaagcttactgaagc

SEQ ID NO: 7946702 - DNA, 22 bp, Homo sapiens
gcctagcattgatcagcctgct

SEQ ID NO: 7946703 - DNA, 22 bp, Homo sapiens
gcctagcattgatcagcctgct

SEQ ID NO: 7946704 - DNA, 22 bp, Homo sapiens
gcctagcattgatcagcctgct

SEQ ID NO: 7946705 - DNA, 20 bp, Homo sapiens
gcctagagatggaaggcgca

SEQ ID NO: 7946706 - DNA, 23 bp, Homo sapiens
gcctcagagaaacagctgcacac

SEQ ID NO: 7946707 - DNA, 23 bp, Homo sapiens
gcctcagagaaacagctgcacac

SEQ ID NO: 7946708 - DNA, 22 bp, Homo sapiens
gcctcagagctacacacacgca

SEQ ID NO: 7946709 - DNA, 22 bp, Homo sapiens
gcctcagaaagtggcaggtagg

SEQ ID NO: 7946710 - DNA, 22 bp, Homo sapiens
gccctgaggggtggtgtctgta

SEQ ID NO: 7946711 - DNA, 22 bp, Homo sapiens
gccctgaggggtggtgtctgta

SEQ ID NO: 7946712 - DNA, 22 bp, Homo sapiens
gccctgagggacctcaccccat

SEQ ID NO: 7946713 - DNA, 22 bp, Homo sapiens
gccctgagggacctcaccccat

SEQ ID NO: 7946714 - DNA, 22 bp, Homo sapiens
gccctgaggggtggtgtctgta

SEQ ID NO: 7946715 - DNA, 22 bp, Homo sapiens
gccctgaggggtggtgtctgta

SEQ ID NO: 7946716 - DNA, 22 bp, Homo sapiens
gccctgaggggtggtgtctgta

SEQ ID NO: 7946717 - DNA, 22 bp, Homo sapiens
gccctgaggggtggtgtctgta

SEQ ID NO: 7946718 - DNA, 22 bp, Homo sapiens
gccctgagggtctgggttccca

SEQ ID NO: 7946719 - DNA, 22 bp, Homo sapiens
gcctaaggaaattaatgcaact

SEQ ID NO: 7946720 - DNA, 22 bp, Homo sapiens
gccctgagggtctgggttccca

SEQ ID NO: 7946721 - DNA, 22 bp, Homo sapiens
gccctgagggtctgggttccca

SEQ ID NO: 7946722 - DNA, 22 bp, Homo sapiens
gccctgagggtctgggttccca

SEQ ID NO: 7946723 - DNA, 22 bp, Homo sapiens
gccctgagggtctgggttccca

SEQ ID NO: 7946724 - DNA, 19 bp, Homo sapiens
gccctgagtaagctaggag

SEQ ID NO: 7946725 - DNA, 22 bp, Homo sapiens
gcctcagagggccctagggaca

SEQ ID NO: 7946726 - DNA, 22 bp, Homo sapiens
gcctcagagggccctagggaca

SEQ ID NO: 7946727 - DNA, 22 bp, Homo sapiens
gcctcagagggccctagggaca

SEQ ID NO: 7946728 - DNA, 20 bp, Homo sapiens
gcctcagccaacccatgggg

SEQ ID NO: 7946729 - DNA, 20 bp, Homo sapiens
gcctcagccaacccatgggg

SEQ ID NO: 7946730 - DNA, 20 bp, Homo sapiens
gcctcagccaacccatgggg

SEQ ID NO: 7946731 - DNA, 20 bp, Homo sapiens
gcctcagccaacccatgggg

SEQ ID NO: 7946732 - DNA, 22 bp, Homo sapiens
gcctcagccggcggacgccagg

SEQ ID NO: 7946733 - DNA, 20 bp, Homo sapiens
gcctcagccaacccatgggg

SEQ ID NO: 7946734 - DNA, 20 bp, Homo sapiens
gcctcagccaacccatgggg

SEQ ID NO: 7946735 - DNA, 22 bp, Homo sapiens
gcctcagccggcggacgccagg

SEQ ID NO: 7946736 - DNA, 22 bp, Homo sapiens
gcctcagctcccagcccaggct

SEQ ID NO: 7946737 - DNA, 22 bp, Homo sapiens
gcctcagctcccagcccaggct

SEQ ID NO: 7946738 - DNA, 22 bp, Homo sapiens
gcctcagccggcggacgccagg

SEQ ID NO: 7946739 - DNA, 22 bp, Homo sapiens
gcctcaggactggcatactcat

SEQ ID NO: 7946740 - DNA, 22 bp, Homo sapiens
gcctcaggactggcatactcat

SEQ ID NO: 7946741 - DNA, 22 bp, Homo sapiens
gcctcaggccgccctgctgctc

SEQ ID NO: 7946742 - DNA, 22 bp, Homo sapiens
gcctcaggccgccctgctgctc

SEQ ID NO: 7946743 - DNA, 22 bp, Homo sapiens
gcctcagctgttgcaggggccc

SEQ ID NO: 7946744 - DNA, 22 bp, Homo sapiens
gcctcagctgttgcaggggccc

SEQ ID NO: 7946745 - DNA, 22 bp, Homo sapiens
gcctcaggactggcatactcat

SEQ ID NO: 7946746 - DNA, 22 bp, Homo sapiens
gcctcaggactggcatactcat

SEQ ID NO: 7946747 - DNA, 22 bp, Homo sapiens
gcctcagctcccagcccaggct

SEQ ID NO: 7946748 - DNA, 22 bp, Homo sapiens
gcctcagctcccagcccaggct

SEQ ID NO: 7946749 - DNA, 22 bp, Homo sapiens
gcctcagctcccagcccaggct

SEQ ID NO: 7946750 - DNA, 22 bp, Homo sapiens
gcctcagctgttgcaggggccc

SEQ ID NO: 7946751 - DNA, 22 bp, Homo sapiens
gcctcagctcccagcccaggct

SEQ ID NO: 7946752 - DNA, 22 bp, Homo sapiens
gccctgaggcaaaagaacagtc

SEQ ID NO: 7946753 - DNA, 22 bp, Homo sapiens
gccctgaggcaaaagaacagtc

SEQ ID NO: 7946754 - DNA, 22 bp, Homo sapiens
gccctgaggcaaaagaacagtc

SEQ ID NO: 7946755 - DNA, 22 bp, Homo sapiens
gccctgaggcaaaagaacagtc

SEQ ID NO: 7946756 - DNA, 22 bp, Homo sapiens
gccctgagctagtgtgggcagg

SEQ ID NO: 7946757 - DNA, 22 bp, Homo sapiens
gccctgagctagtgtgggcagg

SEQ ID NO: 7946758 - DNA, 22 bp, Homo sapiens
gccctgaggatttgcatttcct

SEQ ID NO: 7946759 - DNA, 22 bp, Homo sapiens
gccctgaggatttgcatttcct

SEQ ID NO: 7946760 - DNA, 22 bp, Homo sapiens
gccctgagctagtgtgggcagg

SEQ ID NO: 7946761 - DNA, 22 bp, Homo sapiens
gccctgagctagtgtgggcagg

SEQ ID NO: 7946762 - DNA, 22 bp, Homo sapiens
gccctgagctagtgtgggcagg

SEQ ID NO: 7946763 - DNA, 22 bp, Homo sapiens
gccctgagcctatgagcctctc

SEQ ID NO: 7946764 - DNA, 22 bp, Homo sapiens
gccctgagcctatgagcctctc

SEQ ID NO: 7946765 - DNA, 22 bp, Homo sapiens
gccctgagcctatgagcctctc

SEQ ID NO: 7946766 - DNA, 22 bp, Homo sapiens
gccctgagcctatgagcctctc

SEQ ID NO: 7946767 - DNA, 22 bp, Homo sapiens
gccctgagcctatgagcctctc

SEQ ID NO: 7946768 - DNA, 22 bp, Homo sapiens
gccctgagcctatgagcctctc

SEQ ID NO: 7946769 - DNA, 22 bp, Homo sapiens
gccctgagcactgctgctgggg

SEQ ID NO: 7946770 - DNA, 22 bp, Homo sapiens
gccctgagcactgctgctgggg

SEQ ID NO: 7946771 - DNA, 22 bp, Homo sapiens
gccctgagcactgctgctgggg

SEQ ID NO: 7946772 - DNA, 22 bp, Homo sapiens
gccctgagcactgctgctgggg

SEQ ID NO: 7946773 - DNA, 22 bp, Homo sapiens
gccctgagcactgctgctgggg

SEQ ID NO: 7946774 - DNA, 22 bp, Homo sapiens
gccctgagcactgctgctgggg

SEQ ID NO: 7946775 - DNA, 22 bp, Homo sapiens
gccctgagccaccaatgccatt

SEQ ID NO: 7946776 - DNA, 22 bp, Homo sapiens
gccctgagccaccaatgccatt

SEQ ID NO: 7946777 - DNA, 22 bp, Homo sapiens
gccctgagcactgctgctgggg

SEQ ID NO: 7946778 - DNA, 22 bp, Homo sapiens
gccctgagccaccaatgccatt

SEQ ID NO: 7946779 - DNA, 22 bp, Homo sapiens
gccctgagcacacagtagcaaa

SEQ ID NO: 7946780 - DNA, 22 bp, Homo sapiens
gccctgagcacacagtagcaaa

SEQ ID NO: 7946781 - DNA, 22 bp, Homo sapiens
gccctgagattcttggattctg

SEQ ID NO: 7946782 - DNA, 22 bp, Homo sapiens
gccctgagattcttggattctg

SEQ ID NO: 7946783 - DNA, 22 bp, Homo sapiens
gccctgagaggcaatgactctt

SEQ ID NO: 7946784 - DNA, 22 bp, Homo sapiens
gccctgagaggcaatgactctt

SEQ ID NO: 7946785 - DNA, 22 bp, Homo sapiens
gccctgagaatgtgtgtgtcta

SEQ ID NO: 7946786 - DNA, 22 bp, Homo sapiens
gccctgagaatgtgtgtgtcta

SEQ ID NO: 7946787 - DNA, 22 bp, Homo sapiens
gccctgagactgaagaactgtc

SEQ ID NO: 7946788 - DNA, 22 bp, Homo sapiens
gccctgagactgaagaactgtc

SEQ ID NO: 7946789 - DNA, 22 bp, Homo sapiens
gccctgagaagaagtcggaggg

SEQ ID NO: 7946790 - DNA, 22 bp, Homo sapiens
gccctgagaagaagtcggaggg

SEQ ID NO: 7946791 - DNA, 22 bp, Homo sapiens
gccctgagactgagcatgggtt

SEQ ID NO: 7946792 - DNA, 22 bp, Homo sapiens
gccctgagactgagcatgggtt

SEQ ID NO: 7946793 - DNA, 19 bp, Homo sapiens
gccctgagagcttgggttc

SEQ ID NO: 7946794 - DNA, 19 bp, Homo sapiens
gccctgagagcttgggttc

SEQ ID NO: 7946795 - DNA, 22 bp, Homo sapiens
gccctgagactgagcatgggtt

SEQ ID NO: 7946796 - DNA, 22 bp, Homo sapiens
gccctgagactgagcatgggtt

SEQ ID NO: 7946797 - DNA, 22 bp, Homo sapiens
gccctgagactgagcatgggtt

SEQ ID NO: 7946798 - DNA, 22 bp, Homo sapiens
gccctgagactgagcatgggtt

SEQ ID NO: 7946799 - DNA, 22 bp, Homo sapiens
gccctgacactttgcagctgag

SEQ ID NO: 7946800 - DNA, 22 bp, Homo sapiens
gccctgaccttcactgactctc

SEQ ID NO: 7946801 - DNA, 22 bp, Homo sapiens
gccctgacactttgcagctgag

SEQ ID NO: 7946802 - DNA, 22 bp, Homo sapiens
gccctgaagctgagggtgttaa

SEQ ID NO: 7946803 - DNA, 22 bp, Homo sapiens
gccctgaacgaggggtctggag

SEQ ID NO: 7946804 - DNA, 22 bp, Homo sapiens
gccctctgttattgcatcctta

SEQ ID NO: 7946805 - DNA, 22 bp, Homo sapiens
gccctctgttttgtaagcaacg

SEQ ID NO: 7946806 - DNA, 18 bp, Homo sapiens
gcagtctctctggtcttc

SEQ ID NO: 7946807 - DNA, 20 bp, Homo sapiens
gcagtctgcctctgtgtggt

SEQ ID NO: 7946808 - DNA, 20 bp, Homo sapiens
gcagtctgcctctgtgtggt

SEQ ID NO: 7946809 - DNA, 18 bp, Homo sapiens
gcagtctctctggtcttc

SEQ ID NO: 7946810 - DNA, 22 bp, Homo sapiens
gcagtctccatatacatttaca

SEQ ID NO: 7946811 - DNA, 22 bp, Homo sapiens
gcagtctctcaggatttaagct

SEQ ID NO: 7946812 - DNA, 22 bp, Homo sapiens
gcagtctttgaatgtgaaatag

SEQ ID NO: 7946813 - DNA, 20 bp, Homo sapiens
gcagtctgtcacagagcatg

SEQ ID NO: 7946814 - DNA, 20 bp, Homo sapiens
gcagtctgtcacagagcatg

SEQ ID NO: 7946815 - DNA, 19 bp, Homo sapiens
gcagtctgttgaagggcag

SEQ ID NO: 7946816 - DNA, 19 bp, Homo sapiens
gcagtctgttgaagggcag

SEQ ID NO: 7946817 - DNA, 22 bp, Homo sapiens
gcagtgaagatttgggctctgg

SEQ ID NO: 7946818 - DNA, 18 bp, Homo sapiens
gcagtgaagaaagagctt

SEQ ID NO: 7946819 - DNA, 22 bp, Homo sapiens
gcagtgaacataacacagaagg

SEQ ID NO: 7946820 - DNA, 17 bp, Homo sapiens
gcagtgaaaagagatca

SEQ ID NO: 7946821 - DNA, 22 bp, Homo sapiens
gcagtgaaacaataggatcaaa

SEQ ID NO: 7946822 - DNA, 22 bp, Homo sapiens
gcagtgaaaaagtgcaccctgt

SEQ ID NO: 7946823 - DNA, 22 bp, Homo sapiens
gcagtgaaaaagtgcaccctgt

SEQ ID NO: 7946824 - DNA, 17 bp, Homo sapiens
gcagtgaaaagagatca

SEQ ID NO: 7946825 - DNA, 22 bp, Homo sapiens
gcagtgaaaaagtgcaccctgt

SEQ ID NO: 7946826 - DNA, 22 bp, Homo sapiens
gcagtccattgacagaggtctt

SEQ ID NO: 7946827 - DNA, 20 bp, Homo sapiens
gcagtcccatttctgagcct

SEQ ID NO: 7946828 - DNA, 22 bp, Homo sapiens
gcagtccattgacagaggtctt

SEQ ID NO: 7946829 - DNA, 20 bp, Homo sapiens
gcagtccagatgcttttaac

SEQ ID NO: 7946830 - DNA, 22 bp, Homo sapiens
gcagtccattgacagaggtctt

SEQ ID NO: 7946831 - DNA, 22 bp, Homo sapiens
gcagtccgctcacccgcattgg

SEQ ID NO: 7946832 - DNA, 22 bp, Homo sapiens
gcagtccccgtcgtggcaggga

SEQ ID NO: 7946833 - DNA, 22 bp, Homo sapiens
gcagtcctagggtgctctgcag

SEQ ID NO: 7946834 - DNA, 22 bp, Homo sapiens
gcagtccaaagtggctctcacc

SEQ ID NO: 7946835 - DNA, 22 bp, Homo sapiens
gcagtcctcatcctttagcagt

SEQ ID NO: 7946836 - DNA, 22 bp, Homo sapiens
gcagtcctcctgcctcagcctc

SEQ ID NO: 7946837 - DNA, 22 bp, Homo sapiens
gcagtcctcatcctttagcagt

SEQ ID NO: 7946838 - DNA, 22 bp, Homo sapiens
gcagtcctctcattggcctcct

SEQ ID NO: 7946839 - DNA, 22 bp, Homo sapiens
gcagtcctctcattggcctcct

SEQ ID NO: 7946840 - DNA, 22 bp, Homo sapiens
gcagtccttaggagaggaagta

SEQ ID NO: 7946841 - DNA, 22 bp, Homo sapiens
gcagtcctgggattctgtcctt

SEQ ID NO: 7946842 - DNA, 22 bp, Homo sapiens
gcagggctattggaaggagatg

SEQ ID NO: 7946843 - DNA, 22 bp, Homo sapiens
gcagggctcaacaggacacccc

SEQ ID NO: 7946844 - DNA, 22 bp, Homo sapiens
gcagggctcaacaggacacccc

SEQ ID NO: 7946845 - DNA, 22 bp, Homo sapiens
gcagggctcaacaggacacccc

SEQ ID NO: 7946846 - DNA, 22 bp, Homo sapiens
gcagggctcagccgctcccacc

SEQ ID NO: 7946847 - DNA, 22 bp, Homo sapiens
gcagggctcagccgctcccacc

SEQ ID NO: 7946848 - DNA, 22 bp, Homo sapiens
gcagggctcagccgctcccacc

SEQ ID NO: 7946849 - DNA, 22 bp, Homo sapiens
gcagggctcattgccaggcatt

SEQ ID NO: 7946850 - DNA, 22 bp, Homo sapiens
gcagggctccactgtggccaag

SEQ ID NO: 7946851 - DNA, 22 bp, Homo sapiens
gcagggctccactgtggccaag

SEQ ID NO: 7946852 - DNA, 22 bp, Homo sapiens
gcagggctccactgtggccaag

SEQ ID NO: 7946853 - DNA, 22 bp, Homo sapiens
gcagggctccactgtggccaag

SEQ ID NO: 7946854 - DNA, 22 bp, Homo sapiens
gcagggctccactgtggccaag

SEQ ID NO: 7946855 - DNA, 22 bp, Homo sapiens
gcagggctccccaggcccgagg

SEQ ID NO: 7946856 - DNA, 22 bp, Homo sapiens
gcagggctcattctagtacaat

SEQ ID NO: 7946857 - DNA, 22 bp, Homo sapiens
gcagggctcattgccaggcatt

SEQ ID NO: 7946858 - DNA, 22 bp, Homo sapiens
gcagggctcattgccaggcatt

SEQ ID NO: 7946859 - DNA, 22 bp, Homo sapiens
gcagggctcattgccaggcatt

SEQ ID NO: 7946860 - DNA, 22 bp, Homo sapiens
gcagggctcattgccaggcatt

SEQ ID NO: 7946861 - DNA, 22 bp, Homo sapiens
gcagggctcattgccaggcatt

SEQ ID NO: 7946862 - DNA, 22 bp, Homo sapiens
gcagggctcattgccaggcatt

SEQ ID NO: 7946863 - DNA, 22 bp, Homo sapiens
gcagggctcattgccaggcatt

SEQ ID NO: 7946864 - DNA, 22 bp, Homo sapiens
gcagggctcattgccaggcatt

SEQ ID NO: 7946865 - DNA, 22 bp, Homo sapiens
gcagggctctgctgtagtccta

SEQ ID NO: 7946866 - DNA, 22 bp, Homo sapiens
gcagggctctgctgtagtccta

SEQ ID NO: 7946867 - DNA, 19 bp, Homo sapiens
gcagggctctcccagatgc

SEQ ID NO: 7946868 - DNA, 22 bp, Homo sapiens
gcagtcacagggagatggtgac

SEQ ID NO: 7946869 - DNA, 22 bp, Homo sapiens
gcagtattcattgtttccctga

SEQ ID NO: 7946870 - DNA, 22 bp, Homo sapiens
gcagtatctatgtgatgggttg

SEQ ID NO: 7946871 - DNA, 22 bp, Homo sapiens
gcagtatatggattttaaacat

SEQ ID NO: 7946872 - DNA, 22 bp, Homo sapiens
gcagtatatggattttaaacat

SEQ ID NO: 7946873 - DNA, 22 bp, Homo sapiens
gcagggctctgctgtagtccta

SEQ ID NO: 7946874 - DNA, 22 bp, Homo sapiens
gcagtatatggattttaaacat

SEQ ID NO: 7946875 - DNA, 22 bp, Homo sapiens
gcagtatctatgtgatgggttg

SEQ ID NO: 7946876 - DNA, 21 bp, Homo sapiens
gcagtcactcggttggctacc

SEQ ID NO: 7946877 - DNA, 21 bp, Homo sapiens
gcagtcactcggttggctacc

SEQ ID NO: 7946878 - DNA, 22 bp, Homo sapiens
gcagtcagacaggaggagctcc

SEQ ID NO: 7946879 - DNA, 21 bp, Homo sapiens
gcagtcactcggttggctacc

SEQ ID NO: 7946880 - DNA, 22 bp, Homo sapiens
gcagtcagacaggaggagctcc

SEQ ID NO: 7946881 - DNA, 22 bp, Homo sapiens
gcagtcagacaggaggagctcc

SEQ ID NO: 7946882 - DNA, 22 bp, Homo sapiens
gcagtcagacaggaggagctcc

SEQ ID NO: 7946883 - DNA, 22 bp, Homo sapiens
gcagtcagtgttgactacatgc

SEQ ID NO: 7946884 - DNA, 22 bp, Homo sapiens
gcagtcagtgttgactacatgc

SEQ ID NO: 7946885 - DNA, 22 bp, Homo sapiens
gcagtcaggttaaggccttccc

SEQ ID NO: 7946886 - DNA, 22 bp, Homo sapiens
gcagtcagtaaggcagccagaa

SEQ ID NO: 7946887 - DNA, 22 bp, Homo sapiens
gcagtcagtaaggcagccagaa

SEQ ID NO: 7946888 - DNA, 19 bp, Homo sapiens
gcatttcatttaaccatca

SEQ ID NO: 7946889 - DNA, 19 bp, Homo sapiens
gcatttcatttaaccatca

SEQ ID NO: 7946890 - DNA, 22 bp, Homo sapiens
gcatttcctgtgcttggcatat

SEQ ID NO: 7946891 - DNA, 22 bp, Homo sapiens
gcatgattaatatgcttactgt

SEQ ID NO: 7946892 - DNA, 22 bp, Homo sapiens
gcatgcaaatagtcatgcttcc

SEQ ID NO: 7946893 - DNA, 22 bp, Homo sapiens
gcatgcaaatagtcatgcttcc

SEQ ID NO: 7946894 - DNA, 19 bp, Homo sapiens
gcatttctctttacagcca

SEQ ID NO: 7946895 - DNA, 22 bp, Homo sapiens
gcatgcaaatagtcatgcttcc

SEQ ID NO: 7946896 - DNA, 22 bp, Homo sapiens
gcatttctgtgcatacacatga

SEQ ID NO: 7946897 - DNA, 22 bp, Homo sapiens
gcatttctgtgcatacacatga

SEQ ID NO: 7946898 - DNA, 22 bp, Homo sapiens
gcatttctgtgcatacacatga

SEQ ID NO: 7946899 - DNA, 22 bp, Homo sapiens
gcatttggaacttggttgagat

SEQ ID NO: 7946900 - DNA, 22 bp, Homo sapiens
gcatttggaattgtgtatagaa

SEQ ID NO: 7946901 - DNA, 22 bp, Homo sapiens
gcatttggtgatgcaccgttta

SEQ ID NO: 7946902 - DNA, 18 bp, Homo sapiens
gcatttggtgagtttggc

SEQ ID NO: 7946903 - DNA, 22 bp, Homo sapiens
gcatttggtttggctcaggcca

SEQ ID NO: 7946904 - DNA, 21 bp, Homo sapiens
gcatttggtgccctgtctgct

SEQ ID NO: 7946905 - DNA, 21 bp, Homo sapiens
gcatttggtgccctgtctgct

SEQ ID NO: 7946906 - DNA, 21 bp, Homo sapiens
gcatttggttttgtcaatgct

SEQ ID NO: 7946907 - DNA, 22 bp, Homo sapiens
gcatttgtacaaaatgcagtag

SEQ ID NO: 7946908 - DNA, 22 bp, Homo sapiens
gcatttgtacaaaatgcagtag

SEQ ID NO: 7946909 - DNA, 22 bp, Homo sapiens
gcatttggaaaatgtttggctt

SEQ ID NO: 7946910 - DNA, 22 bp, Homo sapiens
gcatttggaaaatgtttggctt

SEQ ID NO: 7946911 - DNA, 22 bp, Homo sapiens
gcatttgaaatgcaagaaagtg

SEQ ID NO: 7946912 - DNA, 22 bp, Homo sapiens
gcatttgagcacattttaaaga

SEQ ID NO: 7946913 - DNA, 22 bp, Homo sapiens
gcatttcttcctggtgtgagcc

SEQ ID NO: 7946914 - DNA, 22 bp, Homo sapiens
gcatctgatccaatagatatat

SEQ ID NO: 7946915 - DNA, 19 bp, Homo sapiens
gcatctgcatgatggggtt

SEQ ID NO: 7946916 - DNA, 19 bp, Homo sapiens
gcatctgcatgatggggtt

SEQ ID NO: 7946917 - DNA, 22 bp, Homo sapiens
gcatctgttagagtgtgcatgc

SEQ ID NO: 7946918 - DNA, 22 bp, Homo sapiens
gcatgaaatgagcgaatataat

SEQ ID NO: 7946919 - DNA, 22 bp, Homo sapiens
gcatctttagcctctccgtggc

SEQ ID NO: 7946920 - DNA, 22 bp, Homo sapiens
gcatctttctgtccattcagca

SEQ ID NO: 7946921 - DNA, 22 bp, Homo sapiens
gcatctttagcctctccgtggc

SEQ ID NO: 7946922 - DNA, 22 bp, Homo sapiens
gcatctttctgtccattcagca

SEQ ID NO: 7946923 - DNA, 22 bp, Homo sapiens
gcatgaggttcttggccagcat

SEQ ID NO: 7946924 - DNA, 22 bp, Homo sapiens
gcatgaggttcttggccagcat

SEQ ID NO: 7946925 - DNA, 22 bp, Homo sapiens
gcatgatgaaggaggaggagtc

SEQ ID NO: 7946926 - DNA, 22 bp, Homo sapiens
gcatgaggtttgggctctgtga

SEQ ID NO: 7946927 - DNA, 22 bp, Homo sapiens
gcatgaggttcttggccagcat

SEQ ID NO: 7946928 - DNA, 20 bp, Homo sapiens
gcatgaggaatcattgcagc

SEQ ID NO: 7946929 - DNA, 22 bp, Homo sapiens
gcatgaggggggttaggaagtt

SEQ ID NO: 7946930 - DNA, 22 bp, Homo sapiens
gcatgacattcctaatcacagt

SEQ ID NO: 7946931 - DNA, 22 bp, Homo sapiens
gcatgagactagctcatgagca

SEQ ID NO: 7946932 - DNA, 22 bp, Homo sapiens
gcataattaaacaggcaagatt

SEQ ID NO: 7946933 - DNA, 22 bp, Homo sapiens
gcatccaaatgtttcatttctt

SEQ ID NO: 7946934 - DNA, 22 bp, Homo sapiens
gcataattaaacaggcaagatt

SEQ ID NO: 7946935 - DNA, 22 bp, Homo sapiens
gcataaatgttctttcagattt

SEQ ID NO: 7946936 - DNA, 22 bp, Homo sapiens
gcataaatgtgcacacacatgt

SEQ ID NO: 7946937 - DNA, 22 bp, Homo sapiens
gcataaatgtgcacacacatgt

SEQ ID NO: 7946938 - DNA, 22 bp, Homo sapiens
gcataaatgttctttcagattt

SEQ ID NO: 7946939 - DNA, 22 bp, Homo sapiens
gcataaatgttctttcagattt

SEQ ID NO: 7946940 - DNA, 22 bp, Homo sapiens
gcataaatgttctttcagattt

SEQ ID NO: 7946941 - DNA, 22 bp, Homo sapiens
gcataaatgtgcacacacatgt

SEQ ID NO: 7946942 - DNA, 19 bp, Homo sapiens
gcataaatacactattgtc

SEQ ID NO: 7946943 - DNA, 19 bp, Homo sapiens
gcataaatacactattgtc

SEQ ID NO: 7946944 - DNA, 19 bp, Homo sapiens
gcataaatacactattgtc

SEQ ID NO: 7946945 - DNA, 19 bp, Homo sapiens
gcataaatacactattgtc

SEQ ID NO: 7946946 - DNA, 22 bp, Homo sapiens
gcagtgaagatttgggctctgg

SEQ ID NO: 7946947 - DNA, 22 bp, Homo sapiens
gcataaacttaagattttgttt

SEQ ID NO: 7946948 - DNA, 22 bp, Homo sapiens
gcatccaggctgcccctctgcg

SEQ ID NO: 7946949 - DNA, 22 bp, Homo sapiens
gcatccagtcttggctcctgga

SEQ ID NO: 7946950 - DNA, 22 bp, Homo sapiens
gcatccagtcttggctcctgga

SEQ ID NO: 7946951 - DNA, 22 bp, Homo sapiens
gcatccagaggtagccactgtg

SEQ ID NO: 7946952 - DNA, 22 bp, Homo sapiens
gcatccagaggtagccactgtg

SEQ ID NO: 7946953 - DNA, 22 bp, Homo sapiens
gcatccaggactatatgatgat

SEQ ID NO: 7946954 - DNA, 20 bp, Homo sapiens
gcatccagacacccagctgc

SEQ ID NO: 7946955 - DNA, 22 bp, Homo sapiens
gcatccagaggtagccactgtg

SEQ ID NO: 7946956 - DNA, 22 bp, Homo sapiens
gcatcccaaatctgaaagtcca

SEQ ID NO: 7946957 - DNA, 19 bp, Homo sapiens
gcatccatggaggccgctt

SEQ ID NO: 7946958 - DNA, 22 bp, Homo sapiens
gcatccctctgaggggccaggc

SEQ ID NO: 7946959 - DNA, 22 bp, Homo sapiens
gcatcctggctctaggtgtcat

SEQ ID NO: 7946960 - DNA, 22 bp, Homo sapiens
gcatccttaactctgtagatgc

SEQ ID NO: 7946961 - DNA, 22 bp, Homo sapiens
gcatcctggctctaggtgtcat

SEQ ID NO: 7946962 - DNA, 22 bp, Homo sapiens
gcatcctggctctaggtgtcat

SEQ ID NO: 7946963 - DNA, 22 bp, Homo sapiens
gcatcctcccggtgctgctggc

SEQ ID NO: 7946964 - DNA, 22 bp, Homo sapiens
gcatccattgtttatgtgtttc

SEQ ID NO: 7946965 - DNA, 22 bp, Homo sapiens
gcatccattcactcaacttaga

SEQ ID NO: 7946966 - DNA, 19 bp, Homo sapiens
gcatccatggaggccgctt

SEQ ID NO: 7946967 - DNA, 19 bp, Homo sapiens
gcatccatggaggccgctt

SEQ ID NO: 7946968 - DNA, 20 bp, Homo sapiens
gcatccatatatgcatgtgt

SEQ ID NO: 7946969 - DNA, 22 bp, Homo sapiens
gcatccagtcttggctcctgga

SEQ ID NO: 7946970 - DNA, 22 bp, Homo sapiens
gcatccatcagcagattgactg

SEQ ID NO: 7946971 - DNA, 22 bp, Homo sapiens
gcatccatgcatgcagggtgtg

SEQ ID NO: 7946972 - DNA, 22 bp, Homo sapiens
gcatccatggagagcactctga

SEQ ID NO: 7946973 - DNA, 22 bp, Homo sapiens
gcatctaaggtggataacttct

SEQ ID NO: 7946974 - DNA, 20 bp, Homo sapiens
gcatctccagggctgtctcc

SEQ ID NO: 7946975 - DNA, 22 bp, Homo sapiens
gcatcggcgtctgttcaggttt

SEQ ID NO: 7946976 - DNA, 22 bp, Homo sapiens
gcatccttcctgctgggcctgg

SEQ ID NO: 7946977 - DNA, 22 bp, Homo sapiens
gcatccttaatccacatcagag

SEQ ID NO: 7946978 - DNA, 22 bp, Homo sapiens
gcatccttctcattcccaagct

SEQ ID NO: 7946979 - DNA, 22 bp, Homo sapiens
gcatccttctcattcccaagct

SEQ ID NO: 7946980 - DNA, 20 bp, Homo sapiens
gcatccttctcttccactcc

SEQ ID NO: 7946981 - DNA, 20 bp, Homo sapiens
gcatccttctcttccactcc

SEQ ID NO: 7946982 - DNA, 22 bp, Homo sapiens
gcatccttgggcccagctcctg

SEQ ID NO: 7946983 - DNA, 22 bp, Homo sapiens
gcatccttgggcccagctcctg

SEQ ID NO: 7946984 - DNA, 22 bp, Homo sapiens
gcatcctttcctttccattgtg

SEQ ID NO: 7946985 - DNA, 22 bp, Homo sapiens
gcatccttttttcctgccctgc

SEQ ID NO: 7946986 - DNA, 22 bp, Homo sapiens
gcatcctttcctttccattgtg

SEQ ID NO: 7946987 - DNA, 22 bp, Homo sapiens
gcatccttttttcctgccctgc

SEQ ID NO: 7946988 - DNA, 22 bp, Homo sapiens
gccagccaagattgagaaggta

SEQ ID NO: 7946989 - DNA, 22 bp, Homo sapiens
gccagcattccttggctcctgg

SEQ ID NO: 7946990 - DNA, 22 bp, Homo sapiens
gccagcatcctggtggtggttg

SEQ ID NO: 7946991 - DNA, 22 bp, Homo sapiens
gccagcatcctggtggtggttg

SEQ ID NO: 7946992 - DNA, 22 bp, Homo sapiens
gccagcatcctggtggtggttg

SEQ ID NO: 7946993 - DNA, 22 bp, Homo sapiens
gccagcatcctgcattagggtg

SEQ ID NO: 7946994 - DNA, 22 bp, Homo sapiens
gccagcatagtaagcagtcatc

SEQ ID NO: 7946995 - DNA, 22 bp, Homo sapiens
gccagcatagtaagcagtcatc

SEQ ID NO: 7946996 - DNA, 22 bp, Homo sapiens
gccagcatagtaagcagtcatc

SEQ ID NO: 7946997 - DNA, 23 bp, Homo sapiens
gccagcatagatcattctgagta

SEQ ID NO: 7946998 - DNA, 22 bp, Homo sapiens
gccagcagtggccaccaccagg

SEQ ID NO: 7946999 - DNA, 22 bp, Homo sapiens
gccagcagtggccaccaccagg

SEQ ID NO: 7947000 - DNA, 22 bp, Homo sapiens
gccagcagtggccaccaccagg

SEQ ID NO: 7947001 - DNA, 22 bp, Homo sapiens
gccagcagtcctgctgtgtgcc

SEQ ID NO: 7947002 - DNA, 22 bp, Homo sapiens
gccagcagtcctgctgtgtgcc

SEQ ID NO: 7947003 - DNA, 22 bp, Homo sapiens
gccagcagtcctgctgtgtgcc

SEQ ID NO: 7947004 - DNA, 22 bp, Homo sapiens
gccagcagtcctgctgtgtgcc

SEQ ID NO: 7947005 - DNA, 22 bp, Homo sapiens
gccagcagtcctgctgtgtgcc

SEQ ID NO: 7947006 - DNA, 22 bp, Homo sapiens
gccagcagtcctgctgtgtgcc

SEQ ID NO: 7947007 - DNA, 22 bp, Homo sapiens
gccagcagtcctgctgtgtgcc

SEQ ID NO: 7947008 - DNA, 22 bp, Homo sapiens
gccagcagtcctgctgtgtgcc

SEQ ID NO: 7947009 - DNA, 22 bp, Homo sapiens
gccagcagtcctgctgtgtgcc

SEQ ID NO: 7947010 - DNA, 22 bp, Homo sapiens
gccagcagtccagtccttagtg

SEQ ID NO: 7947011 - DNA, 22 bp, Homo sapiens
gccagcagtccagtccttagtg

SEQ ID NO: 7947012 - DNA, 22 bp, Homo sapiens
gccagcagtccagtccttagtg

SEQ ID NO: 7947013 - DNA, 22 bp, Homo sapiens
gccagcagtatgtcctggcagt

SEQ ID NO: 7947014 - DNA, 22 bp, Homo sapiens
gccagcagtatgtcctggcagt

SEQ ID NO: 7947015 - DNA, 22 bp, Homo sapiens
gccagccccagacatcctatcg

SEQ ID NO: 7947016 - DNA, 22 bp, Homo sapiens
gccagccccagacatcctatcg

SEQ ID NO: 7947017 - DNA, 22 bp, Homo sapiens
gccagcccattaacccctgtcc

SEQ ID NO: 7947018 - DNA, 22 bp, Homo sapiens
gccagccccagacatcctatcg

SEQ ID NO: 7947019 - DNA, 22 bp, Homo sapiens
gccagcccctccatcctgttca

SEQ ID NO: 7947020 - DNA, 22 bp, Homo sapiens
gccagcccctccatcctgttca

SEQ ID NO: 7947021 - DNA, 22 bp, Homo sapiens
gccagccccttagggctctccc

SEQ ID NO: 7947022 - DNA, 22 bp, Homo sapiens
gccagccccttagggctctccc

SEQ ID NO: 7947023 - DNA, 22 bp, Homo sapiens
gccagccccttagggctctccc

SEQ ID NO: 7947024 - DNA, 22 bp, Homo sapiens
gccagccccttagggctctccc

SEQ ID NO: 7947025 - DNA, 22 bp, Homo sapiens
gccagccccttagggctctccc

SEQ ID NO: 7947026 - DNA, 22 bp, Homo sapiens
gccagcccctccatcctgttca

SEQ ID NO: 7947027 - DNA, 22 bp, Homo sapiens
gccagccccttagggctctccc

SEQ ID NO: 7947028 - DNA, 22 bp, Homo sapiens
gccagcccagctccaggggaaa

SEQ ID NO: 7947029 - DNA, 21 bp, Homo sapiens
gccagccatgcttgcctaggc

SEQ ID NO: 7947030 - DNA, 21 bp, Homo sapiens
gccagccatgcttgcctaggc

SEQ ID NO: 7947031 - DNA, 21 bp, Homo sapiens
gccagccatgcttgcctaggc

SEQ ID NO: 7947032 - DNA, 22 bp, Homo sapiens
gccagcccagctccaggggaaa

SEQ ID NO: 7947033 - DNA, 22 bp, Homo sapiens
gccagccataggccagcactgg

SEQ ID NO: 7947034 - DNA, 22 bp, Homo sapiens
gccagccataggccagcactgg

SEQ ID NO: 7947035 - DNA, 22 bp, Homo sapiens
gccagccataggccagcactgg

SEQ ID NO: 7947036 - DNA, 21 bp, Homo sapiens
gccagccatgcttgcctaggc

SEQ ID NO: 7947037 - DNA, 22 bp, Homo sapiens
gccagcccagctccaggggaaa

SEQ ID NO: 7947038 - DNA, 22 bp, Homo sapiens
gccagcccagctccaggggaaa

SEQ ID NO: 7947039 - DNA, 22 bp, Homo sapiens
gccagcccagctccaggggaaa

SEQ ID NO: 7947040 - DNA, 22 bp, Homo sapiens
gccagcccattaacccctgtcc

SEQ ID NO: 7947041 - DNA, 22 bp, Homo sapiens
gccagcaggtggagagatcaag

SEQ ID NO: 7947042 - DNA, 22 bp, Homo sapiens
gccagcaggtggagagatcaag

SEQ ID NO: 7947043 - DNA, 22 bp, Homo sapiens
gccagcaggtggagagatcaag

SEQ ID NO: 7947044 - DNA, 22 bp, Homo sapiens
gccagcaggttgtcaaggagct

SEQ ID NO: 7947045 - DNA, 22 bp, Homo sapiens
gccagcaggttgtcaaggagct

SEQ ID NO: 7947046 - DNA, 22 bp, Homo sapiens
gccagcaggttgtcaaggagct

SEQ ID NO: 7947047 - DNA, 22 bp, Homo sapiens
gccagcagtatgtcctggcagt

SEQ ID NO: 7947048 - DNA, 22 bp, Homo sapiens
gccagcagtatgtcctggcagt

SEQ ID NO: 7947049 - DNA, 22 bp, Homo sapiens
gccagcagtatgtcctggcagt

SEQ ID NO: 7947050 - DNA, 22 bp, Homo sapiens
gccagcagtatgtcctggcagt

SEQ ID NO: 7947051 - DNA, 22 bp, Homo sapiens
gccagcaggttgtcaaggagct

SEQ ID NO: 7947052 - DNA, 22 bp, Homo sapiens
gccagcaggttgtcaaggagct

SEQ ID NO: 7947053 - DNA, 22 bp, Homo sapiens
gccagcagggcggagccatcta

SEQ ID NO: 7947054 - DNA, 22 bp, Homo sapiens
gccagcagggcggagccatcta

SEQ ID NO: 7947055 - DNA, 22 bp, Homo sapiens
gccagcaggtggagagatcaag

SEQ ID NO: 7947056 - DNA, 22 bp, Homo sapiens
gccagcaggtggagagatcaag

SEQ ID NO: 7947057 - DNA, 22 bp, Homo sapiens
gccagcagggcggagccatcta

SEQ ID NO: 7947058 - DNA, 22 bp, Homo sapiens
gccagcagggcggagccatcta

SEQ ID NO: 7947059 - DNA, 22 bp, Homo sapiens
gccagcagggcggagccatcta

SEQ ID NO: 7947060 - DNA, 22 bp, Homo sapiens
gccagcagggcggagccatcta

SEQ ID NO: 7947061 - DNA, 22 bp, Homo sapiens
gccagcagggcggagccatcta

SEQ ID NO: 7947062 - DNA, 22 bp, Homo sapiens
gccagaggcccaaggacagctg

SEQ ID NO: 7947063 - DNA, 22 bp, Homo sapiens
gccagaggcccaaggacagctg

SEQ ID NO: 7947064 - DNA, 22 bp, Homo sapiens
gccagaggcccaaggacagctg

SEQ ID NO: 7947065 - DNA, 22 bp, Homo sapiens
gccagcagggcccaaatgctgg

SEQ ID NO: 7947066 - DNA, 22 bp, Homo sapiens
gccagcagggcggagccatcta

SEQ ID NO: 7947067 - DNA, 22 bp, Homo sapiens
gccagcagggcccaaatgctgg

SEQ ID NO: 7947068 - DNA, 22 bp, Homo sapiens
gccagaggcccaaggacagctg

SEQ ID NO: 7947069 - DNA, 22 bp, Homo sapiens
gccagaggcccaaggacagctg

SEQ ID NO: 7947070 - DNA, 22 bp, Homo sapiens
gccagaggcccaaggacagctg

SEQ ID NO: 7947071 - DNA, 22 bp, Homo sapiens
gccagaggcccaaggacagctg

SEQ ID NO: 7947072 - DNA, 22 bp, Homo sapiens
gccagaggcccaaggacagctg

SEQ ID NO: 7947073 - DNA, 22 bp, Homo sapiens
gccagaggcccaaggacagctg

SEQ ID NO: 7947074 - DNA, 22 bp, Homo sapiens
gccagaggcccaaggacagctg

SEQ ID NO: 7947075 - DNA, 22 bp, Homo sapiens
gccagaggcccaaggacagctg

SEQ ID NO: 7947076 - DNA, 22 bp, Homo sapiens
gccagaggcccaaggacagctg

SEQ ID NO: 7947077 - DNA, 22 bp, Homo sapiens
gccagaggaacgctgcgcgccc

SEQ ID NO: 7947078 - DNA, 23 bp, Homo sapiens
gccagaggaacgcagagctttct

SEQ ID NO: 7947079 - DNA, 23 bp, Homo sapiens
gccagaggaacgcagagctttct

SEQ ID NO: 7947080 - DNA, 23 bp, Homo sapiens
gccagaggaacgcagagctttct

SEQ ID NO: 7947081 - DNA, 23 bp, Homo sapiens
gccagaggaacgcagagctttct

SEQ ID NO: 7947082 - DNA, 23 bp, Homo sapiens
gccagaggaacgcagagctttct

SEQ ID NO: 7947083 - DNA, 22 bp, Homo sapiens
gccagagctgagtgaggttctt

SEQ ID NO: 7947084 - DNA, 22 bp, Homo sapiens
gccagagctgagtgaggttctt

SEQ ID NO: 7947085 - DNA, 22 bp, Homo sapiens
gccagagctgagtgaggttctt

SEQ ID NO: 7947086 - DNA, 22 bp, Homo sapiens
gccagagctgagacacgagtcc

SEQ ID NO: 7947087 - DNA, 22 bp, Homo sapiens
gccagagctgagacacgagtcc

SEQ ID NO: 7947088 - DNA, 22 bp, Homo sapiens
gccagagcttcccccgagtgtg

SEQ ID NO: 7947089 - DNA, 23 bp, Homo sapiens
gccagaggaacgcagagctttct

SEQ ID NO: 7947090 - DNA, 22 bp, Homo sapiens
gccagagcttcccccgagtgtg

SEQ ID NO: 7947091 - DNA, 22 bp, Homo sapiens
gccagagcttcccccgagtgtg

SEQ ID NO: 7947092 - DNA, 23 bp, Homo sapiens
gccagagctgcctgcccttgctg

SEQ ID NO: 7947093 - DNA, 23 bp, Homo sapiens
gccagagctgcctgcccttgctg

SEQ ID NO: 7947094 - DNA, 22 bp, Homo sapiens
gcatttttctaatcattggcat

SEQ ID NO: 7947095 - DNA, 22 bp, Homo sapiens
gcatttttctaatcattggcat

SEQ ID NO: 7947096 - DNA, 22 bp, Homo sapiens
gcatttttctctcctataggag

SEQ ID NO: 7947097 - DNA, 22 bp, Homo sapiens
gcatttttcatccctcttgggt

SEQ ID NO: 7947098 - DNA, 22 bp, Homo sapiens
gcatttttcatccctcttgggt

SEQ ID NO: 7947099 - DNA, 22 bp, Homo sapiens
gcattttagaatattggagcaa

SEQ ID NO: 7947100 - DNA, 22 bp, Homo sapiens
gcattttagaatattggagcaa

SEQ ID NO: 7947101 - DNA, 22 bp, Homo sapiens
gcattttataaagagttatttg

SEQ ID NO: 7947102 - DNA, 22 bp, Homo sapiens
gcattttataaagagttatttg

SEQ ID NO: 7947103 - DNA, 22 bp, Homo sapiens
gcattttaataagattcatagg

SEQ ID NO: 7947104 - DNA, 18 bp, Homo sapiens
gcattttaatctgaggca

SEQ ID NO: 7947105 - DNA, 18 bp, Homo sapiens
gcattttaatctgaggca

SEQ ID NO: 7947106 - DNA, 22 bp, Homo sapiens
gcattttaatgaggtttatgag

SEQ ID NO: 7947107 - DNA, 22 bp, Homo sapiens
gcattttaatgaggtttatgag

SEQ ID NO: 7947108 - DNA, 22 bp, Homo sapiens
gcattttaataagattcatagg

SEQ ID NO: 7947109 - DNA, 22 bp, Homo sapiens
gcatttgtttgggctaatctta

SEQ ID NO: 7947110 - DNA, 22 bp, Homo sapiens
gcatttgtttgggctaatctta

SEQ ID NO: 7947111 - DNA, 22 bp, Homo sapiens
gcatttgttgagttgccagcta

SEQ ID NO: 7947112 - DNA, 22 bp, Homo sapiens
gcatttgttgactgaccttccc

SEQ ID NO: 7947113 - DNA, 22 bp, Homo sapiens
gcatttgtgtggcggaaggatt

SEQ ID NO: 7947114 - DNA, 22 bp, Homo sapiens
gcatttgtgttcttcctagagc

SEQ ID NO: 7947115 - DNA, 22 bp, Homo sapiens
gcatttgtgttcttcctagagc

SEQ ID NO: 7947116 - DNA, 22 bp, Homo sapiens
gcatttgttccgctttgtcatc

SEQ ID NO: 7947117 - DNA, 22 bp, Homo sapiens
gcatttgttccgctttgtcatc

SEQ ID NO: 7947118 - DNA, 22 bp, Homo sapiens
gccaaggaaggcttcctggaag

SEQ ID NO: 7947119 - DNA, 22 bp, Homo sapiens
gccaaggaaggcttcctggaag

SEQ ID NO: 7947120 - DNA, 22 bp, Homo sapiens
gccaaggaaggcttcctggaag

SEQ ID NO: 7947121 - DNA, 22 bp, Homo sapiens
gccaagctggatgaagaggttg

SEQ ID NO: 7947122 - DNA, 22 bp, Homo sapiens
gccaagctgtttttcagagacg

SEQ ID NO: 7947123 - DNA, 22 bp, Homo sapiens
gccaagctctttaaaggccaaa

SEQ ID NO: 7947124 - DNA, 22 bp, Homo sapiens
gccaagcttggaaggatcatgg

SEQ ID NO: 7947125 - DNA, 22 bp, Homo sapiens
gccaagcctgtagacacaagct

SEQ ID NO: 7947126 - DNA, 22 bp, Homo sapiens
gccaagcctgtagacacaagct

SEQ ID NO: 7947127 - DNA, 22 bp, Homo sapiens
gccaagcctgtagacacaagct

SEQ ID NO: 7947128 - DNA, 22 bp, Homo sapiens
gccaagctcaccttctgatgga

SEQ ID NO: 7947129 - DNA, 22 bp, Homo sapiens
gccaagctcaccttctgatgga

SEQ ID NO: 7947130 - DNA, 22 bp, Homo sapiens
gcatttttgatcccactaggat

SEQ ID NO: 7947131 - DNA, 22 bp, Homo sapiens
gccaaggcctctgcaggatgag

SEQ ID NO: 7947132 - DNA, 22 bp, Homo sapiens
gccaaggcctctgcaggatgag

SEQ ID NO: 7947133 - DNA, 22 bp, Homo sapiens
gccaaggcctctgcaggatgag

SEQ ID NO: 7947134 - DNA, 22 bp, Homo sapiens
gccaaggctgaggccctgggct

SEQ ID NO: 7947135 - DNA, 22 bp, Homo sapiens
gccaaggcctgcagcacctcat

SEQ ID NO: 7947136 - DNA, 22 bp, Homo sapiens
gccaaggctgaggccctgggct

SEQ ID NO: 7947137 - DNA, 22 bp, Homo sapiens
gccaaggcctgcagcacctcat

SEQ ID NO: 7947138 - DNA, 22 bp, Homo sapiens
gccaaggcctgcagcacctcat

SEQ ID NO: 7947139 - DNA, 22 bp, Homo sapiens
gccaaggcctctgcaggatgag

SEQ ID NO: 7947140 - DNA, 22 bp, Homo sapiens
gccaaggcctctgcaggatgag

SEQ ID NO: 7947141 - DNA, 22 bp, Homo sapiens
gccaaggataccagctgtgaga

SEQ ID NO: 7947142 - DNA, 22 bp, Homo sapiens
gccaaggcctctgcaggatgag

SEQ ID NO: 7947143 - DNA, 21 bp, Homo sapiens
gccaaggaggctagagaacat

SEQ ID NO: 7947144 - DNA, 21 bp, Homo sapiens
gccaaggaggctagagaacat

SEQ ID NO: 7947145 - DNA, 20 bp, Homo sapiens
gccaaggaggagaaacaggc

SEQ ID NO: 7947146 - DNA, 22 bp, Homo sapiens
gccagagcatgcactgcctgca

SEQ ID NO: 7947147 - DNA, 22 bp, Homo sapiens
gccagagcatgcactgcctgca

SEQ ID NO: 7947148 - DNA, 22 bp, Homo sapiens
gccagagccacttttgggtgat

SEQ ID NO: 7947149 - DNA, 22 bp, Homo sapiens
gccagagccacttttgggtgat

SEQ ID NO: 7947150 - DNA, 22 bp, Homo sapiens
gccagagccggcttcacaggat

SEQ ID NO: 7947151 - DNA, 22 bp, Homo sapiens
gccagagccggcttcacaggat

SEQ ID NO: 7947152 - DNA, 22 bp, Homo sapiens
gccagagccggcttcacaggat

SEQ ID NO: 7947153 - DNA, 22 bp, Homo sapiens
gccagagccggcttcacaggat

SEQ ID NO: 7947154 - DNA, 22 bp, Homo sapiens
gccagagctgagacacgagtcc

SEQ ID NO: 7947155 - DNA, 22 bp, Homo sapiens
gccagagcagaatagagtggcc

SEQ ID NO: 7947156 - DNA, 22 bp, Homo sapiens
gccagagcagaatagagtggcc

SEQ ID NO: 7947157 - DNA, 22 bp, Homo sapiens
gccagagcagaatagagtggcc

SEQ ID NO: 7947158 - DNA, 22 bp, Homo sapiens
gccagagcagaatagagtggcc

SEQ ID NO: 7947159 - DNA, 22 bp, Homo sapiens
gccagagcagaatagagtggcc

SEQ ID NO: 7947160 - DNA, 21 bp, Homo sapiens
gccagagcagtacaatgaggt

SEQ ID NO: 7947161 - DNA, 21 bp, Homo sapiens
gccagagcagtacaatgaggt

SEQ ID NO: 7947162 - DNA, 22 bp, Homo sapiens
gccagagcatcgcaccctccat

SEQ ID NO: 7947163 - DNA, 22 bp, Homo sapiens
gccagagcatgcactgcctgca

SEQ ID NO: 7947164 - DNA, 21 bp, Homo sapiens
gccagagcagtacaatgaggt

SEQ ID NO: 7947165 - DNA, 21 bp, Homo sapiens
gccagagcagtacaatgaggt

SEQ ID NO: 7947166 - DNA, 18 bp, Homo sapiens
gccagagcatatctccag

SEQ ID NO: 7947167 - DNA, 22 bp, Homo sapiens
gccagagcagaatagagtggcc

SEQ ID NO: 7947168 - DNA, 22 bp, Homo sapiens
gccagagcacaggctggtagta

SEQ ID NO: 7947169 - DNA, 22 bp, Homo sapiens
gccagagcacaggctggtagta

SEQ ID NO: 7947170 - DNA, 22 bp, Homo sapiens
gccagagcacaggctggtagta

SEQ ID NO: 7947171 - DNA, 22 bp, Homo sapiens
gccagagaggccttagaatcca

SEQ ID NO: 7947172 - DNA, 22 bp, Homo sapiens
gccagagaggccttagaatcca

SEQ ID NO: 7947173 - DNA, 22 bp, Homo sapiens
gccagagcacaggctggtagta

SEQ ID NO: 7947174 - DNA, 22 bp, Homo sapiens
gccagagagagtccctgggcct

SEQ ID NO: 7947175 - DNA, 22 bp, Homo sapiens
gccagagagagtccctgggcct

SEQ ID NO: 7947176 - DNA, 22 bp, Homo sapiens
gccagagagatggaaaagctta

SEQ ID NO: 7947177 - DNA, 22 bp, Homo sapiens
gccagagaggcctaaggccata

SEQ ID NO: 7947178 - DNA, 22 bp, Homo sapiens
gccagagaggcctaaggccata

SEQ ID NO: 7947179 - DNA, 22 bp, Homo sapiens
gccagagaggcctaaggccata

SEQ ID NO: 7947180 - DNA, 22 bp, Homo sapiens
gccagagaggccgaggtaccca

SEQ ID NO: 7947181 - DNA, 22 bp, Homo sapiens
gccagagaggccgaggtaccca

SEQ ID NO: 7947182 - DNA, 22 bp, Homo sapiens
gccagagaggccgaggtaccca

SEQ ID NO: 7947183 - DNA, 22 bp, Homo sapiens
gccagagaggcaaatcctagca

SEQ ID NO: 7947184 - DNA, 22 bp, Homo sapiens
gccagagagagtccctgggcct

SEQ ID NO: 7947185 - DNA, 22 bp, Homo sapiens
gccagagagactgatacatgct

SEQ ID NO: 7947186 - DNA, 22 bp, Homo sapiens
gccagagagactgatacatgct

SEQ ID NO: 7947187 - DNA, 22 bp, Homo sapiens
gccagagagactgatacatgct

SEQ ID NO: 7947188 - DNA, 22 bp, Homo sapiens
gccagagagactgatacatgct

SEQ ID NO: 7947189 - DNA, 22 bp, Homo sapiens
gccaagggtagtggaggcccct

SEQ ID NO: 7947190 - DNA, 22 bp, Homo sapiens
gccaagggaactgagccggagg

SEQ ID NO: 7947191 - DNA, 22 bp, Homo sapiens
gccaaggctgaggccctgggct

SEQ ID NO: 7947192 - DNA, 22 bp, Homo sapiens
gccaagggaactgagccggagg

SEQ ID NO: 7947193 - DNA, 22 bp, Homo sapiens
gccaagggaactgagccggagg

SEQ ID NO: 7947194 - DNA, 19 bp, Homo sapiens
gccaagggacttgcttctt

SEQ ID NO: 7947195 - DNA, 22 bp, Homo sapiens
gccaagggggcagtgcatgggt

SEQ ID NO: 7947196 - DNA, 22 bp, Homo sapiens
gccaagggggcagtgcatgggt

SEQ ID NO: 7947197 - DNA, 22 bp, Homo sapiens
gcacaggccatgggaggacagc

SEQ ID NO: 7947198 - DNA, 22 bp, Homo sapiens
gcacaggccatgggaggacagc

SEQ ID NO: 7947199 - DNA, 22 bp, Homo sapiens
gcacaggccatgggaggacagc

SEQ ID NO: 7947200 - DNA, 22 bp, Homo sapiens
gcacaggcacagagggccactg

SEQ ID NO: 7947201 - DNA, 22 bp, Homo sapiens
gcacaggcatcaggctttttct

SEQ ID NO: 7947202 - DNA, 22 bp, Homo sapiens
gcacaggcacagagggccactg

SEQ ID NO: 7947203 - DNA, 22 bp, Homo sapiens
gcacaggcacagagggccactg

SEQ ID NO: 7947204 - DNA, 22 bp, Homo sapiens
gcacaggcacagagggccactg

SEQ ID NO: 7947205 - DNA, 22 bp, Homo sapiens
gcacaggcacagagggccactg

SEQ ID NO: 7947206 - DNA, 22 bp, Homo sapiens
gcacctgggacccagaggcacc

SEQ ID NO: 7947207 - DNA, 22 bp, Homo sapiens
gcacctgggcaaggattcagag

SEQ ID NO: 7947208 - DNA, 22 bp, Homo sapiens
gcacctggggtacacagctaca

SEQ ID NO: 7947209 - DNA, 22 bp, Homo sapiens
gcacctgggacccagaggcacc

SEQ ID NO: 7947210 - DNA, 22 bp, Homo sapiens
gcacctgggacccagaggcacc

SEQ ID NO: 7947211 - DNA, 22 bp, Homo sapiens
gcacctgggacccagaggcacc

SEQ ID NO: 7947212 - DNA, 22 bp, Homo sapiens
gcactctcctggctgccacagt

SEQ ID NO: 7947213 - DNA, 18 bp, Homo sapiens
gcactctgactgcagagc

SEQ ID NO: 7947214 - DNA, 18 bp, Homo sapiens
gcactctgactgcagagc

SEQ ID NO: 7947215 - DNA, 21 bp, Homo sapiens
gcactcagtcactactcaaga

SEQ ID NO: 7947216 - DNA, 17 bp, Homo sapiens
gcactcccccacctcct

SEQ ID NO: 7947217 - DNA, 22 bp, Homo sapiens
gcactctgccaggtctcctgat

SEQ ID NO: 7947218 - DNA, 18 bp, Homo sapiens
gcactctgactgcagagc

SEQ ID NO: 7947219 - DNA, 22 bp, Homo sapiens
gcactctgtttctcctgtcagc

SEQ ID NO: 7947220 - DNA, 22 bp, Homo sapiens
gcactctgtgatctgcagagcc

SEQ ID NO: 7947221 - DNA, 22 bp, Homo sapiens
gcactctgtttctcctgtcagc

SEQ ID NO: 7947222 - DNA, 22 bp, Homo sapiens
gcactgaaaatgttggattcca

SEQ ID NO: 7947223 - DNA, 22 bp, Homo sapiens
gcactgaaaatgttggattcca

SEQ ID NO: 7947224 - DNA, 22 bp, Homo sapiens
gcactgaaattatatgcatttg

SEQ ID NO: 7947225 - DNA, 18 bp, Homo sapiens
gcactgaggaaaacctct

SEQ ID NO: 7947226 - DNA, 22 bp, Homo sapiens
gcactgagtctgtcatgctgca

SEQ ID NO: 7947227 - DNA, 22 bp, Homo sapiens
gcactgagtctgtcatgctgca

SEQ ID NO: 7947228 - DNA, 22 bp, Homo sapiens
gcactgaggaaggagggagtgg

SEQ ID NO: 7947229 - DNA, 22 bp, Homo sapiens
gcactgaggaaggagggagtgg

SEQ ID NO: 7947230 - DNA, 17 bp, Homo sapiens
gcactgagccacagttt

SEQ ID NO: 7947231 - DNA, 17 bp, Homo sapiens
gcactgagccacagttt

SEQ ID NO: 7947232 - DNA, 21 bp, Homo sapiens
gcactgagcatctcctctgcc

SEQ ID NO: 7947233 - DNA, 22 bp, Homo sapiens
gcactgagcaccagccacagat

SEQ ID NO: 7947234 - DNA, 22 bp, Homo sapiens
gcactgagcaccagccacagat

SEQ ID NO: 7947235 - DNA, 22 bp, Homo sapiens
gcactgagcaccagccacagat

SEQ ID NO: 7947236 - DNA, 22 bp, Homo sapiens
gcactgaactttaatcatttct

SEQ ID NO: 7947237 - DNA, 19 bp, Homo sapiens
gcactgaagagttggtcac

SEQ ID NO: 7947238 - DNA, 20 bp, Homo sapiens
gcactgaaggttccagggga

SEQ ID NO: 7947239 - DNA, 17 bp, Homo sapiens
gcactgaacaatcctgt

SEQ ID NO: 7947240 - DNA, 20 bp, Homo sapiens
gcactgaaattcaatgtttg

SEQ ID NO: 7947241 - DNA, 22 bp, Homo sapiens
gcactgaatgccaaagtgtagg

SEQ ID NO: 7947242 - DNA, 22 bp, Homo sapiens
gcactgaatgccaaagtgtagg

SEQ ID NO: 7947243 - DNA, 22 bp, Homo sapiens
gcactgaatgcttttactgtaa

SEQ ID NO: 7947244 - DNA, 22 bp, Homo sapiens
gcactgacatttcaagaacagc

SEQ ID NO: 7947245 - DNA, 22 bp, Homo sapiens
gcactgagcaccagccacagat

SEQ ID NO: 7947246 - DNA, 22 bp, Homo sapiens
gcactgcaggtgggtggagagg

SEQ ID NO: 7947247 - DNA, 22 bp, Homo sapiens
gcactgccacataatctcagca

SEQ ID NO: 7947248 - DNA, 22 bp, Homo sapiens
gcactgccacataatctcagca

SEQ ID NO: 7947249 - DNA, 22 bp, Homo sapiens
gcactgccacataatctcagca

SEQ ID NO: 7947250 - DNA, 22 bp, Homo sapiens
gcactgcagcctcagatggtgg

SEQ ID NO: 7947251 - DNA, 22 bp, Homo sapiens
gcactgcaggtgggtggagagg

SEQ ID NO: 7947252 - DNA, 22 bp, Homo sapiens
gcactgagtctgtcatgctgca

SEQ ID NO: 7947253 - DNA, 22 bp, Homo sapiens
gcactgagtctgtcatgctgca

SEQ ID NO: 7947254 - DNA, 22 bp, Homo sapiens
gcactgagtctgtcatgctgca

SEQ ID NO: 7947255 - DNA, 22 bp, Homo sapiens
gcactgagtctgtcatgctgca

SEQ ID NO: 7947256 - DNA, 22 bp, Homo sapiens
gcactgctccaggtgtggcttg

SEQ ID NO: 7947257 - DNA, 22 bp, Homo sapiens
gcactgctccaggtgtggcttg

SEQ ID NO: 7947258 - DNA, 22 bp, Homo sapiens
gcactgctatttagctccatca

SEQ ID NO: 7947259 - DNA, 22 bp, Homo sapiens
gcactgctatttagctccatca

SEQ ID NO: 7947260 - DNA, 21 bp, Homo sapiens
gcactgctagaaccccctgga

SEQ ID NO: 7947261 - DNA, 16 bp, Homo sapiens
gcactgccttgggccc

SEQ ID NO: 7947262 - DNA, 22 bp, Homo sapiens
gcactgcctgtgttcagggtaa

SEQ ID NO: 7947263 - DNA, 23 bp, Homo sapiens
gcactgccatgtgctctgcaggc

SEQ ID NO: 7947264 - DNA, 23 bp, Homo sapiens
gcactgccatgtgctctgcaggc

SEQ ID NO: 7947265 - DNA, 23 bp, Homo sapiens
gcactgccatgtgctctgcaggc

SEQ ID NO: 7947266 - DNA, 23 bp, Homo sapiens
gcactgccatgtgctctgcaggc

SEQ ID NO: 7947267 - DNA, 22 bp, Homo sapiens
gcactgggaagaatgagcctgt

SEQ ID NO: 7947268 - DNA, 22 bp, Homo sapiens
gcactgggaagaatgagcctgt

SEQ ID NO: 7947269 - DNA, 22 bp, Homo sapiens
gcactgggaagaatgagcctgt

SEQ ID NO: 7947270 - DNA, 22 bp, Homo sapiens
gcactggccgcacgcgtagggc

SEQ ID NO: 7947271 - DNA, 22 bp, Homo sapiens
gcactggattttgatctgcaag

SEQ ID NO: 7947272 - DNA, 22 bp, Homo sapiens
gcactggatcttgggagacgtg

SEQ ID NO: 7947273 - DNA, 22 bp, Homo sapiens
gcactggatcttgggagacgtg

SEQ ID NO: 7947274 - DNA, 22 bp, Homo sapiens
gcactggatcttgggagacgtg

SEQ ID NO: 7947275 - DNA, 22 bp, Homo sapiens
gcactggagggtgtagttgctg

SEQ ID NO: 7947276 - DNA, 22 bp, Homo sapiens
gcactggattttgatctgcaag

SEQ ID NO: 7947277 - DNA, 22 bp, Homo sapiens
gcactggattttgatctgcaag

SEQ ID NO: 7947278 - DNA, 22 bp, Homo sapiens
gcactggattttgatctgcaag

SEQ ID NO: 7947279 - DNA, 22 bp, Homo sapiens
gcactgggaatgagggcagctt

SEQ ID NO: 7947280 - DNA, 22 bp, Homo sapiens
gcactgggaatgagggcagctt

SEQ ID NO: 7947281 - DNA, 22 bp, Homo sapiens
gcactgggaatgagggcagctt

SEQ ID NO: 7947282 - DNA, 22 bp, Homo sapiens
gcactgggaagaatgagcctgt

SEQ ID NO: 7947283 - DNA, 22 bp, Homo sapiens
gcactgggaatgagggcagctt

SEQ ID NO: 7947284 - DNA, 22 bp, Homo sapiens
gcactgggaagaatgagcctgt

SEQ ID NO: 7947285 - DNA, 22 bp, Homo sapiens
gcactgggaagaatgagcctgt

SEQ ID NO: 7947286 - DNA, 22 bp, Homo sapiens
gcactgcttttacctaggtgag

SEQ ID NO: 7947287 - DNA, 22 bp, Homo sapiens
gcactgcttttacctaggtgag

SEQ ID NO: 7947288 - DNA, 22 bp, Homo sapiens
gcactgcttttacctaggtgag

SEQ ID NO: 7947289 - DNA, 23 bp, Homo sapiens
gcactggaaaaatgaagattact

SEQ ID NO: 7947290 - DNA, 22 bp, Homo sapiens
gcactgctccagtctctgcttt

SEQ ID NO: 7947291 - DNA, 22 bp, Homo sapiens
gcactgctccagtctctgcttt

SEQ ID NO: 7947292 - DNA, 22 bp, Homo sapiens
gcactgctccaggtgtggcttg

SEQ ID NO: 7947293 - DNA, 22 bp, Homo sapiens
gcactgctccagtctctgcttt

SEQ ID NO: 7947294 - DNA, 22 bp, Homo sapiens
gcactggaaatacctagatgaa

SEQ ID NO: 7947295 - DNA, 22 bp, Homo sapiens
gcactggaaggagggaatctta

SEQ ID NO: 7947296 - DNA, 22 bp, Homo sapiens
gcactggaaatacctagatgaa

SEQ ID NO: 7947297 - DNA, 22 bp, Homo sapiens
gcactggaaatacctagatgaa

SEQ ID NO: 7947298 - DNA, 22 bp, Homo sapiens
gcactggaaatacctagatgaa

SEQ ID NO: 7947299 - DNA, 22 bp, Homo sapiens
gcactggacaggagtgaaatta

SEQ ID NO: 7947300 - DNA, 22 bp, Homo sapiens
gcactggacaggagtgaaatta

SEQ ID NO: 7947301 - DNA, 22 bp, Homo sapiens
gcactggaaggagggaatctta

SEQ ID NO: 7947302 - DNA, 22 bp, Homo sapiens
gcactggagaatggctgtattc

SEQ ID NO: 7947303 - DNA, 22 bp, Homo sapiens
gcactggagaatggctgtattc

SEQ ID NO: 7947304 - DNA, 22 bp, Homo sapiens
gcactggagaatggctgtattc

SEQ ID NO: 7947305 - DNA, 22 bp, Homo sapiens
gcactggagaatggctgtattc

SEQ ID NO: 7947306 - DNA, 22 bp, Homo sapiens
gcactggagatacagagatgaa

SEQ ID NO: 7947307 - DNA, 22 bp, Homo sapiens
gcactggaccccaggatatgga

SEQ ID NO: 7947308 - DNA, 22 bp, Homo sapiens
gcactggaccccaggatatgga

SEQ ID NO: 7947309 - DNA, 22 bp, Homo sapiens
gcactggaccccaggatatgga

SEQ ID NO: 7947310 - DNA, 22 bp, Homo sapiens
gcactggagatacagagatgaa

SEQ ID NO: 7947311 - DNA, 22 bp, Homo sapiens
gcactggagatacagagatgaa

SEQ ID NO: 7947312 - DNA, 22 bp, Homo sapiens
gcactggagatacagagatgaa

SEQ ID NO: 7947313 - DNA, 22 bp, Homo sapiens
gcactggagatacagagatgaa

SEQ ID NO: 7947314 - DNA, 22 bp, Homo sapiens
gcactggagatggggttgtcgg

SEQ ID NO: 7947315 - DNA, 22 bp, Homo sapiens
gcactggagatggggttgtcgg

SEQ ID NO: 7947316 - DNA, 22 bp, Homo sapiens
gcactggagggtgtagttgctg

SEQ ID NO: 7947317 - DNA, 22 bp, Homo sapiens
gcactggagatggggttgtcgg

SEQ ID NO: 7947318 - DNA, 22 bp, Homo sapiens
gcactggagatggggttgtcgg

SEQ ID NO: 7947319 - DNA, 22 bp, Homo sapiens
gcactgtgctaaacatgtatca

SEQ ID NO: 7947320 - DNA, 22 bp, Homo sapiens
gcactgtgatcaaggctaagca

SEQ ID NO: 7947321 - DNA, 22 bp, Homo sapiens
gcactgtgctagaagccagggg

SEQ ID NO: 7947322 - DNA, 22 bp, Homo sapiens
gcactgtgctagaagccagggg

SEQ ID NO: 7947323 - DNA, 22 bp, Homo sapiens
gcactgtgctaaacatgtatca

SEQ ID NO: 7947324 - DNA, 22 bp, Homo sapiens
gcactgtgctaaacatgtatca

SEQ ID NO: 7947325 - DNA, 22 bp, Homo sapiens
gcactgtgctagaagccagggg

SEQ ID NO: 7947326 - DNA, 22 bp, Homo sapiens
gcactgggctccaggaaggagg

SEQ ID NO: 7947327 - DNA, 23 bp, Homo sapiens
gcactgggctctcagcaaggtgt

SEQ ID NO: 7947328 - DNA, 22 bp, Homo sapiens
gcactgggctccaggaaggagg

SEQ ID NO: 7947329 - DNA, 23 bp, Homo sapiens
gcactgggctctcagcaaggtgt

SEQ ID NO: 7947330 - DNA, 23 bp, Homo sapiens
gcactgggctctcagcaaggtgt

SEQ ID NO: 7947331 - DNA, 22 bp, Homo sapiens
gcactgggctccaggaaggagg

SEQ ID NO: 7947332 - DNA, 22 bp, Homo sapiens
gcactgggctccaggaaggagg

SEQ ID NO: 7947333 - DNA, 22 bp, Homo sapiens
gcactgggctccaggaaggagg

SEQ ID NO: 7947334 - DNA, 22 bp, Homo sapiens
gcactgggctccaggaaggagg

SEQ ID NO: 7947335 - DNA, 16 bp, Homo sapiens
gcactgggatgtcttc

SEQ ID NO: 7947336 - DNA, 16 bp, Homo sapiens
gcactgggatgtcttc

SEQ ID NO: 7947337 - DNA, 22 bp, Homo sapiens
gcactgggctccaggaaggagg

SEQ ID NO: 7947338 - DNA, 22 bp, Homo sapiens
gcactgggagtctgtgggggtt

SEQ ID NO: 7947339 - DNA, 22 bp, Homo sapiens
gcactgggagtctgtgggggtt

SEQ ID NO: 7947340 - DNA, 22 bp, Homo sapiens
gcactgggagtctgtgggggtt

SEQ ID NO: 7947341 - DNA, 22 bp, Homo sapiens
gcactgggagtctgtgggggtt

SEQ ID NO: 7947342 - DNA, 22 bp, Homo sapiens
gcactgggaatgtgagcagctg

SEQ ID NO: 7947343 - DNA, 22 bp, Homo sapiens
gcactgggaatgtgagcagctg

SEQ ID NO: 7947344 - DNA, 22 bp, Homo sapiens
gcactgggaatgtgagcagctg

SEQ ID NO: 7947345 - DNA, 22 bp, Homo sapiens
gcactgggagctgcctgccggt

SEQ ID NO: 7947346 - DNA, 22 bp, Homo sapiens
gcactgggagctgcctgccggt

SEQ ID NO: 7947347 - DNA, 22 bp, Homo sapiens
gcactgggagtctgtgggggtt

SEQ ID NO: 7947348 - DNA, 22 bp, Homo sapiens
gcactgggagtctgtgggggtt

SEQ ID NO: 7947349 - DNA, 22 bp, Homo sapiens
gcactgggaatgtgagcagctg

SEQ ID NO: 7947350 - DNA, 22 bp, Homo sapiens
gcactgggagtctgtgggggtt

SEQ ID NO: 7947351 - DNA, 22 bp, Homo sapiens
gcactgggagctgcctgccggt

SEQ ID NO: 7947352 - DNA, 22 bp, Homo sapiens
gcactgggaatgctgatgggct

SEQ ID NO: 7947353 - DNA, 22 bp, Homo sapiens
gcactgggaatgctgatgggct

SEQ ID NO: 7947354 - DNA, 22 bp, Homo sapiens
gcactgggaatgctgatgggct

SEQ ID NO: 7947355 - DNA, 22 bp, Homo sapiens
gcactgggaatgtgagcagctg

SEQ ID NO: 7947356 - DNA, 22 bp, Homo sapiens
gcactgggaatgtgagcagctg

SEQ ID NO: 7947357 - DNA, 22 bp, Homo sapiens
gcactgggaatgtgagcagctg

SEQ ID NO: 7947358 - DNA, 22 bp, Homo sapiens
gcactgggaatgtgagcagctg

SEQ ID NO: 7947359 - DNA, 22 bp, Homo sapiens
gcactgggaatgagggcagctt

SEQ ID NO: 7947360 - DNA, 22 bp, Homo sapiens
gcactgggaatgctgatgggct

SEQ ID NO: 7947361 - DNA, 22 bp, Homo sapiens
gcactgggaatgctgatgggct

SEQ ID NO: 7947362 - DNA, 22 bp, Homo sapiens
gcactgtgctagaagccagggg

SEQ ID NO: 7947363 - DNA, 22 bp, Homo sapiens
gcactgtgctaggtatcaggga

SEQ ID NO: 7947364 - DNA, 22 bp, Homo sapiens
gcactgtgctagaagccagggg

SEQ ID NO: 7947365 - DNA, 22 bp, Homo sapiens
gcactgtgctagaagccagggg

SEQ ID NO: 7947366 - DNA, 22 bp, Homo sapiens
gcactgttctaggtgcagagct

SEQ ID NO: 7947367 - DNA, 22 bp, Homo sapiens
gcactgtgcttagttcactatt

SEQ ID NO: 7947368 - DNA, 20 bp, Homo sapiens
gcactgttacaaagcacacc

SEQ ID NO: 7947369 - DNA, 22 bp, Homo sapiens
gcactgtgctaggtatcaggga

SEQ ID NO: 7947370 - DNA, 22 bp, Homo sapiens
gcactgttctaggtgcagagct

SEQ ID NO: 7947371 - DNA, 22 bp, Homo sapiens
gcactgttctcagagcattaga

SEQ ID NO: 7947372 - DNA, 22 bp, Homo sapiens
gcacttaactggaaaagaattt

SEQ ID NO: 7947373 - DNA, 22 bp, Homo sapiens
gcacttagggtatgtactgggc

SEQ ID NO: 7947374 - DNA, 18 bp, Homo sapiens
gcacttcacagggatagt

SEQ ID NO: 7947375 - DNA, 22 bp, Homo sapiens
gcacttgaaaagatcaggtgca

SEQ ID NO: 7947376 - DNA, 22 bp, Homo sapiens
gcacttctatttttttcagtgg

SEQ ID NO: 7947377 - DNA, 22 bp, Homo sapiens
gcacttcaccactgtcctggtt

SEQ ID NO: 7947378 - DNA, 22 bp, Homo sapiens
gcacttgataaatgttaactga

SEQ ID NO: 7947379 - DNA, 22 bp, Homo sapiens
gcacttgataaatgttaactga

SEQ ID NO: 7947380 - DNA, 22 bp, Homo sapiens
gcacttgaggacgactcagctg

SEQ ID NO: 7947381 - DNA, 22 bp, Homo sapiens
gcacttgagccaatgctagtag

SEQ ID NO: 7947382 - DNA, 22 bp, Homo sapiens
gcacttgaaaagatcaggtgca

SEQ ID NO: 7947383 - DNA, 22 bp, Homo sapiens
gcacttgacccccagagctggt

SEQ ID NO: 7947384 - DNA, 22 bp, Homo sapiens
gcacttgacccccagagctggt

SEQ ID NO: 7947385 - DNA, 22 bp, Homo sapiens
gcacttgagccaatgctagtag

SEQ ID NO: 7947386 - DNA, 23 bp, Homo sapiens
gcagaggagcaagctggacacca

SEQ ID NO: 7947387 - DNA, 23 bp, Homo sapiens
gcagaggagcaagctggacacca

SEQ ID NO: 7947388 - DNA, 23 bp, Homo sapiens
gcagaggagcaagctggacacca

SEQ ID NO: 7947389 - DNA, 23 bp, Homo sapiens
gcagaggagcaagctggacacca

SEQ ID NO: 7947390 - DNA, 23 bp, Homo sapiens
gcagaggagcaagctggacacca

SEQ ID NO: 7947391 - DNA, 23 bp, Homo sapiens
gcagaggagcaagctggacacca

SEQ ID NO: 7947392 - DNA, 22 bp, Homo sapiens
gcagaggagcaagctggacacc

SEQ ID NO: 7947393 - DNA, 22 bp, Homo sapiens
gcagaggagcaagctggacacc

SEQ ID NO: 7947394 - DNA, 22 bp, Homo sapiens
gcagaggagcaagctggacacc

SEQ ID NO: 7947395 - DNA, 22 bp, Homo sapiens
gcagaggagcaagctggacacc

SEQ ID NO: 7947396 - DNA, 22 bp, Homo sapiens
gcagaggagcaagctggacacc

SEQ ID NO: 7947397 - DNA, 22 bp, Homo sapiens
gcagaggagcaagctggacacc

SEQ ID NO: 7947398 - DNA, 22 bp, Homo sapiens
gcagaggagcaagctggacacc

SEQ ID NO: 7947399 - DNA, 22 bp, Homo sapiens
gcagaggacagggatttagatt

SEQ ID NO: 7947400 - DNA, 22 bp, Homo sapiens
gcagaggacagggatttagatt

SEQ ID NO: 7947401 - DNA, 22 bp, Homo sapiens
gcagaggagatgaagatacttt

SEQ ID NO: 7947402 - DNA, 22 bp, Homo sapiens
gcagaggactcaatcaaggtat

SEQ ID NO: 7947403 - DNA, 22 bp, Homo sapiens
gcagaggactcaatcaaggtat

SEQ ID NO: 7947404 - DNA, 22 bp, Homo sapiens
gcagaggactcaatcaaggtat

SEQ ID NO: 7947405 - DNA, 22 bp, Homo sapiens
gcagaggactcaatcaaggtat

SEQ ID NO: 7947406 - DNA, 22 bp, Homo sapiens
gcagaggactcaatcaaggtat

SEQ ID NO: 7947407 - DNA, 22 bp, Homo sapiens
gcacttggaggtgcccacacag

SEQ ID NO: 7947408 - DNA, 22 bp, Homo sapiens
gcacttgattacattagtgcct

SEQ ID NO: 7947409 - DNA, 22 bp, Homo sapiens
gcacttgattacattagtgcct

SEQ ID NO: 7947410 - DNA, 22 bp, Homo sapiens
gcacttggatatacaaatgaag

SEQ ID NO: 7947411 - DNA, 22 bp, Homo sapiens
gcagagctccccaagacaccaa

SEQ ID NO: 7947412 - DNA, 22 bp, Homo sapiens
gcagagctctgttcttatctcc

SEQ ID NO: 7947413 - DNA, 22 bp, Homo sapiens
gcagagctgagcggctgcccgg

SEQ ID NO: 7947414 - DNA, 22 bp, Homo sapiens
gcagagctgagcggctgcccgg

SEQ ID NO: 7947415 - DNA, 22 bp, Homo sapiens
gcagagctctgttcttatctcc

SEQ ID NO: 7947416 - DNA, 22 bp, Homo sapiens
gcagagctgcagcgaggcctgg

SEQ ID NO: 7947417 - DNA, 22 bp, Homo sapiens
gcagagctgcagcgaggcctgg

SEQ ID NO: 7947418 - DNA, 22 bp, Homo sapiens
gcagagctgcagcgaggcctgg

SEQ ID NO: 7947419 - DNA, 22 bp, Homo sapiens
gcagagctgcagcgaggcctgg

SEQ ID NO: 7947420 - DNA, 22 bp, Homo sapiens
gcagaggacacaggagggcaag

SEQ ID NO: 7947421 - DNA, 22 bp, Homo sapiens
gcagaggacacaggagggcaag

SEQ ID NO: 7947422 - DNA, 22 bp, Homo sapiens
gcagaggacacaggagggcaag

SEQ ID NO: 7947423 - DNA, 22 bp, Homo sapiens
gcagaggacacaggagggcaag

SEQ ID NO: 7947424 - DNA, 22 bp, Homo sapiens
gcagaggacacaggagggcaag

SEQ ID NO: 7947425 - DNA, 22 bp, Homo sapiens
gcagaggacacaggagggcaag

SEQ ID NO: 7947426 - DNA, 22 bp, Homo sapiens
gcagaggacacaggagggcaag

SEQ ID NO: 7947427 - DNA, 22 bp, Homo sapiens
gcagaggacacaggagggcaag

SEQ ID NO: 7947428 - DNA, 22 bp, Homo sapiens
gcagaggacacaggagggcaag

SEQ ID NO: 7947429 - DNA, 22 bp, Homo sapiens
gcagaggacacaggagggcaag

SEQ ID NO: 7947430 - DNA, 22 bp, Homo sapiens
gcagaggacacaggagggcaag

SEQ ID NO: 7947431 - DNA, 22 bp, Homo sapiens
gcacagccttgccctgtgccct

SEQ ID NO: 7947432 - DNA, 22 bp, Homo sapiens
gcacagccttgccctgtgccct

SEQ ID NO: 7947433 - DNA, 22 bp, Homo sapiens
gcacagccttgccctgtgccct

SEQ ID NO: 7947434 - DNA, 22 bp, Homo sapiens
gcacagccttgccctgtgccct

SEQ ID NO: 7947435 - DNA, 22 bp, Homo sapiens
gcacagcctgtccctgtcctgg

SEQ ID NO: 7947436 - DNA, 22 bp, Homo sapiens
gcacagcctgtccctgtcctgg

SEQ ID NO: 7947437 - DNA, 22 bp, Homo sapiens
gcacagccttgccctgtgccct

SEQ ID NO: 7947438 - DNA, 22 bp, Homo sapiens
gcacagccttgccctgtgccct

SEQ ID NO: 7947439 - DNA, 22 bp, Homo sapiens
gcacagcctgtccctgtcctgg

SEQ ID NO: 7947440 - DNA, 22 bp, Homo sapiens
gcacagccctggtcggggcccc

SEQ ID NO: 7947441 - DNA, 22 bp, Homo sapiens
gcacagccctggtcggggcccc

SEQ ID NO: 7947442 - DNA, 22 bp, Homo sapiens
gcacagccggaccgaggaaaag

SEQ ID NO: 7947443 - DNA, 22 bp, Homo sapiens
gcacagccggaccgaggaaaag

SEQ ID NO: 7947444 - DNA, 22 bp, Homo sapiens
gcacagccctggtcggggcccc

SEQ ID NO: 7947445 - DNA, 22 bp, Homo sapiens
gcacagccctgagcgcatgtct

SEQ ID NO: 7947446 - DNA, 22 bp, Homo sapiens
gcacagccagcatctgagggat

SEQ ID NO: 7947447 - DNA, 22 bp, Homo sapiens
gcacagccagcatctgagggat

SEQ ID NO: 7947448 - DNA, 18 bp, Homo sapiens
gcacagctaggagggtcc

SEQ ID NO: 7947449 - DNA, 22 bp, Homo sapiens
gcacagctagacggtagccaaa

SEQ ID NO: 7947450 - DNA, 22 bp, Homo sapiens
gcacagctagacggtagccaaa

SEQ ID NO: 7947451 - DNA, 22 bp, Homo sapiens
gcacagctcagcatgggaggac

SEQ ID NO: 7947452 - DNA, 22 bp, Homo sapiens
gcacagctatgagctgaattgt

SEQ ID NO: 7947453 - DNA, 18 bp, Homo sapiens
gcacagctaggagggtcc

SEQ ID NO: 7947454 - DNA, 18 bp, Homo sapiens
gcacagctaggagggtcc

SEQ ID NO: 7947455 - DNA, 22 bp, Homo sapiens
gcacagctccgcttcctcacac

SEQ ID NO: 7947456 - DNA, 22 bp, Homo sapiens
gcacagctcgagctcaggaggg

SEQ ID NO: 7947457 - DNA, 22 bp, Homo sapiens
gcacagctcctggtaagctggg

SEQ ID NO: 7947458 - DNA, 22 bp, Homo sapiens
gcacagctccgcttcctcacac

SEQ ID NO: 7947459 - DNA, 22 bp, Homo sapiens
gcacagctccgcttcctcacac

SEQ ID NO: 7947460 - DNA, 22 bp, Homo sapiens
gcacagctcagtactccctctg

SEQ ID NO: 7947461 - DNA, 22 bp, Homo sapiens
gcacagctcagtactccctctg

SEQ ID NO: 7947462 - DNA, 22 bp, Homo sapiens
gcacagctcagtactccctctg

SEQ ID NO: 7947463 - DNA, 22 bp, Homo sapiens
gcacagctcagcatgggaggac

SEQ ID NO: 7947464 - DNA, 22 bp, Homo sapiens
gcacaggcaatagatacagcta

SEQ ID NO: 7947465 - DNA, 22 bp, Homo sapiens
gcacaggcaatagatacagcta

SEQ ID NO: 7947466 - DNA, 22 bp, Homo sapiens
gcacaggcaatagatacagcta

SEQ ID NO: 7947467 - DNA, 22 bp, Homo sapiens
gcacaggcacagagggccactg

SEQ ID NO: 7947468 - DNA, 22 bp, Homo sapiens
gcacaggcacagagggccactg

SEQ ID NO: 7947469 - DNA, 22 bp, Homo sapiens
gcacaggcacagagggccactg

SEQ ID NO: 7947470 - DNA, 19 bp, Homo sapiens
gcacaggacatctgatgga

SEQ ID NO: 7947471 - DNA, 22 bp, Homo sapiens
gcacaggagccaggtccttcac

SEQ ID NO: 7947472 - DNA, 22 bp, Homo sapiens
gcacaggagccaggtccttcac

SEQ ID NO: 7947473 - DNA, 22 bp, Homo sapiens
gcacaggagccaggtccttcac

SEQ ID NO: 7947474 - DNA, 22 bp, Homo sapiens
gcacaggaggccgatgctcatg

SEQ ID NO: 7947475 - DNA, 22 bp, Homo sapiens
gcacaggaggccgatgctcatg

SEQ ID NO: 7947476 - DNA, 22 bp, Homo sapiens
gcacaggaggccgatgctcatg

SEQ ID NO: 7947477 - DNA, 22 bp, Homo sapiens
gcacaggaggccgatgctcatg

SEQ ID NO: 7947478 - DNA, 22 bp, Homo sapiens
gcacaggatgatgggttgaggg

SEQ ID NO: 7947479 - DNA, 22 bp, Homo sapiens
gcacaggaggccgatgctcatg

SEQ ID NO: 7947480 - DNA, 22 bp, Homo sapiens
gcacagctctccccaagacgaa

SEQ ID NO: 7947481 - DNA, 20 bp, Homo sapiens
gcacagctgagttcagggtc

SEQ ID NO: 7947482 - DNA, 22 bp, Homo sapiens
gcacagctcgagctcaggaggg

SEQ ID NO: 7947483 - DNA, 22 bp, Homo sapiens
gcacagctcgagctcaggaggg

SEQ ID NO: 7947484 - DNA, 19 bp, Homo sapiens
gcacaggacatctgatgga

SEQ ID NO: 7947485 - DNA, 19 bp, Homo sapiens
gcacaggacatctgatgga

SEQ ID NO: 7947486 - DNA, 22 bp, Homo sapiens
gcacaggaaatgactcatgtta

SEQ ID NO: 7947487 - DNA, 22 bp, Homo sapiens
gcacaggaaatgactcatgtta

SEQ ID NO: 7947488 - DNA, 22 bp, Homo sapiens
gcacaggaaatgactcatgtta

SEQ ID NO: 7947489 - DNA, 22 bp, Homo sapiens
gcacaggaaatgactcatgtta

SEQ ID NO: 7947490 - DNA, 22 bp, Homo sapiens
gcacagcttcctctttctctga

SEQ ID NO: 7947491 - DNA, 22 bp, Homo sapiens
gcacagctggggtatgatgcca

SEQ ID NO: 7947492 - DNA, 22 bp, Homo sapiens
gcacagctggggtatgatgcca

SEQ ID NO: 7947493 - DNA, 22 bp, Homo sapiens
gcacagctggggtatgatgcca

SEQ ID NO: 7947494 - DNA, 22 bp, Homo sapiens
gcacagctggggtatgatgcca

SEQ ID NO: 7947495 - DNA, 22 bp, Homo sapiens
gcacagctggactctgcctggc

SEQ ID NO: 7947496 - DNA, 21 bp, Homo sapiens
gcaagccaccactgctgccac

SEQ ID NO: 7947497 - DNA, 18 bp, Homo sapiens
gcaagccctctccattaa

SEQ ID NO: 7947498 - DNA, 20 bp, Homo sapiens
gcaagcatgaagagtagaga

SEQ ID NO: 7947499 - DNA, 22 bp, Homo sapiens
gcaagctgatgtgatagtgaaa

SEQ ID NO: 7947500 - DNA, 22 bp, Homo sapiens
gcaagctgatgtgatagtgaaa

SEQ ID NO: 7947501 - DNA, 22 bp, Homo sapiens
gcaagctctctgcaggcagagc

SEQ ID NO: 7947502 - DNA, 22 bp, Homo sapiens
gcaagctggctgttagaggatg

SEQ ID NO: 7947503 - DNA, 22 bp, Homo sapiens
gcaagctggctgttagaggatg

SEQ ID NO: 7947504 - DNA, 22 bp, Homo sapiens
gcaagctgcttaagctcattgt

SEQ ID NO: 7947505 - DNA, 22 bp, Homo sapiens
gcaagctgctcttatgtggagg

SEQ ID NO: 7947506 - DNA, 22 bp, Homo sapiens
gcaagctgatgtgatagtgaaa

SEQ ID NO: 7947507 - DNA, 22 bp, Homo sapiens
gcaagctgctcttatgtggagg

SEQ ID NO: 7947508 - DNA, 22 bp, Homo sapiens
gcaagctgctcttatgtggagg

SEQ ID NO: 7947509 - DNA, 22 bp, Homo sapiens
gcaagcagggttccttagggca

SEQ ID NO: 7947510 - DNA, 22 bp, Homo sapiens
gcaagcagttacccaggattcg

SEQ ID NO: 7947511 - DNA, 22 bp, Homo sapiens
gcaagcagttacccaggattcg

SEQ ID NO: 7947512 - DNA, 22 bp, Homo sapiens
gcaagcagttgtggcttctgag

SEQ ID NO: 7947513 - DNA, 22 bp, Homo sapiens
gcaagcagttgtggcttctgag

SEQ ID NO: 7947514 - DNA, 22 bp, Homo sapiens
gcaagcagttgtggcttctgag

SEQ ID NO: 7947515 - DNA, 22 bp, Homo sapiens
gcaagcagatctccggagggaa

SEQ ID NO: 7947516 - DNA, 22 bp, Homo sapiens
gcaagcagatctccggagggaa

SEQ ID NO: 7947517 - DNA, 22 bp, Homo sapiens
gcaagcagatctccggagggaa

SEQ ID NO: 7947518 - DNA, 22 bp, Homo sapiens
gcaagcagcccagaacagctct

SEQ ID NO: 7947519 - DNA, 22 bp, Homo sapiens
gcaagcagcccagaacagctct

SEQ ID NO: 7947520 - DNA, 22 bp, Homo sapiens
gcaagcagacattcaggtaggt

SEQ ID NO: 7947521 - DNA, 22 bp, Homo sapiens
gcaagctgtccttttgcatggc

SEQ ID NO: 7947522 - DNA, 22 bp, Homo sapiens
gcaagctgtccttttgcatggc

SEQ ID NO: 7947523 - DNA, 22 bp, Homo sapiens
gcaagctgtgatttatgtgaat

SEQ ID NO: 7947524 - DNA, 22 bp, Homo sapiens
gcaagctgtgatttatgtgaat

SEQ ID NO: 7947525 - DNA, 22 bp, Homo sapiens
gcaagctgtgatttatgtgaat

SEQ ID NO: 7947526 - DNA, 20 bp, Homo sapiens
gcaagcttattagtgatatt

SEQ ID NO: 7947527 - DNA, 22 bp, Homo sapiens
gcacagcagtggcataaacaat

SEQ ID NO: 7947528 - DNA, 22 bp, Homo sapiens
gcacagcagctgggggccctgg

SEQ ID NO: 7947529 - DNA, 22 bp, Homo sapiens
gcacagcagtggcataaacaat

SEQ ID NO: 7947530 - DNA, 22 bp, Homo sapiens
gcaaggaacaaatgctctgctt

SEQ ID NO: 7947531 - DNA, 22 bp, Homo sapiens
gcaagcttcatatggcattttc

SEQ ID NO: 7947532 - DNA, 20 bp, Homo sapiens
gcaagcttattagtgatatt

SEQ ID NO: 7947533 - DNA, 22 bp, Homo sapiens
gcaagcttcatatggcattttc

SEQ ID NO: 7947534 - DNA, 22 bp, Homo sapiens
gcaaggaacaaatgctctgctt

SEQ ID NO: 7947535 - DNA, 22 bp, Homo sapiens
gcaaggaacaaatgctctgctt

SEQ ID NO: 7947536 - DNA, 22 bp, Homo sapiens
gcacagccactgagtgagaacc

SEQ ID NO: 7947537 - DNA, 22 bp, Homo sapiens
gcacagccagcatctgagggat

SEQ ID NO: 7947538 - DNA, 22 bp, Homo sapiens
gcacagccagcatctgagggat

SEQ ID NO: 7947539 - DNA, 22 bp, Homo sapiens
gcacagccacgtaatgtggtca

SEQ ID NO: 7947540 - DNA, 22 bp, Homo sapiens
gcacagccacgtaatgtggtca

SEQ ID NO: 7947541 - DNA, 21 bp, Homo sapiens
gcacagcatgagtgttggcat

SEQ ID NO: 7947542 - DNA, 22 bp, Homo sapiens
gcacagccactgagtgagaacc

SEQ ID NO: 7947543 - DNA, 22 bp, Homo sapiens
gcacagccactgagtgagaacc

SEQ ID NO: 7947544 - DNA, 22 bp, Homo sapiens
gcacagcatgaagagaggaagc

SEQ ID NO: 7947545 - DNA, 22 bp, Homo sapiens
gcacagcatgaagagaggaagc

SEQ ID NO: 7947546 - DNA, 22 bp, Homo sapiens
gcacagcatgaagagaggaagc

SEQ ID NO: 7947547 - DNA, 22 bp, Homo sapiens
gcacagcatgaagagaggaagc

SEQ ID NO: 7947548 - DNA, 21 bp, Homo sapiens
gcacagcatgagtgttggcat

SEQ ID NO: 7947549 - DNA, 21 bp, Homo sapiens
gcacagcatgagtgttggcat

SEQ ID NO: 7947550 - DNA, 21 bp, Homo sapiens
gcacagcatgagtgttggcat

SEQ ID NO: 7947551 - DNA, 22 bp, Homo sapiens
gcaaatgatggcttgctggctg

SEQ ID NO: 7947552 - DNA, 22 bp, Homo sapiens
gcaaatgcactgcatttagatt

SEQ ID NO: 7947553 - DNA, 22 bp, Homo sapiens
gcaaatgctaaagtgtagagac

SEQ ID NO: 7947554 - DNA, 22 bp, Homo sapiens
gcaaatgagttgtaacataaaa

SEQ ID NO: 7947555 - DNA, 22 bp, Homo sapiens
gcaaatgagttgtaacataaaa

SEQ ID NO: 7947556 - DNA, 21 bp, Homo sapiens
gcaaatgagttaactaactca

SEQ ID NO: 7947557 - DNA, 22 bp, Homo sapiens
gcaagacaatggagcataaacg

SEQ ID NO: 7947558 - DNA, 22 bp, Homo sapiens
gcaaatgaactgatgccaatgg

SEQ ID NO: 7947559 - DNA, 19 bp, Homo sapiens
gcaaatctgaccaaatagt

SEQ ID NO: 7947560 - DNA, 22 bp, Homo sapiens
gagggtccctgctcagggccag

SEQ ID NO: 7947561 - DNA, 22 bp, Homo sapiens
gagggtccctgctcagggccag

SEQ ID NO: 7947562 - DNA, 22 bp, Homo sapiens
gagggtccccatgcagagctca

SEQ ID NO: 7947563 - DNA, 22 bp, Homo sapiens
gagggtcccgagccctgtcaga

SEQ ID NO: 7947564 - DNA, 22 bp, Homo sapiens
gagggtcccgagccctgtcaga

SEQ ID NO: 7947565 - DNA, 22 bp, Homo sapiens
gcaagagacttttatgtctgcc

SEQ ID NO: 7947566 - DNA, 22 bp, Homo sapiens
gcaagagacttttatgtctgcc

SEQ ID NO: 7947567 - DNA, 22 bp, Homo sapiens
gcaagagacttttatgtctgcc

SEQ ID NO: 7947568 - DNA, 22 bp, Homo sapiens
gcaagagacttttatgtctgcc

SEQ ID NO: 7947569 - DNA, 22 bp, Homo sapiens
gcaagagcaactttatggagct

SEQ ID NO: 7947570 - DNA, 22 bp, Homo sapiens
gcaagagcaactttatggagct

SEQ ID NO: 7947571 - DNA, 22 bp, Homo sapiens
gcaagatgttaacatagggaga

SEQ ID NO: 7947572 - DNA, 22 bp, Homo sapiens
gcaagatggttataaaaaatgt

SEQ ID NO: 7947573 - DNA, 22 bp, Homo sapiens
gcaagatggttataaaaaatgt

SEQ ID NO: 7947574 - DNA, 22 bp, Homo sapiens
gcaagagtttctggagcagagt

SEQ ID NO: 7947575 - DNA, 22 bp, Homo sapiens
gcaagcaaattatttataggca

SEQ ID NO: 7947576 - DNA, 22 bp, Homo sapiens
gcaagcaaattatttataggca

SEQ ID NO: 7947577 - DNA, 22 bp, Homo sapiens
gcaagcaaaatgggagattccc

SEQ ID NO: 7947578 - DNA, 22 bp, Homo sapiens
gcaagcaaaatgggagattccc

SEQ ID NO: 7947579 - DNA, 22 bp, Homo sapiens
gcaagatttacagacaacttcg

SEQ ID NO: 7947580 - DNA, 22 bp, Homo sapiens
gcaagattccttgagcctagtt

SEQ ID NO: 7947581 - DNA, 22 bp, Homo sapiens
gcaagattagaatcaactgtga

SEQ ID NO: 7947582 - DNA, 22 bp, Homo sapiens
gcaagcaagcaggtagagctga

SEQ ID NO: 7947583 - DNA, 23 bp, Homo sapiens
gcaagcaaggcagggtaaagaga

SEQ ID NO: 7947584 - DNA, 22 bp, Homo sapiens
gcaagcaagcaggtagagctga

SEQ ID NO: 7947585 - DNA, 22 bp, Homo sapiens
gcaagcacagatagactcagcc

SEQ ID NO: 7947586 - DNA, 22 bp, Homo sapiens
gcaagcagacattcaggtaggt

SEQ ID NO: 7947587 - DNA, 22 bp, Homo sapiens
gcaagcagacattcaggtaggt

SEQ ID NO: 7947588 - DNA, 22 bp, Homo sapiens
gcaagcaatggacggtgacttt

SEQ ID NO: 7947589 - DNA, 22 bp, Homo sapiens
gcaagcaagtatctggcaggga

SEQ ID NO: 7947590 - DNA, 22 bp, Homo sapiens
gcaagcaagtatctggcaggga

SEQ ID NO: 7947591 - DNA, 22 bp, Homo sapiens
gagggggaaagtccctggagtc

SEQ ID NO: 7947592 - DNA, 22 bp, Homo sapiens
gagggggaaagtccctggagtc

SEQ ID NO: 7947593 - DNA, 22 bp, Homo sapiens
gagggggacgtatcctggtatg

SEQ ID NO: 7947594 - DNA, 22 bp, Homo sapiens
gagggggagatgtgcacacact

SEQ ID NO: 7947595 - DNA, 22 bp, Homo sapiens
gagggggacgtatcctggtatg

SEQ ID NO: 7947596 - DNA, 22 bp, Homo sapiens
gagggggaaagtccctggagtc

SEQ ID NO: 7947597 - DNA, 22 bp, Homo sapiens
gagggggaaagtccctggagtc

SEQ ID NO: 7947598 - DNA, 22 bp, Homo sapiens
gaggggctgtggagctctctgg

SEQ ID NO: 7947599 - DNA, 22 bp, Homo sapiens
gaggggctgggtagggcaaccc

SEQ ID NO: 7947600 - DNA, 22 bp, Homo sapiens
gaggggctgggtagggcaaccc

SEQ ID NO: 7947601 - DNA, 22 bp, Homo sapiens
gaggggctgtggagctctctgg

SEQ ID NO: 7947602 - DNA, 22 bp, Homo sapiens
gaggggctgggtagggcaaccc

SEQ ID NO: 7947603 - DNA, 22 bp, Homo sapiens
gaggggtcttttgttgtcaggg

SEQ ID NO: 7947604 - DNA, 22 bp, Homo sapiens
gaggggtcttttgttgtcaggg

SEQ ID NO: 7947605 - DNA, 22 bp, Homo sapiens
gaggggtcttttgttgtcaggg

SEQ ID NO: 7947606 - DNA, 22 bp, Homo sapiens
gagggggcgaacagaagcaagg

SEQ ID NO: 7947607 - DNA, 22 bp, Homo sapiens
gaggggtccaggaggcacttac

SEQ ID NO: 7947608 - DNA, 22 bp, Homo sapiens
gaggggtccaggaggcacttac

SEQ ID NO: 7947609 - DNA, 22 bp, Homo sapiens
gaggggtccaggaggcacttac

SEQ ID NO: 7947610 - DNA, 22 bp, Homo sapiens
gagggggcgaacagaagcaagg

SEQ ID NO: 7947611 - DNA, 22 bp, Homo sapiens
gagggggagatgtgcacacact

SEQ ID NO: 7947612 - DNA, 22 bp, Homo sapiens
gagggggcgaacagaagcaagg

SEQ ID NO: 7947613 - DNA, 22 bp, Homo sapiens
gagggggcgaacagaagcaagg

SEQ ID NO: 7947614 - DNA, 22 bp, Homo sapiens
gagggggcgaacagaagcaagg

SEQ ID NO: 7947615 - DNA, 22 bp, Homo sapiens
gaggggtgtggagccatcagtt

SEQ ID NO: 7947616 - DNA, 22 bp, Homo sapiens
gaggggtgtggagccatcagtt

SEQ ID NO: 7947617 - DNA, 22 bp, Homo sapiens
gaggggtgtggagccatcagtt

SEQ ID NO: 7947618 - DNA, 22 bp, Homo sapiens
gaggggtgtggagccatcagtt

SEQ ID NO: 7947619 - DNA, 22 bp, Homo sapiens
gaggggtggccctggcgtgtac

SEQ ID NO: 7947620 - DNA, 22 bp, Homo sapiens
gaggggtggccctggcgtgtac

SEQ ID NO: 7947621 - DNA, 22 bp, Homo sapiens
gaggggtggccctggcgtgtac

SEQ ID NO: 7947622 - DNA, 22 bp, Homo sapiens
gaggggtggccctggcgtgtac

SEQ ID NO: 7947623 - DNA, 22 bp, Homo sapiens
gaggggtggccctggcgtgtac

SEQ ID NO: 7947624 - DNA, 22 bp, Homo sapiens
gaggggtggccctggcgtgtac

SEQ ID NO: 7947625 - DNA, 22 bp, Homo sapiens
gaggggtgggctggaagttata

SEQ ID NO: 7947626 - DNA, 22 bp, Homo sapiens
gaggggtgggctggaagttata

SEQ ID NO: 7947627 - DNA, 22 bp, Homo sapiens
gaggggtggcgttggcatttag

SEQ ID NO: 7947628 - DNA, 22 bp, Homo sapiens
gaggggtggcgttggcatttag

SEQ ID NO: 7947629 - DNA, 22 bp, Homo sapiens
gaggggtggcgttggcatttag

SEQ ID NO: 7947630 - DNA, 22 bp, Homo sapiens
gcagcagtggtctgtagaagga

SEQ ID NO: 7947631 - DNA, 22 bp, Homo sapiens
gcagcagtggtctgtagaagga

SEQ ID NO: 7947632 - DNA, 22 bp, Homo sapiens
gcagcagtggtctgtagaagga

SEQ ID NO: 7947633 - DNA, 22 bp, Homo sapiens
gcagcagtggctgcaggtccca

SEQ ID NO: 7947634 - DNA, 22 bp, Homo sapiens
gcagcagtggctgcaggtccca

SEQ ID NO: 7947635 - DNA, 22 bp, Homo sapiens
gcagcagtggctgcaggtccca

SEQ ID NO: 7947636 - DNA, 22 bp, Homo sapiens
gcagcagtggctgcaggtccca

SEQ ID NO: 7947637 - DNA, 22 bp, Homo sapiens
gcagcagtggctgcaggtccca

SEQ ID NO: 7947638 - DNA, 22 bp, Homo sapiens
gcagcagtggctgcaggtccca

SEQ ID NO: 7947639 - DNA, 21 bp, Homo sapiens
gcagcagtgttctagaatact

SEQ ID NO: 7947640 - DNA, 21 bp, Homo sapiens
gcagcagtgttctagaatact

SEQ ID NO: 7947641 - DNA, 22 bp, Homo sapiens
gcagcagtgtgggctgaaccta

SEQ ID NO: 7947642 - DNA, 22 bp, Homo sapiens
gcagcagtgtgggctgaaccta

SEQ ID NO: 7947643 - DNA, 22 bp, Homo sapiens
gcagcagtgtgggctgaaccta

SEQ ID NO: 7947644 - DNA, 22 bp, Homo sapiens
gcagcagtgtctcccatcttgc

SEQ ID NO: 7947645 - DNA, 22 bp, Homo sapiens
gcagcagtgtctcccatcttgc

SEQ ID NO: 7947646 - DNA, 20 bp, Homo sapiens
gcagcagtgcaagtcctctt

SEQ ID NO: 7947647 - DNA, 22 bp, Homo sapiens
gcagcagtgcgggcagctacag

SEQ ID NO: 7947648 - DNA, 22 bp, Homo sapiens
gcagcagtgcgggcagctacag

SEQ ID NO: 7947649 - DNA, 22 bp, Homo sapiens
gcagcagtgcgggcagctacag

SEQ ID NO: 7947650 - DNA, 19 bp, Homo sapiens
gcagcagtggaaggaaaaa

SEQ ID NO: 7947651 - DNA, 22 bp, Homo sapiens
gcagcagtaggaaataacacag

SEQ ID NO: 7947652 - DNA, 20 bp, Homo sapiens
gcagcagtgcaagtcctctt

SEQ ID NO: 7947653 - DNA, 20 bp, Homo sapiens
gcagcagtgcaagtcctctt

SEQ ID NO: 7947654 - DNA, 22 bp, Homo sapiens
gcagcaggtgtgcttttaatga

SEQ ID NO: 7947655 - DNA, 22 bp, Homo sapiens
gcagcagtactcaatatcctgg

SEQ ID NO: 7947656 - DNA, 22 bp, Homo sapiens
gcagcaggtgtgcttttaatga

SEQ ID NO: 7947657 - DNA, 22 bp, Homo sapiens
gcagcaggtgtgcttttaatga

SEQ ID NO: 7947658 - DNA, 22 bp, Homo sapiens
gcagcatctagggcactggcct

SEQ ID NO: 7947659 - DNA, 22 bp, Homo sapiens
gcagcatctagggcactggcct

SEQ ID NO: 7947660 - DNA, 22 bp, Homo sapiens
gcagcatctgtacatagacgct

SEQ ID NO: 7947661 - DNA, 22 bp, Homo sapiens
gcagcatctgtacatagacgct

SEQ ID NO: 7947662 - DNA, 22 bp, Homo sapiens
gcagcatccttggcctccaccc

SEQ ID NO: 7947663 - DNA, 22 bp, Homo sapiens
gcagcatccttggcctccaccc

SEQ ID NO: 7947664 - DNA, 22 bp, Homo sapiens
gcagcatctagggcactggcct

SEQ ID NO: 7947665 - DNA, 22 bp, Homo sapiens
gcagcatccttggcctccaccc

SEQ ID NO: 7947666 - DNA, 22 bp, Homo sapiens
gcagcatcctgggccacagtcc

SEQ ID NO: 7947667 - DNA, 22 bp, Homo sapiens
gcagcatcctgggccacagtcc

SEQ ID NO: 7947668 - DNA, 22 bp, Homo sapiens
gcagcatcaggttcactgcgtg

SEQ ID NO: 7947669 - DNA, 22 bp, Homo sapiens
gcagcatcctgggccacagtcc

SEQ ID NO: 7947670 - DNA, 22 bp, Homo sapiens
gcagcatccccaggcagcaggg

SEQ ID NO: 7947671 - DNA, 22 bp, Homo sapiens
gcagcatcctgggccacagtcc

SEQ ID NO: 7947672 - DNA, 22 bp, Homo sapiens
gcagcatccccaggcagcaggg

SEQ ID NO: 7947673 - DNA, 22 bp, Homo sapiens
gcagcatccccaggcagcaggg

SEQ ID NO: 7947674 - DNA, 22 bp, Homo sapiens
gcagcatcaatccatgcttctc

SEQ ID NO: 7947675 - DNA, 22 bp, Homo sapiens
gcagcatcaatccatgcttctc

SEQ ID NO: 7947676 - DNA, 22 bp, Homo sapiens
gcagcatcaggttcactgcgtg

SEQ ID NO: 7947677 - DNA, 22 bp, Homo sapiens
gcagcatcaggttcactgcgtg

SEQ ID NO: 7947678 - DNA, 22 bp, Homo sapiens
gcagcatggagaagtagctaga

SEQ ID NO: 7947679 - DNA, 21 bp, Homo sapiens
gcagcatgagaaagccccaaa

SEQ ID NO: 7947680 - DNA, 22 bp, Homo sapiens
gcagcatggagttgtggaatga

SEQ ID NO: 7947681 - DNA, 22 bp, Homo sapiens
gcagcatggagttgtggaatga

SEQ ID NO: 7947682 - DNA, 22 bp, Homo sapiens
gcagcatggagttgtggaatga

SEQ ID NO: 7947683 - DNA, 22 bp, Homo sapiens
gcagcattgcacttttgttctt

SEQ ID NO: 7947684 - DNA, 22 bp, Homo sapiens
gcagcattaccaagacatggca

SEQ ID NO: 7947685 - DNA, 22 bp, Homo sapiens
gcagcatgttgaaagggccaca

SEQ ID NO: 7947686 - DNA, 22 bp, Homo sapiens
gcagcatgttgaaagggccaca

SEQ ID NO: 7947687 - DNA, 22 bp, Homo sapiens
gcagcatgttgaaagggccaca

SEQ ID NO: 7947688 - DNA, 22 bp, Homo sapiens
gcagctgcagaccctcagtgct

SEQ ID NO: 7947689 - DNA, 22 bp, Homo sapiens
gcagctgcagaccctcagtgct

SEQ ID NO: 7947690 - DNA, 22 bp, Homo sapiens
gcagctgcagaccctcagtgct

SEQ ID NO: 7947691 - DNA, 22 bp, Homo sapiens
gcagctgcagaccctcagtgct

SEQ ID NO: 7947692 - DNA, 22 bp, Homo sapiens
gcagctgcagaccctcagtgct

SEQ ID NO: 7947693 - DNA, 22 bp, Homo sapiens
gcagctgcagaccctcagtgct

SEQ ID NO: 7947694 - DNA, 22 bp, Homo sapiens
gcagctgcagagaccgggtggg

SEQ ID NO: 7947695 - DNA, 22 bp, Homo sapiens
gcagctgcagagaccgggtggg

SEQ ID NO: 7947696 - DNA, 22 bp, Homo sapiens
gcagctgcagagaccgggtggg

SEQ ID NO: 7947697 - DNA, 22 bp, Homo sapiens
gcagctgcagagaccgggtggg

SEQ ID NO: 7947698 - DNA, 22 bp, Homo sapiens
gcagctgcagagaccgggtggg

SEQ ID NO: 7947699 - DNA, 22 bp, Homo sapiens
gcagctgcagaccctcagtgct

SEQ ID NO: 7947700 - DNA, 22 bp, Homo sapiens
gcagctgcaataggcatcaagc

SEQ ID NO: 7947701 - DNA, 22 bp, Homo sapiens
gcagctgcacttctacctaatt

SEQ ID NO: 7947702 - DNA, 22 bp, Homo sapiens
gcagctgcacttctacctaatt

SEQ ID NO: 7947703 - DNA, 22 bp, Homo sapiens
gcagctgcaataggcatcaagc

SEQ ID NO: 7947704 - DNA, 22 bp, Homo sapiens
gcagctgcaataggcatcaagc

SEQ ID NO: 7947705 - DNA, 22 bp, Homo sapiens
gcagctgcaagcacttctggca

SEQ ID NO: 7947706 - DNA, 22 bp, Homo sapiens
gcagctgcaagcacttctggca

SEQ ID NO: 7947707 - DNA, 22 bp, Homo sapiens
gcagcattgtgaggtcctgccc

SEQ ID NO: 7947708 - DNA, 22 bp, Homo sapiens
gcagcattgcacttttgttctt

SEQ ID NO: 7947709 - DNA, 22 bp, Homo sapiens
gcagcattgcacttttgttctt

SEQ ID NO: 7947710 - DNA, 22 bp, Homo sapiens
gcagcatttctcaaagggtggt

SEQ ID NO: 7947711 - DNA, 22 bp, Homo sapiens
gcagcatttgtggaatgggccc

SEQ ID NO: 7947712 - DNA, 22 bp, Homo sapiens
gcagcatttgtggaatgggccc

SEQ ID NO: 7947713 - DNA, 22 bp, Homo sapiens
gcagccaagccatgaggactac

SEQ ID NO: 7947714 - DNA, 22 bp, Homo sapiens
gcagccaagaccccaagaactg

SEQ ID NO: 7947715 - DNA, 22 bp, Homo sapiens
gcagctgatggaagtcctattg

SEQ ID NO: 7947716 - DNA, 22 bp, Homo sapiens
gcagccacagaggagggatgca

SEQ ID NO: 7947717 - DNA, 22 bp, Homo sapiens
gcagccacactgttacagaatg

SEQ ID NO: 7947718 - DNA, 23 bp, Homo sapiens
gcagccaagagaccagggcaggc

SEQ ID NO: 7947719 - DNA, 22 bp, Homo sapiens
gcagccacactgttacagaatg

SEQ ID NO: 7947720 - DNA, 22 bp, Homo sapiens
gcagctgcaagcacttctggca

SEQ ID NO: 7947721 - DNA, 22 bp, Homo sapiens
gcagctgcaagcacttctggca

SEQ ID NO: 7947722 - DNA, 22 bp, Homo sapiens
gcagctgcaggcaggcttgctg

SEQ ID NO: 7947723 - DNA, 22 bp, Homo sapiens
gcagctgcaggcaggcttgctg

SEQ ID NO: 7947724 - DNA, 22 bp, Homo sapiens
gcagctgcaggcaggcttgctg

SEQ ID NO: 7947725 - DNA, 22 bp, Homo sapiens
gcagctgcaggtggtcccatgc

SEQ ID NO: 7947726 - DNA, 22 bp, Homo sapiens
gcagctgcaggtggtcccatgc

SEQ ID NO: 7947727 - DNA, 22 bp, Homo sapiens
gcagctgcaggcaggcttgctg

SEQ ID NO: 7947728 - DNA, 22 bp, Homo sapiens
gcagctgcaggcaggcttgctg

SEQ ID NO: 7947729 - DNA, 18 bp, Homo sapiens
gcagctgcagttgtagct

SEQ ID NO: 7947730 - DNA, 18 bp, Homo sapiens
gcagctgcagttgtagct

SEQ ID NO: 7947731 - DNA, 18 bp, Homo sapiens
gcagctgcagttgtagct

SEQ ID NO: 7947732 - DNA, 22 bp, Homo sapiens
gcagctgcaggtggtcccatgc

SEQ ID NO: 7947733 - DNA, 18 bp, Homo sapiens
gcagctgcagttgtagct

SEQ ID NO: 7947734 - DNA, 20 bp, Homo sapiens
gcagctgcccccagtccctg

SEQ ID NO: 7947735 - DNA, 22 bp, Homo sapiens
gcagctgccagtccccttccag

SEQ ID NO: 7947736 - DNA, 22 bp, Homo sapiens
gcagctgccagtccccttccag

SEQ ID NO: 7947737 - DNA, 22 bp, Homo sapiens
gcagctgccagtccccttccag

SEQ ID NO: 7947738 - DNA, 22 bp, Homo sapiens
gcagctgccagtccccttccag

SEQ ID NO: 7947739 - DNA, 22 bp, Homo sapiens
gcagctgccccgactgtgagtc

SEQ ID NO: 7947740 - DNA, 22 bp, Homo sapiens
gcagctgccccgactgtgagtc

SEQ ID NO: 7947741 - DNA, 22 bp, Homo sapiens
gcagctgccccgactgtgagtc

SEQ ID NO: 7947742 - DNA, 22 bp, Homo sapiens
gcagctgccccgactgtgagtc

SEQ ID NO: 7947743 - DNA, 20 bp, Homo sapiens
gcagctgcccccagtccctg

SEQ ID NO: 7947744 - DNA, 20 bp, Homo sapiens
gcagctgcccccagtccctg

SEQ ID NO: 7947745 - DNA, 20 bp, Homo sapiens
gcagctgcccccagtccctg

SEQ ID NO: 7947746 - DNA, 22 bp, Homo sapiens
gcagctgccccgactgtgagtc

SEQ ID NO: 7947747 - DNA, 22 bp, Homo sapiens
gcagctgccgtgagctcacgcc

SEQ ID NO: 7947748 - DNA, 22 bp, Homo sapiens
gcagctgccccgactgtgagtc

SEQ ID NO: 7947749 - DNA, 22 bp, Homo sapiens
gcagctgccgtgagctcacgcc

SEQ ID NO: 7947750 - DNA, 22 bp, Homo sapiens
gcagctgccgtgagctcacgcc

SEQ ID NO: 7947751 - DNA, 22 bp, Homo sapiens
gcagctgcctaaagtgctaaga

SEQ ID NO: 7947752 - DNA, 22 bp, Homo sapiens
gcagctgcctaaagtgctaaga

SEQ ID NO: 7947753 - DNA, 22 bp, Homo sapiens
gcagctgcctaaagtgctaaga

SEQ ID NO: 7947754 - DNA, 22 bp, Homo sapiens
gcagctgccgtgagctcacgcc

SEQ ID NO: 7947755 - DNA, 22 bp, Homo sapiens
gcagctgccgtgagctcacgcc

SEQ ID NO: 7947756 - DNA, 22 bp, Homo sapiens
gcagaggaggacccaggaatta

SEQ ID NO: 7947757 - DNA, 22 bp, Homo sapiens
gcagaggaggacccaggaatta

SEQ ID NO: 7947758 - DNA, 22 bp, Homo sapiens
gcagaggaggacccaggaatta

SEQ ID NO: 7947759 - DNA, 22 bp, Homo sapiens
gcagaggaggacccaggaatta

SEQ ID NO: 7947760 - DNA, 22 bp, Homo sapiens
gcagaggaggacccaggaatta

SEQ ID NO: 7947761 - DNA, 22 bp, Homo sapiens
gcagaggagcaagttgctacag

SEQ ID NO: 7947762 - DNA, 22 bp, Homo sapiens
gcagaggaggacccaggaatta

SEQ ID NO: 7947763 - DNA, 22 bp, Homo sapiens
gcagaggagcaagttgctacag

SEQ ID NO: 7947764 - DNA, 22 bp, Homo sapiens
gcagaggaggacccaggaatta

SEQ ID NO: 7947765 - DNA, 22 bp, Homo sapiens
gcagaggaggacccaggaatta

SEQ ID NO: 7947766 - DNA, 22 bp, Homo sapiens
gcagaggaggacccaggaatta

SEQ ID NO: 7947767 - DNA, 22 bp, Homo sapiens
gcagcagcccagggctctcaga

SEQ ID NO: 7947768 - DNA, 22 bp, Homo sapiens
gcagcagcccagggctctcaga

SEQ ID NO: 7947769 - DNA, 22 bp, Homo sapiens
gcagcagcccagggctctcaga

SEQ ID NO: 7947770 - DNA, 22 bp, Homo sapiens
gcagcagccgacatggattgca

SEQ ID NO: 7947771 - DNA, 22 bp, Homo sapiens
gcagcagcggggcccctgcgcg

SEQ ID NO: 7947772 - DNA, 22 bp, Homo sapiens
gcagcagcggggcccctgcgcg

SEQ ID NO: 7947773 - DNA, 22 bp, Homo sapiens
gcagcagcggggcccctgcgcg

SEQ ID NO: 7947774 - DNA, 22 bp, Homo sapiens
gcagcagcggggcccctgcgcg

SEQ ID NO: 7947775 - DNA, 22 bp, Homo sapiens
gcagcagccgacatggattgca

SEQ ID NO: 7947776 - DNA, 22 bp, Homo sapiens
gcagcagccgacatggattgca

SEQ ID NO: 7947777 - DNA, 22 bp, Homo sapiens
gcagcagccgacatggattgca

SEQ ID NO: 7947778 - DNA, 22 bp, Homo sapiens
gcagcagcggggcccctgcgcg

SEQ ID NO: 7947779 - DNA, 22 bp, Homo sapiens
gcagcagccgacatggattgca

SEQ ID NO: 7947780 - DNA, 22 bp, Homo sapiens
gcagcagccgacatggattgca

SEQ ID NO: 7947781 - DNA, 22 bp, Homo sapiens
gcagcagccgacatggattgca

SEQ ID NO: 7947782 - DNA, 22 bp, Homo sapiens
gcagcagccgacatggattgca

SEQ ID NO: 7947783 - DNA, 22 bp, Homo sapiens
gcagcagctcagccgggcactg

SEQ ID NO: 7947784 - DNA, 22 bp, Homo sapiens
gcagcagctcagttctgggagg

SEQ ID NO: 7947785 - DNA, 22 bp, Homo sapiens
gcagcagctcagttctgggagg

SEQ ID NO: 7947786 - DNA, 22 bp, Homo sapiens
gcagcagctcagccgggcactg

SEQ ID NO: 7947787 - DNA, 22 bp, Homo sapiens
gcagcagctcagccgggcactg

SEQ ID NO: 7947788 - DNA, 22 bp, Homo sapiens
gcagcagctcagccgggcactg

SEQ ID NO: 7947789 - DNA, 22 bp, Homo sapiens
gcagcagcggggcccctgcgcg

SEQ ID NO: 7947790 - DNA, 22 bp, Homo sapiens
gcagcagctcagccgggcactg

SEQ ID NO: 7947791 - DNA, 22 bp, Homo sapiens
gcagcagctcagccgggcactg

SEQ ID NO: 7947792 - DNA, 22 bp, Homo sapiens
gcagcagctcagccgggcactg

SEQ ID NO: 7947793 - DNA, 22 bp, Homo sapiens
gcagcagctcagccgggcactg

SEQ ID NO: 7947794 - DNA, 22 bp, Homo sapiens
gcagcagctcagccgggcactg

SEQ ID NO: 7947795 - DNA, 22 bp, Homo sapiens
gcagcagctcagccgggcactg

SEQ ID NO: 7947796 - DNA, 22 bp, Homo sapiens
gcagcagctcagccgggcactg

SEQ ID NO: 7947797 - DNA, 22 bp, Homo sapiens
gcagcagctcagttctgggagg

SEQ ID NO: 7947798 - DNA, 22 bp, Homo sapiens
gcagcagctcagttctgggagg

SEQ ID NO: 7947799 - DNA, 22 bp, Homo sapiens
gcagcagctcagttctgggagg

SEQ ID NO: 7947800 - DNA, 22 bp, Homo sapiens
gcagcagctccctatccaggct

SEQ ID NO: 7947801 - DNA, 22 bp, Homo sapiens
gcagcagctcagttctgggagg

SEQ ID NO: 7947802 - DNA, 22 bp, Homo sapiens
gcagcagctccctatccaggct

SEQ ID NO: 7947803 - DNA, 22 bp, Homo sapiens
gcagcagctccctatccaggct

SEQ ID NO: 7947804 - DNA, 22 bp, Homo sapiens
gcagcagctccctatccaggct

SEQ ID NO: 7947805 - DNA, 22 bp, Homo sapiens
gcagcagctctgaatgggcccc

SEQ ID NO: 7947806 - DNA, 22 bp, Homo sapiens
gcagcagctctgaatgggcccc

SEQ ID NO: 7947807 - DNA, 22 bp, Homo sapiens
gcagcagctgacagtgggtgcc

SEQ ID NO: 7947808 - DNA, 22 bp, Homo sapiens
gcagcagctctgaatgggcccc

SEQ ID NO: 7947809 - DNA, 22 bp, Homo sapiens
gcagcagctgacagtgggtgcc

SEQ ID NO: 7947810 - DNA, 22 bp, Homo sapiens
gcagcagctgacagtgggtgcc

SEQ ID NO: 7947811 - DNA, 22 bp, Homo sapiens
gcagcagctgacagtgggtgcc

SEQ ID NO: 7947812 - DNA, 22 bp, Homo sapiens
gcagcagctgacagtgggtgcc

SEQ ID NO: 7947813 - DNA, 22 bp, Homo sapiens
gcagcagctctgaatgggcccc

SEQ ID NO: 7947814 - DNA, 22 bp, Homo sapiens
gcagcagctctgaatgggcccc

SEQ ID NO: 7947815 - DNA, 22 bp, Homo sapiens
gcagcagctctgaatgggcccc

SEQ ID NO: 7947816 - DNA, 22 bp, Homo sapiens
gcagcagctctgaatgggcccc

SEQ ID NO: 7947817 - DNA, 22 bp, Homo sapiens
gcagcagctctgaatgggcccc

SEQ ID NO: 7947818 - DNA, 22 bp, Homo sapiens
gcagcagctctcaaagtggtct

SEQ ID NO: 7947819 - DNA, 22 bp, Homo sapiens
gcagcagctctgaatgggcccc

SEQ ID NO: 7947820 - DNA, 22 bp, Homo sapiens
gcagcagctctgaatgggcccc

SEQ ID NO: 7947821 - DNA, 22 bp, Homo sapiens
gcagcagctctcaaagtggtct

SEQ ID NO: 7947822 - DNA, 22 bp, Homo sapiens
gcagcagctctcaaagtggtct

SEQ ID NO: 7947823 - DNA, 22 bp, Homo sapiens
gcagcagctccctatccaggct

SEQ ID NO: 7947824 - DNA, 22 bp, Homo sapiens
gcagcagctccctatccaggct

SEQ ID NO: 7947825 - DNA, 22 bp, Homo sapiens
gcagcaggaataggataagcaa

SEQ ID NO: 7947826 - DNA, 22 bp, Homo sapiens
gcagcagctgacagtgggtgcc

SEQ ID NO: 7947827 - DNA, 22 bp, Homo sapiens
gcagcagctgacagtgggtgcc

SEQ ID NO: 7947828 - DNA, 22 bp, Homo sapiens
gcagcagctgacagtgggtgcc

SEQ ID NO: 7947829 - DNA, 22 bp, Homo sapiens
gcagcagctgacagtgggtgcc

SEQ ID NO: 7947830 - DNA, 22 bp, Homo sapiens
gcagcaggaataggataagcaa

SEQ ID NO: 7947831 - DNA, 22 bp, Homo sapiens
gcagcaggaataggataagcaa

SEQ ID NO: 7947832 - DNA, 22 bp, Homo sapiens
gcagcaggaataggataagcaa

SEQ ID NO: 7947833 - DNA, 22 bp, Homo sapiens
gcagcaggaatttaaatttata

SEQ ID NO: 7947834 - DNA, 22 bp, Homo sapiens
gcagcaggaatttaaatttata

SEQ ID NO: 7947835 - DNA, 22 bp, Homo sapiens
gcagcaggaataggataagcaa

SEQ ID NO: 7947836 - DNA, 22 bp, Homo sapiens
gcagcaggagagtttgtcctgc

SEQ ID NO: 7947837 - DNA, 22 bp, Homo sapiens
gcagcaggagagtttgtcctgc

SEQ ID NO: 7947838 - DNA, 22 bp, Homo sapiens
gcagcaggagagtttgtcctgc

SEQ ID NO: 7947839 - DNA, 22 bp, Homo sapiens
gcagcaggactgccgttaaagt

SEQ ID NO: 7947840 - DNA, 22 bp, Homo sapiens
gcagcaggactgccgttaaagt

SEQ ID NO: 7947841 - DNA, 22 bp, Homo sapiens
gcagcaggagagtaatagcggt

SEQ ID NO: 7947842 - DNA, 22 bp, Homo sapiens
gcagcaggagagtaatagcggt

SEQ ID NO: 7947843 - DNA, 22 bp, Homo sapiens
gcagcaggagagtaatagcggt

SEQ ID NO: 7947844 - DNA, 22 bp, Homo sapiens
gcagcaggtgtgcttttaatga

SEQ ID NO: 7947845 - DNA, 22 bp, Homo sapiens
gcagcaggtctgtcaatgtcat

SEQ ID NO: 7947846 - DNA, 22 bp, Homo sapiens
gcagcaggtctgtcaatgtcat

SEQ ID NO: 7947847 - DNA, 22 bp, Homo sapiens
gcagcaggtctgtcaatgtcat

SEQ ID NO: 7947848 - DNA, 22 bp, Homo sapiens
gcagcaggcacttaccgttgct

SEQ ID NO: 7947849 - DNA, 22 bp, Homo sapiens
gcagcaggcacttaccgttgct

SEQ ID NO: 7947850 - DNA, 22 bp, Homo sapiens
gcagcaggcacttaccgttgct

SEQ ID NO: 7947851 - DNA, 22 bp, Homo sapiens
gcagcaggcacggtctcgacat

SEQ ID NO: 7947852 - DNA, 22 bp, Homo sapiens
gcagcaggcacggtctcgacat

SEQ ID NO: 7947853 - DNA, 22 bp, Homo sapiens
gcagcaggcacggtctcgacat

SEQ ID NO: 7947854 - DNA, 22 bp, Homo sapiens
gcagcaggatggccaattgcca

SEQ ID NO: 7947855 - DNA, 22 bp, Homo sapiens
gcagcaggcacggtctcgacat

SEQ ID NO: 7947856 - DNA, 22 bp, Homo sapiens
gcagcaggcacggtctcgacat

SEQ ID NO: 7947857 - DNA, 22 bp, Homo sapiens
gcagcaggatggccaattgcca

SEQ ID NO: 7947858 - DNA, 22 bp, Homo sapiens
gcagcaggatggccaattgcca

SEQ ID NO: 7947859 - DNA, 22 bp, Homo sapiens
gcagcaggatggccaattgcca

SEQ ID NO: 7947860 - DNA, 22 bp, Homo sapiens
gcagcaggagagtttgtcctgc

SEQ ID NO: 7947861 - DNA, 22 bp, Homo sapiens
gcagcaggagagtttgtcctgc

SEQ ID NO: 7947862 - DNA, 22 bp, Homo sapiens
gcagcaggatggccaattgcca

SEQ ID NO: 7947863 - DNA, 22 bp, Homo sapiens
gcagctggatttcaagagggag

SEQ ID NO: 7947864 - DNA, 22 bp, Homo sapiens
gcagctggatttcaagagggag

SEQ ID NO: 7947865 - DNA, 22 bp, Homo sapiens
gcagctggatttcaagagggag

SEQ ID NO: 7947866 - DNA, 22 bp, Homo sapiens
gcagctggatttcaagagggag

SEQ ID NO: 7947867 - DNA, 22 bp, Homo sapiens
gcagctggagcatcttctcatc

SEQ ID NO: 7947868 - DNA, 22 bp, Homo sapiens
gcagctggagcatcttctcatc

SEQ ID NO: 7947869 - DNA, 22 bp, Homo sapiens
gcagctggagcatcttctcatc

SEQ ID NO: 7947870 - DNA, 22 bp, Homo sapiens
gcagctggagccagccagacac

SEQ ID NO: 7947871 - DNA, 22 bp, Homo sapiens
gcagctggagccagccagacac

SEQ ID NO: 7947872 - DNA, 22 bp, Homo sapiens
gcagctggagccagccagacac

SEQ ID NO: 7947873 - DNA, 22 bp, Homo sapiens
gcagctggagccagccagacac

SEQ ID NO: 7947874 - DNA, 22 bp, Homo sapiens
gcagctgcctattcagggcttg

SEQ ID NO: 7947875 - DNA, 22 bp, Homo sapiens
gcagctgcctattcagggcttg

SEQ ID NO: 7947876 - DNA, 22 bp, Homo sapiens
gcagctgcctaaagtgctaaga

SEQ ID NO: 7947877 - DNA, 22 bp, Homo sapiens
gcagctggacccacacggctta

SEQ ID NO: 7947878 - DNA, 22 bp, Homo sapiens
gcagctggacccacacggctta

SEQ ID NO: 7947879 - DNA, 22 bp, Homo sapiens
gcagctgcctattcagggcttg

SEQ ID NO: 7947880 - DNA, 22 bp, Homo sapiens
gcagctggagaaataccaccct

SEQ ID NO: 7947881 - DNA, 22 bp, Homo sapiens
gcagctggagaaataccaccct

SEQ ID NO: 7947882 - DNA, 22 bp, Homo sapiens
gcagctggagcatcttctcatc

SEQ ID NO: 7947883 - DNA, 22 bp, Homo sapiens
gcagctggagcatcttctcatc

SEQ ID NO: 7947884 - DNA, 22 bp, Homo sapiens
gcagctggagaaataccaccct

SEQ ID NO: 7947885 - DNA, 22 bp, Homo sapiens
gcagctggagaaataccaccct

SEQ ID NO: 7947886 - DNA, 22 bp, Homo sapiens
gcagctggagaaataccaccct

SEQ ID NO: 7947887 - DNA, 22 bp, Homo sapiens
gcaggagctggaaagtgatgtt

SEQ ID NO: 7947888 - DNA, 22 bp, Homo sapiens
gcaggagctggaaagtgatgtt

SEQ ID NO: 7947889 - DNA, 22 bp, Homo sapiens
gcaggagctggaaagtgatgtt

SEQ ID NO: 7947890 - DNA, 22 bp, Homo sapiens
gcaggagctgctctcctgacga

SEQ ID NO: 7947891 - DNA, 22 bp, Homo sapiens
gcaggagctggaaagtgatgtt

SEQ ID NO: 7947892 - DNA, 22 bp, Homo sapiens
gcagctggccctgacacgcaga

SEQ ID NO: 7947893 - DNA, 22 bp, Homo sapiens
gcagctggcccctttccttgtt

SEQ ID NO: 7947894 - DNA, 22 bp, Homo sapiens
gcagctggatttcaagagggag

SEQ ID NO: 7947895 - DNA, 22 bp, Homo sapiens
gcagctggcccctttccttgtt

SEQ ID NO: 7947896 - DNA, 22 bp, Homo sapiens
gcagctggcccctttccttgtt

SEQ ID NO: 7947897 - DNA, 22 bp, Homo sapiens
gcagctggccctgacacgcaga

SEQ ID NO: 7947898 - DNA, 22 bp, Homo sapiens
gcagctggccctgacacgcaga

SEQ ID NO: 7947899 - DNA, 22 bp, Homo sapiens
gcaggaggagcattaactgagc

SEQ ID NO: 7947900 - DNA, 22 bp, Homo sapiens
gcaggaggagcattaactgagc

SEQ ID NO: 7947901 - DNA, 22 bp, Homo sapiens
gcaggaggagcattaactgagc

SEQ ID NO: 7947902 - DNA, 22 bp, Homo sapiens
gcaggagctggaaagtgatgtt

SEQ ID NO: 7947903 - DNA, 22 bp, Homo sapiens
gcaggagctttgcttactgctg

SEQ ID NO: 7947904 - DNA, 22 bp, Homo sapiens
gcaggagctttgcttactgctg

SEQ ID NO: 7947905 - DNA, 22 bp, Homo sapiens
gcaggaggatcacttgagccca

SEQ ID NO: 7947906 - DNA, 22 bp, Homo sapiens
gcaggaggatcacttgagccca

SEQ ID NO: 7947907 - DNA, 22 bp, Homo sapiens
gcaggaggatcacttgagccca

SEQ ID NO: 7947908 - DNA, 22 bp, Homo sapiens
gcaggaggatcacttgagccca

SEQ ID NO: 7947909 - DNA, 22 bp, Homo sapiens
gcaggagtatgcagctatggtt

SEQ ID NO: 7947910 - DNA, 22 bp, Homo sapiens
gcaggagtatgcagctatggtt

SEQ ID NO: 7947911 - DNA, 22 bp, Homo sapiens
gcaggagtatgcagctatggtt

SEQ ID NO: 7947912 - DNA, 22 bp, Homo sapiens
gcaggagtatctatacattaaa

SEQ ID NO: 7947913 - DNA, 22 bp, Homo sapiens
gcaggagtatgcagctatggtt

SEQ ID NO: 7947914 - DNA, 22 bp, Homo sapiens
gcaggagtatgcagctatggtt

SEQ ID NO: 7947915 - DNA, 22 bp, Homo sapiens
gcaggagtatgcagctatggtt

SEQ ID NO: 7947916 - DNA, 22 bp, Homo sapiens
gcaggagtgacatggatgtgga

SEQ ID NO: 7947917 - DNA, 22 bp, Homo sapiens
gcaggagtgacatggatgtgga

SEQ ID NO: 7947918 - DNA, 22 bp, Homo sapiens
gcaggagtgacatggatgtgga

SEQ ID NO: 7947919 - DNA, 22 bp, Homo sapiens
gcaggagtcactgacttggtcc

SEQ ID NO: 7947920 - DNA, 22 bp, Homo sapiens
gcaggagtcagccctaccttga

SEQ ID NO: 7947921 - DNA, 22 bp, Homo sapiens
gcaggagtcccagaaggttttg

SEQ ID NO: 7947922 - DNA, 22 bp, Homo sapiens
gcaggaggccaggtatgcttta

SEQ ID NO: 7947923 - DNA, 22 bp, Homo sapiens
gcaggaggttgagccaggactg

SEQ ID NO: 7947924 - DNA, 22 bp, Homo sapiens
gcaggaggttgagccaggactg

SEQ ID NO: 7947925 - DNA, 22 bp, Homo sapiens
gcaggaggccaggtatgcttta

SEQ ID NO: 7947926 - DNA, 22 bp, Homo sapiens
gcaggaggttgagccaggactg

SEQ ID NO: 7947927 - DNA, 22 bp, Homo sapiens
gcaggaggttgagccaggactg

SEQ ID NO: 7947928 - DNA, 22 bp, Homo sapiens
gcaggaggttgagccaggactg

SEQ ID NO: 7947929 - DNA, 22 bp, Homo sapiens
gcaggaggttgagccaggactg

SEQ ID NO: 7947930 - DNA, 22 bp, Homo sapiens
gcaggaggttgagccaggactg

SEQ ID NO: 7947931 - DNA, 16 bp, Homo sapiens
gcaggagtaccacttg

SEQ ID NO: 7947932 - DNA, 22 bp, Homo sapiens
gcaggaggttgagccaggactg

SEQ ID NO: 7947933 - DNA, 22 bp, Homo sapiens
gcaggagtgtggtgggacatcc

SEQ ID NO: 7947934 - DNA, 22 bp, Homo sapiens
gcaggagtgtggtgggacatcc

SEQ ID NO: 7947935 - DNA, 22 bp, Homo sapiens
gcaggagtgtggtgggacatcc

SEQ ID NO: 7947936 - DNA, 22 bp, Homo sapiens
gcaggagtgtggtgggacatcc

SEQ ID NO: 7947937 - DNA, 22 bp, Homo sapiens
gcaggagtgtggtgggacatcc

SEQ ID NO: 7947938 - DNA, 22 bp, Homo sapiens
gcaggagtgtatttgcatgtaa

SEQ ID NO: 7947939 - DNA, 22 bp, Homo sapiens
gcaggagtgtatttgcatgtaa

SEQ ID NO: 7947940 - DNA, 22 bp, Homo sapiens
gcaggagtgacatggatgtgga

SEQ ID NO: 7947941 - DNA, 22 bp, Homo sapiens
gcaggagtgacatggatgtgga

SEQ ID NO: 7947942 - DNA, 22 bp, Homo sapiens
gcaggagtgacatggatgtgga

SEQ ID NO: 7947943 - DNA, 22 bp, Homo sapiens
gcaggagtggagaccatgggga

SEQ ID NO: 7947944 - DNA, 22 bp, Homo sapiens
gcaggagtggagaccatgggga

SEQ ID NO: 7947945 - DNA, 22 bp, Homo sapiens
gcaggagtggagaccatgggga

SEQ ID NO: 7947946 - DNA, 22 bp, Homo sapiens
gcaggagtggagaccatgggga

SEQ ID NO: 7947947 - DNA, 22 bp, Homo sapiens
gcaggagttaaaatatgtaatg

SEQ ID NO: 7947948 - DNA, 22 bp, Homo sapiens
gcaggagtgtgtctaatactca

SEQ ID NO: 7947949 - DNA, 22 bp, Homo sapiens
gcaggagttaggcgtcgtggat

SEQ ID NO: 7947950 - DNA, 22 bp, Homo sapiens
gcaggagttagaggtttaatct

SEQ ID NO: 7947951 - DNA, 22 bp, Homo sapiens
gcaggagttaggcgtcgtggat

SEQ ID NO: 7947952 - DNA, 22 bp, Homo sapiens
gcaggcctctgttgagggcctt

SEQ ID NO: 7947953 - DNA, 22 bp, Homo sapiens
gcaggcctctgttgagggcctt

SEQ ID NO: 7947954 - DNA, 22 bp, Homo sapiens
gcaggcctctaattcaccgcag

SEQ ID NO: 7947955 - DNA, 22 bp, Homo sapiens
gcaggcctctgttgagggcctt

SEQ ID NO: 7947956 - DNA, 22 bp, Homo sapiens
gcaggcctctgttgagggcctt

SEQ ID NO: 7947957 - DNA, 19 bp, Homo sapiens
gcaggcctcttgggaatta

SEQ ID NO: 7947958 - DNA, 22 bp, Homo sapiens
gcaggctgagagtccaagaagg

SEQ ID NO: 7947959 - DNA, 22 bp, Homo sapiens
gcaggctgagagtccaagaagg

SEQ ID NO: 7947960 - DNA, 22 bp, Homo sapiens
gcaggctgagtattaccctagt

SEQ ID NO: 7947961 - DNA, 22 bp, Homo sapiens
gcaggctgagtattaccctagt

SEQ ID NO: 7947962 - DNA, 22 bp, Homo sapiens
gcaggctgagtattaccctagt

SEQ ID NO: 7947963 - DNA, 22 bp, Homo sapiens
gcaggctgagtattaccctagt

SEQ ID NO: 7947964 - DNA, 22 bp, Homo sapiens
gcaggctgagtattaccctagt

SEQ ID NO: 7947965 - DNA, 22 bp, Homo sapiens
gcaggctgagtattaccctagt

SEQ ID NO: 7947966 - DNA, 22 bp, Homo sapiens
gcaggctgagttgggaaaccaa

SEQ ID NO: 7947967 - DNA, 22 bp, Homo sapiens
gcaggctgagttgggaaaccaa

SEQ ID NO: 7947968 - DNA, 22 bp, Homo sapiens
gcaggctgagttgggaaaccaa

SEQ ID NO: 7947969 - DNA, 22 bp, Homo sapiens
gcaggctgagtattaccctagt

SEQ ID NO: 7947970 - DNA, 22 bp, Homo sapiens
gcaggctgagttgggaaaccaa

SEQ ID NO: 7947971 - DNA, 22 bp, Homo sapiens
gcaggctgagttgggaaaccaa

SEQ ID NO: 7947972 - DNA, 22 bp, Homo sapiens
gcaggctgatagaggattccat

SEQ ID NO: 7947973 - DNA, 22 bp, Homo sapiens
gcaggctgatagaggattccat

SEQ ID NO: 7947974 - DNA, 22 bp, Homo sapiens
gcaggctgaaactcggggtcta

SEQ ID NO: 7947975 - DNA, 22 bp, Homo sapiens
gcaggctgaaactcggggtcta

SEQ ID NO: 7947976 - DNA, 22 bp, Homo sapiens
gcaggctgaaactcggggtcta

SEQ ID NO: 7947977 - DNA, 22 bp, Homo sapiens
gcaggctgagagtccaagaagg

SEQ ID NO: 7947978 - DNA, 22 bp, Homo sapiens
gcaggctgagagtccaagaagg

SEQ ID NO: 7947979 - DNA, 22 bp, Homo sapiens
gcaggctgaaactcggggtcta

SEQ ID NO: 7947980 - DNA, 22 bp, Homo sapiens
gcaggctgaaactcggggtcta

SEQ ID NO: 7947981 - DNA, 22 bp, Homo sapiens
gcaggctgaaactcggggtcta

SEQ ID NO: 7947982 - DNA, 22 bp, Homo sapiens
gcaggctgaaactcggggtcta

SEQ ID NO: 7947983 - DNA, 22 bp, Homo sapiens
gcaggctcgttggaagtcccct

SEQ ID NO: 7947984 - DNA, 20 bp, Homo sapiens
gcaggctccgggcttgggag

SEQ ID NO: 7947985 - DNA, 22 bp, Homo sapiens
gcaggctcccttgcagagcagg

SEQ ID NO: 7947986 - DNA, 22 bp, Homo sapiens
gcaggctcccttgcagagcagg

SEQ ID NO: 7947987 - DNA, 22 bp, Homo sapiens
gcaggctccaaggcctgggaga

SEQ ID NO: 7947988 - DNA, 22 bp, Homo sapiens
gcaggctccaaggcctgggaga

SEQ ID NO: 7947989 - DNA, 22 bp, Homo sapiens
gcaggctccaaggcctgggaga

SEQ ID NO: 7947990 - DNA, 22 bp, Homo sapiens
gcaggctccaaggcctgggaga

SEQ ID NO: 7947991 - DNA, 22 bp, Homo sapiens
gcaggctccaaggcctgggaga

SEQ ID NO: 7947992 - DNA, 19 bp, Homo sapiens
gcaggcctcttgggaatta

SEQ ID NO: 7947993 - DNA, 19 bp, Homo sapiens
gcaggcctcttgggaatta

SEQ ID NO: 7947994 - DNA, 19 bp, Homo sapiens
gcaggcctcttgggaatta

SEQ ID NO: 7947995 - DNA, 19 bp, Homo sapiens
gcaggcctcttgggaatta

SEQ ID NO: 7947996 - DNA, 22 bp, Homo sapiens
gcaggctcaaaagctggtagga

SEQ ID NO: 7947997 - DNA, 22 bp, Homo sapiens
gcaggctcaaaagctggtagga

SEQ ID NO: 7947998 - DNA, 22 bp, Homo sapiens
gcaggctccaactggaggagtt

SEQ ID NO: 7947999 - DNA, 22 bp, Homo sapiens
gcagggctaggtcttctagggc

SEQ ID NO: 7948000 - DNA, 22 bp, Homo sapiens
gcagggctaggtcttctagggc

SEQ ID NO: 7948001 - DNA, 22 bp, Homo sapiens
gcagggctaggtcttctagggc

SEQ ID NO: 7948002 - DNA, 22 bp, Homo sapiens
gcagggctagatatttgcaagt

SEQ ID NO: 7948003 - DNA, 22 bp, Homo sapiens
gcagggctagatatttgcaagt

SEQ ID NO: 7948004 - DNA, 22 bp, Homo sapiens
gcagggctagatatttgcaagt

SEQ ID NO: 7948005 - DNA, 22 bp, Homo sapiens
gcagggctattggaaggagatg

SEQ ID NO: 7948006 - DNA, 22 bp, Homo sapiens
gcagggctattggaaggagatg

SEQ ID NO: 7948007 - DNA, 22 bp, Homo sapiens
gcagggctattggaaggagatg

SEQ ID NO: 7948008 - DNA, 22 bp, Homo sapiens
gcagggctaggtcttctagggc

SEQ ID NO: 7948009 - DNA, 22 bp, Homo sapiens
gcagggctattggaaggagatg

SEQ ID NO: 7948010 - DNA, 22 bp, Homo sapiens
gcagggctcaacaggacacccc

SEQ ID NO: 7948011 - DNA, 22 bp, Homo sapiens
gcagggctattggaaggagatg

SEQ ID NO: 7948012 - DNA, 22 bp, Homo sapiens
gcagggctattggaaggagatg

SEQ ID NO: 7948013 - DNA, 22 bp, Homo sapiens
gcagggcgcgtttgagcgggct

SEQ ID NO: 7948014 - DNA, 22 bp, Homo sapiens
gcagggcgcgtttgagcgggct

SEQ ID NO: 7948015 - DNA, 22 bp, Homo sapiens
gcagggcgcgtttgagcgggct

SEQ ID NO: 7948016 - DNA, 22 bp, Homo sapiens
gcagggcgcgtttgagcgggct

SEQ ID NO: 7948017 - DNA, 22 bp, Homo sapiens
gcagggcggcccagagcaggcc

SEQ ID NO: 7948018 - DNA, 22 bp, Homo sapiens
gcagggcggcccagagcaggcc

SEQ ID NO: 7948019 - DNA, 22 bp, Homo sapiens
gcagggcggcccagagcaggcc

SEQ ID NO: 7948020 - DNA, 22 bp, Homo sapiens
gcagggcggcccagagcaggcc

SEQ ID NO: 7948021 - DNA, 22 bp, Homo sapiens
gcagggctaatggggcaagtag

SEQ ID NO: 7948022 - DNA, 22 bp, Homo sapiens
gcagggctaatggggcaagtag

SEQ ID NO: 7948023 - DNA, 22 bp, Homo sapiens
gcagggctaatggggcaagtag

SEQ ID NO: 7948024 - DNA, 22 bp, Homo sapiens
gcagggctaatggggcaagtag

SEQ ID NO: 7948025 - DNA, 22 bp, Homo sapiens
gcagggctaatggggcaagtag

SEQ ID NO: 7948026 - DNA, 22 bp, Homo sapiens
gcagggctaatggggcaagtag

SEQ ID NO: 7948027 - DNA, 22 bp, Homo sapiens
gcagggcggcccagagcaggcc

SEQ ID NO: 7948028 - DNA, 22 bp, Homo sapiens
gcagggctaatggggcaagtag

SEQ ID NO: 7948029 - DNA, 22 bp, Homo sapiens
gcagggccttagcagcggctgc

SEQ ID NO: 7948030 - DNA, 22 bp, Homo sapiens
gcagggccttagcagcggctgc

SEQ ID NO: 7948031 - DNA, 22 bp, Homo sapiens
gcagggccttagcagcggctgc

SEQ ID NO: 7948032 - DNA, 22 bp, Homo sapiens
gcagggccttggtcatcttttt

SEQ ID NO: 7948033 - DNA, 20 bp, Homo sapiens
gcagggcgacacgggggagg

SEQ ID NO: 7948034 - DNA, 20 bp, Homo sapiens
gcagggcgacacgggggagg

SEQ ID NO: 7948035 - DNA, 22 bp, Homo sapiens
gcaggctgccaccttctgagtt

SEQ ID NO: 7948036 - DNA, 22 bp, Homo sapiens
gcaggctgccaccttctgagtt

SEQ ID NO: 7948037 - DNA, 22 bp, Homo sapiens
gcaggctgccaccttctgagtt

SEQ ID NO: 7948038 - DNA, 22 bp, Homo sapiens
gcaggctgccaccttctgagtt

SEQ ID NO: 7948039 - DNA, 22 bp, Homo sapiens
gcagggccttagcagcggctgc

SEQ ID NO: 7948040 - DNA, 22 bp, Homo sapiens
gcagggccttagcagcggctgc

SEQ ID NO: 7948041 - DNA, 22 bp, Homo sapiens
gcagggccttagcagcggctgc

SEQ ID NO: 7948042 - DNA, 22 bp, Homo sapiens
gcagggccttagcagcggctgc

SEQ ID NO: 7948043 - DNA, 22 bp, Homo sapiens
gcaggctgatgactggagttgg

SEQ ID NO: 7948044 - DNA, 22 bp, Homo sapiens
gcaggctgatgactggagttgg

SEQ ID NO: 7948045 - DNA, 22 bp, Homo sapiens
gcaggctgatgactggagttgg

SEQ ID NO: 7948046 - DNA, 22 bp, Homo sapiens
gcaggctgatgactggagttgg

SEQ ID NO: 7948047 - DNA, 22 bp, Homo sapiens
gcaggctgatgactggagttgg

SEQ ID NO: 7948048 - DNA, 22 bp, Homo sapiens
gcaggctgatgactggagttgg

SEQ ID NO: 7948049 - DNA, 22 bp, Homo sapiens
gcaggctgatagaggattccat

SEQ ID NO: 7948050 - DNA, 22 bp, Homo sapiens
gcaggctgatagaggattccat

SEQ ID NO: 7948051 - DNA, 22 bp, Homo sapiens
gcaggctgatagaggattccat

SEQ ID NO: 7948052 - DNA, 22 bp, Homo sapiens
gcaggctgatagaggattccat

SEQ ID NO: 7948053 - DNA, 22 bp, Homo sapiens
gcaggctgatgactggagttgg

SEQ ID NO: 7948054 - DNA, 22 bp, Homo sapiens
gcaggctgatgactggagttgg

SEQ ID NO: 7948055 - DNA, 22 bp, Homo sapiens
gtgcctcagcaccgcctgcagc

SEQ ID NO: 7948056 - DNA, 22 bp, Homo sapiens
gtgcctcagcaccgcctgcagc

SEQ ID NO: 7948057 - DNA, 22 bp, Homo sapiens
gtgcctcagcaccgcctgcagc

SEQ ID NO: 7948058 - DNA, 22 bp, Homo sapiens
gtgcctccaggctcgactagtc

SEQ ID NO: 7948059 - DNA, 22 bp, Homo sapiens
gtgcctatgcctgttaatgtct

SEQ ID NO: 7948060 - DNA, 22 bp, Homo sapiens
gtgccgtccctgctctcttgct

SEQ ID NO: 7948061 - DNA, 22 bp, Homo sapiens
gtgccgtgggccttagtgatct

SEQ ID NO: 7948062 - DNA, 22 bp, Homo sapiens
gtgccgcgacgcagtcggtgcc

SEQ ID NO: 7948063 - DNA, 22 bp, Homo sapiens
gtgcctccatcagtgcctccaa

SEQ ID NO: 7948064 - DNA, 22 bp, Homo sapiens
gtgcctccatcagtgcctccaa

SEQ ID NO: 7948065 - DNA, 22 bp, Homo sapiens
gtgcctccatcagtgcctccaa

SEQ ID NO: 7948066 - DNA, 22 bp, Homo sapiens
gtgcctcccgggaccatgcact

SEQ ID NO: 7948067 - DNA, 22 bp, Homo sapiens
gtgcctcccgggaccatgcact

SEQ ID NO: 7948068 - DNA, 22 bp, Homo sapiens
gtgctgggattacaggtgtgag

SEQ ID NO: 7948069 - DNA, 22 bp, Homo sapiens
gtgctgggattacaggtgtgag

SEQ ID NO: 7948070 - DNA, 22 bp, Homo sapiens
gtgctgggattacaggtgtgag

SEQ ID NO: 7948071 - DNA, 22 bp, Homo sapiens
gtgctgggattacaggtgtgag

SEQ ID NO: 7948072 - DNA, 22 bp, Homo sapiens
gtgcctgagccagctgcagctc

SEQ ID NO: 7948073 - DNA, 22 bp, Homo sapiens
gtgcctgaaagccatgctcact

SEQ ID NO: 7948074 - DNA, 22 bp, Homo sapiens
gtgcctctgagctctgctacag

SEQ ID NO: 7948075 - DNA, 22 bp, Homo sapiens
gtgcctctgaccggagaccagg

SEQ ID NO: 7948076 - DNA, 22 bp, Homo sapiens
gtgcctgaaagccatgctcact

SEQ ID NO: 7948077 - DNA, 22 bp, Homo sapiens
gtgcctccctgttgactagggt

SEQ ID NO: 7948078 - DNA, 22 bp, Homo sapiens
gtgcctcccggggctcttcctt

SEQ ID NO: 7948079 - DNA, 22 bp, Homo sapiens
gtgcctcccggggctcttcctt

SEQ ID NO: 7948080 - DNA, 22 bp, Homo sapiens
gtgcctctcattggctgagccc

SEQ ID NO: 7948081 - DNA, 22 bp, Homo sapiens
gtgcctctcttcatacatttgt

SEQ ID NO: 7948082 - DNA, 22 bp, Homo sapiens
gtgcctccttaaattctgcacc

SEQ ID NO: 7948083 - DNA, 22 bp, Homo sapiens
gtgcctctcagctgttcacaat

SEQ ID NO: 7948084 - DNA, 22 bp, Homo sapiens
gtgcctctcagctgttcacaat

SEQ ID NO: 7948085 - DNA, 22 bp, Homo sapiens
gtgcccttcagcggcctcatct

SEQ ID NO: 7948086 - DNA, 22 bp, Homo sapiens
gtgcccttattagatgtcatca

SEQ ID NO: 7948087 - DNA, 22 bp, Homo sapiens
gtgcccttataatagagaccca

SEQ ID NO: 7948088 - DNA, 22 bp, Homo sapiens
gtgcccttataatagagaccca

SEQ ID NO: 7948089 - DNA, 21 bp, Homo sapiens
gtgccctgttcccacatgccc

SEQ ID NO: 7948090 - DNA, 21 bp, Homo sapiens
gtgccctgttcccacatgccc

SEQ ID NO: 7948091 - DNA, 21 bp, Homo sapiens
gtgccctgttcccacatgccc

SEQ ID NO: 7948092 - DNA, 21 bp, Homo sapiens
gtgccctgttcccacatgccc

SEQ ID NO: 7948093 - DNA, 22 bp, Homo sapiens
gtgccctgttgcacacttgagg

SEQ ID NO: 7948094 - DNA, 22 bp, Homo sapiens
gtgccctgttcatttctctccc

SEQ ID NO: 7948095 - DNA, 22 bp, Homo sapiens
gtgccctgtgaactgtaaggaa

SEQ ID NO: 7948096 - DNA, 22 bp, Homo sapiens
gtgccctgtctcttgtctccag

SEQ ID NO: 7948097 - DNA, 22 bp, Homo sapiens
gtgccctggtccccagcatata

SEQ ID NO: 7948098 - DNA, 22 bp, Homo sapiens
gtgccctggtccccagcatata

SEQ ID NO: 7948099 - DNA, 22 bp, Homo sapiens
gtgccctggtccccagcatata

SEQ ID NO: 7948100 - DNA, 22 bp, Homo sapiens
gtgccctgggccttcagggcca

SEQ ID NO: 7948101 - DNA, 22 bp, Homo sapiens
gtgccctggggtgaacccctgg

SEQ ID NO: 7948102 - DNA, 22 bp, Homo sapiens
gtgccctggggtgaacccctgg

SEQ ID NO: 7948103 - DNA, 22 bp, Homo sapiens
gtgccctgggccttcagggcca

SEQ ID NO: 7948104 - DNA, 22 bp, Homo sapiens
gtgccctgggccttcagggcca

SEQ ID NO: 7948105 - DNA, 22 bp, Homo sapiens
gtgccctgggccttcagggcca

SEQ ID NO: 7948106 - DNA, 22 bp, Homo sapiens
gtgccctgggccttcagggcca

SEQ ID NO: 7948107 - DNA, 22 bp, Homo sapiens
gtgccctggctcacagtgtctc

SEQ ID NO: 7948108 - DNA, 22 bp, Homo sapiens
gtgccctggctcacagtgtctc

SEQ ID NO: 7948109 - DNA, 22 bp, Homo sapiens
gtgccctggctcacagtgtctc

SEQ ID NO: 7948110 - DNA, 22 bp, Homo sapiens
gtgccctggctcacagtgtctc

SEQ ID NO: 7948111 - DNA, 22 bp, Homo sapiens
gtgccctggctcacagtgtctc

SEQ ID NO: 7948112 - DNA, 22 bp, Homo sapiens
gtgctgggtgctgcagacaggt

SEQ ID NO: 7948113 - DNA, 22 bp, Homo sapiens
gtgctggtatatgactgagttt

SEQ ID NO: 7948114 - DNA, 22 bp, Homo sapiens
gtgctggtatatgactgagttt

SEQ ID NO: 7948115 - DNA, 22 bp, Homo sapiens
gtgctgtaacaacagagtgtct

SEQ ID NO: 7948116 - DNA, 22 bp, Homo sapiens
gtgctgggtgctgcagacaggt

SEQ ID NO: 7948117 - DNA, 22 bp, Homo sapiens
gtgctgggtgctgcagacaggt

SEQ ID NO: 7948118 - DNA, 22 bp, Homo sapiens
gtgctgggtgctgcagacaggt

SEQ ID NO: 7948119 - DNA, 22 bp, Homo sapiens
gtgctgggtgctgcagacaggt

SEQ ID NO: 7948120 - DNA, 22 bp, Homo sapiens
gtgctgggggtttctgtaggtc

SEQ ID NO: 7948121 - DNA, 22 bp, Homo sapiens
gtgctgggggtttctgtaggtc

SEQ ID NO: 7948122 - DNA, 22 bp, Homo sapiens
gtgctgggtgctgcagacaggt

SEQ ID NO: 7948123 - DNA, 22 bp, Homo sapiens
gtgctgggtgctgcagacaggt

SEQ ID NO: 7948124 - DNA, 22 bp, Homo sapiens
gtgctgggggtttctgtaggtc

SEQ ID NO: 7948125 - DNA, 22 bp, Homo sapiens
gtgctgggtgctgcagacaggt

SEQ ID NO: 7948126 - DNA, 22 bp, Homo sapiens
gtgcttgcagtgagatgagatg

SEQ ID NO: 7948127 - DNA, 22 bp, Homo sapiens
gtgcttgatctcacctgatctc

SEQ ID NO: 7948128 - DNA, 22 bp, Homo sapiens
gtgcttgacgtgtagccgcccc

SEQ ID NO: 7948129 - DNA, 23 bp, Homo sapiens
gtgcttgaaagatgcagaattaa

SEQ ID NO: 7948130 - DNA, 22 bp, Homo sapiens
gtgcttctttctcctcaagcct

SEQ ID NO: 7948131 - DNA, 22 bp, Homo sapiens
gtgcttggaccaggtcatcttc

SEQ ID NO: 7948132 - DNA, 22 bp, Homo sapiens
gtgcttggaccaggtcatcttc

SEQ ID NO: 7948133 - DNA, 23 bp, Homo sapiens
gtgcttgaaagatgcagaattaa

SEQ ID NO: 7948134 - DNA, 22 bp, Homo sapiens
gtgcttctttctcctcaagcct

SEQ ID NO: 7948135 - DNA, 23 bp, Homo sapiens
gtgctgtgagccccttggcctcc

SEQ ID NO: 7948136 - DNA, 23 bp, Homo sapiens
gtgctgtgagccccttggcctcc

SEQ ID NO: 7948137 - DNA, 23 bp, Homo sapiens
gtgctgtgagccccttggcctcc

SEQ ID NO: 7948138 - DNA, 22 bp, Homo sapiens
gtgctgtcactggtaaatgcgg

SEQ ID NO: 7948139 - DNA, 22 bp, Homo sapiens
gtgctgtcaattgctttcagta

SEQ ID NO: 7948140 - DNA, 22 bp, Homo sapiens
gtgctgtattgagacaaggtcg

SEQ ID NO: 7948141 - DNA, 22 bp, Homo sapiens
gtgctgtatcagaatctgctct

SEQ ID NO: 7948142 - DNA, 22 bp, Homo sapiens
gtgctgtatcagaatctgctct

SEQ ID NO: 7948143 - DNA, 22 bp, Homo sapiens
gtgctgggctccaccccagagg

SEQ ID NO: 7948144 - DNA, 22 bp, Homo sapiens
gtgctgggctccaccccagagg

SEQ ID NO: 7948145 - DNA, 22 bp, Homo sapiens
gtgctgggctccaccccagagg

SEQ ID NO: 7948146 - DNA, 22 bp, Homo sapiens
gtgctgggctccaccccagagg

SEQ ID NO: 7948147 - DNA, 22 bp, Homo sapiens
gtgctgggccctgagaccaggg

SEQ ID NO: 7948148 - DNA, 22 bp, Homo sapiens
gtgctgggccctgagaccaggg

SEQ ID NO: 7948149 - DNA, 22 bp, Homo sapiens
gtgctgggccctgagaccaggg

SEQ ID NO: 7948150 - DNA, 22 bp, Homo sapiens
gtgctgggccctgagaccaggg

SEQ ID NO: 7948151 - DNA, 22 bp, Homo sapiens
gtgctgggattacaggtgtgag

SEQ ID NO: 7948152 - DNA, 22 bp, Homo sapiens
gtgctgggattacaggtgtgag

SEQ ID NO: 7948153 - DNA, 22 bp, Homo sapiens
gtgctgggattacaggtgtgag

SEQ ID NO: 7948154 - DNA, 22 bp, Homo sapiens
gtgctgggattacaggtgtgag

SEQ ID NO: 7948155 - DNA, 22 bp, Homo sapiens
gtgctgggattacaggtgtgag

SEQ ID NO: 7948156 - DNA, 22 bp, Homo sapiens
gtgctgggattacaggtgtgag

SEQ ID NO: 7948157 - DNA, 22 bp, Homo sapiens
gtgctgggccctgagaccaggg

SEQ ID NO: 7948158 - DNA, 22 bp, Homo sapiens
gtgctggggagataggaagaga

SEQ ID NO: 7948159 - DNA, 22 bp, Homo sapiens
gtgctggggagataggaagaga

SEQ ID NO: 7948160 - DNA, 22 bp, Homo sapiens
gtgctggggagataggaagaga

SEQ ID NO: 7948161 - DNA, 22 bp, Homo sapiens
gtgctggggagataggaagaga

SEQ ID NO: 7948162 - DNA, 22 bp, Homo sapiens
gtgctggggagataggaagaga

SEQ ID NO: 7948163 - DNA, 22 bp, Homo sapiens
gtgctggggagataggaagaga

SEQ ID NO: 7948164 - DNA, 22 bp, Homo sapiens
gtgctgggggtttctgtaggtc

SEQ ID NO: 7948165 - DNA, 22 bp, Homo sapiens
gtgctgggggtttctgtaggtc

SEQ ID NO: 7948166 - DNA, 22 bp, Homo sapiens
gtgctgggggtttctgtaggtc

SEQ ID NO: 7948167 - DNA, 22 bp, Homo sapiens
gtgctgggggtttctgtaggtc

SEQ ID NO: 7948168 - DNA, 22 bp, Homo sapiens
gtgctgggggtttctgtaggtc

SEQ ID NO: 7948169 - DNA, 22 bp, Homo sapiens
gtgctgggggtttctgtaggtc

SEQ ID NO: 7948170 - DNA, 22 bp, Homo sapiens
gtgctggggagataggaagaga

SEQ ID NO: 7948171 - DNA, 22 bp, Homo sapiens
gtgctgggggtttctgtaggtc

SEQ ID NO: 7948172 - DNA, 22 bp, Homo sapiens
gtgctgggggtttctgtaggtc

SEQ ID NO: 7948173 - DNA, 22 bp, Homo sapiens
gtgcccaggtgtccctgagaag

SEQ ID NO: 7948174 - DNA, 22 bp, Homo sapiens
gtgcccaggtgtccctgagaag

SEQ ID NO: 7948175 - DNA, 22 bp, Homo sapiens
gtgcccaggtgtccctgagaag

SEQ ID NO: 7948176 - DNA, 22 bp, Homo sapiens
gtgccctgagcttatgcattct

SEQ ID NO: 7948177 - DNA, 22 bp, Homo sapiens
gtgcccaggggccagctgccgg

SEQ ID NO: 7948178 - DNA, 22 bp, Homo sapiens
gtgcccaggggccagctgccgg

SEQ ID NO: 7948179 - DNA, 22 bp, Homo sapiens
gtgcccaggggccagctgccgg

SEQ ID NO: 7948180 - DNA, 22 bp, Homo sapiens
gtgcccaggggccagctgccgg

SEQ ID NO: 7948181 - DNA, 22 bp, Homo sapiens
gtgcccaggggccagctgccgg

SEQ ID NO: 7948182 - DNA, 22 bp, Homo sapiens
gtgcccaggggccagctgccgg

SEQ ID NO: 7948183 - DNA, 22 bp, Homo sapiens
gtgccctgcatgccccgggtat

SEQ ID NO: 7948184 - DNA, 22 bp, Homo sapiens
gtgccctgcatgccccgggtat

SEQ ID NO: 7948185 - DNA, 22 bp, Homo sapiens
gtgccctgatgcaattgtctca

SEQ ID NO: 7948186 - DNA, 22 bp, Homo sapiens
gtgccctgagtgggtaggagag

SEQ ID NO: 7948187 - DNA, 22 bp, Homo sapiens
gtgccctgagtgggtaggagag

SEQ ID NO: 7948188 - DNA, 22 bp, Homo sapiens
gtgccctgatcgctaggctccc

SEQ ID NO: 7948189 - DNA, 22 bp, Homo sapiens
gtgcaagaaggggagactgggt

SEQ ID NO: 7948190 - DNA, 22 bp, Homo sapiens
gtgcaataaataaatagattgt

SEQ ID NO: 7948191 - DNA, 22 bp, Homo sapiens
gtgcaagtccagaaagaactct

SEQ ID NO: 7948192 - DNA, 22 bp, Homo sapiens
gtgcaagtccagaaagaactct

SEQ ID NO: 7948193 - DNA, 22 bp, Homo sapiens
gtgcaagacttcctaagcaata

SEQ ID NO: 7948194 - DNA, 22 bp, Homo sapiens
gtgcaagcagtacactcaaagc

SEQ ID NO: 7948195 - DNA, 22 bp, Homo sapiens
gtgcaatctggttaatacgact

SEQ ID NO: 7948196 - DNA, 18 bp, Homo sapiens
gtgcaatgaatagcagag

SEQ ID NO: 7948197 - DNA, 22 bp, Homo sapiens
gtgcaatctgttgactggactt

SEQ ID NO: 7948198 - DNA, 22 bp, Homo sapiens
gtgcaatgtatgtctcaatgat

SEQ ID NO: 7948199 - DNA, 22 bp, Homo sapiens
gtgcaatggggcaatatcagct

SEQ ID NO: 7948200 - DNA, 20 bp, Homo sapiens
gtgcaatggctcagtctcag

SEQ ID NO: 7948201 - DNA, 22 bp, Homo sapiens
gtgcaattttgcatctgtatgc

SEQ ID NO: 7948202 - DNA, 22 bp, Homo sapiens
gtgcacacaagcaatgcactta

SEQ ID NO: 7948203 - DNA, 22 bp, Homo sapiens
gtgcacactcttggggcacttt

SEQ ID NO: 7948204 - DNA, 22 bp, Homo sapiens
gtgcacacatacatgaacgctg

SEQ ID NO: 7948205 - DNA, 22 bp, Homo sapiens
gtgattttgagacctatatagt

SEQ ID NO: 7948206 - DNA, 22 bp, Homo sapiens
gtgcaaaaataattgtggtttt

SEQ ID NO: 7948207 - DNA, 22 bp, Homo sapiens
gtgattttgagacctatatagt

SEQ ID NO: 7948208 - DNA, 22 bp, Homo sapiens
gtgattttctcctcctagaagt

SEQ ID NO: 7948209 - DNA, 22 bp, Homo sapiens
gtgattttgagacctatatagt

SEQ ID NO: 7948210 - DNA, 22 bp, Homo sapiens
gtgattttctcctcctagaagt

SEQ ID NO: 7948211 - DNA, 22 bp, Homo sapiens
gtgattttctcctcctagaagt

SEQ ID NO: 7948212 - DNA, 22 bp, Homo sapiens
gtgcaaaaataattgtggtttt

SEQ ID NO: 7948213 - DNA, 22 bp, Homo sapiens
gtgcaaaaatctatcaccagca

SEQ ID NO: 7948214 - DNA, 22 bp, Homo sapiens
gtgcaaaagcaattgcagtttt

SEQ ID NO: 7948215 - DNA, 22 bp, Homo sapiens
gtgcaaaagcaattgcagtttt

SEQ ID NO: 7948216 - DNA, 22 bp, Homo sapiens
gtgcaaaagcaattgcagtttt

SEQ ID NO: 7948217 - DNA, 22 bp, Homo sapiens
gtgcaaaagcagttggattttt

SEQ ID NO: 7948218 - DNA, 22 bp, Homo sapiens
gtgcaaaagcagttggattttt

SEQ ID NO: 7948219 - DNA, 22 bp, Homo sapiens
gtgcaaaagcagttgtggtttt

SEQ ID NO: 7948220 - DNA, 22 bp, Homo sapiens
gtgcaaaagcagttgtggtttt

SEQ ID NO: 7948221 - DNA, 22 bp, Homo sapiens
gtgcaaaaggcattgtggtttt

SEQ ID NO: 7948222 - DNA, 22 bp, Homo sapiens
gtgcaaaaggcattgtggtttt

SEQ ID NO: 7948223 - DNA, 22 bp, Homo sapiens
gtgcaaaagtaaatgtggtttt

SEQ ID NO: 7948224 - DNA, 22 bp, Homo sapiens
gtgcaaaagtaaatgtggtttt

SEQ ID NO: 7948225 - DNA, 22 bp, Homo sapiens
gtgcaaaagtaactgtggtttt

SEQ ID NO: 7948226 - DNA, 22 bp, Homo sapiens
gtgcaaaagtaactgtggtttt

SEQ ID NO: 7948227 - DNA, 22 bp, Homo sapiens
gtgcaaatgtaattgtgatttt

SEQ ID NO: 7948228 - DNA, 22 bp, Homo sapiens
gtgattctcaaattgtgatatc

SEQ ID NO: 7948229 - DNA, 22 bp, Homo sapiens
gtgattctgaccttcagggagt

SEQ ID NO: 7948230 - DNA, 22 bp, Homo sapiens
gtgattcataaaacactagatg

SEQ ID NO: 7948231 - DNA, 22 bp, Homo sapiens
gtgattatatttctatgtgaat

SEQ ID NO: 7948232 - DNA, 22 bp, Homo sapiens
gtgattatttgtgattaaggag

SEQ ID NO: 7948233 - DNA, 22 bp, Homo sapiens
gtgattatgttatattaaggca

SEQ ID NO: 7948234 - DNA, 22 bp, Homo sapiens
gtgattatatttctatgtgaat

SEQ ID NO: 7948235 - DNA, 22 bp, Homo sapiens
gtgattatagaatgctacaaag

SEQ ID NO: 7948236 - DNA, 22 bp, Homo sapiens
gtgattaatgctgttggagata

SEQ ID NO: 7948237 - DNA, 22 bp, Homo sapiens
gtgattaatgccaatgggcctt

SEQ ID NO: 7948238 - DNA, 22 bp, Homo sapiens
gtgattaataatggccatgcat

SEQ ID NO: 7948239 - DNA, 15 bp, Homo sapiens
gtgattaagtgcgtt

SEQ ID NO: 7948240 - DNA, 22 bp, Homo sapiens
gtgattaagcatttcagaattt

SEQ ID NO: 7948241 - DNA, 22 bp, Homo sapiens
gtgattctggcaggcagaaggg

SEQ ID NO: 7948242 - DNA, 22 bp, Homo sapiens
gtgattctgcctggaaggtcct

SEQ ID NO: 7948243 - DNA, 22 bp, Homo sapiens
gtgattcttcctgctggcatac

SEQ ID NO: 7948244 - DNA, 22 bp, Homo sapiens
gtgatttagtgttaagtatgtt

SEQ ID NO: 7948245 - DNA, 22 bp, Homo sapiens
gtgatttagatgttgaaagtga

SEQ ID NO: 7948246 - DNA, 22 bp, Homo sapiens
gtcttcattcaacaaatattca

SEQ ID NO: 7948247 - DNA, 22 bp, Homo sapiens
gtcttcattctcatagccctgg

SEQ ID NO: 7948248 - DNA, 22 bp, Homo sapiens
gtcttccacatttcaagaggct

SEQ ID NO: 7948249 - DNA, 22 bp, Homo sapiens
gtcttccacatttcaagaggct

SEQ ID NO: 7948250 - DNA, 22 bp, Homo sapiens
gtcttcctaatttgctattagg

SEQ ID NO: 7948251 - DNA, 22 bp, Homo sapiens
gtcttcagtggcaaatggatct

SEQ ID NO: 7948252 - DNA, 22 bp, Homo sapiens
gtcttcctaatttgctattagg

SEQ ID NO: 7948253 - DNA, 20 bp, Homo sapiens
gtcttctattcccagaaagt

SEQ ID NO: 7948254 - DNA, 19 bp, Homo sapiens
gtcttctgaatgtggctgc

SEQ ID NO: 7948255 - DNA, 19 bp, Homo sapiens
gtcttctgaatgtggctgc

SEQ ID NO: 7948256 - DNA, 22 bp, Homo sapiens
gtcttctgatctggttagccat

SEQ ID NO: 7948257 - DNA, 22 bp, Homo sapiens
gtcttctgcaactgcacctgcc

SEQ ID NO: 7948258 - DNA, 22 bp, Homo sapiens
gtcttctgatctggttagccat

SEQ ID NO: 7948259 - DNA, 22 bp, Homo sapiens
gtcttctgcaactgcacctgcc

SEQ ID NO: 7948260 - DNA, 22 bp, Homo sapiens
gtcttctgcccaggcagacgga

SEQ ID NO: 7948261 - DNA, 22 bp, Homo sapiens
gtcttcaacaataactaccact

SEQ ID NO: 7948262 - DNA, 22 bp, Homo sapiens
gtcttcaactggactccaggga

SEQ ID NO: 7948263 - DNA, 22 bp, Homo sapiens
gtcttcaacaaatggtagggtc

SEQ ID NO: 7948264 - DNA, 21 bp, Homo sapiens
gtcttcaaaggcagtgggcag

SEQ ID NO: 7948265 - DNA, 22 bp, Homo sapiens
gtcttattttctgtctactaaa

SEQ ID NO: 7948266 - DNA, 22 bp, Homo sapiens
gtcttatttaaggcttatacaa

SEQ ID NO: 7948267 - DNA, 22 bp, Homo sapiens
gtcttattttctgtctactaaa

SEQ ID NO: 7948268 - DNA, 22 bp, Homo sapiens
gtcttatttaaggacaagaaga

SEQ ID NO: 7948269 - DNA, 22 bp, Homo sapiens
gtcttatttaaggacaagaaga

SEQ ID NO: 7948270 - DNA, 22 bp, Homo sapiens
gtcttatttaaggacaagaaga

SEQ ID NO: 7948271 - DNA, 20 bp, Homo sapiens
gtcttatttaacacatgact

SEQ ID NO: 7948272 - DNA, 22 bp, Homo sapiens
gtcttatttaacctaaatttct

SEQ ID NO: 7948273 - DNA, 22 bp, Homo sapiens
gtcttatttaacctaaatttct

SEQ ID NO: 7948274 - DNA, 22 bp, Homo sapiens
gtcttagatttcaccgataatg

SEQ ID NO: 7948275 - DNA, 22 bp, Homo sapiens
gtcttagatttcaccgataatg

SEQ ID NO: 7948276 - DNA, 22 bp, Homo sapiens
gtcttagatttcaccgataatg

SEQ ID NO: 7948277 - DNA, 22 bp, Homo sapiens
gtcttagatttcaccgataatg

SEQ ID NO: 7948278 - DNA, 22 bp, Homo sapiens
gtctggtttatgaagatcccgt

SEQ ID NO: 7948279 - DNA, 22 bp, Homo sapiens
gtcttagatttcaccgataatg

SEQ ID NO: 7948280 - DNA, 22 bp, Homo sapiens
gtcttattaaaaatctaatccc

SEQ ID NO: 7948281 - DNA, 22 bp, Homo sapiens
gtcttatagtacaatttgaagt

SEQ ID NO: 7948282 - DNA, 22 bp, Homo sapiens
gtctgggtttcatgggcactgg

SEQ ID NO: 7948283 - DNA, 22 bp, Homo sapiens
gtctggtgggattccaagtggc

SEQ ID NO: 7948284 - DNA, 22 bp, Homo sapiens
gtctggtgggattccaagtggc

SEQ ID NO: 7948285 - DNA, 22 bp, Homo sapiens
gtctggtgggattccaagtggc

SEQ ID NO: 7948286 - DNA, 22 bp, Homo sapiens
gtctggtcctcttcacagtggc

SEQ ID NO: 7948287 - DNA, 22 bp, Homo sapiens
gtctgggtctccacagtcagca

SEQ ID NO: 7948288 - DNA, 22 bp, Homo sapiens
gtcttattaggttaaccctgct

SEQ ID NO: 7948289 - DNA, 22 bp, Homo sapiens
gtcttattatgaggttagactt

SEQ ID NO: 7948290 - DNA, 22 bp, Homo sapiens
gtcttattaaaatgcagtttct

SEQ ID NO: 7948291 - DNA, 22 bp, Homo sapiens
gtcttatcacgtggctagctca

SEQ ID NO: 7948292 - DNA, 22 bp, Homo sapiens
gtcttattaaaaatctaatccc

SEQ ID NO: 7948293 - DNA, 22 bp, Homo sapiens
gtcttatttaaagagatcatac

SEQ ID NO: 7948294 - DNA, 22 bp, Homo sapiens
gtcttatttaaagagatcatac

SEQ ID NO: 7948295 - DNA, 22 bp, Homo sapiens
gtcttatttaaagagatcatac

SEQ ID NO: 7948296 - DNA, 22 bp, Homo sapiens
gtcttatttaaagagatcatac

SEQ ID NO: 7948297 - DNA, 22 bp, Homo sapiens
gtcttattgcgtatgtatacaa

SEQ ID NO: 7948298 - DNA, 22 bp, Homo sapiens
gtcttattgcgtatgtatacaa

SEQ ID NO: 7948299 - DNA, 22 bp, Homo sapiens
gtcttattgggtccaaggtggc

SEQ ID NO: 7948300 - DNA, 23 bp, Homo sapiens
gtctctagagtgtggagcaaaga

SEQ ID NO: 7948301 - DNA, 22 bp, Homo sapiens
gtctctatcatagctgaaccct

SEQ ID NO: 7948302 - DNA, 22 bp, Homo sapiens
gtctctagattgggagagagaa

SEQ ID NO: 7948303 - DNA, 23 bp, Homo sapiens
gtctctagagtgtggagcaaaga

SEQ ID NO: 7948304 - DNA, 22 bp, Homo sapiens
gtctcgttgctttataaataga

SEQ ID NO: 7948305 - DNA, 22 bp, Homo sapiens
gtctcgctgagcccccattcta

SEQ ID NO: 7948306 - DNA, 22 bp, Homo sapiens
gtctcgtcaatggcaggttccc

SEQ ID NO: 7948307 - DNA, 22 bp, Homo sapiens
gtctcctgtcctgcaggatgga

SEQ ID NO: 7948308 - DNA, 22 bp, Homo sapiens
gtctcctgtcctgcaggatgga

SEQ ID NO: 7948309 - DNA, 22 bp, Homo sapiens
gtctccttgtggatctcaagga

SEQ ID NO: 7948310 - DNA, 22 bp, Homo sapiens
gtctcctgtcctgcaggatgga

SEQ ID NO: 7948311 - DNA, 22 bp, Homo sapiens
gtctccttgtggatctcaagga

SEQ ID NO: 7948312 - DNA, 22 bp, Homo sapiens
gtctcctgtcctgcaggatgga

SEQ ID NO: 7948313 - DNA, 22 bp, Homo sapiens
gtctcctgtcctgcaggatgga

SEQ ID NO: 7948314 - DNA, 22 bp, Homo sapiens
gtctcctggcttttgtcccagt

SEQ ID NO: 7948315 - DNA, 22 bp, Homo sapiens
gtctcctgtcctgcaggatgga

SEQ ID NO: 7948316 - DNA, 22 bp, Homo sapiens
gtctcctggcttttgtcccagt

SEQ ID NO: 7948317 - DNA, 22 bp, Homo sapiens
gtctctctgactggtccacacc

SEQ ID NO: 7948318 - DNA, 22 bp, Homo sapiens
gtctctctcccaagattggcta

SEQ ID NO: 7948319 - DNA, 22 bp, Homo sapiens
gtctctatcatagctgaaccct

SEQ ID NO: 7948320 - DNA, 22 bp, Homo sapiens
gtctctcaaaactagaagagaa

SEQ ID NO: 7948321 - DNA, 22 bp, Homo sapiens
gtctctcaaaactagaagagaa

SEQ ID NO: 7948322 - DNA, 22 bp, Homo sapiens
gtctctcaaaactagaagagaa

SEQ ID NO: 7948323 - DNA, 22 bp, Homo sapiens
gtctctctcccaagattggcta

SEQ ID NO: 7948324 - DNA, 22 bp, Homo sapiens
gtctggggtactttcatctgat

SEQ ID NO: 7948325 - DNA, 22 bp, Homo sapiens
gtctggggtccttttggcttta

SEQ ID NO: 7948326 - DNA, 22 bp, Homo sapiens
gtctggggtccttttggcttta

SEQ ID NO: 7948327 - DNA, 22 bp, Homo sapiens
gtctggggtactttcatctgat

SEQ ID NO: 7948328 - DNA, 22 bp, Homo sapiens
gtctggggtactttcatctgat

SEQ ID NO: 7948329 - DNA, 22 bp, Homo sapiens
gtctggggtactttcatctgat

SEQ ID NO: 7948330 - DNA, 22 bp, Homo sapiens
gtctctgacctgcgtccctcct

SEQ ID NO: 7948331 - DNA, 22 bp, Homo sapiens
gtctcctgaggcatccattgaa

SEQ ID NO: 7948332 - DNA, 22 bp, Homo sapiens
gtctcctgaggcatccattgaa

SEQ ID NO: 7948333 - DNA, 22 bp, Homo sapiens
gtctcctgaggcatccattgaa

SEQ ID NO: 7948334 - DNA, 22 bp, Homo sapiens
gtctcctgccacactcagtccc

SEQ ID NO: 7948335 - DNA, 22 bp, Homo sapiens
gtctcctgaggcatccattgaa

SEQ ID NO: 7948336 - DNA, 22 bp, Homo sapiens
gtctcctgaggcatccattgaa

SEQ ID NO: 7948337 - DNA, 22 bp, Homo sapiens
gtctcctgccacactcagtccc

SEQ ID NO: 7948338 - DNA, 22 bp, Homo sapiens
gtctcctgagccttgactgcaa

SEQ ID NO: 7948339 - DNA, 22 bp, Homo sapiens
gtctcctgagccttgactgcaa

SEQ ID NO: 7948340 - DNA, 22 bp, Homo sapiens
gtctcctgagccttgactgcaa

SEQ ID NO: 7948341 - DNA, 22 bp, Homo sapiens
gtctcctgagactgcagtcacc

SEQ ID NO: 7948342 - DNA, 22 bp, Homo sapiens
gtctcctgagccttgactgcaa

SEQ ID NO: 7948343 - DNA, 20 bp, Homo sapiens
gtctcctctttgcattccta

SEQ ID NO: 7948344 - DNA, 22 bp, Homo sapiens
gtctcctgagactgcagtcacc

SEQ ID NO: 7948345 - DNA, 22 bp, Homo sapiens
gtctcctgagactgcagtcacc

SEQ ID NO: 7948346 - DNA, 22 bp, Homo sapiens
gtctcctggctgcagctaagac

SEQ ID NO: 7948347 - DNA, 22 bp, Homo sapiens
gtctcctggctgcagctaagac

SEQ ID NO: 7948348 - DNA, 22 bp, Homo sapiens
gtctcctggctgcagctaagac

SEQ ID NO: 7948349 - DNA, 22 bp, Homo sapiens
gtctcctggaaatatgcccata

SEQ ID NO: 7948350 - DNA, 22 bp, Homo sapiens
gtctcctggcctccagtttctc

SEQ ID NO: 7948351 - DNA, 22 bp, Homo sapiens
gtctcctggcctccagtttctc

SEQ ID NO: 7948352 - DNA, 22 bp, Homo sapiens
gtctcctggcctccagtttctc

SEQ ID NO: 7948353 - DNA, 22 bp, Homo sapiens
gtctcctggcctccagtttctc

SEQ ID NO: 7948354 - DNA, 22 bp, Homo sapiens
gtctcctggctgcagctaagac

SEQ ID NO: 7948355 - DNA, 22 bp, Homo sapiens
gtctcctggaaatatgcccata

SEQ ID NO: 7948356 - DNA, 22 bp, Homo sapiens
gtctcctggaaatatgcccata

SEQ ID NO: 7948357 - DNA, 22 bp, Homo sapiens
gtctcctggaaatatgcccata

SEQ ID NO: 7948358 - DNA, 22 bp, Homo sapiens
gtctcctgctagcaagcaccac

SEQ ID NO: 7948359 - DNA, 22 bp, Homo sapiens
gtctcctgctagcaagcaccac

SEQ ID NO: 7948360 - DNA, 22 bp, Homo sapiens
gtctcctgcccccggtgcttgg

SEQ ID NO: 7948361 - DNA, 22 bp, Homo sapiens
gtctcctgcccccggtgcttgg

SEQ ID NO: 7948362 - DNA, 22 bp, Homo sapiens
gtctcctgcccccggtgcttgg

SEQ ID NO: 7948363 - DNA, 22 bp, Homo sapiens
gtctcctgcccccggtgcttgg

SEQ ID NO: 7948364 - DNA, 22 bp, Homo sapiens
gtgaggtctttgggaggtgatt

SEQ ID NO: 7948365 - DNA, 19 bp, Homo sapiens
gtgaggtctttccttttgt

SEQ ID NO: 7948366 - DNA, 22 bp, Homo sapiens
gtgaggtcctgagaggcttgtg

SEQ ID NO: 7948367 - DNA, 22 bp, Homo sapiens
gtgaggtcctccctgctgggag

SEQ ID NO: 7948368 - DNA, 22 bp, Homo sapiens
gtgaggtgggctggccagagac

SEQ ID NO: 7948369 - DNA, 22 bp, Homo sapiens
gtgaggtgagtagtgagaagcc

SEQ ID NO: 7948370 - DNA, 22 bp, Homo sapiens
gtgaggtgggctgggctctatg

SEQ ID NO: 7948371 - DNA, 22 bp, Homo sapiens
gtgaggtgggctggccagagac

SEQ ID NO: 7948372 - DNA, 22 bp, Homo sapiens
gtgaggtgggctgggctctatg

SEQ ID NO: 7948373 - DNA, 22 bp, Homo sapiens
gtgaggtggtacaatattaact

SEQ ID NO: 7948374 - DNA, 22 bp, Homo sapiens
gtgaggtcatatagcgaactcc

SEQ ID NO: 7948375 - DNA, 22 bp, Homo sapiens
gtgaggtccatgttaatgggtt

SEQ ID NO: 7948376 - DNA, 22 bp, Homo sapiens
gtgaggtccagtaacttgtcca

SEQ ID NO: 7948377 - DNA, 22 bp, Homo sapiens
gtgaggtcctaatagacatcga

SEQ ID NO: 7948378 - DNA, 22 bp, Homo sapiens
gtgaggccgcacgccccggagt

SEQ ID NO: 7948379 - DNA, 22 bp, Homo sapiens
gtgaggcattgaagaccggaat

SEQ ID NO: 7948380 - DNA, 22 bp, Homo sapiens
gtgaggcagggaaagaggataa

SEQ ID NO: 7948381 - DNA, 22 bp, Homo sapiens
gtgaggcagggaaagaggataa

SEQ ID NO: 7948382 - DNA, 20 bp, Homo sapiens
gtcttgaaggggtcatggag

SEQ ID NO: 7948383 - DNA, 22 bp, Homo sapiens
gtcttgaaaagtggccagtttg

SEQ ID NO: 7948384 - DNA, 22 bp, Homo sapiens
gtcttcttttcagtctgcttgt

SEQ ID NO: 7948385 - DNA, 22 bp, Homo sapiens
gtcttctgtttactttgaagtt

SEQ ID NO: 7948386 - DNA, 22 bp, Homo sapiens
gtcttctgtttactttgaagtt

SEQ ID NO: 7948387 - DNA, 22 bp, Homo sapiens
gtcttcttgtgttgcctgtctt

SEQ ID NO: 7948388 - DNA, 22 bp, Homo sapiens
gtcttctttgtcatcttaggtt

SEQ ID NO: 7948389 - DNA, 22 bp, Homo sapiens
gtcttctggaagagagccagct

SEQ ID NO: 7948390 - DNA, 22 bp, Homo sapiens
gtcttctggaagagagccagct

SEQ ID NO: 7948391 - DNA, 22 bp, Homo sapiens
gtcttctggaagagagccagct

SEQ ID NO: 7948392 - DNA, 22 bp, Homo sapiens
gtcttctggggccaggcccgct

SEQ ID NO: 7948393 - DNA, 22 bp, Homo sapiens
gtcttctggggccaggcccgct

SEQ ID NO: 7948394 - DNA, 22 bp, Homo sapiens
gtcttctggggccaggcccgct

SEQ ID NO: 7948395 - DNA, 22 bp, Homo sapiens
gtcttctgcccaggcagacgga

SEQ ID NO: 7948396 - DNA, 22 bp, Homo sapiens
gtcttctgcctccattagagtt

SEQ ID NO: 7948397 - DNA, 22 bp, Homo sapiens
gtcttctggaagagagccagct

SEQ ID NO: 7948398 - DNA, 22 bp, Homo sapiens
gtcttctgttctgtgaggcttc

SEQ ID NO: 7948399 - DNA, 22 bp, Homo sapiens
gtcttctgttctgtgaggcttc

SEQ ID NO: 7948400 - DNA, 22 bp, Homo sapiens
gtcttctgttctgtgaggcttc

SEQ ID NO: 7948401 - DNA, 22 bp, Homo sapiens
gtcttctgttctgtgaggcttc

SEQ ID NO: 7948402 - DNA, 22 bp, Homo sapiens
gtcttctgttctgtgaggcttc

SEQ ID NO: 7948403 - DNA, 22 bp, Homo sapiens
gtcttctgtaagatgaggtccc

SEQ ID NO: 7948404 - DNA, 22 bp, Homo sapiens
gtcttctgtctgtctggcatgt

SEQ ID NO: 7948405 - DNA, 22 bp, Homo sapiens
gtcttctgtctgtctggcatgt

SEQ ID NO: 7948406 - DNA, 22 bp, Homo sapiens
gtcttctgtctgtctggcatgt

SEQ ID NO: 7948407 - DNA, 22 bp, Homo sapiens
gtgatgtcagcaagaataggaa

SEQ ID NO: 7948408 - DNA, 22 bp, Homo sapiens
gtgatgtcagcaagaataggaa

SEQ ID NO: 7948409 - DNA, 22 bp, Homo sapiens
gtgatgtcagcaagaataggaa

SEQ ID NO: 7948410 - DNA, 22 bp, Homo sapiens
gtgatgtcttgtacatatgatt

SEQ ID NO: 7948411 - DNA, 22 bp, Homo sapiens
gtgatgtcagacatctggtatt

SEQ ID NO: 7948412 - DNA, 22 bp, Homo sapiens
gtgatgtcacagaataagtgat

SEQ ID NO: 7948413 - DNA, 22 bp, Homo sapiens
gtgatgtcacagaataagtgat

SEQ ID NO: 7948414 - DNA, 22 bp, Homo sapiens
gtgattaactgcagttagagct

SEQ ID NO: 7948415 - DNA, 22 bp, Homo sapiens
gtgattaactgcagttagagct

SEQ ID NO: 7948416 - DNA, 22 bp, Homo sapiens
gtgatgtggggaccgtcctggc

SEQ ID NO: 7948417 - DNA, 22 bp, Homo sapiens
gtgatgggtaactgtttaggga

SEQ ID NO: 7948418 - DNA, 22 bp, Homo sapiens
gtgatggagtcaaggctagaac

SEQ ID NO: 7948419 - DNA, 22 bp, Homo sapiens
gtgatgggtaactgtttaggga

SEQ ID NO: 7948420 - DNA, 22 bp, Homo sapiens
gtgatgtagccctaattctgca

SEQ ID NO: 7948421 - DNA, 22 bp, Homo sapiens
gtgatgtcacacccttgataga

SEQ ID NO: 7948422 - DNA, 22 bp, Homo sapiens
gtgatacaggatggtgataaat

SEQ ID NO: 7948423 - DNA, 23 bp, Homo sapiens
gtgatattaaggatagagacaag

SEQ ID NO: 7948424 - DNA, 22 bp, Homo sapiens
gtgataaaattcaaatagctct

SEQ ID NO: 7948425 - DNA, 22 bp, Homo sapiens
gtgatacaaataaacatatgct

SEQ ID NO: 7948426 - DNA, 22 bp, Homo sapiens
gtgataagacagtaggcacaag

SEQ ID NO: 7948427 - DNA, 22 bp, Homo sapiens
gtgatcactgcttcttccacca

SEQ ID NO: 7948428 - DNA, 22 bp, Homo sapiens
gtgaggtggtacaatattaact

SEQ ID NO: 7948429 - DNA, 22 bp, Homo sapiens
gtgaggtggtacaatattaact

SEQ ID NO: 7948430 - DNA, 22 bp, Homo sapiens
gtgagtcaatgtattgcagcaa

SEQ ID NO: 7948431 - DNA, 22 bp, Homo sapiens
gtgagtacaagaaccgtagtct

SEQ ID NO: 7948432 - DNA, 22 bp, Homo sapiens
gtgagtctgcctagcacatcac

SEQ ID NO: 7948433 - DNA, 22 bp, Homo sapiens
gtgagtcaatgtattgcagcaa

SEQ ID NO: 7948434 - DNA, 22 bp, Homo sapiens
gtgagtctttggagacagttca

SEQ ID NO: 7948435 - DNA, 23 bp, Homo sapiens
gtgagtcttgcctttgctgtgga

SEQ ID NO: 7948436 - DNA, 22 bp, Homo sapiens
gtgagtgtcagtcaaaggtttt

SEQ ID NO: 7948437 - DNA, 23 bp, Homo sapiens
gtgagtcttgcctttgctgtgga

SEQ ID NO: 7948438 - DNA, 22 bp, Homo sapiens
gtgataaaatagaaacagtggt

SEQ ID NO: 7948439 - DNA, 22 bp, Homo sapiens
gtgagttactctggttctcatt

SEQ ID NO: 7948440 - DNA, 22 bp, Homo sapiens
gtgagttcccggatctgttcca

SEQ ID NO: 7948441 - DNA, 22 bp, Homo sapiens
gtgagtgttaacccactgcttc

SEQ ID NO: 7948442 - DNA, 22 bp, Homo sapiens
gtgagtgtcagtcaaaggtttt

SEQ ID NO: 7948443 - DNA, 22 bp, Homo sapiens
gtgataaagacgtgtcataatt

SEQ ID NO: 7948444 - DNA, 22 bp, Homo sapiens
gtgataaaattcaaatagctct

SEQ ID NO: 7948445 - DNA, 22 bp, Homo sapiens
gtgataaaattcaaatagctct

SEQ ID NO: 7948446 - DNA, 22 bp, Homo sapiens
gtgataaaatagaaacagtggt

SEQ ID NO: 7948447 - DNA, 22 bp, Homo sapiens
gtctcccatcgtttgtgaggaa

SEQ ID NO: 7948448 - DNA, 22 bp, Homo sapiens
gtctcccatcgtttgtgaggaa

SEQ ID NO: 7948449 - DNA, 23 bp, Homo sapiens
gtctcccatagcgctcccaggct

SEQ ID NO: 7948450 - DNA, 22 bp, Homo sapiens
gtctcccagcctacatctttct

SEQ ID NO: 7948451 - DNA, 22 bp, Homo sapiens
gtcctctgcttcatgccctgat

SEQ ID NO: 7948452 - DNA, 22 bp, Homo sapiens
gtcctctgcttcatgccctgat

SEQ ID NO: 7948453 - DNA, 22 bp, Homo sapiens
gtcctctgcccaggtcaaggtt

SEQ ID NO: 7948454 - DNA, 22 bp, Homo sapiens
gtcctctgcttcatgccctgat

SEQ ID NO: 7948455 - DNA, 22 bp, Homo sapiens
gtctcccactttctggcctctt

SEQ ID NO: 7948456 - DNA, 22 bp, Homo sapiens
gtctcccactttctggcctctt

SEQ ID NO: 7948457 - DNA, 20 bp, Homo sapiens
gtctcctaccctcagctaga

SEQ ID NO: 7948458 - DNA, 22 bp, Homo sapiens
gtctcctagtcttcacttattg

SEQ ID NO: 7948459 - DNA, 22 bp, Homo sapiens
gtctcccgcccaacaagcaagg

SEQ ID NO: 7948460 - DNA, 22 bp, Homo sapiens
gtctcccatgtccctgtccagt

SEQ ID NO: 7948461 - DNA, 22 bp, Homo sapiens
gtctccccagggccctcttcat

SEQ ID NO: 7948462 - DNA, 22 bp, Homo sapiens
gtctccccagggccctcttcat

SEQ ID NO: 7948463 - DNA, 22 bp, Homo sapiens
gtctccccagggccctcttcat

SEQ ID NO: 7948464 - DNA, 22 bp, Homo sapiens
gtctcccatgtccctgtccagt

SEQ ID NO: 7948465 - DNA, 22 bp, Homo sapiens
gtctcccatgtccctgtccagt

SEQ ID NO: 7948466 - DNA, 22 bp, Homo sapiens
gtctcctccctttcattcacct

SEQ ID NO: 7948467 - DNA, 22 bp, Homo sapiens
gtctcctcttcatatacctgtt

SEQ ID NO: 7948468 - DNA, 20 bp, Homo sapiens
gtctcctctttgcattccta

SEQ ID NO: 7948469 - DNA, 22 bp, Homo sapiens
gtctcctcttcatatacctgtt

SEQ ID NO: 7948470 - DNA, 20 bp, Homo sapiens
gtctcctctttgcattccta

SEQ ID NO: 7948471 - DNA, 22 bp, Homo sapiens
gtctcctccagtaggaagtggc

SEQ ID NO: 7948472 - DNA, 22 bp, Homo sapiens
gtctcctccagtaggaagtggc

SEQ ID NO: 7948473 - DNA, 22 bp, Homo sapiens
gtctcctatagctgcactgaat

SEQ ID NO: 7948474 - DNA, 22 bp, Homo sapiens
gtctcctaaaccatcctggtac

SEQ ID NO: 7948475 - DNA, 22 bp, Homo sapiens
gtctcctatagctgcactgaat

SEQ ID NO: 7948476 - DNA, 22 bp, Homo sapiens
gtctcctatgttgaaacaaaat

SEQ ID NO: 7948477 - DNA, 22 bp, Homo sapiens
gtctcctccatggagatggtat

SEQ ID NO: 7948478 - DNA, 22 bp, Homo sapiens
gtctcctccatggagatggtat

SEQ ID NO: 7948479 - DNA, 22 bp, Homo sapiens
gtcctctagggtgtccagttga

SEQ ID NO: 7948480 - DNA, 22 bp, Homo sapiens
gtcctctccaggaggctctgat

SEQ ID NO: 7948481 - DNA, 22 bp, Homo sapiens
gtcctcagtcagtttggtgggg

SEQ ID NO: 7948482 - DNA, 22 bp, Homo sapiens
gtcctcagtcagtttggtgggg

SEQ ID NO: 7948483 - DNA, 22 bp, Homo sapiens
gtcctcagtcagtttggtgggg

SEQ ID NO: 7948484 - DNA, 22 bp, Homo sapiens
gtcctctgaagttgtgcaatgc

SEQ ID NO: 7948485 - DNA, 22 bp, Homo sapiens
gtcctctgaaagatgaaccatg

SEQ ID NO: 7948486 - DNA, 22 bp, Homo sapiens
gtcctctgaaagatgaaccatg

SEQ ID NO: 7948487 - DNA, 22 bp, Homo sapiens
gtcctctccaggaggctctgat

SEQ ID NO: 7948488 - DNA, 22 bp, Homo sapiens
gtcctctgactcagccttggga

SEQ ID NO: 7948489 - DNA, 22 bp, Homo sapiens
gtcctctgactcagccttggga

SEQ ID NO: 7948490 - DNA, 22 bp, Homo sapiens
gtcctctgagggggctgcacgc

SEQ ID NO: 7948491 - DNA, 22 bp, Homo sapiens
gtcctctgagggggctgcacgc

SEQ ID NO: 7948492 - DNA, 22 bp, Homo sapiens
gtcctctgcccaggtcaaggtt

SEQ ID NO: 7948493 - DNA, 22 bp, Homo sapiens
gtcctctgcccaggtcaaggtt

SEQ ID NO: 7948494 - DNA, 22 bp, Homo sapiens
gtcctctgagggggctgcacgc

SEQ ID NO: 7948495 - DNA, 22 bp, Homo sapiens
gtcctctgatttctaggtatat

SEQ ID NO: 7948496 - DNA, 22 bp, Homo sapiens
gtcctctgatttctaggtatat

SEQ ID NO: 7948497 - DNA, 22 bp, Homo sapiens
gtcctctgatttctaggtatat

SEQ ID NO: 7948498 - DNA, 22 bp, Homo sapiens
gtcctcaggcttgagtgtttat

SEQ ID NO: 7948499 - DNA, 22 bp, Homo sapiens
gtcctcaggaaggctttctgac

SEQ ID NO: 7948500 - DNA, 22 bp, Homo sapiens
gtcctcaggaaggctttctgac

SEQ ID NO: 7948501 - DNA, 21 bp, Homo sapiens
gtcctcagctgatgggagctg

SEQ ID NO: 7948502 - DNA, 22 bp, Homo sapiens
gtcctcaggaaagcagataaca

SEQ ID NO: 7948503 - DNA, 21 bp, Homo sapiens
gtcctcagctgatgggagctg

SEQ ID NO: 7948504 - DNA, 21 bp, Homo sapiens
gtcctcagctgatgggagctg

SEQ ID NO: 7948505 - DNA, 22 bp, Homo sapiens
gtcctcaggaaggctttctgac

SEQ ID NO: 7948506 - DNA, 22 bp, Homo sapiens
gtcctcaggaaagcagataaca

SEQ ID NO: 7948507 - DNA, 22 bp, Homo sapiens
gtcctcagggagtcccagtcat

SEQ ID NO: 7948508 - DNA, 22 bp, Homo sapiens
gtcctcagggagtcccagtcat

SEQ ID NO: 7948509 - DNA, 22 bp, Homo sapiens
gtcctcagggagtcccagtcat

SEQ ID NO: 7948510 - DNA, 22 bp, Homo sapiens
gtcctcagtaagagggcctctg

SEQ ID NO: 7948511 - DNA, 22 bp, Homo sapiens
gtcctcagggaatgtggcgggt

SEQ ID NO: 7948512 - DNA, 22 bp, Homo sapiens
gtcctcagggaatgtggcgggt

SEQ ID NO: 7948513 - DNA, 22 bp, Homo sapiens
gtcctcagggaatgtggcgggt

SEQ ID NO: 7948514 - DNA, 22 bp, Homo sapiens
gtcctcagggaatgtggcgggt

SEQ ID NO: 7948515 - DNA, 22 bp, Homo sapiens
gtcctcagagtgggcaggtcct

SEQ ID NO: 7948516 - DNA, 22 bp, Homo sapiens
gtcctcagagtgggcaggtcct

SEQ ID NO: 7948517 - DNA, 22 bp, Homo sapiens
gtcctcagatgctgctgaaatg

SEQ ID NO: 7948518 - DNA, 22 bp, Homo sapiens
gtcctcagatgctgctgaaatg

SEQ ID NO: 7948519 - DNA, 22 bp, Homo sapiens
gtcctcagatgctgctgaaatg

SEQ ID NO: 7948520 - DNA, 22 bp, Homo sapiens
gtcctcagcaccagaactaggg

SEQ ID NO: 7948521 - DNA, 22 bp, Homo sapiens
gtcctcagcaccagaactaggg

SEQ ID NO: 7948522 - DNA, 22 bp, Homo sapiens
gtcctcagcaccagaactaggg

SEQ ID NO: 7948523 - DNA, 21 bp, Homo sapiens
gtcctcagctgatgggagctg

SEQ ID NO: 7948524 - DNA, 21 bp, Homo sapiens
gtcctcacgctccggcctccc

SEQ ID NO: 7948525 - DNA, 22 bp, Homo sapiens
gtcctcacctctagtgcagaca

SEQ ID NO: 7948526 - DNA, 22 bp, Homo sapiens
gtcctcagaagcctgcttagct

SEQ ID NO: 7948527 - DNA, 22 bp, Homo sapiens
gtcctcagaagcctgcttagct

SEQ ID NO: 7948528 - DNA, 22 bp, Homo sapiens
gtcctcagaagcctgcttagct

SEQ ID NO: 7948529 - DNA, 22 bp, Homo sapiens
gtcctcagagtgggcaggtcct

SEQ ID NO: 7948530 - DNA, 22 bp, Homo sapiens
gtcctcagaagcctgcttagct

SEQ ID NO: 7948531 - DNA, 22 bp, Homo sapiens
gtcctcagagtgggcaggtcct

SEQ ID NO: 7948532 - DNA, 22 bp, Homo sapiens
gtccctggagctgagcagtgct

SEQ ID NO: 7948533 - DNA, 22 bp, Homo sapiens
gtccctggagctgagcagtgct

SEQ ID NO: 7948534 - DNA, 22 bp, Homo sapiens
gtccctggagctgagcagtgct

SEQ ID NO: 7948535 - DNA, 22 bp, Homo sapiens
gtcattttatgggaacagattt

SEQ ID NO: 7948536 - DNA, 22 bp, Homo sapiens
gtcattttatgggaacagattt

SEQ ID NO: 7948537 - DNA, 22 bp, Homo sapiens
gtcattttatgggaacagattt

SEQ ID NO: 7948538 - DNA, 22 bp, Homo sapiens
gtccctggatctgggacagctg

SEQ ID NO: 7948539 - DNA, 22 bp, Homo sapiens
gtccctggagctgagcagtgct

SEQ ID NO: 7948540 - DNA, 22 bp, Homo sapiens
gtcattgtaatattctcattta

SEQ ID NO: 7948541 - DNA, 22 bp, Homo sapiens
gtcattgggggccatctcagag

SEQ ID NO: 7948542 - DNA, 22 bp, Homo sapiens
gtcatttaaagaccattgtggg

SEQ ID NO: 7948543 - DNA, 22 bp, Homo sapiens
gtcatttaggtctgtcagaaat

SEQ ID NO: 7948544 - DNA, 22 bp, Homo sapiens
gtcatttaaagaccattgtggg

SEQ ID NO: 7948545 - DNA, 22 bp, Homo sapiens
gtcatttatgaggaagtgggcc

SEQ ID NO: 7948546 - DNA, 22 bp, Homo sapiens
gtcatttatcatcagaagtcat

SEQ ID NO: 7948547 - DNA, 22 bp, Homo sapiens
gtcatttatcatcagaagtcat

SEQ ID NO: 7948548 - DNA, 22 bp, Homo sapiens
gtcattcttaacaactcagtag

SEQ ID NO: 7948549 - DNA, 22 bp, Homo sapiens
gtcattgagtcgtcagagtctt

SEQ ID NO: 7948550 - DNA, 22 bp, Homo sapiens
gtcattctctggtgtggttgtt

SEQ ID NO: 7948551 - DNA, 22 bp, Homo sapiens
gtcattcttaacaactcagtag

SEQ ID NO: 7948552 - DNA, 22 bp, Homo sapiens
gtcattctccaagaacccgctg

SEQ ID NO: 7948553 - DNA, 22 bp, Homo sapiens
gtcattctctggtgtggttgtt

SEQ ID NO: 7948554 - DNA, 22 bp, Homo sapiens
gtcattcctatccatttgatac

SEQ ID NO: 7948555 - DNA, 17 bp, Homo sapiens
gtcattctcagaaaatg

SEQ ID NO: 7948556 - DNA, 22 bp, Homo sapiens
gtcattcagagatgcaggtaga

SEQ ID NO: 7948557 - DNA, 22 bp, Homo sapiens
gtcattcaaactgtatcacttg

SEQ ID NO: 7948558 - DNA, 22 bp, Homo sapiens
gtcattcaaactgtatcacttg

SEQ ID NO: 7948559 - DNA, 22 bp, Homo sapiens
gtcattcaaactgtatcacttg

SEQ ID NO: 7948560 - DNA, 22 bp, Homo sapiens
gtcataaagacagaaacattcc

SEQ ID NO: 7948561 - DNA, 20 bp, Homo sapiens
gtcagtgtcttcagtagtga

SEQ ID NO: 7948562 - DNA, 22 bp, Homo sapiens
gtcagtgtgagataatcttgga

SEQ ID NO: 7948563 - DNA, 22 bp, Homo sapiens
gtcagtgtgagataatcttgga

SEQ ID NO: 7948564 - DNA, 22 bp, Homo sapiens
gtcagtgtgagttgattccata

SEQ ID NO: 7948565 - DNA, 22 bp, Homo sapiens
gtcagtgtttaacaaccagctc

SEQ ID NO: 7948566 - DNA, 22 bp, Homo sapiens
gtcagtgttataagtttagcca

SEQ ID NO: 7948567 - DNA, 22 bp, Homo sapiens
gtcagtgtggttgctggcttgg

SEQ ID NO: 7948568 - DNA, 22 bp, Homo sapiens
gtcagtgttataagtttagcca

SEQ ID NO: 7948569 - DNA, 22 bp, Homo sapiens
gtcagttattttgagcaattgg

SEQ ID NO: 7948570 - DNA, 22 bp, Homo sapiens
gtcagttacagccacggcgggt

SEQ ID NO: 7948571 - DNA, 22 bp, Homo sapiens
gtcagttattcaattggtttaa

SEQ ID NO: 7948572 - DNA, 22 bp, Homo sapiens
gtcataaaaggaccacctattg

SEQ ID NO: 7948573 - DNA, 22 bp, Homo sapiens
gtcaggtcttggaagataggct

SEQ ID NO: 7948574 - DNA, 22 bp, Homo sapiens
gtcagtaggaacctagggtcaa

SEQ ID NO: 7948575 - DNA, 21 bp, Homo sapiens
gtcaggttttgtatcaatatt

SEQ ID NO: 7948576 - DNA, 22 bp, Homo sapiens
gtcagtaaatcttgttatgaag

SEQ ID NO: 7948577 - DNA, 18 bp, Homo sapiens
gtcagtagagcctgtccc

SEQ ID NO: 7948578 - DNA, 22 bp, Homo sapiens
gtcaggggatgtgctggtggcc

SEQ ID NO: 7948579 - DNA, 22 bp, Homo sapiens
gtcaggggatgtgctggtggcc

SEQ ID NO: 7948580 - DNA, 23 bp, Homo sapiens
gtcagggctggggtcagagtgac

SEQ ID NO: 7948581 - DNA, 22 bp, Homo sapiens
gtcagtgtaggttcatcagtgg

SEQ ID NO: 7948582 - DNA, 22 bp, Homo sapiens
gtcagtgtaggttcatcagtgg

SEQ ID NO: 7948583 - DNA, 22 bp, Homo sapiens
gtcagtgtagcaggtgcaagcc

SEQ ID NO: 7948584 - DNA, 23 bp, Homo sapiens
gtcagtgctttagttcaggatgg

SEQ ID NO: 7948585 - DNA, 22 bp, Homo sapiens
gtcagtctgcctgagcttgttt

SEQ ID NO: 7948586 - DNA, 22 bp, Homo sapiens
gtcagtgtcttaacagagatta

SEQ ID NO: 7948587 - DNA, 20 bp, Homo sapiens
gtcagtgtcttcagtagtga

SEQ ID NO: 7948588 - DNA, 22 bp, Homo sapiens
gtcagtgtcttaacagagatta

SEQ ID NO: 7948589 - DNA, 22 bp, Homo sapiens
gtcagtcatattgtacagatat

SEQ ID NO: 7948590 - DNA, 22 bp, Homo sapiens
gtcagtgccaccagccactgcc

SEQ ID NO: 7948591 - DNA, 22 bp, Homo sapiens
gtcagtgcttgaagggcagaga

SEQ ID NO: 7948592 - DNA, 22 bp, Homo sapiens
gtcagtgcttgaagggcagaga

SEQ ID NO: 7948593 - DNA, 22 bp, Homo sapiens
gtcagtgcttgaagggcagaga

SEQ ID NO: 7948594 - DNA, 22 bp, Homo sapiens
gtcagtgccaccagccactgcc

SEQ ID NO: 7948595 - DNA, 21 bp, Homo sapiens
gtcagtgctgaaacaccttcc

SEQ ID NO: 7948596 - DNA, 22 bp, Homo sapiens
gtcaatataggtttcaaacatg

SEQ ID NO: 7948597 - DNA, 22 bp, Homo sapiens
gtcaatatagatcaatgcacag

SEQ ID NO: 7948598 - DNA, 21 bp, Homo sapiens
gtcaatacataggtgaagagg

SEQ ID NO: 7948599 - DNA, 22 bp, Homo sapiens
gtcaataattgatagatattgg

SEQ ID NO: 7948600 - DNA, 22 bp, Homo sapiens
gtcaatatcgccaagtgtctct

SEQ ID NO: 7948601 - DNA, 22 bp, Homo sapiens
gtcaatatcttggttgtactat

SEQ ID NO: 7948602 - DNA, 22 bp, Homo sapiens
gtcaatgaccctatgtggatgg

SEQ ID NO: 7948603 - DNA, 22 bp, Homo sapiens
gtcaatcagaaatcatgttaca

SEQ ID NO: 7948604 - DNA, 22 bp, Homo sapiens
gtcacagtatcatgtttgaatg

SEQ ID NO: 7948605 - DNA, 22 bp, Homo sapiens
gtcacagtatcatgtttgaatg

SEQ ID NO: 7948606 - DNA, 22 bp, Homo sapiens
gtcacagtatcatgtttgaatg

SEQ ID NO: 7948607 - DNA, 22 bp, Homo sapiens
gtcacagtgacagagatgttag

SEQ ID NO: 7948608 - DNA, 22 bp, Homo sapiens
gtcacagtgcctgaagctctga

SEQ ID NO: 7948609 - DNA, 22 bp, Homo sapiens
gtcacagtgcctgccactcaga

SEQ ID NO: 7948610 - DNA, 22 bp, Homo sapiens
gtcacagtgcctgccactcaga

SEQ ID NO: 7948611 - DNA, 22 bp, Homo sapiens
gtcacagtgcctgaagctctga

SEQ ID NO: 7948612 - DNA, 22 bp, Homo sapiens
gtcacagtgctcccaaagtttg

SEQ ID NO: 7948613 - DNA, 22 bp, Homo sapiens
gtcacaaatcccctcagcaact

SEQ ID NO: 7948614 - DNA, 22 bp, Homo sapiens
gtcacaaaggtgagggacatga

SEQ ID NO: 7948615 - DNA, 22 bp, Homo sapiens
gtcacaggtgtggaggtgctgg

SEQ ID NO: 7948616 - DNA, 22 bp, Homo sapiens
gtcacagggtccccatatggag

SEQ ID NO: 7948617 - DNA, 22 bp, Homo sapiens
gtcacagggtccccatatggag

SEQ ID NO: 7948618 - DNA, 22 bp, Homo sapiens
gtcacatgccagtgcacacagg

SEQ ID NO: 7948619 - DNA, 22 bp, Homo sapiens
gtcacatgccagtgcacacagg

SEQ ID NO: 7948620 - DNA, 22 bp, Homo sapiens
gtcacatggaattgactagagt

SEQ ID NO: 7948621 - DNA, 22 bp, Homo sapiens
gtcacatggaattgactagagt

SEQ ID NO: 7948622 - DNA, 22 bp, Homo sapiens
gtcaccagcaccaatgccacat

SEQ ID NO: 7948623 - DNA, 19 bp, Homo sapiens
gtcacatttgtctcccagg

SEQ ID NO: 7948624 - DNA, 22 bp, Homo sapiens
gtcacagtggggtcacagtgtg

SEQ ID NO: 7948625 - DNA, 22 bp, Homo sapiens
gtcacagtggggtcacagtgtg

SEQ ID NO: 7948626 - DNA, 22 bp, Homo sapiens
gtcacagtgctcccaaagtttg

SEQ ID NO: 7948627 - DNA, 22 bp, Homo sapiens
gtcacagtgctcccaaagtttg

SEQ ID NO: 7948628 - DNA, 22 bp, Homo sapiens
gtcacagtgtatctcttcagct

SEQ ID NO: 7948629 - DNA, 23 bp, Homo sapiens
gtcacagtgggtggtgcctacat

SEQ ID NO: 7948630 - DNA, 22 bp, Homo sapiens
gtcacagtgtatctcttcagct

SEQ ID NO: 7948631 - DNA, 22 bp, Homo sapiens
gtcacatgccagtgcacacagg

SEQ ID NO: 7948632 - DNA, 22 bp, Homo sapiens
gtcacagtgtatctcttcagct

SEQ ID NO: 7948633 - DNA, 22 bp, Homo sapiens
gtcagggctccactcaccctcc

SEQ ID NO: 7948634 - DNA, 23 bp, Homo sapiens
gtcagggctggggtcagagtgac

SEQ ID NO: 7948635 - DNA, 22 bp, Homo sapiens
gtcagggctccactcaccctcc

SEQ ID NO: 7948636 - DNA, 21 bp, Homo sapiens
gtcagggattcaagtgctcac

SEQ ID NO: 7948637 - DNA, 22 bp, Homo sapiens
gtcagggatccactgctcttct

SEQ ID NO: 7948638 - DNA, 21 bp, Homo sapiens
gtcagggattcaagtgctcac

SEQ ID NO: 7948639 - DNA, 22 bp, Homo sapiens
gtcagggcacagtgacagctcc

SEQ ID NO: 7948640 - DNA, 22 bp, Homo sapiens
gtcaccagtcccagctcctgaa

SEQ ID NO: 7948641 - DNA, 22 bp, Homo sapiens
gtcaccaggtctgatgcagcca

SEQ ID NO: 7948642 - DNA, 22 bp, Homo sapiens
gtcaccagtgctaagaggtgga

SEQ ID NO: 7948643 - DNA, 22 bp, Homo sapiens
gtcaccaggtctgatgcagcca

SEQ ID NO: 7948644 - DNA, 22 bp, Homo sapiens
gtcaccagcaccaatgccacat

SEQ ID NO: 7948645 - DNA, 22 bp, Homo sapiens
gtaatcatctgcatgacttgat

SEQ ID NO: 7948646 - DNA, 22 bp, Homo sapiens
gtaatccaaagtaacattaaac

SEQ ID NO: 7948647 - DNA, 22 bp, Homo sapiens
gtaatcgtggtggttaattcca

SEQ ID NO: 7948648 - DNA, 22 bp, Homo sapiens
gtaatctcagctacttgggagg

SEQ ID NO: 7948649 - DNA, 22 bp, Homo sapiens
gtaatctcagctacttgggagg

SEQ ID NO: 7948650 - DNA, 22 bp, Homo sapiens
gtaatctcagctacttgggagg

SEQ ID NO: 7948651 - DNA, 22 bp, Homo sapiens
gtaatctcagctacttgggagg

SEQ ID NO: 7948652 - DNA, 22 bp, Homo sapiens
gtaatctcagctacttgggagg

SEQ ID NO: 7948653 - DNA, 22 bp, Homo sapiens
gtaatctcagctacttgggagg

SEQ ID NO: 7948654 - DNA, 22 bp, Homo sapiens
gtaatgaatcaacattaatgat

SEQ ID NO: 7948655 - DNA, 23 bp, Homo sapiens
gtaatgatgggaatttacttaga

SEQ ID NO: 7948656 - DNA, 20 bp, Homo sapiens
gtaatgaatgtaaacagtaa

SEQ ID NO: 7948657 - DNA, 17 bp, Homo sapiens
gtaatataataagcctt

SEQ ID NO: 7948658 - DNA, 22 bp, Homo sapiens
gtaatagaacactcagcatgga

SEQ ID NO: 7948659 - DNA, 22 bp, Homo sapiens
gtaataatttgctacctggtgg

SEQ ID NO: 7948660 - DNA, 22 bp, Homo sapiens
gtaatacaagctccctgggttc

SEQ ID NO: 7948661 - DNA, 22 bp, Homo sapiens
gtaatacaagctccctgggttc

SEQ ID NO: 7948662 - DNA, 22 bp, Homo sapiens
gtaatacctttctaacacttga

SEQ ID NO: 7948663 - DNA, 22 bp, Homo sapiens
gtaacagaaagtcatgctcatt

SEQ ID NO: 7948664 - DNA, 22 bp, Homo sapiens
gtaacacttggctgcaacctgg

SEQ ID NO: 7948665 - DNA, 22 bp, Homo sapiens
gtaacagagggtttgcagatat

SEQ ID NO: 7948666 - DNA, 22 bp, Homo sapiens
gtaacagagaactcaggtgtta

SEQ ID NO: 7948667 - DNA, 22 bp, Homo sapiens
gtaacagaaagtcatgctcatt

SEQ ID NO: 7948668 - DNA, 22 bp, Homo sapiens
gtaacagagaactcaggtgtta

SEQ ID NO: 7948669 - DNA, 22 bp, Homo sapiens
gtaacaggcaatacaactctct

SEQ ID NO: 7948670 - DNA, 19 bp, Homo sapiens
gtaacagtggacattttag

SEQ ID NO: 7948671 - DNA, 22 bp, Homo sapiens
gtaacaaagtttctaggtgctg

SEQ ID NO: 7948672 - DNA, 22 bp, Homo sapiens
gtaacactagctctgtcacttt

SEQ ID NO: 7948673 - DNA, 22 bp, Homo sapiens
gtaacactagctctgtcacttt

SEQ ID NO: 7948674 - DNA, 22 bp, Homo sapiens
gtaacactggcaccgtctcaca

SEQ ID NO: 7948675 - DNA, 17 bp, Homo sapiens
gtaaggcttgcagatgc

SEQ ID NO: 7948676 - DNA, 22 bp, Homo sapiens
gtaacatagtttgtgcttcatc

SEQ ID NO: 7948677 - DNA, 19 bp, Homo sapiens
gtaacagtggacattttag

SEQ ID NO: 7948678 - DNA, 22 bp, Homo sapiens
gtaacagtttgggttccaattg

SEQ ID NO: 7948679 - DNA, 22 bp, Homo sapiens
gtaacagtttgggttccaattg

SEQ ID NO: 7948680 - DNA, 22 bp, Homo sapiens
gtaaggttaccaggttttgaga

SEQ ID NO: 7948681 - DNA, 22 bp, Homo sapiens
gtaagttatattaaaatttcag

SEQ ID NO: 7948682 - DNA, 22 bp, Homo sapiens
gtaagttagttcctgtgttagt

SEQ ID NO: 7948683 - DNA, 22 bp, Homo sapiens
ggtgggcaggcgaggcccaggt

SEQ ID NO: 7948684 - DNA, 22 bp, Homo sapiens
ggtgggcagctcttggcaggca

SEQ ID NO: 7948685 - DNA, 22 bp, Homo sapiens
ggtgggcagctcttggcaggca

SEQ ID NO: 7948686 - DNA, 22 bp, Homo sapiens
gtaaatattccctcggttccta

SEQ ID NO: 7948687 - DNA, 22 bp, Homo sapiens
gtaaatattccctcggttccta

SEQ ID NO: 7948688 - DNA, 22 bp, Homo sapiens
gtaaatattccctcggttccta

SEQ ID NO: 7948689 - DNA, 22 bp, Homo sapiens
gtaaatattccctcggttccta

SEQ ID NO: 7948690 - DNA, 22 bp, Homo sapiens
gtaaatcagtgtcattttagaa

SEQ ID NO: 7948691 - DNA, 22 bp, Homo sapiens
ggtgggcacccgagactggatc

SEQ ID NO: 7948692 - DNA, 22 bp, Homo sapiens
ggtgggcacccgagactggatc

SEQ ID NO: 7948693 - DNA, 22 bp, Homo sapiens
ggtgggcacattcagtctctgt

SEQ ID NO: 7948694 - DNA, 21 bp, Homo sapiens
ggtgggcacaggagagcagag

SEQ ID NO: 7948695 - DNA, 22 bp, Homo sapiens
ggtgggcagctcttggcaggca

SEQ ID NO: 7948696 - DNA, 22 bp, Homo sapiens
ggtgggcagctcttggcaggca

SEQ ID NO: 7948697 - DNA, 22 bp, Homo sapiens
ggtgggcagctcttggcaggca

SEQ ID NO: 7948698 - DNA, 22 bp, Homo sapiens
ggtgggcagctcttggcaggca

SEQ ID NO: 7948699 - DNA, 22 bp, Homo sapiens
ggtgggcagctcttggcaggca

SEQ ID NO: 7948700 - DNA, 22 bp, Homo sapiens
gtaaatgttgcatttatgggta

SEQ ID NO: 7948701 - DNA, 22 bp, Homo sapiens
gtaaatgctagccctttaaagt

SEQ ID NO: 7948702 - DNA, 22 bp, Homo sapiens
gtaaatgcgattgactgatgga

SEQ ID NO: 7948703 - DNA, 22 bp, Homo sapiens
gtaaatgtgaatgtcatttagc

SEQ ID NO: 7948704 - DNA, 22 bp, Homo sapiens
gtaaatgccacttaatgtaaag

SEQ ID NO: 7948705 - DNA, 22 bp, Homo sapiens
gtaaatgagtcaaatgggggaa

SEQ ID NO: 7948706 - DNA, 22 bp, Homo sapiens
gtaaatcatggtcagaataaat

SEQ ID NO: 7948707 - DNA, 22 bp, Homo sapiens
gtaaatcatggtcagaataaat

SEQ ID NO: 7948708 - DNA, 22 bp, Homo sapiens
gtaaatcatggtcagaataaat

SEQ ID NO: 7948709 - DNA, 22 bp, Homo sapiens
gtaaatcatggtcagaataaat

SEQ ID NO: 7948710 - DNA, 22 bp, Homo sapiens
gtaaatcataaaatttgagctc

SEQ ID NO: 7948711 - DNA, 22 bp, Homo sapiens
gtaaatcatggtcagaataaat

SEQ ID NO: 7948712 - DNA, 22 bp, Homo sapiens
gtaaatcatggtcagaataaat

SEQ ID NO: 7948713 - DNA, 22 bp, Homo sapiens
gtaaattatttcaagatcatct

SEQ ID NO: 7948714 - DNA, 22 bp, Homo sapiens
gtaaattatttcaagatcatct

SEQ ID NO: 7948715 - DNA, 22 bp, Homo sapiens
gtaaattatttcaagatcatct

SEQ ID NO: 7948716 - DNA, 22 bp, Homo sapiens
gtaaattatttcaagatcatct

SEQ ID NO: 7948717 - DNA, 22 bp, Homo sapiens
gtaaattatttcaagatcatct

SEQ ID NO: 7948718 - DNA, 22 bp, Homo sapiens
gtaaattatttcaagatcatct

SEQ ID NO: 7948719 - DNA, 22 bp, Homo sapiens
gtaacaaaggataacttggttt

SEQ ID NO: 7948720 - DNA, 22 bp, Homo sapiens
gtaacaaacggttccaagatgc

SEQ ID NO: 7948721 - DNA, 22 bp, Homo sapiens
gtaacaaaggataacttggttt

SEQ ID NO: 7948722 - DNA, 22 bp, Homo sapiens
gtaacaaaggataacttggttt

SEQ ID NO: 7948723 - DNA, 22 bp, Homo sapiens
gtaacaaaggataacttggttt

SEQ ID NO: 7948724 - DNA, 22 bp, Homo sapiens
gtagctgatattagcaatgagt

SEQ ID NO: 7948725 - DNA, 22 bp, Homo sapiens
gtagctctgtttaaagttcttt

SEQ ID NO: 7948726 - DNA, 22 bp, Homo sapiens
gtagctgtctcggtcaggagtt

SEQ ID NO: 7948727 - DNA, 22 bp, Homo sapiens
gtagcttattagggataatagt

SEQ ID NO: 7948728 - DNA, 22 bp, Homo sapiens
gtagctgcatattttcttagaa

SEQ ID NO: 7948729 - DNA, 22 bp, Homo sapiens
gtagctgatcctgaggacaggg

SEQ ID NO: 7948730 - DNA, 22 bp, Homo sapiens
gtaggaagctctgaggctagtt

SEQ ID NO: 7948731 - DNA, 22 bp, Homo sapiens
gtaggaagctctgaggctagtt

SEQ ID NO: 7948732 - DNA, 22 bp, Homo sapiens
gtaggaaagtaaatgaaataca

SEQ ID NO: 7948733 - DNA, 22 bp, Homo sapiens
gtaggaaatcaggggtttaagc

SEQ ID NO: 7948734 - DNA, 22 bp, Homo sapiens
gtcaacaagtagttttcttcca

SEQ ID NO: 7948735 - DNA, 22 bp, Homo sapiens
gtagcttccagaaagtgtcttt

SEQ ID NO: 7948736 - DNA, 22 bp, Homo sapiens
gtaggaaagggagtgaagggaa

SEQ ID NO: 7948737 - DNA, 22 bp, Homo sapiens
gtaggaaagggagtgaagggaa

SEQ ID NO: 7948738 - DNA, 22 bp, Homo sapiens
gtaggaaagggagtgaagggaa

SEQ ID NO: 7948739 - DNA, 22 bp, Homo sapiens
gtaggaaagtaaatgaaataca

SEQ ID NO: 7948740 - DNA, 22 bp, Homo sapiens
gtcaactttaagatgatctttt

SEQ ID NO: 7948741 - DNA, 22 bp, Homo sapiens
gtcaagcagaagataatttaaa

SEQ ID NO: 7948742 - DNA, 22 bp, Homo sapiens
gtcaacagagacagagacactg

SEQ ID NO: 7948743 - DNA, 17 bp, Homo sapiens
gtcaacaggatttcttt

SEQ ID NO: 7948744 - DNA, 17 bp, Homo sapiens
gtcaacaggatttcttt

SEQ ID NO: 7948745 - DNA, 22 bp, Homo sapiens
gtcaagtcatgactcaaaggaa

SEQ ID NO: 7948746 - DNA, 22 bp, Homo sapiens
gtcaagtacaactcagaaaggt

SEQ ID NO: 7948747 - DNA, 22 bp, Homo sapiens
gtcaagtttatccgctcattca

SEQ ID NO: 7948748 - DNA, 22 bp, Homo sapiens
gtcaagttaagataaggtcatg

SEQ ID NO: 7948749 - DNA, 22 bp, Homo sapiens
gtcaagctaagggctttagaaa

SEQ ID NO: 7948750 - DNA, 22 bp, Homo sapiens
gtcaagctaagggctttagaaa

SEQ ID NO: 7948751 - DNA, 22 bp, Homo sapiens
gtcaaggctactgagtgccctg

SEQ ID NO: 7948752 - DNA, 22 bp, Homo sapiens
gtcaaggcatctctagagcaat

SEQ ID NO: 7948753 - DNA, 22 bp, Homo sapiens
gtcaaggcatctctagagcaat

SEQ ID NO: 7948754 - DNA, 22 bp, Homo sapiens
gtcaataattgatagatattgg

SEQ ID NO: 7948755 - DNA, 22 bp, Homo sapiens
gtcaataattgatagatattgg

SEQ ID NO: 7948756 - DNA, 22 bp, Homo sapiens
gtcaataattttatggagagaa

SEQ ID NO: 7948757 - DNA, 22 bp, Homo sapiens
gtcaataattttatggagagaa

SEQ ID NO: 7948758 - DNA, 22 bp, Homo sapiens
gtcaataattttatggagagaa

SEQ ID NO: 7948759 - DNA, 19 bp, Homo sapiens
gtcaataaaagttaggggt

SEQ ID NO: 7948760 - DNA, 22 bp, Homo sapiens
gtcaataagtttgtaactggat

SEQ ID NO: 7948761 - DNA, 22 bp, Homo sapiens
gtcaataattgatagatattgg

SEQ ID NO: 7948762 - DNA, 22 bp, Homo sapiens
gtagcccacctggggagggcga

SEQ ID NO: 7948763 - DNA, 22 bp, Homo sapiens
gtagcccacctggggagggcga

SEQ ID NO: 7948764 - DNA, 22 bp, Homo sapiens
gtagcccacctggggagggcga

SEQ ID NO: 7948765 - DNA, 22 bp, Homo sapiens
gtagcccacctggggagggcga

SEQ ID NO: 7948766 - DNA, 22 bp, Homo sapiens
gtagcccacctggggagggcga

SEQ ID NO: 7948767 - DNA, 22 bp, Homo sapiens
gtagccagatctgctgtgtctg

SEQ ID NO: 7948768 - DNA, 22 bp, Homo sapiens
gtagccagatctgctgtgtctg

SEQ ID NO: 7948769 - DNA, 22 bp, Homo sapiens
gtagcattctgagttcgcagag

SEQ ID NO: 7948770 - DNA, 22 bp, Homo sapiens
gtagcaggtattctggtgtgag

SEQ ID NO: 7948771 - DNA, 22 bp, Homo sapiens
gtagcagcttcagcccaaatta

SEQ ID NO: 7948772 - DNA, 22 bp, Homo sapiens
gtagcagctctccagggttcac

SEQ ID NO: 7948773 - DNA, 22 bp, Homo sapiens
gtagcagcttcagcccaaatta

SEQ ID NO: 7948774 - DNA, 22 bp, Homo sapiens
gtagcagctctgagcatgctgc

SEQ ID NO: 7948775 - DNA, 22 bp, Homo sapiens
gtagcagcttcagcccaaatta

SEQ ID NO: 7948776 - DNA, 22 bp, Homo sapiens
gtagattcttggaattcaagtc

SEQ ID NO: 7948777 - DNA, 21 bp, Homo sapiens
gtagatttggcccaaagccat

SEQ ID NO: 7948778 - DNA, 17 bp, Homo sapiens
gtagcaaaccttttagg

SEQ ID NO: 7948779 - DNA, 17 bp, Homo sapiens
gtagcaaaccttttagg

SEQ ID NO: 7948780 - DNA, 17 bp, Homo sapiens
gtagcaaaccttttagg

SEQ ID NO: 7948781 - DNA, 18 bp, Homo sapiens
gtagcaaaggagttactt

SEQ ID NO: 7948782 - DNA, 18 bp, Homo sapiens
gtagcaaaggagttactt

SEQ ID NO: 7948783 - DNA, 18 bp, Homo sapiens
gtagcaaaggagttactt

SEQ ID NO: 7948784 - DNA, 22 bp, Homo sapiens
gtagcaaagggacggctctaga

SEQ ID NO: 7948785 - DNA, 22 bp, Homo sapiens
gtagcaccgcgagacttggggc

SEQ ID NO: 7948786 - DNA, 22 bp, Homo sapiens
gtagcacccactacttttcgct

SEQ ID NO: 7948787 - DNA, 22 bp, Homo sapiens
gtagcaccagtgctcttctcaa

SEQ ID NO: 7948788 - DNA, 22 bp, Homo sapiens
gtagcaatgttgaacactgcgt

SEQ ID NO: 7948789 - DNA, 22 bp, Homo sapiens
gtagcaaagggacggctctaga

SEQ ID NO: 7948790 - DNA, 22 bp, Homo sapiens
gtagcagctctccagggttcac

SEQ ID NO: 7948791 - DNA, 22 bp, Homo sapiens
gtagcagctctgagcatgctgc

SEQ ID NO: 7948792 - DNA, 22 bp, Homo sapiens
gtagcagctctgagcatgctgc

SEQ ID NO: 7948793 - DNA, 22 bp, Homo sapiens
gtagcagcagagcaggtcctcc

SEQ ID NO: 7948794 - DNA, 22 bp, Homo sapiens
gtagcagagggcccaggtaact

SEQ ID NO: 7948795 - DNA, 22 bp, Homo sapiens
gtagcagaatcagtgctacaga

SEQ ID NO: 7948796 - DNA, 22 bp, Homo sapiens
gtagaggctcagagagccgcag

SEQ ID NO: 7948797 - DNA, 22 bp, Homo sapiens
gtagaggacatttgacatgatg

SEQ ID NO: 7948798 - DNA, 22 bp, Homo sapiens
gtagaggacatttgacatgatg

SEQ ID NO: 7948799 - DNA, 22 bp, Homo sapiens
gtagaggcagaaactgaaggac

SEQ ID NO: 7948800 - DNA, 22 bp, Homo sapiens
gtagaggacatttgacatgatg

SEQ ID NO: 7948801 - DNA, 22 bp, Homo sapiens
gtagagcagggagcaggaagct

SEQ ID NO: 7948802 - DNA, 22 bp, Homo sapiens
gtagagcaggacttgagatgtt

SEQ ID NO: 7948803 - DNA, 22 bp, Homo sapiens
gtaatgatgtctgagaagtatg

SEQ ID NO: 7948804 - DNA, 22 bp, Homo sapiens
gtagagcaggacttgagatgtt

SEQ ID NO: 7948805 - DNA, 22 bp, Homo sapiens
gtagaccatttatctggggagt

SEQ ID NO: 7948806 - DNA, 22 bp, Homo sapiens
gtagaccatttatctggggagt

SEQ ID NO: 7948807 - DNA, 22 bp, Homo sapiens
gtagacagtttgggccgaaatt

SEQ ID NO: 7948808 - DNA, 22 bp, Homo sapiens
gtagacaggttataaatcagtg

SEQ ID NO: 7948809 - DNA, 22 bp, Homo sapiens
gtagacatctagatttatgtgt

SEQ ID NO: 7948810 - DNA, 21 bp, Homo sapiens
gtagataaagcattttcatta

SEQ ID NO: 7948811 - DNA, 22 bp, Homo sapiens
gtagataaggattgatttttat

SEQ ID NO: 7948812 - DNA, 22 bp, Homo sapiens
gtagaggggtgattctgtgaga

SEQ ID NO: 7948813 - DNA, 22 bp, Homo sapiens
gtagaggggtgattctgtgaga

SEQ ID NO: 7948814 - DNA, 22 bp, Homo sapiens
gtagatggaggggctgcagggc

SEQ ID NO: 7948815 - DNA, 22 bp, Homo sapiens
gtagatggaggggctgcagggc

SEQ ID NO: 7948816 - DNA, 22 bp, Homo sapiens
gtagatgtcttcaaactgattt

SEQ ID NO: 7948817 - DNA, 22 bp, Homo sapiens
gtagattccagtggtctgtgtc

SEQ ID NO: 7948818 - DNA, 22 bp, Homo sapiens
gtagatgtttggttattactct

SEQ ID NO: 7948819 - DNA, 22 bp, Homo sapiens
gtagattccagtggtctgtgtc

SEQ ID NO: 7948820 - DNA, 22 bp, Homo sapiens
gtagatgagctcacatgacctt

SEQ ID NO: 7948821 - DNA, 22 bp, Homo sapiens
gtagatgagctcacatgacctt

SEQ ID NO: 7948822 - DNA, 22 bp, Homo sapiens
gtagatcatgagaatgtttttg

SEQ ID NO: 7948823 - DNA, 22 bp, Homo sapiens
gtagatcatgagaatgtttttg

SEQ ID NO: 7948824 - DNA, 22 bp, Homo sapiens
gtagatctcaacactggaagta

SEQ ID NO: 7948825 - DNA, 22 bp, Homo sapiens
ggtagcagggctgtgagtcaga

SEQ ID NO: 7948826 - DNA, 20 bp, Homo sapiens
ggtagcagctgctgtcatcc

SEQ ID NO: 7948827 - DNA, 20 bp, Homo sapiens
ggtagcagctgctgtcatcc

SEQ ID NO: 7948828 - DNA, 22 bp, Homo sapiens
ggtagactgagctccttgagga

SEQ ID NO: 7948829 - DNA, 23 bp, Homo sapiens
ggtagagccgcgccctgggggaa

SEQ ID NO: 7948830 - DNA, 23 bp, Homo sapiens
ggtagagccgcgccctgggggaa

SEQ ID NO: 7948831 - DNA, 22 bp, Homo sapiens
ggtagctgcagcaggctggcaa

SEQ ID NO: 7948832 - DNA, 20 bp, Homo sapiens
ggtagctgctgcagttggta

SEQ ID NO: 7948833 - DNA, 20 bp, Homo sapiens
ggtagctgctgcagttggta

SEQ ID NO: 7948834 - DNA, 20 bp, Homo sapiens
ggtagctgctgcagttggta

SEQ ID NO: 7948835 - DNA, 22 bp, Homo sapiens
ggtagctgcagcaggctggcaa

SEQ ID NO: 7948836 - DNA, 22 bp, Homo sapiens
ggtagccaatgaaatgacagtt

SEQ ID NO: 7948837 - DNA, 22 bp, Homo sapiens
ggtagccaatttaaacatttcc

SEQ ID NO: 7948838 - DNA, 22 bp, Homo sapiens
ggtagccacatggctgaaatcc

SEQ ID NO: 7948839 - DNA, 22 bp, Homo sapiens
ggtagccagcaactagcccagg

SEQ ID NO: 7948840 - DNA, 22 bp, Homo sapiens
ggtagccaaagagcctgggccc

SEQ ID NO: 7948841 - DNA, 22 bp, Homo sapiens
ggtagccaggcatcccagatgc

SEQ ID NO: 7948842 - DNA, 22 bp, Homo sapiens
ggtagccagtccattacatgta

SEQ ID NO: 7948843 - DNA, 22 bp, Homo sapiens
ggtaggagtattttgcagcagt

SEQ ID NO: 7948844 - DNA, 22 bp, Homo sapiens
ggtaggagtattttgcagcagt

SEQ ID NO: 7948845 - DNA, 22 bp, Homo sapiens
ggtaggagtattttgcagcagt

SEQ ID NO: 7948846 - DNA, 22 bp, Homo sapiens
ggtaggagtattttgcagcagt

SEQ ID NO: 7948847 - DNA, 18 bp, Homo sapiens
ggtaggagccaggaatgt

SEQ ID NO: 7948848 - DNA, 21 bp, Homo sapiens
ggtagcttcccttctggaata

SEQ ID NO: 7948849 - DNA, 22 bp, Homo sapiens
ggtaggcagatcactgtctatg

SEQ ID NO: 7948850 - DNA, 22 bp, Homo sapiens
ggtaggcactggtgggaagaga

SEQ ID NO: 7948851 - DNA, 22 bp, Homo sapiens
ggtaggcactggtgggaagaga

SEQ ID NO: 7948852 - DNA, 22 bp, Homo sapiens
ggtaggagtattttgcagcagt

SEQ ID NO: 7948853 - DNA, 22 bp, Homo sapiens
ggtaggagtattttgcagcagt

SEQ ID NO: 7948854 - DNA, 22 bp, Homo sapiens
ggtaggagtgaagacttaagat

SEQ ID NO: 7948855 - DNA, 22 bp, Homo sapiens
ggtaggcaaactacagttagct

SEQ ID NO: 7948856 - DNA, 22 bp, Homo sapiens
ggtcaggagcccttggccccct

SEQ ID NO: 7948857 - DNA, 22 bp, Homo sapiens
ggtcaggaaaagactccccaga

SEQ ID NO: 7948858 - DNA, 19 bp, Homo sapiens
ggtcaggaatttgacaata

SEQ ID NO: 7948859 - DNA, 22 bp, Homo sapiens
ggtcaggatccaagtctgtgct

SEQ ID NO: 7948860 - DNA, 22 bp, Homo sapiens
ggtcagccttggatttggtagc

SEQ ID NO: 7948861 - DNA, 22 bp, Homo sapiens
ggtcagcccctgctcaaggccg

SEQ ID NO: 7948862 - DNA, 20 bp, Homo sapiens
ggtcagcctggggctccagg

SEQ ID NO: 7948863 - DNA, 22 bp, Homo sapiens
ggtcagccttggatttggtagc

SEQ ID NO: 7948864 - DNA, 19 bp, Homo sapiens
ggtcagctgggctagaggc

SEQ ID NO: 7948865 - DNA, 21 bp, Homo sapiens
ggtcagctctatccacgcctt

SEQ ID NO: 7948866 - DNA, 22 bp, Homo sapiens
ggtagggaaggctctgcgggga

SEQ ID NO: 7948867 - DNA, 22 bp, Homo sapiens
ggtagggaaggctctgcgggga

SEQ ID NO: 7948868 - DNA, 21 bp, Homo sapiens
ggtagggaaggttcgctggtg

SEQ ID NO: 7948869 - DNA, 21 bp, Homo sapiens
ggtagggaaggttcgctggtg

SEQ ID NO: 7948870 - DNA, 22 bp, Homo sapiens
ggtcagcagtttctttgaattt

SEQ ID NO: 7948871 - DNA, 22 bp, Homo sapiens
ggtcagcatctggttgagggca

SEQ ID NO: 7948872 - DNA, 20 bp, Homo sapiens
ggtcagccccacctggcagc

SEQ ID NO: 7948873 - DNA, 22 bp, Homo sapiens
ggtcagcccctgctcaaggccg

SEQ ID NO: 7948874 - DNA, 22 bp, Homo sapiens
ggtcagcccctgctcaaggccg

SEQ ID NO: 7948875 - DNA, 18 bp, Homo sapiens
ggtcaggggcggagagaa

SEQ ID NO: 7948876 - DNA, 18 bp, Homo sapiens
ggtcaggggcggagagaa

SEQ ID NO: 7948877 - DNA, 18 bp, Homo sapiens
ggtcaggggcggagagaa

SEQ ID NO: 7948878 - DNA, 22 bp, Homo sapiens
ggtcagggctgggtatgaagag

SEQ ID NO: 7948879 - DNA, 22 bp, Homo sapiens
ggtcagggctcttccagtggct

SEQ ID NO: 7948880 - DNA, 22 bp, Homo sapiens
ggtcagggctcttccagtggct

SEQ ID NO: 7948881 - DNA, 22 bp, Homo sapiens
ggtcaggggctgctctacagag

SEQ ID NO: 7948882 - DNA, 22 bp, Homo sapiens
ggtcaggggctgctctacagag

SEQ ID NO: 7948883 - DNA, 22 bp, Homo sapiens
ggtcagggggatctgtgaggta

SEQ ID NO: 7948884 - DNA, 22 bp, Homo sapiens
ggtcagggggatctgtgaggta

SEQ ID NO: 7948885 - DNA, 22 bp, Homo sapiens
ggtcagggggatctgtgaggta

SEQ ID NO: 7948886 - DNA, 22 bp, Homo sapiens
ggtcagggggatctgtgaggta

SEQ ID NO: 7948887 - DNA, 22 bp, Homo sapiens
ggtcagggggatctgtgaggta

SEQ ID NO: 7948888 - DNA, 22 bp, Homo sapiens
ggtcagggggatctgtgaggta

SEQ ID NO: 7948889 - DNA, 21 bp, Homo sapiens
ggtcagggggtgcctccaggt

SEQ ID NO: 7948890 - DNA, 21 bp, Homo sapiens
ggtcagggggtgcctccaggt

SEQ ID NO: 7948891 - DNA, 22 bp, Homo sapiens
ggtccaggatcaaggcatcacc

SEQ ID NO: 7948892 - DNA, 22 bp, Homo sapiens
ggtccaggatcaaggcatcacc

SEQ ID NO: 7948893 - DNA, 23 bp, Homo sapiens
ggtccaggaaaggcagcagcacc

SEQ ID NO: 7948894 - DNA, 23 bp, Homo sapiens
ggtccaggaaaggcagcagcacc

SEQ ID NO: 7948895 - DNA, 23 bp, Homo sapiens
ggtccaggaaaggcagcagcacc

SEQ ID NO: 7948896 - DNA, 19 bp, Homo sapiens
ggtccagcacagttccagg

SEQ ID NO: 7948897 - DNA, 22 bp, Homo sapiens
ggtccagccaggtgctcatgcc

SEQ ID NO: 7948898 - DNA, 23 bp, Homo sapiens
ggtccaggaaaggcagcagcacc

SEQ ID NO: 7948899 - DNA, 23 bp, Homo sapiens
ggtccaggaaaggcagcagcacc

SEQ ID NO: 7948900 - DNA, 22 bp, Homo sapiens
ggtcagggttccaggtatcttc

SEQ ID NO: 7948901 - DNA, 22 bp, Homo sapiens
ggtccagcacaacactggcatg

SEQ ID NO: 7948902 - DNA, 22 bp, Homo sapiens
ggtccagagtccttgctagaga

SEQ ID NO: 7948903 - DNA, 22 bp, Homo sapiens
ggtccagagctgatggtctttt

SEQ ID NO: 7948904 - DNA, 22 bp, Homo sapiens
ggtccaggtatgtggtgtgaat

SEQ ID NO: 7948905 - DNA, 22 bp, Homo sapiens
ggtccaggtcctgtgacagcag

SEQ ID NO: 7948906 - DNA, 22 bp, Homo sapiens
ggtccaggtatgtggtgtgaat

SEQ ID NO: 7948907 - DNA, 22 bp, Homo sapiens
ggtccaggtttgctctacttgt

SEQ ID NO: 7948908 - DNA, 22 bp, Homo sapiens
ggtccaggtcctgtgacagcag

SEQ ID NO: 7948909 - DNA, 22 bp, Homo sapiens
ggtccagggggtagatatgtga

SEQ ID NO: 7948910 - DNA, 22 bp, Homo sapiens
ggtccagggaactttgaaggat

SEQ ID NO: 7948911 - DNA, 22 bp, Homo sapiens
ggtccaggatcaaggcatcacc

SEQ ID NO: 7948912 - DNA, 22 bp, Homo sapiens
ggtccaggatcaaggcatcacc

SEQ ID NO: 7948913 - DNA, 22 bp, Homo sapiens
ggtccagggaactttgaaggat

SEQ ID NO: 7948914 - DNA, 22 bp, Homo sapiens
ggtaccaccaattcagctgcca

SEQ ID NO: 7948915 - DNA, 22 bp, Homo sapiens
ggtacatcattaattgcatgtt

SEQ ID NO: 7948916 - DNA, 22 bp, Homo sapiens
ggtaccaccaattcagctgcca

SEQ ID NO: 7948917 - DNA, 22 bp, Homo sapiens
ggtaccaccaattcagctgcca

SEQ ID NO: 7948918 - DNA, 22 bp, Homo sapiens
ggtaccaccaattcagctgcca

SEQ ID NO: 7948919 - DNA, 23 bp, Homo sapiens
ggtaccagcacagagtggagagg

SEQ ID NO: 7948920 - DNA, 22 bp, Homo sapiens
ggtaccaccaattcagctgcca

SEQ ID NO: 7948921 - DNA, 19 bp, Homo sapiens
ggtagaagggaagtgtttt

SEQ ID NO: 7948922 - DNA, 22 bp, Homo sapiens
ggtagacaatggaatgtggcct

SEQ ID NO: 7948923 - DNA, 22 bp, Homo sapiens
ggtagacaactttgtaatagcc

SEQ ID NO: 7948924 - DNA, 22 bp, Homo sapiens
ggtaccatgattcccacttttg

SEQ ID NO: 7948925 - DNA, 22 bp, Homo sapiens
ggtaataagatctgttacatgg

SEQ ID NO: 7948926 - DNA, 22 bp, Homo sapiens
ggtacaaagttagatttaactt

SEQ ID NO: 7948927 - DNA, 17 bp, Homo sapiens
ggtacaaacccattttt

SEQ ID NO: 7948928 - DNA, 22 bp, Homo sapiens
ggtaattctagtcattgcatca

SEQ ID NO: 7948929 - DNA, 22 bp, Homo sapiens
ggtaattagattgattaaattg

SEQ ID NO: 7948930 - DNA, 22 bp, Homo sapiens
ggtacagggcttcctggacaag

SEQ ID NO: 7948931 - DNA, 22 bp, Homo sapiens
gggtccagatggtgagagttaa

SEQ ID NO: 7948932 - DNA, 22 bp, Homo sapiens
gggtccagatggtgagagttaa

SEQ ID NO: 7948933 - DNA, 23 bp, Homo sapiens
gggtccagccaattccaaggaaa

SEQ ID NO: 7948934 - DNA, 22 bp, Homo sapiens
gggtccagatggtgagagttaa

SEQ ID NO: 7948935 - DNA, 22 bp, Homo sapiens
gggtccagcgacagcaggctca

SEQ ID NO: 7948936 - DNA, 22 bp, Homo sapiens
ggtaaaatgcagattcttagcc

SEQ ID NO: 7948937 - DNA, 19 bp, Homo sapiens
ggtaaatgatacatgctga

SEQ ID NO: 7948938 - DNA, 19 bp, Homo sapiens
ggtaaatgatacatgctga

SEQ ID NO: 7948939 - DNA, 22 bp, Homo sapiens
gggtccagcgacagcaggctca

SEQ ID NO: 7948940 - DNA, 22 bp, Homo sapiens
ggtaactgaggccatattctga

SEQ ID NO: 7948941 - DNA, 22 bp, Homo sapiens
ggtaacttagctcatggctgtg

SEQ ID NO: 7948942 - DNA, 22 bp, Homo sapiens
ggtaacttagctcatggctgtg

SEQ ID NO: 7948943 - DNA, 22 bp, Homo sapiens
ggtaacttagctcatggctgtg

SEQ ID NO: 7948944 - DNA, 22 bp, Homo sapiens
ggtaacttagctcatggctgtg

SEQ ID NO: 7948945 - DNA, 22 bp, Homo sapiens
ggtaacttagctcatggctgtg

SEQ ID NO: 7948946 - DNA, 22 bp, Homo sapiens
ggtaagattactttcttagcca

SEQ ID NO: 7948947 - DNA, 22 bp, Homo sapiens
ggtaagattcttcaaacaagag

SEQ ID NO: 7948948 - DNA, 22 bp, Homo sapiens
ggtaacagttacagtaacagta

SEQ ID NO: 7948949 - DNA, 22 bp, Homo sapiens
ggtaacagtatgtagagtaaga

SEQ ID NO: 7948950 - DNA, 22 bp, Homo sapiens
gggtccagacactccagaggaa

SEQ ID NO: 7948951 - DNA, 22 bp, Homo sapiens
gggtccagactatgaagaactt

SEQ ID NO: 7948952 - DNA, 22 bp, Homo sapiens
gggtccagaatgagaatgggct

SEQ ID NO: 7948953 - DNA, 22 bp, Homo sapiens
gggtccagacactccagaggaa

SEQ ID NO: 7948954 - DNA, 22 bp, Homo sapiens
gggtccacctgagcagcagcct

SEQ ID NO: 7948955 - DNA, 22 bp, Homo sapiens
gggtccacctgagcagcagcct

SEQ ID NO: 7948956 - DNA, 22 bp, Homo sapiens
gggtcatagttattttgcaaga

SEQ ID NO: 7948957 - DNA, 22 bp, Homo sapiens
gggtcagggctggctgtcgtca

SEQ ID NO: 7948958 - DNA, 22 bp, Homo sapiens
gggtccacctgagcagcagcct

SEQ ID NO: 7948959 - DNA, 22 bp, Homo sapiens
gggtcagggctggctgtcgtca

SEQ ID NO: 7948960 - DNA, 22 bp, Homo sapiens
gggtcagggctggctgtcgtca

SEQ ID NO: 7948961 - DNA, 22 bp, Homo sapiens
gggtcagggctgcctgggctca

SEQ ID NO: 7948962 - DNA, 22 bp, Homo sapiens
gggtccagagcctcagcccaga

SEQ ID NO: 7948963 - DNA, 22 bp, Homo sapiens
gggtccagagttgaagaggtta

SEQ ID NO: 7948964 - DNA, 23 bp, Homo sapiens
gggtccagagaagccattagggc

SEQ ID NO: 7948965 - DNA, 23 bp, Homo sapiens
gggtccagagacaggcatgggtg

SEQ ID NO: 7948966 - DNA, 23 bp, Homo sapiens
gggtccagagacaggcatgggtg

SEQ ID NO: 7948967 - DNA, 22 bp, Homo sapiens
gggtccagagcctcagcccaga

SEQ ID NO: 7948968 - DNA, 22 bp, Homo sapiens
gggtcaggcctcaaggtgggct

SEQ ID NO: 7948969 - DNA, 22 bp, Homo sapiens
gggtcaggcctcaaggtgggct

SEQ ID NO: 7948970 - DNA, 22 bp, Homo sapiens
gggtcaggcctcaaggtgggct

SEQ ID NO: 7948971 - DNA, 22 bp, Homo sapiens
gggtcaggaagaattctgccaa

SEQ ID NO: 7948972 - DNA, 22 bp, Homo sapiens
gggtcaggaagaattctgccaa

SEQ ID NO: 7948973 - DNA, 22 bp, Homo sapiens
gggtcaggcctcaaggtgggct

SEQ ID NO: 7948974 - DNA, 22 bp, Homo sapiens
gggtcaggctagcccagacttc

SEQ ID NO: 7948975 - DNA, 22 bp, Homo sapiens
gggtcaggctagcccagacttc

SEQ ID NO: 7948976 - DNA, 22 bp, Homo sapiens
gggtcaggctagcccagacttc

SEQ ID NO: 7948977 - DNA, 22 bp, Homo sapiens
gggtcaggctagcccagacttc

SEQ ID NO: 7948978 - DNA, 22 bp, Homo sapiens
gggtcaggcctcaaggtgggct

SEQ ID NO: 7948979 - DNA, 22 bp, Homo sapiens
gggtcaggcctcaaggtgggct

SEQ ID NO: 7948980 - DNA, 22 bp, Homo sapiens
gggtcagggctgcctgggctca

SEQ ID NO: 7948981 - DNA, 22 bp, Homo sapiens
gggtcagggctgcctgggctca

SEQ ID NO: 7948982 - DNA, 22 bp, Homo sapiens
gggtcagggctgcctgggctca

SEQ ID NO: 7948983 - DNA, 22 bp, Homo sapiens
gggtcagggctgcctgggctca

SEQ ID NO: 7948984 - DNA, 22 bp, Homo sapiens
gggtcagggaggccccaccatg

SEQ ID NO: 7948985 - DNA, 22 bp, Homo sapiens
gggtcagggaggccccaccatg

SEQ ID NO: 7948986 - DNA, 22 bp, Homo sapiens
gggtcaggctcagcagggcagc

SEQ ID NO: 7948987 - DNA, 22 bp, Homo sapiens
gggtcaggctcagcagggcagc

SEQ ID NO: 7948988 - DNA, 22 bp, Homo sapiens
gggtcaggctcagcagggcagc

SEQ ID NO: 7948989 - DNA, 22 bp, Homo sapiens
gggtcaggctcagcagggcagc

SEQ ID NO: 7948990 - DNA, 22 bp, Homo sapiens
gggtcaggctcagcagggcagc

SEQ ID NO: 7948991 - DNA, 22 bp, Homo sapiens
gggtcaggctcagcagggcagc

SEQ ID NO: 7948992 - DNA, 21 bp, Homo sapiens
ggtgggcacaggagagcagag

SEQ ID NO: 7948993 - DNA, 21 bp, Homo sapiens
ggtgggcacaggagagcagag

SEQ ID NO: 7948994 - DNA, 21 bp, Homo sapiens
ggtgggcacaggagagcagag

SEQ ID NO: 7948995 - DNA, 21 bp, Homo sapiens
ggtgggcacaggagagcagag

SEQ ID NO: 7948996 - DNA, 21 bp, Homo sapiens
ggtgggcacaggagagcagag

SEQ ID NO: 7948997 - DNA, 22 bp, Homo sapiens
ggtgggcaacatttggcctgag

SEQ ID NO: 7948998 - DNA, 22 bp, Homo sapiens
ggtgggcaacatttggcctgag

SEQ ID NO: 7948999 - DNA, 22 bp, Homo sapiens
ggtgggcaacatttggcctgag

SEQ ID NO: 7949000 - DNA, 22 bp, Homo sapiens
ggtgggcaacatttggcctgag

SEQ ID NO: 7949001 - DNA, 22 bp, Homo sapiens
ggtgggcaacatttggcctgag

SEQ ID NO: 7949002 - DNA, 22 bp, Homo sapiens
ggtgggcaacatttggcctgag

SEQ ID NO: 7949003 - DNA, 22 bp, Homo sapiens
ggtgggatgcctctggagaagt

SEQ ID NO: 7949004 - DNA, 22 bp, Homo sapiens
ggtgggatgcctctggagaagt

SEQ ID NO: 7949005 - DNA, 22 bp, Homo sapiens
ggtgggagtgggcacagttacg

SEQ ID NO: 7949006 - DNA, 22 bp, Homo sapiens
ggtgggagtgggcacagttacg

SEQ ID NO: 7949007 - DNA, 16 bp, Homo sapiens
ggtgggaggtgaggtg

SEQ ID NO: 7949008 - DNA, 16 bp, Homo sapiens
ggtgggaggtgaggtg

SEQ ID NO: 7949009 - DNA, 22 bp, Homo sapiens
ggtgggagtggaacgtggaaga

SEQ ID NO: 7949010 - DNA, 16 bp, Homo sapiens
ggtgggaggtgaggtg

SEQ ID NO: 7949011 - DNA, 16 bp, Homo sapiens
ggtgggaggtgaggtg

SEQ ID NO: 7949012 - DNA, 16 bp, Homo sapiens
ggtgggaggtgaggtg

SEQ ID NO: 7949013 - DNA, 22 bp, Homo sapiens
ggtgggagtggaacgtggaaga

SEQ ID NO: 7949014 - DNA, 22 bp, Homo sapiens
ggtgggagtggaacgtggaaga

SEQ ID NO: 7949015 - DNA, 22 bp, Homo sapiens
ggtgggagtggaacgtggaaga

SEQ ID NO: 7949016 - DNA, 22 bp, Homo sapiens
ggtgggagtggaacgtggaaga

SEQ ID NO: 7949017 - DNA, 22 bp, Homo sapiens
ggtgggagtgggcacagttacg

SEQ ID NO: 7949018 - DNA, 22 bp, Homo sapiens
ggtgggagtggaacgtggaaga

SEQ ID NO: 7949019 - DNA, 22 bp, Homo sapiens
ggtgggagccaacacccttctg

SEQ ID NO: 7949020 - DNA, 23 bp, Homo sapiens
ggtgggagattatccagaattat

SEQ ID NO: 7949021 - DNA, 22 bp, Homo sapiens
ggtgggagccaacacccttctg

SEQ ID NO: 7949022 - DNA, 22 bp, Homo sapiens
ggtgggaggcaggctgctccca

SEQ ID NO: 7949023 - DNA, 22 bp, Homo sapiens
ggtgggaggactgtttgaggca

SEQ ID NO: 7949024 - DNA, 22 bp, Homo sapiens
ggtgggaggactgtttgaggca

SEQ ID NO: 7949025 - DNA, 22 bp, Homo sapiens
ggtgggaggcaggctgctccca

SEQ ID NO: 7949026 - DNA, 22 bp, Homo sapiens
ggtgggaggcaggctgctccca

SEQ ID NO: 7949027 - DNA, 22 bp, Homo sapiens
ggtgggaggcaggctgctccca

SEQ ID NO: 7949028 - DNA, 22 bp, Homo sapiens
ggtgggagggctgcgttcctct

SEQ ID NO: 7949029 - DNA, 22 bp, Homo sapiens
ggtgggagggctgcgttcctct

SEQ ID NO: 7949030 - DNA, 22 bp, Homo sapiens
ggtgggagagctctgtctccag

SEQ ID NO: 7949031 - DNA, 22 bp, Homo sapiens
ggtgggagagctctgtctccag

SEQ ID NO: 7949032 - DNA, 22 bp, Homo sapiens
ggtgggagagcttgctttgatg

SEQ ID NO: 7949033 - DNA, 23 bp, Homo sapiens
ggtgggagattatccagaattat

SEQ ID NO: 7949034 - DNA, 23 bp, Homo sapiens
ggtgggagattatccagaattat

SEQ ID NO: 7949035 - DNA, 22 bp, Homo sapiens
ggtggctgcaatggctaacttc

SEQ ID NO: 7949036 - DNA, 22 bp, Homo sapiens
ggtggctgcaatggctaacttc

SEQ ID NO: 7949037 - DNA, 22 bp, Homo sapiens
ggtggctgcaatggctaacttc

SEQ ID NO: 7949038 - DNA, 22 bp, Homo sapiens
ggtggctgaatcaaatcaggcc

SEQ ID NO: 7949039 - DNA, 22 bp, Homo sapiens
ggtggctgaatcaaatcaggcc

SEQ ID NO: 7949040 - DNA, 22 bp, Homo sapiens
ggtggctgcaccctggctaact

SEQ ID NO: 7949041 - DNA, 22 bp, Homo sapiens
ggtggctgcaccctggctaact

SEQ ID NO: 7949042 - DNA, 22 bp, Homo sapiens
ggtgggagagctctgtctccag

SEQ ID NO: 7949043 - DNA, 22 bp, Homo sapiens
ggtggctgcaccctggctaact

SEQ ID NO: 7949044 - DNA, 22 bp, Homo sapiens
ggtgcccacctgtcttcctgga

SEQ ID NO: 7949045 - DNA, 22 bp, Homo sapiens
ggtgccatattatatacagttt

SEQ ID NO: 7949046 - DNA, 22 bp, Homo sapiens
ggtgcccagcaagctttcaatg

SEQ ID NO: 7949047 - DNA, 22 bp, Homo sapiens
ggtgcccagcgaagtggctgtg

SEQ ID NO: 7949048 - DNA, 22 bp, Homo sapiens
ggtgcccagcgaagtggctgtg

SEQ ID NO: 7949049 - DNA, 22 bp, Homo sapiens
ggtgcccgccggcaaccctcgg

SEQ ID NO: 7949050 - DNA, 22 bp, Homo sapiens
ggtgcctgtatttggggcacag

SEQ ID NO: 7949051 - DNA, 22 bp, Homo sapiens
ggtgccgttgaggaagtaactg

SEQ ID NO: 7949052 - DNA, 22 bp, Homo sapiens
ggtgcctgtatttggggcacag

SEQ ID NO: 7949053 - DNA, 22 bp, Homo sapiens
ggtgcctgatggtgatgaggtc

SEQ ID NO: 7949054 - DNA, 22 bp, Homo sapiens
ggtgccctggaagctgctgcat

SEQ ID NO: 7949055 - DNA, 22 bp, Homo sapiens
ggtgccctggaagctgctgcat

SEQ ID NO: 7949056 - DNA, 22 bp, Homo sapiens
ggtgccctgccaggatgtgcca

SEQ ID NO: 7949057 - DNA, 22 bp, Homo sapiens
ggtgccctcggccaccttcctg

SEQ ID NO: 7949058 - DNA, 22 bp, Homo sapiens
ggtgcctaataattctattgca

SEQ ID NO: 7949059 - DNA, 21 bp, Homo sapiens
ggtgcctttgagtcatgtaac

SEQ ID NO: 7949060 - DNA, 22 bp, Homo sapiens
ggtgcctttggcccctggctag

SEQ ID NO: 7949061 - DNA, 22 bp, Homo sapiens
ggtgccttcctgccagccgcaa

SEQ ID NO: 7949062 - DNA, 22 bp, Homo sapiens
ggtgcctgtatttggggcacag

SEQ ID NO: 7949063 - DNA, 22 bp, Homo sapiens
ggtgcggagactccatgaggcc

SEQ ID NO: 7949064 - DNA, 20 bp, Homo sapiens
ggtgcgaggccagagcagac

SEQ ID NO: 7949065 - DNA, 20 bp, Homo sapiens
ggtgcgaggccagagcagac

SEQ ID NO: 7949066 - DNA, 20 bp, Homo sapiens
ggtgcgaggccagagcagac

SEQ ID NO: 7949067 - DNA, 22 bp, Homo sapiens
ggtgccttttccgtgtggccca

SEQ ID NO: 7949068 - DNA, 22 bp, Homo sapiens
ggtgccttttccgtgtggccca

SEQ ID NO: 7949069 - DNA, 22 bp, Homo sapiens
ggtgctcaagagggcatcctct

SEQ ID NO: 7949070 - DNA, 22 bp, Homo sapiens
ggtggctctgttgtcaactgat

SEQ ID NO: 7949071 - DNA, 22 bp, Homo sapiens
ggtggctgaagcagtcttcggg

SEQ ID NO: 7949072 - DNA, 22 bp, Homo sapiens
ggtggctgaagcagtcttcggg

SEQ ID NO: 7949073 - DNA, 22 bp, Homo sapiens
ggtggctgaagcagtcttcggg

SEQ ID NO: 7949074 - DNA, 22 bp, Homo sapiens
ggtggctgaagcagtcttcggg

SEQ ID NO: 7949075 - DNA, 22 bp, Homo sapiens
ggtggctctgttgtcaactgat

SEQ ID NO: 7949076 - DNA, 22 bp, Homo sapiens
ggtggctctgttgtcaactgat

SEQ ID NO: 7949077 - DNA, 22 bp, Homo sapiens
ggtgccagagtggcccaggggc

SEQ ID NO: 7949078 - DNA, 22 bp, Homo sapiens
ggtgccactgcactctggcctg

SEQ ID NO: 7949079 - DNA, 23 bp, Homo sapiens
ggtgccaagcttctatgtttagc

SEQ ID NO: 7949080 - DNA, 22 bp, Homo sapiens
ggtgccacataaatggagagag

SEQ ID NO: 7949081 - DNA, 22 bp, Homo sapiens
ggtgccacagctacatcctaga

SEQ ID NO: 7949082 - DNA, 22 bp, Homo sapiens
ggtgccagcctagtgcagtggt

SEQ ID NO: 7949083 - DNA, 22 bp, Homo sapiens
ggtgccagcctagtgcagtggt

SEQ ID NO: 7949084 - DNA, 22 bp, Homo sapiens
ggtgccagagtggcccaggggc

SEQ ID NO: 7949085 - DNA, 22 bp, Homo sapiens
ggtgccagatgaggcccgcgat

SEQ ID NO: 7949086 - DNA, 22 bp, Homo sapiens
ggtgccagaaaacttgaagagt

SEQ ID NO: 7949087 - DNA, 22 bp, Homo sapiens
ggtgccagtgggtctcaggata

SEQ ID NO: 7949088 - DNA, 22 bp, Homo sapiens
ggtgccaggctgtagtcagggt

SEQ ID NO: 7949089 - DNA, 22 bp, Homo sapiens
ggtgccaggctgtagtcagggt

SEQ ID NO: 7949090 - DNA, 22 bp, Homo sapiens
ggtgccaggctcccagctcagg

SEQ ID NO: 7949091 - DNA, 22 bp, Homo sapiens
ggtgccagcctagtgcagtggt

SEQ ID NO: 7949092 - DNA, 22 bp, Homo sapiens
ggtcccacggtgaattcgtgcc

SEQ ID NO: 7949093 - DNA, 22 bp, Homo sapiens
ggtcccagaattggttagcaca

SEQ ID NO: 7949094 - DNA, 22 bp, Homo sapiens
ggtcccagaattggttagcaca

SEQ ID NO: 7949095 - DNA, 22 bp, Homo sapiens
ggtcccagaattggttagcaca

SEQ ID NO: 7949096 - DNA, 22 bp, Homo sapiens
ggtctggcctcgggcaccccca

SEQ ID NO: 7949097 - DNA, 22 bp, Homo sapiens
ggtctggcctggcattctatgg

SEQ ID NO: 7949098 - DNA, 22 bp, Homo sapiens
ggtctgggcttgagtccttttg

SEQ ID NO: 7949099 - DNA, 22 bp, Homo sapiens
ggtctggcctggcattctatgg

SEQ ID NO: 7949100 - DNA, 22 bp, Homo sapiens
ggtcccaagcaatgcccttggc

SEQ ID NO: 7949101 - DNA, 22 bp, Homo sapiens
ggtccatgataggaagttccga

SEQ ID NO: 7949102 - DNA, 22 bp, Homo sapiens
ggtcccaagcaatgcccttggc

SEQ ID NO: 7949103 - DNA, 22 bp, Homo sapiens
ggtcccaagtgcttttcctgca

SEQ ID NO: 7949104 - DNA, 22 bp, Homo sapiens
ggtcccaagtgcttttcctgca

SEQ ID NO: 7949105 - DNA, 22 bp, Homo sapiens
ggtcccaatctaatcacatgag

SEQ ID NO: 7949106 - DNA, 17 bp, Homo sapiens
ggtctggggccattggc

SEQ ID NO: 7949107 - DNA, 22 bp, Homo sapiens
ggtctggggcaggcatctgaca

SEQ ID NO: 7949108 - DNA, 22 bp, Homo sapiens
ggtctggggcaggcatctgaca

SEQ ID NO: 7949109 - DNA, 22 bp, Homo sapiens
ggtctggggcaggcatctgaca

SEQ ID NO: 7949110 - DNA, 22 bp, Homo sapiens
ggtctgtaggggaaggtctgga

SEQ ID NO: 7949111 - DNA, 17 bp, Homo sapiens
ggtctggggccattggc

SEQ ID NO: 7949112 - DNA, 17 bp, Homo sapiens
ggtctggggccattggc

SEQ ID NO: 7949113 - DNA, 22 bp, Homo sapiens
ggtctgggtttccccaccacac

SEQ ID NO: 7949114 - DNA, 22 bp, Homo sapiens
ggtctgggtttccccaccacac

SEQ ID NO: 7949115 - DNA, 22 bp, Homo sapiens
ggtctgtgtcataggctgagtt

SEQ ID NO: 7949116 - DNA, 22 bp, Homo sapiens
ggtctgtgtcataggctgagtt

SEQ ID NO: 7949117 - DNA, 22 bp, Homo sapiens
ggtctgtgtcataggctgagtt

SEQ ID NO: 7949118 - DNA, 22 bp, Homo sapiens
ggtctgtgctctggagcctctg

SEQ ID NO: 7949119 - DNA, 22 bp, Homo sapiens
ggtctgtgctctggagcctctg

SEQ ID NO: 7949120 - DNA, 22 bp, Homo sapiens
ggtctgtgctctggagcctctg

SEQ ID NO: 7949121 - DNA, 22 bp, Homo sapiens
ggtctgtgatcttatggattct

SEQ ID NO: 7949122 - DNA, 22 bp, Homo sapiens
ggtgaaattccttgtggaaagt

SEQ ID NO: 7949123 - DNA, 22 bp, Homo sapiens
ggtgaacattgatgtggttaca

SEQ ID NO: 7949124 - DNA, 22 bp, Homo sapiens
ggtgaacagttgtttcaaatat

SEQ ID NO: 7949125 - DNA, 22 bp, Homo sapiens
ggtgaagcgtatttgtggagct

SEQ ID NO: 7949126 - DNA, 22 bp, Homo sapiens
ggtcttttcacagtggtttgag

SEQ ID NO: 7949127 - DNA, 21 bp, Homo sapiens
ggtcttgggaggtgccctggg

SEQ ID NO: 7949128 - DNA, 18 bp, Homo sapiens
ggtctttaggtcagtgtc

SEQ ID NO: 7949129 - DNA, 18 bp, Homo sapiens
ggtctttaggtcagtgtc

SEQ ID NO: 7949130 - DNA, 22 bp, Homo sapiens
ggtcttagccaagtttctttat

SEQ ID NO: 7949131 - DNA, 22 bp, Homo sapiens
ggtctgtgtgctttgggaagtg

SEQ ID NO: 7949132 - DNA, 22 bp, Homo sapiens
ggtctgtgtgctttgggaagtg

SEQ ID NO: 7949133 - DNA, 22 bp, Homo sapiens
ggtctgtgtgctttgggaagtg

SEQ ID NO: 7949134 - DNA, 21 bp, Homo sapiens
ggtcttcaaagcttttacgat

SEQ ID NO: 7949135 - DNA, 17 bp, Homo sapiens
ggtctgtgtctagggaa

SEQ ID NO: 7949136 - DNA, 17 bp, Homo sapiens
ggtctgtgtctagggaa

SEQ ID NO: 7949137 - DNA, 22 bp, Homo sapiens
ggtctgtgtgctttgggaagtg

SEQ ID NO: 7949138 - DNA, 17 bp, Homo sapiens
ggtctgtgtctagggaa

SEQ ID NO: 7949139 - DNA, 17 bp, Homo sapiens
ggtctgtgtctagggaa

SEQ ID NO: 7949140 - DNA, 17 bp, Homo sapiens
ggtctgtgtctagggaa

SEQ ID NO: 7949141 - DNA, 22 bp, Homo sapiens
ggtcttccgagaggcctgtgct

SEQ ID NO: 7949142 - DNA, 21 bp, Homo sapiens
ggtcttcccactgtctggtga

SEQ ID NO: 7949143 - DNA, 22 bp, Homo sapiens
ggtcttcaggtctagttggtat

SEQ ID NO: 7949144 - DNA, 21 bp, Homo sapiens
ggtcttccaaataaggagaaa

SEQ ID NO: 7949145 - DNA, 22 bp, Homo sapiens
ggtcttctctatgagctggtct

SEQ ID NO: 7949146 - DNA, 22 bp, Homo sapiens
ggtcttctctatgagctggtct

SEQ ID NO: 7949147 - DNA, 22 bp, Homo sapiens
ggtcttctggaaagcagactgt

SEQ ID NO: 7949148 - DNA, 22 bp, Homo sapiens
ggtcttctggaaagcagactgt

SEQ ID NO: 7949149 - DNA, 22 bp, Homo sapiens
ggtgcatgtgagaaagactggg

SEQ ID NO: 7949150 - DNA, 22 bp, Homo sapiens
ggtgcatgtgagaaagactggg

SEQ ID NO: 7949151 - DNA, 22 bp, Homo sapiens
ggtgcagtggtgtggcaaaggg

SEQ ID NO: 7949152 - DNA, 21 bp, Homo sapiens
ggtgcaggtaatgatgatata

SEQ ID NO: 7949153 - DNA, 20 bp, Homo sapiens
ggtgcaggtaacgctgtgct

SEQ ID NO: 7949154 - DNA, 20 bp, Homo sapiens
ggtgcaggtaacgctgtgct

SEQ ID NO: 7949155 - DNA, 20 bp, Homo sapiens
ggtgcaggtaacgctgtgct

SEQ ID NO: 7949156 - DNA, 20 bp, Homo sapiens
ggtgcaggtaacgctgtgct

SEQ ID NO: 7949157 - DNA, 20 bp, Homo sapiens
ggtgcaggtaacgctgtgct

SEQ ID NO: 7949158 - DNA, 20 bp, Homo sapiens
ggtgcaggtaacgctgtgct

SEQ ID NO: 7949159 - DNA, 20 bp, Homo sapiens
ggtgcaggtaacgctgtgct

SEQ ID NO: 7949160 - DNA, 20 bp, Homo sapiens
ggtgcaggtaacgctgtgct

SEQ ID NO: 7949161 - DNA, 21 bp, Homo sapiens
ggtgcaggtaatgatgatata

SEQ ID NO: 7949162 - DNA, 21 bp, Homo sapiens
ggtgcaggtaatgatgatata

SEQ ID NO: 7949163 - DNA, 22 bp, Homo sapiens
ggtgaataagctgaacacttgg

SEQ ID NO: 7949164 - DNA, 22 bp, Homo sapiens
ggtgcagggagaggcaggcccc

SEQ ID NO: 7949165 - DNA, 22 bp, Homo sapiens
ggtgcagggagaggcaggcccc

SEQ ID NO: 7949166 - DNA, 22 bp, Homo sapiens
ggtgcagggagaggcaggcccc

SEQ ID NO: 7949167 - DNA, 22 bp, Homo sapiens
ggtgaatagggaaaggttactt

SEQ ID NO: 7949168 - DNA, 22 bp, Homo sapiens
ggtgcagggagaggcaggcccc

SEQ ID NO: 7949169 - DNA, 22 bp, Homo sapiens
ggtgcagggagaggcaggcccc

SEQ ID NO: 7949170 - DNA, 22 bp, Homo sapiens
ggtgcagggagaggcaggcccc

SEQ ID NO: 7949171 - DNA, 22 bp, Homo sapiens
ggtgcagggagaggcaggcccc

SEQ ID NO: 7949172 - DNA, 20 bp, Homo sapiens
ggtgcaggtaacgctgtgct

SEQ ID NO: 7949173 - DNA, 22 bp, Homo sapiens
ggtgaaggtcagagcaggaaaa

SEQ ID NO: 7949174 - DNA, 22 bp, Homo sapiens
ggtgaaggtcagagcaggaaaa

SEQ ID NO: 7949175 - DNA, 22 bp, Homo sapiens
ggtgaaggtcagagcaggaaaa

SEQ ID NO: 7949176 - DNA, 22 bp, Homo sapiens
ggtgaagggtgtcatggcattt

SEQ ID NO: 7949177 - DNA, 22 bp, Homo sapiens
ggtgaaggtggaacgcagagca

SEQ ID NO: 7949178 - DNA, 22 bp, Homo sapiens
ggtgaaggtctactgtgtgcca

SEQ ID NO: 7949179 - DNA, 22 bp, Homo sapiens
ggtgaaggtggaacgcagagca

SEQ ID NO: 7949180 - DNA, 22 bp, Homo sapiens
ggtgaagtaataccaggtgtac

SEQ ID NO: 7949181 - DNA, 22 bp, Homo sapiens
ggtgaaggtggaacgcagagca

SEQ ID NO: 7949182 - DNA, 22 bp, Homo sapiens
ggtgaaggtggaacgcagagca

SEQ ID NO: 7949183 - DNA, 22 bp, Homo sapiens
ggtgaaggtctactgtgtgcca

SEQ ID NO: 7949184 - DNA, 22 bp, Homo sapiens
ggtgaaggtctactgtgtgcca

SEQ ID NO: 7949185 - DNA, 22 bp, Homo sapiens
ggtgaagggccttaggagacag

SEQ ID NO: 7949186 - DNA, 22 bp, Homo sapiens
ggtgaagggccttaggagacag

SEQ ID NO: 7949187 - DNA, 22 bp, Homo sapiens
ggtgaagggccttaggagacag

SEQ ID NO: 7949188 - DNA, 22 bp, Homo sapiens
ggtgaagggccttaggagacag

SEQ ID NO: 7949189 - DNA, 22 bp, Homo sapiens
ggtgaagggccttaggagacag

SEQ ID NO: 7949190 - DNA, 22 bp, Homo sapiens
ggtgaaggcacaagagggcaag

SEQ ID NO: 7949191 - DNA, 22 bp, Homo sapiens
ggtgaaggcacaagagggcaag

SEQ ID NO: 7949192 - DNA, 22 bp, Homo sapiens
ggtgaaggcacaagagggcaag

SEQ ID NO: 7949193 - DNA, 22 bp, Homo sapiens
ggtgaagcgtatttgtggagct

SEQ ID NO: 7949194 - DNA, 22 bp, Homo sapiens
ggtgaaggaggaagctgatgga

SEQ ID NO: 7949195 - DNA, 22 bp, Homo sapiens
ggtgaaggcacaagagggcaag

SEQ ID NO: 7949196 - DNA, 22 bp, Homo sapiens
ggtgaaggcacaagagggcaag

SEQ ID NO: 7949197 - DNA, 22 bp, Homo sapiens
ggtgaaggcacaagagggcaag

SEQ ID NO: 7949198 - DNA, 21 bp, Homo sapiens
gggggaagaggagttgctagt

SEQ ID NO: 7949199 - DNA, 22 bp, Homo sapiens
gggggaagaggcatgaagtcct

SEQ ID NO: 7949200 - DNA, 22 bp, Homo sapiens
gggggaagtaattataaaccaa

SEQ ID NO: 7949201 - DNA, 22 bp, Homo sapiens
gggggaagaggcatgaagtcct

SEQ ID NO: 7949202 - DNA, 22 bp, Homo sapiens
gggggagaagattctgctgctt

SEQ ID NO: 7949203 - DNA, 22 bp, Homo sapiens
gggggactggaccgtcctgggt

SEQ ID NO: 7949204 - DNA, 22 bp, Homo sapiens
gggggacaggatgaatatctgt

SEQ ID NO: 7949205 - DNA, 22 bp, Homo sapiens
gggggacaggatgaatatctgt

SEQ ID NO: 7949206 - DNA, 22 bp, Homo sapiens
gggggacaggatgaatatctgt

SEQ ID NO: 7949207 - DNA, 22 bp, Homo sapiens
gggggaagactgggctagtgat

SEQ ID NO: 7949208 - DNA, 22 bp, Homo sapiens
gggggaagactgggctagtgat

SEQ ID NO: 7949209 - DNA, 22 bp, Homo sapiens
gggggaagactgggctagtgat

SEQ ID NO: 7949210 - DNA, 22 bp, Homo sapiens
gggggaagactgggctagtgat

SEQ ID NO: 7949211 - DNA, 22 bp, Homo sapiens
gggggaagactgggctagtgat

SEQ ID NO: 7949212 - DNA, 22 bp, Homo sapiens
gggggaaagtggaggttcgtga

SEQ ID NO: 7949213 - DNA, 22 bp, Homo sapiens
gggggaagaaagaacatggcat

SEQ ID NO: 7949214 - DNA, 22 bp, Homo sapiens
gggggaaatagaaatgcttaga

SEQ ID NO: 7949215 - DNA, 22 bp, Homo sapiens
gggggaagaaagaacatggcat

SEQ ID NO: 7949216 - DNA, 22 bp, Homo sapiens
gggggaagaaagaacatggcat

SEQ ID NO: 7949217 - DNA, 22 bp, Homo sapiens
gggggaagaaagaacatggcat

SEQ ID NO: 7949218 - DNA, 22 bp, Homo sapiens
gggggaagaaagaacatggcat

SEQ ID NO: 7949219 - DNA, 22 bp, Homo sapiens
ggggcaggagcccttcttcagc

SEQ ID NO: 7949220 - DNA, 22 bp, Homo sapiens
ggggcagctcccgagggcagga

SEQ ID NO: 7949221 - DNA, 22 bp, Homo sapiens
ggggcagctcccgagggcagga

SEQ ID NO: 7949222 - DNA, 22 bp, Homo sapiens
ggggcaggagcccttcttcagc

SEQ ID NO: 7949223 - DNA, 22 bp, Homo sapiens
ggggcaggagcccttcttcagc

SEQ ID NO: 7949224 - DNA, 22 bp, Homo sapiens
ggggcaggagcccttcttcagc

SEQ ID NO: 7949225 - DNA, 22 bp, Homo sapiens
ggggcaggagcccttcttcagc

SEQ ID NO: 7949226 - DNA, 22 bp, Homo sapiens
ggggcaggagcccttcttcagc

SEQ ID NO: 7949227 - DNA, 22 bp, Homo sapiens
ggggcaggagcccttcttcagc

SEQ ID NO: 7949228 - DNA, 22 bp, Homo sapiens
gggggaaagctcaggagcctgt

SEQ ID NO: 7949229 - DNA, 22 bp, Homo sapiens
ggggctgttgaagttagttgag

SEQ ID NO: 7949230 - DNA, 22 bp, Homo sapiens
ggggctgttgaagttagttgag

SEQ ID NO: 7949231 - DNA, 22 bp, Homo sapiens
ggggctgtttttggaatggctg

SEQ ID NO: 7949232 - DNA, 22 bp, Homo sapiens
ggggcaggaggtgttctctttt

SEQ ID NO: 7949233 - DNA, 22 bp, Homo sapiens
ggggcaggaggtgttctctttt

SEQ ID NO: 7949234 - DNA, 22 bp, Homo sapiens
ggggcaggaggtgttctctttt

SEQ ID NO: 7949235 - DNA, 22 bp, Homo sapiens
gggggccagtgtctcttccttg

SEQ ID NO: 7949236 - DNA, 23 bp, Homo sapiens
gggggccgtcctggggattatag

SEQ ID NO: 7949237 - DNA, 23 bp, Homo sapiens
gggggccgtcctggggattatag

SEQ ID NO: 7949238 - DNA, 23 bp, Homo sapiens
gggggccgtcctggggattatag

SEQ ID NO: 7949239 - DNA, 23 bp, Homo sapiens
gggggccgtcctggggattatag

SEQ ID NO: 7949240 - DNA, 22 bp, Homo sapiens
gggggccttgttagtggatgga

SEQ ID NO: 7949241 - DNA, 22 bp, Homo sapiens
gggggcgccccatggaggtgag

SEQ ID NO: 7949242 - DNA, 22 bp, Homo sapiens
gggggcgccccatggaggtgag

SEQ ID NO: 7949243 - DNA, 22 bp, Homo sapiens
gggggcggagcacgtgaccacg

SEQ ID NO: 7949244 - DNA, 22 bp, Homo sapiens
gggggcggagcacgtgaccacg

SEQ ID NO: 7949245 - DNA, 22 bp, Homo sapiens
gggggcggagcacgtgaccacg

SEQ ID NO: 7949246 - DNA, 22 bp, Homo sapiens
gggggagctagtccagctgagg

SEQ ID NO: 7949247 - DNA, 22 bp, Homo sapiens
gggggagctagtccagctgagg

SEQ ID NO: 7949248 - DNA, 22 bp, Homo sapiens
gggggagctagtccagctgagg

SEQ ID NO: 7949249 - DNA, 22 bp, Homo sapiens
gggggagctacaggtcccttgg

SEQ ID NO: 7949250 - DNA, 22 bp, Homo sapiens
gggggagctacaggtcccttgg

SEQ ID NO: 7949251 - DNA, 22 bp, Homo sapiens
gggggagagacgagcggctctg

SEQ ID NO: 7949252 - DNA, 22 bp, Homo sapiens
gggggcagtaaggatatggaaa

SEQ ID NO: 7949253 - DNA, 18 bp, Homo sapiens
gggtatccagaactggtc

SEQ ID NO: 7949254 - DNA, 22 bp, Homo sapiens
gggggctaccgtctctggagct

SEQ ID NO: 7949255 - DNA, 22 bp, Homo sapiens
gggtatgagatataggtgaata

SEQ ID NO: 7949256 - DNA, 22 bp, Homo sapiens
gggtatgagatataggtgaata

SEQ ID NO: 7949257 - DNA, 22 bp, Homo sapiens
gggtatgagatataggtgaata

SEQ ID NO: 7949258 - DNA, 22 bp, Homo sapiens
gggtatgatagggaggtgaaat

SEQ ID NO: 7949259 - DNA, 22 bp, Homo sapiens
gggtatgatagggaggtgaaat

SEQ ID NO: 7949260 - DNA, 22 bp, Homo sapiens
gggtattaaaatgaaggagaaa

SEQ ID NO: 7949261 - DNA, 22 bp, Homo sapiens
gggtatgatagggaggtgaaat

SEQ ID NO: 7949262 - DNA, 22 bp, Homo sapiens
gggggcgggagacagcagtgac

SEQ ID NO: 7949263 - DNA, 22 bp, Homo sapiens
gggggcgggagacagcagtgac

SEQ ID NO: 7949264 - DNA, 22 bp, Homo sapiens
gggggcgggagacagcagtgac

SEQ ID NO: 7949265 - DNA, 22 bp, Homo sapiens
gggggcgggagacagcagtgac

SEQ ID NO: 7949266 - DNA, 22 bp, Homo sapiens
gggggcggagcacgtgaccacg

SEQ ID NO: 7949267 - DNA, 22 bp, Homo sapiens
gggggcgggagacagcagtgac

SEQ ID NO: 7949268 - DNA, 22 bp, Homo sapiens
gggtcagagtaagcaaggacaa

SEQ ID NO: 7949269 - DNA, 22 bp, Homo sapiens
gggtcagagttcaggtcgaggg

SEQ ID NO: 7949270 - DNA, 22 bp, Homo sapiens
gggtcagagttcaggtcgaggg

SEQ ID NO: 7949271 - DNA, 22 bp, Homo sapiens
gggtcagagccgtaacaggact

SEQ ID NO: 7949272 - DNA, 22 bp, Homo sapiens
gggtcagagtaagcaaggacaa

SEQ ID NO: 7949273 - DNA, 22 bp, Homo sapiens
gggtcagagcaagactggggtc

SEQ ID NO: 7949274 - DNA, 22 bp, Homo sapiens
gggtcagagccgtaacaggact

SEQ ID NO: 7949275 - DNA, 22 bp, Homo sapiens
gggtcagagccgtaacaggact

SEQ ID NO: 7949276 - DNA, 22 bp, Homo sapiens
gggtcagcgatttcaggggcag

SEQ ID NO: 7949277 - DNA, 22 bp, Homo sapiens
gggtcagctccctccccagggc

SEQ ID NO: 7949278 - DNA, 22 bp, Homo sapiens
gggtcaagccgttgcccaaggc

SEQ ID NO: 7949279 - DNA, 22 bp, Homo sapiens
gggtattaaaatgaaggagaaa

SEQ ID NO: 7949280 - DNA, 22 bp, Homo sapiens
gggtcagagcaagactggggtc

SEQ ID NO: 7949281 - DNA, 22 bp, Homo sapiens
gggtcacttttgctatgttggc

SEQ ID NO: 7949282 - DNA, 22 bp, Homo sapiens
ggggcacctcctcttggcaatt

SEQ ID NO: 7949283 - DNA, 22 bp, Homo sapiens
ggggcacctcctcttggcaatt

SEQ ID NO: 7949284 - DNA, 22 bp, Homo sapiens
ggggcacttggcacctctgcag

SEQ ID NO: 7949285 - DNA, 22 bp, Homo sapiens
ggggcactttactgcctcatct

SEQ ID NO: 7949286 - DNA, 22 bp, Homo sapiens
ggggcacttccaggctgaggct

SEQ ID NO: 7949287 - DNA, 22 bp, Homo sapiens
ggggcacacttttggtagatat

SEQ ID NO: 7949288 - DNA, 22 bp, Homo sapiens
ggggcacacttttggtagatat

SEQ ID NO: 7949289 - DNA, 22 bp, Homo sapiens
ggggcaaagggagagtccctac

SEQ ID NO: 7949290 - DNA, 22 bp, Homo sapiens
ggggatggtgggaaggcaatct

SEQ ID NO: 7949291 - DNA, 22 bp, Homo sapiens
ggggcaaagggagagtccctac

SEQ ID NO: 7949292 - DNA, 22 bp, Homo sapiens
ggggcaaagtggttgctattgg

SEQ ID NO: 7949293 - DNA, 22 bp, Homo sapiens
ggggcagaaagcccacagagtg

SEQ ID NO: 7949294 - DNA, 22 bp, Homo sapiens
ggggcagaaagcccacagagtg

SEQ ID NO: 7949295 - DNA, 22 bp, Homo sapiens
ggggcagaaagcccacagagtg

SEQ ID NO: 7949296 - DNA, 22 bp, Homo sapiens
ggggcagaagtagtgcccctga

SEQ ID NO: 7949297 - DNA, 22 bp, Homo sapiens
ggggcagaagtagtgcccctga

SEQ ID NO: 7949298 - DNA, 22 bp, Homo sapiens
ggggcagctcccgagggcagga

SEQ ID NO: 7949299 - DNA, 22 bp, Homo sapiens
ggggcagctcccgagggcagga

SEQ ID NO: 7949300 - DNA, 22 bp, Homo sapiens
ggggcagctcccgagggcagga

SEQ ID NO: 7949301 - DNA, 22 bp, Homo sapiens
ggggatggaggcgtgtggtcct

SEQ ID NO: 7949302 - DNA, 22 bp, Homo sapiens
ggggatggaggcgtgtggtcct

SEQ ID NO: 7949303 - DNA, 22 bp, Homo sapiens
ggggatggaggcgtgtggtcct

SEQ ID NO: 7949304 - DNA, 22 bp, Homo sapiens
ggggatggaggcgtgtggtcct

SEQ ID NO: 7949305 - DNA, 22 bp, Homo sapiens
ggggatggaggcgtgtggtcct

SEQ ID NO: 7949306 - DNA, 22 bp, Homo sapiens
ggggatggaggcgtgtggtcct

SEQ ID NO: 7949307 - DNA, 22 bp, Homo sapiens
ggggatggaatgtagtagtgat

SEQ ID NO: 7949308 - DNA, 22 bp, Homo sapiens
ggggatggaatgtagtagtgat

SEQ ID NO: 7949309 - DNA, 22 bp, Homo sapiens
ggggatggaatgtagtagtgat

SEQ ID NO: 7949310 - DNA, 22 bp, Homo sapiens
ggggatggaatgtagtagtgat

SEQ ID NO: 7949311 - DNA, 22 bp, Homo sapiens
ggggatggaatgtagtagtgat

SEQ ID NO: 7949312 - DNA, 22 bp, Homo sapiens
ggggatggaatgtagtagtgat

SEQ ID NO: 7949313 - DNA, 16 bp, Homo sapiens
gggctgggggattctg

SEQ ID NO: 7949314 - DNA, 22 bp, Homo sapiens
ggggatggtgggaaggcaatct

SEQ ID NO: 7949315 - DNA, 22 bp, Homo sapiens
ggggatggtgggaaggcaatct

SEQ ID NO: 7949316 - DNA, 22 bp, Homo sapiens
ggggatggtagaccggtgacgt

SEQ ID NO: 7949317 - DNA, 22 bp, Homo sapiens
ggggatggtagaccggtgacgt

SEQ ID NO: 7949318 - DNA, 22 bp, Homo sapiens
ggggatggtagaccggtgacgt

SEQ ID NO: 7949319 - DNA, 22 bp, Homo sapiens
ggggatggtagaccggtgacgt

SEQ ID NO: 7949320 - DNA, 22 bp, Homo sapiens
ggggatggtagaccggtgacgt

SEQ ID NO: 7949321 - DNA, 22 bp, Homo sapiens
ggggatggattccgggtccctg

SEQ ID NO: 7949322 - DNA, 22 bp, Homo sapiens
ggggatggattccgggtccctg

SEQ ID NO: 7949323 - DNA, 22 bp, Homo sapiens
ggggatggattccgggtccctg

SEQ ID NO: 7949324 - DNA, 22 bp, Homo sapiens
gggctgggcatggtgttccctc

SEQ ID NO: 7949325 - DNA, 22 bp, Homo sapiens
gggctggggctcaataatttgt

SEQ ID NO: 7949326 - DNA, 22 bp, Homo sapiens
gggctgggcatggtgttccctc

SEQ ID NO: 7949327 - DNA, 22 bp, Homo sapiens
gggctggggctcaataatttgt

SEQ ID NO: 7949328 - DNA, 22 bp, Homo sapiens
gggctggggctcaataatttgt

SEQ ID NO: 7949329 - DNA, 22 bp, Homo sapiens
gggctggggctcaataatttgt

SEQ ID NO: 7949330 - DNA, 22 bp, Homo sapiens
gggctggggctcaataatttgt

SEQ ID NO: 7949331 - DNA, 22 bp, Homo sapiens
gggctggggctcaataatttgt

SEQ ID NO: 7949332 - DNA, 16 bp, Homo sapiens
gggctgggggattctg

SEQ ID NO: 7949333 - DNA, 22 bp, Homo sapiens
gggctgggattgcttgctgtga

SEQ ID NO: 7949334 - DNA, 22 bp, Homo sapiens
gggctgggattgcttgctgtga

SEQ ID NO: 7949335 - DNA, 22 bp, Homo sapiens
gggctgggattgcttgctgtga

SEQ ID NO: 7949336 - DNA, 22 bp, Homo sapiens
gggctgggattgcttgctgtga

SEQ ID NO: 7949337 - DNA, 22 bp, Homo sapiens
gggctgggattgcttgctgtga

SEQ ID NO: 7949338 - DNA, 22 bp, Homo sapiens
gggctgggattgcttgctgtga

SEQ ID NO: 7949339 - DNA, 22 bp, Homo sapiens
gggctgggcatggtgttccctc

SEQ ID NO: 7949340 - DNA, 22 bp, Homo sapiens
gggctgggcatggtgttccctc

SEQ ID NO: 7949341 - DNA, 22 bp, Homo sapiens
gggctgggcatggtgttccctc

SEQ ID NO: 7949342 - DNA, 22 bp, Homo sapiens
gggctgggcatggtgttccctc

SEQ ID NO: 7949343 - DNA, 22 bp, Homo sapiens
gggctgggattgcttgctgtga

SEQ ID NO: 7949344 - DNA, 22 bp, Homo sapiens
gggctgggattgcttgctgtga

SEQ ID NO: 7949345 - DNA, 22 bp, Homo sapiens
gggctgggcatggtgttccctc

SEQ ID NO: 7949346 - DNA, 22 bp, Homo sapiens
gggctggctgattttcctctct

SEQ ID NO: 7949347 - DNA, 22 bp, Homo sapiens
gggctggctgattttcctctct

SEQ ID NO: 7949348 - DNA, 22 bp, Homo sapiens
gggctggctgattttcctctct

SEQ ID NO: 7949349 - DNA, 22 bp, Homo sapiens
gggctggctctgtctagaaagg

SEQ ID NO: 7949350 - DNA, 22 bp, Homo sapiens
gggctggctgattttcctctct

SEQ ID NO: 7949351 - DNA, 22 bp, Homo sapiens
gggctgggaatggctaagtatg

SEQ ID NO: 7949352 - DNA, 22 bp, Homo sapiens
gggctggctgattttcctctct

SEQ ID NO: 7949353 - DNA, 22 bp, Homo sapiens
gggctgggaatggctaagtatg

SEQ ID NO: 7949354 - DNA, 22 bp, Homo sapiens
gggctgggaatggctaagtatg

SEQ ID NO: 7949355 - DNA, 22 bp, Homo sapiens
gggctgggatggcttgaagatt

SEQ ID NO: 7949356 - DNA, 22 bp, Homo sapiens
gggctgggatggcttgaagatt

SEQ ID NO: 7949357 - DNA, 22 bp, Homo sapiens
gggctgggatggcttgaagatt

SEQ ID NO: 7949358 - DNA, 22 bp, Homo sapiens
gggctgggatggcttgaagatt

SEQ ID NO: 7949359 - DNA, 22 bp, Homo sapiens
gggctgggattgcttgctgtga

SEQ ID NO: 7949360 - DNA, 22 bp, Homo sapiens
gggctgggaatggctaagtatg

SEQ ID NO: 7949361 - DNA, 22 bp, Homo sapiens
gggctgggaatggctaagtatg

SEQ ID NO: 7949362 - DNA, 22 bp, Homo sapiens
gggctgggatggcttgaagatt

SEQ ID NO: 7949363 - DNA, 22 bp, Homo sapiens
gggctgggatggcttgaagatt

SEQ ID NO: 7949364 - DNA, 22 bp, Homo sapiens
gggctgggatggcttgaagatt

SEQ ID NO: 7949365 - DNA, 22 bp, Homo sapiens
gggcctgaaaccttcagggctt

SEQ ID NO: 7949366 - DNA, 22 bp, Homo sapiens
gggcctctccggcctttgcatc

SEQ ID NO: 7949367 - DNA, 22 bp, Homo sapiens
gggcctctgtgcagaggggcct

SEQ ID NO: 7949368 - DNA, 22 bp, Homo sapiens
gggcctccgtgtgctggtgctc

SEQ ID NO: 7949369 - DNA, 22 bp, Homo sapiens
gggcctccgtgtgctggtgctc

SEQ ID NO: 7949370 - DNA, 22 bp, Homo sapiens
gggcctccgtgtgctggtgctc

SEQ ID NO: 7949371 - DNA, 22 bp, Homo sapiens
gggcctccgtgtgctggtgctc

SEQ ID NO: 7949372 - DNA, 22 bp, Homo sapiens
gggcctccgtgtgctggtgctc

SEQ ID NO: 7949373 - DNA, 22 bp, Homo sapiens
gggcctccgtgtgctggtgctc

SEQ ID NO: 7949374 - DNA, 22 bp, Homo sapiens
gggcctccgtgtgctggtgctc

SEQ ID NO: 7949375 - DNA, 22 bp, Homo sapiens
gggcctccggggtgagctgtgg

SEQ ID NO: 7949376 - DNA, 22 bp, Homo sapiens
gggcctccggggtgagctgtgg

SEQ ID NO: 7949377 - DNA, 22 bp, Homo sapiens
gggcctccggggtgagctgtgg

SEQ ID NO: 7949378 - DNA, 22 bp, Homo sapiens
gggcctcagctctgctctgcaa

SEQ ID NO: 7949379 - DNA, 22 bp, Homo sapiens
gggcctcagctgccaacaggat

SEQ ID NO: 7949380 - DNA, 22 bp, Homo sapiens
gggcctcagctgccaacaggat

SEQ ID NO: 7949381 - DNA, 22 bp, Homo sapiens
gggcctcagctggagtctgcct

SEQ ID NO: 7949382 - DNA, 22 bp, Homo sapiens
gggcctcagctctgctctgcaa

SEQ ID NO: 7949383 - DNA, 22 bp, Homo sapiens
gggcatgcctgcgcagtgcatg

SEQ ID NO: 7949384 - DNA, 22 bp, Homo sapiens
gggcctcagctctgctctgcaa

SEQ ID NO: 7949385 - DNA, 22 bp, Homo sapiens
gggcctcagctctgctctgcaa

SEQ ID NO: 7949386 - DNA, 22 bp, Homo sapiens
gggcctcaggccttgctctgtg

SEQ ID NO: 7949387 - DNA, 22 bp, Homo sapiens
gggcctcaggccttgctctgtg

SEQ ID NO: 7949388 - DNA, 22 bp, Homo sapiens
gggcctcaggccttgctctgtg

SEQ ID NO: 7949389 - DNA, 22 bp, Homo sapiens
gggcctcagctggagtctgcct

SEQ ID NO: 7949390 - DNA, 22 bp, Homo sapiens
gggcctcaggccttgctctgtg

SEQ ID NO: 7949391 - DNA, 22 bp, Homo sapiens
gggcctcatgatggctcaggaa

SEQ ID NO: 7949392 - DNA, 22 bp, Homo sapiens
gggcctcatgatggctcaggaa

SEQ ID NO: 7949393 - DNA, 22 bp, Homo sapiens
gggcatgagaggcaggcaagtg

SEQ ID NO: 7949394 - DNA, 22 bp, Homo sapiens
gggcatgacttttggagtggga

SEQ ID NO: 7949395 - DNA, 22 bp, Homo sapiens
gggcatgacttttggagtggga

SEQ ID NO: 7949396 - DNA, 22 bp, Homo sapiens
gggcatgacttttggagtggga

SEQ ID NO: 7949397 - DNA, 22 bp, Homo sapiens
gggcatgacttttggagtggga

SEQ ID NO: 7949398 - DNA, 22 bp, Homo sapiens
gggcatgacttttggagtggga

SEQ ID NO: 7949399 - DNA, 22 bp, Homo sapiens
gggcatgagagggcagctggca

SEQ ID NO: 7949400 - DNA, 22 bp, Homo sapiens
gggcatgagcacatagtgtcta

SEQ ID NO: 7949401 - DNA, 22 bp, Homo sapiens
gggcatgagcgagctgctttga

SEQ ID NO: 7949402 - DNA, 22 bp, Homo sapiens
gggcatgcaggactgtggcaga

SEQ ID NO: 7949403 - DNA, 22 bp, Homo sapiens
gggcagtgttgtggttctctat

SEQ ID NO: 7949404 - DNA, 19 bp, Homo sapiens
gggcatcaaagtgctggtg

SEQ ID NO: 7949405 - DNA, 22 bp, Homo sapiens
gggcagtttattctagatggtt

SEQ ID NO: 7949406 - DNA, 22 bp, Homo sapiens
gggcatctggtggagcctcagg

SEQ ID NO: 7949407 - DNA, 22 bp, Homo sapiens
gggcatctggtggagcctcagg

SEQ ID NO: 7949408 - DNA, 21 bp, Homo sapiens
gggcatcctttcccaccctgc

SEQ ID NO: 7949409 - DNA, 22 bp, Homo sapiens
gggcatccagagggatgcctgg

SEQ ID NO: 7949410 - DNA, 18 bp, Homo sapiens
gggcatcattcacaaagt

SEQ ID NO: 7949411 - DNA, 22 bp, Homo sapiens
gggcctgagactgagggtgagg

SEQ ID NO: 7949412 - DNA, 22 bp, Homo sapiens
gggcctgattagcaggctagct

SEQ ID NO: 7949413 - DNA, 22 bp, Homo sapiens
gggcctgattagcaggctagct

SEQ ID NO: 7949414 - DNA, 22 bp, Homo sapiens
gggcctgcaggttctgagaggc

SEQ ID NO: 7949415 - DNA, 22 bp, Homo sapiens
gggcctgcaggttctgagaggc

SEQ ID NO: 7949416 - DNA, 22 bp, Homo sapiens
gggcctgattagcaggctagct

SEQ ID NO: 7949417 - DNA, 22 bp, Homo sapiens
gggcctgcaggttctgagaggc

SEQ ID NO: 7949418 - DNA, 22 bp, Homo sapiens
gggcctgccaggctttcagcat

SEQ ID NO: 7949419 - DNA, 22 bp, Homo sapiens
gggcctgccaggctttcagcat

SEQ ID NO: 7949420 - DNA, 22 bp, Homo sapiens
gggcctgccaggctttcagcat

SEQ ID NO: 7949421 - DNA, 22 bp, Homo sapiens
gggcctgccattgctgccccag

SEQ ID NO: 7949422 - DNA, 22 bp, Homo sapiens
gggcctgccattgctgccccag

SEQ ID NO: 7949423 - DNA, 22 bp, Homo sapiens
gggcctgctccccatcgctgct

SEQ ID NO: 7949424 - DNA, 22 bp, Homo sapiens
gggcctgctgcaggttcaggat

SEQ ID NO: 7949425 - DNA, 22 bp, Homo sapiens
gggcctgccattgctgccccag

SEQ ID NO: 7949426 - DNA, 22 bp, Homo sapiens
gggcctgctccccatcgctgct

SEQ ID NO: 7949427 - DNA, 22 bp, Homo sapiens
gggcctgccattgctgccccag

SEQ ID NO: 7949428 - DNA, 22 bp, Homo sapiens
gggcctgctggtgcttccattg

SEQ ID NO: 7949429 - DNA, 22 bp, Homo sapiens
gggcctggcatgcagccccgtt

SEQ ID NO: 7949430 - DNA, 22 bp, Homo sapiens
gggcctggcatgcagccccgtt

SEQ ID NO: 7949431 - DNA, 22 bp, Homo sapiens
gggcctggcatgcagccccgtt

SEQ ID NO: 7949432 - DNA, 21 bp, Homo sapiens
gggcctggctgcgcaggacgg

SEQ ID NO: 7949433 - DNA, 21 bp, Homo sapiens
gggcctggctgcgcaggacgg

SEQ ID NO: 7949434 - DNA, 21 bp, Homo sapiens
gggcctggctgcgcaggacgg

SEQ ID NO: 7949435 - DNA, 21 bp, Homo sapiens
gggcctggctgcgcaggacgg

SEQ ID NO: 7949436 - DNA, 22 bp, Homo sapiens
gggcctggcatgcagccccgtt

SEQ ID NO: 7949437 - DNA, 21 bp, Homo sapiens
gggcctggctgcgcaggacgg

SEQ ID NO: 7949438 - DNA, 21 bp, Homo sapiens
gggcctggctgcgcaggacgg

SEQ ID NO: 7949439 - DNA, 21 bp, Homo sapiens
gggcctggctgcgcaggacgg

SEQ ID NO: 7949440 - DNA, 21 bp, Homo sapiens
gggcctggctgcgcaggacgg

SEQ ID NO: 7949441 - DNA, 21 bp, Homo sapiens
gggcctggctgcgcaggacgg

SEQ ID NO: 7949442 - DNA, 21 bp, Homo sapiens
gggcctggctgcgcaggacgg

SEQ ID NO: 7949443 - DNA, 21 bp, Homo sapiens
gggcctggctgcgcaggacgg

SEQ ID NO: 7949444 - DNA, 22 bp, Homo sapiens
gggcctgggaacttgcatttag

SEQ ID NO: 7949445 - DNA, 22 bp, Homo sapiens
gggcctggggacaccaccatga

SEQ ID NO: 7949446 - DNA, 21 bp, Homo sapiens
gggcctggctgcgcaggacgg

SEQ ID NO: 7949447 - DNA, 22 bp, Homo sapiens
gggcctggggacaccaccatga

SEQ ID NO: 7949448 - DNA, 22 bp, Homo sapiens
gggcctggggacaccaccatga

SEQ ID NO: 7949449 - DNA, 22 bp, Homo sapiens
gggcctggggacaccaccatga

SEQ ID NO: 7949450 - DNA, 22 bp, Homo sapiens
gggcctgggaacttgcatttag

SEQ ID NO: 7949451 - DNA, 22 bp, Homo sapiens
gggcctggggtgacgtacccct

SEQ ID NO: 7949452 - DNA, 22 bp, Homo sapiens
gggcctggggtgacgtacccct

SEQ ID NO: 7949453 - DNA, 22 bp, Homo sapiens
gggcctggggacaccaccatga

SEQ ID NO: 7949454 - DNA, 22 bp, Homo sapiens
gggcctggtgcttctgactcct

SEQ ID NO: 7949455 - DNA, 22 bp, Homo sapiens
gggcctggtgcttctgactcct

SEQ ID NO: 7949456 - DNA, 22 bp, Homo sapiens
gggcctggtgcttctgactcct

SEQ ID NO: 7949457 - DNA, 22 bp, Homo sapiens
gggcctggggtgacgtacccct

SEQ ID NO: 7949458 - DNA, 22 bp, Homo sapiens
gggcctggtgcttctgactcct

SEQ ID NO: 7949459 - DNA, 22 bp, Homo sapiens
gggcctggtgcttctgactcct

SEQ ID NO: 7949460 - DNA, 22 bp, Homo sapiens
gggcctggggtgacgtacccct

SEQ ID NO: 7949461 - DNA, 21 bp, Homo sapiens
gggctctcctgaggccatgaa

SEQ ID NO: 7949462 - DNA, 21 bp, Homo sapiens
gggctctcctgaggccatgaa

SEQ ID NO: 7949463 - DNA, 21 bp, Homo sapiens
gggctctcctgaggccatgaa

SEQ ID NO: 7949464 - DNA, 22 bp, Homo sapiens
gggctctcatgagtgtgtggta

SEQ ID NO: 7949465 - DNA, 21 bp, Homo sapiens
gggctctcctgaggccatgaa

SEQ ID NO: 7949466 - DNA, 22 bp, Homo sapiens
gggctctcaaggcagggcccca

SEQ ID NO: 7949467 - DNA, 22 bp, Homo sapiens
gggctctcatgagtgtgtggta

SEQ ID NO: 7949468 - DNA, 22 bp, Homo sapiens
gggctctcatgagtgtgtggta

SEQ ID NO: 7949469 - DNA, 22 bp, Homo sapiens
gggctctaggccaagagtcccg

SEQ ID NO: 7949470 - DNA, 22 bp, Homo sapiens
gggctcctgcctcctggcacct

SEQ ID NO: 7949471 - DNA, 22 bp, Homo sapiens
gggctcctgcctcctggcacct

SEQ ID NO: 7949472 - DNA, 22 bp, Homo sapiens
gggctcctcctctgactgtggc

SEQ ID NO: 7949473 - DNA, 22 bp, Homo sapiens
gggctcctcctctgactgtggc

SEQ ID NO: 7949474 - DNA, 22 bp, Homo sapiens
gggctcctcctctgactgtggc

SEQ ID NO: 7949475 - DNA, 22 bp, Homo sapiens
gggctcctcctctgactgtggc

SEQ ID NO: 7949476 - DNA, 22 bp, Homo sapiens
gggctcggcatctgtggactct

SEQ ID NO: 7949477 - DNA, 19 bp, Homo sapiens
gggctccttgggcctctct

SEQ ID NO: 7949478 - DNA, 19 bp, Homo sapiens
gggctccttgggcctctct

SEQ ID NO: 7949479 - DNA, 22 bp, Homo sapiens
gggctcctggcagtcatgctca

SEQ ID NO: 7949480 - DNA, 19 bp, Homo sapiens
gggctccttgggcctctct

SEQ ID NO: 7949481 - DNA, 19 bp, Homo sapiens
gggctccttgggcctctct

SEQ ID NO: 7949482 - DNA, 22 bp, Homo sapiens
gggctggcgggaaaggcaattc

SEQ ID NO: 7949483 - DNA, 22 bp, Homo sapiens
gggctggcgggaaaggcaattc

SEQ ID NO: 7949484 - DNA, 22 bp, Homo sapiens
gggctggcgggaaaggcaattc

SEQ ID NO: 7949485 - DNA, 22 bp, Homo sapiens
gggctggcgggaaaggcaattc

SEQ ID NO: 7949486 - DNA, 20 bp, Homo sapiens
gggctggcgcatggggaaag

SEQ ID NO: 7949487 - DNA, 20 bp, Homo sapiens
gggctggcgcatggggaaag

SEQ ID NO: 7949488 - DNA, 22 bp, Homo sapiens
gggctctgaatcccaggtctgc

SEQ ID NO: 7949489 - DNA, 22 bp, Homo sapiens
gggctctgaatcccaggtctgc

SEQ ID NO: 7949490 - DNA, 22 bp, Homo sapiens
gggctctgaatcccaggtctgc

SEQ ID NO: 7949491 - DNA, 20 bp, Homo sapiens
gggctggcgcatggggaaag

SEQ ID NO: 7949492 - DNA, 22 bp, Homo sapiens
gggctctgaatcccaggtctgc

SEQ ID NO: 7949493 - DNA, 22 bp, Homo sapiens
gggctctgaatcccaggtctgc

SEQ ID NO: 7949494 - DNA, 22 bp, Homo sapiens
gggctctctttttggcctgccc

SEQ ID NO: 7949495 - DNA, 22 bp, Homo sapiens
gggctctctttttggcctgccc

SEQ ID NO: 7949496 - DNA, 22 bp, Homo sapiens
gggctggctaagacttttctgt

SEQ ID NO: 7949497 - DNA, 22 bp, Homo sapiens
gggctggcgggaaaggcaattc

SEQ ID NO: 7949498 - DNA, 20 bp, Homo sapiens
gggctggctcaactggatcc

SEQ ID NO: 7949499 - DNA, 22 bp, Homo sapiens
gggctggctaagacttttctgt

SEQ ID NO: 7949500 - DNA, 22 bp, Homo sapiens
gggctggctcccaggtgttgaa

SEQ ID NO: 7949501 - DNA, 22 bp, Homo sapiens
gggctggctcccaggtgttgaa

SEQ ID NO: 7949502 - DNA, 22 bp, Homo sapiens
gggctggctcccaggtgttgaa

SEQ ID NO: 7949503 - DNA, 22 bp, Homo sapiens
gggctggctcccaggtgttgaa

SEQ ID NO: 7949504 - DNA, 23 bp, Homo sapiens
gggctccagtctctgctcagttg

SEQ ID NO: 7949505 - DNA, 23 bp, Homo sapiens
gggctccagtctctgctcagttg

SEQ ID NO: 7949506 - DNA, 22 bp, Homo sapiens
gggctccagctgtttgccatga

SEQ ID NO: 7949507 - DNA, 22 bp, Homo sapiens
gggctccaggcaggcaggaaat

SEQ ID NO: 7949508 - DNA, 22 bp, Homo sapiens
gggctccaggcaggcaggaaat

SEQ ID NO: 7949509 - DNA, 17 bp, Homo sapiens
gggctcctcccctgggg

SEQ ID NO: 7949510 - DNA, 22 bp, Homo sapiens
gggctccgcccttggctgagct

SEQ ID NO: 7949511 - DNA, 22 bp, Homo sapiens
gggctcctcctctgactgtggc

SEQ ID NO: 7949512 - DNA, 17 bp, Homo sapiens
gggctcctcccctgggg

SEQ ID NO: 7949513 - DNA, 22 bp, Homo sapiens
gggctccatcacaggctccatc

SEQ ID NO: 7949514 - DNA, 22 bp, Homo sapiens
gggctccatcggacttgggttt

SEQ ID NO: 7949515 - DNA, 22 bp, Homo sapiens
gggctccatcacaggctccatc

SEQ ID NO: 7949516 - DNA, 22 bp, Homo sapiens
gggctccatcacaggctccatc

SEQ ID NO: 7949517 - DNA, 22 bp, Homo sapiens
gggctccagtttggccaggaag

SEQ ID NO: 7949518 - DNA, 22 bp, Homo sapiens
gggctccagtttggccaggaag

SEQ ID NO: 7949519 - DNA, 22 bp, Homo sapiens
gggctccagtttggccaggaag

SEQ ID NO: 7949520 - DNA, 22 bp, Homo sapiens
gggctccacctagggacactgg

SEQ ID NO: 7949521 - DNA, 22 bp, Homo sapiens
gggctccacgcacgcgagaggt

SEQ ID NO: 7949522 - DNA, 22 bp, Homo sapiens
gggctccacctagggacactgg

SEQ ID NO: 7949523 - DNA, 22 bp, Homo sapiens
gggctccacagcagtgagtgga

SEQ ID NO: 7949524 - DNA, 22 bp, Homo sapiens
gggctccacagcagtgagtgga

SEQ ID NO: 7949525 - DNA, 22 bp, Homo sapiens
gggctccacagcagtgagtgga

SEQ ID NO: 7949526 - DNA, 22 bp, Homo sapiens
gggctccagagtccatgttctt

SEQ ID NO: 7949527 - DNA, 22 bp, Homo sapiens
gggctccagagtccatgttctt

SEQ ID NO: 7949528 - DNA, 22 bp, Homo sapiens
gggctccagattgcagcgatca

SEQ ID NO: 7949529 - DNA, 21 bp, Homo sapiens
gggctccagagatgtagcttc

SEQ ID NO: 7949530 - DNA, 22 bp, Homo sapiens
gggctccagcccgggaccaggt

SEQ ID NO: 7949531 - DNA, 22 bp, Homo sapiens
gggctccagcccgggaccaggt

SEQ ID NO: 7949532 - DNA, 22 bp, Homo sapiens
gggctccagcccgggaccaggt

SEQ ID NO: 7949533 - DNA, 22 bp, Homo sapiens
gggctccagccaggtgtcccca

SEQ ID NO: 7949534 - DNA, 22 bp, Homo sapiens
gggctccagccagctccttgtg

SEQ ID NO: 7949535 - DNA, 22 bp, Homo sapiens
gggctccagcagaggcagccgg

SEQ ID NO: 7949536 - DNA, 22 bp, Homo sapiens
gggctccagcagaggcagccgg

SEQ ID NO: 7949537 - DNA, 22 bp, Homo sapiens
gggctccagccactggctgagg

SEQ ID NO: 7949538 - DNA, 22 bp, Homo sapiens
gggctccagccagctccttgtg

SEQ ID NO: 7949539 - DNA, 22 bp, Homo sapiens
gggctccagccagctccttgtg

SEQ ID NO: 7949540 - DNA, 22 bp, Homo sapiens
ggcctcacccatcggtgccttt

SEQ ID NO: 7949541 - DNA, 22 bp, Homo sapiens
ggcctcactgtgcatcccttgg

SEQ ID NO: 7949542 - DNA, 22 bp, Homo sapiens
ggcctagttttttctggtaggt

SEQ ID NO: 7949543 - DNA, 22 bp, Homo sapiens
ggcctatgttcctgggctaggg

SEQ ID NO: 7949544 - DNA, 22 bp, Homo sapiens
ggcctagggcttggtcatggca

SEQ ID NO: 7949545 - DNA, 22 bp, Homo sapiens
ggcctagggcttggtcatggca

SEQ ID NO: 7949546 - DNA, 22 bp, Homo sapiens
ggcctagggcttggtcatggca

SEQ ID NO: 7949547 - DNA, 22 bp, Homo sapiens
ggcctagggcttggtcatggca

SEQ ID NO: 7949548 - DNA, 22 bp, Homo sapiens
ggcctagggcttggtcatggca

SEQ ID NO: 7949549 - DNA, 21 bp, Homo sapiens
ggcctaggggcagatggtgct

SEQ ID NO: 7949550 - DNA, 21 bp, Homo sapiens
ggcctaggggcagatggtgct

SEQ ID NO: 7949551 - DNA, 21 bp, Homo sapiens
ggccctggttacgcctcctct

SEQ ID NO: 7949552 - DNA, 22 bp, Homo sapiens
ggccgtgctccaaagtcatcgt

SEQ ID NO: 7949553 - DNA, 21 bp, Homo sapiens
ggccctggttacgcctcctct

SEQ ID NO: 7949554 - DNA, 22 bp, Homo sapiens
ggcctaggattctgcatttcta

SEQ ID NO: 7949555 - DNA, 22 bp, Homo sapiens
ggcctaggattctgcatttcta

SEQ ID NO: 7949556 - DNA, 22 bp, Homo sapiens
ggcctagggagtggccatgcct

SEQ ID NO: 7949557 - DNA, 22 bp, Homo sapiens
ggcctaggaaggggatgtaact

SEQ ID NO: 7949558 - DNA, 22 bp, Homo sapiens
ggcctagcctctcctgagagag

SEQ ID NO: 7949559 - DNA, 22 bp, Homo sapiens
ggccctgggacacaacaccgaa

SEQ ID NO: 7949560 - DNA, 22 bp, Homo sapiens
ggccctggcagccacgaaagcc

SEQ ID NO: 7949561 - DNA, 22 bp, Homo sapiens
ggccctgggacacaacaccgaa

SEQ ID NO: 7949562 - DNA, 22 bp, Homo sapiens
ggccctgggatgctcagcagtg

SEQ ID NO: 7949563 - DNA, 22 bp, Homo sapiens
ggccctgggatgctcagcagtg

SEQ ID NO: 7949564 - DNA, 22 bp, Homo sapiens
ggccctgggatgctcagcagtg

SEQ ID NO: 7949565 - DNA, 22 bp, Homo sapiens
ggccctgggcagaggagtgggc

SEQ ID NO: 7949566 - DNA, 22 bp, Homo sapiens
ggccctgggcagaggagtgggc

SEQ ID NO: 7949567 - DNA, 22 bp, Homo sapiens
ggccctgggcagaggagtgggc

SEQ ID NO: 7949568 - DNA, 22 bp, Homo sapiens
ggccctgggccctctagcttgt

SEQ ID NO: 7949569 - DNA, 22 bp, Homo sapiens
ggccctggtcctaggggtggaa

SEQ ID NO: 7949570 - DNA, 22 bp, Homo sapiens
ggccctggtcctaggggtggaa

SEQ ID NO: 7949571 - DNA, 22 bp, Homo sapiens
ggccctggtcctaggggtggaa

SEQ ID NO: 7949572 - DNA, 22 bp, Homo sapiens
ggccctggtcctaggggtggaa

SEQ ID NO: 7949573 - DNA, 21 bp, Homo sapiens
ggccctggttacgcctcctct

SEQ ID NO: 7949574 - DNA, 21 bp, Homo sapiens
ggccctggttacgcctcctct

SEQ ID NO: 7949575 - DNA, 22 bp, Homo sapiens
ggccctgggcagaggagtgggc

SEQ ID NO: 7949576 - DNA, 22 bp, Homo sapiens
ggccctgggcagaggagtgggc

SEQ ID NO: 7949577 - DNA, 22 bp, Homo sapiens
ggccctgggccctctagcttgt

SEQ ID NO: 7949578 - DNA, 22 bp, Homo sapiens
ggccctgggccctctagcttgt

SEQ ID NO: 7949579 - DNA, 22 bp, Homo sapiens
ggccctgggccctctagcttgt

SEQ ID NO: 7949580 - DNA, 22 bp, Homo sapiens
ggccctgggccctctagcttgt

SEQ ID NO: 7949581 - DNA, 22 bp, Homo sapiens
ggccaggccaagagggttggaa

SEQ ID NO: 7949582 - DNA, 22 bp, Homo sapiens
ggccaggccaagagggttggaa

SEQ ID NO: 7949583 - DNA, 22 bp, Homo sapiens
ggccaggccaagagggttggaa

SEQ ID NO: 7949584 - DNA, 22 bp, Homo sapiens
ggccaggcgatgacccctccac

SEQ ID NO: 7949585 - DNA, 22 bp, Homo sapiens
ggccaggcactgtgtgagatat

SEQ ID NO: 7949586 - DNA, 22 bp, Homo sapiens
ggccaggcactgtgtgagatat

SEQ ID NO: 7949587 - DNA, 22 bp, Homo sapiens
ggccaggcactgtgtgagatat

SEQ ID NO: 7949588 - DNA, 22 bp, Homo sapiens
ggccaggatctgtttgtccacc

SEQ ID NO: 7949589 - DNA, 22 bp, Homo sapiens
ggccaggcactgtgtgagatat

SEQ ID NO: 7949590 - DNA, 22 bp, Homo sapiens
ggccaggcactgtgtgagatat

SEQ ID NO: 7949591 - DNA, 22 bp, Homo sapiens
ggccaggcactgtgtgagatat

SEQ ID NO: 7949592 - DNA, 22 bp, Homo sapiens
ggccctgctcaggctgcgatga

SEQ ID NO: 7949593 - DNA, 22 bp, Homo sapiens
ggccctgctgaagccgggtcta

SEQ ID NO: 7949594 - DNA, 22 bp, Homo sapiens
ggccaggcgatgacccctccac

SEQ ID NO: 7949595 - DNA, 22 bp, Homo sapiens
ggccaggcgatgacccctccac

SEQ ID NO: 7949596 - DNA, 19 bp, Homo sapiens
ggccaggctgactgtggtc

SEQ ID NO: 7949597 - DNA, 22 bp, Homo sapiens
ggccctgctcaggctgcgatga

SEQ ID NO: 7949598 - DNA, 22 bp, Homo sapiens
ggccctggcagccacgaaagcc

SEQ ID NO: 7949599 - DNA, 22 bp, Homo sapiens
ggccctggcagccacgaaagcc

SEQ ID NO: 7949600 - DNA, 22 bp, Homo sapiens
ggccctgctgagtggagtggag

SEQ ID NO: 7949601 - DNA, 22 bp, Homo sapiens
ggccctgctgagtggagtggag

SEQ ID NO: 7949602 - DNA, 22 bp, Homo sapiens
ggccaggagcaagccaggctct

SEQ ID NO: 7949603 - DNA, 22 bp, Homo sapiens
ggccaggagctgcacagggctc

SEQ ID NO: 7949604 - DNA, 22 bp, Homo sapiens
ggccaggagcagaatcgcctgc

SEQ ID NO: 7949605 - DNA, 22 bp, Homo sapiens
ggccaggagcagaatcgcctgc

SEQ ID NO: 7949606 - DNA, 22 bp, Homo sapiens
ggccaggagcaagccaggctct

SEQ ID NO: 7949607 - DNA, 22 bp, Homo sapiens
ggccaggagctgcacagggctc

SEQ ID NO: 7949608 - DNA, 22 bp, Homo sapiens
ggccaggagctgcacagggctc

SEQ ID NO: 7949609 - DNA, 22 bp, Homo sapiens
ggccaggagctgcacagggctc

SEQ ID NO: 7949610 - DNA, 22 bp, Homo sapiens
ggccaggagctgcacagggctc

SEQ ID NO: 7949611 - DNA, 22 bp, Homo sapiens
ggccaggagctgcacagggctc

SEQ ID NO: 7949612 - DNA, 22 bp, Homo sapiens
ggccaggagctgcacagggctc

SEQ ID NO: 7949613 - DNA, 22 bp, Homo sapiens
ggccaggaggcaggggctcaat

SEQ ID NO: 7949614 - DNA, 22 bp, Homo sapiens
ggccaggaggcaggggctcaat

SEQ ID NO: 7949615 - DNA, 22 bp, Homo sapiens
ggccaggaggcaggggctcaat

SEQ ID NO: 7949616 - DNA, 22 bp, Homo sapiens
ggccaggaggcaggggctcaat

SEQ ID NO: 7949617 - DNA, 22 bp, Homo sapiens
ggccaggaggcaggggctcaat

SEQ ID NO: 7949618 - DNA, 22 bp, Homo sapiens
ggccaggagctgcacagggctc

SEQ ID NO: 7949619 - DNA, 22 bp, Homo sapiens
ggccaggagaggagggcactga

SEQ ID NO: 7949620 - DNA, 22 bp, Homo sapiens
ggccaggagaggagggcactga

SEQ ID NO: 7949621 - DNA, 22 bp, Homo sapiens
ggccaggagaggagggcactga

SEQ ID NO: 7949622 - DNA, 22 bp, Homo sapiens
ggccaggagaggagggcactga

SEQ ID NO: 7949623 - DNA, 22 bp, Homo sapiens
ggccaggaagggaagatcagca

SEQ ID NO: 7949624 - DNA, 22 bp, Homo sapiens
ggccaggagaggagggcactga

SEQ ID NO: 7949625 - DNA, 22 bp, Homo sapiens
ggccaggagcaagccaggctct

SEQ ID NO: 7949626 - DNA, 22 bp, Homo sapiens
ggccaggagcaagccaggctct

SEQ ID NO: 7949627 - DNA, 22 bp, Homo sapiens
ggccaggagcaagccaggctct

SEQ ID NO: 7949628 - DNA, 22 bp, Homo sapiens
ggcctggaagaggacagagaaa

SEQ ID NO: 7949629 - DNA, 22 bp, Homo sapiens
ggcctggaagaggacagagaaa

SEQ ID NO: 7949630 - DNA, 22 bp, Homo sapiens
ggcctggaaggacagcgtgatg

SEQ ID NO: 7949631 - DNA, 22 bp, Homo sapiens
ggcctggaaggacagcgtgatg

SEQ ID NO: 7949632 - DNA, 22 bp, Homo sapiens
ggcctggaaggacagcgtgatg

SEQ ID NO: 7949633 - DNA, 22 bp, Homo sapiens
ggcctggacaaatgcaccaagg

SEQ ID NO: 7949634 - DNA, 22 bp, Homo sapiens
ggcctggacacctgaggtctta

SEQ ID NO: 7949635 - DNA, 22 bp, Homo sapiens
ggcctggacacctgaggtctta

SEQ ID NO: 7949636 - DNA, 22 bp, Homo sapiens
ggcctggaatgctttcctacca

SEQ ID NO: 7949637 - DNA, 22 bp, Homo sapiens
ggcctggaatgctttcctacca

SEQ ID NO: 7949638 - DNA, 22 bp, Homo sapiens
ggcctggacaaatgcaccaagg

SEQ ID NO: 7949639 - DNA, 22 bp, Homo sapiens
ggcctggacaaatgcaccaagg

SEQ ID NO: 7949640 - DNA, 22 bp, Homo sapiens
ggcctgctttccgagcctgcag

SEQ ID NO: 7949641 - DNA, 22 bp, Homo sapiens
ggcctgctttccgagcctgcag

SEQ ID NO: 7949642 - DNA, 22 bp, Homo sapiens
ggcctgctttccgagcctgcag

SEQ ID NO: 7949643 - DNA, 22 bp, Homo sapiens
ggcctgcttctctgggctttct

SEQ ID NO: 7949644 - DNA, 22 bp, Homo sapiens
ggcctgcttctcagtgagcttg

SEQ ID NO: 7949645 - DNA, 22 bp, Homo sapiens
ggcctgctgtgtactgatgtca

SEQ ID NO: 7949646 - DNA, 22 bp, Homo sapiens
ggcctgctgggccccacagtcc

SEQ ID NO: 7949647 - DNA, 22 bp, Homo sapiens
ggcctgctggggcctcagacac

SEQ ID NO: 7949648 - DNA, 22 bp, Homo sapiens
ggcctgctggggcctcagacac

SEQ ID NO: 7949649 - DNA, 22 bp, Homo sapiens
ggcctgctggctccagcgcccg

SEQ ID NO: 7949650 - DNA, 22 bp, Homo sapiens
ggcctgctggctccagcgcccg

SEQ ID NO: 7949651 - DNA, 22 bp, Homo sapiens
ggcctgctggctccagcgcccg

SEQ ID NO: 7949652 - DNA, 22 bp, Homo sapiens
ggcctgctgggccccacagtcc

SEQ ID NO: 7949653 - DNA, 22 bp, Homo sapiens
ggcctgctgggccccacagtcc

SEQ ID NO: 7949654 - DNA, 22 bp, Homo sapiens
ggcctgctgggccccacagtcc

SEQ ID NO: 7949655 - DNA, 22 bp, Homo sapiens
ggcctgctggctccagcgcccg

SEQ ID NO: 7949656 - DNA, 22 bp, Homo sapiens
ggcctgctggctccagcgcccg

SEQ ID NO: 7949657 - DNA, 22 bp, Homo sapiens
ggcctgctcagtcctctttctt

SEQ ID NO: 7949658 - DNA, 22 bp, Homo sapiens
ggcctgctcaaacagattcctg

SEQ ID NO: 7949659 - DNA, 22 bp, Homo sapiens
ggcctgctcaaacagattcctg

SEQ ID NO: 7949660 - DNA, 22 bp, Homo sapiens
ggcctgctccgggggctgagct

SEQ ID NO: 7949661 - DNA, 22 bp, Homo sapiens
ggcctgctccgggggctgagct

SEQ ID NO: 7949662 - DNA, 22 bp, Homo sapiens
ggcctgctccgggggctgagct

SEQ ID NO: 7949663 - DNA, 22 bp, Homo sapiens
ggcctgctccgggggctgagct

SEQ ID NO: 7949664 - DNA, 22 bp, Homo sapiens
ggcctgctattggtgggcagac

SEQ ID NO: 7949665 - DNA, 22 bp, Homo sapiens
ggcctgctattggtgggcagac

SEQ ID NO: 7949666 - DNA, 22 bp, Homo sapiens
ggcctgctattggtgggcagac

SEQ ID NO: 7949667 - DNA, 22 bp, Homo sapiens
ggcctgctattggtgggcagac

SEQ ID NO: 7949668 - DNA, 22 bp, Homo sapiens
ggcctgctaacctgaaacggag

SEQ ID NO: 7949669 - DNA, 22 bp, Homo sapiens
ggcctgctaacctgaaacggag

SEQ ID NO: 7949670 - DNA, 22 bp, Homo sapiens
ggcctcagaaatagagtaaaat

SEQ ID NO: 7949671 - DNA, 22 bp, Homo sapiens
ggcctcagaccggagctggcca

SEQ ID NO: 7949672 - DNA, 22 bp, Homo sapiens
ggcctcagaccggagctggcca

SEQ ID NO: 7949673 - DNA, 19 bp, Homo sapiens
ggcctgcccaatgtctgct

SEQ ID NO: 7949674 - DNA, 19 bp, Homo sapiens
ggcctgcccaatgtctgct

SEQ ID NO: 7949675 - DNA, 22 bp, Homo sapiens
ggcctgcctcacagtcagcacc

SEQ ID NO: 7949676 - DNA, 22 bp, Homo sapiens
ggcctgcctcacagtcagcacc

SEQ ID NO: 7949677 - DNA, 22 bp, Homo sapiens
ggcctgcctcacagtcagcacc

SEQ ID NO: 7949678 - DNA, 22 bp, Homo sapiens
ggcctgctctggctgtggtcag

SEQ ID NO: 7949679 - DNA, 22 bp, Homo sapiens
ggcctgctctggctgtggtcag

SEQ ID NO: 7949680 - DNA, 22 bp, Homo sapiens
ggcctgctctgcagcctctaca

SEQ ID NO: 7949681 - DNA, 22 bp, Homo sapiens
ggcctgctctgcagcctctaca

SEQ ID NO: 7949682 - DNA, 22 bp, Homo sapiens
ggcctgctgcagtgtgacagtt

SEQ ID NO: 7949683 - DNA, 22 bp, Homo sapiens
ggcctgctctgtttagaggggg

SEQ ID NO: 7949684 - DNA, 22 bp, Homo sapiens
ggcctgctgcagtgtgacagtt

SEQ ID NO: 7949685 - DNA, 22 bp, Homo sapiens
ggcctgctgcagtgtgacagtt

SEQ ID NO: 7949686 - DNA, 22 bp, Homo sapiens
ggcctgctctgtttagaggggg

SEQ ID NO: 7949687 - DNA, 22 bp, Homo sapiens
ggcctgctgctatgacttcctg

SEQ ID NO: 7949688 - DNA, 22 bp, Homo sapiens
ggcctgctgctatgacttcctg

SEQ ID NO: 7949689 - DNA, 22 bp, Homo sapiens
ggcctgctgcagtgtgacagtt

SEQ ID NO: 7949690 - DNA, 22 bp, Homo sapiens
ggcctggagaaggcccagggag

SEQ ID NO: 7949691 - DNA, 22 bp, Homo sapiens
ggcctggagaaggcccagggag

SEQ ID NO: 7949692 - DNA, 22 bp, Homo sapiens
ggcctggagcagagactaggga

SEQ ID NO: 7949693 - DNA, 22 bp, Homo sapiens
ggcctggagcagagactaggga

SEQ ID NO: 7949694 - DNA, 22 bp, Homo sapiens
ggcctggagtcagggaaagcaa

SEQ ID NO: 7949695 - DNA, 22 bp, Homo sapiens
ggcctggagtcagggaaagcaa

SEQ ID NO: 7949696 - DNA, 22 bp, Homo sapiens
ggcctggagtcagggaaagcaa

SEQ ID NO: 7949697 - DNA, 22 bp, Homo sapiens
ggcctggagtttggggaataga

SEQ ID NO: 7949698 - DNA, 19 bp, Homo sapiens
ggcctggatttagggctcc

SEQ ID NO: 7949699 - DNA, 22 bp, Homo sapiens
ggcctggagtttggggaataga

SEQ ID NO: 7949700 - DNA, 19 bp, Homo sapiens
ggcctggatttagggctcc

SEQ ID NO: 7949701 - DNA, 22 bp, Homo sapiens
ggcctggccctcccgggttcaa

SEQ ID NO: 7949702 - DNA, 22 bp, Homo sapiens
ggcctggcctccagatgtgggc

SEQ ID NO: 7949703 - DNA, 22 bp, Homo sapiens
ggcctggcctccagatgtgggc

SEQ ID NO: 7949704 - DNA, 22 bp, Homo sapiens
ggcctggcctccagatgtgggc

SEQ ID NO: 7949705 - DNA, 23 bp, Homo sapiens
ggcctggcccagggccctgatga

SEQ ID NO: 7949706 - DNA, 23 bp, Homo sapiens
ggcctggcccagggccctgatga

SEQ ID NO: 7949707 - DNA, 22 bp, Homo sapiens
ggcctggcatggggactaaggg

SEQ ID NO: 7949708 - DNA, 19 bp, Homo sapiens
ggcctggatttagggctcc

SEQ ID NO: 7949709 - DNA, 22 bp, Homo sapiens
ggcctggcagagcgcgcggctg

SEQ ID NO: 7949710 - DNA, 22 bp, Homo sapiens
ggcctggcagagcgcgcggctg

SEQ ID NO: 7949711 - DNA, 22 bp, Homo sapiens
ggcctggcatggggactaaggg

SEQ ID NO: 7949712 - DNA, 19 bp, Homo sapiens
ggcctggctatccctgctg

SEQ ID NO: 7949713 - DNA, 22 bp, Homo sapiens
ggcctggcctcccttcctagcg

SEQ ID NO: 7949714 - DNA, 22 bp, Homo sapiens
ggcctggcctcccttcctagcg

SEQ ID NO: 7949715 - DNA, 22 bp, Homo sapiens
ggcctggcctcccttcctagcg

SEQ ID NO: 7949716 - DNA, 19 bp, Homo sapiens
ggcctggctatccctgctg

SEQ ID NO: 7949717 - DNA, 19 bp, Homo sapiens
ggcctggctatccctgctg

SEQ ID NO: 7949718 - DNA, 19 bp, Homo sapiens
ggcctggctatccctgctg

SEQ ID NO: 7949719 - DNA, 19 bp, Homo sapiens
ggcctggctatccctgctg

SEQ ID NO: 7949720 - DNA, 22 bp, Homo sapiens
ggcctggctcttgcccagcctg

SEQ ID NO: 7949721 - DNA, 22 bp, Homo sapiens
ggcgggggtccaggagcctgca

SEQ ID NO: 7949722 - DNA, 22 bp, Homo sapiens
ggcgggtgataggatgagcagg

SEQ ID NO: 7949723 - DNA, 22 bp, Homo sapiens
ggcctggctcttgcccagcctg

SEQ ID NO: 7949724 - DNA, 22 bp, Homo sapiens
ggcctggctcttgcccagcctg

SEQ ID NO: 7949725 - DNA, 22 bp, Homo sapiens
ggcctggctcttgcccagcctg

SEQ ID NO: 7949726 - DNA, 22 bp, Homo sapiens
ggcctggctggttcagtaccct

SEQ ID NO: 7949727 - DNA, 22 bp, Homo sapiens
ggcggtggcgtgaaggtggctg

SEQ ID NO: 7949728 - DNA, 22 bp, Homo sapiens
ggcggtggcgtgaaggtggctg

SEQ ID NO: 7949729 - DNA, 22 bp, Homo sapiens
ggcggtggcgtgaaggtggctg

SEQ ID NO: 7949730 - DNA, 22 bp, Homo sapiens
ggcggtggcgtgaaggtggctg

SEQ ID NO: 7949731 - DNA, 22 bp, Homo sapiens
ggcggtctcagcaccctcttgg

SEQ ID NO: 7949732 - DNA, 18 bp, Homo sapiens
ggcgggtgttttattcac

SEQ ID NO: 7949733 - DNA, 18 bp, Homo sapiens
ggcgggtgttttattcac

SEQ ID NO: 7949734 - DNA, 22 bp, Homo sapiens
ggcgggtgtaagtaggacagcg

SEQ ID NO: 7949735 - DNA, 18 bp, Homo sapiens
ggcgggtgttttattcac

SEQ ID NO: 7949736 - DNA, 18 bp, Homo sapiens
ggcgggtgttttattcac

SEQ ID NO: 7949737 - DNA, 19 bp, Homo sapiens
ggcgggtggactggagccc

SEQ ID NO: 7949738 - DNA, 19 bp, Homo sapiens
ggcgggtggactggagccc

SEQ ID NO: 7949739 - DNA, 22 bp, Homo sapiens
ggcgggtgtaagtaggacagcg

SEQ ID NO: 7949740 - DNA, 22 bp, Homo sapiens
ggcgggtgtaagtaggacagcg

SEQ ID NO: 7949741 - DNA, 22 bp, Homo sapiens
ggcgggtgtaagtaggacagcg

SEQ ID NO: 7949742 - DNA, 22 bp, Homo sapiens
ggcgggtggcgaggcttctcgg

SEQ ID NO: 7949743 - DNA, 22 bp, Homo sapiens
ggcgggtgtaagtaggacagcg

SEQ ID NO: 7949744 - DNA, 22 bp, Homo sapiens
ggcagtggtgggaggctcgctc

SEQ ID NO: 7949745 - DNA, 22 bp, Homo sapiens
ggcatcagggtaggaaggtatc

SEQ ID NO: 7949746 - DNA, 22 bp, Homo sapiens
ggcatccaaataccaagatgta

SEQ ID NO: 7949747 - DNA, 22 bp, Homo sapiens
ggcatcagtatggccatagggt

SEQ ID NO: 7949748 - DNA, 22 bp, Homo sapiens
ggcatccaaataccaagatgta

SEQ ID NO: 7949749 - DNA, 19 bp, Homo sapiens
ggcatccacgaatgcagag

SEQ ID NO: 7949750 - DNA, 22 bp, Homo sapiens
ggcatccaaataccaagatgta

SEQ ID NO: 7949751 - DNA, 22 bp, Homo sapiens
ggcatccaaataccaagatgta

SEQ ID NO: 7949752 - DNA, 22 bp, Homo sapiens
ggcatctcgcattcttgtttct

SEQ ID NO: 7949753 - DNA, 22 bp, Homo sapiens
ggcatcgtcctgggcataggga

SEQ ID NO: 7949754 - DNA, 22 bp, Homo sapiens
ggcatccagttctgatcaacaa

SEQ ID NO: 7949755 - DNA, 21 bp, Homo sapiens
ggcatcggcgcagtgatagag

SEQ ID NO: 7949756 - DNA, 22 bp, Homo sapiens
ggcatcggaggctgaagtttcc

SEQ ID NO: 7949757 - DNA, 22 bp, Homo sapiens
ggcatcggttgcttttcatatc

SEQ ID NO: 7949758 - DNA, 22 bp, Homo sapiens
ggcatcgtcctgggcataggga

SEQ ID NO: 7949759 - DNA, 22 bp, Homo sapiens
ggcatcctccatataggtgaat

SEQ ID NO: 7949760 - DNA, 22 bp, Homo sapiens
ggcatccgcctggagggtgcta

SEQ ID NO: 7949761 - DNA, 22 bp, Homo sapiens
ggcatcctccatataggtgaat

SEQ ID NO: 7949762 - DNA, 22 bp, Homo sapiens
ggcatccagttctgatcaacaa

SEQ ID NO: 7949763 - DNA, 21 bp, Homo sapiens
ggcatgagggcagtgagcaga

SEQ ID NO: 7949764 - DNA, 21 bp, Homo sapiens
ggcatgagggcagtgagcaga

SEQ ID NO: 7949765 - DNA, 21 bp, Homo sapiens
ggcatgagggcagtgagcaga

SEQ ID NO: 7949766 - DNA, 21 bp, Homo sapiens
ggcatgagggcagtgagcaga

SEQ ID NO: 7949767 - DNA, 22 bp, Homo sapiens
ggcatgagcacgaagtggtacc

SEQ ID NO: 7949768 - DNA, 21 bp, Homo sapiens
ggcatgagggcagtgagcaga

SEQ ID NO: 7949769 - DNA, 22 bp, Homo sapiens
ggcatgagtaacgtgagtgagg

SEQ ID NO: 7949770 - DNA, 22 bp, Homo sapiens
ggcatgagtaacgtgagtgagg

SEQ ID NO: 7949771 - DNA, 20 bp, Homo sapiens
ggcatgagatgtgagggagg

SEQ ID NO: 7949772 - DNA, 20 bp, Homo sapiens
ggcatgagatgtgagggagg

SEQ ID NO: 7949773 - DNA, 22 bp, Homo sapiens
ggcatgagaggtcctggggatt

SEQ ID NO: 7949774 - DNA, 22 bp, Homo sapiens
ggcatgagaggtcctggggatt

SEQ ID NO: 7949775 - DNA, 20 bp, Homo sapiens
ggcatgagatgtgagggagg

SEQ ID NO: 7949776 - DNA, 20 bp, Homo sapiens
ggcatgagatgtgagggagg

SEQ ID NO: 7949777 - DNA, 20 bp, Homo sapiens
ggcatgagatgtgagggagg

SEQ ID NO: 7949778 - DNA, 22 bp, Homo sapiens
ggcatcttgttgctcaaatcta

SEQ ID NO: 7949779 - DNA, 22 bp, Homo sapiens
ggcatcttgttgctcaaatcta

SEQ ID NO: 7949780 - DNA, 23 bp, Homo sapiens
ggcatcttgtctagagaaatctg

SEQ ID NO: 7949781 - DNA, 22 bp, Homo sapiens
ggcatcttgttgctcaaatcta

SEQ ID NO: 7949782 - DNA, 22 bp, Homo sapiens
ggcatgagaggtcctggggatt

SEQ ID NO: 7949783 - DNA, 22 bp, Homo sapiens
ggcatgagaggtcctggggatt

SEQ ID NO: 7949784 - DNA, 22 bp, Homo sapiens
ggcatgagaggtcctggggatt

SEQ ID NO: 7949785 - DNA, 22 bp, Homo sapiens
ggcatgagaggtcctggggatt

SEQ ID NO: 7949786 - DNA, 22 bp, Homo sapiens
ggcatctgtccatctctccagc

SEQ ID NO: 7949787 - DNA, 22 bp, Homo sapiens
ggcatctgtggagccttttcca

SEQ ID NO: 7949788 - DNA, 18 bp, Homo sapiens
ggcatctgcacagcagcc

SEQ ID NO: 7949789 - DNA, 22 bp, Homo sapiens
ggcatctggatctgcttctccc

SEQ ID NO: 7949790 - DNA, 22 bp, Homo sapiens
ggcatctcgcattcttgtttct

SEQ ID NO: 7949791 - DNA, 22 bp, Homo sapiens
ggcatctgagctgtgtatggtt

SEQ ID NO: 7949792 - DNA, 22 bp, Homo sapiens
ggcatctgagctgtgtatggtt

SEQ ID NO: 7949793 - DNA, 22 bp, Homo sapiens
ggcatgagtggcagtgggcagt

SEQ ID NO: 7949794 - DNA, 22 bp, Homo sapiens
ggcatgagtaacgtgagtgagg

SEQ ID NO: 7949795 - DNA, 22 bp, Homo sapiens
ggcatgagtggcagtgggcagt

SEQ ID NO: 7949796 - DNA, 22 bp, Homo sapiens
ggcatgagtaacgtgagtgagg

SEQ ID NO: 7949797 - DNA, 22 bp, Homo sapiens
ggcatgagtggcagtgggcagt

SEQ ID NO: 7949798 - DNA, 22 bp, Homo sapiens
ggcatgagtggcagtgggcagt

SEQ ID NO: 7949799 - DNA, 23 bp, Homo sapiens
ggcatgcaatggacagagctgga

SEQ ID NO: 7949800 - DNA, 23 bp, Homo sapiens
ggcatgcaatggacagagctgga

SEQ ID NO: 7949801 - DNA, 22 bp, Homo sapiens
ggcatgcaaatgtgggtgacct

SEQ ID NO: 7949802 - DNA, 22 bp, Homo sapiens
ggcatgcaaatgtgggtgacct

SEQ ID NO: 7949803 - DNA, 19 bp, Homo sapiens
ggccagctgtctcctgcta

SEQ ID NO: 7949804 - DNA, 22 bp, Homo sapiens
ggccagctgtaagctgctgaat

SEQ ID NO: 7949805 - DNA, 22 bp, Homo sapiens
ggccagctgtaagctgctgaat

SEQ ID NO: 7949806 - DNA, 21 bp, Homo sapiens
ggcatgctgctgctacttggc

SEQ ID NO: 7949807 - DNA, 22 bp, Homo sapiens
ggcatgcttgctgtttgggaat

SEQ ID NO: 7949808 - DNA, 22 bp, Homo sapiens
ggcatgctctttatattgcaat

SEQ ID NO: 7949809 - DNA, 22 bp, Homo sapiens
ggcatgctctgggggtcctccg

SEQ ID NO: 7949810 - DNA, 22 bp, Homo sapiens
ggcatgctcaggcttcttgctg

SEQ ID NO: 7949811 - DNA, 22 bp, Homo sapiens
ggcatgctgcgtacagatgaac

SEQ ID NO: 7949812 - DNA, 22 bp, Homo sapiens
ggcatgctacttcttcaatttt

SEQ ID NO: 7949813 - DNA, 22 bp, Homo sapiens
ggcatgctaggcattttatggg

SEQ ID NO: 7949814 - DNA, 22 bp, Homo sapiens
ggccagcttattagctcagagg

SEQ ID NO: 7949815 - DNA, 22 bp, Homo sapiens
ggccagcttattagctcagagg

SEQ ID NO: 7949816 - DNA, 22 bp, Homo sapiens
ggccagctgtgggattttctgc

SEQ ID NO: 7949817 - DNA, 22 bp, Homo sapiens
ggccagctgtggggccgagcct

SEQ ID NO: 7949818 - DNA, 19 bp, Homo sapiens
ggccagctgtctcctgcta

SEQ ID NO: 7949819 - DNA, 19 bp, Homo sapiens
ggccagctgtctcctgcta

SEQ ID NO: 7949820 - DNA, 19 bp, Homo sapiens
ggccagctgtctcctgcta

SEQ ID NO: 7949821 - DNA, 22 bp, Homo sapiens
ggccagcttctctgctgcctgt

SEQ ID NO: 7949822 - DNA, 22 bp, Homo sapiens
ggccagcttattagctcagagg

SEQ ID NO: 7949823 - DNA, 22 bp, Homo sapiens
ggccagcttctctgctgcctgt

SEQ ID NO: 7949824 - DNA, 22 bp, Homo sapiens
ggccagcttctctgctgcctgt

SEQ ID NO: 7949825 - DNA, 22 bp, Homo sapiens
ggccaggaacttttgggatggg

SEQ ID NO: 7949826 - DNA, 22 bp, Homo sapiens
ggccaggaacttttgggatggg

SEQ ID NO: 7949827 - DNA, 22 bp, Homo sapiens
ggccaggaagggaagatcagca

SEQ ID NO: 7949828 - DNA, 22 bp, Homo sapiens
ggccaggaagggaagatcagca

SEQ ID NO: 7949829 - DNA, 22 bp, Homo sapiens
ggccaggaagggaagatcagca

SEQ ID NO: 7949830 - DNA, 22 bp, Homo sapiens
ggccaggaagggaagatcagca

SEQ ID NO: 7949831 - DNA, 22 bp, Homo sapiens
ggccaggaacttttgggatggg

SEQ ID NO: 7949832 - DNA, 22 bp, Homo sapiens
ggccaggaacttttgggatggg

SEQ ID NO: 7949833 - DNA, 22 bp, Homo sapiens
ggccaggaacttttgggatggg

SEQ ID NO: 7949834 - DNA, 22 bp, Homo sapiens
ggccaggaacgatcctaccctt

SEQ ID NO: 7949835 - DNA, 22 bp, Homo sapiens
ggccaggaacttttgggatggg

SEQ ID NO: 7949836 - DNA, 22 bp, Homo sapiens
ggccagctttctgtcttctagg

SEQ ID NO: 7949837 - DNA, 22 bp, Homo sapiens
ggccagctttgagctgcaggaa

SEQ ID NO: 7949838 - DNA, 22 bp, Homo sapiens
ggccagctttctgtcttctagg

SEQ ID NO: 7949839 - DNA, 22 bp, Homo sapiens
ggccagctttgagctgcaggaa

SEQ ID NO: 7949840 - DNA, 22 bp, Homo sapiens
ggccagctttgagctgcaggaa

SEQ ID NO: 7949841 - DNA, 22 bp, Homo sapiens
ggcaggagaatggcgtgaactc

SEQ ID NO: 7949842 - DNA, 22 bp, Homo sapiens
ggcaggagaatggcgtgaactc

SEQ ID NO: 7949843 - DNA, 22 bp, Homo sapiens
ggcaggagaatggcgtgaactc

SEQ ID NO: 7949844 - DNA, 22 bp, Homo sapiens
ggcaggagataaaatattagtt

SEQ ID NO: 7949845 - DNA, 22 bp, Homo sapiens
ggcaggagaatggcgtgaactc

SEQ ID NO: 7949846 - DNA, 18 bp, Homo sapiens
ggcaggagcaagaatagg

SEQ ID NO: 7949847 - DNA, 18 bp, Homo sapiens
ggcaggagcaagaatagg

SEQ ID NO: 7949848 - DNA, 18 bp, Homo sapiens
ggcaggagcaagaatagg

SEQ ID NO: 7949849 - DNA, 18 bp, Homo sapiens
ggcaggagcaagaatagg

SEQ ID NO: 7949850 - DNA, 22 bp, Homo sapiens
ggcaggagctcaggttggttcc

SEQ ID NO: 7949851 - DNA, 22 bp, Homo sapiens
ggcaggagctcaggttggttcc

SEQ ID NO: 7949852 - DNA, 22 bp, Homo sapiens
ggcaggagctcaggttggttcc

SEQ ID NO: 7949853 - DNA, 22 bp, Homo sapiens
ggcaggagctctccagtttgcc

SEQ ID NO: 7949854 - DNA, 22 bp, Homo sapiens
ggcaggagctctccagtttgcc

SEQ ID NO: 7949855 - DNA, 22 bp, Homo sapiens
ggcaggagctctccagtttgcc

SEQ ID NO: 7949856 - DNA, 22 bp, Homo sapiens
ggcaggagctctccagtttgcc

SEQ ID NO: 7949857 - DNA, 22 bp, Homo sapiens
ggcaggagctctccagtttgcc

SEQ ID NO: 7949858 - DNA, 22 bp, Homo sapiens
ggcaggagctctccagtttgcc

SEQ ID NO: 7949859 - DNA, 22 bp, Homo sapiens
ggcaggagctctccagtttgcc

SEQ ID NO: 7949860 - DNA, 22 bp, Homo sapiens
ggcaggaggaagagttagcacc

SEQ ID NO: 7949861 - DNA, 22 bp, Homo sapiens
ggcaggaggaagagttagcacc

SEQ ID NO: 7949862 - DNA, 18 bp, Homo sapiens
ggcaggggtgaaccacag

SEQ ID NO: 7949863 - DNA, 18 bp, Homo sapiens
ggcaggggtgaaccacag

SEQ ID NO: 7949864 - DNA, 22 bp, Homo sapiens
ggcaggagctctccagtttgcc

SEQ ID NO: 7949865 - DNA, 22 bp, Homo sapiens
ggcaggaggaagagttagcacc

SEQ ID NO: 7949866 - DNA, 22 bp, Homo sapiens
ggcaggaggaagagttagcacc

SEQ ID NO: 7949867 - DNA, 22 bp, Homo sapiens
ggcagggtccacacctgggaaa

SEQ ID NO: 7949868 - DNA, 22 bp, Homo sapiens
ggcagggtccacacctgggaaa

SEQ ID NO: 7949869 - DNA, 22 bp, Homo sapiens
ggcagggtgcctggctcctgtt

SEQ ID NO: 7949870 - DNA, 22 bp, Homo sapiens
ggcaggggttcattttgtctta

SEQ ID NO: 7949871 - DNA, 22 bp, Homo sapiens
ggcagggtaaaccgaggtaagt

SEQ ID NO: 7949872 - DNA, 22 bp, Homo sapiens
ggcagggtaaaccgaggtaagt

SEQ ID NO: 7949873 - DNA, 22 bp, Homo sapiens
ggcagggtaaaccgaggtaagt

SEQ ID NO: 7949874 - DNA, 22 bp, Homo sapiens
ggcaggggtgaggccactctga

SEQ ID NO: 7949875 - DNA, 22 bp, Homo sapiens
ggcaggggtgaggccactctga

SEQ ID NO: 7949876 - DNA, 18 bp, Homo sapiens
ggcaggggtgaaccacag

SEQ ID NO: 7949877 - DNA, 22 bp, Homo sapiens
ggcaggggtgaggccactctga

SEQ ID NO: 7949878 - DNA, 22 bp, Homo sapiens
ggcaggggtggccttcctttgg

SEQ ID NO: 7949879 - DNA, 22 bp, Homo sapiens
ggcaggggtgaggccactctga

SEQ ID NO: 7949880 - DNA, 22 bp, Homo sapiens
ggcaggggttcattttgtctta

SEQ ID NO: 7949881 - DNA, 22 bp, Homo sapiens
ggcaggggttcattttgtctta

SEQ ID NO: 7949882 - DNA, 22 bp, Homo sapiens
ggcaggggtggccttcctttgg

SEQ ID NO: 7949883 - DNA, 22 bp, Homo sapiens
ggcaggtgacggggatgagtat

SEQ ID NO: 7949884 - DNA, 22 bp, Homo sapiens
ggcaggtgacggggatgagtat

SEQ ID NO: 7949885 - DNA, 22 bp, Homo sapiens
ggcaggtgacggggatgagtat

SEQ ID NO: 7949886 - DNA, 22 bp, Homo sapiens
ggcaggtgacggggatgagtat

SEQ ID NO: 7949887 - DNA, 22 bp, Homo sapiens
ggcaggtgacggggatgagtat

SEQ ID NO: 7949888 - DNA, 22 bp, Homo sapiens
ggcaggtgacggggatgagtat

SEQ ID NO: 7949889 - DNA, 22 bp, Homo sapiens
ggcaggtgagagctctttgaaa

SEQ ID NO: 7949890 - DNA, 22 bp, Homo sapiens
ggcaggtgagagctctttgaaa

SEQ ID NO: 7949891 - DNA, 22 bp, Homo sapiens
ggcaggtgaggcatgtgcctgg

SEQ ID NO: 7949892 - DNA, 22 bp, Homo sapiens
ggcaggtgacctggcctcccag

SEQ ID NO: 7949893 - DNA, 17 bp, Homo sapiens
ggcaggtgacagacacc

SEQ ID NO: 7949894 - DNA, 22 bp, Homo sapiens
ggcaggtgacctggcctcccag

SEQ ID NO: 7949895 - DNA, 22 bp, Homo sapiens
ggcaggtgacggggatgagtat

SEQ ID NO: 7949896 - DNA, 17 bp, Homo sapiens
ggcaggtgacagacacc

SEQ ID NO: 7949897 - DNA, 17 bp, Homo sapiens
ggcaggtgacagacacc

SEQ ID NO: 7949898 - DNA, 17 bp, Homo sapiens
ggcaggtgacagacacc

SEQ ID NO: 7949899 - DNA, 22 bp, Homo sapiens
ggcaggtcatcaactgtaattt

SEQ ID NO: 7949900 - DNA, 22 bp, Homo sapiens
ggcaggtagcctagaggaggtt

SEQ ID NO: 7949901 - DNA, 22 bp, Homo sapiens
ggcaggtagcctagaggaggtt

SEQ ID NO: 7949902 - DNA, 22 bp, Homo sapiens
ggcaggtagcctagaggaggtt

SEQ ID NO: 7949903 - DNA, 19 bp, Homo sapiens
ggcaggtagagggccagtc

SEQ ID NO: 7949904 - DNA, 22 bp, Homo sapiens
ggcagggtttctccattctgcc

SEQ ID NO: 7949905 - DNA, 22 bp, Homo sapiens
ggcaggtacagcaagaggacaa

SEQ ID NO: 7949906 - DNA, 22 bp, Homo sapiens
ggcaggtactggggagtgaaga

SEQ ID NO: 7949907 - DNA, 22 bp, Homo sapiens
ggcaggtactggggagtgaaga

SEQ ID NO: 7949908 - DNA, 22 bp, Homo sapiens
ggcagggtgtggagttgggaca

SEQ ID NO: 7949909 - DNA, 22 bp, Homo sapiens
ggcagggtgtggagttgggaca

SEQ ID NO: 7949910 - DNA, 22 bp, Homo sapiens
ggcagggtgtggagttgggaca

SEQ ID NO: 7949911 - DNA, 22 bp, Homo sapiens
ggcagggtttacaatagcaata

SEQ ID NO: 7949912 - DNA, 22 bp, Homo sapiens
ggcagggtggcagaggctcaga

SEQ ID NO: 7949913 - DNA, 22 bp, Homo sapiens
ggcagggtggcagaggctcaga

SEQ ID NO: 7949914 - DNA, 22 bp, Homo sapiens
ggcagggtggcagaggctcaga

SEQ ID NO: 7949915 - DNA, 22 bp, Homo sapiens
ggcagggtggccctccagtgag

SEQ ID NO: 7949916 - DNA, 17 bp, Homo sapiens
ggcagggtgctgggtat

SEQ ID NO: 7949917 - DNA, 17 bp, Homo sapiens
ggcagggtgctgggtat

SEQ ID NO: 7949918 - DNA, 17 bp, Homo sapiens
ggcagggtgctgggtat

SEQ ID NO: 7949919 - DNA, 17 bp, Homo sapiens
ggcagggtgctgggtat

SEQ ID NO: 7949920 - DNA, 22 bp, Homo sapiens
ggcagcaggagccatctggtag

SEQ ID NO: 7949921 - DNA, 22 bp, Homo sapiens
ggcagcaggagccatctggtag

SEQ ID NO: 7949922 - DNA, 22 bp, Homo sapiens
ggcagcaggagccatctggtag

SEQ ID NO: 7949923 - DNA, 20 bp, Homo sapiens
ggcagcaggagtttcctctt

SEQ ID NO: 7949924 - DNA, 22 bp, Homo sapiens
ggcagcaggagccatctggtag

SEQ ID NO: 7949925 - DNA, 22 bp, Homo sapiens
ggcagcaggagccatctggtag

SEQ ID NO: 7949926 - DNA, 22 bp, Homo sapiens
ggcagcaggagccatctggtag

SEQ ID NO: 7949927 - DNA, 16 bp, Homo sapiens
ggcagcagctccgtgc

SEQ ID NO: 7949928 - DNA, 22 bp, Homo sapiens
ggcagcaggagccatctggtag

SEQ ID NO: 7949929 - DNA, 22 bp, Homo sapiens
ggcagcaggagccatctggtag

SEQ ID NO: 7949930 - DNA, 22 bp, Homo sapiens
ggcagcaggagccatctggtag

SEQ ID NO: 7949931 - DNA, 22 bp, Homo sapiens
ggcagcaggagccatctggtag

SEQ ID NO: 7949932 - DNA, 22 bp, Homo sapiens
ggcagcaggagccatctggtag

SEQ ID NO: 7949933 - DNA, 22 bp, Homo sapiens
ggcagcagcaaggttggagctg

SEQ ID NO: 7949934 - DNA, 22 bp, Homo sapiens
ggcagcagcaaggttggagctg

SEQ ID NO: 7949935 - DNA, 22 bp, Homo sapiens
ggcagcagcaaggttggagctg

SEQ ID NO: 7949936 - DNA, 22 bp, Homo sapiens
ggcagcagcaaggttggagctg

SEQ ID NO: 7949937 - DNA, 22 bp, Homo sapiens
ggcagcagcaaggttggagctg

SEQ ID NO: 7949938 - DNA, 22 bp, Homo sapiens
ggcagcagcaaggttggagctg

SEQ ID NO: 7949939 - DNA, 22 bp, Homo sapiens
ggcagcagcaaggttggagctg

SEQ ID NO: 7949940 - DNA, 22 bp, Homo sapiens
ggcagcagacccctaagtctac

SEQ ID NO: 7949941 - DNA, 21 bp, Homo sapiens
ggcagaagtagcatggacggg

SEQ ID NO: 7949942 - DNA, 21 bp, Homo sapiens
ggcagaagtagcatggacggg

SEQ ID NO: 7949943 - DNA, 21 bp, Homo sapiens
ggcagaagtagcatggacggg

SEQ ID NO: 7949944 - DNA, 21 bp, Homo sapiens
ggcagaagtagcatggacggg

SEQ ID NO: 7949945 - DNA, 22 bp, Homo sapiens
ggcagaaggttgaagtaatttg

SEQ ID NO: 7949946 - DNA, 21 bp, Homo sapiens
ggcagaagtagcatggacggg

SEQ ID NO: 7949947 - DNA, 21 bp, Homo sapiens
ggcagaagtagcatggacggg

SEQ ID NO: 7949948 - DNA, 21 bp, Homo sapiens
ggcagaagtagcatggacggg

SEQ ID NO: 7949949 - DNA, 22 bp, Homo sapiens
ggcagaagaaaggctaagtctc

SEQ ID NO: 7949950 - DNA, 22 bp, Homo sapiens
ggcagaagaaaggctaagtctc

SEQ ID NO: 7949951 - DNA, 22 bp, Homo sapiens
ggcagaagaaaggctaagtctc

SEQ ID NO: 7949952 - DNA, 22 bp, Homo sapiens
ggcagaagataggacagggaat

SEQ ID NO: 7949953 - DNA, 22 bp, Homo sapiens
ggcagaagataggacagggaat

SEQ ID NO: 7949954 - DNA, 22 bp, Homo sapiens
ggcagaaggcaattagagactg

SEQ ID NO: 7949955 - DNA, 22 bp, Homo sapiens
ggcagaaggcaattagagactg

SEQ ID NO: 7949956 - DNA, 22 bp, Homo sapiens
ggcagaagataggacagggaat

SEQ ID NO: 7949957 - DNA, 22 bp, Homo sapiens
ggcagaagataggacagggaat

SEQ ID NO: 7949958 - DNA, 22 bp, Homo sapiens
ggcagaagataggacagggaat

SEQ ID NO: 7949959 - DNA, 22 bp, Homo sapiens
ggcagaagataggacagggaat

SEQ ID NO: 7949960 - DNA, 22 bp, Homo sapiens
ggcagaagataggacagggaat

SEQ ID NO: 7949961 - DNA, 19 bp, Homo sapiens
ggcagaaggtgtaggggga

SEQ ID NO: 7949962 - DNA, 19 bp, Homo sapiens
ggcagaaggtgtaggggga

SEQ ID NO: 7949963 - DNA, 19 bp, Homo sapiens
ggcagaaggtgtaggggga

SEQ ID NO: 7949964 - DNA, 19 bp, Homo sapiens
ggcagaaggtgtaggggga

SEQ ID NO: 7949965 - DNA, 19 bp, Homo sapiens
ggcagaaggtgtaggggga

SEQ ID NO: 7949966 - DNA, 22 bp, Homo sapiens
ggcagaaggcaattagagactg

SEQ ID NO: 7949967 - DNA, 22 bp, Homo sapiens
ggcagaaggcaattagagactg

SEQ ID NO: 7949968 - DNA, 22 bp, Homo sapiens
ggcagaaggcctcccagctcct

SEQ ID NO: 7949969 - DNA, 22 bp, Homo sapiens
ggcagaaggcctcccagctcct

SEQ ID NO: 7949970 - DNA, 22 bp, Homo sapiens
ggatttactatcttgaaatata

SEQ ID NO: 7949971 - DNA, 22 bp, Homo sapiens
ggatttactatcttgaaatata

SEQ ID NO: 7949972 - DNA, 23 bp, Homo sapiens
ggatttagtggatgagctgagtg

SEQ ID NO: 7949973 - DNA, 22 bp, Homo sapiens
ggatttgggcttgcagcagagc

SEQ ID NO: 7949974 - DNA, 22 bp, Homo sapiens
ggatttgaattgttgaaatgat

SEQ ID NO: 7949975 - DNA, 22 bp, Homo sapiens
ggatttgaactagagccctgcc

SEQ ID NO: 7949976 - DNA, 22 bp, Homo sapiens
ggatttgaattgttgaaatgat

SEQ ID NO: 7949977 - DNA, 22 bp, Homo sapiens
ggatttgggcttgcagcagagc

SEQ ID NO: 7949978 - DNA, 22 bp, Homo sapiens
ggatttacccaatggatagatg

SEQ ID NO: 7949979 - DNA, 20 bp, Homo sapiens
ggatttacaggggaaaagtg

SEQ ID NO: 7949980 - DNA, 22 bp, Homo sapiens
ggatttacccaatggatagatg

SEQ ID NO: 7949981 - DNA, 20 bp, Homo sapiens
ggatttacaggggaaaagtg

SEQ ID NO: 7949982 - DNA, 22 bp, Homo sapiens
ggatttacacacctgcctgtca

SEQ ID NO: 7949983 - DNA, 22 bp, Homo sapiens
ggatttacacacctgcctgtca

SEQ ID NO: 7949984 - DNA, 22 bp, Homo sapiens
ggatttacaagtttaactctca

SEQ ID NO: 7949985 - DNA, 22 bp, Homo sapiens
ggatttacaagtttaactctca

SEQ ID NO: 7949986 - DNA, 22 bp, Homo sapiens
ggattgaagggaacctcagaat

SEQ ID NO: 7949987 - DNA, 22 bp, Homo sapiens
ggattgcaacaagctagtttag

SEQ ID NO: 7949988 - DNA, 22 bp, Homo sapiens
ggcactgggcaccggctgaggg

SEQ ID NO: 7949989 - DNA, 19 bp, Homo sapiens
ggcactggggccaggacca

SEQ ID NO: 7949990 - DNA, 22 bp, Homo sapiens
ggcactgggcaccggctgaggg

SEQ ID NO: 7949991 - DNA, 22 bp, Homo sapiens
ggcactgctgtaggcagtgagg

SEQ ID NO: 7949992 - DNA, 22 bp, Homo sapiens
ggcactgggcaccggctgaggg

SEQ ID NO: 7949993 - DNA, 21 bp, Homo sapiens
ggcactgctgggccatctgct

SEQ ID NO: 7949994 - DNA, 22 bp, Homo sapiens
ggcactgctgtaggcagtgagg

SEQ ID NO: 7949995 - DNA, 21 bp, Homo sapiens
ggcactgctgggccatctgct

SEQ ID NO: 7949996 - DNA, 22 bp, Homo sapiens
ggcactgattccattcatgaag

SEQ ID NO: 7949997 - DNA, 21 bp, Homo sapiens
ggattttaaaaactgcacctg

SEQ ID NO: 7949998 - DNA, 20 bp, Homo sapiens
ggcactgcaccagttagtag

SEQ ID NO: 7949999 - DNA, 20 bp, Homo sapiens
ggcactgcaccagttagtag

SEQ ID NO: 7950000 - DNA, 22 bp, Homo sapiens
ggcactgcaggtaagtgctgtc

SEQ ID NO: 7950001 - DNA, 22 bp, Homo sapiens
ggcactgcaggtaagtgctgtc

SEQ ID NO: 7950002 - DNA, 22 bp, Homo sapiens
ggcactgcccaccctcacaggg

SEQ ID NO: 7950003 - DNA, 22 bp, Homo sapiens
ggcactgcccaccctcacaggg

SEQ ID NO: 7950004 - DNA, 22 bp, Homo sapiens
ggcactgcaggtaagtgctgtc

SEQ ID NO: 7950005 - DNA, 22 bp, Homo sapiens
ggcactgcaggtaagtgctgtc

SEQ ID NO: 7950006 - DNA, 22 bp, Homo sapiens
ggcactgcaggtaagtgctgtc

SEQ ID NO: 7950007 - DNA, 22 bp, Homo sapiens
ggcactgccccctgcccaggac

SEQ ID NO: 7950008 - DNA, 22 bp, Homo sapiens
ggcactgcccaccctcacaggg

SEQ ID NO: 7950009 - DNA, 18 bp, Homo sapiens
ggcactggtgatgcagag

SEQ ID NO: 7950010 - DNA, 18 bp, Homo sapiens
ggcactggtgatgcagag

SEQ ID NO: 7950011 - DNA, 22 bp, Homo sapiens
ggcactgtgtacacacagagac

SEQ ID NO: 7950012 - DNA, 22 bp, Homo sapiens
ggcactgtgtacacacagagac

SEQ ID NO: 7950013 - DNA, 22 bp, Homo sapiens
ggcactgtttttgtattcagtt

SEQ ID NO: 7950014 - DNA, 18 bp, Homo sapiens
ggcactggtgatgcagag

SEQ ID NO: 7950015 - DNA, 18 bp, Homo sapiens
ggcactggtgatgcagag

SEQ ID NO: 7950016 - DNA, 18 bp, Homo sapiens
ggcactggtgatgcagag

SEQ ID NO: 7950017 - DNA, 18 bp, Homo sapiens
ggcactggtgatgcagag

SEQ ID NO: 7950018 - DNA, 18 bp, Homo sapiens
ggcactggtgatgcagag

SEQ ID NO: 7950019 - DNA, 18 bp, Homo sapiens
ggcactggtgatgcagag

SEQ ID NO: 7950020 - DNA, 22 bp, Homo sapiens
ggcactttgattttgagatgca

SEQ ID NO: 7950021 - DNA, 22 bp, Homo sapiens
ggcactttccagtctatagagc

SEQ ID NO: 7950022 - DNA, 22 bp, Homo sapiens
ggcactgtttttgtattcagtt

SEQ ID NO: 7950023 - DNA, 22 bp, Homo sapiens
ggcactttgattttgagatgca

SEQ ID NO: 7950024 - DNA, 22 bp, Homo sapiens
ggcactgtttttgtattcagtt

SEQ ID NO: 7950025 - DNA, 20 bp, Homo sapiens
ggcacttgatcccctggttc

SEQ ID NO: 7950026 - DNA, 20 bp, Homo sapiens
ggcacttgatcccctggttc

SEQ ID NO: 7950027 - DNA, 22 bp, Homo sapiens
ggcacttggatcttagttgggg

SEQ ID NO: 7950028 - DNA, 22 bp, Homo sapiens
ggcacttggatcttagttgggg

SEQ ID NO: 7950029 - DNA, 22 bp, Homo sapiens
ggcacttgcttgctgcctttat

SEQ ID NO: 7950030 - DNA, 22 bp, Homo sapiens
ggcactgggtgagggtcactgg

SEQ ID NO: 7950031 - DNA, 19 bp, Homo sapiens
ggcactggggccaggacca

SEQ ID NO: 7950032 - DNA, 22 bp, Homo sapiens
ggcactgggtgagggtcactgg

SEQ ID NO: 7950033 - DNA, 19 bp, Homo sapiens
ggcactggggccaggacca

SEQ ID NO: 7950034 - DNA, 19 bp, Homo sapiens
ggcactggggccaggacca

SEQ ID NO: 7950035 - DNA, 22 bp, Homo sapiens
ggcactgggttgtaggaattaa

SEQ ID NO: 7950036 - DNA, 18 bp, Homo sapiens
ggcactggtgatgcagag

SEQ ID NO: 7950037 - DNA, 18 bp, Homo sapiens
ggcactggtgatgcagag

SEQ ID NO: 7950038 - DNA, 18 bp, Homo sapiens
ggcactggtgatgcagag

SEQ ID NO: 7950039 - DNA, 22 bp, Homo sapiens
ggcactgggttgtaggaattaa

SEQ ID NO: 7950040 - DNA, 22 bp, Homo sapiens
ggcactgggtgagggtcactgg

SEQ ID NO: 7950041 - DNA, 22 bp, Homo sapiens
ggcagccatgcacgctgcctgg

SEQ ID NO: 7950042 - DNA, 22 bp, Homo sapiens
ggcagccatgctccaggtgcag

SEQ ID NO: 7950043 - DNA, 22 bp, Homo sapiens
ggcagccatgctccaggtgcag

SEQ ID NO: 7950044 - DNA, 22 bp, Homo sapiens
ggcagccatgctccaggtgcag

SEQ ID NO: 7950045 - DNA, 22 bp, Homo sapiens
ggcagccatgctccaggtgcag

SEQ ID NO: 7950046 - DNA, 22 bp, Homo sapiens
ggcagccatggacactggctag

SEQ ID NO: 7950047 - DNA, 22 bp, Homo sapiens
ggcagccatgcacgctgcctgg

SEQ ID NO: 7950048 - DNA, 22 bp, Homo sapiens
ggcagccatgcacgctgcctgg

SEQ ID NO: 7950049 - DNA, 22 bp, Homo sapiens
ggcagccatactcagacctggg

SEQ ID NO: 7950050 - DNA, 22 bp, Homo sapiens
ggcagccatactcagacctggg

SEQ ID NO: 7950051 - DNA, 22 bp, Homo sapiens
ggcagccatactcagacctggg

SEQ ID NO: 7950052 - DNA, 22 bp, Homo sapiens
ggcagccagtagggccagcctg

SEQ ID NO: 7950053 - DNA, 22 bp, Homo sapiens
ggcagccagtagggccagcctg

SEQ ID NO: 7950054 - DNA, 22 bp, Homo sapiens
ggcagccaggagggtgtagttt

SEQ ID NO: 7950055 - DNA, 22 bp, Homo sapiens
ggcagccagcacgcagttgatg

SEQ ID NO: 7950056 - DNA, 22 bp, Homo sapiens
ggcagccagcacgcagttgatg

SEQ ID NO: 7950057 - DNA, 22 bp, Homo sapiens
ggcagccagcaatgagaagttt

SEQ ID NO: 7950058 - DNA, 22 bp, Homo sapiens
ggcagccagcgggtggacgcgc

SEQ ID NO: 7950059 - DNA, 22 bp, Homo sapiens
ggcagccagcgggtggacgcgc

SEQ ID NO: 7950060 - DNA, 22 bp, Homo sapiens
ggcagccagagggcagctggat

SEQ ID NO: 7950061 - DNA, 22 bp, Homo sapiens
ggcagccagcaatgagaagttt

SEQ ID NO: 7950062 - DNA, 22 bp, Homo sapiens
ggcagccagcaatgagaagttt

SEQ ID NO: 7950063 - DNA, 22 bp, Homo sapiens
ggcagcagtggctgctattgtc

SEQ ID NO: 7950064 - DNA, 22 bp, Homo sapiens
ggcagcagtccatggcccaagg

SEQ ID NO: 7950065 - DNA, 22 bp, Homo sapiens
ggcagcagtccatggcccaagg

SEQ ID NO: 7950066 - DNA, 22 bp, Homo sapiens
ggcagcagtccatggcccaagg

SEQ ID NO: 7950067 - DNA, 22 bp, Homo sapiens
ggcagcagtccatggcccaagg

SEQ ID NO: 7950068 - DNA, 22 bp, Homo sapiens
ggcagcagggctgtctccctac

SEQ ID NO: 7950069 - DNA, 22 bp, Homo sapiens
ggcagcagggctgtctccctac

SEQ ID NO: 7950070 - DNA, 22 bp, Homo sapiens
ggcagcaggcgacttccctatt

SEQ ID NO: 7950071 - DNA, 22 bp, Homo sapiens
ggcagcaggcgacttccctatt

SEQ ID NO: 7950072 - DNA, 22 bp, Homo sapiens
ggcagcaggcgacttccctatt

SEQ ID NO: 7950073 - DNA, 20 bp, Homo sapiens
ggcagcaggagtttcctctt

SEQ ID NO: 7950074 - DNA, 22 bp, Homo sapiens
ggcagcagggtagccatttctc

SEQ ID NO: 7950075 - DNA, 22 bp, Homo sapiens
ggcagcagggctgtctccctac

SEQ ID NO: 7950076 - DNA, 22 bp, Homo sapiens
ggcagcagggtagccatttctc

SEQ ID NO: 7950077 - DNA, 22 bp, Homo sapiens
ggcagcagggtagccatttctc

SEQ ID NO: 7950078 - DNA, 22 bp, Homo sapiens
ggcagcagggtagccatttctc

SEQ ID NO: 7950079 - DNA, 22 bp, Homo sapiens
ggcagcagggctgtctccctac

SEQ ID NO: 7950080 - DNA, 22 bp, Homo sapiens
ggcagcagggctgtctccctac

SEQ ID NO: 7950081 - DNA, 22 bp, Homo sapiens
ggcagcagggtctagattgatg

SEQ ID NO: 7950082 - DNA, 22 bp, Homo sapiens
ggcagcagggtagccatttctc

SEQ ID NO: 7950083 - DNA, 22 bp, Homo sapiens
ggcagcagggtctagattgatg

SEQ ID NO: 7950084 - DNA, 22 bp, Homo sapiens
ggcagcagggtagccatttctc

SEQ ID NO: 7950085 - DNA, 22 bp, Homo sapiens
ggcagcagggtctagattgatg

SEQ ID NO: 7950086 - DNA, 22 bp, Homo sapiens
ggcagcagggtctagattgatg

SEQ ID NO: 7950087 - DNA, 22 bp, Homo sapiens
ggcagcagggtctagattgatg

SEQ ID NO: 7950088 - DNA, 22 bp, Homo sapiens
ggcagcagggtctagattgatg

SEQ ID NO: 7950089 - DNA, 22 bp, Homo sapiens
ggcagcagggtctagattgatg

SEQ ID NO: 7950090 - DNA, 22 bp, Homo sapiens
ggcagcagtaggagctaatctt

SEQ ID NO: 7950091 - DNA, 22 bp, Homo sapiens
ggcagcagtccatggcccaagg

SEQ ID NO: 7950092 - DNA, 22 bp, Homo sapiens
ggcagcagtccatggcccaagg

SEQ ID NO: 7950093 - DNA, 22 bp, Homo sapiens
ggcagcagtccatggcccaagg

SEQ ID NO: 7950094 - DNA, 22 bp, Homo sapiens
ggcagcagtccatggcccaagg

SEQ ID NO: 7950095 - DNA, 22 bp, Homo sapiens
ggcagcagtaggagctaatctt

SEQ ID NO: 7950096 - DNA, 22 bp, Homo sapiens
ggcagcttctcccaggctgttt

SEQ ID NO: 7950097 - DNA, 22 bp, Homo sapiens
ggcagcttctcccaggctgttt

SEQ ID NO: 7950098 - DNA, 22 bp, Homo sapiens
ggcagcttcggacggcttataa

SEQ ID NO: 7950099 - DNA, 22 bp, Homo sapiens
ggcagcttcttaatatggagac

SEQ ID NO: 7950100 - DNA, 22 bp, Homo sapiens
ggcagcttcttaatatggagac

SEQ ID NO: 7950101 - DNA, 22 bp, Homo sapiens
ggcagcttcttaatatggagac

SEQ ID NO: 7950102 - DNA, 22 bp, Homo sapiens
ggcagcttgccctggtctcaac

SEQ ID NO: 7950103 - DNA, 18 bp, Homo sapiens
ggcagcttgactagcaac

SEQ ID NO: 7950104 - DNA, 22 bp, Homo sapiens
ggcagcttcctaggagagggca

SEQ ID NO: 7950105 - DNA, 22 bp, Homo sapiens
ggcagcttcctaggagagggca

SEQ ID NO: 7950106 - DNA, 22 bp, Homo sapiens
ggcagcttcctaggagagggca

SEQ ID NO: 7950107 - DNA, 23 bp, Homo sapiens
ggcagcttatactttcatagaca

SEQ ID NO: 7950108 - DNA, 23 bp, Homo sapiens
ggcagcttatactttcatagaca

SEQ ID NO: 7950109 - DNA, 23 bp, Homo sapiens
ggcagcttacttggtctctttca

SEQ ID NO: 7950110 - DNA, 22 bp, Homo sapiens
ggcagctgtttgtcctcctgtt

SEQ ID NO: 7950111 - DNA, 22 bp, Homo sapiens
ggcagcttaaaccacagacatt

SEQ ID NO: 7950112 - DNA, 22 bp, Homo sapiens
ggcagctttgagtcttagagta

SEQ ID NO: 7950113 - DNA, 22 bp, Homo sapiens
ggcagctttgagtcttagagta

SEQ ID NO: 7950114 - DNA, 22 bp, Homo sapiens
ggcagcttgtccttcaggagag

SEQ ID NO: 7950115 - DNA, 22 bp, Homo sapiens
ggcagctttcaatagggttatg

SEQ ID NO: 7950116 - DNA, 22 bp, Homo sapiens
ggcaggagaatggcgtgaactc

SEQ ID NO: 7950117 - DNA, 22 bp, Homo sapiens
ggcagctttgccctcactgtcc

SEQ ID NO: 7950118 - DNA, 22 bp, Homo sapiens
ggcagctttgccctcactgtcc

SEQ ID NO: 7950119 - DNA, 22 bp, Homo sapiens
ggcagctttggattcgcggctg

SEQ ID NO: 7950120 - DNA, 22 bp, Homo sapiens
ggcagctttcaatagggttatg

SEQ ID NO: 7950121 - DNA, 22 bp, Homo sapiens
ggcagcttgtccttcaggagag

SEQ ID NO: 7950122 - DNA, 22 bp, Homo sapiens
ggcagcttgtccttcaggagag

SEQ ID NO: 7950123 - DNA, 23 bp, Homo sapiens
ggcagcttgttcctttgcttcca

SEQ ID NO: 7950124 - DNA, 22 bp, Homo sapiens
ggcagcttgtccttcaggagag

SEQ ID NO: 7950125 - DNA, 22 bp, Homo sapiens
ggcagcttgtccttcaggagag

SEQ ID NO: 7950126 - DNA, 22 bp, Homo sapiens
ggcagcttgtcctggaggatgg

SEQ ID NO: 7950127 - DNA, 19 bp, Homo sapiens
ggcagcttgggaaggtagc

SEQ ID NO: 7950128 - DNA, 22 bp, Homo sapiens
ggcagctgttggctctctagga

SEQ ID NO: 7950129 - DNA, 22 bp, Homo sapiens
ggcagctgttggctctctagga

SEQ ID NO: 7950130 - DNA, 22 bp, Homo sapiens
ggcagctgttggctctctagga

SEQ ID NO: 7950131 - DNA, 22 bp, Homo sapiens
ggcagctgttggctctctagga

SEQ ID NO: 7950132 - DNA, 22 bp, Homo sapiens
ggcagctgttggctctctagga

SEQ ID NO: 7950133 - DNA, 22 bp, Homo sapiens
ggcagctgttggctctctagga

SEQ ID NO: 7950134 - DNA, 22 bp, Homo sapiens
ggcagctgttggctctctagga

SEQ ID NO: 7950135 - DNA, 22 bp, Homo sapiens
ggcagctgttggctctctagga

SEQ ID NO: 7950136 - DNA, 22 bp, Homo sapiens
ggcagctgttggctctctagga

SEQ ID NO: 7950137 - DNA, 22 bp, Homo sapiens
ggcagctgttggctctctagga

SEQ ID NO: 7950138 - DNA, 22 bp, Homo sapiens
ggcagctgtttgtcctcctgtt

SEQ ID NO: 7950139 - DNA, 22 bp, Homo sapiens
ggcagctgttggctctctagga

SEQ ID NO: 7950140 - DNA, 22 bp, Homo sapiens
ggcagctgttggctctctagga

SEQ ID NO: 7950141 - DNA, 22 bp, Homo sapiens
ggcagctgtttgtcctcctgtt

SEQ ID NO: 7950142 - DNA, 22 bp, Homo sapiens
ggcagctgtttgtcctcctgtt

SEQ ID NO: 7950143 - DNA, 22 bp, Homo sapiens
ggcagctgtttgtcctcctgtt

SEQ ID NO: 7950144 - DNA, 22 bp, Homo sapiens
ggcagctgtttgtcctcctgtt

SEQ ID NO: 7950145 - DNA, 22 bp, Homo sapiens
ggcagctgtttgtcctcctgtt

SEQ ID NO: 7950146 - DNA, 22 bp, Homo sapiens
ggcagctgtttgtcctcctgtt

SEQ ID NO: 7950147 - DNA, 17 bp, Homo sapiens
ggcagctgtgtgcatgc

SEQ ID NO: 7950148 - DNA, 17 bp, Homo sapiens
ggcagctgtgtgcatgc

SEQ ID NO: 7950149 - DNA, 17 bp, Homo sapiens
ggcagctgtgtgcatgc

SEQ ID NO: 7950150 - DNA, 21 bp, Homo sapiens
ggcagctgtggttaattgaac

SEQ ID NO: 7950151 - DNA, 17 bp, Homo sapiens
ggcagctgtgtgcatgc

SEQ ID NO: 7950152 - DNA, 17 bp, Homo sapiens
ggcagctgtgtgcatgc

SEQ ID NO: 7950153 - DNA, 17 bp, Homo sapiens
ggcagctgtgtgcatgc

SEQ ID NO: 7950154 - DNA, 17 bp, Homo sapiens
ggcagctgtgtgcatgc

SEQ ID NO: 7950155 - DNA, 22 bp, Homo sapiens
ggcagctgtgaagtgcctcaca

SEQ ID NO: 7950156 - DNA, 22 bp, Homo sapiens
ggcagctgtggacgtcgtcatt

SEQ ID NO: 7950157 - DNA, 22 bp, Homo sapiens
ggcagctgtggacgtcgtcatt

SEQ ID NO: 7950158 - DNA, 22 bp, Homo sapiens
ggcagctgtggacgtcgtcatt

SEQ ID NO: 7950159 - DNA, 22 bp, Homo sapiens
ggcagctgtggacgtcgtcatt

SEQ ID NO: 7950160 - DNA, 21 bp, Homo sapiens
ggcagctgtggttaattgaac

SEQ ID NO: 7950161 - DNA, 21 bp, Homo sapiens
ggcagctgtggttaattgaac

SEQ ID NO: 7950162 - DNA, 21 bp, Homo sapiens
ggcagctgtggttaattgaac

SEQ ID NO: 7950163 - DNA, 17 bp, Homo sapiens
ggagcagatccaccatt

SEQ ID NO: 7950164 - DNA, 17 bp, Homo sapiens
ggagcagatccaccatt

SEQ ID NO: 7950165 - DNA, 17 bp, Homo sapiens
ggagcagatccaccatt

SEQ ID NO: 7950166 - DNA, 17 bp, Homo sapiens
ggagcagatccaccatt

SEQ ID NO: 7950167 - DNA, 22 bp, Homo sapiens
ggagcagagctgggcttggctg

SEQ ID NO: 7950168 - DNA, 22 bp, Homo sapiens
ggagcagagctgggcttggctg

SEQ ID NO: 7950169 - DNA, 22 bp, Homo sapiens
ggagcagagctgggcttggctg

SEQ ID NO: 7950170 - DNA, 22 bp, Homo sapiens
ggagcagagctgggcttggctg

SEQ ID NO: 7950171 - DNA, 22 bp, Homo sapiens
ggagcagagctgggcttggctg

SEQ ID NO: 7950172 - DNA, 22 bp, Homo sapiens
ggagcagatgtcttcatggcct

SEQ ID NO: 7950173 - DNA, 22 bp, Homo sapiens
ggagttggaggctccagggaac

SEQ ID NO: 7950174 - DNA, 23 bp, Homo sapiens
ggagttggattgtacttgctgct

SEQ ID NO: 7950175 - DNA, 22 bp, Homo sapiens
ggagttggaggctccagggaac

SEQ ID NO: 7950176 - DNA, 22 bp, Homo sapiens
ggagcagatgtcttcatggcct

SEQ ID NO: 7950177 - DNA, 22 bp, Homo sapiens
ggagcagatgtcttcatggcct

SEQ ID NO: 7950178 - DNA, 22 bp, Homo sapiens
ggagcagagcatttcacagcct

SEQ ID NO: 7950179 - DNA, 22 bp, Homo sapiens
ggagcagagcatttcacagcct

SEQ ID NO: 7950180 - DNA, 22 bp, Homo sapiens
ggagcagagcatttcacagcct

SEQ ID NO: 7950181 - DNA, 22 bp, Homo sapiens
ggagcagagcatttcacagcct

SEQ ID NO: 7950182 - DNA, 22 bp, Homo sapiens
ggagcagacataaccttacaga

SEQ ID NO: 7950183 - DNA, 22 bp, Homo sapiens
ggagcagagcatttcacagcct

SEQ ID NO: 7950184 - DNA, 22 bp, Homo sapiens
ggagcagacataaccttacaga

SEQ ID NO: 7950185 - DNA, 22 bp, Homo sapiens
ggagcagagctgggcttggctg

SEQ ID NO: 7950186 - DNA, 22 bp, Homo sapiens
ggagcagagctgggcttggctg

SEQ ID NO: 7950187 - DNA, 22 bp, Homo sapiens
ggagcagagctcttcatctgca

SEQ ID NO: 7950188 - DNA, 22 bp, Homo sapiens
ggagcagagctcttcatctgca

SEQ ID NO: 7950189 - DNA, 22 bp, Homo sapiens
ggagcagagctcttcatctgca

SEQ ID NO: 7950190 - DNA, 22 bp, Homo sapiens
ggagcagagcatttcacagcct

SEQ ID NO: 7950191 - DNA, 22 bp, Homo sapiens
ggagttggtggcccggaatctc

SEQ ID NO: 7950192 - DNA, 23 bp, Homo sapiens
ggagttggattgtacttgctgct

SEQ ID NO: 7950193 - DNA, 23 bp, Homo sapiens
ggagttggattgtacttgctgct

SEQ ID NO: 7950194 - DNA, 19 bp, Homo sapiens
ggagtttccaatgggtaaa

SEQ ID NO: 7950195 - DNA, 22 bp, Homo sapiens
ggatctggggctctgctgctca

SEQ ID NO: 7950196 - DNA, 22 bp, Homo sapiens
ggatctgttttgcctctgaggg

SEQ ID NO: 7950197 - DNA, 22 bp, Homo sapiens
ggatctggggtagagcagtggg

SEQ ID NO: 7950198 - DNA, 22 bp, Homo sapiens
ggatctgttttgcctctgaggg

SEQ ID NO: 7950199 - DNA, 22 bp, Homo sapiens
ggatgacaaggaaagcaaacca

SEQ ID NO: 7950200 - DNA, 22 bp, Homo sapiens
ggatctttaagttcttttccat

SEQ ID NO: 7950201 - DNA, 22 bp, Homo sapiens
ggatgacacagttagaaagaga

SEQ ID NO: 7950202 - DNA, 19 bp, Homo sapiens
ggatgagggtcaggcatag

SEQ ID NO: 7950203 - DNA, 19 bp, Homo sapiens
ggatgagggtcaggcatag

SEQ ID NO: 7950204 - DNA, 19 bp, Homo sapiens
ggatgagggtcaggcatag

SEQ ID NO: 7950205 - DNA, 22 bp, Homo sapiens
ggatgaggaagattactgagaa

SEQ ID NO: 7950206 - DNA, 22 bp, Homo sapiens
ggatgaggaagattactgagaa

SEQ ID NO: 7950207 - DNA, 22 bp, Homo sapiens
ggatgaggaagattactgagaa

SEQ ID NO: 7950208 - DNA, 22 bp, Homo sapiens
ggatgaggaaaccacagtgtcc

SEQ ID NO: 7950209 - DNA, 22 bp, Homo sapiens
ggatgaggaaaccacagtgtcc

SEQ ID NO: 7950210 - DNA, 22 bp, Homo sapiens
ggatgaggaaaccacagtgtcc

SEQ ID NO: 7950211 - DNA, 22 bp, Homo sapiens
ggatgacccgagtctggggaac

SEQ ID NO: 7950212 - DNA, 22 bp, Homo sapiens
ggatgacagataacagtattaa

SEQ ID NO: 7950213 - DNA, 22 bp, Homo sapiens
ggatgacagctcttccatgtgg

SEQ ID NO: 7950214 - DNA, 22 bp, Homo sapiens
ggatgacagcaagggggtgaag

SEQ ID NO: 7950215 - DNA, 22 bp, Homo sapiens
ggagatggtggaagctggtgca

SEQ ID NO: 7950216 - DNA, 22 bp, Homo sapiens
ggagatggtggaagctggtgca

SEQ ID NO: 7950217 - DNA, 22 bp, Homo sapiens
ggagatggtggaagctggtgca

SEQ ID NO: 7950218 - DNA, 22 bp, Homo sapiens
ggagatggtggaagctggtgca

SEQ ID NO: 7950219 - DNA, 22 bp, Homo sapiens
ggagatggtggaagctggtgca

SEQ ID NO: 7950220 - DNA, 22 bp, Homo sapiens
ggagatggtggaagctggtgca

SEQ ID NO: 7950221 - DNA, 22 bp, Homo sapiens
ggagatggtggaagctggtgca

SEQ ID NO: 7950222 - DNA, 21 bp, Homo sapiens
ggagatgttgtgcaggagggt

SEQ ID NO: 7950223 - DNA, 22 bp, Homo sapiens
ggagatgtagtgtcactggact

SEQ ID NO: 7950224 - DNA, 22 bp, Homo sapiens
ggagatgtagtgtcactggact

SEQ ID NO: 7950225 - DNA, 22 bp, Homo sapiens
ggagatgtagtgtcactggact

SEQ ID NO: 7950226 - DNA, 22 bp, Homo sapiens
ggagcaagaggtggtgaaaaat

SEQ ID NO: 7950227 - DNA, 22 bp, Homo sapiens
ggagcaaatgccaagtgggagg

SEQ ID NO: 7950228 - DNA, 22 bp, Homo sapiens
ggagcactttctaggagaagcc

SEQ ID NO: 7950229 - DNA, 22 bp, Homo sapiens
ggagcaccctgctcagccaagc

SEQ ID NO: 7950230 - DNA, 22 bp, Homo sapiens
ggagcaccctgctcagccaagc

SEQ ID NO: 7950231 - DNA, 22 bp, Homo sapiens
ggagcaagtcccaggcactagt

SEQ ID NO: 7950232 - DNA, 22 bp, Homo sapiens
ggagcaagtcccaggcactagt

SEQ ID NO: 7950233 - DNA, 22 bp, Homo sapiens
ggagcacagccttgccagtacc

SEQ ID NO: 7950234 - DNA, 22 bp, Homo sapiens
ggagcacagccttgccagtacc

SEQ ID NO: 7950235 - DNA, 22 bp, Homo sapiens
ggagcacaccgggagcttgcct

SEQ ID NO: 7950236 - DNA, 22 bp, Homo sapiens
ggagatggagtggattcagcag

SEQ ID NO: 7950237 - DNA, 22 bp, Homo sapiens
ggagatggagtggattcagcag

SEQ ID NO: 7950238 - DNA, 22 bp, Homo sapiens
ggagatggagtggattcagcag

SEQ ID NO: 7950239 - DNA, 22 bp, Homo sapiens
ggagaggcttggcccagcctgg

SEQ ID NO: 7950240 - DNA, 22 bp, Homo sapiens
ggagaggcttccagagtcgtgc

SEQ ID NO: 7950241 - DNA, 22 bp, Homo sapiens
ggagatggccacgtcactcagt

SEQ ID NO: 7950242 - DNA, 22 bp, Homo sapiens
ggagatggccaaaaacacaaat

SEQ ID NO: 7950243 - DNA, 22 bp, Homo sapiens
ggagatggccaaaaacacaaat

SEQ ID NO: 7950244 - DNA, 22 bp, Homo sapiens
ggagatggcaagaagttattag

SEQ ID NO: 7950245 - DNA, 22 bp, Homo sapiens
ggagatggcaagaagttattag

SEQ ID NO: 7950246 - DNA, 22 bp, Homo sapiens
ggagatggctggcaggtagatg

SEQ ID NO: 7950247 - DNA, 22 bp, Homo sapiens
ggagatggctggcaggtagatg

SEQ ID NO: 7950248 - DNA, 22 bp, Homo sapiens
ggagatggctggcaggtagatg

SEQ ID NO: 7950249 - DNA, 22 bp, Homo sapiens
ggagatggctctgcaaggtcta

SEQ ID NO: 7950250 - DNA, 22 bp, Homo sapiens
ggagatggccacgtcactcagt

SEQ ID NO: 7950251 - DNA, 22 bp, Homo sapiens
ggagatggccacgtcactcagt

SEQ ID NO: 7950252 - DNA, 22 bp, Homo sapiens
ggagatggctctgcaaggtcta

SEQ ID NO: 7950253 - DNA, 22 bp, Homo sapiens
ggagatggctctgcaaggtcta

SEQ ID NO: 7950254 - DNA, 22 bp, Homo sapiens
ggagatggctctgcaaggtcta

SEQ ID NO: 7950255 - DNA, 22 bp, Homo sapiens
ggagatggctctgcaaggtcta

SEQ ID NO: 7950256 - DNA, 22 bp, Homo sapiens
ggagatggctggcaggtagatg

SEQ ID NO: 7950257 - DNA, 22 bp, Homo sapiens
ggagatggctggcaggtagatg

SEQ ID NO: 7950258 - DNA, 22 bp, Homo sapiens
ggagatgggggattttacagcg

SEQ ID NO: 7950259 - DNA, 22 bp, Homo sapiens
ggagatgggggattttacagcg

SEQ ID NO: 7950260 - DNA, 22 bp, Homo sapiens
ggagatggctggcaggtagatg

SEQ ID NO: 7950261 - DNA, 22 bp, Homo sapiens
ggagatggtctgttctcatatt

SEQ ID NO: 7950262 - DNA, 21 bp, Homo sapiens
ggagatgggtatcgcctgggc

SEQ ID NO: 7950263 - DNA, 22 bp, Homo sapiens
ggagatggtctgttctcatatt

SEQ ID NO: 7950264 - DNA, 22 bp, Homo sapiens
ggagatggtctgttctcatatt

SEQ ID NO: 7950265 - DNA, 21 bp, Homo sapiens
ggagatgggtatcgcctgggc

SEQ ID NO: 7950266 - DNA, 21 bp, Homo sapiens
ggagatgggtatcgcctgggc

SEQ ID NO: 7950267 - DNA, 21 bp, Homo sapiens
ggagatgggtatcgcctgggc

SEQ ID NO: 7950268 - DNA, 21 bp, Homo sapiens
ggagatgggtatcgcctgggc

SEQ ID NO: 7950269 - DNA, 21 bp, Homo sapiens
ggagatgggtatcgcctgggc

SEQ ID NO: 7950270 - DNA, 21 bp, Homo sapiens
ggagatgggtatcgcctgggc

SEQ ID NO: 7950271 - DNA, 22 bp, Homo sapiens
ggatgcaggaacacagcgacct

SEQ ID NO: 7950272 - DNA, 22 bp, Homo sapiens
ggatgcaggaacacagcgacct

SEQ ID NO: 7950273 - DNA, 22 bp, Homo sapiens
ggatgcaggacggcatggatgt

SEQ ID NO: 7950274 - DNA, 22 bp, Homo sapiens
ggatgcaggaacacagcgacct

SEQ ID NO: 7950275 - DNA, 22 bp, Homo sapiens
ggatgcaggaacacagcgacct

SEQ ID NO: 7950276 - DNA, 22 bp, Homo sapiens
ggatgcaggaacacagcgacct

SEQ ID NO: 7950277 - DNA, 22 bp, Homo sapiens
ggatgcaggaacacagcgacct

SEQ ID NO: 7950278 - DNA, 22 bp, Homo sapiens
ggatgaggtagatgaacaaggg

SEQ ID NO: 7950279 - DNA, 22 bp, Homo sapiens
ggatgaggtagatgaacaaggg

SEQ ID NO: 7950280 - DNA, 22 bp, Homo sapiens
ggatgaggtagatgaacaaggg

SEQ ID NO: 7950281 - DNA, 22 bp, Homo sapiens
ggatgaggtagatgaacaaggg

SEQ ID NO: 7950282 - DNA, 22 bp, Homo sapiens
ggatgcaggggcagcagagcct

SEQ ID NO: 7950283 - DNA, 22 bp, Homo sapiens
ggatgcaggagttgaagaagga

SEQ ID NO: 7950284 - DNA, 22 bp, Homo sapiens
ggatgcaggacggcatggatgt

SEQ ID NO: 7950285 - DNA, 22 bp, Homo sapiens
ggatgcaggaggtcggggagca

SEQ ID NO: 7950286 - DNA, 21 bp, Homo sapiens
ggatgccacgaagcaccagga

SEQ ID NO: 7950287 - DNA, 22 bp, Homo sapiens
ggatgccatttgggtctggctt

SEQ ID NO: 7950288 - DNA, 22 bp, Homo sapiens
ggatgccatttgggtctggctt

SEQ ID NO: 7950289 - DNA, 22 bp, Homo sapiens
ggatgcaggggcagcagagcct

SEQ ID NO: 7950290 - DNA, 22 bp, Homo sapiens
ggatgcaggggcagcagagcct

SEQ ID NO: 7950291 - DNA, 22 bp, Homo sapiens
ggatgcaggggcagcagagcct

SEQ ID NO: 7950292 - DNA, 22 bp, Homo sapiens
ggatgcaggggcagcagagcct

SEQ ID NO: 7950293 - DNA, 22 bp, Homo sapiens
ggatgcagtgaggagcccgcgc

SEQ ID NO: 7950294 - DNA, 22 bp, Homo sapiens
ggatgcagtgaggagcccgcgc

SEQ ID NO: 7950295 - DNA, 23 bp, Homo sapiens
ggatggacgtgatgccttagcca

SEQ ID NO: 7950296 - DNA, 18 bp, Homo sapiens
ggatgctgtgtgctcctt

SEQ ID NO: 7950297 - DNA, 23 bp, Homo sapiens
ggatggacgtgatgccttagcca

SEQ ID NO: 7950298 - DNA, 22 bp, Homo sapiens
ggatgcttaggttgttttatta

SEQ ID NO: 7950299 - DNA, 22 bp, Homo sapiens
ggatggagatgaccatggtgac

SEQ ID NO: 7950300 - DNA, 22 bp, Homo sapiens
ggatggagatgaccatggtgac

SEQ ID NO: 7950301 - DNA, 23 bp, Homo sapiens
ggatggacgtgatgccttagcca

SEQ ID NO: 7950302 - DNA, 23 bp, Homo sapiens
ggatggacgtgatgccttagcca

SEQ ID NO: 7950303 - DNA, 18 bp, Homo sapiens
ggatgctgtgtgctcctt

SEQ ID NO: 7950304 - DNA, 18 bp, Homo sapiens
ggatgctgtgtgctcctt

SEQ ID NO: 7950305 - DNA, 22 bp, Homo sapiens
ggatgctgtgcactactctggc

SEQ ID NO: 7950306 - DNA, 22 bp, Homo sapiens
ggatgctgtctaagctgaggac

SEQ ID NO: 7950307 - DNA, 22 bp, Homo sapiens
ggatgctgtctaagctgaggac

SEQ ID NO: 7950308 - DNA, 22 bp, Homo sapiens
ggatgctgtctaagctgaggac

SEQ ID NO: 7950309 - DNA, 22 bp, Homo sapiens
ggatgctgtctaagctgaggac

SEQ ID NO: 7950310 - DNA, 22 bp, Homo sapiens
ggatgctggggaccaatctctg

SEQ ID NO: 7950311 - DNA, 22 bp, Homo sapiens
ggatgctgtctaagctgaggac

SEQ ID NO: 7950312 - DNA, 22 bp, Homo sapiens
ggatgctgtctaagctgaggac

SEQ ID NO: 7950313 - DNA, 22 bp, Homo sapiens
ggatgctggggaccaatctctg

SEQ ID NO: 7950314 - DNA, 22 bp, Homo sapiens
ggatgctgggagacagcaggca

SEQ ID NO: 7950315 - DNA, 22 bp, Homo sapiens
ggatgctgggagacagcaggca

SEQ ID NO: 7950316 - DNA, 22 bp, Homo sapiens
ggatgctgggagacagcaggca

SEQ ID NO: 7950317 - DNA, 22 bp, Homo sapiens
ggatgctgggagacagcaggca

SEQ ID NO: 7950318 - DNA, 22 bp, Homo sapiens
ggatgctgggagacagcaggca

SEQ ID NO: 7950319 - DNA, 22 bp, Homo sapiens
ggatgctgggagacagcaggca

SEQ ID NO: 7950320 - DNA, 22 bp, Homo sapiens
ggatgctgctatcaggcttcga

SEQ ID NO: 7950321 - DNA, 22 bp, Homo sapiens
ggatgctgctatcaggcttcga

SEQ ID NO: 7950322 - DNA, 22 bp, Homo sapiens
ggatgctgctgcacatcctgca

SEQ ID NO: 7950323 - DNA, 22 bp, Homo sapiens
ggatgctgctgcacatcctgca

SEQ ID NO: 7950324 - DNA, 22 bp, Homo sapiens
ggatgctgactttggagcatgg

SEQ ID NO: 7950325 - DNA, 22 bp, Homo sapiens
ggatgctgactttggagcatgg

SEQ ID NO: 7950326 - DNA, 22 bp, Homo sapiens
ggatgctgctatcaggcttcga

SEQ ID NO: 7950327 - DNA, 22 bp, Homo sapiens
ggatgctgattccagtctccag

SEQ ID NO: 7950328 - DNA, 22 bp, Homo sapiens
ggatgctgatatagagcattct

SEQ ID NO: 7950329 - DNA, 22 bp, Homo sapiens
ggatgctgactttggagcatgg

SEQ ID NO: 7950330 - DNA, 22 bp, Homo sapiens
ggatgttgattgaatggccatt

SEQ ID NO: 7950331 - DNA, 22 bp, Homo sapiens
ggatgggaacttggtagggcat

SEQ ID NO: 7950332 - DNA, 22 bp, Homo sapiens
ggatgggaacttggtagggcat

SEQ ID NO: 7950333 - DNA, 22 bp, Homo sapiens
ggatgggaacttggtagggcat

SEQ ID NO: 7950334 - DNA, 22 bp, Homo sapiens
ggatgggaacttggtagggcat

SEQ ID NO: 7950335 - DNA, 22 bp, Homo sapiens
ggatgggaacttggtagggcat

SEQ ID NO: 7950336 - DNA, 22 bp, Homo sapiens
ggatggccttcttgctcaggaa

SEQ ID NO: 7950337 - DNA, 22 bp, Homo sapiens
ggatggccttcttgctcaggaa

SEQ ID NO: 7950338 - DNA, 22 bp, Homo sapiens
ggatggccttcttgctcaggaa

SEQ ID NO: 7950339 - DNA, 20 bp, Homo sapiens
ggatggccggaccagagcct

SEQ ID NO: 7950340 - DNA, 22 bp, Homo sapiens
ggatggctccacagtttctccc

SEQ ID NO: 7950341 - DNA, 22 bp, Homo sapiens
ggatggctccagaaagcagggt

SEQ ID NO: 7950342 - DNA, 20 bp, Homo sapiens
ggatggctccacatcatttt

SEQ ID NO: 7950343 - DNA, 22 bp, Homo sapiens
ggatggctgtaaaaggtgggaa

SEQ ID NO: 7950344 - DNA, 22 bp, Homo sapiens
ggatggcttgcatttgaggact

SEQ ID NO: 7950345 - DNA, 22 bp, Homo sapiens
ggatggcttgcatttgaggact

SEQ ID NO: 7950346 - DNA, 22 bp, Homo sapiens
ggattgagagcactggtagctg

SEQ ID NO: 7950347 - DNA, 22 bp, Homo sapiens
ggattgaaggcccttaactgat

SEQ ID NO: 7950348 - DNA, 20 bp, Homo sapiens
ggattctgactgtgaagagg

SEQ ID NO: 7950349 - DNA, 22 bp, Homo sapiens
ggattccatggtcaggaaatag

SEQ ID NO: 7950350 - DNA, 22 bp, Homo sapiens
ggattccatggtcaggaaatag

SEQ ID NO: 7950351 - DNA, 22 bp, Homo sapiens
ggatgtttatcctatcttagtt

SEQ ID NO: 7950352 - DNA, 22 bp, Homo sapiens
ggatgtttgctagcattcctgg

SEQ ID NO: 7950353 - DNA, 22 bp, Homo sapiens
ggattagcttttgttcttgact

SEQ ID NO: 7950354 - DNA, 22 bp, Homo sapiens
ggattaatgagggggttccggt

SEQ ID NO: 7950355 - DNA, 22 bp, Homo sapiens
ggattcagcgaggcagcctgga

SEQ ID NO: 7950356 - DNA, 22 bp, Homo sapiens
ggattcagcgaggcagcctgga

SEQ ID NO: 7950357 - DNA, 22 bp, Homo sapiens
ggattcagataagtggaggtga

SEQ ID NO: 7950358 - DNA, 22 bp, Homo sapiens
ggatggcagtctgcatgagaaa

SEQ ID NO: 7950359 - DNA, 22 bp, Homo sapiens
ggatggcatgttgggctctgtt

SEQ ID NO: 7950360 - DNA, 22 bp, Homo sapiens
ggatggcagtctgcatgagaaa

SEQ ID NO: 7950361 - DNA, 20 bp, Homo sapiens
ggatggccggaccagagcct

SEQ ID NO: 7950362 - DNA, 22 bp, Homo sapiens
ggatggccgagaagacagcgta

SEQ ID NO: 7950363 - DNA, 20 bp, Homo sapiens
ggatggccggaccagagcct

SEQ ID NO: 7950364 - DNA, 22 bp, Homo sapiens
ggatggcatgttgggctctgtt

SEQ ID NO: 7950365 - DNA, 22 bp, Homo sapiens
ggatggaggttctcagatgctc

SEQ ID NO: 7950366 - DNA, 21 bp, Homo sapiens
ggatggatagggaagagattt

SEQ ID NO: 7950367 - DNA, 22 bp, Homo sapiens
ggatggaggttctcagatgctc

SEQ ID NO: 7950368 - DNA, 22 bp, Homo sapiens
ggatggcagacagtgagtggct

SEQ ID NO: 7950369 - DNA, 22 bp, Homo sapiens
ggatggcaggacaaggacccag

SEQ ID NO: 7950370 - DNA, 22 bp, Homo sapiens
ggatggcagacagtgagtggct

SEQ ID NO: 7950371 - DNA, 22 bp, Homo sapiens
ggatggcagacagtgagtggct

SEQ ID NO: 7950372 - DNA, 22 bp, Homo sapiens
ggatggcaggacaaggacccag

SEQ ID NO: 7950373 - DNA, 22 bp, Homo sapiens
ggatggcagtctgcatgagaaa

SEQ ID NO: 7950374 - DNA, 22 bp, Homo sapiens
ggatggcagtctgcatgagaaa

SEQ ID NO: 7950375 - DNA, 22 bp, Homo sapiens
ggatggaggttctcagatgctc

SEQ ID NO: 7950376 - DNA, 22 bp, Homo sapiens
ggatggaggttctcagatgctc

SEQ ID NO: 7950377 - DNA, 22 bp, Homo sapiens
ggatggaggttctcagatgctc

SEQ ID NO: 7950378 - DNA, 22 bp, Homo sapiens
ggatggaggttctcagatgctc

SEQ ID NO: 7950379 - DNA, 23 bp, Homo sapiens
ggatggagccactttgaaaccac

SEQ ID NO: 7950380 - DNA, 22 bp, Homo sapiens
ggatggaggttctcagatgctc

SEQ ID NO: 7950381 - DNA, 22 bp, Homo sapiens
ggatggagatgaccatggtgac

SEQ ID NO: 7950382 - DNA, 22 bp, Homo sapiens
ggatggagatgaccatggtgac

SEQ ID NO: 7950383 - DNA, 23 bp, Homo sapiens
ggatggagccactttgaaaccac

SEQ ID NO: 7950384 - DNA, 22 bp, Homo sapiens
ggatggagatgaccatggtgac

SEQ ID NO: 7950385 - DNA, 22 bp, Homo sapiens
ggatggagatgaccatggtgac

SEQ ID NO: 7950386 - DNA, 22 bp, Homo sapiens
ggatggagatgaccatggtgac

SEQ ID NO: 7950387 - DNA, 22 bp, Homo sapiens
gggaagggagctgggtatttag

SEQ ID NO: 7950388 - DNA, 22 bp, Homo sapiens
gggaagggagggacctcagtct

SEQ ID NO: 7950389 - DNA, 22 bp, Homo sapiens
gggaagggagctgggtatttag

SEQ ID NO: 7950390 - DNA, 22 bp, Homo sapiens
gggaagggagctgggtatttag

SEQ ID NO: 7950391 - DNA, 22 bp, Homo sapiens
gggaagggagctgggtatttag

SEQ ID NO: 7950392 - DNA, 22 bp, Homo sapiens
gggaagggagggacctcagtct

SEQ ID NO: 7950393 - DNA, 22 bp, Homo sapiens
gggaagggagggacctcagtct

SEQ ID NO: 7950394 - DNA, 22 bp, Homo sapiens
gggaagggagggacctcagtct

SEQ ID NO: 7950395 - DNA, 22 bp, Homo sapiens
gggaagggagggacctcagtct

SEQ ID NO: 7950396 - DNA, 22 bp, Homo sapiens
gggaagggagggcctccagtca

SEQ ID NO: 7950397 - DNA, 22 bp, Homo sapiens
gggaagggagggcctccagtca

SEQ ID NO: 7950398 - DNA, 22 bp, Homo sapiens
gggaagggagggcctccagtca

SEQ ID NO: 7950399 - DNA, 22 bp, Homo sapiens
gggaagggagggacctcagtct

SEQ ID NO: 7950400 - DNA, 22 bp, Homo sapiens
gggaagggagggacctcagtct

SEQ ID NO: 7950401 - DNA, 22 bp, Homo sapiens
gggaagggagggacctcagtct

SEQ ID NO: 7950402 - DNA, 22 bp, Homo sapiens
gggaagggagggacctcagtct

SEQ ID NO: 7950403 - DNA, 22 bp, Homo sapiens
gggaagggacttgtttaaggtc

SEQ ID NO: 7950404 - DNA, 22 bp, Homo sapiens
gggaagggacttgtttaaggtc

SEQ ID NO: 7950405 - DNA, 22 bp, Homo sapiens
gggaagggacttgtttaaggtc

SEQ ID NO: 7950406 - DNA, 22 bp, Homo sapiens
gggaagggacttgtttaaggtc

SEQ ID NO: 7950407 - DNA, 22 bp, Homo sapiens
gggaaggctgcctgagggatgg

SEQ ID NO: 7950408 - DNA, 22 bp, Homo sapiens
gggaaggctgcctgagggatgg

SEQ ID NO: 7950409 - DNA, 22 bp, Homo sapiens
gggaaggctgcctgagggatgg

SEQ ID NO: 7950410 - DNA, 22 bp, Homo sapiens
gggaaggctgcctgagggatgg

SEQ ID NO: 7950411 - DNA, 22 bp, Homo sapiens
gggaaggctgcctgagggatgg

SEQ ID NO: 7950412 - DNA, 22 bp, Homo sapiens
ggctttgcctggaatttccttg

SEQ ID NO: 7950413 - DNA, 23 bp, Homo sapiens
ggctttgccacatattgaccatg

SEQ ID NO: 7950414 - DNA, 22 bp, Homo sapiens
ggctttgcagcctcattgctct

SEQ ID NO: 7950415 - DNA, 22 bp, Homo sapiens
ggctttgacatgctgaattaaa

SEQ ID NO: 7950416 - DNA, 22 bp, Homo sapiens
ggctttgacatgctgaattaaa

SEQ ID NO: 7950417 - DNA, 22 bp, Homo sapiens
ggctttgacatgctgaattaaa

SEQ ID NO: 7950418 - DNA, 22 bp, Homo sapiens
ggctttgacatgctgaattaaa

SEQ ID NO: 7950419 - DNA, 22 bp, Homo sapiens
ggctttgaggatacagaggaaa

SEQ ID NO: 7950420 - DNA, 22 bp, Homo sapiens
ggctttgaggatacagaggaaa

SEQ ID NO: 7950421 - DNA, 22 bp, Homo sapiens
ggctttgaggatacagaggaaa

SEQ ID NO: 7950422 - DNA, 22 bp, Homo sapiens
ggctttgatgtggtgtcaattt

SEQ ID NO: 7950423 - DNA, 22 bp, Homo sapiens
ggctttctgagtcaaacactga

SEQ ID NO: 7950424 - DNA, 22 bp, Homo sapiens
ggctttctgtctgcgtctgtgt

SEQ ID NO: 7950425 - DNA, 22 bp, Homo sapiens
ggctttctgtctgcgtctgtgt

SEQ ID NO: 7950426 - DNA, 20 bp, Homo sapiens
ggctttctgtgatcctcagt

SEQ ID NO: 7950427 - DNA, 22 bp, Homo sapiens
ggctttcttgttaaatgtccat

SEQ ID NO: 7950428 - DNA, 22 bp, Homo sapiens
ggctttctccttgccttagtct

SEQ ID NO: 7950429 - DNA, 22 bp, Homo sapiens
ggctttctccttgccttagtct

SEQ ID NO: 7950430 - DNA, 22 bp, Homo sapiens
ggctttctcacagcatggcagc

SEQ ID NO: 7950431 - DNA, 22 bp, Homo sapiens
ggctttctcacagcatggcagc

SEQ ID NO: 7950432 - DNA, 22 bp, Homo sapiens
ggctttctatgaactcaaaggc

SEQ ID NO: 7950433 - DNA, 22 bp, Homo sapiens
ggctttctagatctagctctgt

SEQ ID NO: 7950434 - DNA, 22 bp, Homo sapiens
ggctttctagatctagctctgt

SEQ ID NO: 7950435 - DNA, 22 bp, Homo sapiens
ggctttcaacacaggctttcct

SEQ ID NO: 7950436 - DNA, 22 bp, Homo sapiens
ggctgtgcctcaaggctactca

SEQ ID NO: 7950437 - DNA, 22 bp, Homo sapiens
ggctgtgcctcaaggctactca

SEQ ID NO: 7950438 - DNA, 22 bp, Homo sapiens
ggctgtgcctcaaggctactca

SEQ ID NO: 7950439 - DNA, 22 bp, Homo sapiens
ggctttatattgtttgagcaga

SEQ ID NO: 7950440 - DNA, 22 bp, Homo sapiens
ggctttatagggtagaggatca

SEQ ID NO: 7950441 - DNA, 22 bp, Homo sapiens
ggctgtgcgggcagccgtggga

SEQ ID NO: 7950442 - DNA, 22 bp, Homo sapiens
ggctgtgcctctggcagcacat

SEQ ID NO: 7950443 - DNA, 22 bp, Homo sapiens
ggctttatgcagggatagaaat

SEQ ID NO: 7950444 - DNA, 22 bp, Homo sapiens
ggctttatgcagggatagaaat

SEQ ID NO: 7950445 - DNA, 22 bp, Homo sapiens
ggctttatgcacagcagatggt

SEQ ID NO: 7950446 - DNA, 22 bp, Homo sapiens
ggctttatcaaatgagaccctg

SEQ ID NO: 7950447 - DNA, 22 bp, Homo sapiens
ggctttatattgtttgagcaga

SEQ ID NO: 7950448 - DNA, 22 bp, Homo sapiens
ggctttatattgtttgagcaga

SEQ ID NO: 7950449 - DNA, 22 bp, Homo sapiens
ggctttatttcactgtaccata

SEQ ID NO: 7950450 - DNA, 22 bp, Homo sapiens
ggctttattatgtggccatgtg

SEQ ID NO: 7950451 - DNA, 22 bp, Homo sapiens
ggctttattatgtggccatgtg

SEQ ID NO: 7950452 - DNA, 22 bp, Homo sapiens
ggctttattatgtggccatgtg

SEQ ID NO: 7950453 - DNA, 22 bp, Homo sapiens
ggctttattttgcatgaatgct

SEQ ID NO: 7950454 - DNA, 22 bp, Homo sapiens
ggctttatttgcagccattgtt

SEQ ID NO: 7950455 - DNA, 22 bp, Homo sapiens
ggctttatttgcagccattgtt

SEQ ID NO: 7950456 - DNA, 21 bp, Homo sapiens
ggctttatgctcacccagcct

SEQ ID NO: 7950457 - DNA, 22 bp, Homo sapiens
ggctttatgtttttcatgtggt

SEQ ID NO: 7950458 - DNA, 22 bp, Homo sapiens
ggctttattaactcatccgtaa

SEQ ID NO: 7950459 - DNA, 22 bp, Homo sapiens
ggctttattaagcagggtaagt

SEQ ID NO: 7950460 - DNA, 19 bp, Homo sapiens
gggagctgaggtctttggt

SEQ ID NO: 7950461 - DNA, 19 bp, Homo sapiens
gggagctgaggtctttggt

SEQ ID NO: 7950462 - DNA, 19 bp, Homo sapiens
gggagctgaggtctttggt

SEQ ID NO: 7950463 - DNA, 22 bp, Homo sapiens
gggagctggagctggaagactc

SEQ ID NO: 7950464 - DNA, 22 bp, Homo sapiens
gggagctggagctggaagactc

SEQ ID NO: 7950465 - DNA, 22 bp, Homo sapiens
gggagctggagctggaagactc

SEQ ID NO: 7950466 - DNA, 22 bp, Homo sapiens
gggagctggagctggaagactc

SEQ ID NO: 7950467 - DNA, 22 bp, Homo sapiens
gggagctggagctggaagactc

SEQ ID NO: 7950468 - DNA, 22 bp, Homo sapiens
gggagctggagctggaagactc

SEQ ID NO: 7950469 - DNA, 22 bp, Homo sapiens
gggagctggagctggaagactc

SEQ ID NO: 7950470 - DNA, 22 bp, Homo sapiens
gggagctggagctggaagactc

SEQ ID NO: 7950471 - DNA, 22 bp, Homo sapiens
gggagctggagctggaagactc

SEQ ID NO: 7950472 - DNA, 22 bp, Homo sapiens
gggagctggagctggaagactc

SEQ ID NO: 7950473 - DNA, 22 bp, Homo sapiens
gggagctgagggacctctgtgg

SEQ ID NO: 7950474 - DNA, 22 bp, Homo sapiens
gggagctgagggacctctgtgg

SEQ ID NO: 7950475 - DNA, 22 bp, Homo sapiens
gggagctgagggacctctgtgg

SEQ ID NO: 7950476 - DNA, 22 bp, Homo sapiens
gggagctgagggacctctgtgg

SEQ ID NO: 7950477 - DNA, 22 bp, Homo sapiens
gggagctgaggagccccgtcgg

SEQ ID NO: 7950478 - DNA, 22 bp, Homo sapiens
gggagctgaggagccccgtcgg

SEQ ID NO: 7950479 - DNA, 22 bp, Homo sapiens
gggagctgaggagccccgtcgg

SEQ ID NO: 7950480 - DNA, 22 bp, Homo sapiens
gggagctgagctggaagagaat

SEQ ID NO: 7950481 - DNA, 22 bp, Homo sapiens
gggagctgagctggaagagaat

SEQ ID NO: 7950482 - DNA, 22 bp, Homo sapiens
gggagctgagctctgagccacg

SEQ ID NO: 7950483 - DNA, 22 bp, Homo sapiens
gggagctgagctctgagccacg

SEQ ID NO: 7950484 - DNA, 22 bp, Homo sapiens
gggagctgagctctgagccacg

SEQ ID NO: 7950485 - DNA, 22 bp, Homo sapiens
gggagctgagctctgagccacg

SEQ ID NO: 7950486 - DNA, 22 bp, Homo sapiens
gggagctgagctggaagagaat

SEQ ID NO: 7950487 - DNA, 22 bp, Homo sapiens
gggagctgagctggaagagaat

SEQ ID NO: 7950488 - DNA, 22 bp, Homo sapiens
gggagctgagctggaagagaat

SEQ ID NO: 7950489 - DNA, 22 bp, Homo sapiens
gggagctgagctggaagagaat

SEQ ID NO: 7950490 - DNA, 22 bp, Homo sapiens
gggagctgagctggaagagaat

SEQ ID NO: 7950491 - DNA, 22 bp, Homo sapiens
gggagctgagctggaagagaat

SEQ ID NO: 7950492 - DNA, 22 bp, Homo sapiens
gggagctgagctggaagagaat

SEQ ID NO: 7950493 - DNA, 22 bp, Homo sapiens
gggagctgagctctgagccacg

SEQ ID NO: 7950494 - DNA, 22 bp, Homo sapiens
gggagctgagctctgagccacg

SEQ ID NO: 7950495 - DNA, 22 bp, Homo sapiens
gggagctgagctctgagccacg

SEQ ID NO: 7950496 - DNA, 22 bp, Homo sapiens
gggagctgagctctgagccacg

SEQ ID NO: 7950497 - DNA, 22 bp, Homo sapiens
gggagctgagctctgagccacg

SEQ ID NO: 7950498 - DNA, 22 bp, Homo sapiens
gggagctgacctgcaggttccc

SEQ ID NO: 7950499 - DNA, 22 bp, Homo sapiens
gggagctgacctgcaggttccc

SEQ ID NO: 7950500 - DNA, 22 bp, Homo sapiens
gggagctgacctgcaggttccc

SEQ ID NO: 7950501 - DNA, 22 bp, Homo sapiens
gggagctgacctgcaggttccc

SEQ ID NO: 7950502 - DNA, 21 bp, Homo sapiens
gggagctgacagcagcacggc

SEQ ID NO: 7950503 - DNA, 21 bp, Homo sapiens
gggagctgacagcagcacggc

SEQ ID NO: 7950504 - DNA, 21 bp, Homo sapiens
gggagctgacagcagcacggc

SEQ ID NO: 7950505 - DNA, 22 bp, Homo sapiens
gggaagtgccctcttcaggaga

SEQ ID NO: 7950506 - DNA, 22 bp, Homo sapiens
gggaagtgatggagccaggatt

SEQ ID NO: 7950507 - DNA, 17 bp, Homo sapiens
gggaagtggagaaagct

SEQ ID NO: 7950508 - DNA, 17 bp, Homo sapiens
gggaagtggagaaagct

SEQ ID NO: 7950509 - DNA, 17 bp, Homo sapiens
gggaagtggagaaagct

SEQ ID NO: 7950510 - DNA, 17 bp, Homo sapiens
gggaagtggagaaagct

SEQ ID NO: 7950511 - DNA, 23 bp, Homo sapiens
gggaagtggggatttgaagtcat

SEQ ID NO: 7950512 - DNA, 23 bp, Homo sapiens
gggaagtggggatttgaagtcat

SEQ ID NO: 7950513 - DNA, 22 bp, Homo sapiens
gggaagtgtgcagagttctctt

SEQ ID NO: 7950514 - DNA, 22 bp, Homo sapiens
gggaagtgtggtttctttacag

SEQ ID NO: 7950515 - DNA, 21 bp, Homo sapiens
gggagctgacagcagcacggc

SEQ ID NO: 7950516 - DNA, 21 bp, Homo sapiens
gggagctgacagcagcacggc

SEQ ID NO: 7950517 - DNA, 21 bp, Homo sapiens
gggagctgacagcagcacggc

SEQ ID NO: 7950518 - DNA, 21 bp, Homo sapiens
gggagctgacagcagcacggc

SEQ ID NO: 7950519 - DNA, 22 bp, Homo sapiens
gggaatgtaagatatatactag

SEQ ID NO: 7950520 - DNA, 21 bp, Homo sapiens
gggagctgacagcagcacggc

SEQ ID NO: 7950521 - DNA, 19 bp, Homo sapiens
gggaatgatggaagacttc

SEQ ID NO: 7950522 - DNA, 22 bp, Homo sapiens
gggaatgaggcagatagataaa

SEQ ID NO: 7950523 - DNA, 22 bp, Homo sapiens
gggaatatggaagtggacactt

SEQ ID NO: 7950524 - DNA, 22 bp, Homo sapiens
gggaagtttgtttggactggga

SEQ ID NO: 7950525 - DNA, 22 bp, Homo sapiens
gggaagtttgtgggaggaatat

SEQ ID NO: 7950526 - DNA, 22 bp, Homo sapiens
gggaataggacaaatgaaggag

SEQ ID NO: 7950527 - DNA, 22 bp, Homo sapiens
gggaatgaccttaataagtagg

SEQ ID NO: 7950528 - DNA, 22 bp, Homo sapiens
gggaatgagagtcagcccagga

SEQ ID NO: 7950529 - DNA, 22 bp, Homo sapiens
gggaatgagagtcagcccagga

SEQ ID NO: 7950530 - DNA, 22 bp, Homo sapiens
gggaagtgagctggaatcaagg

SEQ ID NO: 7950531 - DNA, 22 bp, Homo sapiens
gggaagtgagctggaatcaagg

SEQ ID NO: 7950532 - DNA, 22 bp, Homo sapiens
gggaagtcgggttgagcactta

SEQ ID NO: 7950533 - DNA, 22 bp, Homo sapiens
gggaagtcctgaggtcaaataa

SEQ ID NO: 7950534 - DNA, 22 bp, Homo sapiens
gggaagtgaagtgtagctgtct

SEQ ID NO: 7950535 - DNA, 23 bp, Homo sapiens
gggaagtgaggagcccctcagcc

SEQ ID NO: 7950536 - DNA, 22 bp, Homo sapiens
gggaagtgatggagccaggatt

SEQ ID NO: 7950537 - DNA, 22 bp, Homo sapiens
gggaagtgatggagccaggatt

SEQ ID NO: 7950538 - DNA, 22 bp, Homo sapiens
gggaagtgatggagccaggatt

SEQ ID NO: 7950539 - DNA, 22 bp, Homo sapiens
gggaagtgatggagccaggatt

SEQ ID NO: 7950540 - DNA, 22 bp, Homo sapiens
gggaagtgatggagccaggatt

SEQ ID NO: 7950541 - DNA, 22 bp, Homo sapiens
gggaagggtgttgtcttatctt

SEQ ID NO: 7950542 - DNA, 22 bp, Homo sapiens
gggaagggtgttgtcttatctt

SEQ ID NO: 7950543 - DNA, 22 bp, Homo sapiens
gggaagggtgttgtcttatctt

SEQ ID NO: 7950544 - DNA, 22 bp, Homo sapiens
gggaagggctccttttattgca

SEQ ID NO: 7950545 - DNA, 20 bp, Homo sapiens
gggaagtcccgcctgtcttc

SEQ ID NO: 7950546 - DNA, 21 bp, Homo sapiens
gggaagtcataaaattagggc

SEQ ID NO: 7950547 - DNA, 22 bp, Homo sapiens
gggaagtcctgaggtcaaataa

SEQ ID NO: 7950548 - DNA, 22 bp, Homo sapiens
gggaaggtatttagctgctgaa

SEQ ID NO: 7950549 - DNA, 22 bp, Homo sapiens
gggaagggtgttgtcttatctt

SEQ ID NO: 7950550 - DNA, 22 bp, Homo sapiens
gggaagggagggcctccagtca

SEQ ID NO: 7950551 - DNA, 22 bp, Homo sapiens
gggaagggagggcctccagtca

SEQ ID NO: 7950552 - DNA, 22 bp, Homo sapiens
gggaagggagggcctccagtca

SEQ ID NO: 7950553 - DNA, 22 bp, Homo sapiens
gggaagggagggcctccagtca

SEQ ID NO: 7950554 - DNA, 22 bp, Homo sapiens
gggaagggctccttttattgca

SEQ ID NO: 7950555 - DNA, 22 bp, Homo sapiens
gggaagggagggcctccagtca

SEQ ID NO: 7950556 - DNA, 22 bp, Homo sapiens
gggaagggctccttttattgca

SEQ ID NO: 7950557 - DNA, 22 bp, Homo sapiens
gggaagggctccttttattgca

SEQ ID NO: 7950558 - DNA, 21 bp, Homo sapiens
gggagggatggaaatgatgtt

SEQ ID NO: 7950559 - DNA, 21 bp, Homo sapiens
gggagggatggaaatgatgtt

SEQ ID NO: 7950560 - DNA, 21 bp, Homo sapiens
gggagggatggaaatgatgtt

SEQ ID NO: 7950561 - DNA, 21 bp, Homo sapiens
gggagggatggaaatgatgtt

SEQ ID NO: 7950562 - DNA, 21 bp, Homo sapiens
gggagggatggaaatgatgtt

SEQ ID NO: 7950563 - DNA, 21 bp, Homo sapiens
gggagggatggaaatgatgtt

SEQ ID NO: 7950564 - DNA, 21 bp, Homo sapiens
gggagggatggaaatgatgtt

SEQ ID NO: 7950565 - DNA, 21 bp, Homo sapiens
gggagggatggaaatgatgtt

SEQ ID NO: 7950566 - DNA, 22 bp, Homo sapiens
gggagggattagttctgcctgg

SEQ ID NO: 7950567 - DNA, 21 bp, Homo sapiens
gggagggatggaaatgatgtt

SEQ ID NO: 7950568 - DNA, 22 bp, Homo sapiens
gggagggattagttctgcctgg

SEQ ID NO: 7950569 - DNA, 22 bp, Homo sapiens
gggagggattagttctgcctgg

SEQ ID NO: 7950570 - DNA, 22 bp, Homo sapiens
gggaggtgatggcaagcagcgg

SEQ ID NO: 7950571 - DNA, 22 bp, Homo sapiens
gggaggtgatggcaagcagcgg

SEQ ID NO: 7950572 - DNA, 22 bp, Homo sapiens
gggaggtgatggcaagcagcgg

SEQ ID NO: 7950573 - DNA, 22 bp, Homo sapiens
gggagggccaggctcacccagg

SEQ ID NO: 7950574 - DNA, 22 bp, Homo sapiens
gggagggccaggctcacccagg

SEQ ID NO: 7950575 - DNA, 22 bp, Homo sapiens
gggaggtgaaaggttgctgcag

SEQ ID NO: 7950576 - DNA, 22 bp, Homo sapiens
gggaggtgattaggaccatgta

SEQ ID NO: 7950577 - DNA, 22 bp, Homo sapiens
gggaggtgattaggaccatgta

SEQ ID NO: 7950578 - DNA, 22 bp, Homo sapiens
gggaggtgattaggaccatgta

SEQ ID NO: 7950579 - DNA, 22 bp, Homo sapiens
gggaggtgatggcaagcagcgg

SEQ ID NO: 7950580 - DNA, 22 bp, Homo sapiens
gggaggtgatggcaagcagcgg

SEQ ID NO: 7950581 - DNA, 22 bp, Homo sapiens
gggaggtgatggcaagcagcgg

SEQ ID NO: 7950582 - DNA, 22 bp, Homo sapiens
gggaggtgatggcaagcagcgg

SEQ ID NO: 7950583 - DNA, 22 bp, Homo sapiens
gggaggtgttccagtgttggta

SEQ ID NO: 7950584 - DNA, 22 bp, Homo sapiens
gggaggtgttccagtgttggta

SEQ ID NO: 7950585 - DNA, 22 bp, Homo sapiens
gggaggtgttccagtgttggta

SEQ ID NO: 7950586 - DNA, 22 bp, Homo sapiens
gggaggtgttccagtgttggta

SEQ ID NO: 7950587 - DNA, 22 bp, Homo sapiens
gggaggtgttccagtgttggta

SEQ ID NO: 7950588 - DNA, 22 bp, Homo sapiens
gggaggtgttctgccaacgcgg

SEQ ID NO: 7950589 - DNA, 22 bp, Homo sapiens
gggaggtgttccagtgttggta

SEQ ID NO: 7950590 - DNA, 22 bp, Homo sapiens
gggaggtgttccagtgttggta

SEQ ID NO: 7950591 - DNA, 22 bp, Homo sapiens
gggaggtgttccagtgttggta

SEQ ID NO: 7950592 - DNA, 22 bp, Homo sapiens
gggaggtgattaggaccatgta

SEQ ID NO: 7950593 - DNA, 22 bp, Homo sapiens
gggaggtgattaggaccatgta

SEQ ID NO: 7950594 - DNA, 22 bp, Homo sapiens
gggaggtgattaggaccatgta

SEQ ID NO: 7950595 - DNA, 22 bp, Homo sapiens
gggaggttctgttcgcacttga

SEQ ID NO: 7950596 - DNA, 22 bp, Homo sapiens
gggaggttgaggctgcagtgag

SEQ ID NO: 7950597 - DNA, 22 bp, Homo sapiens
gggaggttgaggctgcagtgag

SEQ ID NO: 7950598 - DNA, 22 bp, Homo sapiens
gggaggttgaggctgcagtgag

SEQ ID NO: 7950599 - DNA, 22 bp, Homo sapiens
gggaggttgaggctgcagtgag

SEQ ID NO: 7950600 - DNA, 22 bp, Homo sapiens
gggaggttgaggctgcagtgag

SEQ ID NO: 7950601 - DNA, 22 bp, Homo sapiens
gggcacaggagaaggatctggc

SEQ ID NO: 7950602 - DNA, 22 bp, Homo sapiens
gggcacaggagaaggatctggc

SEQ ID NO: 7950603 - DNA, 22 bp, Homo sapiens
gggcacaggagaaggatctggc

SEQ ID NO: 7950604 - DNA, 22 bp, Homo sapiens
gggcacagtactccaatcaact

SEQ ID NO: 7950605 - DNA, 22 bp, Homo sapiens
gggcacaggagaaggatctggc

SEQ ID NO: 7950606 - DNA, 22 bp, Homo sapiens
gggcacaggagaaggatctggc

SEQ ID NO: 7950607 - DNA, 22 bp, Homo sapiens
gggagggaggtgatgcttggct

SEQ ID NO: 7950608 - DNA, 22 bp, Homo sapiens
gggagggaggtgatgcttggct

SEQ ID NO: 7950609 - DNA, 22 bp, Homo sapiens
gggagggaggtgatgcttggct

SEQ ID NO: 7950610 - DNA, 22 bp, Homo sapiens
gggagggaggtgatgcttggct

SEQ ID NO: 7950611 - DNA, 22 bp, Homo sapiens
gggagggaggtgatgcttggct

SEQ ID NO: 7950612 - DNA, 22 bp, Homo sapiens
gggagggaggtgatgcttggct

SEQ ID NO: 7950613 - DNA, 22 bp, Homo sapiens
gggagggaggtgatgcttggct

SEQ ID NO: 7950614 - DNA, 22 bp, Homo sapiens
gggagggaggtgatgcttggct

SEQ ID NO: 7950615 - DNA, 22 bp, Homo sapiens
gggagggagaggacagttctat

SEQ ID NO: 7950616 - DNA, 22 bp, Homo sapiens
gggagggagaggacagttctat

SEQ ID NO: 7950617 - DNA, 22 bp, Homo sapiens
gggagggaggtgatgcttggct

SEQ ID NO: 7950618 - DNA, 22 bp, Homo sapiens
gggagggaggtgatgcttggct

SEQ ID NO: 7950619 - DNA, 22 bp, Homo sapiens
gggagggaggtgctggttcacg

SEQ ID NO: 7950620 - DNA, 22 bp, Homo sapiens
gggagggaggtgctggttcacg

SEQ ID NO: 7950621 - DNA, 22 bp, Homo sapiens
gggagggatctgctaggcaatg

SEQ ID NO: 7950622 - DNA, 22 bp, Homo sapiens
gggagggatctgctaggcaatg

SEQ ID NO: 7950623 - DNA, 22 bp, Homo sapiens
gggagggatctgctaggcaatg

SEQ ID NO: 7950624 - DNA, 22 bp, Homo sapiens
gggagggatctgctaggcaatg

SEQ ID NO: 7950625 - DNA, 22 bp, Homo sapiens
gggagggatctgctaggcaatg

SEQ ID NO: 7950626 - DNA, 22 bp, Homo sapiens
gggagggatctgctaggcaatg

SEQ ID NO: 7950627 - DNA, 22 bp, Homo sapiens
gggagggatctgctaggcaatg

SEQ ID NO: 7950628 - DNA, 22 bp, Homo sapiens
gggagggaggtgctggttcacg

SEQ ID NO: 7950629 - DNA, 22 bp, Homo sapiens
gggagggaggtgctggttcacg

SEQ ID NO: 7950630 - DNA, 22 bp, Homo sapiens
gggagggaggtgctggttcacg

SEQ ID NO: 7950631 - DNA, 22 bp, Homo sapiens
gggagggaggtgctggttcacg

SEQ ID NO: 7950632 - DNA, 16 bp, Homo sapiens
gggagggagttggtgg

SEQ ID NO: 7950633 - DNA, 16 bp, Homo sapiens
gggagggagttggtgg

SEQ ID NO: 7950634 - DNA, 22 bp, Homo sapiens
gggagggatctgctaggcaatg

SEQ ID NO: 7950635 - DNA, 22 bp, Homo sapiens
gggagggacacaaagagttccc

SEQ ID NO: 7950636 - DNA, 22 bp, Homo sapiens
gggagggagaggacagttctat

SEQ ID NO: 7950637 - DNA, 22 bp, Homo sapiens
gggagggagaggacagttctat

SEQ ID NO: 7950638 - DNA, 22 bp, Homo sapiens
gggagggagaggacagttctat

SEQ ID NO: 7950639 - DNA, 22 bp, Homo sapiens
gggagggacacaaagagttccc

SEQ ID NO: 7950640 - DNA, 22 bp, Homo sapiens
gggagggacacaaagagttccc

SEQ ID NO: 7950641 - DNA, 22 bp, Homo sapiens
gggagggacacaaagagttccc

SEQ ID NO: 7950642 - DNA, 22 bp, Homo sapiens
gggagggacacaaagagttccc

SEQ ID NO: 7950643 - DNA, 22 bp, Homo sapiens
gggagggacacaaagagttccc

SEQ ID NO: 7950644 - DNA, 22 bp, Homo sapiens
gggagctggatgattgaggcaa

SEQ ID NO: 7950645 - DNA, 22 bp, Homo sapiens
gggagctggatgattgaggcaa

SEQ ID NO: 7950646 - DNA, 22 bp, Homo sapiens
gggagctggatgattgaggcaa

SEQ ID NO: 7950647 - DNA, 22 bp, Homo sapiens
gggagctggcctactattagat

SEQ ID NO: 7950648 - DNA, 22 bp, Homo sapiens
gggagctggcctactattagat

SEQ ID NO: 7950649 - DNA, 22 bp, Homo sapiens
gggagctggagttgtgttgcct

SEQ ID NO: 7950650 - DNA, 22 bp, Homo sapiens
gggagctggatcgcgcgcccgg

SEQ ID NO: 7950651 - DNA, 22 bp, Homo sapiens
gggagctggatcgcgcgcccgg

SEQ ID NO: 7950652 - DNA, 22 bp, Homo sapiens
gggagctggagctggaagactc

SEQ ID NO: 7950653 - DNA, 22 bp, Homo sapiens
gggagctggagctggaagactc

SEQ ID NO: 7950654 - DNA, 22 bp, Homo sapiens
gggagctggagctggaagactc

SEQ ID NO: 7950655 - DNA, 22 bp, Homo sapiens
gggagctggagctggaagactc

SEQ ID NO: 7950656 - DNA, 22 bp, Homo sapiens
gggcacagtctgcagcccccca

SEQ ID NO: 7950657 - DNA, 22 bp, Homo sapiens
gggcaccagcggccgcactgcc

SEQ ID NO: 7950658 - DNA, 22 bp, Homo sapiens
gggcaccagcggccgcactgcc

SEQ ID NO: 7950659 - DNA, 22 bp, Homo sapiens
gggcaccagcggccgcactgcc

SEQ ID NO: 7950660 - DNA, 23 bp, Homo sapiens
gggcaccaggagcaccggacagg

SEQ ID NO: 7950661 - DNA, 23 bp, Homo sapiens
gggcaccaggagcaccggacagg

SEQ ID NO: 7950662 - DNA, 23 bp, Homo sapiens
gggcaccaggagcaccggacagg

SEQ ID NO: 7950663 - DNA, 22 bp, Homo sapiens
gggcacagtctaaagttgggcc

SEQ ID NO: 7950664 - DNA, 22 bp, Homo sapiens
gggcacagtctaaagttgggcc

SEQ ID NO: 7950665 - DNA, 22 bp, Homo sapiens
gggcacagtctaaagttgggcc

SEQ ID NO: 7950666 - DNA, 22 bp, Homo sapiens
gggcacagtctaaagttgggcc

SEQ ID NO: 7950667 - DNA, 22 bp, Homo sapiens
gggcacagtctgcagcccccca

SEQ ID NO: 7950668 - DNA, 22 bp, Homo sapiens
gggcacagtctgcagcccccca

SEQ ID NO: 7950669 - DNA, 22 bp, Homo sapiens
gggcaccttgggtctcaggcaa

SEQ ID NO: 7950670 - DNA, 22 bp, Homo sapiens
gggcaccttgggtctcaggcaa

SEQ ID NO: 7950671 - DNA, 22 bp, Homo sapiens
gggcacctggctagtgacagtg

SEQ ID NO: 7950672 - DNA, 22 bp, Homo sapiens
gggcaccttgggtctcaggcaa

SEQ ID NO: 7950673 - DNA, 22 bp, Homo sapiens
gggcacctggctagtgacagtg

SEQ ID NO: 7950674 - DNA, 22 bp, Homo sapiens
gggcacctggctagtgacagtg

SEQ ID NO: 7950675 - DNA, 21 bp, Homo sapiens
gggcacccttagcctcctctg

SEQ ID NO: 7950676 - DNA, 21 bp, Homo sapiens
gggcacccttagcctcctctg

SEQ ID NO: 7950677 - DNA, 21 bp, Homo sapiens
gggcactgaaagggaatagca
